United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 54

SEQ ID NO: 1926797 - RNA, 14 nt, Shigella flexneri 2a str. 2457T
cagaacaccauaau

SEQ ID NO: 1926798 - RNA, 16 nt, Shigella flexneri 2a str. 2457T
cagaaaugguaaagaa

SEQ ID NO: 1926799 - RNA, 18 nt, Shigella flexneri 2a str. 2457T
cagaaaugguaaagaagg

SEQ ID NO: 1926800 - RNA, 20 nt, Shigella flexneri 2a str. 2457T
cagaaauggcccaaaaggca

SEQ ID NO: 1926801 - RNA, 20 nt, Shigella flexneri 2a str. 2457T
cagaaaugguaaagaaggca

SEQ ID NO: 1926802 - RNA, 18 nt, Shigella flexneri 2a str. 2457T
cagaaauuuggcuccucu

SEQ ID NO: 1926803 - RNA, 18 nt, Shigella flexneri 2a str. 2457T
cagaaauucguaauccau

SEQ ID NO: 1926804 - RNA, 21 nt, Shigella flexneri 2a str. 2457T
cagaaauugaccccagccagu

SEQ ID NO: 1926805 - RNA, 21 nt, Shigella flexneri 2a str. 2457T
cagacacaguucuucaaaaau

SEQ ID NO: 1926806 - RNA, 15 nt, Shigella flexneri 2a str. 2457T
cagacacaauaauuu

SEQ ID NO: 1926807 - RNA, 17 nt, Shigella flexneri 2a str. 2457T
cagacaauuuguuggcg

SEQ ID NO: 1926808 - RNA, 17 nt, Shigella flexneri 2a str. 2457T
cagacaaucgccaguga

SEQ ID NO: 1926809 - RNA, 22 nt, Shigella flexneri 2a str. 2457T
cagacaagaaguuccagggcag

SEQ ID NO: 1926810 - RNA, 14 nt, Shigella flexneri 2a str. 2457T
cagacaacuucccu

SEQ ID NO: 1926811 - RNA, 12 nt, Shigella flexneri 2a str. 2457T
cagacaucaagu

SEQ ID NO: 1926812 - RNA, 13 nt, Shigella flexneri 2a str. 2457T
cagacacugcuga

SEQ ID NO: 1926813 - RNA, 17 nt, Shigella flexneri 2a str. 2457T
cagacaccgauugcccc

SEQ ID NO: 1926814 - RNA, 14 nt, Shigella flexneri 2a str. 2457T
cagacacugcugau

SEQ ID NO: 1926815 - RNA, 13 nt, Shigella flexneri 2a str. 2457T
cagaccagcaccg

SEQ ID NO: 1926816 - RNA, 20 nt, Shigella flexneri 2a str. 2457T
cagaccagaaacgccaccau

SEQ ID NO: 1926817 - RNA, 13 nt, Shigella flexneri 2a str. 2457T
cagaccaauguua

SEQ ID NO: 1926818 - RNA, 19 nt, Shigella flexneri 2a str. 2457T
cagaccauauuuucauuau

SEQ ID NO: 1926819 - RNA, 22 nt, Shigella flexneri 2a str. 2457T
cagacgcaaaguagcggccuga

SEQ ID NO: 1926820 - RNA, 16 nt, Shigella flexneri 2a str. 2457T
cagacgcaggcgcgcu

SEQ ID NO: 1926821 - RNA, 23 nt, Shigella flexneri 2a str. 2457T
cagacguguugucagcucaucca

SEQ ID NO: 1926822 - RNA, 14 nt, Shigella flexneri 2a str. 2457T
cagacguucuuccu

SEQ ID NO: 1926823 - RNA, 15 nt, Shigella flexneri 2a str. 2457T
cagacguucuuccug

SEQ ID NO: 1926824 - RNA, 22 nt, Shigella flexneri 2a str. 2457T
cagacgcuacuuuuuucaccca

SEQ ID NO: 1926825 - RNA, 19 nt, Shigella flexneri 2a str. 2457T
cagacgcucgccauuuuuc

SEQ ID NO: 1926826 - RNA, 13 nt, Shigella flexneri 2a str. 2457T
cagacgcucuuca

SEQ ID NO: 1926827 - RNA, 18 nt, Shigella flexneri 2a str. 2457T
cagacgcgcagcuucacu

SEQ ID NO: 1926828 - RNA, 18 nt, Shigella flexneri 2a str. 2457T
cagacgcaguacgccacc

SEQ ID NO: 1926829 - RNA, 18 nt, Shigella flexneri 2a str. 2457T
cagagaaacgccagcagc

SEQ ID NO: 1926830 - RNA, 20 nt, Shigella flexneri 2a str. 2457T
aaaaucaaccauacggucug

SEQ ID NO: 1926831 - RNA, 15 nt, Shigella flexneri 2a str. 2457T
aaaaucaacgacaaa

SEQ ID NO: 1926832 - RNA, 19 nt, Shigella flexneri 2a str. 2457T
cagagaacuguagacaaaa

SEQ ID NO: 1926833 - RNA, 18 nt, Shigella flexneri 2a str. 2457T
cagagaacuggcggcaaa

SEQ ID NO: 1926834 - RNA, 20 nt, Shigella flexneri 2a str. 2457T
cagagaacaucaauccaaac

SEQ ID NO: 1926835 - RNA, 19 nt, Shigella flexneri 2a str. 2457T
cagagaacgaccaucagcu

SEQ ID NO: 1926836 - RNA, 21 nt, Shigella flexneri 2a str. 2457T
cagagaacgugguauggaguu

SEQ ID NO: 1926837 - RNA, 17 nt, Shigella flexneri 2a str. 2457T
cagacuauucagcucuu

SEQ ID NO: 1926838 - RNA, 14 nt, Shigella flexneri 2a str. 2457T
cagacucaaaccaa

SEQ ID NO: 1926839 - RNA, 13 nt, Shigella flexneri 2a str. 2457T
aaaauauuucugc

SEQ ID NO: 1926840 - RNA, 15 nt, Shigella flexneri 2a str. 2457T
cagagcugaauauca

SEQ ID NO: 1926841 - RNA, 23 nt, Shigella flexneri 2a str. 2457T
cagagcugcguuugaaauaccag

SEQ ID NO: 1926842 - RNA, 22 nt, Shigella flexneri 2a str. 2457T
cagagcuuuguugcgcugaagu

SEQ ID NO: 1926843 - RNA, 19 nt, Shigella flexneri 2a str. 2457T
cagaggaaucgcuguugag

SEQ ID NO: 1926844 - RNA, 12 nt, Shigella flexneri 2a str. 2457T
cagagcagcuua

SEQ ID NO: 1926845 - RNA, 13 nt, Shigella flexneri 2a str. 2457T
cagagcagcaaca

SEQ ID NO: 1926846 - RNA, 23 nt, Shigella flexneri 2a str. 2457T
cagagcaucaguuaacggcacca

SEQ ID NO: 1926847 - RNA, 23 nt, Shigella flexneri 2a str. 2457T
cagagcaucgguaucuucccagc

SEQ ID NO: 1926848 - RNA, 12 nt, Shigella flexneri 2a str. 2457T
cagagugaaaau

SEQ ID NO: 1926849 - RNA, 18 nt, Shigella flexneri 2a str. 2457T
cagaguggauuaucuuca

SEQ ID NO: 1926850 - RNA, 22 nt, Shigella flexneri 2a str. 2457T
cagaggaaucgcuguugaggca

SEQ ID NO: 1926851 - RNA, 14 nt, Shigella flexneri 2a str. 2457T
cagaggagccauca

SEQ ID NO: 1926852 - RNA, 14 nt, Shigella flexneri 2a str. 2457T
cagaggcccgcccc

SEQ ID NO: 1926853 - RNA, 16 nt, Shigella flexneri 2a str. 2457T
cagagcaaucaccaga

SEQ ID NO: 1926854 - RNA, 21 nt, Shigella flexneri 2a str. 2457T
cagagauaaccacguucauuu

SEQ ID NO: 1926855 - RNA, 22 nt, Shigella flexneri 2a str. 2457T
aaaaucauucgccgguuccagc

SEQ ID NO: 1926856 - RNA, 10 nt, Shigella flexneri 2a str. 2457T
aaaaucaucu

SEQ ID NO: 1926857 - RNA, 18 nt, Shigella flexneri 2a str. 2457T
cagagacgcacugcuuga

SEQ ID NO: 1926858 - RNA, 19 nt, Shigella flexneri 2a str. 2457T
aaaaucauccgcucccugg

SEQ ID NO: 1926859 - RNA, 16 nt, Shigella flexneri 2a str. 2457T
cagauguuccgccauu

SEQ ID NO: 1926860 - RNA, 16 nt, Shigella flexneri 2a str. 2457T
cagauguaaugagaac

SEQ ID NO: 1926861 - RNA, 14 nt, Shigella flexneri 2a str. 2457T
aaaaucugaauugu

SEQ ID NO: 1926862 - RNA, 21 nt, Shigella flexneri 2a str. 2457T
aaaaucuccugccaauacaaa

SEQ ID NO: 1926863 - RNA, 15 nt, Shigella flexneri 2a str. 2457T
cagauggcuuuccac

SEQ ID NO: 1926864 - RNA, 23 nt, Shigella flexneri 2a str. 2457T
cagaugcgcgguugccugcugug

SEQ ID NO: 1926865 - RNA, 18 nt, Shigella flexneri 2a str. 2457T
cagaugcgucuucugcag

SEQ ID NO: 1926866 - RNA, 21 nt, Shigella flexneri 2a str. 2457T
cagauuuuaagguugauacga

SEQ ID NO: 1926867 - RNA, 19 nt, Shigella flexneri 2a str. 2457T
cagauuuauaaaagaaaaa

SEQ ID NO: 1926868 - RNA, 21 nt, Shigella flexneri 2a str. 2457T
cagauuaugucgcucaaugcg

SEQ ID NO: 1926869 - RNA, 17 nt, Shigella flexneri 2a str. 2457T
cagauucaaauuauguc

SEQ ID NO: 1926870 - RNA, 23 nt, Shigella flexneri 2a str. 2457T
cagauuauugacaaagugcgcuu

SEQ ID NO: 1926871 - RNA, 23 nt, Shigella flexneri 2a str. 2457T
cagaucugaauauucggcuccag

SEQ ID NO: 1926872 - RNA, 16 nt, Shigella flexneri 2a str. 2457T
cagaucguuuuccugc

SEQ ID NO: 1926873 - RNA, 17 nt, Shigella flexneri 2a str. 2457T
cagaucgugcaucuccu

SEQ ID NO: 1926874 - RNA, 16 nt, Shigella flexneri 2a str. 2457T
cagaucguugaccuga

SEQ ID NO: 1926875 - RNA, 13 nt, Shigella flexneri 2a str. 2457T
cagaucguuuucc

SEQ ID NO: 1926876 - RNA, 20 nt, Shigella flexneri 2a str. 2457T
cagaucuggcgauuauuuuc

SEQ ID NO: 1926877 - RNA, 21 nt, Shigella flexneri 2a str. 2457T
cagaucuggcgauuauuuucc

SEQ ID NO: 1926878 - RNA, 22 nt, Shigella flexneri 2a str. 2457T
cagaucuuccgaggcguuuucu

SEQ ID NO: 1926879 - RNA, 18 nt, Shigella flexneri 2a str. 2457T
cagaugaagauuuaaaca

SEQ ID NO: 1926880 - RNA, 23 nt, Shigella flexneri 2a str. 2457T
cagaugaacgagucaacgcuuca

SEQ ID NO: 1926881 - RNA, 19 nt, Shigella flexneri 2a str. 2457T
cagaugaagcuggcaaagu

SEQ ID NO: 1926882 - RNA, 24 nt, Shigella flexneri 2a str. 2457T
cagaugaauagcgcaaaauuaugu

SEQ ID NO: 1926883 - RNA, 22 nt, Shigella flexneri 2a str. 2457T
cagaugauuagucuuuaucugc

SEQ ID NO: 1926884 - RNA, 20 nt, Shigella flexneri 2a str. 2457T
cagaugauuagucuuuaucu

SEQ ID NO: 1926885 - RNA, 23 nt, Shigella flexneri 2a str. 2457T
cagaugcaggauuucuucaccag

SEQ ID NO: 1926886 - RNA, 22 nt, Shigella flexneri 2a str. 2457T
cagaugcaggauuucuucacca

SEQ ID NO: 1926887 - RNA, 14 nt, Shigella flexneri 2a str. 2457T
cagaugcaucaccg

SEQ ID NO: 1926888 - RNA, 23 nt, Shigella flexneri 2a str. 2457T
cagaugcgacggcaccacauucu

SEQ ID NO: 1926889 - RNA, 15 nt, Shigella flexneri 2a str. 2457T
cagaugccaggaaca

SEQ ID NO: 1926890 - RNA, 21 nt, Shigella flexneri 2a str. 2457T
cagauaauccccaaugaccuu

SEQ ID NO: 1926891 - RNA, 13 nt, Shigella flexneri 2a str. 2457T
cagauaaucaccu

SEQ ID NO: 1926892 - RNA, 15 nt, Shigella flexneri 2a str. 2457T
cagauaaucaccugc

SEQ ID NO: 1926893 - RNA, 22 nt, Shigella flexneri 2a str. 2457T
cagauaauauuuaucuucccag

SEQ ID NO: 1926894 - RNA, 23 nt, Shigella flexneri 2a str. 2457T
cagauaaggugccaauccuucuu

SEQ ID NO: 1926895 - RNA, 18 nt, Shigella flexneri 2a str. 2457T
cagauaaggcguuuacgc

SEQ ID NO: 1926896 - RNA, 18 nt, Shigella flexneri 2a str. 2457T
cagauaauauuuaucuuc

SEQ ID NO: 1926897 - RNA, 15 nt, Shigella flexneri 2a str. 2457T
cagaguugccacccg

SEQ ID NO: 1926898 - RNA, 17 nt, Shigella flexneri 2a str. 2457T
cagaguugccacccggc

SEQ ID NO: 1926899 - RNA, 15 nt, Shigella flexneri 2a str. 2457T
cagaguugaaaaaca

SEQ ID NO: 1926900 - RNA, 14 nt, Shigella flexneri 2a str. 2457T
cagauaagacacua

SEQ ID NO: 1926901 - RNA, 19 nt, Shigella flexneri 2a str. 2457T
cagauaagccugcgcgccc

SEQ ID NO: 1926902 - RNA, 23 nt, Shigella flexneri 2a str. 2457T
cagauaagacgcgucagugucuu

SEQ ID NO: 1926903 - RNA, 23 nt, Shigella flexneri 2a str. 2457T
cagauaagacgcguuagugucuu

SEQ ID NO: 1926904 - RNA, 18 nt, Shigella flexneri 2a str. 2457T
cagaucgaucauauuucc

SEQ ID NO: 1926905 - RNA, 17 nt, Shigella flexneri 2a str. 2457T
cagaucgccaauaucaa

SEQ ID NO: 1926906 - RNA, 21 nt, Shigella flexneri 2a str. 2457T
cagaucgaucauauuuccuuc

SEQ ID NO: 1926907 - RNA, 20 nt, Shigella flexneri 2a str. 2457T
cagaucgccccggucaucaa

SEQ ID NO: 1926908 - RNA, 16 nt, Shigella flexneri 2a str. 2457T
cagaucgcucaucugc

SEQ ID NO: 1926909 - RNA, 21 nt, Shigella flexneri 2a str. 2457T
cagaucggacuucaugcgcag

SEQ ID NO: 1926910 - RNA, 16 nt, Shigella flexneri 2a str. 2457T
cagaucgguugccaua

SEQ ID NO: 1926911 - RNA, 14 nt, Shigella flexneri 2a str. 2457T
cagcacgccccggc

SEQ ID NO: 1926912 - RNA, 23 nt, Shigella flexneri 2a str. 2457T
cagcacuucgccaucugccagac

SEQ ID NO: 1926913 - RNA, 14 nt, Shigella flexneri 2a str. 2457T
cagcagaacaucag

SEQ ID NO: 1926914 - RNA, 19 nt, Shigella flexneri 2a str. 2457T
cagcacagcaucaggcuaa

SEQ ID NO: 1926915 - RNA, 15 nt, Shigella flexneri 2a str. 2457T
cagcacacuguaagc

SEQ ID NO: 1926916 - RNA, 22 nt, Shigella flexneri 2a str. 2457T
cagcacaccacaucgccgaccg

SEQ ID NO: 1926917 - RNA, 23 nt, Shigella flexneri 2a str. 2457T
cagcacauuucagaaaguauaua

SEQ ID NO: 1926918 - RNA, 15 nt, Shigella flexneri 2a str. 2457T
cagcacaucagccag

SEQ ID NO: 1926919 - RNA, 15 nt, Shigella flexneri 2a str. 2457T
cagcacaucaucaaa

SEQ ID NO: 1926920 - RNA, 21 nt, Shigella flexneri 2a str. 2457T
cagcacaucaucaaagccaau

SEQ ID NO: 1926921 - RNA, 18 nt, Shigella flexneri 2a str. 2457T
cagcaagagcaaauaaaa

SEQ ID NO: 1926922 - RNA, 16 nt, Shigella flexneri 2a str. 2457T
cagcaagcgauaauuu

SEQ ID NO: 1926923 - RNA, 12 nt, Shigella flexneri 2a str. 2457T
cagcaagccacu

SEQ ID NO: 1926924 - RNA, 14 nt, Shigella flexneri 2a str. 2457T
aaaauggccgauac

SEQ ID NO: 1926925 - RNA, 14 nt, Shigella flexneri 2a str. 2457T
cagcaaccgcuucc

SEQ ID NO: 1926926 - RNA, 16 nt, Shigella flexneri 2a str. 2457T
aaaaugcugcaauugc

SEQ ID NO: 1926927 - RNA, 19 nt, Shigella flexneri 2a str. 2457T
cagcaauuguaaaucuuug

SEQ ID NO: 1926928 - RNA, 13 nt, Shigella flexneri 2a str. 2457T
cagcaauuuacgc

SEQ ID NO: 1926929 - RNA, 21 nt, Shigella flexneri 2a str. 2457T
cagcaauuuacgcuuuucuuc

SEQ ID NO: 1926930 - RNA, 16 nt, Shigella flexneri 2a str. 2457T
cagcaauuuaucuuug

SEQ ID NO: 1926931 - RNA, 15 nt, Shigella flexneri 2a str. 2457T
cagcaauguuucucu

SEQ ID NO: 1926932 - RNA, 21 nt, Shigella flexneri 2a str. 2457T
cagcaaucugaagccgcaccu

SEQ ID NO: 1926933 - RNA, 15 nt, Shigella flexneri 2a str. 2457T
cagcaaucccaaaau

SEQ ID NO: 1926934 - RNA, 15 nt, Shigella flexneri 2a str. 2457T
cagcaauccugcaug

SEQ ID NO: 1926935 - RNA, 15 nt, Shigella flexneri 2a str. 2457T
cagcaauccccagac

SEQ ID NO: 1926936 - RNA, 17 nt, Shigella flexneri 2a str. 2457T
cagcaaucccaaaauaa

SEQ ID NO: 1926937 - RNA, 19 nt, Shigella flexneri 2a str. 2457T
cagcaaggguucaccggug

SEQ ID NO: 1926938 - RNA, 15 nt, Shigella flexneri 2a str. 2457T
cagcaaggaaaacca

SEQ ID NO: 1926939 - RNA, 16 nt, Shigella flexneri 2a str. 2457T
cagcaagccacuggcg

SEQ ID NO: 1926940 - RNA, 14 nt, Shigella flexneri 2a str. 2457T
cagcaucgaccagg

SEQ ID NO: 1926941 - RNA, 18 nt, Shigella flexneri 2a str. 2457T
cagcaucgaccaggauuu

SEQ ID NO: 1926942 - RNA, 22 nt, Shigella flexneri 2a str. 2457T
cagcaucggugaggaucaccag

SEQ ID NO: 1926943 - RNA, 16 nt, Shigella flexneri 2a str. 2457T
cagcaucggcagcgcc

SEQ ID NO: 1926944 - RNA, 16 nt, Shigella flexneri 2a str. 2457T
cagcaucucgcgcucu

SEQ ID NO: 1926945 - RNA, 11 nt, Shigella flexneri 2a str. 2457T
cagcaucuccu

SEQ ID NO: 1926946 - RNA, 15 nt, Shigella flexneri 2a str. 2457T
cagcaucgucaucag

SEQ ID NO: 1926947 - RNA, 17 nt, Shigella flexneri 2a str. 2457T
cagcaucgucaucauuc

SEQ ID NO: 1926948 - RNA, 18 nt, Shigella flexneri 2a str. 2457T
cagcaucauaccuccgca

SEQ ID NO: 1926949 - RNA, 19 nt, Shigella flexneri 2a str. 2457T
cagcaugcacccucaacaa

SEQ ID NO: 1926950 - RNA, 19 nt, Shigella flexneri 2a str. 2457T
cagcaugcacccucaauaa

SEQ ID NO: 1926951 - RNA, 12 nt, Shigella flexneri 2a str. 2457T
cagcauggcaau

SEQ ID NO: 1926952 - RNA, 20 nt, Shigella flexneri 2a str. 2457T
cagcaugacguccuguacug

SEQ ID NO: 1926953 - RNA, 13 nt, Shigella flexneri 2a str. 2457T
cagcaugcacccu

SEQ ID NO: 1926954 - RNA, 17 nt, Shigella flexneri 2a str. 2457T
cagcauguagaugccgg

SEQ ID NO: 1926955 - RNA, 13 nt, Shigella flexneri 2a str. 2457T
cagcauggcaaua

SEQ ID NO: 1926956 - RNA, 17 nt, Shigella flexneri 2a str. 2457T
cagcauguucggugcug

SEQ ID NO: 1926957 - RNA, 18 nt, Shigella flexneri 2a str. 2457T
cagcauguguaaccgcuu

SEQ ID NO: 1926958 - RNA, 20 nt, Shigella flexneri 2a str. 2457T
cagccagccgaacagcgcca

SEQ ID NO: 1926959 - RNA, 22 nt, Shigella flexneri 2a str. 2457T
cagccagccgaacagcgccaga

SEQ ID NO: 1926960 - RNA, 17 nt, Shigella flexneri 2a str. 2457T
cagccacggcuccagca

SEQ ID NO: 1926961 - RNA, 16 nt, Shigella flexneri 2a str. 2457T
cagccacggcuccagc

SEQ ID NO: 1926962 - RNA, 20 nt, Shigella flexneri 2a str. 2457T
cagccacgcgaaugugcguu

SEQ ID NO: 1926963 - RNA, 14 nt, Shigella flexneri 2a str. 2457T
cagccaggccgcca

SEQ ID NO: 1926964 - RNA, 12 nt, Shigella flexneri 2a str. 2457T
cagcauuucuuc

SEQ ID NO: 1926965 - RNA, 14 nt, Shigella flexneri 2a str. 2457T
cagcauuucuucca

SEQ ID NO: 1926966 - RNA, 22 nt, Shigella flexneri 2a str. 2457T
cagcauuucuggugucacagug

SEQ ID NO: 1926967 - RNA, 16 nt, Shigella flexneri 2a str. 2457T
cagccacaccaaucaa

SEQ ID NO: 1926968 - RNA, 21 nt, Shigella flexneri 2a str. 2457T
cagcauugcucaccgccagca

SEQ ID NO: 1926969 - RNA, 22 nt, Shigella flexneri 2a str. 2457T
cagcauugcucaccgccagcau

SEQ ID NO: 1926970 - RNA, 19 nt, Shigella flexneri 2a str. 2457T
cagcauucccgccagcggc

SEQ ID NO: 1926971 - RNA, 21 nt, Shigella flexneri 2a str. 2457T
cagcauuccggcauuuaaagg

SEQ ID NO: 1926972 - RNA, 21 nt, Shigella flexneri 2a str. 2457T
cagcauucgccgcauugucua

SEQ ID NO: 1926973 - RNA, 20 nt, Shigella flexneri 2a str. 2457T
cagccacagggugaucacca

SEQ ID NO: 1926974 - RNA, 15 nt, Shigella flexneri 2a str. 2457T
cagccaccgccagcg

SEQ ID NO: 1926975 - RNA, 17 nt, Shigella flexneri 2a str. 2457T
cagcaguucagcacgag

SEQ ID NO: 1926976 - RNA, 20 nt, Shigella flexneri 2a str. 2457T
cagcaguucacgcagcuucu

SEQ ID NO: 1926977 - RNA, 15 nt, Shigella flexneri 2a str. 2457T
cagcaguucagucag

SEQ ID NO: 1926978 - RNA, 21 nt, Shigella flexneri 2a str. 2457T
cagcaguuuuaccgacgcgcu

SEQ ID NO: 1926979 - RNA, 18 nt, Shigella flexneri 2a str. 2457T
cagcauaccuuccagcgc

SEQ ID NO: 1926980 - RNA, 17 nt, Shigella flexneri 2a str. 2457T
cagcauaguacgggcaa

SEQ ID NO: 1926981 - RNA, 19 nt, Shigella flexneri 2a str. 2457T
cagcauauaggaggccucg

SEQ ID NO: 1926982 - RNA, 20 nt, Shigella flexneri 2a str. 2457T
cagcauaaucaccaguaccg

SEQ ID NO: 1926983 - RNA, 15 nt, Shigella flexneri 2a str. 2457T
cagcauaccuuccag

SEQ ID NO: 1926984 - RNA, 13 nt, Shigella flexneri 2a str. 2457T
cagcauaaaaaua

SEQ ID NO: 1926985 - RNA, 16 nt, Shigella flexneri 2a str. 2457T
cagcagguccccgagc

SEQ ID NO: 1926986 - RNA, 17 nt, Shigella flexneri 2a str. 2457T
cagcaggugcgccagcg

SEQ ID NO: 1926987 - RNA, 18 nt, Shigella flexneri 2a str. 2457T
cagcaguaaaccacccac

SEQ ID NO: 1926988 - RNA, 14 nt, Shigella flexneri 2a str. 2457T
cagcaguaaaccgc

SEQ ID NO: 1926989 - RNA, 21 nt, Shigella flexneri 2a str. 2457T
cagcaguacgccgagaauaaa

SEQ ID NO: 1926990 - RNA, 22 nt, Shigella flexneri 2a str. 2457T
cagcaguaaaccacccaccagc

SEQ ID NO: 1926991 - RNA, 19 nt, Shigella flexneri 2a str. 2457T
cagcagggcaaacagcacg

SEQ ID NO: 1926992 - RNA, 15 nt, Shigella flexneri 2a str. 2457T
cagcaggcucagaag

SEQ ID NO: 1926993 - RNA, 13 nt, Shigella flexneri 2a str. 2457T
cagcagggccuga

SEQ ID NO: 1926994 - RNA, 15 nt, Shigella flexneri 2a str. 2457T
cagcaggcagaucca

SEQ ID NO: 1926995 - RNA, 23 nt, Shigella flexneri 2a str. 2457T
cagcaggauuugcgguagcgggc

SEQ ID NO: 1926996 - RNA, 17 nt, Shigella flexneri 2a str. 2457T
cagcaggauggcuggcc

SEQ ID NO: 1926997 - RNA, 22 nt, Shigella flexneri 2a str. 2457T
cagcaggauguuccggcaaagu

SEQ ID NO: 1926998 - RNA, 17 nt, Shigella flexneri 2a str. 2457T
cagcaggaucuccagcu

SEQ ID NO: 1926999 - RNA, 13 nt, Shigella flexneri 2a str. 2457T
cagcagcgccgca

SEQ ID NO: 1927000 - RNA, 17 nt, Shigella flexneri 2a str. 2457T
cagcagaccuucugcca

SEQ ID NO: 1927001 - RNA, 11 nt, Shigella flexneri 2a str. 2457T
cagcagaccag

SEQ ID NO: 1927002 - RNA, 14 nt, Shigella flexneri 2a str. 2457T
cagcagaccagcaa

SEQ ID NO: 1927003 - RNA, 16 nt, Shigella flexneri 2a str. 2457T
cagcagacagccuacc

SEQ ID NO: 1927004 - RNA, 20 nt, Shigella flexneri 2a str. 2457T
cagcagacagccuaccagac

SEQ ID NO: 1927005 - RNA, 19 nt, Shigella flexneri 2a str. 2457T
cagcagaaccgccaucaug

SEQ ID NO: 1927006 - RNA, 23 nt, Shigella flexneri 2a str. 2457T
cagcagauaucccgccagcacca

SEQ ID NO: 1927007 - RNA, 18 nt, Shigella flexneri 2a str. 2457T
cagcagagcaaucaccag

SEQ ID NO: 1927008 - RNA, 19 nt, Shigella flexneri 2a str. 2457T
cagcagagcaaucaccaga

SEQ ID NO: 1927009 - RNA, 16 nt, Shigella flexneri 2a str. 2457T
cagcgaaaucgccuuu

SEQ ID NO: 1927010 - RNA, 22 nt, Shigella flexneri 2a str. 2457T
cagcgaaaguaacaccauccau

SEQ ID NO: 1927011 - RNA, 13 nt, Shigella flexneri 2a str. 2457T
cagccuuuuucuc

SEQ ID NO: 1927012 - RNA, 19 nt, Shigella flexneri 2a str. 2457T
cagcgaaaaucaaccauac

SEQ ID NO: 1927013 - RNA, 14 nt, Shigella flexneri 2a str. 2457T
cagccuuucucaga

SEQ ID NO: 1927014 - RNA, 21 nt, Shigella flexneri 2a str. 2457T
cagccuggcggaaagccagaa

SEQ ID NO: 1927015 - RNA, 16 nt, Shigella flexneri 2a str. 2457T
cagcgaauggguugua

SEQ ID NO: 1927016 - RNA, 15 nt, Shigella flexneri 2a str. 2457T
cagcgaauccguucu

SEQ ID NO: 1927017 - RNA, 13 nt, Shigella flexneri 2a str. 2457T
cagcgaagagauc

SEQ ID NO: 1927018 - RNA, 24 nt, Shigella flexneri 2a str. 2457T
cagcgaagcauucagacacgccgc

SEQ ID NO: 1927019 - RNA, 15 nt, Shigella flexneri 2a str. 2457T
cagccggacccacac

SEQ ID NO: 1927020 - RNA, 14 nt, Shigella flexneri 2a str. 2457T
cagccggaauaauc

SEQ ID NO: 1927021 - RNA, 21 nt, Shigella flexneri 2a str. 2457T
cagccucaagcacccgccgcu

SEQ ID NO: 1927022 - RNA, 16 nt, Shigella flexneri 2a str. 2457T
cagccucccagccauu

SEQ ID NO: 1927023 - RNA, 15 nt, Shigella flexneri 2a str. 2457T
cagccugcgcuucuu

SEQ ID NO: 1927024 - RNA, 13 nt, Shigella flexneri 2a str. 2457T
cagccucugccgc

SEQ ID NO: 1927025 - RNA, 14 nt, Shigella flexneri 2a str. 2457T
cagccucugccgcg

SEQ ID NO: 1927026 - RNA, 12 nt, Shigella flexneri 2a str. 2457T
cagccucugccg

SEQ ID NO: 1927027 - RNA, 16 nt, Shigella flexneri 2a str. 2457T
cagccgccgcuccuca

SEQ ID NO: 1927028 - RNA, 17 nt, Shigella flexneri 2a str. 2457T
cagccgagguagaaccc

SEQ ID NO: 1927029 - RNA, 16 nt, Shigella flexneri 2a str. 2457T
cagccgaccgcugucc

SEQ ID NO: 1927030 - RNA, 19 nt, Shigella flexneri 2a str. 2457T
cagccgcaaaccuggcaac

SEQ ID NO: 1927031 - RNA, 16 nt, Shigella flexneri 2a str. 2457T
cagccgcacuuuuuaa

SEQ ID NO: 1927032 - RNA, 22 nt, Shigella flexneri 2a str. 2457T
cagccauucaaucuucgacagc

SEQ ID NO: 1927033 - RNA, 14 nt, Shigella flexneri 2a str. 2457T
cagccauucaaucu

SEQ ID NO: 1927034 - RNA, 21 nt, Shigella flexneri 2a str. 2457T
cagccauuaaccagccacugc

SEQ ID NO: 1927035 - RNA, 20 nt, Shigella flexneri 2a str. 2457T
cagccauucgaugguuuuau

SEQ ID NO: 1927036 - RNA, 15 nt, Shigella flexneri 2a str. 2457T
cagccaucauccauu

SEQ ID NO: 1927037 - RNA, 19 nt, Shigella flexneri 2a str. 2457T
cagccaucuguuccggcgu

SEQ ID NO: 1927038 - RNA, 17 nt, Shigella flexneri 2a str. 2457T
cagccaugcggcaucuu

SEQ ID NO: 1927039 - RNA, 17 nt, Shigella flexneri 2a str. 2457T
cagccgacaaugccaca

SEQ ID NO: 1927040 - RNA, 20 nt, Shigella flexneri 2a str. 2457T
cagccgacaaugccacaaac

SEQ ID NO: 1927041 - RNA, 14 nt, Shigella flexneri 2a str. 2457T
cagcccuucuuuca

SEQ ID NO: 1927042 - RNA, 19 nt, Shigella flexneri 2a str. 2457T
cagcccuucuuucacuuca

SEQ ID NO: 1927043 - RNA, 17 nt, Shigella flexneri 2a str. 2457T
cagcgccagacaaacca

SEQ ID NO: 1927044 - RNA, 15 nt, Shigella flexneri 2a str. 2457T
cagcgccagacacug

SEQ ID NO: 1927045 - RNA, 15 nt, Shigella flexneri 2a str. 2457T
cagcgccagauagcc

SEQ ID NO: 1927046 - RNA, 23 nt, Shigella flexneri 2a str. 2457T
cagcgccagcgcgaugcaggcca

SEQ ID NO: 1927047 - RNA, 15 nt, Shigella flexneri 2a str. 2457T
cagcgcccaacacuu

SEQ ID NO: 1927048 - RNA, 14 nt, Shigella flexneri 2a str. 2457T
cagcgccaguugcu

SEQ ID NO: 1927049 - RNA, 24 nt, Shigella flexneri 2a str. 2457T
cagcgacggaugacacgcaggcgu

SEQ ID NO: 1927050 - RNA, 18 nt, Shigella flexneri 2a str. 2457T
cagcgacguugauuuugu

SEQ ID NO: 1927051 - RNA, 15 nt, Shigella flexneri 2a str. 2457T
cagcgcaaucaccgg

SEQ ID NO: 1927052 - RNA, 21 nt, Shigella flexneri 2a str. 2457T
cagcgacugucuuucaggcag

SEQ ID NO: 1927053 - RNA, 19 nt, Shigella flexneri 2a str. 2457T
cagcgcacgggcgguuaau

SEQ ID NO: 1927054 - RNA, 19 nt, Shigella flexneri 2a str. 2457T
cagcgcaauuaacgcccca

SEQ ID NO: 1927055 - RNA, 14 nt, Shigella flexneri 2a str. 2457T
cagcgcaccagaaa

SEQ ID NO: 1927056 - RNA, 17 nt, Shigella flexneri 2a str. 2457T
cagcgccaccaccagca

SEQ ID NO: 1927057 - RNA, 12 nt, Shigella flexneri 2a str. 2457T
cagcgccaccac

SEQ ID NO: 1927058 - RNA, 15 nt, Shigella flexneri 2a str. 2457T
cagcgcagcacccag

SEQ ID NO: 1927059 - RNA, 14 nt, Shigella flexneri 2a str. 2457T
cagcgccgcgccua

SEQ ID NO: 1927060 - RNA, 19 nt, Shigella flexneri 2a str. 2457T
cagcgccgacagcagcccu

SEQ ID NO: 1927061 - RNA, 19 nt, Shigella flexneri 2a str. 2457T
cagcgcgccugaaugccac

SEQ ID NO: 1927062 - RNA, 15 nt, Shigella flexneri 2a str. 2457T
cagcgcgcaguugca

SEQ ID NO: 1927063 - RNA, 18 nt, Shigella flexneri 2a str. 2457T
cagcgccugacgcggggu

SEQ ID NO: 1927064 - RNA, 14 nt, Shigella flexneri 2a str. 2457T
cagcgccugaugga

SEQ ID NO: 1927065 - RNA, 11 nt, Shigella flexneri 2a str. 2457T
uuuuuuuucag

SEQ ID NO: 1927066 - RNA, 16 nt, Shigella flexneri 2a str. 2457T
uuuuuuaaacauuaaa

SEQ ID NO: 1927067 - RNA, 17 nt, Shigella flexneri 2a str. 2457T
uuuuugcagaaacauaa

SEQ ID NO: 1927068 - RNA, 23 nt, Shigella flexneri 2a str. 2457T
uuuuugcagaaacauaauauaaa

SEQ ID NO: 1927069 - RNA, 23 nt, Shigella flexneri 2a str. 2457T
uuuuugcauaauuuccagcagug

SEQ ID NO: 1927070 - RNA, 16 nt, Shigella flexneri 2a str. 2457T
uuuuugagcagcauua

SEQ ID NO: 1927071 - RNA, 14 nt, Shigella flexneri 2a str. 2457T
uuuuuccgcuuugu

SEQ ID NO: 1927072 - RNA, 22 nt, Shigella flexneri 2a str. 2457T
uuuuucgcgauagccgcuuucu

SEQ ID NO: 1927073 - RNA, 21 nt, Shigella flexneri 2a str. 2457T
uuuuucgcgcguuaucccuua

SEQ ID NO: 1927074 - RNA, 23 nt, Shigella flexneri 2a str. 2457T
uuuuucgugagagugaagccuga

SEQ ID NO: 1927075 - RNA, 20 nt, Shigella flexneri 2a str. 2457T
uuuuucuaugaguaauguua

SEQ ID NO: 1927076 - RNA, 11 nt, Shigella flexneri 2a str. 2457T
uuuuucucaac

SEQ ID NO: 1927077 - RNA, 20 nt, Shigella flexneri 2a str. 2457T
uuuuucugcguuccugggga

SEQ ID NO: 1927078 - RNA, 23 nt, Shigella flexneri 2a str. 2457T
uuuuauacaagggaaauaagaaa

SEQ ID NO: 1927079 - RNA, 17 nt, Shigella flexneri 2a str. 2457T
uuuuaguaucuauucau

SEQ ID NO: 1927080 - RNA, 15 nt, Shigella flexneri 2a str. 2457T
uuuuaucugugaacu

SEQ ID NO: 1927081 - RNA, 20 nt, Shigella flexneri 2a str. 2457T
uuuuaucggagaacaggaau

SEQ ID NO: 1927082 - RNA, 20 nt, Shigella flexneri 2a str. 2457T
uuuuaucucccuguauccca

SEQ ID NO: 1927083 - RNA, 18 nt, Shigella flexneri 2a str. 2457T
uuuuaucucuuacagaaa

SEQ ID NO: 1927084 - RNA, 13 nt, Shigella flexneri 2a str. 2457T
uuuuaucccuucu

SEQ ID NO: 1927085 - RNA, 22 nt, Shigella flexneri 2a str. 2457T
uuuuaauggcuggggaauauuu

SEQ ID NO: 1927086 - RNA, 20 nt, Shigella flexneri 2a str. 2457T
uuuuaaucgucaguuuuuca

SEQ ID NO: 1927087 - RNA, 19 nt, Shigella flexneri 2a str. 2457T
uuuuacaacguauugaaau

SEQ ID NO: 1927088 - RNA, 16 nt, Shigella flexneri 2a str. 2457T
uuuuacccaugacuuu

SEQ ID NO: 1927089 - RNA, 20 nt, Shigella flexneri 2a str. 2457T
uuuuacccagcagcagcggu

SEQ ID NO: 1927090 - RNA, 16 nt, Shigella flexneri 2a str. 2457T
uuuuacuuguuuuuca

SEQ ID NO: 1927091 - RNA, 12 nt, Shigella flexneri 2a str. 2457T
uuuuagaaaaac

SEQ ID NO: 1927092 - RNA, 17 nt, Shigella flexneri 2a str. 2457T
uuuuagaaaaacuuaau

SEQ ID NO: 1927093 - RNA, 12 nt, Shigella flexneri 2a str. 2457T
uuuuacugggaa

SEQ ID NO: 1927094 - RNA, 21 nt, Shigella flexneri 2a str. 2457T
uuuuacugggaagaauggaaa

SEQ ID NO: 1927095 - RNA, 22 nt, Shigella flexneri 2a str. 2457T
uuuuacguugcauuuccauaaa

SEQ ID NO: 1927096 - RNA, 22 nt, Shigella flexneri 2a str. 2457T
uuuuaccucuuucucauaaaac

SEQ ID NO: 1927097 - RNA, 21 nt, Shigella flexneri 2a str. 2457T
uuuuaccucuuuuuucaacau

SEQ ID NO: 1927098 - RNA, 17 nt, Shigella flexneri 2a str. 2457T
uuuucuguagauaaaac

SEQ ID NO: 1927099 - RNA, 21 nt, Shigella flexneri 2a str. 2457T
uuuucuuaacaaaaacuuuug

SEQ ID NO: 1927100 - RNA, 12 nt, Shigella flexneri 2a str. 2457T
uuuucuucaguu

SEQ ID NO: 1927101 - RNA, 21 nt, Shigella flexneri 2a str. 2457T
uuuucuucagccccuccacau

SEQ ID NO: 1927102 - RNA, 16 nt, Shigella flexneri 2a str. 2457T
uuuugaacagaccaca

SEQ ID NO: 1927103 - RNA, 22 nt, Shigella flexneri 2a str. 2457T
uuuucguuacguggcacauucu

SEQ ID NO: 1927104 - RNA, 14 nt, Shigella flexneri 2a str. 2457T
uuuucuaugaguaa

SEQ ID NO: 1927105 - RNA, 20 nt, Shigella flexneri 2a str. 2457T
uuuucccaacgugaccagua

SEQ ID NO: 1927106 - RNA, 18 nt, Shigella flexneri 2a str. 2457T
uuuucccugguaaaaaau

SEQ ID NO: 1927107 - RNA, 16 nt, Shigella flexneri 2a str. 2457T
uuuucccgucaaagag

SEQ ID NO: 1927108 - RNA, 16 nt, Shigella flexneri 2a str. 2457T
uuuuauguucagauaa

SEQ ID NO: 1927109 - RNA, 21 nt, Shigella flexneri 2a str. 2457T
uuuuauuauucgcuaaucaau

SEQ ID NO: 1927110 - RNA, 17 nt, Shigella flexneri 2a str. 2457T
uuuuauuaaauguguuu

SEQ ID NO: 1927111 - RNA, 22 nt, Shigella flexneri 2a str. 2457T
uuuuauucauauuguuaucaau

SEQ ID NO: 1927112 - RNA, 14 nt, Shigella flexneri 2a str. 2457T
uuuuauugcaaaac

SEQ ID NO: 1927113 - RNA, 19 nt, Shigella flexneri 2a str. 2457T
uuuuauugcguaaucuuuu

SEQ ID NO: 1927114 - RNA, 13 nt, Shigella flexneri 2a str. 2457T
uuuuauuuacacu

SEQ ID NO: 1927115 - RNA, 20 nt, Shigella flexneri 2a str. 2457T
uuuuauuugugguuggcgug

SEQ ID NO: 1927116 - RNA, 21 nt, Shigella flexneri 2a str. 2457T
uuuucaaccauccuaaaaaag

SEQ ID NO: 1927117 - RNA, 19 nt, Shigella flexneri 2a str. 2457T
uuuucaauaaccugcaaaa

SEQ ID NO: 1927118 - RNA, 22 nt, Shigella flexneri 2a str. 2457T
uuuucaauucacgaauauuucc

SEQ ID NO: 1927119 - RNA, 16 nt, Shigella flexneri 2a str. 2457T
uuuuccagcugugcca

SEQ ID NO: 1927120 - RNA, 17 nt, Shigella flexneri 2a str. 2457T
uuuuccagcugugccag

SEQ ID NO: 1927121 - RNA, 12 nt, Shigella flexneri 2a str. 2457T
uuuuccagugcc

SEQ ID NO: 1927122 - RNA, 20 nt, Shigella flexneri 2a str. 2457T
uuuggcagacaaccauauuu

SEQ ID NO: 1927123 - RNA, 17 nt, Shigella flexneri 2a str. 2457T
uuuggcaucaaucaacg

SEQ ID NO: 1927124 - RNA, 21 nt, Shigella flexneri 2a str. 2457T
uuuggcaaacuacaaauccaa

SEQ ID NO: 1927125 - RNA, 17 nt, Shigella flexneri 2a str. 2457T
uuuggcaaaugcaucag

SEQ ID NO: 1927126 - RNA, 15 nt, Shigella flexneri 2a str. 2457T
uuugcuguugccgcc

SEQ ID NO: 1927127 - RNA, 19 nt, Shigella flexneri 2a str. 2457T
uuugcuugccggaagcaaa

SEQ ID NO: 1927128 - RNA, 22 nt, Shigella flexneri 2a str. 2457T
uuugcuugccgguuauuuugcu

SEQ ID NO: 1927129 - RNA, 12 nt, Shigella flexneri 2a str. 2457T
uuugcuuuuguu

SEQ ID NO: 1927130 - RNA, 19 nt, Shigella flexneri 2a str. 2457T
uuugcgcguaaacaaacaa

SEQ ID NO: 1927131 - RNA, 17 nt, Shigella flexneri 2a str. 2457T
uuugcggcccuucuucu

SEQ ID NO: 1927132 - RNA, 17 nt, Shigella flexneri 2a str. 2457T
uuugcguuugucauaaa

SEQ ID NO: 1927133 - RNA, 20 nt, Shigella flexneri 2a str. 2457T
uuugcguuccaucagauuca

SEQ ID NO: 1927134 - RNA, 22 nt, Shigella flexneri 2a str. 2457T
uuugcguccgguaauuuuuaua

SEQ ID NO: 1927135 - RNA, 15 nt, Shigella flexneri 2a str. 2457T
uuugcgguuaaaaau

SEQ ID NO: 1927136 - RNA, 22 nt, Shigella flexneri 2a str. 2457T
uuugcguagucugaccucuucu

SEQ ID NO: 1927137 - RNA, 15 nt, Shigella flexneri 2a str. 2457T
uuugcugauucuccc

SEQ ID NO: 1927138 - RNA, 20 nt, Shigella flexneri 2a str. 2457T
uuugcucgcgacguaauuua

SEQ ID NO: 1927139 - RNA, 22 nt, Shigella flexneri 2a str. 2457T
uuugcuccguuccccucaacau

SEQ ID NO: 1927140 - RNA, 16 nt, Shigella flexneri 2a str. 2457T
uuuguauuuauuuuca

SEQ ID NO: 1927141 - RNA, 13 nt, Shigella flexneri 2a str. 2457T
uuugucaaaaauc

SEQ ID NO: 1927142 - RNA, 18 nt, Shigella flexneri 2a str. 2457T
uuuguauuagaugcuagu

SEQ ID NO: 1927143 - RNA, 20 nt, Shigella flexneri 2a str. 2457T
uuuguaugccuggcauuucu

SEQ ID NO: 1927144 - RNA, 15 nt, Shigella flexneri 2a str. 2457T
uuuguaggccugaua

SEQ ID NO: 1927145 - RNA, 19 nt, Shigella flexneri 2a str. 2457T
uuuguagauugcacuugcu

SEQ ID NO: 1927146 - RNA, 13 nt, Shigella flexneri 2a str. 2457T
uuuguaucgcuga

SEQ ID NO: 1927147 - RNA, 18 nt, Shigella flexneri 2a str. 2457T
uuuguaaagucaucgcau

SEQ ID NO: 1927148 - RNA, 11 nt, Shigella flexneri 2a str. 2457T
uuuggcugccg

SEQ ID NO: 1927149 - RNA, 18 nt, Shigella flexneri 2a str. 2457T
uuuggcuggaguggugaa

SEQ ID NO: 1927150 - RNA, 17 nt, Shigella flexneri 2a str. 2457T
uuuggugagaacaccaa

SEQ ID NO: 1927151 - RNA, 18 nt, Shigella flexneri 2a str. 2457T
uuuggucuggcaaaaaua

SEQ ID NO: 1927152 - RNA, 13 nt, Shigella flexneri 2a str. 2457T
uuuggugaagacg

SEQ ID NO: 1927153 - RNA, 23 nt, Shigella flexneri 2a str. 2457T
uuuggugaagugagaauuuuuca

SEQ ID NO: 1927154 - RNA, 22 nt, Shigella flexneri 2a str. 2457T
uuuuaacgccugacuggcuacu

SEQ ID NO: 1927155 - RNA, 15 nt, Shigella flexneri 2a str. 2457T
uuuuaaagcaaaaaa

SEQ ID NO: 1927156 - RNA, 23 nt, Shigella flexneri 2a str. 2457T
uuuguuauuacugcguauuuccu

SEQ ID NO: 1927157 - RNA, 20 nt, Shigella flexneri 2a str. 2457T
uuuguuauccaccgaaauaa

SEQ ID NO: 1927158 - RNA, 19 nt, Shigella flexneri 2a str. 2457T
uuuguugauaaacaaacag

SEQ ID NO: 1927159 - RNA, 19 nt, Shigella flexneri 2a str. 2457T
uuuguuagcgaauaaagua

SEQ ID NO: 1927160 - RNA, 15 nt, Shigella flexneri 2a str. 2457T
uuuguuuguucuucu

SEQ ID NO: 1927161 - RNA, 16 nt, Shigella flexneri 2a str. 2457T
uuugucgaacagguua

SEQ ID NO: 1927162 - RNA, 16 nt, Shigella flexneri 2a str. 2457T
uuuguccgcuauuucu

SEQ ID NO: 1927163 - RNA, 16 nt, Shigella flexneri 2a str. 2457T
uuugucaucaguuuca

SEQ ID NO: 1927164 - RNA, 20 nt, Shigella flexneri 2a str. 2457T
uuugucaguucggcaucauc

SEQ ID NO: 1927165 - RNA, 15 nt, Shigella flexneri 2a str. 2457T
uuugugaucuuuuuc

SEQ ID NO: 1927166 - RNA, 16 nt, Shigella flexneri 2a str. 2457T
uuugugcagcaugcac

SEQ ID NO: 1927167 - RNA, 13 nt, Shigella flexneri 2a str. 2457T
uuugugcauagca

SEQ ID NO: 1927168 - RNA, 19 nt, Shigella flexneri 2a str. 2457T
uuuacgccgcaucaggcau

SEQ ID NO: 1927169 - RNA, 12 nt, Shigella flexneri 2a str. 2457T
uuuacgccgcau

SEQ ID NO: 1927170 - RNA, 17 nt, Shigella flexneri 2a str. 2457T
uuuacggcuugcgcgca

SEQ ID NO: 1927171 - RNA, 22 nt, Shigella flexneri 2a str. 2457T
uuuacagccggacccacacccc

SEQ ID NO: 1927172 - RNA, 22 nt, Shigella flexneri 2a str. 2457T
uuuacagcccuggcucugcacu

SEQ ID NO: 1927173 - RNA, 16 nt, Shigella flexneri 2a str. 2457T
uuuacagcuuagcgcc

SEQ ID NO: 1927174 - RNA, 17 nt, Shigella flexneri 2a str. 2457T
uuuacagauuucccauu

SEQ ID NO: 1927175 - RNA, 13 nt, Shigella flexneri 2a str. 2457T
uuuacaucaucag

SEQ ID NO: 1927176 - RNA, 22 nt, Shigella flexneri 2a str. 2457T
uuuacucccguucauucaacuu

SEQ ID NO: 1927177 - RNA, 15 nt, Shigella flexneri 2a str. 2457T
uuuacuauuauuuuu

SEQ ID NO: 1927178 - RNA, 19 nt, Shigella flexneri 2a str. 2457T
uuuacuacguaauuucaau

SEQ ID NO: 1927179 - RNA, 22 nt, Shigella flexneri 2a str. 2457T
uuuacugacuagaugugcaguu

SEQ ID NO: 1927180 - RNA, 19 nt, Shigella flexneri 2a str. 2457T
uuuacugauaauuuuuuca

SEQ ID NO: 1927181 - RNA, 16 nt, Shigella flexneri 2a str. 2457T
uuuacugucugcuucu

SEQ ID NO: 1927182 - RNA, 15 nt, Shigella flexneri 2a str. 2457T
uuuacuuguuuuuca

SEQ ID NO: 1927183 - RNA, 14 nt, Shigella flexneri 2a str. 2457T
uuuagaaaaacuua

SEQ ID NO: 1927184 - RNA, 13 nt, Shigella flexneri 2a str. 2457T
uuuaguauuguua

SEQ ID NO: 1927185 - RNA, 22 nt, Shigella flexneri 2a str. 2457T
uuuaguaacaacggauuauccc

SEQ ID NO: 1927186 - RNA, 14 nt, Shigella flexneri 2a str. 2457T
uuuagagaauuaau

SEQ ID NO: 1927187 - RNA, 14 nt, Shigella flexneri 2a str. 2457T
uuuagcauaaaaac

SEQ ID NO: 1927188 - RNA, 18 nt, Shigella flexneri 2a str. 2457T
uuuagccgcuucugcagc

SEQ ID NO: 1927189 - RNA, 13 nt, Shigella flexneri 2a str. 2457T
uuuagcaaacuga

SEQ ID NO: 1927190 - RNA, 18 nt, Shigella flexneri 2a str. 2457T
uuuauaaucuuuaaaaaa

SEQ ID NO: 1927191 - RNA, 20 nt, Shigella flexneri 2a str. 2457T
uuuauagagauuuuucccca

SEQ ID NO: 1927192 - RNA, 19 nt, Shigella flexneri 2a str. 2457T
uuuauagcuuauucuuauu

SEQ ID NO: 1927193 - RNA, 14 nt, Shigella flexneri 2a str. 2457T
uuuauacucaguca

SEQ ID NO: 1927194 - RNA, 12 nt, Shigella flexneri 2a str. 2457T
uuuauaaagaac

SEQ ID NO: 1927195 - RNA, 20 nt, Shigella flexneri 2a str. 2457T
uuuauaacggugcugcacau

SEQ ID NO: 1927196 - RNA, 22 nt, Shigella flexneri 2a str. 2457T
uuuaucacgcaaccacaacgca

SEQ ID NO: 1927197 - RNA, 15 nt, Shigella flexneri 2a str. 2457T
uuuaucaccaaugau

SEQ ID NO: 1927198 - RNA, 12 nt, Shigella flexneri 2a str. 2457T
uuuaucacugag

SEQ ID NO: 1927199 - RNA, 16 nt, Shigella flexneri 2a str. 2457T
uuuaucacugugaugg

SEQ ID NO: 1927200 - RNA, 13 nt, Shigella flexneri 2a str. 2457T
uuuaucaggccac

SEQ ID NO: 1927201 - RNA, 16 nt, Shigella flexneri 2a str. 2457T
uuuauagggugcaauu

SEQ ID NO: 1927202 - RNA, 20 nt, Shigella flexneri 2a str. 2457T
uuuaucuucgagauucuuaa

SEQ ID NO: 1927203 - RNA, 12 nt, Shigella flexneri 2a str. 2457T
uuuaucuuccca

SEQ ID NO: 1927204 - RNA, 21 nt, Shigella flexneri 2a str. 2457T
uuuaucuaucaggacgaaaaa

SEQ ID NO: 1927205 - RNA, 16 nt, Shigella flexneri 2a str. 2457T
uuuaucgcgcaaaaaa

SEQ ID NO: 1927206 - RNA, 16 nt, Shigella flexneri 2a str. 2457T
uuuaucguuuucacga

SEQ ID NO: 1927207 - RNA, 15 nt, Shigella flexneri 2a str. 2457T
uuuaucccuucucca

SEQ ID NO: 1927208 - RNA, 23 nt, Shigella flexneri 2a str. 2457T
uuuaucgauaaauggcgcaucca

SEQ ID NO: 1927209 - RNA, 18 nt, Shigella flexneri 2a str. 2457T
uuuaucccaaccuaaaaa

SEQ ID NO: 1927210 - RNA, 22 nt, Shigella flexneri 2a str. 2457T
uuuaugguagugccgucagcag

SEQ ID NO: 1927211 - RNA, 18 nt, Shigella flexneri 2a str. 2457T
uuuauuaaugacauucag

SEQ ID NO: 1927212 - RNA, 19 nt, Shigella flexneri 2a str. 2457T
uuuaugcgccuuuaccaga

SEQ ID NO: 1927213 - RNA, 17 nt, Shigella flexneri 2a str. 2457T
uuuaugcgcuaaauguu

SEQ ID NO: 1927214 - RNA, 17 nt, Shigella flexneri 2a str. 2457T
uuucauuuauuaccucc

SEQ ID NO: 1927215 - RNA, 19 nt, Shigella flexneri 2a str. 2457T
uuucauuuugauauuucgu

SEQ ID NO: 1927216 - RNA, 21 nt, Shigella flexneri 2a str. 2457T
uuucauguuaaauuccggcuc

SEQ ID NO: 1927217 - RNA, 18 nt, Shigella flexneri 2a str. 2457T
uuucaugcuauuccuuga

SEQ ID NO: 1927218 - RNA, 23 nt, Shigella flexneri 2a str. 2457T
uuucaucgcuuacccuaaauccg

SEQ ID NO: 1927219 - RNA, 13 nt, Shigella flexneri 2a str. 2457T
uuucaucaaaaaa

SEQ ID NO: 1927220 - RNA, 16 nt, Shigella flexneri 2a str. 2457T
uuucaucaaaaaauga

SEQ ID NO: 1927221 - RNA, 19 nt, Shigella flexneri 2a str. 2457T
uuucaucccgagucgcuga

SEQ ID NO: 1927222 - RNA, 12 nt, Shigella flexneri 2a str. 2457T
uuucagcugccc

SEQ ID NO: 1927223 - RNA, 18 nt, Shigella flexneri 2a str. 2457T
uuucagcggcguguuauu

SEQ ID NO: 1927224 - RNA, 23 nt, Shigella flexneri 2a str. 2457T
uuucagcgaaaaagucccuuccc

SEQ ID NO: 1927225 - RNA, 17 nt, Shigella flexneri 2a str. 2457T
uuucagccuuaaagaua

SEQ ID NO: 1927226 - RNA, 19 nt, Shigella flexneri 2a str. 2457T
uuucagcaccagauaauga

SEQ ID NO: 1927227 - RNA, 14 nt, Shigella flexneri 2a str. 2457T
uuucagcaccagau

SEQ ID NO: 1927228 - RNA, 14 nt, Shigella flexneri 2a str. 2457T
uuucagcacuuauc

SEQ ID NO: 1927229 - RNA, 16 nt, Shigella flexneri 2a str. 2457T
uuucacuuaaugaauc

SEQ ID NO: 1927230 - RNA, 18 nt, Shigella flexneri 2a str. 2457T
uuucagaaaguauauaaa

SEQ ID NO: 1927231 - RNA, 14 nt, Shigella flexneri 2a str. 2457T
uuucacuucucauu

SEQ ID NO: 1927232 - RNA, 23 nt, Shigella flexneri 2a str. 2457T
uuucacuucucauuucugccauu

SEQ ID NO: 1927233 - RNA, 22 nt, Shigella flexneri 2a str. 2457T
uuucagaaauuuggcuccucug

SEQ ID NO: 1927234 - RNA, 20 nt, Shigella flexneri 2a str. 2457T
uuucacuucgucagaaaugg

SEQ ID NO: 1927235 - RNA, 20 nt, Shigella flexneri 2a str. 2457T
uuucagauuggugacaaagu

SEQ ID NO: 1927236 - RNA, 19 nt, Shigella flexneri 2a str. 2457T
uuucagauuguugacaaag

SEQ ID NO: 1927237 - RNA, 16 nt, Shigella flexneri 2a str. 2457T
uuucaggcagucgcug

SEQ ID NO: 1927238 - RNA, 20 nt, Shigella flexneri 2a str. 2457T
uuucaggcuuuuuuccagcu

SEQ ID NO: 1927239 - RNA, 15 nt, Shigella flexneri 2a str. 2457T
uuucaggucgguuuu

SEQ ID NO: 1927240 - RNA, 16 nt, Shigella flexneri 2a str. 2457T
uuucagguuacgcccu

SEQ ID NO: 1927241 - RNA, 14 nt, Shigella flexneri 2a str. 2457T
uuucaguaacauca

SEQ ID NO: 1927242 - RNA, 17 nt, Shigella flexneri 2a str. 2457T
uuucagguuguuuucug

SEQ ID NO: 1927243 - RNA, 13 nt, Shigella flexneri 2a str. 2457T
uuucaguuggcug

SEQ ID NO: 1927244 - RNA, 19 nt, Shigella flexneri 2a str. 2457T
uuucaguuggcugacaaag

SEQ ID NO: 1927245 - RNA, 18 nt, Shigella flexneri 2a str. 2457T
uuucauauuauuugcuau

SEQ ID NO: 1927246 - RNA, 20 nt, Shigella flexneri 2a str. 2457T
uuucauaccccacauaguuu

SEQ ID NO: 1927247 - RNA, 14 nt, Shigella flexneri 2a str. 2457T
uuucauacugccga

SEQ ID NO: 1927248 - RNA, 15 nt, Shigella flexneri 2a str. 2457T
uuucaguuugccgcu

SEQ ID NO: 1927249 - RNA, 13 nt, Shigella flexneri 2a str. 2457T
uuucaguuugccg

SEQ ID NO: 1927250 - RNA, 18 nt, Shigella flexneri 2a str. 2457T
uuucaaucacaucaucau

SEQ ID NO: 1927251 - RNA, 13 nt, Shigella flexneri 2a str. 2457T
uuucaaugcuuuu

SEQ ID NO: 1927252 - RNA, 23 nt, Shigella flexneri 2a str. 2457T
uuucaaugauaaaggucaucaca

SEQ ID NO: 1927253 - RNA, 19 nt, Shigella flexneri 2a str. 2457T
uuucaauaucguuaucacc

SEQ ID NO: 1927254 - RNA, 22 nt, Shigella flexneri 2a str. 2457T
uuucaauaaccugcaaaauagu

SEQ ID NO: 1927255 - RNA, 23 nt, Shigella flexneri 2a str. 2457T
uuucaacgacccagccagacgcc

SEQ ID NO: 1927256 - RNA, 17 nt, Shigella flexneri 2a str. 2457T
uuucaacggaccaauaa

SEQ ID NO: 1927257 - RNA, 19 nt, Shigella flexneri 2a str. 2457T
uuucaacguacucugccac

SEQ ID NO: 1927258 - RNA, 19 nt, Shigella flexneri 2a str. 2457T
uuucaccugauuaccguga

SEQ ID NO: 1927259 - RNA, 15 nt, Shigella flexneri 2a str. 2457T
uuucacgaacacagu

SEQ ID NO: 1927260 - RNA, 19 nt, Shigella flexneri 2a str. 2457T
uuucacgaagcucucugcu

SEQ ID NO: 1927261 - RNA, 21 nt, Shigella flexneri 2a str. 2457T
uuucacgccgccguuagcuuc

SEQ ID NO: 1927262 - RNA, 16 nt, Shigella flexneri 2a str. 2457T
uuucacgcaauaccug

SEQ ID NO: 1927263 - RNA, 14 nt, Shigella flexneri 2a str. 2457T
uuucacuauuucuu

SEQ ID NO: 1927264 - RNA, 15 nt, Shigella flexneri 2a str. 2457T
uuucacuauuucuuu

SEQ ID NO: 1927265 - RNA, 16 nt, Shigella flexneri 2a str. 2457T
uuucacggcaccagcc

SEQ ID NO: 1927266 - RNA, 19 nt, Shigella flexneri 2a str. 2457T
uuucacagaagugaagcau

SEQ ID NO: 1927267 - RNA, 18 nt, Shigella flexneri 2a str. 2457T
uuucacaggaaaaacuuu

SEQ ID NO: 1927268 - RNA, 20 nt, Shigella flexneri 2a str. 2457T
uuucaccaacgaugaagaga

SEQ ID NO: 1927269 - RNA, 17 nt, Shigella flexneri 2a str. 2457T
uuucacauguucauuua

SEQ ID NO: 1927270 - RNA, 17 nt, Shigella flexneri 2a str. 2457T
uuuauugcaaaaccauc

SEQ ID NO: 1927271 - RNA, 12 nt, Shigella flexneri 2a str. 2457T
uuuauugccauc

SEQ ID NO: 1927272 - RNA, 18 nt, Shigella flexneri 2a str. 2457T
uuuauuggcauggcgcug

SEQ ID NO: 1927273 - RNA, 13 nt, Shigella flexneri 2a str. 2457T
uuuauuucggaaa

SEQ ID NO: 1927274 - RNA, 19 nt, Shigella flexneri 2a str. 2457T
uuuauuuauucaaaccaau

SEQ ID NO: 1927275 - RNA, 20 nt, Shigella flexneri 2a str. 2457T
uuuauucggcauacauaauc

SEQ ID NO: 1927276 - RNA, 17 nt, Shigella flexneri 2a str. 2457T
uuuauucggucagguga

SEQ ID NO: 1927277 - RNA, 22 nt, Shigella flexneri 2a str. 2457T
uuuauucauucgcucaggaaaa

SEQ ID NO: 1927278 - RNA, 14 nt, Shigella flexneri 2a str. 2457T
uuuauucaccagua

SEQ ID NO: 1927279 - RNA, 13 nt, Shigella flexneri 2a str. 2457T
uuuauuuuuccuc

SEQ ID NO: 1927280 - RNA, 16 nt, Shigella flexneri 2a str. 2457T
uuucaaaaacaaagaa

SEQ ID NO: 1927281 - RNA, 18 nt, Shigella flexneri 2a str. 2457T
uuucaaagguaaugguca

SEQ ID NO: 1927282 - RNA, 14 nt, Shigella flexneri 2a str. 2457T
uuucaaauaucuau

SEQ ID NO: 1927283 - RNA, 18 nt, Shigella flexneri 2a str. 2457T
uuucaaacucuucacacc

SEQ ID NO: 1927284 - RNA, 12 nt, Shigella flexneri 2a str. 2457T
uuucaaacgcca

SEQ ID NO: 1927285 - RNA, 14 nt, Shigella flexneri 2a str. 2457T
uuucuggcgucaaa

SEQ ID NO: 1927286 - RNA, 19 nt, Shigella flexneri 2a str. 2457T
uuucuggcaccuguaccag

SEQ ID NO: 1927287 - RNA, 19 nt, Shigella flexneri 2a str. 2457T
uuucuggcaucacuucuuu

SEQ ID NO: 1927288 - RNA, 17 nt, Shigella flexneri 2a str. 2457T
uuucuggucauugccag

SEQ ID NO: 1927289 - RNA, 21 nt, Shigella flexneri 2a str. 2457T
uuucugucuuaacgcaccaug

SEQ ID NO: 1927290 - RNA, 16 nt, Shigella flexneri 2a str. 2457T
uuucuucagccccucc

SEQ ID NO: 1927291 - RNA, 12 nt, Shigella flexneri 2a str. 2457T
uuucuuauuuuu

SEQ ID NO: 1927292 - RNA, 14 nt, Shigella flexneri 2a str. 2457T
uuucuuauuucacu

SEQ ID NO: 1927293 - RNA, 21 nt, Shigella flexneri 2a str. 2457T
uuucuuaccccugauuuuguu

SEQ ID NO: 1927294 - RNA, 16 nt, Shigella flexneri 2a str. 2457T
uuucuuucaccucuuc

SEQ ID NO: 1927295 - RNA, 11 nt, Shigella flexneri 2a str. 2457T
uuucuuuaccg

SEQ ID NO: 1927296 - RNA, 11 nt, Shigella flexneri 2a str. 2457T
uuucuucuucg

SEQ ID NO: 1927297 - RNA, 12 nt, Shigella flexneri 2a str. 2457T
uuucuuuuuaaa

SEQ ID NO: 1927298 - RNA, 17 nt, Shigella flexneri 2a str. 2457T
uuucuuuggcaucaauc

SEQ ID NO: 1927299 - RNA, 22 nt, Shigella flexneri 2a str. 2457T
uuugacagccccugugccagcu

SEQ ID NO: 1927300 - RNA, 19 nt, Shigella flexneri 2a str. 2457T
uuugacagccccugugcca

SEQ ID NO: 1927301 - RNA, 22 nt, Shigella flexneri 2a str. 2457T
uuugagcaucaaacuuuuaaau

SEQ ID NO: 1927302 - RNA, 11 nt, Shigella flexneri 2a str. 2457T
uuugagcagca

SEQ ID NO: 1927303 - RNA, 22 nt, Shigella flexneri 2a str. 2457T
uuugauaaaccuccagcaucag

SEQ ID NO: 1927304 - RNA, 14 nt, Shigella flexneri 2a str. 2457T
uuugaguucacugc

SEQ ID NO: 1927305 - RNA, 13 nt, Shigella flexneri 2a str. 2457T
uuugauauuuauu

SEQ ID NO: 1927306 - RNA, 14 nt, Shigella flexneri 2a str. 2457T
uuugaugccugcau

SEQ ID NO: 1927307 - RNA, 17 nt, Shigella flexneri 2a str. 2457T
uuugccgaggaagacaa

SEQ ID NO: 1927308 - RNA, 18 nt, Shigella flexneri 2a str. 2457T
uuugccaaauaucuuaua

SEQ ID NO: 1927309 - RNA, 18 nt, Shigella flexneri 2a str. 2457T
uuugcauuacugcuaucu

SEQ ID NO: 1927310 - RNA, 17 nt, Shigella flexneri 2a str. 2457T
uuugccagaaauccagg

SEQ ID NO: 1927311 - RNA, 14 nt, Shigella flexneri 2a str. 2457T
uuugccacugccgg

SEQ ID NO: 1927312 - RNA, 13 nt, Shigella flexneri 2a str. 2457T
uuugcgccuggau

SEQ ID NO: 1927313 - RNA, 14 nt, Shigella flexneri 2a str. 2457T
uuugcgcaaucaca

SEQ ID NO: 1927314 - RNA, 15 nt, Shigella flexneri 2a str. 2457T
uuugccuuauugccu

SEQ ID NO: 1927315 - RNA, 19 nt, Shigella flexneri 2a str. 2457T
uuugccugugcaaccuuuu

SEQ ID NO: 1927316 - RNA, 20 nt, Shigella flexneri 2a str. 2457T
uuugcacgcuuucugcguga

SEQ ID NO: 1927317 - RNA, 12 nt, Shigella flexneri 2a str. 2457T
uuugcagauuca

SEQ ID NO: 1927318 - RNA, 15 nt, Shigella flexneri 2a str. 2457T
uuugcaaucagauaa

SEQ ID NO: 1927319 - RNA, 18 nt, Shigella flexneri 2a str. 2457T
uuugcaggugaccagcag

SEQ ID NO: 1927320 - RNA, 20 nt, Shigella flexneri 2a str. 2457T
uuugcagugaucgugugcca

SEQ ID NO: 1927321 - RNA, 14 nt, Shigella flexneri 2a str. 2457T
uuugcauaauuucc

SEQ ID NO: 1927322 - RNA, 16 nt, Shigella flexneri 2a str. 2457T
uuugcauuacugcuau

SEQ ID NO: 1927323 - RNA, 18 nt, Shigella flexneri 2a str. 2457T
uuugcauggauaaaauua

SEQ ID NO: 1927324 - RNA, 17 nt, Shigella flexneri 2a str. 2457T
uuugcauccacaacccg

SEQ ID NO: 1927325 - RNA, 14 nt, Shigella flexneri 2a str. 2457T
uuugcauccagcuc

SEQ ID NO: 1927326 - RNA, 20 nt, Shigella flexneri 2a str. 2457T
uuugcaucguccacuugaaa

SEQ ID NO: 1927327 - RNA, 22 nt, Shigella flexneri 2a str. 2457T
uuugcaucccagaaaaaaagua

SEQ ID NO: 1927328 - RNA, 15 nt, Shigella flexneri 2a str. 2457T
uuuccgucagcggca

SEQ ID NO: 1927329 - RNA, 19 nt, Shigella flexneri 2a str. 2457T
uuuccguugugcgauccac

SEQ ID NO: 1927330 - RNA, 16 nt, Shigella flexneri 2a str. 2457T
uuuccguuuuccagcc

SEQ ID NO: 1927331 - RNA, 20 nt, Shigella flexneri 2a str. 2457T
uuuccggcggcggaaaguau

SEQ ID NO: 1927332 - RNA, 15 nt, Shigella flexneri 2a str. 2457T
uuuccggcagaagca

SEQ ID NO: 1927333 - RNA, 14 nt, Shigella flexneri 2a str. 2457T
uuuccgcuucugcu

SEQ ID NO: 1927334 - RNA, 14 nt, Shigella flexneri 2a str. 2457T
uuuccggcagaagc

SEQ ID NO: 1927335 - RNA, 20 nt, Shigella flexneri 2a str. 2457T
uuuccggguuguacauuuug

SEQ ID NO: 1927336 - RNA, 18 nt, Shigella flexneri 2a str. 2457T
uuuccugcuucacgccca

SEQ ID NO: 1927337 - RNA, 19 nt, Shigella flexneri 2a str. 2457T
uuuccugcugcaucugaaa

SEQ ID NO: 1927338 - RNA, 24 nt, Shigella flexneri 2a str. 2457T
uuuccuggucggcaaacugcugau

SEQ ID NO: 1927339 - RNA, 21 nt, Shigella flexneri 2a str. 2457T
uuuccugcucaaugucuguca

SEQ ID NO: 1927340 - RNA, 20 nt, Shigella flexneri 2a str. 2457T
uuuccugccagaccuuauca

SEQ ID NO: 1927341 - RNA, 18 nt, Shigella flexneri 2a str. 2457T
uuuccuccugucuucccu

SEQ ID NO: 1927342 - RNA, 17 nt, Shigella flexneri 2a str. 2457T
uuucgaacgccaguuca

SEQ ID NO: 1927343 - RNA, 15 nt, Shigella flexneri 2a str. 2457T
uuucgaauuuuccau

SEQ ID NO: 1927344 - RNA, 20 nt, Shigella flexneri 2a str. 2457T
uuuccuucaggaucaaccgc

SEQ ID NO: 1927345 - RNA, 18 nt, Shigella flexneri 2a str. 2457T
uuuccuuaaacaccuggc

SEQ ID NO: 1927346 - RNA, 18 nt, Shigella flexneri 2a str. 2457T
uuuccuuaacuccucgcc

SEQ ID NO: 1927347 - RNA, 16 nt, Shigella flexneri 2a str. 2457T
uuucgccaguuuuuuc

SEQ ID NO: 1927348 - RNA, 15 nt, Shigella flexneri 2a str. 2457T
uuucgccacccaguc

SEQ ID NO: 1927349 - RNA, 15 nt, Shigella flexneri 2a str. 2457T
uuucgcaaaccaaac

SEQ ID NO: 1927350 - RNA, 13 nt, Shigella flexneri 2a str. 2457T
uuucgauugcaca

SEQ ID NO: 1927351 - RNA, 22 nt, Shigella flexneri 2a str. 2457T
uuucgaggauccaugacaucuc

SEQ ID NO: 1927352 - RNA, 17 nt, Shigella flexneri 2a str. 2457T
uuucgauaucaagccau

SEQ ID NO: 1927353 - RNA, 15 nt, Shigella flexneri 2a str. 2457T
uuucgauaaucauca

SEQ ID NO: 1927354 - RNA, 19 nt, Shigella flexneri 2a str. 2457T
uuuccagcaguuccagcau

SEQ ID NO: 1927355 - RNA, 15 nt, Shigella flexneri 2a str. 2457T
uuuccagcauuucuu

SEQ ID NO: 1927356 - RNA, 21 nt, Shigella flexneri 2a str. 2457T
uuuccagcucaaccagauucg

SEQ ID NO: 1927357 - RNA, 17 nt, Shigella flexneri 2a str. 2457T
uuuccaggcaucagcaa

SEQ ID NO: 1927358 - RNA, 23 nt, Shigella flexneri 2a str. 2457T
uuuccagaucgaucauauuuccu

SEQ ID NO: 1927359 - RNA, 14 nt, Shigella flexneri 2a str. 2457T
uuuccacuuccacc

SEQ ID NO: 1927360 - RNA, 13 nt, Shigella flexneri 2a str. 2457T
uuuccauuuuuca

SEQ ID NO: 1927361 - RNA, 16 nt, Shigella flexneri 2a str. 2457T
uuuccaucuuuccuca

SEQ ID NO: 1927362 - RNA, 20 nt, Shigella flexneri 2a str. 2457T
uuuccaucuccagcugcucg

SEQ ID NO: 1927363 - RNA, 14 nt, Shigella flexneri 2a str. 2457T
uuuccauccggcaa

SEQ ID NO: 1927364 - RNA, 23 nt, Shigella flexneri 2a str. 2457T
uuuccaguucacgaauauuuccc

SEQ ID NO: 1927365 - RNA, 21 nt, Shigella flexneri 2a str. 2457T
uuuccgcgaauuaugcagccu

SEQ ID NO: 1927366 - RNA, 18 nt, Shigella flexneri 2a str. 2457T
uuuccggaucgccaaagc

SEQ ID NO: 1927367 - RNA, 23 nt, Shigella flexneri 2a str. 2457T
uuuccgaccaggcguucugccug

SEQ ID NO: 1927368 - RNA, 22 nt, Shigella flexneri 2a str. 2457T
uuucccugacauugcguugaua

SEQ ID NO: 1927369 - RNA, 14 nt, Shigella flexneri 2a str. 2457T
uuucccuccacucc

SEQ ID NO: 1927370 - RNA, 21 nt, Shigella flexneri 2a str. 2457T
uuucccagcaagaaccaugca

SEQ ID NO: 1927371 - RNA, 14 nt, Shigella flexneri 2a str. 2457T
uuucccccacagcu

SEQ ID NO: 1927372 - RNA, 19 nt, Shigella flexneri 2a str. 2457T
uuucccgcuucguuuucag

SEQ ID NO: 1927373 - RNA, 18 nt, Shigella flexneri 2a str. 2457T
uuuccccuaacucuuuca

SEQ ID NO: 1927374 - RNA, 15 nt, Shigella flexneri 2a str. 2457T
uuuccccuucuuuga

SEQ ID NO: 1927375 - RNA, 13 nt, Shigella flexneri 2a str. 2457T
uuucuaccagguu

SEQ ID NO: 1927376 - RNA, 19 nt, Shigella flexneri 2a str. 2457T
uuucgcggcauaacagaau

SEQ ID NO: 1927377 - RNA, 19 nt, Shigella flexneri 2a str. 2457T
uuucggacgauauuuuucc

SEQ ID NO: 1927378 - RNA, 16 nt, Shigella flexneri 2a str. 2457T
uuucggcaucagcaga

SEQ ID NO: 1927379 - RNA, 21 nt, Shigella flexneri 2a str. 2457T
uuucguguggaguaauaauuu

SEQ ID NO: 1927380 - RNA, 15 nt, Shigella flexneri 2a str. 2457T
uuucgucguacugac

SEQ ID NO: 1927381 - RNA, 15 nt, Shigella flexneri 2a str. 2457T
uuucuccuucacucu

SEQ ID NO: 1927382 - RNA, 11 nt, Shigella flexneri 2a str. 2457T
uuucucccucg

SEQ ID NO: 1927383 - RNA, 11 nt, Shigella flexneri 2a str. 2457T
uuucucacccg

SEQ ID NO: 1927384 - RNA, 19 nt, Shigella flexneri 2a str. 2457T
uuucuaugagaaaauuuca

SEQ ID NO: 1927385 - RNA, 19 nt, Shigella flexneri 2a str. 2457T
uuucucugcaaauauuaau

SEQ ID NO: 1927386 - RNA, 12 nt, Shigella flexneri 2a str. 2457T
uuucucuuucag

SEQ ID NO: 1927387 - RNA, 15 nt, Shigella flexneri 2a str. 2457T
uuucucuuucuucag

SEQ ID NO: 1927388 - RNA, 12 nt, Shigella flexneri 2a str. 2457T
uuucucuuucuu

SEQ ID NO: 1927389 - RNA, 21 nt, Shigella flexneri 2a str. 2457T
uuucucggaucgcacaaucca

SEQ ID NO: 1927390 - RNA, 17 nt, Shigella flexneri 2a str. 2457T
uuucucggcaauaauuu

SEQ ID NO: 1927391 - RNA, 20 nt, Shigella flexneri 2a str. 2457T
uuucucgguauuacaaugcg

SEQ ID NO: 1927392 - RNA, 17 nt, Shigella flexneri 2a str. 2457T
uuucucuuucuucagca

SEQ ID NO: 1927393 - RNA, 13 nt, Shigella flexneri 2a str. 2457T
uuucugaacugaa

SEQ ID NO: 1927394 - RNA, 14 nt, Shigella flexneri 2a str. 2457T
uuucuggaguuaaa

SEQ ID NO: 1927395 - RNA, 18 nt, Shigella flexneri 2a str. 2457T
uuucuggaguuaaauuaa

SEQ ID NO: 1927396 - RNA, 18 nt, Shigella flexneri 2a str. 2457T
uuucuggaugccaucgca

SEQ ID NO: 1927397 - RNA, 15 nt, Shigella flexneri 2a str. 2457T
uuucugcuuuucccu

SEQ ID NO: 1927398 - RNA, 16 nt, Shigella flexneri 2a str. 2457T
uuucugccuugaguuu

SEQ ID NO: 1927399 - RNA, 17 nt, Shigella flexneri 2a str. 2457T
uuucugccauuuugcuu

SEQ ID NO: 1927400 - RNA, 11 nt, Shigella flexneri 2a str. 2457T
uuucugccuca

SEQ ID NO: 1927401 - RNA, 21 nt, Shigella flexneri 2a str. 2457T
uuucugaugcauaaaaaaacg

SEQ ID NO: 1927402 - RNA, 17 nt, Shigella flexneri 2a str. 2457T
uuucugcaucaaccaac

SEQ ID NO: 1927403 - RNA, 17 nt, Shigella flexneri 2a str. 2457T
uugccggacgcugagca

SEQ ID NO: 1927404 - RNA, 20 nt, Shigella flexneri 2a str. 2457T
uugccggauauuccugaaug

SEQ ID NO: 1927405 - RNA, 22 nt, Shigella flexneri 2a str. 2457T
uugccggaugcggcguaaaugc

SEQ ID NO: 1927406 - RNA, 17 nt, Shigella flexneri 2a str. 2457T
uugccggaugugaugca

SEQ ID NO: 1927407 - RNA, 18 nt, Shigella flexneri 2a str. 2457T
uugccgcgcucuuuaaag

SEQ ID NO: 1927408 - RNA, 21 nt, Shigella flexneri 2a str. 2457T
uugcgagccuguaccacaacc

SEQ ID NO: 1927409 - RNA, 14 nt, Shigella flexneri 2a str. 2457T
uugcgcuggcaccg

SEQ ID NO: 1927410 - RNA, 24 nt, Shigella flexneri 2a str. 2457T
uugcgcgucgcccaguucuacaau

SEQ ID NO: 1927411 - RNA, 23 nt, Shigella flexneri 2a str. 2457T
uugcucaggaguaaacuuucccu

SEQ ID NO: 1927412 - RNA, 13 nt, Shigella flexneri 2a str. 2457T
uugcucauaaaau

SEQ ID NO: 1927413 - RNA, 16 nt, Shigella flexneri 2a str. 2457T
uugcucauaaaaugau

SEQ ID NO: 1927414 - RNA, 15 nt, Shigella flexneri 2a str. 2457T
uugcagaaacauaau

SEQ ID NO: 1927415 - RNA, 16 nt, Shigella flexneri 2a str. 2457T
uugcagaucgccaaua

SEQ ID NO: 1927416 - RNA, 22 nt, Shigella flexneri 2a str. 2457T
uugcagacccguuaagcguuca

SEQ ID NO: 1927417 - RNA, 15 nt, Shigella flexneri 2a str. 2457T
uugcauuuuaaauga

SEQ ID NO: 1927418 - RNA, 17 nt, Shigella flexneri 2a str. 2457T
uugcauuuccauaaauu

SEQ ID NO: 1927419 - RNA, 21 nt, Shigella flexneri 2a str. 2457T
uugcauuccaguccacaucaa

SEQ ID NO: 1927420 - RNA, 16 nt, Shigella flexneri 2a str. 2457T
uugcaucgucuguuuu

SEQ ID NO: 1927421 - RNA, 13 nt, Shigella flexneri 2a str. 2457T
uugcauccgguca

SEQ ID NO: 1927422 - RNA, 20 nt, Shigella flexneri 2a str. 2457T
uugcccgcgcguuaacuccc

SEQ ID NO: 1927423 - RNA, 16 nt, Shigella flexneri 2a str. 2457T
uugcccgcaagcugcg

SEQ ID NO: 1927424 - RNA, 16 nt, Shigella flexneri 2a str. 2457T
uugcccucacccugua

SEQ ID NO: 1927425 - RNA, 20 nt, Shigella flexneri 2a str. 2457T
uugcccuuuucaccaugggc

SEQ ID NO: 1927426 - RNA, 16 nt, Shigella flexneri 2a str. 2457T
uugccgaugauuccca

SEQ ID NO: 1927427 - RNA, 18 nt, Shigella flexneri 2a str. 2457T
uugccgcagcaguugcca

SEQ ID NO: 1927428 - RNA, 15 nt, Shigella flexneri 2a str. 2457T
uugccaccaugcaaa

SEQ ID NO: 1927429 - RNA, 16 nt, Shigella flexneri 2a str. 2457T
uugcccgcaaagauga

SEQ ID NO: 1927430 - RNA, 15 nt, Shigella flexneri 2a str. 2457T
uugccaaauaucuua

SEQ ID NO: 1927431 - RNA, 21 nt, Shigella flexneri 2a str. 2457T
uugguggcgaccggaauguuc

SEQ ID NO: 1927432 - RNA, 15 nt, Shigella flexneri 2a str. 2457T
uugguauucugggaa

SEQ ID NO: 1927433 - RNA, 17 nt, Shigella flexneri 2a str. 2457T
uugggcgaucucccgcu

SEQ ID NO: 1927434 - RNA, 18 nt, Shigella flexneri 2a str. 2457T
uugggcaauucaccguaa

SEQ ID NO: 1927435 - RNA, 17 nt, Shigella flexneri 2a str. 2457T
uugggcauuugcacaau

SEQ ID NO: 1927436 - RNA, 13 nt, Shigella flexneri 2a str. 2457T
uuggggagacuaa

SEQ ID NO: 1927437 - RNA, 15 nt, Shigella flexneri 2a str. 2457T
uugggcucaucaaua

SEQ ID NO: 1927438 - RNA, 17 nt, Shigella flexneri 2a str. 2457T
uugggaugccgaaaaaa

SEQ ID NO: 1927439 - RNA, 15 nt, Shigella flexneri 2a str. 2457T
uuggcguaccauuaa

SEQ ID NO: 1927440 - RNA, 17 nt, Shigella flexneri 2a str. 2457T
uuggcaucguauuucag

SEQ ID NO: 1927441 - RNA, 14 nt, Shigella flexneri 2a str. 2457T
uuggcagacaacca

SEQ ID NO: 1927442 - RNA, 11 nt, Shigella flexneri 2a str. 2457T
uugcuuugcaa

SEQ ID NO: 1927443 - RNA, 19 nt, Shigella flexneri 2a str. 2457T
uugcuuuuaccauacugga

SEQ ID NO: 1927444 - RNA, 13 nt, Shigella flexneri 2a str. 2457T
uugcugccuucac

SEQ ID NO: 1927445 - RNA, 22 nt, Shigella flexneri 2a str. 2457T
uugcugccgccaguucuuccag

SEQ ID NO: 1927446 - RNA, 14 nt, Shigella flexneri 2a str. 2457T
uugcugcaccaggc

SEQ ID NO: 1927447 - RNA, 15 nt, Shigella flexneri 2a str. 2457T
uugcugauucucccu

SEQ ID NO: 1927448 - RNA, 12 nt, Shigella flexneri 2a str. 2457T
uugcuccagaaa

SEQ ID NO: 1927449 - RNA, 15 nt, Shigella flexneri 2a str. 2457T
uugcugaaauacaga

SEQ ID NO: 1927450 - RNA, 14 nt, Shigella flexneri 2a str. 2457T
uugcuguuguucaa

SEQ ID NO: 1927451 - RNA, 14 nt, Shigella flexneri 2a str. 2457T
uugcuuaaaaaauc

SEQ ID NO: 1927452 - RNA, 23 nt, Shigella flexneri 2a str. 2457T
uugcuuaaauacgccucuucaua

SEQ ID NO: 1927453 - RNA, 15 nt, Shigella flexneri 2a str. 2457T
uuguuuuauaaagaa

SEQ ID NO: 1927454 - RNA, 14 nt, Shigella flexneri 2a str. 2457T
uuguuggcaaaaaa

SEQ ID NO: 1927455 - RNA, 18 nt, Shigella flexneri 2a str. 2457T
uuguuggcaaaaaaauuc

SEQ ID NO: 1927456 - RNA, 18 nt, Shigella flexneri 2a str. 2457T
uuguuggcgaaaaucuuu

SEQ ID NO: 1927457 - RNA, 21 nt, Shigella flexneri 2a str. 2457T
uuguuggcgaaaaucuuugca

SEQ ID NO: 1927458 - RNA, 12 nt, Shigella flexneri 2a str. 2457T
uuguuuaaauau

SEQ ID NO: 1927459 - RNA, 17 nt, Shigella flexneri 2a str. 2457T
uuguugucuauuuccac

SEQ ID NO: 1927460 - RNA, 13 nt, Shigella flexneri 2a str. 2457T
uuguugucacacc

SEQ ID NO: 1927461 - RNA, 17 nt, Shigella flexneri 2a str. 2457T
uuuaacaauuuaucaga

SEQ ID NO: 1927462 - RNA, 11 nt, Shigella flexneri 2a str. 2457T
uuuaaccaaca

SEQ ID NO: 1927463 - RNA, 14 nt, Shigella flexneri 2a str. 2457T
uuguuuucaugccg

SEQ ID NO: 1927464 - RNA, 20 nt, Shigella flexneri 2a str. 2457T
uuuaaaaccacuacccauau

SEQ ID NO: 1927465 - RNA, 16 nt, Shigella flexneri 2a str. 2457T
uuuaacgcaugcacau

SEQ ID NO: 1927466 - RNA, 13 nt, Shigella flexneri 2a str. 2457T
uuuaaguuuaugg

SEQ ID NO: 1927467 - RNA, 12 nt, Shigella flexneri 2a str. 2457T
uuuaauucagga

SEQ ID NO: 1927468 - RNA, 21 nt, Shigella flexneri 2a str. 2457T
uuuaauaaugagcguuuuuug

SEQ ID NO: 1927469 - RNA, 12 nt, Shigella flexneri 2a str. 2457T
uuuaauuccugc

SEQ ID NO: 1927470 - RNA, 17 nt, Shigella flexneri 2a str. 2457T
uuguaaucauauuaaau

SEQ ID NO: 1927471 - RNA, 22 nt, Shigella flexneri 2a str. 2457T
uugguuaacugaauauuccagu

SEQ ID NO: 1927472 - RNA, 14 nt, Shigella flexneri 2a str. 2457T
uugguuaacugaau

SEQ ID NO: 1927473 - RNA, 16 nt, Shigella flexneri 2a str. 2457T
uuguauaacgugguga

SEQ ID NO: 1927474 - RNA, 16 nt, Shigella flexneri 2a str. 2457T
uuguacuuuccagcca

SEQ ID NO: 1927475 - RNA, 16 nt, Shigella flexneri 2a str. 2457T
uuguacuccagcagac

SEQ ID NO: 1927476 - RNA, 14 nt, Shigella flexneri 2a str. 2457T
uuguacaaaccaua

SEQ ID NO: 1927477 - RNA, 12 nt, Shigella flexneri 2a str. 2457T
uuguacaaaaaa

SEQ ID NO: 1927478 - RNA, 13 nt, Shigella flexneri 2a str. 2457T
uuguacaaaaaau

SEQ ID NO: 1927479 - RNA, 17 nt, Shigella flexneri 2a str. 2457T
uugucaucaguuucaaa

SEQ ID NO: 1927480 - RNA, 19 nt, Shigella flexneri 2a str. 2457T
uugucauagcgacuaccac

SEQ ID NO: 1927481 - RNA, 18 nt, Shigella flexneri 2a str. 2457T
uugucagcccuuuuucac

SEQ ID NO: 1927482 - RNA, 23 nt, Shigella flexneri 2a str. 2457T
uugucacuuuuacucauuucugu

SEQ ID NO: 1927483 - RNA, 17 nt, Shigella flexneri 2a str. 2457T
uuguccgcuauuucuug

SEQ ID NO: 1927484 - RNA, 16 nt, Shigella flexneri 2a str. 2457T
uugucucuucaugccu

SEQ ID NO: 1927485 - RNA, 16 nt, Shigella flexneri 2a str. 2457T
uugucuccaccaauga

SEQ ID NO: 1927486 - RNA, 18 nt, Shigella flexneri 2a str. 2457T
uugucuccaccaaugacg

SEQ ID NO: 1927487 - RNA, 12 nt, Shigella flexneri 2a str. 2457T
uugugccagacc

SEQ ID NO: 1927488 - RNA, 14 nt, Shigella flexneri 2a str. 2457T
uugugccagaccaa

SEQ ID NO: 1927489 - RNA, 16 nt, Shigella flexneri 2a str. 2457T
uugugcagcaugcacc

SEQ ID NO: 1927490 - RNA, 20 nt, Shigella flexneri 2a str. 2457T
uugugcaaauucaauaaauu

SEQ ID NO: 1927491 - RNA, 15 nt, Shigella flexneri 2a str. 2457T
uugugcaccaccaaa

SEQ ID NO: 1927492 - RNA, 22 nt, Shigella flexneri 2a str. 2457T
uuguuaacaacgugugcuuugu

SEQ ID NO: 1927493 - RNA, 20 nt, Shigella flexneri 2a str. 2457T
uuguuaaauauuaaggguaa

SEQ ID NO: 1927494 - RNA, 15 nt, Shigella flexneri 2a str. 2457T
uuguggcggaaagac

SEQ ID NO: 1927495 - RNA, 15 nt, Shigella flexneri 2a str. 2457T
uuguuacgguguuca

SEQ ID NO: 1927496 - RNA, 15 nt, Shigella flexneri 2a str. 2457T
uucuacgaugcgaua

SEQ ID NO: 1927497 - RNA, 22 nt, Shigella flexneri 2a str. 2457T
uucuaccagguuucgcaauaac

SEQ ID NO: 1927498 - RNA, 16 nt, Shigella flexneri 2a str. 2457T
uucuacacccagcccc

SEQ ID NO: 1927499 - RNA, 16 nt, Shigella flexneri 2a str. 2457T
uucuacagaaaugaaa

SEQ ID NO: 1927500 - RNA, 14 nt, Shigella flexneri 2a str. 2457T
uucuacaagcagag

SEQ ID NO: 1927501 - RNA, 13 nt, Shigella flexneri 2a str. 2457T
uucuaaagccuga

SEQ ID NO: 1927502 - RNA, 17 nt, Shigella flexneri 2a str. 2457T
uucuacggguaaguguu

SEQ ID NO: 1927503 - RNA, 20 nt, Shigella flexneri 2a str. 2457T
uucuacggguaaguguuuca

SEQ ID NO: 1927504 - RNA, 14 nt, Shigella flexneri 2a str. 2457T
uucuaugaagaacu

SEQ ID NO: 1927505 - RNA, 17 nt, Shigella flexneri 2a str. 2457T
uucuauuuugcauuauu

SEQ ID NO: 1927506 - RNA, 12 nt, Shigella flexneri 2a str. 2457T
uucguauuuaaa

SEQ ID NO: 1927507 - RNA, 17 nt, Shigella flexneri 2a str. 2457T
uucggugcgacaaacau

SEQ ID NO: 1927508 - RNA, 14 nt, Shigella flexneri 2a str. 2457T
uucguagcguuuuu

SEQ ID NO: 1927509 - RNA, 14 nt, Shigella flexneri 2a str. 2457T
uucggugacagaaa

SEQ ID NO: 1927510 - RNA, 23 nt, Shigella flexneri 2a str. 2457T
uucgguccgacgugcucgaacau

SEQ ID NO: 1927511 - RNA, 17 nt, Shigella flexneri 2a str. 2457T
uucguuuuaaugcgauc

SEQ ID NO: 1927512 - RNA, 17 nt, Shigella flexneri 2a str. 2457T
uuaucagcaacuggcaa

SEQ ID NO: 1927513 - RNA, 21 nt, Shigella flexneri 2a str. 2457T
uuaucagacaccgauugcccc

SEQ ID NO: 1927514 - RNA, 18 nt, Shigella flexneri 2a str. 2457T
uuaucaggccuacaaguc

SEQ ID NO: 1927515 - RNA, 15 nt, Shigella flexneri 2a str. 2457T
uuaucacuuaaccca

SEQ ID NO: 1927516 - RNA, 16 nt, Shigella flexneri 2a str. 2457T
uucgguaaugacucca

SEQ ID NO: 1927517 - RNA, 22 nt, Shigella flexneri 2a str. 2457T
uucgguauuaaucugccagcgu

SEQ ID NO: 1927518 - RNA, 18 nt, Shigella flexneri 2a str. 2457T
uucucucugauuacccuu

SEQ ID NO: 1927519 - RNA, 20 nt, Shigella flexneri 2a str. 2457T
uucucucaauccgccaaaac

SEQ ID NO: 1927520 - RNA, 15 nt, Shigella flexneri 2a str. 2457T
uucucaccuugcucu

SEQ ID NO: 1927521 - RNA, 23 nt, Shigella flexneri 2a str. 2457T
uucucacccgcaaacaggaacac

SEQ ID NO: 1927522 - RNA, 22 nt, Shigella flexneri 2a str. 2457T
uucucaccuauguggaaacagu

SEQ ID NO: 1927523 - RNA, 16 nt, Shigella flexneri 2a str. 2457T
uucucaaucccuuucu

SEQ ID NO: 1927524 - RNA, 20 nt, Shigella flexneri 2a str. 2457T
uucucaauaaaaggaaacag

SEQ ID NO: 1927525 - RNA, 20 nt, Shigella flexneri 2a str. 2457T
uucucacuccagccagagcc

SEQ ID NO: 1927526 - RNA, 11 nt, Shigella flexneri 2a str. 2457T
uucuccagcuu

SEQ ID NO: 1927527 - RNA, 23 nt, Shigella flexneri 2a str. 2457T
uucugcaauauauugaauuugga

SEQ ID NO: 1927528 - RNA, 23 nt, Shigella flexneri 2a str. 2457T
uucugccaaacgcucccugccag

SEQ ID NO: 1927529 - RNA, 18 nt, Shigella flexneri 2a str. 2457T
uucugccgcuuccagcag

SEQ ID NO: 1927530 - RNA, 19 nt, Shigella flexneri 2a str. 2457T
uucugcucgcgguuaaguu

SEQ ID NO: 1927531 - RNA, 14 nt, Shigella flexneri 2a str. 2457T
uucugcugccuaca

SEQ ID NO: 1927532 - RNA, 15 nt, Shigella flexneri 2a str. 2457T
uucuguagauaaaac

SEQ ID NO: 1927533 - RNA, 15 nt, Shigella flexneri 2a str. 2457T
uucugucggcaaaac

SEQ ID NO: 1927534 - RNA, 11 nt, Shigella flexneri 2a str. 2457T
uucugucauga

SEQ ID NO: 1927535 - RNA, 19 nt, Shigella flexneri 2a str. 2457T
uucugcguucugauuuaau

SEQ ID NO: 1927536 - RNA, 22 nt, Shigella flexneri 2a str. 2457T
uucugccuguccaccacgcugc

SEQ ID NO: 1927537 - RNA, 20 nt, Shigella flexneri 2a str. 2457T
uucugucuuaacgcaccaug

SEQ ID NO: 1927538 - RNA, 13 nt, Shigella flexneri 2a str. 2457T
uucugugcaucug

SEQ ID NO: 1927539 - RNA, 16 nt, Shigella flexneri 2a str. 2457T
uucuguggcagggcag

SEQ ID NO: 1927540 - RNA, 21 nt, Shigella flexneri 2a str. 2457T
uucuguguaaaugccuuucuc

SEQ ID NO: 1927541 - RNA, 19 nt, Shigella flexneri 2a str. 2457T
uucuguuuucguaauaauu

SEQ ID NO: 1927542 - RNA, 14 nt, Shigella flexneri 2a str. 2457T
uucuuauaaagaaa

SEQ ID NO: 1927543 - RNA, 19 nt, Shigella flexneri 2a str. 2457T
uucuucuccggcauccuua

SEQ ID NO: 1927544 - RNA, 22 nt, Shigella flexneri 2a str. 2457T
uucuucucgauaaaaccuuccu

SEQ ID NO: 1927545 - RNA, 22 nt, Shigella flexneri 2a str. 2457T
uugaugcguaccucacguucca

SEQ ID NO: 1927546 - RNA, 13 nt, Shigella flexneri 2a str. 2457T
uugauccaggagc

SEQ ID NO: 1927547 - RNA, 21 nt, Shigella flexneri 2a str. 2457T
uugaucccggcuccaaugacu

SEQ ID NO: 1927548 - RNA, 20 nt, Shigella flexneri 2a str. 2457T
uugauggaaaauuguuccgu

SEQ ID NO: 1927549 - RNA, 15 nt, Shigella flexneri 2a str. 2457T
uugauggggguccug

SEQ ID NO: 1927550 - RNA, 16 nt, Shigella flexneri 2a str. 2457T
uugauguccaguuccc

SEQ ID NO: 1927551 - RNA, 19 nt, Shigella flexneri 2a str. 2457T
uugauguggcggauggcga

SEQ ID NO: 1927552 - RNA, 19 nt, Shigella flexneri 2a str. 2457T
uugauguugguaaccaaau

SEQ ID NO: 1927553 - RNA, 20 nt, Shigella flexneri 2a str. 2457T
uugcaaagagaacugagcga

SEQ ID NO: 1927554 - RNA, 17 nt, Shigella flexneri 2a str. 2457T
uugcaaccacacaggca

SEQ ID NO: 1927555 - RNA, 14 nt, Shigella flexneri 2a str. 2457T
uugcaccugaucca

SEQ ID NO: 1927556 - RNA, 15 nt, Shigella flexneri 2a str. 2457T
uugcaccuaaagcgc

SEQ ID NO: 1927557 - RNA, 16 nt, Shigella flexneri 2a str. 2457T
uugcaccucugcugcu

SEQ ID NO: 1927558 - RNA, 20 nt, Shigella flexneri 2a str. 2457T
uugcacgaaggugcauugcu

SEQ ID NO: 1927559 - RNA, 16 nt, Shigella flexneri 2a str. 2457T
uugcaccagcaacaag

SEQ ID NO: 1927560 - RNA, 17 nt, Shigella flexneri 2a str. 2457T
uugcaccgaggccaaaa

SEQ ID NO: 1927561 - RNA, 23 nt, Shigella flexneri 2a str. 2457T
uugcacagguggcaaacgccacc

SEQ ID NO: 1927562 - RNA, 20 nt, Shigella flexneri 2a str. 2457T
uugcaccauccauuuuucac

SEQ ID NO: 1927563 - RNA, 20 nt, Shigella flexneri 2a str. 2457T
uugauacaggcgcuguaugc

SEQ ID NO: 1927564 - RNA, 16 nt, Shigella flexneri 2a str. 2457T
uugauaauaaagcuac

SEQ ID NO: 1927565 - RNA, 17 nt, Shigella flexneri 2a str. 2457T
uugauaaggaaauucag

SEQ ID NO: 1927566 - RNA, 22 nt, Shigella flexneri 2a str. 2457T
uugaggaaguuauacagacuca

SEQ ID NO: 1927567 - RNA, 18 nt, Shigella flexneri 2a str. 2457T
uugaggaacucaaaccau

SEQ ID NO: 1927568 - RNA, 14 nt, Shigella flexneri 2a str. 2457T
uugaggaucacaaa

SEQ ID NO: 1927569 - RNA, 13 nt, Shigella flexneri 2a str. 2457T
uugauagaacaaa

SEQ ID NO: 1927570 - RNA, 21 nt, Shigella flexneri 2a str. 2457T
uugacuaaaguuucuuuagga

SEQ ID NO: 1927571 - RNA, 23 nt, Shigella flexneri 2a str. 2457T
uugacucgccuucaggaauacgc

SEQ ID NO: 1927572 - RNA, 13 nt, Shigella flexneri 2a str. 2457T
uugacucggaguc

SEQ ID NO: 1927573 - RNA, 14 nt, Shigella flexneri 2a str. 2457T
uugacucucaucca

SEQ ID NO: 1927574 - RNA, 14 nt, Shigella flexneri 2a str. 2457T
uugaccgccagcgc

SEQ ID NO: 1927575 - RNA, 19 nt, Shigella flexneri 2a str. 2457T
uugacccaucugccagcgc

SEQ ID NO: 1927576 - RNA, 16 nt, Shigella flexneri 2a str. 2457T
uugaccgccagcgcca

SEQ ID NO: 1927577 - RNA, 18 nt, Shigella flexneri 2a str. 2457T
uugacgugucuuaucagg

SEQ ID NO: 1927578 - RNA, 12 nt, Shigella flexneri 2a str. 2457T
uugaaaagguac

SEQ ID NO: 1927579 - RNA, 16 nt, Shigella flexneri 2a str. 2457T
uugaaauauauccuau

SEQ ID NO: 1927580 - RNA, 14 nt, Shigella flexneri 2a str. 2457T
uugaaauaccaggu

SEQ ID NO: 1927581 - RNA, 13 nt, Shigella flexneri 2a str. 2457T
uugaaauagccaa

SEQ ID NO: 1927582 - RNA, 13 nt, Shigella flexneri 2a str. 2457T
uugaaaucgaaca

SEQ ID NO: 1927583 - RNA, 11 nt, Shigella flexneri 2a str. 2457T
uucuuuuucaa

SEQ ID NO: 1927584 - RNA, 16 nt, Shigella flexneri 2a str. 2457T
uugaaaaaucaaaaaa

SEQ ID NO: 1927585 - RNA, 20 nt, Shigella flexneri 2a str. 2457T
uugaaaaauaaagucuuagc

SEQ ID NO: 1927586 - RNA, 14 nt, Shigella flexneri 2a str. 2457T
uugaaaaaucaaaa

SEQ ID NO: 1927587 - RNA, 15 nt, Shigella flexneri 2a str. 2457T
uucuuuuaccuucag

SEQ ID NO: 1927588 - RNA, 18 nt, Shigella flexneri 2a str. 2457T
uucuuucucgcucaguuu

SEQ ID NO: 1927589 - RNA, 15 nt, Shigella flexneri 2a str. 2457T
uucuucuucacuaag

SEQ ID NO: 1927590 - RNA, 14 nt, Shigella flexneri 2a str. 2457T
uucuucuuucagua

SEQ ID NO: 1927591 - RNA, 14 nt, Shigella flexneri 2a str. 2457T
uucuuuaaauaugg

SEQ ID NO: 1927592 - RNA, 14 nt, Shigella flexneri 2a str. 2457T
uucuuucaccucuu

SEQ ID NO: 1927593 - RNA, 22 nt, Shigella flexneri 2a str. 2457T
uugacauauaaccggcaacaga

SEQ ID NO: 1927594 - RNA, 15 nt, Shigella flexneri 2a str. 2457T
uugaauaucuccucu

SEQ ID NO: 1927595 - RNA, 16 nt, Shigella flexneri 2a str. 2457T
uugaauaucuccucug

SEQ ID NO: 1927596 - RNA, 20 nt, Shigella flexneri 2a str. 2457T
uugaagucuuuuuucaacuu

SEQ ID NO: 1927597 - RNA, 17 nt, Shigella flexneri 2a str. 2457T
uugaagucuuuuuucaa

SEQ ID NO: 1927598 - RNA, 11 nt, Shigella flexneri 2a str. 2457T
uugaagucagg

SEQ ID NO: 1927599 - RNA, 23 nt, Shigella flexneri 2a str. 2457T
uugaaggguauugccgaugaacg

SEQ ID NO: 1927600 - RNA, 22 nt, Shigella flexneri 2a str. 2457T
uugaagauguugccacacgccc

SEQ ID NO: 1927601 - RNA, 12 nt, Shigella flexneri 2a str. 2457T
uugaagauuagc

SEQ ID NO: 1927602 - RNA, 19 nt, Shigella flexneri 2a str. 2457T
uugaagauuuugcugugcu

SEQ ID NO: 1927603 - RNA, 21 nt, Shigella flexneri 2a str. 2457T
uugaacaaccagaaagaugca

SEQ ID NO: 1927604 - RNA, 16 nt, Shigella flexneri 2a str. 2457T
ugaugugauccaucag

SEQ ID NO: 1927605 - RNA, 16 nt, Shigella flexneri 2a str. 2457T
ugaugugcuucaucag

SEQ ID NO: 1927606 - RNA, 22 nt, Shigella flexneri 2a str. 2457T
ugaugugaaaacucuuagcaaa

SEQ ID NO: 1927607 - RNA, 16 nt, Shigella flexneri 2a str. 2457T
ugaugucucuguuuug

SEQ ID NO: 1927608 - RNA, 11 nt, Shigella flexneri 2a str. 2457T
ugauuccugca

SEQ ID NO: 1927609 - RNA, 11 nt, Shigella flexneri 2a str. 2457T
ugauucacaag

SEQ ID NO: 1927610 - RNA, 14 nt, Shigella flexneri 2a str. 2457T
ugauucacaguuaa

SEQ ID NO: 1927611 - RNA, 22 nt, Shigella flexneri 2a str. 2457T
ugauuauuggacgguaaaaaga

SEQ ID NO: 1927612 - RNA, 14 nt, Shigella flexneri 2a str. 2457T
ugaugucacagccg

SEQ ID NO: 1927613 - RNA, 19 nt, Shigella flexneri 2a str. 2457T
ugaugguaaaauaucacuc

SEQ ID NO: 1927614 - RNA, 17 nt, Shigella flexneri 2a str. 2457T
ugauggcgauaaucuuu

SEQ ID NO: 1927615 - RNA, 15 nt, Shigella flexneri 2a str. 2457T
ugauggcuauuagaa

SEQ ID NO: 1927616 - RNA, 21 nt, Shigella flexneri 2a str. 2457T
ugauggcauucucacuccagc

SEQ ID NO: 1927617 - RNA, 20 nt, Shigella flexneri 2a str. 2457T
ugauggcauaacguugcagc

SEQ ID NO: 1927618 - RNA, 22 nt, Shigella flexneri 2a str. 2457T
ugauggccagauaacccagggg

SEQ ID NO: 1927619 - RNA, 16 nt, Shigella flexneri 2a str. 2457T
ugauggcccguuuuag

SEQ ID NO: 1927620 - RNA, 22 nt, Shigella flexneri 2a str. 2457T
ugauuuccccuaacucuuucaa

SEQ ID NO: 1927621 - RNA, 20 nt, Shigella flexneri 2a str. 2457T
ugauuuccugcgugacuaaa

SEQ ID NO: 1927622 - RNA, 19 nt, Shigella flexneri 2a str. 2457T
ugauuucgucauccggugu

SEQ ID NO: 1927623 - RNA, 20 nt, Shigella flexneri 2a str. 2457T
ugauuuaaaaaauggccaga

SEQ ID NO: 1927624 - RNA, 16 nt, Shigella flexneri 2a str. 2457T
ugauucgauucacauu

SEQ ID NO: 1927625 - RNA, 21 nt, Shigella flexneri 2a str. 2457T
ugauucgcgccacguucggug

SEQ ID NO: 1927626 - RNA, 23 nt, Shigella flexneri 2a str. 2457T
ugauuguugcgccaguaaauuua

SEQ ID NO: 1927627 - RNA, 18 nt, Shigella flexneri 2a str. 2457T
ugauuguggcaaucauau

SEQ ID NO: 1927628 - RNA, 15 nt, Shigella flexneri 2a str. 2457T
ugauuuuauugcguc

SEQ ID NO: 1927629 - RNA, 18 nt, Shigella flexneri 2a str. 2457T
ugauuuucaccagcaucg

SEQ ID NO: 1927630 - RNA, 21 nt, Shigella flexneri 2a str. 2457T
ugauuuuugagacgcagcguu

SEQ ID NO: 1927631 - RNA, 19 nt, Shigella flexneri 2a str. 2457T
ugauuuuuuccaacaggcg

SEQ ID NO: 1927632 - RNA, 15 nt, Shigella flexneri 2a str. 2457T
ugaucggcgcgaaag

SEQ ID NO: 1927633 - RNA, 13 nt, Shigella flexneri 2a str. 2457T
ugaugaagcaagc

SEQ ID NO: 1927634 - RNA, 11 nt, Shigella flexneri 2a str. 2457T
ugaugaaucag

SEQ ID NO: 1927635 - RNA, 19 nt, Shigella flexneri 2a str. 2457T
ugaucgcaccuuaucgauu

SEQ ID NO: 1927636 - RNA, 20 nt, Shigella flexneri 2a str. 2457T
ugaucgccauauuucuccau

SEQ ID NO: 1927637 - RNA, 13 nt, Shigella flexneri 2a str. 2457T
ugaucgccauauu

SEQ ID NO: 1927638 - RNA, 15 nt, Shigella flexneri 2a str. 2457T
ugaucgccauauuuc

SEQ ID NO: 1927639 - RNA, 19 nt, Shigella flexneri 2a str. 2457T
ugaucgccgcacuuucucc

SEQ ID NO: 1927640 - RNA, 16 nt, Shigella flexneri 2a str. 2457T
ugaucgccgcacuuuc

SEQ ID NO: 1927641 - RNA, 17 nt, Shigella flexneri 2a str. 2457T
ugauggaauuucaucau

SEQ ID NO: 1927642 - RNA, 18 nt, Shigella flexneri 2a str. 2457T
ugaugcggcgcuuucagc

SEQ ID NO: 1927643 - RNA, 16 nt, Shigella flexneri 2a str. 2457T
ugaugcgcggcuccag

SEQ ID NO: 1927644 - RNA, 23 nt, Shigella flexneri 2a str. 2457T
ugaugcgcuucgcuuaccaugcc

SEQ ID NO: 1927645 - RNA, 19 nt, Shigella flexneri 2a str. 2457T
ugaugcgcuucgcuuauca

SEQ ID NO: 1927646 - RNA, 19 nt, Shigella flexneri 2a str. 2457T
ugaugauuuccggcagcau

SEQ ID NO: 1927647 - RNA, 11 nt, Shigella flexneri 2a str. 2457T
ugaugccaucg

SEQ ID NO: 1927648 - RNA, 17 nt, Shigella flexneri 2a str. 2457T
ugaugcagccagugauu

SEQ ID NO: 1927649 - RNA, 15 nt, Shigella flexneri 2a str. 2457T
ugauccccgcuuccu

SEQ ID NO: 1927650 - RNA, 19 nt, Shigella flexneri 2a str. 2457T
ugauccccggaaucagagg

SEQ ID NO: 1927651 - RNA, 17 nt, Shigella flexneri 2a str. 2457T
ugauccccgcuuccugc

SEQ ID NO: 1927652 - RNA, 13 nt, Shigella flexneri 2a str. 2457T
ugauccaggagcu

SEQ ID NO: 1927653 - RNA, 19 nt, Shigella flexneri 2a str. 2457T
ugauccagccauugccaua

SEQ ID NO: 1927654 - RNA, 23 nt, Shigella flexneri 2a str. 2457T
ugaucccgauggucagcuucacc

SEQ ID NO: 1927655 - RNA, 21 nt, Shigella flexneri 2a str. 2457T
ugauccugcaacagcaccagc

SEQ ID NO: 1927656 - RNA, 18 nt, Shigella flexneri 2a str. 2457T
ugauccuggauuuccucg

SEQ ID NO: 1927657 - RNA, 18 nt, Shigella flexneri 2a str. 2457T
ugaucacuuucaccggcg

SEQ ID NO: 1927658 - RNA, 23 nt, Shigella flexneri 2a str. 2457T
ugaucaccguaaugaugauccag

SEQ ID NO: 1927659 - RNA, 15 nt, Shigella flexneri 2a str. 2457T
ugauauuuuucccug

SEQ ID NO: 1927660 - RNA, 14 nt, Shigella flexneri 2a str. 2457T
ugauauuuucugcc

SEQ ID NO: 1927661 - RNA, 16 nt, Shigella flexneri 2a str. 2457T
ugaucagcaaucugaa

SEQ ID NO: 1927662 - RNA, 23 nt, Shigella flexneri 2a str. 2457T
ugaucagacacguuaauggcuuu

SEQ ID NO: 1927663 - RNA, 22 nt, Shigella flexneri 2a str. 2457T
ugaucagccccggcaaaugacg

SEQ ID NO: 1927664 - RNA, 23 nt, Shigella flexneri 2a str. 2457T
ugauaucagccugcaaacgcuuu

SEQ ID NO: 1927665 - RNA, 16 nt, Shigella flexneri 2a str. 2457T
ugauaucauuaaaguu

SEQ ID NO: 1927666 - RNA, 19 nt, Shigella flexneri 2a str. 2457T
ugauauugcccgugacucc

SEQ ID NO: 1927667 - RNA, 18 nt, Shigella flexneri 2a str. 2457T
ugaguggaguccagcgcc

SEQ ID NO: 1927668 - RNA, 14 nt, Shigella flexneri 2a str. 2457T
ugcacaucuaacca

SEQ ID NO: 1927669 - RNA, 20 nt, Shigella flexneri 2a str. 2457T
ugcacauccacgccuuuuuu

SEQ ID NO: 1927670 - RNA, 19 nt, Shigella flexneri 2a str. 2457T
ugcacaucuaaccauuauu

SEQ ID NO: 1927671 - RNA, 13 nt, Shigella flexneri 2a str. 2457T
ugcacaugcuuca

SEQ ID NO: 1927672 - RNA, 22 nt, Shigella flexneri 2a str. 2457T
ugcacaugaugauggcuaucaa

SEQ ID NO: 1927673 - RNA, 14 nt, Shigella flexneri 2a str. 2457T
ugcacaugcaacgu

SEQ ID NO: 1927674 - RNA, 16 nt, Shigella flexneri 2a str. 2457T
ugcacauauucuggag

SEQ ID NO: 1927675 - RNA, 15 nt, Shigella flexneri 2a str. 2457T
ugcacacuuuccaua

SEQ ID NO: 1927676 - RNA, 20 nt, Shigella flexneri 2a str. 2457T
ugcacagacuuaauauugcc

SEQ ID NO: 1927677 - RNA, 15 nt, Shigella flexneri 2a str. 2457T
ugcacagcacgcuuu

SEQ ID NO: 1927678 - RNA, 16 nt, Shigella flexneri 2a str. 2457T
ugcacgaaccagagac

SEQ ID NO: 1927679 - RNA, 14 nt, Shigella flexneri 2a str. 2457T
ugcacgaaaccacu

SEQ ID NO: 1927680 - RNA, 16 nt, Shigella flexneri 2a str. 2457T
ugcacgaggcuggcuu

SEQ ID NO: 1927681 - RNA, 17 nt, Shigella flexneri 2a str. 2457T
ugcacgaggcuggcuuu

SEQ ID NO: 1927682 - RNA, 23 nt, Shigella flexneri 2a str. 2457T
ugcacgaccggguuuucaaugau

SEQ ID NO: 1927683 - RNA, 17 nt, Shigella flexneri 2a str. 2457T
ugcaccaacaaauagag

SEQ ID NO: 1927684 - RNA, 17 nt, Shigella flexneri 2a str. 2457T
ugcacuuugucaauaau

SEQ ID NO: 1927685 - RNA, 15 nt, Shigella flexneri 2a str. 2457T
ugcacgaugccugau

SEQ ID NO: 1927686 - RNA, 22 nt, Shigella flexneri 2a str. 2457T
ugcacguccgguggcauccgca

SEQ ID NO: 1927687 - RNA, 22 nt, Shigella flexneri 2a str. 2457T
ugcacguuaucagacaccagcc

SEQ ID NO: 1927688 - RNA, 17 nt, Shigella flexneri 2a str. 2457T
ugcacguuaucagacac

SEQ ID NO: 1927689 - RNA, 22 nt, Shigella flexneri 2a str. 2457T
ugcacaagcgauaacucgcuuu

SEQ ID NO: 1927690 - RNA, 16 nt, Shigella flexneri 2a str. 2457T
ugcacaacaaucugca

SEQ ID NO: 1927691 - RNA, 22 nt, Shigella flexneri 2a str. 2457T
ugcacaccccgcgccgcugaga

SEQ ID NO: 1927692 - RNA, 20 nt, Shigella flexneri 2a str. 2457T
ugcacaccgcggaacgcacu

SEQ ID NO: 1927693 - RNA, 15 nt, Shigella flexneri 2a str. 2457T
ugcaauuuuuuauug

SEQ ID NO: 1927694 - RNA, 16 nt, Shigella flexneri 2a str. 2457T
ugcacaauugccagcc

SEQ ID NO: 1927695 - RNA, 21 nt, Shigella flexneri 2a str. 2457T
ugcaaugacgccgaggaguuu

SEQ ID NO: 1927696 - RNA, 16 nt, Shigella flexneri 2a str. 2457T
ugcaauggaauggcug

SEQ ID NO: 1927697 - RNA, 17 nt, Shigella flexneri 2a str. 2457T
ugcaaacgauaaaagug

SEQ ID NO: 1927698 - RNA, 13 nt, Shigella flexneri 2a str. 2457T
ugcaaacauuuca

SEQ ID NO: 1927699 - RNA, 16 nt, Shigella flexneri 2a str. 2457T
ugcaagccuguaguac

SEQ ID NO: 1927700 - RNA, 13 nt, Shigella flexneri 2a str. 2457T
ugcaauaaauaug

SEQ ID NO: 1927701 - RNA, 21 nt, Shigella flexneri 2a str. 2457T
ugcagacaugacgcccggcaa

SEQ ID NO: 1927702 - RNA, 14 nt, Shigella flexneri 2a str. 2457T
ugcagacaaaguga

SEQ ID NO: 1927703 - RNA, 16 nt, Shigella flexneri 2a str. 2457T
ugcagacggcucauca

SEQ ID NO: 1927704 - RNA, 15 nt, Shigella flexneri 2a str. 2457T
ugcagacugaauacg

SEQ ID NO: 1927705 - RNA, 15 nt, Shigella flexneri 2a str. 2457T
ugcagauaccacauc

SEQ ID NO: 1927706 - RNA, 19 nt, Shigella flexneri 2a str. 2457T
ugcagauuugccaguaccg

SEQ ID NO: 1927707 - RNA, 22 nt, Shigella flexneri 2a str. 2457T
ugcagaucguuuuccugcauua

SEQ ID NO: 1927708 - RNA, 22 nt, Shigella flexneri 2a str. 2457T
ugcagaucgcgauagugcuuaa

SEQ ID NO: 1927709 - RNA, 14 nt, Shigella flexneri 2a str. 2457T
ugcagccaggguca

SEQ ID NO: 1927710 - RNA, 22 nt, Shigella flexneri 2a str. 2457T
ugcagccuucauucaggcauug

SEQ ID NO: 1927711 - RNA, 22 nt, Shigella flexneri 2a str. 2457T
ugcagcacacauuauaggccug

SEQ ID NO: 1927712 - RNA, 17 nt, Shigella flexneri 2a str. 2457T
ugcagcacggagagacg

SEQ ID NO: 1927713 - RNA, 14 nt, Shigella flexneri 2a str. 2457T
ugcagcacugauaa

SEQ ID NO: 1927714 - RNA, 21 nt, Shigella flexneri 2a str. 2457T
ugcagcagcuguuucugcuuu

SEQ ID NO: 1927715 - RNA, 14 nt, Shigella flexneri 2a str. 2457T
ugcagcaugcaccc

SEQ ID NO: 1927716 - RNA, 15 nt, Shigella flexneri 2a str. 2457T
ugcagcaugcacccu

SEQ ID NO: 1927717 - RNA, 19 nt, Shigella flexneri 2a str. 2457T
ugcagcgcaaucgccucca

SEQ ID NO: 1927718 - RNA, 13 nt, Shigella flexneri 2a str. 2457T
ugcagcguuucca

SEQ ID NO: 1927719 - RNA, 17 nt, Shigella flexneri 2a str. 2457T
ugcagcggguuaauuuc

SEQ ID NO: 1927720 - RNA, 21 nt, Shigella flexneri 2a str. 2457T
ugcagcggucacauguuccag

SEQ ID NO: 1927721 - RNA, 21 nt, Shigella flexneri 2a str. 2457T
ugcagcuccaccgauuuugag

SEQ ID NO: 1927722 - RNA, 14 nt, Shigella flexneri 2a str. 2457T
ugcagcguuuccag

SEQ ID NO: 1927723 - RNA, 18 nt, Shigella flexneri 2a str. 2457T
ugcagcguuucgcgcgcg

SEQ ID NO: 1927724 - RNA, 19 nt, Shigella flexneri 2a str. 2457T
ugcagcucuugcagcagcu

SEQ ID NO: 1927725 - RNA, 17 nt, Shigella flexneri 2a str. 2457T
ugcagcugccuggccca

SEQ ID NO: 1927726 - RNA, 16 nt, Shigella flexneri 2a str. 2457T
ugcaggaccauacuga

SEQ ID NO: 1927727 - RNA, 13 nt, Shigella flexneri 2a str. 2457T
ugcagcugcucga

SEQ ID NO: 1927728 - RNA, 16 nt, Shigella flexneri 2a str. 2457T
ugcaggcuauuucugg

SEQ ID NO: 1927729 - RNA, 16 nt, Shigella flexneri 2a str. 2457T
ugcaggcaacagggaa

SEQ ID NO: 1927730 - RNA, 12 nt, Shigella flexneri 2a str. 2457T
ugagcguuaccc

SEQ ID NO: 1927731 - RNA, 19 nt, Shigella flexneri 2a str. 2457T
ugagcgggcgaaccaggcc

SEQ ID NO: 1927732 - RNA, 16 nt, Shigella flexneri 2a str. 2457T
ugagcgguacaccaaa

SEQ ID NO: 1927733 - RNA, 18 nt, Shigella flexneri 2a str. 2457T
ugagcuaaugcaaaucac

SEQ ID NO: 1927734 - RNA, 23 nt, Shigella flexneri 2a str. 2457T
ugagcuaaugcaaaucacgcugc

SEQ ID NO: 1927735 - RNA, 19 nt, Shigella flexneri 2a str. 2457T
ugagcggcgggcuuuaauc

SEQ ID NO: 1927736 - RNA, 21 nt, Shigella flexneri 2a str. 2457T
ugagcggacugaacgcggccc

SEQ ID NO: 1927737 - RNA, 13 nt, Shigella flexneri 2a str. 2457T
ugagcgauaccca

SEQ ID NO: 1927738 - RNA, 15 nt, Shigella flexneri 2a str. 2457T
ugagcugcaucuguu

SEQ ID NO: 1927739 - RNA, 20 nt, Shigella flexneri 2a str. 2457T
ugagcugcgcgacucccuga

SEQ ID NO: 1927740 - RNA, 14 nt, Shigella flexneri 2a str. 2457T
ugaggaugcggguc

SEQ ID NO: 1927741 - RNA, 17 nt, Shigella flexneri 2a str. 2457T
ugaggaugcuaaggcug

SEQ ID NO: 1927742 - RNA, 14 nt, Shigella flexneri 2a str. 2457T
ugaggaucaccagu

SEQ ID NO: 1927743 - RNA, 13 nt, Shigella flexneri 2a str. 2457T
ugaguaauaacuu

SEQ ID NO: 1927744 - RNA, 16 nt, Shigella flexneri 2a str. 2457T
ugaguaauaacuuccu

SEQ ID NO: 1927745 - RNA, 20 nt, Shigella flexneri 2a str. 2457T
ugagguggccgagaggcuga

SEQ ID NO: 1927746 - RNA, 12 nt, Shigella flexneri 2a str. 2457T
ugagguuaugca

SEQ ID NO: 1927747 - RNA, 17 nt, Shigella flexneri 2a str. 2457T
ugagguuagcaaugccu

SEQ ID NO: 1927748 - RNA, 22 nt, Shigella flexneri 2a str. 2457T
ugaggcuuuaauaccugccugg

SEQ ID NO: 1927749 - RNA, 16 nt, Shigella flexneri 2a str. 2457T
ugagggcaaacaccgc

SEQ ID NO: 1927750 - RNA, 18 nt, Shigella flexneri 2a str. 2457T
ugaggggggauguuggcg

SEQ ID NO: 1927751 - RNA, 16 nt, Shigella flexneri 2a str. 2457T
ugagguccagcgagcc

SEQ ID NO: 1927752 - RNA, 23 nt, Shigella flexneri 2a str. 2457T
ugaggcggucuggauuuggcugc

SEQ ID NO: 1927753 - RNA, 15 nt, Shigella flexneri 2a str. 2457T
ugaggcuaccggaca

SEQ ID NO: 1927754 - RNA, 21 nt, Shigella flexneri 2a str. 2457T
ugaggauuacgucuuuacuaa

SEQ ID NO: 1927755 - RNA, 14 nt, Shigella flexneri 2a str. 2457T
ugagauauuuaaau

SEQ ID NO: 1927756 - RNA, 20 nt, Shigella flexneri 2a str. 2457T
ugagaucauuauuaaacaga

SEQ ID NO: 1927757 - RNA, 21 nt, Shigella flexneri 2a str. 2457T
ugagauaccaguugaucaaau

SEQ ID NO: 1927758 - RNA, 16 nt, Shigella flexneri 2a str. 2457T
ugagaugcuggagaac

SEQ ID NO: 1927759 - RNA, 18 nt, Shigella flexneri 2a str. 2457T
ugagaucgugaaacucag

SEQ ID NO: 1927760 - RNA, 16 nt, Shigella flexneri 2a str. 2457T
ugagcagaccaauaac

SEQ ID NO: 1927761 - RNA, 19 nt, Shigella flexneri 2a str. 2457T
ugagcagaagguaaauugu

SEQ ID NO: 1927762 - RNA, 13 nt, Shigella flexneri 2a str. 2457T
ugagcacuuuucu

SEQ ID NO: 1927763 - RNA, 20 nt, Shigella flexneri 2a str. 2457T
ugagcaccuuuuuucugucu

SEQ ID NO: 1927764 - RNA, 20 nt, Shigella flexneri 2a str. 2457T
ugagcaaacaguucugcagc

SEQ ID NO: 1927765 - RNA, 18 nt, Shigella flexneri 2a str. 2457T
ugagcgaauaaaaaaaga

SEQ ID NO: 1927766 - RNA, 21 nt, Shigella flexneri 2a str. 2457T
ugagccggaguugcagauuug

SEQ ID NO: 1927767 - RNA, 21 nt, Shigella flexneri 2a str. 2457T
ugagccgaaauauggcgcugc

SEQ ID NO: 1927768 - RNA, 17 nt, Shigella flexneri 2a str. 2457T
ugacuuugauccagcca

SEQ ID NO: 1927769 - RNA, 13 nt, Shigella flexneri 2a str. 2457T
ugacuguacagau

SEQ ID NO: 1927770 - RNA, 18 nt, Shigella flexneri 2a str. 2457T
ugacuuuuacagcuuagc

SEQ ID NO: 1927771 - RNA, 19 nt, Shigella flexneri 2a str. 2457T
ugacuuuugcccggcauga

SEQ ID NO: 1927772 - RNA, 20 nt, Shigella flexneri 2a str. 2457T
ugagaacggaguugagguuu

SEQ ID NO: 1927773 - RNA, 18 nt, Shigella flexneri 2a str. 2457T
ugagaacgacagugacuu

SEQ ID NO: 1927774 - RNA, 21 nt, Shigella flexneri 2a str. 2457T
ugacuccaacuuacugauagu

SEQ ID NO: 1927775 - RNA, 19 nt, Shigella flexneri 2a str. 2457T
ugacucagaccauauuccc

SEQ ID NO: 1927776 - RNA, 20 nt, Shigella flexneri 2a str. 2457T
ugacucagcggcugccagca

SEQ ID NO: 1927777 - RNA, 21 nt, Shigella flexneri 2a str. 2457T
ugacugguagugcaguacauc

SEQ ID NO: 1927778 - RNA, 16 nt, Shigella flexneri 2a str. 2457T
ugacugguagugcagu

SEQ ID NO: 1927779 - RNA, 16 nt, Shigella flexneri 2a str. 2457T
ugacuggcucuuuuuc

SEQ ID NO: 1927780 - RNA, 20 nt, Shigella flexneri 2a str. 2457T
ugacugcgccacuucccagc

SEQ ID NO: 1927781 - RNA, 15 nt, Shigella flexneri 2a str. 2457T
ugacugccccaguuc

SEQ ID NO: 1927782 - RNA, 18 nt, Shigella flexneri 2a str. 2457T
ugacucuacgcaagucau

SEQ ID NO: 1927783 - RNA, 21 nt, Shigella flexneri 2a str. 2457T
ugacucggagucgacuucaga

SEQ ID NO: 1927784 - RNA, 14 nt, Shigella flexneri 2a str. 2457T
ugaccgucuuucau

SEQ ID NO: 1927785 - RNA, 19 nt, Shigella flexneri 2a str. 2457T
ugacccgcagccagcacug

SEQ ID NO: 1927786 - RNA, 14 nt, Shigella flexneri 2a str. 2457T
ugaccgcuccgcca

SEQ ID NO: 1927787 - RNA, 13 nt, Shigella flexneri 2a str. 2457T
ugacccagcacca

SEQ ID NO: 1927788 - RNA, 15 nt, Shigella flexneri 2a str. 2457T
ugacccaccccagca

SEQ ID NO: 1927789 - RNA, 22 nt, Shigella flexneri 2a str. 2457T
ugacccaccccagcagcagccg

SEQ ID NO: 1927790 - RNA, 17 nt, Shigella flexneri 2a str. 2457T
ugaccauuaucaaacag

SEQ ID NO: 1927791 - RNA, 15 nt, Shigella flexneri 2a str. 2457T
ugaccaucagcagcg

SEQ ID NO: 1927792 - RNA, 20 nt, Shigella flexneri 2a str. 2457T
ugacgaucauauuguucccc

SEQ ID NO: 1927793 - RNA, 11 nt, Shigella flexneri 2a str. 2457T
ugaccugcaaa

SEQ ID NO: 1927794 - RNA, 17 nt, Shigella flexneri 2a str. 2457T
ugacgacuuuuuccauu

SEQ ID NO: 1927795 - RNA, 22 nt, Shigella flexneri 2a str. 2457T
ugaccuagcaaacuaucugugu

SEQ ID NO: 1927796 - RNA, 16 nt, Shigella flexneri 2a str. 2457T
ugaccuacgcuuucga

SEQ ID NO: 1927797 - RNA, 13 nt, Shigella flexneri 2a str. 2457T
ugaccguuuuacu

SEQ ID NO: 1927798 - RNA, 15 nt, Shigella flexneri 2a str. 2457T
ugaccguuacugaua

SEQ ID NO: 1927799 - RNA, 23 nt, Shigella flexneri 2a str. 2457T
ugaccguuagcauauugcaggcu

SEQ ID NO: 1927800 - RNA, 16 nt, Shigella flexneri 2a str. 2457T
ugacagggugagcagg

SEQ ID NO: 1927801 - RNA, 23 nt, Shigella flexneri 2a str. 2457T
ugacagcgcccgacaagauccug

SEQ ID NO: 1927802 - RNA, 17 nt, Shigella flexneri 2a str. 2457T
ugacagauuugauuauc

SEQ ID NO: 1927803 - RNA, 19 nt, Shigella flexneri 2a str. 2457T
ugacagaguuccggcccua

SEQ ID NO: 1927804 - RNA, 13 nt, Shigella flexneri 2a str. 2457T
ugacagcaaauac

SEQ ID NO: 1927805 - RNA, 17 nt, Shigella flexneri 2a str. 2457T
ugacagccaaagggcug

SEQ ID NO: 1927806 - RNA, 23 nt, Shigella flexneri 2a str. 2457T
ugacagaccguugcucagaauca

SEQ ID NO: 1927807 - RNA, 16 nt, Shigella flexneri 2a str. 2457T
ugacacuauucgccag

SEQ ID NO: 1927808 - RNA, 17 nt, Shigella flexneri 2a str. 2457T
ugacacuucagccauca

SEQ ID NO: 1927809 - RNA, 14 nt, Shigella flexneri 2a str. 2457T
ugacacugauugau

SEQ ID NO: 1927810 - RNA, 16 nt, Shigella flexneri 2a str. 2457T
ugacacgaauacggga

SEQ ID NO: 1927811 - RNA, 14 nt, Shigella flexneri 2a str. 2457T
ugaccaccagcacg

SEQ ID NO: 1927812 - RNA, 12 nt, Shigella flexneri 2a str. 2457T
ugaccaccagca

SEQ ID NO: 1927813 - RNA, 14 nt, Shigella flexneri 2a str. 2457T
ugaccauaaaaggc

SEQ ID NO: 1927814 - RNA, 22 nt, Shigella flexneri 2a str. 2457T
ugaccaguugcuccagcaauaa

SEQ ID NO: 1927815 - RNA, 17 nt, Shigella flexneri 2a str. 2457T
ugaccacggccacagcc

SEQ ID NO: 1927816 - RNA, 14 nt, Shigella flexneri 2a str. 2457T
ugaccagaacugau

SEQ ID NO: 1927817 - RNA, 18 nt, Shigella flexneri 2a str. 2457T
ugaccacuuugcgcuccu

SEQ ID NO: 1927818 - RNA, 20 nt, Shigella flexneri 2a str. 2457T
ugacauaguagccagccaga

SEQ ID NO: 1927819 - RNA, 14 nt, Shigella flexneri 2a str. 2457T
ugacauaaugcaaa

SEQ ID NO: 1927820 - RNA, 14 nt, Shigella flexneri 2a str. 2457T
ugacaguugucagc

SEQ ID NO: 1927821 - RNA, 16 nt, Shigella flexneri 2a str. 2457T
ugacagucuggaagcc

SEQ ID NO: 1927822 - RNA, 19 nt, Shigella flexneri 2a str. 2457T
ugacagucuggaagccagu

SEQ ID NO: 1927823 - RNA, 21 nt, Shigella flexneri 2a str. 2457T
ugacagucuggaagccaguca

SEQ ID NO: 1927824 - RNA, 22 nt, Shigella flexneri 2a str. 2457T
ugacagguugcucauaaaauga

SEQ ID NO: 1927825 - RNA, 17 nt, Shigella flexneri 2a str. 2457T
ugacagguuuaaacaga

SEQ ID NO: 1927826 - RNA, 17 nt, Shigella flexneri 2a str. 2457T
ugacaguaucgugacaa

SEQ ID NO: 1927827 - RNA, 19 nt, Shigella flexneri 2a str. 2457T
ugacaaauuccgaacaaaa

SEQ ID NO: 1927828 - RNA, 16 nt, Shigella flexneri 2a str. 2457T
ugacaaacacaaaacu

SEQ ID NO: 1927829 - RNA, 11 nt, Shigella flexneri 2a str. 2457T
ugacaccagca

SEQ ID NO: 1927830 - RNA, 13 nt, Shigella flexneri 2a str. 2457T
ugacacccaaugu

SEQ ID NO: 1927831 - RNA, 14 nt, Shigella flexneri 2a str. 2457T
ugacaccagcacau

SEQ ID NO: 1927832 - RNA, 18 nt, Shigella flexneri 2a str. 2457T
ugacacaucaccuccagc

SEQ ID NO: 1927833 - RNA, 16 nt, Shigella flexneri 2a str. 2457T
ugacacaggcagcaau

SEQ ID NO: 1927834 - RNA, 16 nt, Shigella flexneri 2a str. 2457T
ugacaacucaucacug

SEQ ID NO: 1927835 - RNA, 20 nt, Shigella flexneri 2a str. 2457T
ugacaacguagcguuaaaac

SEQ ID NO: 1927836 - RNA, 15 nt, Shigella flexneri 2a str. 2457T
ugacaagcucaccuc

SEQ ID NO: 1927837 - RNA, 18 nt, Shigella flexneri 2a str. 2457T
ugacaagcguaugauugc

SEQ ID NO: 1927838 - RNA, 18 nt, Shigella flexneri 2a str. 2457T
ugacaacucaucacugua

SEQ ID NO: 1927839 - RNA, 20 nt, Shigella flexneri 2a str. 2457T
ugaauugcacgaaggugcau

SEQ ID NO: 1927840 - RNA, 23 nt, Shigella flexneri 2a str. 2457T
ugaauugaaaaguccaggcugca

SEQ ID NO: 1927841 - RNA, 19 nt, Shigella flexneri 2a str. 2457T
ugaauuuacacaauuuugu

SEQ ID NO: 1927842 - RNA, 15 nt, Shigella flexneri 2a str. 2457T
ugaauuguuuuauaa

SEQ ID NO: 1927843 - RNA, 12 nt, Shigella flexneri 2a str. 2457T
ugaauuucacuu

SEQ ID NO: 1927844 - RNA, 19 nt, Shigella flexneri 2a str. 2457T
ugaauuccgaauuucaucc

SEQ ID NO: 1927845 - RNA, 22 nt, Shigella flexneri 2a str. 2457T
ugaauauaccauggaagaaaaa

SEQ ID NO: 1927846 - RNA, 23 nt, Shigella flexneri 2a str. 2457T
ugaauauaccauggaagaaaaau

SEQ ID NO: 1927847 - RNA, 14 nt, Shigella flexneri 2a str. 2457T
ucuuucaaugcuuu

SEQ ID NO: 1927848 - RNA, 14 nt, Shigella flexneri 2a str. 2457T
ucuuucaauuugua

SEQ ID NO: 1927849 - RNA, 13 nt, Shigella flexneri 2a str. 2457T
ucuuuauaaauuc

SEQ ID NO: 1927850 - RNA, 23 nt, Shigella flexneri 2a str. 2457T
ucuuuauaaauuccuaaaguugu

SEQ ID NO: 1927851 - RNA, 16 nt, Shigella flexneri 2a str. 2457T
ugaauauauaauuaaa

SEQ ID NO: 1927852 - RNA, 17 nt, Shigella flexneri 2a str. 2457T
ugaauaucuccucugcu

SEQ ID NO: 1927853 - RNA, 20 nt, Shigella flexneri 2a str. 2457T
ugaaucgggcgugauuccag

SEQ ID NO: 1927854 - RNA, 23 nt, Shigella flexneri 2a str. 2457T
ugaaucgcuauuaacccgcaaca

SEQ ID NO: 1927855 - RNA, 19 nt, Shigella flexneri 2a str. 2457T
ugaauaugucgcgccaggc

SEQ ID NO: 1927856 - RNA, 13 nt, Shigella flexneri 2a str. 2457T
ugaaucugagcau

SEQ ID NO: 1927857 - RNA, 21 nt, Shigella flexneri 2a str. 2457T
ugccugcagcugcucauuaca

SEQ ID NO: 1927858 - RNA, 18 nt, Shigella flexneri 2a str. 2457T
ugccugauguacaaccau

SEQ ID NO: 1927859 - RNA, 17 nt, Shigella flexneri 2a str. 2457T
ugccugcacuuuguguc

SEQ ID NO: 1927860 - RNA, 16 nt, Shigella flexneri 2a str. 2457T
ugccugauccugggcu

SEQ ID NO: 1927861 - RNA, 22 nt, Shigella flexneri 2a str. 2457T
ugccugaugcgcuacgcuuauc

SEQ ID NO: 1927862 - RNA, 14 nt, Shigella flexneri 2a str. 2457T
ugccugauuuuauu

SEQ ID NO: 1927863 - RNA, 12 nt, Shigella flexneri 2a str. 2457T
ugccugauuacg

SEQ ID NO: 1927864 - RNA, 22 nt, Shigella flexneri 2a str. 2457T
ugccugaugcggcguaaacgcc

SEQ ID NO: 1927865 - RNA, 21 nt, Shigella flexneri 2a str. 2457T
ugccgucugggcaaaaucauc

SEQ ID NO: 1927866 - RNA, 15 nt, Shigella flexneri 2a str. 2457T
ugccuacauauuuuu

SEQ ID NO: 1927867 - RNA, 20 nt, Shigella flexneri 2a str. 2457T
ugccucaacccuuuuuuaaa

SEQ ID NO: 1927868 - RNA, 22 nt, Shigella flexneri 2a str. 2457T
ugccucaacccuuuuuuaaaca

SEQ ID NO: 1927869 - RNA, 16 nt, Shigella flexneri 2a str. 2457T
ugccuguucgccgccg

SEQ ID NO: 1927870 - RNA, 22 nt, Shigella flexneri 2a str. 2457T
ugccugugcaaccuuuuccauu

SEQ ID NO: 1927871 - RNA, 14 nt, Shigella flexneri 2a str. 2457T
ugccugugcaggcg

SEQ ID NO: 1927872 - RNA, 15 nt, Shigella flexneri 2a str. 2457T
ugccugugcaggcgu

SEQ ID NO: 1927873 - RNA, 14 nt, Shigella flexneri 2a str. 2457T
ugccugucgggaca

SEQ ID NO: 1927874 - RNA, 14 nt, Shigella flexneri 2a str. 2457T
ugccuucauacugc

SEQ ID NO: 1927875 - RNA, 23 nt, Shigella flexneri 2a str. 2457T
ugccuucacggcuuugucauuaa

SEQ ID NO: 1927876 - RNA, 12 nt, Shigella flexneri 2a str. 2457T
ugccuuaaucaa

SEQ ID NO: 1927877 - RNA, 19 nt, Shigella flexneri 2a str. 2457T
ugccuuauccggcaugaaa

SEQ ID NO: 1927878 - RNA, 18 nt, Shigella flexneri 2a str. 2457T
ugccuugugggccugaaa

SEQ ID NO: 1927879 - RNA, 22 nt, Shigella flexneri 2a str. 2457T
ugccuuugaaaucgaacagguu

SEQ ID NO: 1927880 - RNA, 22 nt, Shigella flexneri 2a str. 2457T
ugccuugaguuuuucaucccuc

SEQ ID NO: 1927881 - RNA, 15 nt, Shigella flexneri 2a str. 2457T
ugccggaugcaugau

SEQ ID NO: 1927882 - RNA, 15 nt, Shigella flexneri 2a str. 2457T
ugccggaucaggcgu

SEQ ID NO: 1927883 - RNA, 20 nt, Shigella flexneri 2a str. 2457T
ugccggaucacguacacaac

SEQ ID NO: 1927884 - RNA, 21 nt, Shigella flexneri 2a str. 2457T
ugccggaggaguaucugcugu

SEQ ID NO: 1927885 - RNA, 18 nt, Shigella flexneri 2a str. 2457T
ugccggagucgcauuaac

SEQ ID NO: 1927886 - RNA, 16 nt, Shigella flexneri 2a str. 2457T
ugccggauaaauuaaa

SEQ ID NO: 1927887 - RNA, 15 nt, Shigella flexneri 2a str. 2457T
ugccgcacauuuccc

SEQ ID NO: 1927888 - RNA, 12 nt, Shigella flexneri 2a str. 2457T
ugccgccaggcu

SEQ ID NO: 1927889 - RNA, 17 nt, Shigella flexneri 2a str. 2457T
ugccggaugugaugcau

SEQ ID NO: 1927890 - RNA, 21 nt, Shigella flexneri 2a str. 2457T
ugcgagguuauccgccagcgc

SEQ ID NO: 1927891 - RNA, 22 nt, Shigella flexneri 2a str. 2457T
ugcgagguuauccgccagcgcc

SEQ ID NO: 1927892 - RNA, 15 nt, Shigella flexneri 2a str. 2457T
ugcgagcgccuuauc

SEQ ID NO: 1927893 - RNA, 13 nt, Shigella flexneri 2a str. 2457T
ugcgagcaaaauc

SEQ ID NO: 1927894 - RNA, 15 nt, Shigella flexneri 2a str. 2457T
ugcgacucucagccg

SEQ ID NO: 1927895 - RNA, 14 nt, Shigella flexneri 2a str. 2457T
ugcgacaucaucag

SEQ ID NO: 1927896 - RNA, 20 nt, Shigella flexneri 2a str. 2457T
ugcgacagggaucucuucca

SEQ ID NO: 1927897 - RNA, 21 nt, Shigella flexneri 2a str. 2457T
ugcgacagggaucucuuccag

SEQ ID NO: 1927898 - RNA, 21 nt, Shigella flexneri 2a str. 2457T
ugcgaccggcguaacggccac

SEQ ID NO: 1927899 - RNA, 16 nt, Shigella flexneri 2a str. 2457T
ugcgaccguacaacca

SEQ ID NO: 1927900 - RNA, 16 nt, Shigella flexneri 2a str. 2457T
ugcgacgcuugccgcg

SEQ ID NO: 1927901 - RNA, 11 nt, Shigella flexneri 2a str. 2457T
ugcgaaacgau

SEQ ID NO: 1927902 - RNA, 16 nt, Shigella flexneri 2a str. 2457T
ugcgaaagcgagcagu

SEQ ID NO: 1927903 - RNA, 17 nt, Shigella flexneri 2a str. 2457T
ugcgaaagcgucagcuu

SEQ ID NO: 1927904 - RNA, 16 nt, Shigella flexneri 2a str. 2457T
ugccuuuuuuguacuc

SEQ ID NO: 1927905 - RNA, 16 nt, Shigella flexneri 2a str. 2457T
ugcgaacugugcaccc

SEQ ID NO: 1927906 - RNA, 22 nt, Shigella flexneri 2a str. 2457T
ugcgaacugugcacccgcuuca

SEQ ID NO: 1927907 - RNA, 15 nt, Shigella flexneri 2a str. 2457T
ugcgaauacacccug

SEQ ID NO: 1927908 - RNA, 22 nt, Shigella flexneri 2a str. 2457T
ugcgaauaagcugcgugacgaa

SEQ ID NO: 1927909 - RNA, 22 nt, Shigella flexneri 2a str. 2457T
ugcgacagagauauucagcccg

SEQ ID NO: 1927910 - RNA, 16 nt, Shigella flexneri 2a str. 2457T
ugcgacagauucgcgg

SEQ ID NO: 1927911 - RNA, 17 nt, Shigella flexneri 2a str. 2457T
ugcgcaacgcaaucccc

SEQ ID NO: 1927912 - RNA, 20 nt, Shigella flexneri 2a str. 2457T
ugcgcaaccguaaacgauca

SEQ ID NO: 1927913 - RNA, 22 nt, Shigella flexneri 2a str. 2457T
ugcgcaaaauucacgccacugu

SEQ ID NO: 1927914 - RNA, 15 nt, Shigella flexneri 2a str. 2457T
ugcgauguucuucac

SEQ ID NO: 1927915 - RNA, 15 nt, Shigella flexneri 2a str. 2457T
ugcgauauucuucag

SEQ ID NO: 1927916 - RNA, 15 nt, Shigella flexneri 2a str. 2457T
ugcgaucaggcauuc

SEQ ID NO: 1927917 - RNA, 19 nt, Shigella flexneri 2a str. 2457T
ugcgaguuuuaccuucauc

SEQ ID NO: 1927918 - RNA, 17 nt, Shigella flexneri 2a str. 2457T
ugcgaguuuucgcaucc

SEQ ID NO: 1927919 - RNA, 18 nt, Shigella flexneri 2a str. 2457T
ugcgaugcuugacguguc

SEQ ID NO: 1927920 - RNA, 16 nt, Shigella flexneri 2a str. 2457T
ugcgaucgcaaaucca

SEQ ID NO: 1927921 - RNA, 18 nt, Shigella flexneri 2a str. 2457T
ugcgcaguaccagcaacg

SEQ ID NO: 1927922 - RNA, 17 nt, Shigella flexneri 2a str. 2457T
ugcgcaaugcguuuagu

SEQ ID NO: 1927923 - RNA, 16 nt, Shigella flexneri 2a str. 2457T
ugccgacaaaugcagu

SEQ ID NO: 1927924 - RNA, 16 nt, Shigella flexneri 2a str. 2457T
ugccgaagaacauaaa

SEQ ID NO: 1927925 - RNA, 22 nt, Shigella flexneri 2a str. 2457T
ugccgaacguaggcuggauaag

SEQ ID NO: 1927926 - RNA, 17 nt, Shigella flexneri 2a str. 2457T
ugccgaagcagucaaca

SEQ ID NO: 1927927 - RNA, 15 nt, Shigella flexneri 2a str. 2457T
ugccgacaucgccac

SEQ ID NO: 1927928 - RNA, 23 nt, Shigella flexneri 2a str. 2457T
ugccgacaaaugcaguuuuuaau

SEQ ID NO: 1927929 - RNA, 13 nt, Shigella flexneri 2a str. 2457T
ugccgcaauggcc

SEQ ID NO: 1927930 - RNA, 16 nt, Shigella flexneri 2a str. 2457T
ugccgaugauucccag

SEQ ID NO: 1927931 - RNA, 17 nt, Shigella flexneri 2a str. 2457T
ugccgagaguaacacau

SEQ ID NO: 1927932 - RNA, 16 nt, Shigella flexneri 2a str. 2457T
ugccgauggcaaaagu

SEQ ID NO: 1927933 - RNA, 16 nt, Shigella flexneri 2a str. 2457T
ugcccgccgugcugcc

SEQ ID NO: 1927934 - RNA, 22 nt, Shigella flexneri 2a str. 2457T
ugcccggcugcgcgacuucauu

SEQ ID NO: 1927935 - RNA, 15 nt, Shigella flexneri 2a str. 2457T
ugcccggucaggaug

SEQ ID NO: 1927936 - RNA, 14 nt, Shigella flexneri 2a str. 2457T
ugcccggucaggau

SEQ ID NO: 1927937 - RNA, 12 nt, Shigella flexneri 2a str. 2457T
ugccgaaaaaag

SEQ ID NO: 1927938 - RNA, 14 nt, Shigella flexneri 2a str. 2457T
ugccgaaccacuga

SEQ ID NO: 1927939 - RNA, 21 nt, Shigella flexneri 2a str. 2457T
ugccgaaaaaagucauuacca

SEQ ID NO: 1927940 - RNA, 13 nt, Shigella flexneri 2a str. 2457T
ugcccgcaucugc

SEQ ID NO: 1927941 - RNA, 19 nt, Shigella flexneri 2a str. 2457T
ugcccgcaacggcugcuuc

SEQ ID NO: 1927942 - RNA, 16 nt, Shigella flexneri 2a str. 2457T
ugcccauguaguaccc

SEQ ID NO: 1927943 - RNA, 12 nt, Shigella flexneri 2a str. 2457T
ugcccaugcuuc

SEQ ID NO: 1927944 - RNA, 13 nt, Shigella flexneri 2a str. 2457T
ugcccaugcgcuc

SEQ ID NO: 1927945 - RNA, 15 nt, Shigella flexneri 2a str. 2457T
ugccccugaauaauc

SEQ ID NO: 1927946 - RNA, 22 nt, Shigella flexneri 2a str. 2457T
ugcccagcucaaucaacuccau

SEQ ID NO: 1927947 - RNA, 18 nt, Shigella flexneri 2a str. 2457T
ugcccacgggcaggcuuu

SEQ ID NO: 1927948 - RNA, 19 nt, Shigella flexneri 2a str. 2457T
ugcccaggugugucucaag

SEQ ID NO: 1927949 - RNA, 13 nt, Shigella flexneri 2a str. 2457T
ugcccaucucuuc

SEQ ID NO: 1927950 - RNA, 22 nt, Shigella flexneri 2a str. 2457T
ugcccaugauaguguccauuaa

SEQ ID NO: 1927951 - RNA, 14 nt, Shigella flexneri 2a str. 2457T
ugccagucuggcuu

SEQ ID NO: 1927952 - RNA, 18 nt, Shigella flexneri 2a str. 2457T
ugccagcuuucaccugcg

SEQ ID NO: 1927953 - RNA, 16 nt, Shigella flexneri 2a str. 2457T
ugccagcuuuaaauua

SEQ ID NO: 1927954 - RNA, 15 nt, Shigella flexneri 2a str. 2457T
ugccagcuuucaccu

SEQ ID NO: 1927955 - RNA, 18 nt, Shigella flexneri 2a str. 2457T
ugccagcuugcuuuccag

SEQ ID NO: 1927956 - RNA, 17 nt, Shigella flexneri 2a str. 2457T
ugccagcuucccgcugg

SEQ ID NO: 1927957 - RNA, 14 nt, Shigella flexneri 2a str. 2457T
ugccagcgugucga

SEQ ID NO: 1927958 - RNA, 20 nt, Shigella flexneri 2a str. 2457T
ugccagccacaccuggugca

SEQ ID NO: 1927959 - RNA, 20 nt, Shigella flexneri 2a str. 2457T
ugccagcauaccgccgagga

SEQ ID NO: 1927960 - RNA, 21 nt, Shigella flexneri 2a str. 2457T
ugccagccauuuggugaagac

SEQ ID NO: 1927961 - RNA, 15 nt, Shigella flexneri 2a str. 2457T
ugccagccauaaaaa

SEQ ID NO: 1927962 - RNA, 19 nt, Shigella flexneri 2a str. 2457T
ugccagcguaaauccugac

SEQ ID NO: 1927963 - RNA, 20 nt, Shigella flexneri 2a str. 2457T
ugccagcguaaauccugacg

SEQ ID NO: 1927964 - RNA, 13 nt, Shigella flexneri 2a str. 2457T
ugccagcacagau

SEQ ID NO: 1927965 - RNA, 22 nt, Shigella flexneri 2a str. 2457T
ugccagaauagccgcagccauc

SEQ ID NO: 1927966 - RNA, 21 nt, Shigella flexneri 2a str. 2457T
ugcccaacaggcgcuggucag

SEQ ID NO: 1927967 - RNA, 23 nt, Shigella flexneri 2a str. 2457T
ugccauauucgcuuucagcgagu

SEQ ID NO: 1927968 - RNA, 15 nt, Shigella flexneri 2a str. 2457T
ugccagucagcucca

SEQ ID NO: 1927969 - RNA, 19 nt, Shigella flexneri 2a str. 2457T
ugccagugccguuccagcc

SEQ ID NO: 1927970 - RNA, 23 nt, Shigella flexneri 2a str. 2457T
ugccauacgugguugccgaagau

SEQ ID NO: 1927971 - RNA, 23 nt, Shigella flexneri 2a str. 2457T
ugccaacgcaaacgcccguccau

SEQ ID NO: 1927972 - RNA, 17 nt, Shigella flexneri 2a str. 2457T
ugcagucaccugcccuc

SEQ ID NO: 1927973 - RNA, 16 nt, Shigella flexneri 2a str. 2457T
ugcagucauagguucu

SEQ ID NO: 1927974 - RNA, 17 nt, Shigella flexneri 2a str. 2457T
ugcagucauaaccaguc

SEQ ID NO: 1927975 - RNA, 20 nt, Shigella flexneri 2a str. 2457T
ugcagucauaaccaguccau

SEQ ID NO: 1927976 - RNA, 23 nt, Shigella flexneri 2a str. 2457T
ugcaguacaucguagugaugcca

SEQ ID NO: 1927977 - RNA, 14 nt, Shigella flexneri 2a str. 2457T
ugcagguucgacug

SEQ ID NO: 1927978 - RNA, 14 nt, Shigella flexneri 2a str. 2457T
ugcaggucguccug

SEQ ID NO: 1927979 - RNA, 20 nt, Shigella flexneri 2a str. 2457T
ugccacauugcguccaggcc

SEQ ID NO: 1927980 - RNA, 11 nt, Shigella flexneri 2a str. 2457T
ugccacaucac

SEQ ID NO: 1927981 - RNA, 13 nt, Shigella flexneri 2a str. 2457T
ugccacaucacug

SEQ ID NO: 1927982 - RNA, 14 nt, Shigella flexneri 2a str. 2457T
ugccaccacaccgg

SEQ ID NO: 1927983 - RNA, 14 nt, Shigella flexneri 2a str. 2457T
ugccaccagcagcg

SEQ ID NO: 1927984 - RNA, 14 nt, Shigella flexneri 2a str. 2457T
ugccaccacugcaa

SEQ ID NO: 1927985 - RNA, 19 nt, Shigella flexneri 2a str. 2457T
ugccaccagugcaggcacc

SEQ ID NO: 1927986 - RNA, 15 nt, Shigella flexneri 2a str. 2457T
ugccaccaugcaaaa

SEQ ID NO: 1927987 - RNA, 18 nt, Shigella flexneri 2a str. 2457T
ugccacuuugcaguuccu

SEQ ID NO: 1927988 - RNA, 22 nt, Shigella flexneri 2a str. 2457T
ugccagaaagcguauccaucac

SEQ ID NO: 1927989 - RNA, 20 nt, Shigella flexneri 2a str. 2457T
ugccagaauagccgcagcca

SEQ ID NO: 1927990 - RNA, 13 nt, Shigella flexneri 2a str. 2457T
ugccagaacugau

SEQ ID NO: 1927991 - RNA, 22 nt, Shigella flexneri 2a str. 2457T
ugcguaucgacggcguauugca

SEQ ID NO: 1927992 - RNA, 14 nt, Shigella flexneri 2a str. 2457T
ugcgucgcacucuc

SEQ ID NO: 1927993 - RNA, 20 nt, Shigella flexneri 2a str. 2457T
ugcgucgacauagccauccc

SEQ ID NO: 1927994 - RNA, 15 nt, Shigella flexneri 2a str. 2457T
ugcgucauuccggag

SEQ ID NO: 1927995 - RNA, 18 nt, Shigella flexneri 2a str. 2457T
ugcguccgguaauuuuua

SEQ ID NO: 1927996 - RNA, 22 nt, Shigella flexneri 2a str. 2457T
ugcguuccccgaagacgugcgc

SEQ ID NO: 1927997 - RNA, 23 nt, Shigella flexneri 2a str. 2457T
ugcguucgcgaccggcgauggca

SEQ ID NO: 1927998 - RNA, 13 nt, Shigella flexneri 2a str. 2457T
ugcguucagcagu

SEQ ID NO: 1927999 - RNA, 14 nt, Shigella flexneri 2a str. 2457T
ugcguucaucaguu

SEQ ID NO: 1928000 - RNA, 21 nt, Shigella flexneri 2a str. 2457T
ugcguuccagcauguuauuca

SEQ ID NO: 1928001 - RNA, 20 nt, Shigella flexneri 2a str. 2457T
ugcguucagcaguucugcca

SEQ ID NO: 1928002 - RNA, 19 nt, Shigella flexneri 2a str. 2457T
ugcguggcaucaaacacug

SEQ ID NO: 1928003 - RNA, 20 nt, Shigella flexneri 2a str. 2457T
ugcguuaagacuuuuuucau

SEQ ID NO: 1928004 - RNA, 17 nt, Shigella flexneri 2a str. 2457T
ugcggguuuucgcugcc

SEQ ID NO: 1928005 - RNA, 22 nt, Shigella flexneri 2a str. 2457T
ugcgguaagguugucgauacca

SEQ ID NO: 1928006 - RNA, 17 nt, Shigella flexneri 2a str. 2457T
ugcggucaaaagcugca

SEQ ID NO: 1928007 - RNA, 18 nt, Shigella flexneri 2a str. 2457T
ugcguacaccaacaucac

SEQ ID NO: 1928008 - RNA, 15 nt, Shigella flexneri 2a str. 2457T
ugcguacaccaacau

SEQ ID NO: 1928009 - RNA, 14 nt, Shigella flexneri 2a str. 2457T
ugcguaauguuuag

SEQ ID NO: 1928010 - RNA, 17 nt, Shigella flexneri 2a str. 2457T
ugcguacuggcauuuau

SEQ ID NO: 1928011 - RNA, 18 nt, Shigella flexneri 2a str. 2457T
ugcguagccgauccgcgu

SEQ ID NO: 1928012 - RNA, 16 nt, Shigella flexneri 2a str. 2457T
ugcggguuagucugca

SEQ ID NO: 1928013 - RNA, 18 nt, Shigella flexneri 2a str. 2457T
ugcggguuagucugcauu

SEQ ID NO: 1928014 - RNA, 15 nt, Shigella flexneri 2a str. 2457T
ugcgggaguggcgaa

SEQ ID NO: 1928015 - RNA, 23 nt, Shigella flexneri 2a str. 2457T
ugcgggagcgcuuuuuuccugcc

SEQ ID NO: 1928016 - RNA, 22 nt, Shigella flexneri 2a str. 2457T
ugcgcugcuuguuccacuucau

SEQ ID NO: 1928017 - RNA, 22 nt, Shigella flexneri 2a str. 2457T
ugcgcucuucaacuucagcagc

SEQ ID NO: 1928018 - RNA, 16 nt, Shigella flexneri 2a str. 2457T
ugcgcugacucuacug

SEQ ID NO: 1928019 - RNA, 13 nt, Shigella flexneri 2a str. 2457T
ugcgcuggcaguu

SEQ ID NO: 1928020 - RNA, 13 nt, Shigella flexneri 2a str. 2457T
ugcgcuucaccag

SEQ ID NO: 1928021 - RNA, 17 nt, Shigella flexneri 2a str. 2457T
ugcgcauucuacuuugc

SEQ ID NO: 1928022 - RNA, 23 nt, Shigella flexneri 2a str. 2457T
ugcgccaaaugucagcugccagu

SEQ ID NO: 1928023 - RNA, 17 nt, Shigella flexneri 2a str. 2457T
ugcgcaucaugccaccc

SEQ ID NO: 1928024 - RNA, 18 nt, Shigella flexneri 2a str. 2457T
ugcgcaucaucgauacca

SEQ ID NO: 1928025 - RNA, 18 nt, Shigella flexneri 2a str. 2457T
ugcgccacaaccguccuc

SEQ ID NO: 1928026 - RNA, 17 nt, Shigella flexneri 2a str. 2457T
ugcggcggcggaaaaag

SEQ ID NO: 1928027 - RNA, 20 nt, Shigella flexneri 2a str. 2457T
ugcggcugguuacucaccag

SEQ ID NO: 1928028 - RNA, 20 nt, Shigella flexneri 2a str. 2457T
ugcggcuuauucauuacuca

SEQ ID NO: 1928029 - RNA, 19 nt, Shigella flexneri 2a str. 2457T
ugcggcuuauucauuacuu

SEQ ID NO: 1928030 - RNA, 19 nt, Shigella flexneri 2a str. 2457T
ugcgcuuccugcagcuuca

SEQ ID NO: 1928031 - RNA, 13 nt, Shigella flexneri 2a str. 2457T
ugcgcuuccagcu

SEQ ID NO: 1928032 - RNA, 13 nt, Shigella flexneri 2a str. 2457T
ugcgcuuccugca

SEQ ID NO: 1928033 - RNA, 24 nt, Shigella flexneri 2a str. 2457T
ugcgcuuccugcaacgagugcauc

SEQ ID NO: 1928034 - RNA, 12 nt, Shigella flexneri 2a str. 2457T
ugcggcaaauac

SEQ ID NO: 1928035 - RNA, 13 nt, Shigella flexneri 2a str. 2457T
ugcggcagcucca

SEQ ID NO: 1928036 - RNA, 21 nt, Shigella flexneri 2a str. 2457T
ugcuauuuuagaaaaacuuaa

SEQ ID NO: 1928037 - RNA, 22 nt, Shigella flexneri 2a str. 2457T
ugcuaugcuuaagaaauuauuc

SEQ ID NO: 1928038 - RNA, 15 nt, Shigella flexneri 2a str. 2457T
ugcuauggggaaaaa

SEQ ID NO: 1928039 - RNA, 16 nt, Shigella flexneri 2a str. 2457T
ugcuauggggaaaaau

SEQ ID NO: 1928040 - RNA, 22 nt, Shigella flexneri 2a str. 2457T
ugcuaugguccguucucaccag

SEQ ID NO: 1928041 - RNA, 13 nt, Shigella flexneri 2a str. 2457T
ugcuauuccuuga

SEQ ID NO: 1928042 - RNA, 19 nt, Shigella flexneri 2a str. 2457T
ugcuaguuaucuccuugcu

SEQ ID NO: 1928043 - RNA, 23 nt, Shigella flexneri 2a str. 2457T
ugcuaguuaucuccuugcuggug

SEQ ID NO: 1928044 - RNA, 21 nt, Shigella flexneri 2a str. 2457T
ugcuaucuccuguugugaugc

SEQ ID NO: 1928045 - RNA, 22 nt, Shigella flexneri 2a str. 2457T
ugcuaacucaucaccaucaggc

SEQ ID NO: 1928046 - RNA, 20 nt, Shigella flexneri 2a str. 2457T
ugcuaaaccagcccugguuu

SEQ ID NO: 1928047 - RNA, 13 nt, Shigella flexneri 2a str. 2457T
ugcuaacucauca

SEQ ID NO: 1928048 - RNA, 16 nt, Shigella flexneri 2a str. 2457T
ugcguuuuuaucuuca

SEQ ID NO: 1928049 - RNA, 18 nt, Shigella flexneri 2a str. 2457T
ugcguuuuuaucuucaca

SEQ ID NO: 1928050 - RNA, 16 nt, Shigella flexneri 2a str. 2457T
ugcucuguuuucucac

SEQ ID NO: 1928051 - RNA, 13 nt, Shigella flexneri 2a str. 2457T
ugcucuggugcgg

SEQ ID NO: 1928052 - RNA, 16 nt, Shigella flexneri 2a str. 2457T
ugcucuuuauaauuau

SEQ ID NO: 1928053 - RNA, 20 nt, Shigella flexneri 2a str. 2457T
ugcucugaggcugaugacaa

SEQ ID NO: 1928054 - RNA, 22 nt, Shigella flexneri 2a str. 2457T
ugcucugaggcugaugacaaac

SEQ ID NO: 1928055 - RNA, 15 nt, Shigella flexneri 2a str. 2457T
ugcucuaacccuucc

SEQ ID NO: 1928056 - RNA, 22 nt, Shigella flexneri 2a str. 2457T
ugcucuaacccuuccagauuca

SEQ ID NO: 1928057 - RNA, 19 nt, Shigella flexneri 2a str. 2457T
ugcucagagcuacaaagau

SEQ ID NO: 1928058 - RNA, 18 nt, Shigella flexneri 2a str. 2457T
ugcucagaaucacgccaa

SEQ ID NO: 1928059 - RNA, 21 nt, Shigella flexneri 2a str. 2457T
ugcucagaaucacgccaacaa

SEQ ID NO: 1928060 - RNA, 18 nt, Shigella flexneri 2a str. 2457T
ugcuccagcguaccugcc

SEQ ID NO: 1928061 - RNA, 20 nt, Shigella flexneri 2a str. 2457T
ugcuccagucguucaaccac

SEQ ID NO: 1928062 - RNA, 20 nt, Shigella flexneri 2a str. 2457T
ugcucaggaguaaacuuucc

SEQ ID NO: 1928063 - RNA, 13 nt, Shigella flexneri 2a str. 2457T
ugcuccagcagau

SEQ ID NO: 1928064 - RNA, 13 nt, Shigella flexneri 2a str. 2457T
ugcuccacugcuc

SEQ ID NO: 1928065 - RNA, 22 nt, Shigella flexneri 2a str. 2457T
ugcuccauuagcccgagaucuu

SEQ ID NO: 1928066 - RNA, 14 nt, Shigella flexneri 2a str. 2457T
ugcucccagcgcau

SEQ ID NO: 1928067 - RNA, 12 nt, Shigella flexneri 2a str. 2457T
uggacaccagcu

SEQ ID NO: 1928068 - RNA, 21 nt, Shigella flexneri 2a str. 2457T
uggacgccguauucacuuuca

SEQ ID NO: 1928069 - RNA, 14 nt, Shigella flexneri 2a str. 2457T
uggacgcagcucau

SEQ ID NO: 1928070 - RNA, 19 nt, Shigella flexneri 2a str. 2457T
uggacgcaacuuccccucu

SEQ ID NO: 1928071 - RNA, 16 nt, Shigella flexneri 2a str. 2457T
uggacgauaagcaccg

SEQ ID NO: 1928072 - RNA, 12 nt, Shigella flexneri 2a str. 2457T
uggaauggucaa

SEQ ID NO: 1928073 - RNA, 15 nt, Shigella flexneri 2a str. 2457T
uggaauuuguccacc

SEQ ID NO: 1928074 - RNA, 17 nt, Shigella flexneri 2a str. 2457T
uggaauuccuuucccua

SEQ ID NO: 1928075 - RNA, 13 nt, Shigella flexneri 2a str. 2457T
uggaauaagccaa

SEQ ID NO: 1928076 - RNA, 16 nt, Shigella flexneri 2a str. 2457T
uggaaucgcucucaga

SEQ ID NO: 1928077 - RNA, 19 nt, Shigella flexneri 2a str. 2457T
uggaaggguugaaauauau

SEQ ID NO: 1928078 - RNA, 20 nt, Shigella flexneri 2a str. 2457T
uggaagcauaauaagcuuuu

SEQ ID NO: 1928079 - RNA, 16 nt, Shigella flexneri 2a str. 2457T
uggaagccagucacau

SEQ ID NO: 1928080 - RNA, 18 nt, Shigella flexneri 2a str. 2457T
uggaagaaaccagcgugu

SEQ ID NO: 1928081 - RNA, 15 nt, Shigella flexneri 2a str. 2457T
uggaagaaacgcuua

SEQ ID NO: 1928082 - RNA, 23 nt, Shigella flexneri 2a str. 2457T
uggaagaccugacuguuccagca

SEQ ID NO: 1928083 - RNA, 18 nt, Shigella flexneri 2a str. 2457T
uggaacggcagauccaaa

SEQ ID NO: 1928084 - RNA, 13 nt, Shigella flexneri 2a str. 2457T
uggaacccgcagc

SEQ ID NO: 1928085 - RNA, 14 nt, Shigella flexneri 2a str. 2457T
ugcuuuuuuccaua

SEQ ID NO: 1928086 - RNA, 21 nt, Shigella flexneri 2a str. 2457T
uggaaauguccgcgaacagca

SEQ ID NO: 1928087 - RNA, 19 nt, Shigella flexneri 2a str. 2457T
uggaaauuguuuuugauuu

SEQ ID NO: 1928088 - RNA, 20 nt, Shigella flexneri 2a str. 2457T
ugcuuucagcacuuaucucu

SEQ ID NO: 1928089 - RNA, 19 nt, Shigella flexneri 2a str. 2457T
ugcuuuccaacuguaccag

SEQ ID NO: 1928090 - RNA, 17 nt, Shigella flexneri 2a str. 2457T
ugcuuuuguuaauugcu

SEQ ID NO: 1928091 - RNA, 18 nt, Shigella flexneri 2a str. 2457T
ugcuuguggcggaaagac

SEQ ID NO: 1928092 - RNA, 12 nt, Shigella flexneri 2a str. 2457T
ugcuuuaaaaaa

SEQ ID NO: 1928093 - RNA, 15 nt, Shigella flexneri 2a str. 2457T
ugcuuuaaaaaagaa

SEQ ID NO: 1928094 - RNA, 17 nt, Shigella flexneri 2a str. 2457T
ugcuuucagcacuuauc

SEQ ID NO: 1928095 - RNA, 15 nt, Shigella flexneri 2a str. 2457T
ugcuuccggcaagca

SEQ ID NO: 1928096 - RNA, 22 nt, Shigella flexneri 2a str. 2457T
ugcuucggucagaauuucgacu

SEQ ID NO: 1928097 - RNA, 19 nt, Shigella flexneri 2a str. 2457T
ugcuucguuaacgugucau

SEQ ID NO: 1928098 - RNA, 16 nt, Shigella flexneri 2a str. 2457T
ugcuucggucagcacg

SEQ ID NO: 1928099 - RNA, 22 nt, Shigella flexneri 2a str. 2457T
ugcuucguccaguuucacuuuc

SEQ ID NO: 1928100 - RNA, 19 nt, Shigella flexneri 2a str. 2457T
ugcugcggcggcggaaaaa

SEQ ID NO: 1928101 - RNA, 22 nt, Shigella flexneri 2a str. 2457T
ugcuggaccuuaucgaagaggg

SEQ ID NO: 1928102 - RNA, 16 nt, Shigella flexneri 2a str. 2457T
ugcuggacgcauugca

SEQ ID NO: 1928103 - RNA, 20 nt, Shigella flexneri 2a str. 2457T
ugcuggacgcauugcauuuc

SEQ ID NO: 1928104 - RNA, 22 nt, Shigella flexneri 2a str. 2457T
ugcugcguuugcccuaaagcgc

SEQ ID NO: 1928105 - RNA, 16 nt, Shigella flexneri 2a str. 2457T
ugcuggcagauaaauu

SEQ ID NO: 1928106 - RNA, 12 nt, Shigella flexneri 2a str. 2457T
ugcuggcauuac

SEQ ID NO: 1928107 - RNA, 21 nt, Shigella flexneri 2a str. 2457T
ugcuggaucugcggguuaguc

SEQ ID NO: 1928108 - RNA, 15 nt, Shigella flexneri 2a str. 2457T
ugcugacaaugugcu

SEQ ID NO: 1928109 - RNA, 21 nt, Shigella flexneri 2a str. 2457T
ugcugguucugcggguuaguc

SEQ ID NO: 1928110 - RNA, 17 nt, Shigella flexneri 2a str. 2457T
ugcugugccggaagggg

SEQ ID NO: 1928111 - RNA, 17 nt, Shigella flexneri 2a str. 2457T
ugcuguggauucagcac

SEQ ID NO: 1928112 - RNA, 18 nt, Shigella flexneri 2a str. 2457T
ugcuguggauucagcacc

SEQ ID NO: 1928113 - RNA, 20 nt, Shigella flexneri 2a str. 2457T
ugcugucuuuuuacucccgc

SEQ ID NO: 1928114 - RNA, 16 nt, Shigella flexneri 2a str. 2457T
ugcugguagaagcugg

SEQ ID NO: 1928115 - RNA, 15 nt, Shigella flexneri 2a str. 2457T
uuaguagaagaggaa

SEQ ID NO: 1928116 - RNA, 16 nt, Shigella flexneri 2a str. 2457T
uuaguagaagaggaac

SEQ ID NO: 1928117 - RNA, 19 nt, Shigella flexneri 2a str. 2457T
uuaguauuguuaaauauua

SEQ ID NO: 1928118 - RNA, 15 nt, Shigella flexneri 2a str. 2457T
uuaguaacaacggau

SEQ ID NO: 1928119 - RNA, 12 nt, Shigella flexneri 2a str. 2457T
uuagguggaaga

SEQ ID NO: 1928120 - RNA, 20 nt, Shigella flexneri 2a str. 2457T
uuagggugaggggaacagac

SEQ ID NO: 1928121 - RNA, 18 nt, Shigella flexneri 2a str. 2457T
uuaguggcaaccacaacc

SEQ ID NO: 1928122 - RNA, 12 nt, Shigella flexneri 2a str. 2457T
uuagucugcauu

SEQ ID NO: 1928123 - RNA, 16 nt, Shigella flexneri 2a str. 2457T
uuagucugcauuuucu

SEQ ID NO: 1928124 - RNA, 21 nt, Shigella flexneri 2a str. 2457T
uuaguauuguuaaauauuaag

SEQ ID NO: 1928125 - RNA, 14 nt, Shigella flexneri 2a str. 2457T
uuaguuuaaacauu

SEQ ID NO: 1928126 - RNA, 22 nt, Shigella flexneri 2a str. 2457T
uuauauggugagcgauauuuau

SEQ ID NO: 1928127 - RNA, 11 nt, Shigella flexneri 2a str. 2457T
uuauauuuccc

SEQ ID NO: 1928128 - RNA, 20 nt, Shigella flexneri 2a str. 2457T
uuaucacgaugcuaaaaaca

SEQ ID NO: 1928129 - RNA, 18 nt, Shigella flexneri 2a str. 2457T
uuauauggaaaaauauuc

SEQ ID NO: 1928130 - RNA, 20 nt, Shigella flexneri 2a str. 2457T
uuauaugaugaaacugauaa

SEQ ID NO: 1928131 - RNA, 15 nt, Shigella flexneri 2a str. 2457T
uuauacucagucagg

SEQ ID NO: 1928132 - RNA, 20 nt, Shigella flexneri 2a str. 2457T
uuacuuccgguuacgccacc

SEQ ID NO: 1928133 - RNA, 15 nt, Shigella flexneri 2a str. 2457T
uuacuucuauaauga

SEQ ID NO: 1928134 - RNA, 16 nt, Shigella flexneri 2a str. 2457T
uuacuucucgauaaac

SEQ ID NO: 1928135 - RNA, 23 nt, Shigella flexneri 2a str. 2457T
uuagaaacaaaaaaaccgccuca

SEQ ID NO: 1928136 - RNA, 21 nt, Shigella flexneri 2a str. 2457T
uuagaaauucacagguaacau

SEQ ID NO: 1928137 - RNA, 10 nt, Shigella flexneri 2a str. 2457T
uuacuuaaug

SEQ ID NO: 1928138 - RNA, 21 nt, Shigella flexneri 2a str. 2457T
uuagaugauggcauucucacu

SEQ ID NO: 1928139 - RNA, 16 nt, Shigella flexneri 2a str. 2457T
uuagaugauggcauuc

SEQ ID NO: 1928140 - RNA, 18 nt, Shigella flexneri 2a str. 2457T
uuagaugauggcauucuc

SEQ ID NO: 1928141 - RNA, 22 nt, Shigella flexneri 2a str. 2457T
uuagauucguuuuccagugcca

SEQ ID NO: 1928142 - RNA, 19 nt, Shigella flexneri 2a str. 2457T
uuagacggcgcaacauccg

SEQ ID NO: 1928143 - RNA, 18 nt, Shigella flexneri 2a str. 2457T
uuagcaaaauagcuguuu

SEQ ID NO: 1928144 - RNA, 18 nt, Shigella flexneri 2a str. 2457T
uuagcaaugccuucugga

SEQ ID NO: 1928145 - RNA, 16 nt, Shigella flexneri 2a str. 2457T
uuagcaauauuuuuau

SEQ ID NO: 1928146 - RNA, 19 nt, Shigella flexneri 2a str. 2457T
uuagcaaccaaaaaaagaa

SEQ ID NO: 1928147 - RNA, 12 nt, Shigella flexneri 2a str. 2457T
uuagcaucccca

SEQ ID NO: 1928148 - RNA, 14 nt, Shigella flexneri 2a str. 2457T
uuagcaucagucuc

SEQ ID NO: 1928149 - RNA, 14 nt, Shigella flexneri 2a str. 2457T
uuagcccuuuguag

SEQ ID NO: 1928150 - RNA, 15 nt, Shigella flexneri 2a str. 2457T
uuagccggauaaaca

SEQ ID NO: 1928151 - RNA, 19 nt, Shigella flexneri 2a str. 2457T
uuagccgcagguaaacuca

SEQ ID NO: 1928152 - RNA, 19 nt, Shigella flexneri 2a str. 2457T
uuagccuguaaugucaucu

SEQ ID NO: 1928153 - RNA, 23 nt, Shigella flexneri 2a str. 2457T
uuagcguugcgccuguucccuuc

SEQ ID NO: 1928154 - RNA, 21 nt, Shigella flexneri 2a str. 2457T
uuagcgggucaggucgucaaa

SEQ ID NO: 1928155 - RNA, 15 nt, Shigella flexneri 2a str. 2457T
uuagcgccagccaga

SEQ ID NO: 1928156 - RNA, 17 nt, Shigella flexneri 2a str. 2457T
uuagcgacgaacagcga

SEQ ID NO: 1928157 - RNA, 16 nt, Shigella flexneri 2a str. 2457T
uuaggaauaaugucuu

SEQ ID NO: 1928158 - RNA, 15 nt, Shigella flexneri 2a str. 2457T
uuaggcacaucaaca

SEQ ID NO: 1928159 - RNA, 17 nt, Shigella flexneri 2a str. 2457T
uuaacugcuuaucauca

SEQ ID NO: 1928160 - RNA, 22 nt, Shigella flexneri 2a str. 2457T
uuaacugacuuucguuugaaaa

SEQ ID NO: 1928161 - RNA, 17 nt, Shigella flexneri 2a str. 2457T
uuaacuguucugaaaac

SEQ ID NO: 1928162 - RNA, 15 nt, Shigella flexneri 2a str. 2457T
uuaaauaaagccuau

SEQ ID NO: 1928163 - RNA, 18 nt, Shigella flexneri 2a str. 2457T
uuaaauccugucuggcga

SEQ ID NO: 1928164 - RNA, 14 nt, Shigella flexneri 2a str. 2457T
uuaauaauaaguau

SEQ ID NO: 1928165 - RNA, 13 nt, Shigella flexneri 2a str. 2457T
uuaaucaccagcg

SEQ ID NO: 1928166 - RNA, 20 nt, Shigella flexneri 2a str. 2457T
uuaaucagcgaguuaccuua

SEQ ID NO: 1928167 - RNA, 14 nt, Shigella flexneri 2a str. 2457T
uuaaucaacucacg

SEQ ID NO: 1928168 - RNA, 23 nt, Shigella flexneri 2a str. 2457T
uuaaucaagaaaccgaaguugua

SEQ ID NO: 1928169 - RNA, 16 nt, Shigella flexneri 2a str. 2457T
uuaaucagugcaauca

SEQ ID NO: 1928170 - RNA, 13 nt, Shigella flexneri 2a str. 2457T
uuaaucaucaaug

SEQ ID NO: 1928171 - RNA, 19 nt, Shigella flexneri 2a str. 2457T
uuaauaugcucaacaauaa

SEQ ID NO: 1928172 - RNA, 16 nt, Shigella flexneri 2a str. 2457T
uuaauauuaacuuaau

SEQ ID NO: 1928173 - RNA, 19 nt, Shigella flexneri 2a str. 2457T
uuacaaaaagugcuuucug

SEQ ID NO: 1928174 - RNA, 17 nt, Shigella flexneri 2a str. 2457T
uuacaaaaccugcuuaa

SEQ ID NO: 1928175 - RNA, 18 nt, Shigella flexneri 2a str. 2457T
uuacaaaaccugcuuaac

SEQ ID NO: 1928176 - RNA, 20 nt, Shigella flexneri 2a str. 2457T
uuaauugcccgaagccaauu

SEQ ID NO: 1928177 - RNA, 17 nt, Shigella flexneri 2a str. 2457T
uuaauugccguuaaaac

SEQ ID NO: 1928178 - RNA, 19 nt, Shigella flexneri 2a str. 2457T
uuaauugccguuaaaacua

SEQ ID NO: 1928179 - RNA, 17 nt, Shigella flexneri 2a str. 2457T
uuaaugugucugaaagc

SEQ ID NO: 1928180 - RNA, 22 nt, Shigella flexneri 2a str. 2457T
uuaauguuguaagcuugacaua

SEQ ID NO: 1928181 - RNA, 18 nt, Shigella flexneri 2a str. 2457T
uuaauuacugagaacgca

SEQ ID NO: 1928182 - RNA, 20 nt, Shigella flexneri 2a str. 2457T
uuaauuacaccaaucauuca

SEQ ID NO: 1928183 - RNA, 23 nt, Shigella flexneri 2a str. 2457T
uuaauucugagagcaugaaauga

SEQ ID NO: 1928184 - RNA, 21 nt, Shigella flexneri 2a str. 2457T
uuaauccugaguuaagcaaaa

SEQ ID NO: 1928185 - RNA, 21 nt, Shigella flexneri 2a str. 2457T
uuacaguagcuauaaaccugc

SEQ ID NO: 1928186 - RNA, 21 nt, Shigella flexneri 2a str. 2457T
uuacaguaugagcaaacaaua

SEQ ID NO: 1928187 - RNA, 23 nt, Shigella flexneri 2a str. 2457T
uuacaggguaaaaccaugccauc

SEQ ID NO: 1928188 - RNA, 22 nt, Shigella flexneri 2a str. 2457T
uuacacagcgacguaaaaaaca

SEQ ID NO: 1928189 - RNA, 19 nt, Shigella flexneri 2a str. 2457T
uuacaccaauaccgcccac

SEQ ID NO: 1928190 - RNA, 13 nt, Shigella flexneri 2a str. 2457T
uuacacaauuuug

SEQ ID NO: 1928191 - RNA, 21 nt, Shigella flexneri 2a str. 2457T
uuacaaucaccguuucuggug

SEQ ID NO: 1928192 - RNA, 22 nt, Shigella flexneri 2a str. 2457T
uuacaauuuacguuuuaaaccu

SEQ ID NO: 1928193 - RNA, 16 nt, Shigella flexneri 2a str. 2457T
uuaccugagugcaggc

SEQ ID NO: 1928194 - RNA, 21 nt, Shigella flexneri 2a str. 2457T
uuaccuguggcguauucggca

SEQ ID NO: 1928195 - RNA, 12 nt, Shigella flexneri 2a str. 2457T
uuaccucaccgg

SEQ ID NO: 1928196 - RNA, 23 nt, Shigella flexneri 2a str. 2457T
uuaccugaaugcucugaggcuga

SEQ ID NO: 1928197 - RNA, 17 nt, Shigella flexneri 2a str. 2457T
uuaccggugccagcaac

SEQ ID NO: 1928198 - RNA, 19 nt, Shigella flexneri 2a str. 2457T
uuaccggugccagcaacug

SEQ ID NO: 1928199 - RNA, 20 nt, Shigella flexneri 2a str. 2457T
uuaccgacgcugcucaaagc

SEQ ID NO: 1928200 - RNA, 16 nt, Shigella flexneri 2a str. 2457T
uuaccgcaaagcccac

SEQ ID NO: 1928201 - RNA, 13 nt, Shigella flexneri 2a str. 2457T
uuaccgcaccacc

SEQ ID NO: 1928202 - RNA, 17 nt, Shigella flexneri 2a str. 2457T
uuaccgcaccaccagca

SEQ ID NO: 1928203 - RNA, 21 nt, Shigella flexneri 2a str. 2457T
uuaccgauccccggauucaug

SEQ ID NO: 1928204 - RNA, 14 nt, Shigella flexneri 2a str. 2457T
uuaccagcccuaau

SEQ ID NO: 1928205 - RNA, 15 nt, Shigella flexneri 2a str. 2457T
uuaccagcccuaaua

SEQ ID NO: 1928206 - RNA, 18 nt, Shigella flexneri 2a str. 2457T
uuacccugugacagacua

SEQ ID NO: 1928207 - RNA, 13 nt, Shigella flexneri 2a str. 2457T
ugugucacuuuga

SEQ ID NO: 1928208 - RNA, 13 nt, Shigella flexneri 2a str. 2457T
ugugucagcgcca

SEQ ID NO: 1928209 - RNA, 14 nt, Shigella flexneri 2a str. 2457T
ugugucuuauuggc

SEQ ID NO: 1928210 - RNA, 15 nt, Shigella flexneri 2a str. 2457T
ugugugccagguucg

SEQ ID NO: 1928211 - RNA, 17 nt, Shigella flexneri 2a str. 2457T
uguuaacagcaacauag

SEQ ID NO: 1928212 - RNA, 17 nt, Shigella flexneri 2a str. 2457T
ugugggauuccagcgcc

SEQ ID NO: 1928213 - RNA, 15 nt, Shigella flexneri 2a str. 2457T
ugugggauugcuuca

SEQ ID NO: 1928214 - RNA, 17 nt, Shigella flexneri 2a str. 2457T
ugugggauugcuucagu

SEQ ID NO: 1928215 - RNA, 23 nt, Shigella flexneri 2a str. 2457T
uguggggaacagaauguuugcca

SEQ ID NO: 1928216 - RNA, 15 nt, Shigella flexneri 2a str. 2457T
ugugggguauuucca

SEQ ID NO: 1928217 - RNA, 15 nt, Shigella flexneri 2a str. 2457T
uguggcccagccuuu

SEQ ID NO: 1928218 - RNA, 14 nt, Shigella flexneri 2a str. 2457T
ugugcucacacuua

SEQ ID NO: 1928219 - RNA, 17 nt, Shigella flexneri 2a str. 2457T
ugugcuauuuuagaaaa

SEQ ID NO: 1928220 - RNA, 18 nt, Shigella flexneri 2a str. 2457T
ugugcuauuuuagaaaaa

SEQ ID NO: 1928221 - RNA, 17 nt, Shigella flexneri 2a str. 2457T
ugugacgacaccaucuc

SEQ ID NO: 1928222 - RNA, 17 nt, Shigella flexneri 2a str. 2457T
ugugacuuccgacagaa

SEQ ID NO: 1928223 - RNA, 14 nt, Shigella flexneri 2a str. 2457T
ugugacagauuuug

SEQ ID NO: 1928224 - RNA, 16 nt, Shigella flexneri 2a str. 2457T
ugugacagcagcggca

SEQ ID NO: 1928225 - RNA, 15 nt, Shigella flexneri 2a str. 2457T
ugucagcccuuuuuc

SEQ ID NO: 1928226 - RNA, 16 nt, Shigella flexneri 2a str. 2457T
ugucagaaaugauggg

SEQ ID NO: 1928227 - RNA, 18 nt, Shigella flexneri 2a str. 2457T
ugucagcaaccugcuuaa

SEQ ID NO: 1928228 - RNA, 16 nt, Shigella flexneri 2a str. 2457T
ugucacgucucaucag

SEQ ID NO: 1928229 - RNA, 17 nt, Shigella flexneri 2a str. 2457T
ugucacgucucaucagg

SEQ ID NO: 1928230 - RNA, 22 nt, Shigella flexneri 2a str. 2457T
ugucaccauuggcauugguauc

SEQ ID NO: 1928231 - RNA, 16 nt, Shigella flexneri 2a str. 2457T
ugugcacgaggcuggc

SEQ ID NO: 1928232 - RNA, 20 nt, Shigella flexneri 2a str. 2457T
ugugcaucaggcaaacuuca

SEQ ID NO: 1928233 - RNA, 15 nt, Shigella flexneri 2a str. 2457T
ugugcaguuccugca

SEQ ID NO: 1928234 - RNA, 14 nt, Shigella flexneri 2a str. 2457T
ugugcaccuuuucc

SEQ ID NO: 1928235 - RNA, 17 nt, Shigella flexneri 2a str. 2457T
ugugcgcgauccggcgg

SEQ ID NO: 1928236 - RNA, 14 nt, Shigella flexneri 2a str. 2457T
ugugcgcacauugc

SEQ ID NO: 1928237 - RNA, 19 nt, Shigella flexneri 2a str. 2457T
ugugccugaauauacgcca

SEQ ID NO: 1928238 - RNA, 19 nt, Shigella flexneri 2a str. 2457T
ugugcauuuaagagaaacg

SEQ ID NO: 1928239 - RNA, 22 nt, Shigella flexneri 2a str. 2457T
ugugccggcaacaauauuaacu

SEQ ID NO: 1928240 - RNA, 17 nt, Shigella flexneri 2a str. 2457T
uguuguaauaguguauu

SEQ ID NO: 1928241 - RNA, 18 nt, Shigella flexneri 2a str. 2457T
uguuguagacaugguaaa

SEQ ID NO: 1928242 - RNA, 21 nt, Shigella flexneri 2a str. 2457T
uguuguauccuguuuuuaagu

SEQ ID NO: 1928243 - RNA, 20 nt, Shigella flexneri 2a str. 2457T
uguuggcaggccaaaaaaca

SEQ ID NO: 1928244 - RNA, 13 nt, Shigella flexneri 2a str. 2457T
uguucucagcaca

SEQ ID NO: 1928245 - RNA, 23 nt, Shigella flexneri 2a str. 2457T
uguugcaagacgaugacauuauc

SEQ ID NO: 1928246 - RNA, 20 nt, Shigella flexneri 2a str. 2457T
uguugcaccgaguucuucac

SEQ ID NO: 1928247 - RNA, 22 nt, Shigella flexneri 2a str. 2457T
uguugcugccgacaaaugcagu

SEQ ID NO: 1928248 - RNA, 14 nt, Shigella flexneri 2a str. 2457T
uguuggauccccug

SEQ ID NO: 1928249 - RNA, 18 nt, Shigella flexneri 2a str. 2457T
uguugcugccgacaaaug

SEQ ID NO: 1928250 - RNA, 14 nt, Shigella flexneri 2a str. 2457T
uguugcugaaauuc

SEQ ID NO: 1928251 - RNA, 16 nt, Shigella flexneri 2a str. 2457T
uguugcaggaacagaa

SEQ ID NO: 1928252 - RNA, 15 nt, Shigella flexneri 2a str. 2457T
uguuccaucuuuaug

SEQ ID NO: 1928253 - RNA, 15 nt, Shigella flexneri 2a str. 2457T
uguucccuucucagc

SEQ ID NO: 1928254 - RNA, 20 nt, Shigella flexneri 2a str. 2457T
uguuccgccagcgacugcgc

SEQ ID NO: 1928255 - RNA, 12 nt, Shigella flexneri 2a str. 2457T
uguuccagugcg

SEQ ID NO: 1928256 - RNA, 18 nt, Shigella flexneri 2a str. 2457T
uguuccaguugauacagg

SEQ ID NO: 1928257 - RNA, 21 nt, Shigella flexneri 2a str. 2457T
uguuccagaccauauuuucau

SEQ ID NO: 1928258 - RNA, 23 nt, Shigella flexneri 2a str. 2457T
uguuccagacgcugcauugacaa

SEQ ID NO: 1928259 - RNA, 12 nt, Shigella flexneri 2a str. 2457T
uguuccucugcu

SEQ ID NO: 1928260 - RNA, 22 nt, Shigella flexneri 2a str. 2457T
uguuccggcuuucugggaugau

SEQ ID NO: 1928261 - RNA, 23 nt, Shigella flexneri 2a str. 2457T
uguuccgcuuguugcuaauuuag

SEQ ID NO: 1928262 - RNA, 13 nt, Shigella flexneri 2a str. 2457T
uguuccgucagcc

SEQ ID NO: 1928263 - RNA, 19 nt, Shigella flexneri 2a str. 2457T
uguuauuuaauuacugaga

SEQ ID NO: 1928264 - RNA, 15 nt, Shigella flexneri 2a str. 2457T
uguucagccugacag

SEQ ID NO: 1928265 - RNA, 22 nt, Shigella flexneri 2a str. 2457T
uguucagcgggcagggcaucaa

SEQ ID NO: 1928266 - RNA, 13 nt, Shigella flexneri 2a str. 2457T
uguucagcaaaug

SEQ ID NO: 1928267 - RNA, 17 nt, Shigella flexneri 2a str. 2457T
uguucagaaugcccacg

SEQ ID NO: 1928268 - RNA, 13 nt, Shigella flexneri 2a str. 2457T
uguucagauaaug

SEQ ID NO: 1928269 - RNA, 14 nt, Shigella flexneri 2a str. 2457T
uguucagauggcca

SEQ ID NO: 1928270 - RNA, 18 nt, Shigella flexneri 2a str. 2457T
uguucagauggccaauaa

SEQ ID NO: 1928271 - RNA, 17 nt, Shigella flexneri 2a str. 2457T
uguucagaaagcgccag

SEQ ID NO: 1928272 - RNA, 22 nt, Shigella flexneri 2a str. 2457T
uguucacuuuugcugcaaaauu

SEQ ID NO: 1928273 - RNA, 22 nt, Shigella flexneri 2a str. 2457T
uguuauccgacuuauucuucaa

SEQ ID NO: 1928274 - RNA, 14 nt, Shigella flexneri 2a str. 2457T
uguuaucaauaagu

SEQ ID NO: 1928275 - RNA, 16 nt, Shigella flexneri 2a str. 2457T
uguuaugagauaauuc

SEQ ID NO: 1928276 - RNA, 19 nt, Shigella flexneri 2a str. 2457T
uguuauuaguguguauaua

SEQ ID NO: 1928277 - RNA, 16 nt, Shigella flexneri 2a str. 2457T
uguuaucccgaugaug

SEQ ID NO: 1928278 - RNA, 22 nt, Shigella flexneri 2a str. 2457T
uguuaaguuuaucccaauuauc

SEQ ID NO: 1928279 - RNA, 17 nt, Shigella flexneri 2a str. 2457T
uguuuuuaguuaaaucg

SEQ ID NO: 1928280 - RNA, 15 nt, Shigella flexneri 2a str. 2457T
uguuuuuaagguuuc

SEQ ID NO: 1928281 - RNA, 20 nt, Shigella flexneri 2a str. 2457T
uguuuuucaucgcuaauaau

SEQ ID NO: 1928282 - RNA, 12 nt, Shigella flexneri 2a str. 2457T
uuaaaaaaacac

SEQ ID NO: 1928283 - RNA, 21 nt, Shigella flexneri 2a str. 2457T
uuaaaaacuucguuagguucu

SEQ ID NO: 1928284 - RNA, 10 nt, Shigella flexneri 2a str. 2457T
uuaaaaacag

SEQ ID NO: 1928285 - RNA, 13 nt, Shigella flexneri 2a str. 2457T
uuaaaaacagcca

SEQ ID NO: 1928286 - RNA, 18 nt, Shigella flexneri 2a str. 2457T
uuaaaacgcacgcuguca

SEQ ID NO: 1928287 - RNA, 15 nt, Shigella flexneri 2a str. 2457T
uuaaaacguaaagcc

SEQ ID NO: 1928288 - RNA, 13 nt, Shigella flexneri 2a str. 2457T
uuaaaacuaaaaa

SEQ ID NO: 1928289 - RNA, 20 nt, Shigella flexneri 2a str. 2457T
uuaaacgggucaucaaaauc

SEQ ID NO: 1928290 - RNA, 15 nt, Shigella flexneri 2a str. 2457T
uuaaaauugcaugaa

SEQ ID NO: 1928291 - RNA, 20 nt, Shigella flexneri 2a str. 2457T
uuaaaauucaagacaucaau

SEQ ID NO: 1928292 - RNA, 19 nt, Shigella flexneri 2a str. 2457T
uuaaagccgccaaacggau

SEQ ID NO: 1928293 - RNA, 12 nt, Shigella flexneri 2a str. 2457T
uuaaagccggug

SEQ ID NO: 1928294 - RNA, 12 nt, Shigella flexneri 2a str. 2457T
uuaaagcaaaaa

SEQ ID NO: 1928295 - RNA, 20 nt, Shigella flexneri 2a str. 2457T
uuaaaguugagcgaaaacga

SEQ ID NO: 1928296 - RNA, 20 nt, Shigella flexneri 2a str. 2457T
uuaaagcaucugccagccau

SEQ ID NO: 1928297 - RNA, 21 nt, Shigella flexneri 2a str. 2457T
uuaaagucuuuguauuuauuu

SEQ ID NO: 1928298 - RNA, 14 nt, Shigella flexneri 2a str. 2457T
uguuucaggaacac

SEQ ID NO: 1928299 - RNA, 18 nt, Shigella flexneri 2a str. 2457T
uguuuaaggaaaaacgaa

SEQ ID NO: 1928300 - RNA, 13 nt, Shigella flexneri 2a str. 2457T
uguuuaaccaaca

SEQ ID NO: 1928301 - RNA, 19 nt, Shigella flexneri 2a str. 2457T
uguuuaauggcaaaaacuu

SEQ ID NO: 1928302 - RNA, 19 nt, Shigella flexneri 2a str. 2457T
uguuuaccggugccagcaa

SEQ ID NO: 1928303 - RNA, 23 nt, Shigella flexneri 2a str. 2457T
uguuuagccgcuucugcagcuuu

SEQ ID NO: 1928304 - RNA, 14 nt, Shigella flexneri 2a str. 2457T
uguuuauaagccau

SEQ ID NO: 1928305 - RNA, 22 nt, Shigella flexneri 2a str. 2457T
uguuuaucuauaacaaaacuga

SEQ ID NO: 1928306 - RNA, 17 nt, Shigella flexneri 2a str. 2457T
uguuuuccgaugagcga

SEQ ID NO: 1928307 - RNA, 22 nt, Shigella flexneri 2a str. 2457T
uguuuuccguugugcgauccac

SEQ ID NO: 1928308 - RNA, 13 nt, Shigella flexneri 2a str. 2457T
uguuuuauaaaga

SEQ ID NO: 1928309 - RNA, 23 nt, Shigella flexneri 2a str. 2457T
uguuuuaucucccuguaucccag

SEQ ID NO: 1928310 - RNA, 13 nt, Shigella flexneri 2a str. 2457T
uguuuuauauaac

SEQ ID NO: 1928311 - RNA, 23 nt, Shigella flexneri 2a str. 2457T
uguuugcauccggcacaaugcuu

SEQ ID NO: 1928312 - RNA, 18 nt, Shigella flexneri 2a str. 2457T
uguuugacaacucaucac

SEQ ID NO: 1928313 - RNA, 15 nt, Shigella flexneri 2a str. 2457T
uguuugacaacucau

SEQ ID NO: 1928314 - RNA, 14 nt, Shigella flexneri 2a str. 2457T
uggauucagcaccg

SEQ ID NO: 1928315 - RNA, 22 nt, Shigella flexneri 2a str. 2457T
uggauuagcgaccgaacagauc

SEQ ID NO: 1928316 - RNA, 14 nt, Shigella flexneri 2a str. 2457T
uggauuaucuucac

SEQ ID NO: 1928317 - RNA, 14 nt, Shigella flexneri 2a str. 2457T
uggcaaacuacaaa

SEQ ID NO: 1928318 - RNA, 14 nt, Shigella flexneri 2a str. 2457T
uggcaacaauggca

SEQ ID NO: 1928319 - RNA, 16 nt, Shigella flexneri 2a str. 2457T
uggcaaauuuauuauc

SEQ ID NO: 1928320 - RNA, 15 nt, Shigella flexneri 2a str. 2457T
uggcaaccagcagau

SEQ ID NO: 1928321 - RNA, 13 nt, Shigella flexneri 2a str. 2457T
uggcaacacagau

SEQ ID NO: 1928322 - RNA, 16 nt, Shigella flexneri 2a str. 2457T
uggcaacuuuaauaau

SEQ ID NO: 1928323 - RNA, 20 nt, Shigella flexneri 2a str. 2457T
uggcaaccuucuucuuucag

SEQ ID NO: 1928324 - RNA, 21 nt, Shigella flexneri 2a str. 2457T
uggcaauccagcucuuuucca

SEQ ID NO: 1928325 - RNA, 21 nt, Shigella flexneri 2a str. 2457T
uggcaaugacuagcgccauaa

SEQ ID NO: 1928326 - RNA, 16 nt, Shigella flexneri 2a str. 2457T
uggcaaucuuccucgc

SEQ ID NO: 1928327 - RNA, 18 nt, Shigella flexneri 2a str. 2457T
uggcaaucuuccucgcca

SEQ ID NO: 1928328 - RNA, 18 nt, Shigella flexneri 2a str. 2457T
uggcaauggcgacuucug

SEQ ID NO: 1928329 - RNA, 19 nt, Shigella flexneri 2a str. 2457T
uggcaagcggugcgaugcc

SEQ ID NO: 1928330 - RNA, 16 nt, Shigella flexneri 2a str. 2457T
uggcaauaaagacauc

SEQ ID NO: 1928331 - RNA, 20 nt, Shigella flexneri 2a str. 2457T
uggcaauacgauccugagca

SEQ ID NO: 1928332 - RNA, 19 nt, Shigella flexneri 2a str. 2457T
uggcacaugcauaaagcgg

SEQ ID NO: 1928333 - RNA, 22 nt, Shigella flexneri 2a str. 2457T
uggcacaaucucggcgcucaau

SEQ ID NO: 1928334 - RNA, 22 nt, Shigella flexneri 2a str. 2457T
uggcacaaaaaaucgugcugca

SEQ ID NO: 1928335 - RNA, 23 nt, Shigella flexneri 2a str. 2457T
uggcacaaaaaaucgugcugcaa

SEQ ID NO: 1928336 - RNA, 20 nt, Shigella flexneri 2a str. 2457T
uggcacaaauggcaaugacu

SEQ ID NO: 1928337 - RNA, 18 nt, Shigella flexneri 2a str. 2457T
uggcaccuguaccagccc

SEQ ID NO: 1928338 - RNA, 20 nt, Shigella flexneri 2a str. 2457T
uggcaccguucuuuauuggc

SEQ ID NO: 1928339 - RNA, 22 nt, Shigella flexneri 2a str. 2457T
uggcaccaucccuaugcauaau

SEQ ID NO: 1928340 - RNA, 14 nt, Shigella flexneri 2a str. 2457T
uggcacccagcgcu

SEQ ID NO: 1928341 - RNA, 15 nt, Shigella flexneri 2a str. 2457T
uggcaccaaagggca

SEQ ID NO: 1928342 - RNA, 22 nt, Shigella flexneri 2a str. 2457T
uggcaccaggcguucauaucua

SEQ ID NO: 1928343 - RNA, 22 nt, Shigella flexneri 2a str. 2457T
uggcagaauuugaggaagcugc

SEQ ID NO: 1928344 - RNA, 18 nt, Shigella flexneri 2a str. 2457T
uggcacguaccaugcgca

SEQ ID NO: 1928345 - RNA, 15 nt, Shigella flexneri 2a str. 2457T
uggcacucaacaacc

SEQ ID NO: 1928346 - RNA, 17 nt, Shigella flexneri 2a str. 2457T
uggcagauacauugcca

SEQ ID NO: 1928347 - RNA, 21 nt, Shigella flexneri 2a str. 2457T
uggcagcaccgauccuggcgg

SEQ ID NO: 1928348 - RNA, 22 nt, Shigella flexneri 2a str. 2457T
uggcagcguuaugucccgcugg

SEQ ID NO: 1928349 - RNA, 19 nt, Shigella flexneri 2a str. 2457T
uggcagcgcgcauucagca

SEQ ID NO: 1928350 - RNA, 18 nt, Shigella flexneri 2a str. 2457T
uggcagccauaaucacuc

SEQ ID NO: 1928351 - RNA, 23 nt, Shigella flexneri 2a str. 2457T
uggcagguaaucggcauuggcau

SEQ ID NO: 1928352 - RNA, 17 nt, Shigella flexneri 2a str. 2457T
uggcaggaguggcagca

SEQ ID NO: 1928353 - RNA, 22 nt, Shigella flexneri 2a str. 2457T
uggcaucaaacacugaaccgaa

SEQ ID NO: 1928354 - RNA, 13 nt, Shigella flexneri 2a str. 2457T
uggcagucuuaau

SEQ ID NO: 1928355 - RNA, 22 nt, Shigella flexneri 2a str. 2457T
uggcauaaacaaagcgcacuau

SEQ ID NO: 1928356 - RNA, 23 nt, Shigella flexneri 2a str. 2457T
uggcagugggccagaaaaaacgu

SEQ ID NO: 1928357 - RNA, 14 nt, Shigella flexneri 2a str. 2457T
uggaugucuggcag

SEQ ID NO: 1928358 - RNA, 23 nt, Shigella flexneri 2a str. 2457T
uggaugcgauguucccccagcca

SEQ ID NO: 1928359 - RNA, 20 nt, Shigella flexneri 2a str. 2457T
uggaugcgauguucccccag

SEQ ID NO: 1928360 - RNA, 18 nt, Shigella flexneri 2a str. 2457T
uggaucccagaagaauau

SEQ ID NO: 1928361 - RNA, 15 nt, Shigella flexneri 2a str. 2457T
uggaucccagaagau

SEQ ID NO: 1928362 - RNA, 14 nt, Shigella flexneri 2a str. 2457T
uggauaaaauuauc

SEQ ID NO: 1928363 - RNA, 13 nt, Shigella flexneri 2a str. 2457T
uggaguggcccag

SEQ ID NO: 1928364 - RNA, 14 nt, Shigella flexneri 2a str. 2457T
uggaguggcccagg

SEQ ID NO: 1928365 - RNA, 13 nt, Shigella flexneri 2a str. 2457T
uggauaggcaccg

SEQ ID NO: 1928366 - RNA, 22 nt, Shigella flexneri 2a str. 2457T
uggaucaaggauugcagcacug

SEQ ID NO: 1928367 - RNA, 16 nt, Shigella flexneri 2a str. 2457T
uggaucaacaggcacu

SEQ ID NO: 1928368 - RNA, 15 nt, Shigella flexneri 2a str. 2457T
uggaucaagccccag

SEQ ID NO: 1928369 - RNA, 13 nt, Shigella flexneri 2a str. 2457T
uggacgguaaaaa

SEQ ID NO: 1928370 - RNA, 14 nt, Shigella flexneri 2a str. 2457T
uggacgguggagca

SEQ ID NO: 1928371 - RNA, 22 nt, Shigella flexneri 2a str. 2457T
uggacgccguauucacuuucaa

SEQ ID NO: 1928372 - RNA, 19 nt, Shigella flexneri 2a str. 2457T
uggacgccguuuaaaggga

SEQ ID NO: 1928373 - RNA, 18 nt, Shigella flexneri 2a str. 2457T
uggacguuugauuuuuaa

SEQ ID NO: 1928374 - RNA, 20 nt, Shigella flexneri 2a str. 2457T
uggagaguugcaccagcaac

SEQ ID NO: 1928375 - RNA, 22 nt, Shigella flexneri 2a str. 2457T
uggagaguugcaccagcaacaa

SEQ ID NO: 1928376 - RNA, 17 nt, Shigella flexneri 2a str. 2457T
uggagaguugcaccagc

SEQ ID NO: 1928377 - RNA, 13 nt, Shigella flexneri 2a str. 2457T
uggaguaauaauu

SEQ ID NO: 1928378 - RNA, 15 nt, Shigella flexneri 2a str. 2457T
uggaguaauaauuuc

SEQ ID NO: 1928379 - RNA, 15 nt, Shigella flexneri 2a str. 2457T
uggagugagaaugca

SEQ ID NO: 1928380 - RNA, 16 nt, Shigella flexneri 2a str. 2457T
uggagugcagcaugca

SEQ ID NO: 1928381 - RNA, 19 nt, Shigella flexneri 2a str. 2457T
uggagccgaaagaucgcgg

SEQ ID NO: 1928382 - RNA, 21 nt, Shigella flexneri 2a str. 2457T
uggagcuggacggucugcuca

SEQ ID NO: 1928383 - RNA, 13 nt, Shigella flexneri 2a str. 2457T
uggagcaggaaua

SEQ ID NO: 1928384 - RNA, 13 nt, Shigella flexneri 2a str. 2457T
uggcgcauccagc

SEQ ID NO: 1928385 - RNA, 20 nt, Shigella flexneri 2a str. 2457T
uggcgcaccuuuuuuuaugc

SEQ ID NO: 1928386 - RNA, 21 nt, Shigella flexneri 2a str. 2457T
uggcgcaaguuacuccuggua

SEQ ID NO: 1928387 - RNA, 20 nt, Shigella flexneri 2a str. 2457T
uggcgacggcgaaucaaccg

SEQ ID NO: 1928388 - RNA, 16 nt, Shigella flexneri 2a str. 2457T
uggcgacggcggaaca

SEQ ID NO: 1928389 - RNA, 18 nt, Shigella flexneri 2a str. 2457T
uggcgaagaacgcauugc

SEQ ID NO: 1928390 - RNA, 22 nt, Shigella flexneri 2a str. 2457T
uggcgauaaucgaaccaaacag

SEQ ID NO: 1928391 - RNA, 18 nt, Shigella flexneri 2a str. 2457T
uggccuuuaauaugccac

SEQ ID NO: 1928392 - RNA, 21 nt, Shigella flexneri 2a str. 2457T
uggccgugaauuacugcugcg

SEQ ID NO: 1928393 - RNA, 14 nt, Shigella flexneri 2a str. 2457T
uggccgugcagacc

SEQ ID NO: 1928394 - RNA, 20 nt, Shigella flexneri 2a str. 2457T
uggccaauuggcuggcccuu

SEQ ID NO: 1928395 - RNA, 15 nt, Shigella flexneri 2a str. 2457T
uggccaauuggcugg

SEQ ID NO: 1928396 - RNA, 19 nt, Shigella flexneri 2a str. 2457T
uggccaauuggcuggcccu

SEQ ID NO: 1928397 - RNA, 19 nt, Shigella flexneri 2a str. 2457T
uggccacuucuguuacucc

SEQ ID NO: 1928398 - RNA, 14 nt, Shigella flexneri 2a str. 2457T
uggccagagugcgu

SEQ ID NO: 1928399 - RNA, 14 nt, Shigella flexneri 2a str. 2457T
uggcauucucacuc

SEQ ID NO: 1928400 - RNA, 18 nt, Shigella flexneri 2a str. 2457T
uggcauucucacuccagc

SEQ ID NO: 1928401 - RNA, 18 nt, Shigella flexneri 2a str. 2457T
uggcauguccuucuucug

SEQ ID NO: 1928402 - RNA, 22 nt, Shigella flexneri 2a str. 2457T
uggcauuuuuaucucaaaaauu

SEQ ID NO: 1928403 - RNA, 18 nt, Shigella flexneri 2a str. 2457T
uggcauuggccguugcca

SEQ ID NO: 1928404 - RNA, 14 nt, Shigella flexneri 2a str. 2457T
uggcaucacuucuu

SEQ ID NO: 1928405 - RNA, 15 nt, Shigella flexneri 2a str. 2457T
uggcauccuguuuuc

SEQ ID NO: 1928406 - RNA, 13 nt, Shigella flexneri 2a str. 2457T
uggcauccuugcu

SEQ ID NO: 1928407 - RNA, 22 nt, Shigella flexneri 2a str. 2457T
uggcauccuugcuaaccaacaa

SEQ ID NO: 1928408 - RNA, 17 nt, Shigella flexneri 2a str. 2457T
uggcauggcgcuggcag

SEQ ID NO: 1928409 - RNA, 17 nt, Shigella flexneri 2a str. 2457T
uggcauuaauaugcuca

SEQ ID NO: 1928410 - RNA, 11 nt, Shigella flexneri 2a str. 2457T
uggcccgccgc

SEQ ID NO: 1928411 - RNA, 16 nt, Shigella flexneri 2a str. 2457T
uggccauuucugccag

SEQ ID NO: 1928412 - RNA, 21 nt, Shigella flexneri 2a str. 2457T
uggcccaguugauucgcgcgu

SEQ ID NO: 1928413 - RNA, 15 nt, Shigella flexneri 2a str. 2457T
uggcccuugcucaau

SEQ ID NO: 1928414 - RNA, 17 nt, Shigella flexneri 2a str. 2457T
uggcccuaggcauagaa

SEQ ID NO: 1928415 - RNA, 13 nt, Shigella flexneri 2a str. 2457T
uggccgaagagga

SEQ ID NO: 1928416 - RNA, 13 nt, Shigella flexneri 2a str. 2457T
uguacggcaguga

SEQ ID NO: 1928417 - RNA, 15 nt, Shigella flexneri 2a str. 2457T
uguacgaaaacgggc

SEQ ID NO: 1928418 - RNA, 22 nt, Shigella flexneri 2a str. 2457T
uguaccuucacgcgcuccagga

SEQ ID NO: 1928419 - RNA, 23 nt, Shigella flexneri 2a str. 2457T
uguaccuucacgcgcuccaggag

SEQ ID NO: 1928420 - RNA, 20 nt, Shigella flexneri 2a str. 2457T
uguacccgcugcagcucuuu

SEQ ID NO: 1928421 - RNA, 15 nt, Shigella flexneri 2a str. 2457T
uguacuccagcagac

SEQ ID NO: 1928422 - RNA, 15 nt, Shigella flexneri 2a str. 2457T
uguacuguuucacug

SEQ ID NO: 1928423 - RNA, 22 nt, Shigella flexneri 2a str. 2457T
uguacauuaccacgauuuugac

SEQ ID NO: 1928424 - RNA, 14 nt, Shigella flexneri 2a str. 2457T
uguaccacaaccug

SEQ ID NO: 1928425 - RNA, 15 nt, Shigella flexneri 2a str. 2457T
uguacaacuuucucg

SEQ ID NO: 1928426 - RNA, 18 nt, Shigella flexneri 2a str. 2457T
uguaauuuuuuuauugau

SEQ ID NO: 1928427 - RNA, 17 nt, Shigella flexneri 2a str. 2457T
uguacauggugcacauu

SEQ ID NO: 1928428 - RNA, 17 nt, Shigella flexneri 2a str. 2457T
uguaauacgcucaucug

SEQ ID NO: 1928429 - RNA, 19 nt, Shigella flexneri 2a str. 2457T
uguaauacggcucucaccu

SEQ ID NO: 1928430 - RNA, 17 nt, Shigella flexneri 2a str. 2457T
uguaauaguguauuaau

SEQ ID NO: 1928431 - RNA, 22 nt, Shigella flexneri 2a str. 2457T
uguaauaguguauuaaucuauu

SEQ ID NO: 1928432 - RNA, 17 nt, Shigella flexneri 2a str. 2457T
uguaaccuaauuuauua

SEQ ID NO: 1928433 - RNA, 18 nt, Shigella flexneri 2a str. 2457T
uguaacgccggguaaaug

SEQ ID NO: 1928434 - RNA, 17 nt, Shigella flexneri 2a str. 2457T
uguaacgccuuuuccag

SEQ ID NO: 1928435 - RNA, 17 nt, Shigella flexneri 2a str. 2457T
uguaacggagguacaac

SEQ ID NO: 1928436 - RNA, 21 nt, Shigella flexneri 2a str. 2457T
uguaagacauuuaacccuuca

SEQ ID NO: 1928437 - RNA, 21 nt, Shigella flexneri 2a str. 2457T
uguaaagucaucgcauacaaa

SEQ ID NO: 1928438 - RNA, 21 nt, Shigella flexneri 2a str. 2457T
ugguucagugggcgcugcugu

SEQ ID NO: 1928439 - RNA, 19 nt, Shigella flexneri 2a str. 2457T
ugguuaucuuccaccacca

SEQ ID NO: 1928440 - RNA, 20 nt, Shigella flexneri 2a str. 2457T
ugguuauccagcaaccaggu

SEQ ID NO: 1928441 - RNA, 15 nt, Shigella flexneri 2a str. 2457T
ugguuauauuucccc

SEQ ID NO: 1928442 - RNA, 11 nt, Shigella flexneri 2a str. 2457T
uguaaaagaag

SEQ ID NO: 1928443 - RNA, 14 nt, Shigella flexneri 2a str. 2457T
uguaaaccucuuuc

SEQ ID NO: 1928444 - RNA, 18 nt, Shigella flexneri 2a str. 2457T
uguaaacgaagcgccauu

SEQ ID NO: 1928445 - RNA, 14 nt, Shigella flexneri 2a str. 2457T
uguaguuauccgca

SEQ ID NO: 1928446 - RNA, 15 nt, Shigella flexneri 2a str. 2457T
uguaguucuggccuu

SEQ ID NO: 1928447 - RNA, 17 nt, Shigella flexneri 2a str. 2457T
uguaggccugauaagug

SEQ ID NO: 1928448 - RNA, 14 nt, Shigella flexneri 2a str. 2457T
uguaggccagauaa

SEQ ID NO: 1928449 - RNA, 14 nt, Shigella flexneri 2a str. 2457T
uguaggguggggaa

SEQ ID NO: 1928450 - RNA, 20 nt, Shigella flexneri 2a str. 2457T
uguaggguggggaaaaacac

SEQ ID NO: 1928451 - RNA, 21 nt, Shigella flexneri 2a str. 2457T
uguaguccuaacagagcacug

SEQ ID NO: 1928452 - RNA, 23 nt, Shigella flexneri 2a str. 2457T
uguaguacccggccuguuuaucc

SEQ ID NO: 1928453 - RNA, 19 nt, Shigella flexneri 2a str. 2457T
uguagccaauaaaugccac

SEQ ID NO: 1928454 - RNA, 18 nt, Shigella flexneri 2a str. 2457T
uguagccaauaaaugcca

SEQ ID NO: 1928455 - RNA, 20 nt, Shigella flexneri 2a str. 2457T
uguagcgcaucacuuccagu

SEQ ID NO: 1928456 - RNA, 18 nt, Shigella flexneri 2a str. 2457T
uguagcguuaccagcaaa

SEQ ID NO: 1928457 - RNA, 19 nt, Shigella flexneri 2a str. 2457T
uguagaaaaucucaaugua

SEQ ID NO: 1928458 - RNA, 19 nt, Shigella flexneri 2a str. 2457T
uguauacgggcuuuuuaau

SEQ ID NO: 1928459 - RNA, 13 nt, Shigella flexneri 2a str. 2457T
uguauacgcuggc

SEQ ID NO: 1928460 - RNA, 21 nt, Shigella flexneri 2a str. 2457T
uguaucaacaauaaaaccagu

SEQ ID NO: 1928461 - RNA, 12 nt, Shigella flexneri 2a str. 2457T
uguaucccaguu

SEQ ID NO: 1928462 - RNA, 16 nt, Shigella flexneri 2a str. 2457T
uguaucgucacugguu

SEQ ID NO: 1928463 - RNA, 21 nt, Shigella flexneri 2a str. 2457T
uguaucgacgcgccagcaccg

SEQ ID NO: 1928464 - RNA, 21 nt, Shigella flexneri 2a str. 2457T
uguaucggcggcgauguccag

SEQ ID NO: 1928465 - RNA, 21 nt, Shigella flexneri 2a str. 2457T
uguauuaaucgugaaaagcug

SEQ ID NO: 1928466 - RNA, 16 nt, Shigella flexneri 2a str. 2457T
uguauuacaacgugcu

SEQ ID NO: 1928467 - RNA, 22 nt, Shigella flexneri 2a str. 2457T
uguauuacagagguuuuaugau

SEQ ID NO: 1928468 - RNA, 13 nt, Shigella flexneri 2a str. 2457T
uguauuaacauua

SEQ ID NO: 1928469 - RNA, 14 nt, Shigella flexneri 2a str. 2457T
uguauuaacauuag

SEQ ID NO: 1928470 - RNA, 21 nt, Shigella flexneri 2a str. 2457T
uguauguaggguacagcacga

SEQ ID NO: 1928471 - RNA, 22 nt, Shigella flexneri 2a str. 2457T
uguauuucuucauacuaccugg

SEQ ID NO: 1928472 - RNA, 15 nt, Shigella flexneri 2a str. 2457T
ugucaaaaucaaaau

SEQ ID NO: 1928473 - RNA, 19 nt, Shigella flexneri 2a str. 2457T
ugguaaaaccgacuuaaaa

SEQ ID NO: 1928474 - RNA, 20 nt, Shigella flexneri 2a str. 2457T
ugguaaagccgguuuugguu

SEQ ID NO: 1928475 - RNA, 18 nt, Shigella flexneri 2a str. 2457T
uggguucgauuucauuca

SEQ ID NO: 1928476 - RNA, 17 nt, Shigella flexneri 2a str. 2457T
ugggugucgccuuccac

SEQ ID NO: 1928477 - RNA, 16 nt, Shigella flexneri 2a str. 2457T
ugggugcuugaggcug

SEQ ID NO: 1928478 - RNA, 16 nt, Shigella flexneri 2a str. 2457T
ugguauuaaauuugcu

SEQ ID NO: 1928479 - RNA, 17 nt, Shigella flexneri 2a str. 2457T
uggucaguacgccgccg

SEQ ID NO: 1928480 - RNA, 12 nt, Shigella flexneri 2a str. 2457T
uggucagcaucg

SEQ ID NO: 1928481 - RNA, 14 nt, Shigella flexneri 2a str. 2457T
uggucagaacgacc

SEQ ID NO: 1928482 - RNA, 22 nt, Shigella flexneri 2a str. 2457T
ugguacgucaccacacgccgca

SEQ ID NO: 1928483 - RNA, 17 nt, Shigella flexneri 2a str. 2457T
ugguacuggugcaaaac

SEQ ID NO: 1928484 - RNA, 21 nt, Shigella flexneri 2a str. 2457T
ugguauaaggcgcaauaauca

SEQ ID NO: 1928485 - RNA, 23 nt, Shigella flexneri 2a str. 2457T
uggugauaaaacgcagucuuccc

SEQ ID NO: 1928486 - RNA, 16 nt, Shigella flexneri 2a str. 2457T
uggugaggccagagca

SEQ ID NO: 1928487 - RNA, 22 nt, Shigella flexneri 2a str. 2457T
uggugagccacauugcaucuga

SEQ ID NO: 1928488 - RNA, 15 nt, Shigella flexneri 2a str. 2457T
ugguggagauaaacu

SEQ ID NO: 1928489 - RNA, 21 nt, Shigella flexneri 2a str. 2457T
ugguggccgccacgcgugagc

SEQ ID NO: 1928490 - RNA, 13 nt, Shigella flexneri 2a str. 2457T
ugguguuaaaucu

SEQ ID NO: 1928491 - RNA, 18 nt, Shigella flexneri 2a str. 2457T
ugguguuaaaucuguuca

SEQ ID NO: 1928492 - RNA, 21 nt, Shigella flexneri 2a str. 2457T
ugguguuuucgaacaggcagg

SEQ ID NO: 1928493 - RNA, 15 nt, Shigella flexneri 2a str. 2457T
uggucaguuggcugg

SEQ ID NO: 1928494 - RNA, 23 nt, Shigella flexneri 2a str. 2457T
ugguccuucaucuucaacugcca

SEQ ID NO: 1928495 - RNA, 14 nt, Shigella flexneri 2a str. 2457T
uggugaccugcagc

SEQ ID NO: 1928496 - RNA, 21 nt, Shigella flexneri 2a str. 2457T
uggugaauuugucgauuucca

SEQ ID NO: 1928497 - RNA, 15 nt, Shigella flexneri 2a str. 2457T
uggugacaccaugcc

SEQ ID NO: 1928498 - RNA, 21 nt, Shigella flexneri 2a str. 2457T
uggucuccacgcuuaacaacc

SEQ ID NO: 1928499 - RNA, 16 nt, Shigella flexneri 2a str. 2457T
ugggugagcgaugcug

SEQ ID NO: 1928500 - RNA, 19 nt, Shigella flexneri 2a str. 2457T
uggguauauuucaggccaa

SEQ ID NO: 1928501 - RNA, 18 nt, Shigella flexneri 2a str. 2457T
uggguacgaaaagggcug

SEQ ID NO: 1928502 - RNA, 15 nt, Shigella flexneri 2a str. 2457T
uggguaaugcuguga

SEQ ID NO: 1928503 - RNA, 22 nt, Shigella flexneri 2a str. 2457T
uggguaccgagaaaaucauccg

SEQ ID NO: 1928504 - RNA, 14 nt, Shigella flexneri 2a str. 2457T
uggggcuaucucac

SEQ ID NO: 1928505 - RNA, 14 nt, Shigella flexneri 2a str. 2457T
ugggcuucauccag

SEQ ID NO: 1928506 - RNA, 16 nt, Shigella flexneri 2a str. 2457T
ugggcuucauccagca

SEQ ID NO: 1928507 - RNA, 17 nt, Shigella flexneri 2a str. 2457T
ugggcuucauccagcag

SEQ ID NO: 1928508 - RNA, 20 nt, Shigella flexneri 2a str. 2457T
uggggcauauuaucagcaaa

SEQ ID NO: 1928509 - RNA, 16 nt, Shigella flexneri 2a str. 2457T
ugggcucaucaauacg

SEQ ID NO: 1928510 - RNA, 16 nt, Shigella flexneri 2a str. 2457T
ugggccugaaagcuca

SEQ ID NO: 1928511 - RNA, 18 nt, Shigella flexneri 2a str. 2457T
ugggccgccauccggcaa

SEQ ID NO: 1928512 - RNA, 13 nt, Shigella flexneri 2a str. 2457T
ugggcgaagagaa

SEQ ID NO: 1928513 - RNA, 20 nt, Shigella flexneri 2a str. 2457T
ugggcgaagagaaagaacga

SEQ ID NO: 1928514 - RNA, 23 nt, Shigella flexneri 2a str. 2457T
ugggcgagggcaaaccucaccgc

SEQ ID NO: 1928515 - RNA, 15 nt, Shigella flexneri 2a str. 2457T
ugggcuaacacccgu

SEQ ID NO: 1928516 - RNA, 20 nt, Shigella flexneri 2a str. 2457T
ugggcaggccuggguaaaaa

SEQ ID NO: 1928517 - RNA, 24 nt, Shigella flexneri 2a str. 2457T
ugggcaucgcgacagugcauaaau

SEQ ID NO: 1928518 - RNA, 15 nt, Shigella flexneri 2a str. 2457T
ugggcaaucucacuc

SEQ ID NO: 1928519 - RNA, 20 nt, Shigella flexneri 2a str. 2457T
ugggcaaucucacuccggcc

SEQ ID NO: 1928520 - RNA, 21 nt, Shigella flexneri 2a str. 2457T
ugggauuaaaaaguaagaauu

SEQ ID NO: 1928521 - RNA, 16 nt, Shigella flexneri 2a str. 2457T
uggcuuuccgggagca

SEQ ID NO: 1928522 - RNA, 15 nt, Shigella flexneri 2a str. 2457T
ugggaucgccagguu

SEQ ID NO: 1928523 - RNA, 21 nt, Shigella flexneri 2a str. 2457T
ugggauaugagcgauuuuuua

SEQ ID NO: 1928524 - RNA, 20 nt, Shigella flexneri 2a str. 2457T
ucugcgcauuucccagcaag

SEQ ID NO: 1928525 - RNA, 21 nt, Shigella flexneri 2a str. 2457T
ucugcgcauaacugccggaug

SEQ ID NO: 1928526 - RNA, 14 nt, Shigella flexneri 2a str. 2457T
ucugcgacuguucg

SEQ ID NO: 1928527 - RNA, 21 nt, Shigella flexneri 2a str. 2457T
ucugcgagcuuucgaccagcc

SEQ ID NO: 1928528 - RNA, 14 nt, Shigella flexneri 2a str. 2457T
ucugcuucugccug

SEQ ID NO: 1928529 - RNA, 16 nt, Shigella flexneri 2a str. 2457T
ucugcuucugccuggg

SEQ ID NO: 1928530 - RNA, 19 nt, Shigella flexneri 2a str. 2457T
ucugcuucugccugggccu

SEQ ID NO: 1928531 - RNA, 20 nt, Shigella flexneri 2a str. 2457T
ucugcuucugccugggccug

SEQ ID NO: 1928532 - RNA, 23 nt, Shigella flexneri 2a str. 2457T
ucugcuucguuaacgugucauaa

SEQ ID NO: 1928533 - RNA, 15 nt, Shigella flexneri 2a str. 2457T
ucuggauuuggcugc

SEQ ID NO: 1928534 - RNA, 23 nt, Shigella flexneri 2a str. 2457T
ucuggauccacgauuaucaccug

SEQ ID NO: 1928535 - RNA, 17 nt, Shigella flexneri 2a str. 2457T
ucuggauaaucaaugac

SEQ ID NO: 1928536 - RNA, 21 nt, Shigella flexneri 2a str. 2457T
ucuggauagagcucauuucau

SEQ ID NO: 1928537 - RNA, 22 nt, Shigella flexneri 2a str. 2457T
ucugcuuucauucgguuuucaa

SEQ ID NO: 1928538 - RNA, 19 nt, Shigella flexneri 2a str. 2457T
ucuggcgacauuuucucua

SEQ ID NO: 1928539 - RNA, 16 nt, Shigella flexneri 2a str. 2457T
ucuggccguacccagc

SEQ ID NO: 1928540 - RNA, 16 nt, Shigella flexneri 2a str. 2457T
ucuggcaucacuucuu

SEQ ID NO: 1928541 - RNA, 15 nt, Shigella flexneri 2a str. 2457T
ucuggcauuuggcuc

SEQ ID NO: 1928542 - RNA, 16 nt, Shigella flexneri 2a str. 2457T
ucuggcagcugcgcuu

SEQ ID NO: 1928543 - RNA, 21 nt, Shigella flexneri 2a str. 2457T
ucuggcaccuguaccagcccg

SEQ ID NO: 1928544 - RNA, 16 nt, Shigella flexneri 2a str. 2457T
ucuggguggcguucca

SEQ ID NO: 1928545 - RNA, 16 nt, Shigella flexneri 2a str. 2457T
ucuggguugccugaug

SEQ ID NO: 1928546 - RNA, 17 nt, Shigella flexneri 2a str. 2457T
ucuggggcguguuuugu

SEQ ID NO: 1928547 - RNA, 14 nt, Shigella flexneri 2a str. 2457T
ucugggcugaagag

SEQ ID NO: 1928548 - RNA, 15 nt, Shigella flexneri 2a str. 2457T
ucuggugaccuggga

SEQ ID NO: 1928549 - RNA, 14 nt, Shigella flexneri 2a str. 2457T
ucuggugaccuggg

SEQ ID NO: 1928550 - RNA, 18 nt, Shigella flexneri 2a str. 2457T
ucugucugauaaaaaacc

SEQ ID NO: 1928551 - RNA, 18 nt, Shigella flexneri 2a str. 2457T
ucuuaaaauaguccugag

SEQ ID NO: 1928552 - RNA, 15 nt, Shigella flexneri 2a str. 2457T
ucuguggcagggcag

SEQ ID NO: 1928553 - RNA, 19 nt, Shigella flexneri 2a str. 2457T
ucuguugccgcuacaucac

SEQ ID NO: 1928554 - RNA, 16 nt, Shigella flexneri 2a str. 2457T
ucuguuucaucucuuc

SEQ ID NO: 1928555 - RNA, 14 nt, Shigella flexneri 2a str. 2457T
ucuguugugccaca

SEQ ID NO: 1928556 - RNA, 19 nt, Shigella flexneri 2a str. 2457T
ucuguuugcaggugaccag

SEQ ID NO: 1928557 - RNA, 20 nt, Shigella flexneri 2a str. 2457T
ucugauuuaaccaacaauaa

SEQ ID NO: 1928558 - RNA, 12 nt, Shigella flexneri 2a str. 2457T
ucugcagcuuua

SEQ ID NO: 1928559 - RNA, 13 nt, Shigella flexneri 2a str. 2457T
ucugccagaccca

SEQ ID NO: 1928560 - RNA, 21 nt, Shigella flexneri 2a str. 2457T
ucugccagacgguaaccccuc

SEQ ID NO: 1928561 - RNA, 21 nt, Shigella flexneri 2a str. 2457T
ucugcauucaacuggauaaaa

SEQ ID NO: 1928562 - RNA, 22 nt, Shigella flexneri 2a str. 2457T
ucugccaacuuugccgugaaca

SEQ ID NO: 1928563 - RNA, 14 nt, Shigella flexneri 2a str. 2457T
ucugcccaugcugg

SEQ ID NO: 1928564 - RNA, 22 nt, Shigella flexneri 2a str. 2457T
ucugcccaucauaccugagugg

SEQ ID NO: 1928565 - RNA, 22 nt, Shigella flexneri 2a str. 2457T
ucugccauccugauuuauccca

SEQ ID NO: 1928566 - RNA, 21 nt, Shigella flexneri 2a str. 2457T
ucugcccgagauacaucaccg

SEQ ID NO: 1928567 - RNA, 16 nt, Shigella flexneri 2a str. 2457T
ucugccggaagacaca

SEQ ID NO: 1928568 - RNA, 17 nt, Shigella flexneri 2a str. 2457T
ucugccgcuuccagcag

SEQ ID NO: 1928569 - RNA, 22 nt, Shigella flexneri 2a str. 2457T
ucugccgcauggaaccaguuca

SEQ ID NO: 1928570 - RNA, 24 nt, Shigella flexneri 2a str. 2457T
ucugccgcauggaaccaguucacu

SEQ ID NO: 1928571 - RNA, 14 nt, Shigella flexneri 2a str. 2457T
ucugccucugccag

SEQ ID NO: 1928572 - RNA, 17 nt, Shigella flexneri 2a str. 2457T
ucugccugauccugggc

SEQ ID NO: 1928573 - RNA, 17 nt, Shigella flexneri 2a str. 2457T
ucugccgggaagcucuc

SEQ ID NO: 1928574 - RNA, 22 nt, Shigella flexneri 2a str. 2457T
ucugccgggaagcucucuucca

SEQ ID NO: 1928575 - RNA, 21 nt, Shigella flexneri 2a str. 2457T
ucugccuguccaccacgcugc

SEQ ID NO: 1928576 - RNA, 23 nt, Shigella flexneri 2a str. 2457T
ucugccuugaguuuuucaucccu

SEQ ID NO: 1928577 - RNA, 23 nt, Shigella flexneri 2a str. 2457T
ucucgcucaaaaauccagauuua

SEQ ID NO: 1928578 - RNA, 21 nt, Shigella flexneri 2a str. 2457T
ucucgcucgagagagaaaaua

SEQ ID NO: 1928579 - RNA, 15 nt, Shigella flexneri 2a str. 2457T
ucucgcccagcagac

SEQ ID NO: 1928580 - RNA, 15 nt, Shigella flexneri 2a str. 2457T
ucuccuuucuuucug

SEQ ID NO: 1928581 - RNA, 19 nt, Shigella flexneri 2a str. 2457T
ucugauacugcuccggcgc

SEQ ID NO: 1928582 - RNA, 17 nt, Shigella flexneri 2a str. 2457T
ucugauacaugcuguug

SEQ ID NO: 1928583 - RNA, 18 nt, Shigella flexneri 2a str. 2457T
ucugauguuguuuuuaac

SEQ ID NO: 1928584 - RNA, 19 nt, Shigella flexneri 2a str. 2457T
ucugacauccgaccaaugc

SEQ ID NO: 1928585 - RNA, 23 nt, Shigella flexneri 2a str. 2457T
ucugacauaaccacucaccgccg

SEQ ID NO: 1928586 - RNA, 12 nt, Shigella flexneri 2a str. 2457T
ucugacagcaaa

SEQ ID NO: 1928587 - RNA, 21 nt, Shigella flexneri 2a str. 2457T
ucugaauuucagcgccugaua

SEQ ID NO: 1928588 - RNA, 18 nt, Shigella flexneri 2a str. 2457T
ucugaauggcugcauucc

SEQ ID NO: 1928589 - RNA, 20 nt, Shigella flexneri 2a str. 2457T
ucugaaugguggugugcuca

SEQ ID NO: 1928590 - RNA, 15 nt, Shigella flexneri 2a str. 2457T
ucuucugguuucagu

SEQ ID NO: 1928591 - RNA, 18 nt, Shigella flexneri 2a str. 2457T
ucuucuucacuucuucaa

SEQ ID NO: 1928592 - RNA, 20 nt, Shigella flexneri 2a str. 2457T
ucuucuucacuucuucaaua

SEQ ID NO: 1928593 - RNA, 14 nt, Shigella flexneri 2a str. 2457T
ucuucuuucaucau

SEQ ID NO: 1928594 - RNA, 13 nt, Shigella flexneri 2a str. 2457T
ucuugauaccaaa

SEQ ID NO: 1928595 - RNA, 16 nt, Shigella flexneri 2a str. 2457T
ucuugaguuggcaugc

SEQ ID NO: 1928596 - RNA, 15 nt, Shigella flexneri 2a str. 2457T
ucuuuacgcaaaauc

SEQ ID NO: 1928597 - RNA, 16 nt, Shigella flexneri 2a str. 2457T
ucuuuacgcaaaauca

SEQ ID NO: 1928598 - RNA, 16 nt, Shigella flexneri 2a str. 2457T
ucuuuacugauaauuu

SEQ ID NO: 1928599 - RNA, 19 nt, Shigella flexneri 2a str. 2457T
ucuuuaaaucacccgugag

SEQ ID NO: 1928600 - RNA, 11 nt, Shigella flexneri 2a str. 2457T
ucuuuaaacag

SEQ ID NO: 1928601 - RNA, 15 nt, Shigella flexneri 2a str. 2457T
ucuuuaaaaaguaaa

SEQ ID NO: 1928602 - RNA, 16 nt, Shigella flexneri 2a str. 2457T
ucuuguaggccugaua

SEQ ID NO: 1928603 - RNA, 12 nt, Shigella flexneri 2a str. 2457T
ucuuguaggcca

SEQ ID NO: 1928604 - RNA, 20 nt, Shigella flexneri 2a str. 2457T
ucuugccuuuccuccugucu

SEQ ID NO: 1928605 - RNA, 14 nt, Shigella flexneri 2a str. 2457T
ucuugauuuacuac

SEQ ID NO: 1928606 - RNA, 22 nt, Shigella flexneri 2a str. 2457T
ucuugcagcucuugcagcagcu

SEQ ID NO: 1928607 - RNA, 16 nt, Shigella flexneri 2a str. 2457T
ucuugcagcuuaauca

SEQ ID NO: 1928608 - RNA, 20 nt, Shigella flexneri 2a str. 2457T
ucuucucgauaaaaccuucc

SEQ ID NO: 1928609 - RNA, 14 nt, Shigella flexneri 2a str. 2457T
ucuucguucgcugc

SEQ ID NO: 1928610 - RNA, 14 nt, Shigella flexneri 2a str. 2457T
ucuucguucuucuu

SEQ ID NO: 1928611 - RNA, 20 nt, Shigella flexneri 2a str. 2457T
ucuucguagcguuuuuucau

SEQ ID NO: 1928612 - RNA, 19 nt, Shigella flexneri 2a str. 2457T
ucuucgcacuuaccuucac

SEQ ID NO: 1928613 - RNA, 23 nt, Shigella flexneri 2a str. 2457T
ucuucgccugccugcagcugcuc

SEQ ID NO: 1928614 - RNA, 20 nt, Shigella flexneri 2a str. 2457T
ucuucgacaaucgcaaauau

SEQ ID NO: 1928615 - RNA, 23 nt, Shigella flexneri 2a str. 2457T
ucuucgauuuaaccgcuuucacc

SEQ ID NO: 1928616 - RNA, 17 nt, Shigella flexneri 2a str. 2457T
ucuucgauauugacgau

SEQ ID NO: 1928617 - RNA, 21 nt, Shigella flexneri 2a str. 2457T
ucuucauacgcggcagaaugg

SEQ ID NO: 1928618 - RNA, 22 nt, Shigella flexneri 2a str. 2457T
ucuuacagaaaugguaaagaag

SEQ ID NO: 1928619 - RNA, 20 nt, Shigella flexneri 2a str. 2457T
ucuuaaucgcuucuucuuua

SEQ ID NO: 1928620 - RNA, 20 nt, Shigella flexneri 2a str. 2457T
ucuuaagguucacuuaaucu

SEQ ID NO: 1928621 - RNA, 22 nt, Shigella flexneri 2a str. 2457T
ucuucauuaugaauagcggaaa

SEQ ID NO: 1928622 - RNA, 13 nt, Shigella flexneri 2a str. 2457T
ucuucauuaccuu

SEQ ID NO: 1928623 - RNA, 18 nt, Shigella flexneri 2a str. 2457T
ucuuccggcgauucuuug

SEQ ID NO: 1928624 - RNA, 22 nt, Shigella flexneri 2a str. 2457T
ucuuccguagcggcucggaaua

SEQ ID NO: 1928625 - RNA, 18 nt, Shigella flexneri 2a str. 2457T
ucuuccuggcuuggcugg

SEQ ID NO: 1928626 - RNA, 14 nt, Shigella flexneri 2a str. 2457T
ucgucuccuggccg

SEQ ID NO: 1928627 - RNA, 21 nt, Shigella flexneri 2a str. 2457T
ucgucugggcauugaaggcag

SEQ ID NO: 1928628 - RNA, 21 nt, Shigella flexneri 2a str. 2457T
ucgugcaccaauugccggaug

SEQ ID NO: 1928629 - RNA, 17 nt, Shigella flexneri 2a str. 2457T
ucgucuucgucccaguc

SEQ ID NO: 1928630 - RNA, 16 nt, Shigella flexneri 2a str. 2457T
ucgucuuuauccugac

SEQ ID NO: 1928631 - RNA, 18 nt, Shigella flexneri 2a str. 2457T
ucguguggaguaauaauu

SEQ ID NO: 1928632 - RNA, 21 nt, Shigella flexneri 2a str. 2457T
ucguggcaaucguagcccagc

SEQ ID NO: 1928633 - RNA, 18 nt, Shigella flexneri 2a str. 2457T
ucgugcggguaaccagcc

SEQ ID NO: 1928634 - RNA, 20 nt, Shigella flexneri 2a str. 2457T
ucgugcuggauuugugucag

SEQ ID NO: 1928635 - RNA, 10 nt, Shigella flexneri 2a str. 2457T
ucgugcagaa

SEQ ID NO: 1928636 - RNA, 14 nt, Shigella flexneri 2a str. 2457T
ucgucaguuuauac

SEQ ID NO: 1928637 - RNA, 13 nt, Shigella flexneri 2a str. 2457T
ucgucaucccagu

SEQ ID NO: 1928638 - RNA, 15 nt, Shigella flexneri 2a str. 2457T
ucgucaucagcucca

SEQ ID NO: 1928639 - RNA, 14 nt, Shigella flexneri 2a str. 2457T
ucgucagaaauggu

SEQ ID NO: 1928640 - RNA, 21 nt, Shigella flexneri 2a str. 2457T
ucgucacgcgcgccaagcccg

SEQ ID NO: 1928641 - RNA, 14 nt, Shigella flexneri 2a str. 2457T
ucguaggccugaua

SEQ ID NO: 1928642 - RNA, 18 nt, Shigella flexneri 2a str. 2457T
ucguauugguacauaaca

SEQ ID NO: 1928643 - RNA, 13 nt, Shigella flexneri 2a str. 2457T
ucguauuuaaaac

SEQ ID NO: 1928644 - RNA, 15 nt, Shigella flexneri 2a str. 2457T
ucguauuuaaaaccc

SEQ ID NO: 1928645 - RNA, 18 nt, Shigella flexneri 2a str. 2457T
ucguagccaccaucuuuu

SEQ ID NO: 1928646 - RNA, 16 nt, Shigella flexneri 2a str. 2457T
ucguagccaccaucuu

SEQ ID NO: 1928647 - RNA, 14 nt, Shigella flexneri 2a str. 2457T
ucguagccaccauc

SEQ ID NO: 1928648 - RNA, 14 nt, Shigella flexneri 2a str. 2457T
ucgguuucaucaca

SEQ ID NO: 1928649 - RNA, 16 nt, Shigella flexneri 2a str. 2457T
ucgguucgccugcacc

SEQ ID NO: 1928650 - RNA, 12 nt, Shigella flexneri 2a str. 2457T
ucgguugccaua

SEQ ID NO: 1928651 - RNA, 16 nt, Shigella flexneri 2a str. 2457T
ucgguugccauaaccu

SEQ ID NO: 1928652 - RNA, 18 nt, Shigella flexneri 2a str. 2457T
ucgguuaccacaccggca

SEQ ID NO: 1928653 - RNA, 16 nt, Shigella flexneri 2a str. 2457T
ucgguucaauacccac

SEQ ID NO: 1928654 - RNA, 22 nt, Shigella flexneri 2a str. 2457T
ucggcaguaucagagauaacca

SEQ ID NO: 1928655 - RNA, 22 nt, Shigella flexneri 2a str. 2457T
ucggcaucaaaccauucccugc

SEQ ID NO: 1928656 - RNA, 14 nt, Shigella flexneri 2a str. 2457T
ucggcaucgcucca

SEQ ID NO: 1928657 - RNA, 11 nt, Shigella flexneri 2a str. 2457T
ucguguuaaca

SEQ ID NO: 1928658 - RNA, 16 nt, Shigella flexneri 2a str. 2457T
ucguugccaccaaagu

SEQ ID NO: 1928659 - RNA, 18 nt, Shigella flexneri 2a str. 2457T
ucguuuggggcauauuau

SEQ ID NO: 1928660 - RNA, 22 nt, Shigella flexneri 2a str. 2457T
ucguuuuaaugcgauccugagc

SEQ ID NO: 1928661 - RNA, 13 nt, Shigella flexneri 2a str. 2457T
ucuaaauuuugca

SEQ ID NO: 1928662 - RNA, 15 nt, Shigella flexneri 2a str. 2457T
ucuaacagaucaucc

SEQ ID NO: 1928663 - RNA, 20 nt, Shigella flexneri 2a str. 2457T
ucuaaagcaacuccaucaag

SEQ ID NO: 1928664 - RNA, 12 nt, Shigella flexneri 2a str. 2457T
ucuaaugcuuuu

SEQ ID NO: 1928665 - RNA, 15 nt, Shigella flexneri 2a str. 2457T
ucuaacgaugccagc

SEQ ID NO: 1928666 - RNA, 16 nt, Shigella flexneri 2a str. 2457T
ucuaauccugaagacg

SEQ ID NO: 1928667 - RNA, 22 nt, Shigella flexneri 2a str. 2457T
ucuaccaugaugauaucacugg

SEQ ID NO: 1928668 - RNA, 13 nt, Shigella flexneri 2a str. 2457T
ucuaccagcaccu

SEQ ID NO: 1928669 - RNA, 14 nt, Shigella flexneri 2a str. 2457T
ucuaccacaugauu

SEQ ID NO: 1928670 - RNA, 17 nt, Shigella flexneri 2a str. 2457T
ucuacacgcuaccaaaa

SEQ ID NO: 1928671 - RNA, 19 nt, Shigella flexneri 2a str. 2457T
ucuacagaaaugaaaaaau

SEQ ID NO: 1928672 - RNA, 22 nt, Shigella flexneri 2a str. 2457T
ucuacacgcuaccaaaaaauca

SEQ ID NO: 1928673 - RNA, 19 nt, Shigella flexneri 2a str. 2457T
ucuacagcuucacgcgcca

SEQ ID NO: 1928674 - RNA, 16 nt, Shigella flexneri 2a str. 2457T
ucuacagcgcccgcca

SEQ ID NO: 1928675 - RNA, 21 nt, Shigella flexneri 2a str. 2457T
ucuacguuuccacggauaaca

SEQ ID NO: 1928676 - RNA, 20 nt, Shigella flexneri 2a str. 2457T
ucuacugaaggcgcauugcu

SEQ ID NO: 1928677 - RNA, 22 nt, Shigella flexneri 2a str. 2457T
ucuaccuuaacgguaucuuucc

SEQ ID NO: 1928678 - RNA, 14 nt, Shigella flexneri 2a str. 2457T
ucuauaccgcugaa

SEQ ID NO: 1928679 - RNA, 21 nt, Shigella flexneri 2a str. 2457T
ucuauaccgugcacaauauuu

SEQ ID NO: 1928680 - RNA, 22 nt, Shigella flexneri 2a str. 2457T
ucuauaccgugcacaauauuuu

SEQ ID NO: 1928681 - RNA, 21 nt, Shigella flexneri 2a str. 2457T
ucuaucaaggcgauguuccuu

SEQ ID NO: 1928682 - RNA, 20 nt, Shigella flexneri 2a str. 2457T
ucuaucaggacgaaaaauca

SEQ ID NO: 1928683 - RNA, 14 nt, Shigella flexneri 2a str. 2457T
ucuaucucccugau

SEQ ID NO: 1928684 - RNA, 13 nt, Shigella flexneri 2a str. 2457T
ucuaucuuucaga

SEQ ID NO: 1928685 - RNA, 17 nt, Shigella flexneri 2a str. 2457T
ucuaugguuuugaagaa

SEQ ID NO: 1928686 - RNA, 20 nt, Shigella flexneri 2a str. 2457T
ucuaugguuuugaagaagac

SEQ ID NO: 1928687 - RNA, 17 nt, Shigella flexneri 2a str. 2457T
ucuaugguuuuuucuac

SEQ ID NO: 1928688 - RNA, 20 nt, Shigella flexneri 2a str. 2457T
ucuaugguuuuuucuacaca

SEQ ID NO: 1928689 - RNA, 12 nt, Shigella flexneri 2a str. 2457T
ucucaacacacg

SEQ ID NO: 1928690 - RNA, 17 nt, Shigella flexneri 2a str. 2457T
ucuauugcaacauguug

SEQ ID NO: 1928691 - RNA, 15 nt, Shigella flexneri 2a str. 2457T
ucucaauuuucacuu

SEQ ID NO: 1928692 - RNA, 13 nt, Shigella flexneri 2a str. 2457T
ucucaaucuucac

SEQ ID NO: 1928693 - RNA, 12 nt, Shigella flexneri 2a str. 2457T
ucucaaucuuca

SEQ ID NO: 1928694 - RNA, 18 nt, Shigella flexneri 2a str. 2457T
ucucaaucucuuuuucca

SEQ ID NO: 1928695 - RNA, 22 nt, Shigella flexneri 2a str. 2457T
ucucaaucccuuucucuucaaa

SEQ ID NO: 1928696 - RNA, 13 nt, Shigella flexneri 2a str. 2457T
ucucaauaaaagg

SEQ ID NO: 1928697 - RNA, 18 nt, Shigella flexneri 2a str. 2457T
ucucaauaaaaggaaaca

SEQ ID NO: 1928698 - RNA, 23 nt, Shigella flexneri 2a str. 2457T
ucucaccuauguggaaacaguga

SEQ ID NO: 1928699 - RNA, 19 nt, Shigella flexneri 2a str. 2457T
ucucacuccagccagagcc

SEQ ID NO: 1928700 - RNA, 18 nt, Shigella flexneri 2a str. 2457T
ucucagcacauugauggc

SEQ ID NO: 1928701 - RNA, 21 nt, Shigella flexneri 2a str. 2457T
ucucagagagaaccucaacag

SEQ ID NO: 1928702 - RNA, 15 nt, Shigella flexneri 2a str. 2457T
ucucagauaaaugca

SEQ ID NO: 1928703 - RNA, 13 nt, Shigella flexneri 2a str. 2457T
ucuccuucgcaca

SEQ ID NO: 1928704 - RNA, 15 nt, Shigella flexneri 2a str. 2457T
ucuccuucacucuau

SEQ ID NO: 1928705 - RNA, 15 nt, Shigella flexneri 2a str. 2457T
ucuccuguuucacuu

SEQ ID NO: 1928706 - RNA, 15 nt, Shigella flexneri 2a str. 2457T
ucuccccaagggggc

SEQ ID NO: 1928707 - RNA, 12 nt, Shigella flexneri 2a str. 2457T
ucuccccaaggg

SEQ ID NO: 1928708 - RNA, 12 nt, Shigella flexneri 2a str. 2457T
ucuccccggagg

SEQ ID NO: 1928709 - RNA, 15 nt, Shigella flexneri 2a str. 2457T
ucuccauuucauuga

SEQ ID NO: 1928710 - RNA, 19 nt, Shigella flexneri 2a str. 2457T
ucucagcucauuaaaaaua

SEQ ID NO: 1928711 - RNA, 11 nt, Shigella flexneri 2a str. 2457T
ucucagcacac

SEQ ID NO: 1928712 - RNA, 15 nt, Shigella flexneri 2a str. 2457T
ucucagcugcaagau

SEQ ID NO: 1928713 - RNA, 12 nt, Shigella flexneri 2a str. 2457T
ucucauuuuuca

SEQ ID NO: 1928714 - RNA, 13 nt, Shigella flexneri 2a str. 2457T
ucucauuuuucag

SEQ ID NO: 1928715 - RNA, 18 nt, Shigella flexneri 2a str. 2457T
ucucauccaauaacguga

SEQ ID NO: 1928716 - RNA, 14 nt, Shigella flexneri 2a str. 2457T
ucucauccuucccc

SEQ ID NO: 1928717 - RNA, 13 nt, Shigella flexneri 2a str. 2457T
uccgcuauuucuu

SEQ ID NO: 1928718 - RNA, 20 nt, Shigella flexneri 2a str. 2457T
uccgcucggucacugacacc

SEQ ID NO: 1928719 - RNA, 13 nt, Shigella flexneri 2a str. 2457T
uccgcucuuucac

SEQ ID NO: 1928720 - RNA, 15 nt, Shigella flexneri 2a str. 2457T
uccgcgugacgcugg

SEQ ID NO: 1928721 - RNA, 16 nt, Shigella flexneri 2a str. 2457T
uccgcuaucaguucag

SEQ ID NO: 1928722 - RNA, 23 nt, Shigella flexneri 2a str. 2457T
uccgcuuuguguaaguuuaaccu

SEQ ID NO: 1928723 - RNA, 17 nt, Shigella flexneri 2a str. 2457T
uccgcuggcccaucaga

SEQ ID NO: 1928724 - RNA, 17 nt, Shigella flexneri 2a str. 2457T
uccgcuggcgucugggc

SEQ ID NO: 1928725 - RNA, 21 nt, Shigella flexneri 2a str. 2457T
uccgcuuacucauccacugcc

SEQ ID NO: 1928726 - RNA, 18 nt, Shigella flexneri 2a str. 2457T
uccgcuucaccaccgcaa

SEQ ID NO: 1928727 - RNA, 20 nt, Shigella flexneri 2a str. 2457T
uccgcgaauuaugcagccuu

SEQ ID NO: 1928728 - RNA, 23 nt, Shigella flexneri 2a str. 2457T
uccgccucuaacagaucauccau

SEQ ID NO: 1928729 - RNA, 17 nt, Shigella flexneri 2a str. 2457T
uccgccagccuacagaa

SEQ ID NO: 1928730 - RNA, 18 nt, Shigella flexneri 2a str. 2457T
uccgccagauuuauuuac

SEQ ID NO: 1928731 - RNA, 21 nt, Shigella flexneri 2a str. 2457T
uccgccagcuccgggcugguu

SEQ ID NO: 1928732 - RNA, 13 nt, Shigella flexneri 2a str. 2457T
uccgccagcgcca

SEQ ID NO: 1928733 - RNA, 11 nt, Shigella flexneri 2a str. 2457T
uccgccagcgg

SEQ ID NO: 1928734 - RNA, 13 nt, Shigella flexneri 2a str. 2457T
uccgccagcggcg

SEQ ID NO: 1928735 - RNA, 16 nt, Shigella flexneri 2a str. 2457T
uccgccaguuuguagc

SEQ ID NO: 1928736 - RNA, 14 nt, Shigella flexneri 2a str. 2457T
uccgccaucagucg

SEQ ID NO: 1928737 - RNA, 21 nt, Shigella flexneri 2a str. 2457T
uccgccauuuuaaucaucuga

SEQ ID NO: 1928738 - RNA, 17 nt, Shigella flexneri 2a str. 2457T
uccgccguggaugcgau

SEQ ID NO: 1928739 - RNA, 21 nt, Shigella flexneri 2a str. 2457T
uccgcaaugcggagguuucuu

SEQ ID NO: 1928740 - RNA, 13 nt, Shigella flexneri 2a str. 2457T
uccgcaaugugua

SEQ ID NO: 1928741 - RNA, 22 nt, Shigella flexneri 2a str. 2457T
uccgcaccaacuccacuucacc

SEQ ID NO: 1928742 - RNA, 12 nt, Shigella flexneri 2a str. 2457T
uccgcaaucaaa

SEQ ID NO: 1928743 - RNA, 20 nt, Shigella flexneri 2a str. 2457T
uccgcaauacaucaaagcgu

SEQ ID NO: 1928744 - RNA, 19 nt, Shigella flexneri 2a str. 2457T
uccgcaugauucugagaaa

SEQ ID NO: 1928745 - RNA, 17 nt, Shigella flexneri 2a str. 2457T
uccgcauccggcauaaa

SEQ ID NO: 1928746 - RNA, 23 nt, Shigella flexneri 2a str. 2457T
uccgcaggugacgcgggcagcag

SEQ ID NO: 1928747 - RNA, 13 nt, Shigella flexneri 2a str. 2457T
uccgccaccugcg

SEQ ID NO: 1928748 - RNA, 21 nt, Shigella flexneri 2a str. 2457T
uccgccagaccaaucaccacu

SEQ ID NO: 1928749 - RNA, 21 nt, Shigella flexneri 2a str. 2457T
uccgcauuuguaggcaggaua

SEQ ID NO: 1928750 - RNA, 14 nt, Shigella flexneri 2a str. 2457T
uccggguuuucaac

SEQ ID NO: 1928751 - RNA, 16 nt, Shigella flexneri 2a str. 2457T
uccgguguuuucucuc

SEQ ID NO: 1928752 - RNA, 14 nt, Shigella flexneri 2a str. 2457T
uccggugccaaagu

SEQ ID NO: 1928753 - RNA, 15 nt, Shigella flexneri 2a str. 2457T
uccgguucacuucac

SEQ ID NO: 1928754 - RNA, 22 nt, Shigella flexneri 2a str. 2457T
uccgguguuuucucucucugca

SEQ ID NO: 1928755 - RNA, 15 nt, Shigella flexneri 2a str. 2457T
uccguagugaaaaag

SEQ ID NO: 1928756 - RNA, 18 nt, Shigella flexneri 2a str. 2457T
uccguauaccgucaggau

SEQ ID NO: 1928757 - RNA, 21 nt, Shigella flexneri 2a str. 2457T
uccgguuugcguugcacgcag

SEQ ID NO: 1928758 - RNA, 14 nt, Shigella flexneri 2a str. 2457T
uccgggucuguaaa

SEQ ID NO: 1928759 - RNA, 19 nt, Shigella flexneri 2a str. 2457T
uccggguuugccacaucac

SEQ ID NO: 1928760 - RNA, 17 nt, Shigella flexneri 2a str. 2457T
uccgggauggucagcgg

SEQ ID NO: 1928761 - RNA, 22 nt, Shigella flexneri 2a str. 2457T
uccgggccgaacaucagauaau

SEQ ID NO: 1928762 - RNA, 19 nt, Shigella flexneri 2a str. 2457T
uccgggccgaacaucagau

SEQ ID NO: 1928763 - RNA, 15 nt, Shigella flexneri 2a str. 2457T
uccggcuuuuuacuu

SEQ ID NO: 1928764 - RNA, 20 nt, Shigella flexneri 2a str. 2457T
uccgggaaaacgcuggcagc

SEQ ID NO: 1928765 - RNA, 17 nt, Shigella flexneri 2a str. 2457T
uccgggagcaauuugua

SEQ ID NO: 1928766 - RNA, 20 nt, Shigella flexneri 2a str. 2457T
uccggcugccagccaggaua

SEQ ID NO: 1928767 - RNA, 15 nt, Shigella flexneri 2a str. 2457T
uccggcgacacaucu

SEQ ID NO: 1928768 - RNA, 16 nt, Shigella flexneri 2a str. 2457T
uccggccgccacacag

SEQ ID NO: 1928769 - RNA, 23 nt, Shigella flexneri 2a str. 2457T
uccggcgguaaaugcucauacca

SEQ ID NO: 1928770 - RNA, 20 nt, Shigella flexneri 2a str. 2457T
uccggcguuuugauuuucac

SEQ ID NO: 1928771 - RNA, 23 nt, Shigella flexneri 2a str. 2457T
uccggcgcgauaucgacgaccug

SEQ ID NO: 1928772 - RNA, 17 nt, Shigella flexneri 2a str. 2457T
uccggauucaaaccuaa

SEQ ID NO: 1928773 - RNA, 22 nt, Shigella flexneri 2a str. 2457T
uccggcaccaauguaggccuga

SEQ ID NO: 1928774 - RNA, 15 nt, Shigella flexneri 2a str. 2457T
uccggcaccuuuuca

SEQ ID NO: 1928775 - RNA, 20 nt, Shigella flexneri 2a str. 2457T
uccggcaucguuugcugccu

SEQ ID NO: 1928776 - RNA, 19 nt, Shigella flexneri 2a str. 2457T
uccggcauuaucacaucag

SEQ ID NO: 1928777 - RNA, 13 nt, Shigella flexneri 2a str. 2457T
uccggcagucagu

SEQ ID NO: 1928778 - RNA, 20 nt, Shigella flexneri 2a str. 2457T
uccggcaguaauaccagacc

SEQ ID NO: 1928779 - RNA, 16 nt, Shigella flexneri 2a str. 2457T
uccggcagcaugugua

SEQ ID NO: 1928780 - RNA, 16 nt, Shigella flexneri 2a str. 2457T
uccggcagcagaaagc

SEQ ID NO: 1928781 - RNA, 15 nt, Shigella flexneri 2a str. 2457T
uccggcagcagaaag

SEQ ID NO: 1928782 - RNA, 12 nt, Shigella flexneri 2a str. 2457T
uccggcaccauu

SEQ ID NO: 1928783 - RNA, 20 nt, Shigella flexneri 2a str. 2457T
uccgucgaaagcccaucauc

SEQ ID NO: 1928784 - RNA, 17 nt, Shigella flexneri 2a str. 2457T
uccguuuucagugucca

SEQ ID NO: 1928785 - RNA, 19 nt, Shigella flexneri 2a str. 2457T
uccguuugcgucaugguau

SEQ ID NO: 1928786 - RNA, 15 nt, Shigella flexneri 2a str. 2457T
uccuacaacugggac

SEQ ID NO: 1928787 - RNA, 21 nt, Shigella flexneri 2a str. 2457T
uccuacaacugggacaugauu

SEQ ID NO: 1928788 - RNA, 19 nt, Shigella flexneri 2a str. 2457T
uccguuuuacugggaagaa

SEQ ID NO: 1928789 - RNA, 20 nt, Shigella flexneri 2a str. 2457T
uccucccuuuugcaguuaaa

SEQ ID NO: 1928790 - RNA, 13 nt, Shigella flexneri 2a str. 2457T
uccucccguuaug

SEQ ID NO: 1928791 - RNA, 13 nt, Shigella flexneri 2a str. 2457T
uccuccagcuccu

SEQ ID NO: 1928792 - RNA, 23 nt, Shigella flexneri 2a str. 2457T
uccucaucgauauuaucuucauc

SEQ ID NO: 1928793 - RNA, 13 nt, Shigella flexneri 2a str. 2457T
uccuauugcugcu

SEQ ID NO: 1928794 - RNA, 20 nt, Shigella flexneri 2a str. 2457T
uccucgccguuuucuggggc

SEQ ID NO: 1928795 - RNA, 16 nt, Shigella flexneri 2a str. 2457T
uccucgccguuaauga

SEQ ID NO: 1928796 - RNA, 20 nt, Shigella flexneri 2a str. 2457T
uccucgaguccuuccagguc

SEQ ID NO: 1928797 - RNA, 15 nt, Shigella flexneri 2a str. 2457T
uccucucaugagcag

SEQ ID NO: 1928798 - RNA, 18 nt, Shigella flexneri 2a str. 2457T
uccugacaagguacgaaa

SEQ ID NO: 1928799 - RNA, 17 nt, Shigella flexneri 2a str. 2457T
uccugaauggugaccug

SEQ ID NO: 1928800 - RNA, 21 nt, Shigella flexneri 2a str. 2457T
uccugaaauagaauggcauca

SEQ ID NO: 1928801 - RNA, 23 nt, Shigella flexneri 2a str. 2457T
uccugaaaccauagcaucccaau

SEQ ID NO: 1928802 - RNA, 19 nt, Shigella flexneri 2a str. 2457T
uccugaagacgccucgcau

SEQ ID NO: 1928803 - RNA, 14 nt, Shigella flexneri 2a str. 2457T
uccugaacuuucuc

SEQ ID NO: 1928804 - RNA, 14 nt, Shigella flexneri 2a str. 2457T
uccugaagacgccu

SEQ ID NO: 1928805 - RNA, 23 nt, Shigella flexneri 2a str. 2457T
uccugaacggucgaggcaaccag

SEQ ID NO: 1928806 - RNA, 18 nt, Shigella flexneri 2a str. 2457T
uccucuguaaacuccuuu

SEQ ID NO: 1928807 - RNA, 23 nt, Shigella flexneri 2a str. 2457T
uccucugucaggguuauagccuu

SEQ ID NO: 1928808 - RNA, 13 nt, Shigella flexneri 2a str. 2457T
uccugcgccagcc

SEQ ID NO: 1928809 - RNA, 19 nt, Shigella flexneri 2a str. 2457T
uccugccgcguuggcaaug

SEQ ID NO: 1928810 - RNA, 21 nt, Shigella flexneri 2a str. 2457T
uccugccggacguguuuucac

SEQ ID NO: 1928811 - RNA, 21 nt, Shigella flexneri 2a str. 2457T
uccuggcuguuacucaacuga

SEQ ID NO: 1928812 - RNA, 18 nt, Shigella flexneri 2a str. 2457T
uccuggcuugccagccau

SEQ ID NO: 1928813 - RNA, 14 nt, Shigella flexneri 2a str. 2457T
uccuggcuuggcug

SEQ ID NO: 1928814 - RNA, 13 nt, Shigella flexneri 2a str. 2457T
uccuggcgcuggc

SEQ ID NO: 1928815 - RNA, 19 nt, Shigella flexneri 2a str. 2457T
uccuggcgguuaauaauga

SEQ ID NO: 1928816 - RNA, 20 nt, Shigella flexneri 2a str. 2457T
uccuggcgguuaauaaugau

SEQ ID NO: 1928817 - RNA, 21 nt, Shigella flexneri 2a str. 2457T
uccuggcgguuaauaaugauu

SEQ ID NO: 1928818 - RNA, 18 nt, Shigella flexneri 2a str. 2457T
uccuggggucaucagcau

SEQ ID NO: 1928819 - RNA, 18 nt, Shigella flexneri 2a str. 2457T
uccuggggguucaucacc

SEQ ID NO: 1928820 - RNA, 18 nt, Shigella flexneri 2a str. 2457T
uccugguaguccaggaug

SEQ ID NO: 1928821 - RNA, 15 nt, Shigella flexneri 2a str. 2457T
uccugagcacugggg

SEQ ID NO: 1928822 - RNA, 16 nt, Shigella flexneri 2a str. 2457T
uccugagcacuggggc

SEQ ID NO: 1928823 - RNA, 17 nt, Shigella flexneri 2a str. 2457T
uccugagcacuggggcu

SEQ ID NO: 1928824 - RNA, 23 nt, Shigella flexneri 2a str. 2457T
uccugauaaccuuccagcuucgc

SEQ ID NO: 1928825 - RNA, 22 nt, Shigella flexneri 2a str. 2457T
uccugauaaaaaccauucaggc

SEQ ID NO: 1928826 - RNA, 19 nt, Shigella flexneri 2a str. 2457T
uccugaguuaagcaaaaaa

SEQ ID NO: 1928827 - RNA, 18 nt, Shigella flexneri 2a str. 2457T
uccugagcuauaccaugc

SEQ ID NO: 1928828 - RNA, 23 nt, Shigella flexneri 2a str. 2457T
uccugaucaagcacaugcugaca

SEQ ID NO: 1928829 - RNA, 14 nt, Shigella flexneri 2a str. 2457T
uccugcaagccaac

SEQ ID NO: 1928830 - RNA, 14 nt, Shigella flexneri 2a str. 2457T
uccugcaacagcac

SEQ ID NO: 1928831 - RNA, 23 nt, Shigella flexneri 2a str. 2457T
uccugcaaacaguaacccggcac

SEQ ID NO: 1928832 - RNA, 18 nt, Shigella flexneri 2a str. 2457T
uccugccgaucaacugcg

SEQ ID NO: 1928833 - RNA, 14 nt, Shigella flexneri 2a str. 2457T
uccugccacuguuc

SEQ ID NO: 1928834 - RNA, 17 nt, Shigella flexneri 2a str. 2457T
uccugccaguuuuuccg

SEQ ID NO: 1928835 - RNA, 21 nt, Shigella flexneri 2a str. 2457T
ucgaugcggcucagccagacg

SEQ ID NO: 1928836 - RNA, 15 nt, Shigella flexneri 2a str. 2457T
ucgaugcgcuggcgg

SEQ ID NO: 1928837 - RNA, 19 nt, Shigella flexneri 2a str. 2457T
ucgaugccuugugggccug

SEQ ID NO: 1928838 - RNA, 16 nt, Shigella flexneri 2a str. 2457T
ucgaugcgcaauuaaa

SEQ ID NO: 1928839 - RNA, 15 nt, Shigella flexneri 2a str. 2457T
ucgauuuuuaaugaa

SEQ ID NO: 1928840 - RNA, 19 nt, Shigella flexneri 2a str. 2457T
ucgauccagugauuccagu

SEQ ID NO: 1928841 - RNA, 18 nt, Shigella flexneri 2a str. 2457T
ucgauaccaucgcuucau

SEQ ID NO: 1928842 - RNA, 19 nt, Shigella flexneri 2a str. 2457T
ucgagcgguaaaccguuau

SEQ ID NO: 1928843 - RNA, 12 nt, Shigella flexneri 2a str. 2457T
ucgccagcucaa

SEQ ID NO: 1928844 - RNA, 15 nt, Shigella flexneri 2a str. 2457T
ucgccagcggcagcu

SEQ ID NO: 1928845 - RNA, 22 nt, Shigella flexneri 2a str. 2457T
ucgccagauagauugcgcuggc

SEQ ID NO: 1928846 - RNA, 16 nt, Shigella flexneri 2a str. 2457T
ucgccacggcaugaaa

SEQ ID NO: 1928847 - RNA, 19 nt, Shigella flexneri 2a str. 2457T
ucgccacggcaugaaagcg

SEQ ID NO: 1928848 - RNA, 16 nt, Shigella flexneri 2a str. 2457T
ucgccacuaaagccug

SEQ ID NO: 1928849 - RNA, 13 nt, Shigella flexneri 2a str. 2457T
ucgccagaaauca

SEQ ID NO: 1928850 - RNA, 17 nt, Shigella flexneri 2a str. 2457T
ucgcaaacaguacaucu

SEQ ID NO: 1928851 - RNA, 22 nt, Shigella flexneri 2a str. 2457T
ucgcagaugaauuuaucuuuaa

SEQ ID NO: 1928852 - RNA, 17 nt, Shigella flexneri 2a str. 2457T
ucgcagcaaacgaaagc

SEQ ID NO: 1928853 - RNA, 22 nt, Shigella flexneri 2a str. 2457T
ucgcagagaucauacagaugcu

SEQ ID NO: 1928854 - RNA, 21 nt, Shigella flexneri 2a str. 2457T
ucgcaaauugacuacaccauu

SEQ ID NO: 1928855 - RNA, 18 nt, Shigella flexneri 2a str. 2457T
ucgcaaauauuucacccg

SEQ ID NO: 1928856 - RNA, 17 nt, Shigella flexneri 2a str. 2457T
ucgcagcgugcucucaa

SEQ ID NO: 1928857 - RNA, 23 nt, Shigella flexneri 2a str. 2457T
ucgcaucccgguaucaaagcgcc

SEQ ID NO: 1928858 - RNA, 16 nt, Shigella flexneri 2a str. 2457T
ucgcauccgacaucaa

SEQ ID NO: 1928859 - RNA, 13 nt, Shigella flexneri 2a str. 2457T
ucgcauccucuuu

SEQ ID NO: 1928860 - RNA, 17 nt, Shigella flexneri 2a str. 2457T
ucgcaucggauugcucc

SEQ ID NO: 1928861 - RNA, 15 nt, Shigella flexneri 2a str. 2457T
ucgcaggcugagaaa

SEQ ID NO: 1928862 - RNA, 23 nt, Shigella flexneri 2a str. 2457T
ucgcauggccuaaauccuccacg

SEQ ID NO: 1928863 - RNA, 17 nt, Shigella flexneri 2a str. 2457T
ucgcauuaacagccaga

SEQ ID NO: 1928864 - RNA, 18 nt, Shigella flexneri 2a str. 2457T
uccuuaacuccucgccuu

SEQ ID NO: 1928865 - RNA, 14 nt, Shigella flexneri 2a str. 2457T
uccuuaaacaccug

SEQ ID NO: 1928866 - RNA, 17 nt, Shigella flexneri 2a str. 2457T
uccuguugcguuaagcc

SEQ ID NO: 1928867 - RNA, 15 nt, Shigella flexneri 2a str. 2457T
uccuguugaaaaacc

SEQ ID NO: 1928868 - RNA, 21 nt, Shigella flexneri 2a str. 2457T
ucgaaggauaaugaaggauga

SEQ ID NO: 1928869 - RNA, 14 nt, Shigella flexneri 2a str. 2457T
ucgaagcuucucau

SEQ ID NO: 1928870 - RNA, 21 nt, Shigella flexneri 2a str. 2457T
ucgaaugccgucgaggaacau

SEQ ID NO: 1928871 - RNA, 15 nt, Shigella flexneri 2a str. 2457T
ucgaauuacacagcc

SEQ ID NO: 1928872 - RNA, 14 nt, Shigella flexneri 2a str. 2457T
ucgacaucugcaau

SEQ ID NO: 1928873 - RNA, 15 nt, Shigella flexneri 2a str. 2457T
ucgacaucaagaaau

SEQ ID NO: 1928874 - RNA, 14 nt, Shigella flexneri 2a str. 2457T
ucgacauauucacc

SEQ ID NO: 1928875 - RNA, 15 nt, Shigella flexneri 2a str. 2457T
ucgacaguugcugcg

SEQ ID NO: 1928876 - RNA, 15 nt, Shigella flexneri 2a str. 2457T
ucgacaguuucaccu

SEQ ID NO: 1928877 - RNA, 17 nt, Shigella flexneri 2a str. 2457T
ucgacaaaaucggaaac

SEQ ID NO: 1928878 - RNA, 22 nt, Shigella flexneri 2a str. 2457T
ucgaccugcgccugcaccauug

SEQ ID NO: 1928879 - RNA, 21 nt, Shigella flexneri 2a str. 2457T
ucgaccaggccaucagcagcg

SEQ ID NO: 1928880 - RNA, 12 nt, Shigella flexneri 2a str. 2457T
ucgaccagccag

SEQ ID NO: 1928881 - RNA, 12 nt, Shigella flexneri 2a str. 2457T
ucgacuggagcc

SEQ ID NO: 1928882 - RNA, 13 nt, Shigella flexneri 2a str. 2457T
ucgacuccuauua

SEQ ID NO: 1928883 - RNA, 17 nt, Shigella flexneri 2a str. 2457T
ucgacuaaccugagagu

SEQ ID NO: 1928884 - RNA, 17 nt, Shigella flexneri 2a str. 2457T
ucgacguccaaucagca

SEQ ID NO: 1928885 - RNA, 22 nt, Shigella flexneri 2a str. 2457T
ucgacgacaacgcggcacagca

SEQ ID NO: 1928886 - RNA, 12 nt, Shigella flexneri 2a str. 2457T
ucgacgggccca

SEQ ID NO: 1928887 - RNA, 20 nt, Shigella flexneri 2a str. 2457T
ucgacggggugcgguaaaac

SEQ ID NO: 1928888 - RNA, 18 nt, Shigella flexneri 2a str. 2457T
ucgacggggauguuccau

SEQ ID NO: 1928889 - RNA, 20 nt, Shigella flexneri 2a str. 2457T
ucgagacgggcgaggaaauu

SEQ ID NO: 1928890 - RNA, 20 nt, Shigella flexneri 2a str. 2457T
ucgagauucuuaaagucuuu

SEQ ID NO: 1928891 - RNA, 19 nt, Shigella flexneri 2a str. 2457T
ucgagaagaccauuaucau

SEQ ID NO: 1928892 - RNA, 20 nt, Shigella flexneri 2a str. 2457T
ucgagaacacgguaaugacu

SEQ ID NO: 1928893 - RNA, 13 nt, Shigella flexneri 2a str. 2457T
ucgagcagagaaa

SEQ ID NO: 1928894 - RNA, 16 nt, Shigella flexneri 2a str. 2457T
ucgagcgacagauuca

SEQ ID NO: 1928895 - RNA, 13 nt, Shigella flexneri 2a str. 2457T
ucgagccuuuacg

SEQ ID NO: 1928896 - RNA, 22 nt, Shigella flexneri 2a str. 2457T
ucgcggcgauauccagcgcggc

SEQ ID NO: 1928897 - RNA, 20 nt, Shigella flexneri 2a str. 2457T
ucgcgcuuaucgccagcgcc

SEQ ID NO: 1928898 - RNA, 17 nt, Shigella flexneri 2a str. 2457T
ucgcgccaucaaaucug

SEQ ID NO: 1928899 - RNA, 19 nt, Shigella flexneri 2a str. 2457T
ucgcgccgcauccggcauu

SEQ ID NO: 1928900 - RNA, 12 nt, Shigella flexneri 2a str. 2457T
ucgcgccagcca

SEQ ID NO: 1928901 - RNA, 14 nt, Shigella flexneri 2a str. 2457T
ucgcgccagccagu

SEQ ID NO: 1928902 - RNA, 24 nt, Shigella flexneri 2a str. 2457T
ucgcgcaauugccagacaacauga

SEQ ID NO: 1928903 - RNA, 23 nt, Shigella flexneri 2a str. 2457T
ucgccugaaaguauuugacuguu

SEQ ID NO: 1928904 - RNA, 16 nt, Shigella flexneri 2a str. 2457T
ucgccuuucggcugca

SEQ ID NO: 1928905 - RNA, 17 nt, Shigella flexneri 2a str. 2457T
ucgccugcaccaugucc

SEQ ID NO: 1928906 - RNA, 13 nt, Shigella flexneri 2a str. 2457T
ucgccuccuguuc

SEQ ID NO: 1928907 - RNA, 19 nt, Shigella flexneri 2a str. 2457T
ucgccuuucggcugcagca

SEQ ID NO: 1928908 - RNA, 12 nt, Shigella flexneri 2a str. 2457T
ucgcgaaaugca

SEQ ID NO: 1928909 - RNA, 15 nt, Shigella flexneri 2a str. 2457T
ucgcgaaaaaaagau

SEQ ID NO: 1928910 - RNA, 23 nt, Shigella flexneri 2a str. 2457T
ucgcgaccgccucgcgccagcgu

SEQ ID NO: 1928911 - RNA, 18 nt, Shigella flexneri 2a str. 2457T
ucgcgacgaccacccacc

SEQ ID NO: 1928912 - RNA, 15 nt, Shigella flexneri 2a str. 2457T
ucgcgauauugcugc

SEQ ID NO: 1928913 - RNA, 13 nt, Shigella flexneri 2a str. 2457T
ucgccgccgcugg

SEQ ID NO: 1928914 - RNA, 23 nt, Shigella flexneri 2a str. 2457T
ucgccaggcguuugaaaaagcca

SEQ ID NO: 1928915 - RNA, 17 nt, Shigella flexneri 2a str. 2457T
ucgccagguuaaacauc

SEQ ID NO: 1928916 - RNA, 20 nt, Shigella flexneri 2a str. 2457T
ucgccagugccgcccaccac

SEQ ID NO: 1928917 - RNA, 21 nt, Shigella flexneri 2a str. 2457T
ucggagaacugcaacucaccu

SEQ ID NO: 1928918 - RNA, 22 nt, Shigella flexneri 2a str. 2457T
ucggcaacuuuggguugccgcc

SEQ ID NO: 1928919 - RNA, 16 nt, Shigella flexneri 2a str. 2457T
ucggcaaucacgcccg

SEQ ID NO: 1928920 - RNA, 23 nt, Shigella flexneri 2a str. 2457T
ucggcacugcgaccgaucaccac

SEQ ID NO: 1928921 - RNA, 13 nt, Shigella flexneri 2a str. 2457T
ucggcacugacca

SEQ ID NO: 1928922 - RNA, 13 nt, Shigella flexneri 2a str. 2457T
ucggaauaagacu

SEQ ID NO: 1928923 - RNA, 15 nt, Shigella flexneri 2a str. 2457T
ucggaaugcaccgcc

SEQ ID NO: 1928924 - RNA, 20 nt, Shigella flexneri 2a str. 2457T
ucggaaugcaccgccugaua

SEQ ID NO: 1928925 - RNA, 18 nt, Shigella flexneri 2a str. 2457T
ucgcuugcaggaucagcu

SEQ ID NO: 1928926 - RNA, 20 nt, Shigella flexneri 2a str. 2457T
ucggaaacaaauacaugaug

SEQ ID NO: 1928927 - RNA, 22 nt, Shigella flexneri 2a str. 2457T
ucgcuuaagccaucaucaauau

SEQ ID NO: 1928928 - RNA, 18 nt, Shigella flexneri 2a str. 2457T
ucgcugccgauaauacuc

SEQ ID NO: 1928929 - RNA, 13 nt, Shigella flexneri 2a str. 2457T
ucgcuuaauugac

SEQ ID NO: 1928930 - RNA, 11 nt, Shigella flexneri 2a str. 2457T
ucgcuucaacc

SEQ ID NO: 1928931 - RNA, 18 nt, Shigella flexneri 2a str. 2457T
ucgcuuccauugagaaag

SEQ ID NO: 1928932 - RNA, 19 nt, Shigella flexneri 2a str. 2457T
ucgcuuccauugagaaagc

SEQ ID NO: 1928933 - RNA, 16 nt, Shigella flexneri 2a str. 2457T
ucgcuucaugcccgcc

SEQ ID NO: 1928934 - RNA, 16 nt, Shigella flexneri 2a str. 2457T
ucgcuucuagugcuug

SEQ ID NO: 1928935 - RNA, 14 nt, Shigella flexneri 2a str. 2457T
ucgcuucuagugcu

SEQ ID NO: 1928936 - RNA, 20 nt, Shigella flexneri 2a str. 2457T
ucgcugaacgggccauccau

SEQ ID NO: 1928937 - RNA, 21 nt, Shigella flexneri 2a str. 2457T
ucgcugaacgggccauccauc

SEQ ID NO: 1928938 - RNA, 17 nt, Shigella flexneri 2a str. 2457T
ucgcucucuuucucgcu

SEQ ID NO: 1928939 - RNA, 20 nt, Shigella flexneri 2a str. 2457T
ucgcugauauacccuucauc

SEQ ID NO: 1928940 - RNA, 23 nt, Shigella flexneri 2a str. 2457T
ucgcugauccucuaucuguuugc

SEQ ID NO: 1928941 - RNA, 19 nt, Shigella flexneri 2a str. 2457T
ucgcugauuucaccaucuu

SEQ ID NO: 1928942 - RNA, 16 nt, Shigella flexneri 2a str. 2457T
ucgcucaucugcugcg

SEQ ID NO: 1928943 - RNA, 22 nt, Shigella flexneri 2a str. 2457T
ucgcucauaugacguaucaccg

SEQ ID NO: 1928944 - RNA, 20 nt, Shigella flexneri 2a str. 2457T
ucgcuccauuccaucgccug

SEQ ID NO: 1928945 - RNA, 21 nt, Shigella flexneri 2a str. 2457T
ucgcucgcgccgcauccgaca

SEQ ID NO: 1928946 - RNA, 20 nt, Shigella flexneri 2a str. 2457T
ucgcuacuauggaacgcuca

SEQ ID NO: 1928947 - RNA, 13 nt, Shigella flexneri 2a str. 2457T
ucgcuaccuuuca

SEQ ID NO: 1928948 - RNA, 16 nt, Shigella flexneri 2a str. 2457T
ucgcuaucagcgccac

SEQ ID NO: 1928949 - RNA, 17 nt, Shigella flexneri 2a str. 2457T
ucgcguugucauacgag

SEQ ID NO: 1928950 - RNA, 20 nt, Shigella flexneri 2a str. 2457T
ucgcuacaccaaucgucaau

SEQ ID NO: 1928951 - RNA, 22 nt, Shigella flexneri 2a str. 2457T
ucgcuaauuucgccgaggcgcu

SEQ ID NO: 1928952 - RNA, 18 nt, Shigella flexneri 2a str. 2457T
ucgcgguaaacugcgucg

SEQ ID NO: 1928953 - RNA, 15 nt, Shigella flexneri 2a str. 2457T
ucgcggucaaccauc

SEQ ID NO: 1928954 - RNA, 18 nt, Shigella flexneri 2a str. 2457T
ucgcgucuaaauuuugca

SEQ ID NO: 1928955 - RNA, 17 nt, Shigella flexneri 2a str. 2457T
uccgcaaagcgccaggg

SEQ ID NO: 1928956 - RNA, 22 nt, Shigella flexneri 2a str. 2457T
uccgcaagcgaaugaggcagca

SEQ ID NO: 1928957 - RNA, 15 nt, Shigella flexneri 2a str. 2457T
uccgaucgcgcauca

SEQ ID NO: 1928958 - RNA, 16 nt, Shigella flexneri 2a str. 2457T
uccgauuaccggcaac

SEQ ID NO: 1928959 - RNA, 15 nt, Shigella flexneri 2a str. 2457T
uccgauauucaauug

SEQ ID NO: 1928960 - RNA, 23 nt, Shigella flexneri 2a str. 2457T
uccgagaaucguacucaccagac

SEQ ID NO: 1928961 - RNA, 18 nt, Shigella flexneri 2a str. 2457T
uccgacauuucugcugcc

SEQ ID NO: 1928962 - RNA, 22 nt, Shigella flexneri 2a str. 2457T
uccgaccaggcguucugccugg

SEQ ID NO: 1928963 - RNA, 20 nt, Shigella flexneri 2a str. 2457T
uccgaagccggacugggcgc

SEQ ID NO: 1928964 - RNA, 13 nt, Shigella flexneri 2a str. 2457T
uccgaaaaaggau

SEQ ID NO: 1928965 - RNA, 16 nt, Shigella flexneri 2a str. 2457T
ucccuugcucugguuc

SEQ ID NO: 1928966 - RNA, 15 nt, Shigella flexneri 2a str. 2457T
ucccuuucucuucaa

SEQ ID NO: 1928967 - RNA, 21 nt, Shigella flexneri 2a str. 2457T
ucccuuccgcaauacagccag

SEQ ID NO: 1928968 - RNA, 18 nt, Shigella flexneri 2a str. 2457T
ucccuucagccaccaggu

SEQ ID NO: 1928969 - RNA, 14 nt, Shigella flexneri 2a str. 2457T
ucccugucucucag

SEQ ID NO: 1928970 - RNA, 17 nt, Shigella flexneri 2a str. 2457T
ucccuuagcuaauuuuu

SEQ ID NO: 1928971 - RNA, 18 nt, Shigella flexneri 2a str. 2457T
ucccugcgccagcggcag

SEQ ID NO: 1928972 - RNA, 16 nt, Shigella flexneri 2a str. 2457T
ucccugcuguccugag

SEQ ID NO: 1928973 - RNA, 19 nt, Shigella flexneri 2a str. 2457T
ucccugcugaauccccuuc

SEQ ID NO: 1928974 - RNA, 11 nt, Shigella flexneri 2a str. 2457T
ucccugcggua

SEQ ID NO: 1928975 - RNA, 15 nt, Shigella flexneri 2a str. 2457T
ucccugaaggcugcc

SEQ ID NO: 1928976 - RNA, 18 nt, Shigella flexneri 2a str. 2457T
ucccugacgauagauaga

SEQ ID NO: 1928977 - RNA, 22 nt, Shigella flexneri 2a str. 2457T
ucccugcaauagauugaauuag

SEQ ID NO: 1928978 - RNA, 20 nt, Shigella flexneri 2a str. 2457T
ucccugaugcaucagucacg

SEQ ID NO: 1928979 - RNA, 21 nt, Shigella flexneri 2a str. 2457T
ucccucgucgguggugguccc

SEQ ID NO: 1928980 - RNA, 11 nt, Shigella flexneri 2a str. 2457T
ucccugaaggc

SEQ ID NO: 1928981 - RNA, 22 nt, Shigella flexneri 2a str. 2457T
ucccugaauaacaccagccaga

SEQ ID NO: 1928982 - RNA, 15 nt, Shigella flexneri 2a str. 2457T
ucccugacaaaucau

SEQ ID NO: 1928983 - RNA, 21 nt, Shigella flexneri 2a str. 2457T
ucccugacaaaucaugcggau

SEQ ID NO: 1928984 - RNA, 22 nt, Shigella flexneri 2a str. 2457T
ucccugacaaaucaugcggaua

SEQ ID NO: 1928985 - RNA, 18 nt, Shigella flexneri 2a str. 2457T
ucccuccacuccgguguu

SEQ ID NO: 1928986 - RNA, 17 nt, Shigella flexneri 2a str. 2457T
ucccucccguuucccug

SEQ ID NO: 1928987 - RNA, 19 nt, Shigella flexneri 2a str. 2457T
ucccucccguuucccuguc

SEQ ID NO: 1928988 - RNA, 23 nt, Shigella flexneri 2a str. 2457T
ucccucaacaacagucucugccg

SEQ ID NO: 1928989 - RNA, 22 nt, Shigella flexneri 2a str. 2457T
ucccucaacaacagucucugcc

SEQ ID NO: 1928990 - RNA, 14 nt, Shigella flexneri 2a str. 2457T
ucccuaaaauauug

SEQ ID NO: 1928991 - RNA, 12 nt, Shigella flexneri 2a str. 2457T
ucccuaaaauau

SEQ ID NO: 1928992 - RNA, 19 nt, Shigella flexneri 2a str. 2457T
ucccgucaggagcuggaug

SEQ ID NO: 1928993 - RNA, 14 nt, Shigella flexneri 2a str. 2457T
ucccgugcacaaau

SEQ ID NO: 1928994 - RNA, 13 nt, Shigella flexneri 2a str. 2457T
ucccggugaagcg

SEQ ID NO: 1928995 - RNA, 15 nt, Shigella flexneri 2a str. 2457T
ucccggcagagaaaa

SEQ ID NO: 1928996 - RNA, 16 nt, Shigella flexneri 2a str. 2457T
ucccggcauuucugau

SEQ ID NO: 1928997 - RNA, 14 nt, Shigella flexneri 2a str. 2457T
ucccgcucuguaag

SEQ ID NO: 1928998 - RNA, 12 nt, Shigella flexneri 2a str. 2457T
ucccgcuggugc

SEQ ID NO: 1928999 - RNA, 18 nt, Shigella flexneri 2a str. 2457T
ucccgcuucguuuucagc

SEQ ID NO: 1929000 - RNA, 19 nt, Shigella flexneri 2a str. 2457T
ucccgcuucguuuucagcu

SEQ ID NO: 1929001 - RNA, 14 nt, Shigella flexneri 2a str. 2457T
ucccggaagccacc

SEQ ID NO: 1929002 - RNA, 21 nt, Shigella flexneri 2a str. 2457T
ucccggcaaucaccgccagcg

SEQ ID NO: 1929003 - RNA, 16 nt, Shigella flexneri 2a str. 2457T
ucccggcaagauucca

SEQ ID NO: 1929004 - RNA, 14 nt, Shigella flexneri 2a str. 2457T
ucccggauauccca

SEQ ID NO: 1929005 - RNA, 13 nt, Shigella flexneri 2a str. 2457T
uccccugcaauau

SEQ ID NO: 1929006 - RNA, 14 nt, Shigella flexneri 2a str. 2457T
ucccgaaaaaccug

SEQ ID NO: 1929007 - RNA, 21 nt, Shigella flexneri 2a str. 2457T
uccccuucucaaucccuuucu

SEQ ID NO: 1929008 - RNA, 20 nt, Shigella flexneri 2a str. 2457T
uccccggcagugcuuucauu

SEQ ID NO: 1929009 - RNA, 21 nt, Shigella flexneri 2a str. 2457T
uccccggcgcggugcuggaug

SEQ ID NO: 1929010 - RNA, 15 nt, Shigella flexneri 2a str. 2457T
uccccguaucuucau

SEQ ID NO: 1929011 - RNA, 11 nt, Shigella flexneri 2a str. 2457T
uccccggugaa

SEQ ID NO: 1929012 - RNA, 16 nt, Shigella flexneri 2a str. 2457T
uccccuccagcgagcu

SEQ ID NO: 1929013 - RNA, 14 nt, Shigella flexneri 2a str. 2457T
uccccucgcuccuc

SEQ ID NO: 1929014 - RNA, 16 nt, Shigella flexneri 2a str. 2457T
uccccucacccuaacc

SEQ ID NO: 1929015 - RNA, 22 nt, Shigella flexneri 2a str. 2457T
uccccucaucagugaacccaua

SEQ ID NO: 1929016 - RNA, 20 nt, Shigella flexneri 2a str. 2457T
ucccgcgauggcccggcggu

SEQ ID NO: 1929017 - RNA, 19 nt, Shigella flexneri 2a str. 2457T
ucccgcgauuuccugaccc

SEQ ID NO: 1929018 - RNA, 14 nt, Shigella flexneri 2a str. 2457T
ucccgccagcacca

SEQ ID NO: 1929019 - RNA, 17 nt, Shigella flexneri 2a str. 2457T
ucccgcagauaaauauc

SEQ ID NO: 1929020 - RNA, 19 nt, Shigella flexneri 2a str. 2457T
ucccgcaggagcgccgaau

SEQ ID NO: 1929021 - RNA, 13 nt, Shigella flexneri 2a str. 2457T
ucccgcaccagcg

SEQ ID NO: 1929022 - RNA, 20 nt, Shigella flexneri 2a str. 2457T
ucccgauggucagcuucacc

SEQ ID NO: 1929023 - RNA, 17 nt, Shigella flexneri 2a str. 2457T
ucccacuuuuauuucac

SEQ ID NO: 1929024 - RNA, 15 nt, Shigella flexneri 2a str. 2457T
ucccagaauguuaac

SEQ ID NO: 1929025 - RNA, 14 nt, Shigella flexneri 2a str. 2457T
ucccagaccuucau

SEQ ID NO: 1929026 - RNA, 19 nt, Shigella flexneri 2a str. 2457T
ucccacgcggcaacggcuu

SEQ ID NO: 1929027 - RNA, 16 nt, Shigella flexneri 2a str. 2457T
ucccaccugaaauggu

SEQ ID NO: 1929028 - RNA, 16 nt, Shigella flexneri 2a str. 2457T
ucccaccgggcaacug

SEQ ID NO: 1929029 - RNA, 17 nt, Shigella flexneri 2a str. 2457T
ucccaauugcacauauu

SEQ ID NO: 1929030 - RNA, 18 nt, Shigella flexneri 2a str. 2457T
ucccaacaacagcgcgcu

SEQ ID NO: 1929031 - RNA, 21 nt, Shigella flexneri 2a str. 2457T
ucccaaauaugaaaucucuug

SEQ ID NO: 1929032 - RNA, 13 nt, Shigella flexneri 2a str. 2457T
ucccaacaacagc

SEQ ID NO: 1929033 - RNA, 12 nt, Shigella flexneri 2a str. 2457T
uccauuuuucac

SEQ ID NO: 1929034 - RNA, 17 nt, Shigella flexneri 2a str. 2457T
uccauuuuucacuuaau

SEQ ID NO: 1929035 - RNA, 22 nt, Shigella flexneri 2a str. 2457T
ucccaaaagcucggucauugcc

SEQ ID NO: 1929036 - RNA, 18 nt, Shigella flexneri 2a str. 2457T
uccauuucccugacaaau

SEQ ID NO: 1929037 - RNA, 21 nt, Shigella flexneri 2a str. 2457T
uccauuggcggcguccuggaa

SEQ ID NO: 1929038 - RNA, 20 nt, Shigella flexneri 2a str. 2457T
uccauucaccauuuuuuaau

SEQ ID NO: 1929039 - RNA, 21 nt, Shigella flexneri 2a str. 2457T
uccauucaccauuuuuuaauu

SEQ ID NO: 1929040 - RNA, 20 nt, Shigella flexneri 2a str. 2457T
uccauucaaacgugaacagc

SEQ ID NO: 1929041 - RNA, 20 nt, Shigella flexneri 2a str. 2457T
uccauucuggauaaucaaug

SEQ ID NO: 1929042 - RNA, 16 nt, Shigella flexneri 2a str. 2457T
uccauucgcugcugcg

SEQ ID NO: 1929043 - RNA, 19 nt, Shigella flexneri 2a str. 2457T
uccaucgucuccagagcag

SEQ ID NO: 1929044 - RNA, 14 nt, Shigella flexneri 2a str. 2457T
uccaugaaaauaga

SEQ ID NO: 1929045 - RNA, 22 nt, Shigella flexneri 2a str. 2457T
ucccagcccccgcaauuccggu

SEQ ID NO: 1929046 - RNA, 20 nt, Shigella flexneri 2a str. 2457T
ucccagccggguaagaaaag

SEQ ID NO: 1929047 - RNA, 13 nt, Shigella flexneri 2a str. 2457T
ucccagucauccg

SEQ ID NO: 1929048 - RNA, 15 nt, Shigella flexneri 2a str. 2457T
ucccagucuucauca

SEQ ID NO: 1929049 - RNA, 16 nt, Shigella flexneri 2a str. 2457T
ucccauaaccaacaau

SEQ ID NO: 1929050 - RNA, 23 nt, Shigella flexneri 2a str. 2457T
ucccauuuauuuuuccuccauug

SEQ ID NO: 1929051 - RNA, 20 nt, Shigella flexneri 2a str. 2457T
uccccacaggcgaugcacau

SEQ ID NO: 1929052 - RNA, 15 nt, Shigella flexneri 2a str. 2457T
uccccaaugaccuuu

SEQ ID NO: 1929053 - RNA, 16 nt, Shigella flexneri 2a str. 2457T
uccccaccucaucaga

SEQ ID NO: 1929054 - RNA, 18 nt, Shigella flexneri 2a str. 2457T
uccccagcggaaaauauc

SEQ ID NO: 1929055 - RNA, 22 nt, Shigella flexneri 2a str. 2457T
uccccaguaaucgggcaacugc

SEQ ID NO: 1929056 - RNA, 13 nt, Shigella flexneri 2a str. 2457T
uccccagacaaaa

SEQ ID NO: 1929057 - RNA, 22 nt, Shigella flexneri 2a str. 2457T
uccccagaauccaggaaagcca

SEQ ID NO: 1929058 - RNA, 12 nt, Shigella flexneri 2a str. 2457T
ucccccacagcu

SEQ ID NO: 1929059 - RNA, 13 nt, Shigella flexneri 2a str. 2457T
uccccauaucccg

SEQ ID NO: 1929060 - RNA, 15 nt, Shigella flexneri 2a str. 2457T
uccccauaucccgga

SEQ ID NO: 1929061 - RNA, 15 nt, Shigella flexneri 2a str. 2457T
uccccgccucaccgc

SEQ ID NO: 1929062 - RNA, 21 nt, Shigella flexneri 2a str. 2457T
uccccggcaaccacacccaca

SEQ ID NO: 1929063 - RNA, 16 nt, Shigella flexneri 2a str. 2457T
uccccgcuucgcccgc

SEQ ID NO: 1929064 - RNA, 15 nt, Shigella flexneri 2a str. 2457T
uccccgagaaauacu

SEQ ID NO: 1929065 - RNA, 18 nt, Shigella flexneri 2a str. 2457T
ucccccuuucugagagga

SEQ ID NO: 1929066 - RNA, 19 nt, Shigella flexneri 2a str. 2457T
uccacaacggcauuauuca

SEQ ID NO: 1929067 - RNA, 15 nt, Shigella flexneri 2a str. 2457T
uccacaagaaugccu

SEQ ID NO: 1929068 - RNA, 21 nt, Shigella flexneri 2a str. 2457T
uccacaacgugggccuggcgu

SEQ ID NO: 1929069 - RNA, 20 nt, Shigella flexneri 2a str. 2457T
uccaacuuacugauaguguu

SEQ ID NO: 1929070 - RNA, 16 nt, Shigella flexneri 2a str. 2457T
uccaccacgcugcaug

SEQ ID NO: 1929071 - RNA, 22 nt, Shigella flexneri 2a str. 2457T
uccaccaccgcaaaauagguau

SEQ ID NO: 1929072 - RNA, 21 nt, Shigella flexneri 2a str. 2457T
uccacaugguuuucaauuauc

SEQ ID NO: 1929073 - RNA, 20 nt, Shigella flexneri 2a str. 2457T
uccacauauuauugaaauca

SEQ ID NO: 1929074 - RNA, 15 nt, Shigella flexneri 2a str. 2457T
uccacauaaaguagc

SEQ ID NO: 1929075 - RNA, 15 nt, Shigella flexneri 2a str. 2457T
uccacagucaggcug

SEQ ID NO: 1929076 - RNA, 16 nt, Shigella flexneri 2a str. 2457T
uccaccgaaauaauca

SEQ ID NO: 1929077 - RNA, 14 nt, Shigella flexneri 2a str. 2457T
uccacccgcagcca

SEQ ID NO: 1929078 - RNA, 15 nt, Shigella flexneri 2a str. 2457T
uccaccgauuuugag

SEQ ID NO: 1929079 - RNA, 19 nt, Shigella flexneri 2a str. 2457T
uccaccgcguucagcagcu

SEQ ID NO: 1929080 - RNA, 19 nt, Shigella flexneri 2a str. 2457T
uccaccguuucuuuuucga

SEQ ID NO: 1929081 - RNA, 10 nt, Shigella flexneri 2a str. 2457T
uccaccagug

SEQ ID NO: 1929082 - RNA, 13 nt, Shigella flexneri 2a str. 2457T
uccaccagcacca

SEQ ID NO: 1929083 - RNA, 13 nt, Shigella flexneri 2a str. 2457T
uccaccagcggcu

SEQ ID NO: 1929084 - RNA, 13 nt, Shigella flexneri 2a str. 2457T
uccaccagcgcgu

SEQ ID NO: 1929085 - RNA, 17 nt, Shigella flexneri 2a str. 2457T
uccacgcccagcgcagg

SEQ ID NO: 1929086 - RNA, 18 nt, Shigella flexneri 2a str. 2457T
uccaccuucuguaacugg

SEQ ID NO: 1929087 - RNA, 17 nt, Shigella flexneri 2a str. 2457T
uccacgcgccacgcacg

SEQ ID NO: 1929088 - RNA, 15 nt, Shigella flexneri 2a str. 2457T
uccacgguucuccac

SEQ ID NO: 1929089 - RNA, 19 nt, Shigella flexneri 2a str. 2457T
uccacgguugguuuuaucc

SEQ ID NO: 1929090 - RNA, 19 nt, Shigella flexneri 2a str. 2457T
uccacggggacuccacacc

SEQ ID NO: 1929091 - RNA, 17 nt, Shigella flexneri 2a str. 2457T
uccacggaaucaccgcc

SEQ ID NO: 1929092 - RNA, 21 nt, Shigella flexneri 2a str. 2457T
uccacggacugaacgcccacg

SEQ ID NO: 1929093 - RNA, 16 nt, Shigella flexneri 2a str. 2457T
uccacuuucacgccca

SEQ ID NO: 1929094 - RNA, 16 nt, Shigella flexneri 2a str. 2457T
uccacuuccaccagcg

SEQ ID NO: 1929095 - RNA, 21 nt, Shigella flexneri 2a str. 2457T
uccacuucugcacgguuuuuc

SEQ ID NO: 1929096 - RNA, 14 nt, Shigella flexneri 2a str. 2457T
uccacuugaaaauu

SEQ ID NO: 1929097 - RNA, 14 nt, Shigella flexneri 2a str. 2457T
uccacuuccaccac

SEQ ID NO: 1929098 - RNA, 21 nt, Shigella flexneri 2a str. 2457T
uccacuuccgcgucaaucugc

SEQ ID NO: 1929099 - RNA, 17 nt, Shigella flexneri 2a str. 2457T
uccacuucauaauccag

SEQ ID NO: 1929100 - RNA, 21 nt, Shigella flexneri 2a str. 2457T
uccacuucaucaagcaaggcc

SEQ ID NO: 1929101 - RNA, 15 nt, Shigella flexneri 2a str. 2457T
uccacugcgagaaaa

SEQ ID NO: 1929102 - RNA, 14 nt, Shigella flexneri 2a str. 2457T
uccacguuccccag

SEQ ID NO: 1929103 - RNA, 18 nt, Shigella flexneri 2a str. 2457T
uccacuauuucaauauga

SEQ ID NO: 1929104 - RNA, 22 nt, Shigella flexneri 2a str. 2457T
uccagacgggucauaaucagau

SEQ ID NO: 1929105 - RNA, 21 nt, Shigella flexneri 2a str. 2457T
uccagacgcgcagcuucacuu

SEQ ID NO: 1929106 - RNA, 19 nt, Shigella flexneri 2a str. 2457T
uccagaucuuuuugcgcaa

SEQ ID NO: 1929107 - RNA, 22 nt, Shigella flexneri 2a str. 2457T
uccagaucgaucauauuuccuu

SEQ ID NO: 1929108 - RNA, 23 nt, Shigella flexneri 2a str. 2457T
uccagauagaacaucucuuccca

SEQ ID NO: 1929109 - RNA, 23 nt, Shigella flexneri 2a str. 2457T
uccagaauaucuucaaccgucac

SEQ ID NO: 1929110 - RNA, 20 nt, Shigella flexneri 2a str. 2457T
uccagacacuccagagaauu

SEQ ID NO: 1929111 - RNA, 14 nt, Shigella flexneri 2a str. 2457T
uccagacccuucau

SEQ ID NO: 1929112 - RNA, 21 nt, Shigella flexneri 2a str. 2457T
uccagcaccaguucacccuca

SEQ ID NO: 1929113 - RNA, 14 nt, Shigella flexneri 2a str. 2457T
uccagcaccaguuc

SEQ ID NO: 1929114 - RNA, 17 nt, Shigella flexneri 2a str. 2457T
uccagcacggugaagaa

SEQ ID NO: 1929115 - RNA, 18 nt, Shigella flexneri 2a str. 2457T
uccagcacgucgagcagg

SEQ ID NO: 1929116 - RNA, 20 nt, Shigella flexneri 2a str. 2457T
uccagcagaccuucugccag

SEQ ID NO: 1929117 - RNA, 20 nt, Shigella flexneri 2a str. 2457T
uccagaugcgagaugucccc

SEQ ID NO: 1929118 - RNA, 14 nt, Shigella flexneri 2a str. 2457T
uccagauuuuucag

SEQ ID NO: 1929119 - RNA, 17 nt, Shigella flexneri 2a str. 2457T
uccagauuuauaaaaga

SEQ ID NO: 1929120 - RNA, 20 nt, Shigella flexneri 2a str. 2457T
uccagauggcuauaaucacu

SEQ ID NO: 1929121 - RNA, 18 nt, Shigella flexneri 2a str. 2457T
uccagauuaccagcgaca

SEQ ID NO: 1929122 - RNA, 17 nt, Shigella flexneri 2a str. 2457T
uccagcacacuguaagc

SEQ ID NO: 1929123 - RNA, 10 nt, Shigella flexneri 2a str. 2457T
uccagcacca

SEQ ID NO: 1929124 - RNA, 14 nt, Shigella flexneri 2a str. 2457T
uccagcaagccacu

SEQ ID NO: 1929125 - RNA, 19 nt, Shigella flexneri 2a str. 2457T
uccagcaacaacagcgcga

SEQ ID NO: 1929126 - RNA, 14 nt, Shigella flexneri 2a str. 2457T
uccagcaacaacag

SEQ ID NO: 1929127 - RNA, 12 nt, Shigella flexneri 2a str. 2457T
uccagccagagc

SEQ ID NO: 1929128 - RNA, 21 nt, Shigella flexneri 2a str. 2457T
uccagccaccgcguggcagac

SEQ ID NO: 1929129 - RNA, 16 nt, Shigella flexneri 2a str. 2457T
uccagccagucggaac

SEQ ID NO: 1929130 - RNA, 15 nt, Shigella flexneri 2a str. 2457T
uccagcagugccgca

SEQ ID NO: 1929131 - RNA, 15 nt, Shigella flexneri 2a str. 2457T
uccagcauaccuucc

SEQ ID NO: 1929132 - RNA, 22 nt, Shigella flexneri 2a str. 2457T
uccagcauaccuuccagcgcgu

SEQ ID NO: 1929133 - RNA, 18 nt, Shigella flexneri 2a str. 2457T
uccagcauaguacgggca

SEQ ID NO: 1929134 - RNA, 19 nt, Shigella flexneri 2a str. 2457T
uccagcauauguuuacgcu

SEQ ID NO: 1929135 - RNA, 16 nt, Shigella flexneri 2a str. 2457T
uccagcaucuccugca

SEQ ID NO: 1929136 - RNA, 12 nt, Shigella flexneri 2a str. 2457T
uccagcagcccu

SEQ ID NO: 1929137 - RNA, 17 nt, Shigella flexneri 2a str. 2457T
uccagcagcgcaauuaa

SEQ ID NO: 1929138 - RNA, 14 nt, Shigella flexneri 2a str. 2457T
uccagcgauaauga

SEQ ID NO: 1929139 - RNA, 14 nt, Shigella flexneri 2a str. 2457T
uccagcgcugcggc

SEQ ID NO: 1929140 - RNA, 23 nt, Shigella flexneri 2a str. 2457T
uccagcgccauuggcuuuugcuu

SEQ ID NO: 1929141 - RNA, 22 nt, Shigella flexneri 2a str. 2457T
uccagcgccgccagaagggaag

SEQ ID NO: 1929142 - RNA, 20 nt, Shigella flexneri 2a str. 2457T
uccagcgcggcgaaggugcc

SEQ ID NO: 1929143 - RNA, 23 nt, Shigella flexneri 2a str. 2457T
uccaggaagggcauaucagcaac

SEQ ID NO: 1929144 - RNA, 17 nt, Shigella flexneri 2a str. 2457T
uccaggaguuccggguc

SEQ ID NO: 1929145 - RNA, 23 nt, Shigella flexneri 2a str. 2457T
uccaggaguuccgggucauccag

SEQ ID NO: 1929146 - RNA, 20 nt, Shigella flexneri 2a str. 2457T
uccaggagcuccagguccuc

SEQ ID NO: 1929147 - RNA, 17 nt, Shigella flexneri 2a str. 2457T
uccaggagcuccagguc

SEQ ID NO: 1929148 - RNA, 16 nt, Shigella flexneri 2a str. 2457T
uccaggcucgccgccg

SEQ ID NO: 1929149 - RNA, 13 nt, Shigella flexneri 2a str. 2457T
uccagggccucuc

SEQ ID NO: 1929150 - RNA, 15 nt, Shigella flexneri 2a str. 2457T
uccagcuccguccag

SEQ ID NO: 1929151 - RNA, 16 nt, Shigella flexneri 2a str. 2457T
uccagcucuucuucac

SEQ ID NO: 1929152 - RNA, 15 nt, Shigella flexneri 2a str. 2457T
uccagcuuccaggca

SEQ ID NO: 1929153 - RNA, 19 nt, Shigella flexneri 2a str. 2457T
uccagcuuagcauccccau

SEQ ID NO: 1929154 - RNA, 13 nt, Shigella flexneri 2a str. 2457T
uccagcucaacca

SEQ ID NO: 1929155 - RNA, 16 nt, Shigella flexneri 2a str. 2457T
uccagcguuaccggcu

SEQ ID NO: 1929156 - RNA, 17 nt, Shigella flexneri 2a str. 2457T
uccagcguuaccggcuu

SEQ ID NO: 1929157 - RNA, 23 nt, Shigella flexneri 2a str. 2457T
uccagcgguaacuuaucuguaau

SEQ ID NO: 1929158 - RNA, 13 nt, Shigella flexneri 2a str. 2457T
uccaguacgccuu

SEQ ID NO: 1929159 - RNA, 21 nt, Shigella flexneri 2a str. 2457T
uccaguaaugcgcccaugccg

SEQ ID NO: 1929160 - RNA, 16 nt, Shigella flexneri 2a str. 2457T
uccagguuucuuccag

SEQ ID NO: 1929161 - RNA, 22 nt, Shigella flexneri 2a str. 2457T
uccagggggaagcgcaccaauu

SEQ ID NO: 1929162 - RNA, 15 nt, Shigella flexneri 2a str. 2457T
uccaggguaaacauc

SEQ ID NO: 1929163 - RNA, 18 nt, Shigella flexneri 2a str. 2457T
uccaggguaaacaucggu

SEQ ID NO: 1929164 - RNA, 13 nt, Shigella flexneri 2a str. 2457T
uccagguccuccu

SEQ ID NO: 1929165 - RNA, 21 nt, Shigella flexneri 2a str. 2457T
uccagguccuccuguaccuuc

SEQ ID NO: 1929166 - RNA, 14 nt, Shigella flexneri 2a str. 2457T
uccagguauuuaac

SEQ ID NO: 1929167 - RNA, 15 nt, Shigella flexneri 2a str. 2457T
uccagguauuuaacc

SEQ ID NO: 1929168 - RNA, 20 nt, Shigella flexneri 2a str. 2457T
uccaggucaaccuagccuuc

SEQ ID NO: 1929169 - RNA, 19 nt, Shigella flexneri 2a str. 2457T
uccaguucgaucucuucgc

SEQ ID NO: 1929170 - RNA, 15 nt, Shigella flexneri 2a str. 2457T
uccaguucugcuuca

SEQ ID NO: 1929171 - RNA, 20 nt, Shigella flexneri 2a str. 2457T
uccaguuaucgcgauacacc

SEQ ID NO: 1929172 - RNA, 14 nt, Shigella flexneri 2a str. 2457T
uccaguugauacag

SEQ ID NO: 1929173 - RNA, 14 nt, Shigella flexneri 2a str. 2457T
uccaguugguugau

SEQ ID NO: 1929174 - RNA, 17 nt, Shigella flexneri 2a str. 2457T
uccaguuucacuuucac

SEQ ID NO: 1929175 - RNA, 16 nt, Shigella flexneri 2a str. 2457T
uccagucgagaaccug

SEQ ID NO: 1929176 - RNA, 17 nt, Shigella flexneri 2a str. 2457T
uccagucgagaaccuga

SEQ ID NO: 1929177 - RNA, 20 nt, Shigella flexneri 2a str. 2457T
uccagucgcaaaccuggcau

SEQ ID NO: 1929178 - RNA, 22 nt, Shigella flexneri 2a str. 2457T
uccagucggcguaauccugaaa

SEQ ID NO: 1929179 - RNA, 16 nt, Shigella flexneri 2a str. 2457T
uccaguggugauacca

SEQ ID NO: 1929180 - RNA, 12 nt, Shigella flexneri 2a str. 2457T
uccaguggcuga

SEQ ID NO: 1929181 - RNA, 21 nt, Shigella flexneri 2a str. 2457T
uccagugccggaugauucaca

SEQ ID NO: 1929182 - RNA, 16 nt, Shigella flexneri 2a str. 2457T
uccagugcauccagca

SEQ ID NO: 1929183 - RNA, 16 nt, Shigella flexneri 2a str. 2457T
uccaucaagauuagcg

SEQ ID NO: 1929184 - RNA, 21 nt, Shigella flexneri 2a str. 2457T
uccaucaaagguuuuucagua

SEQ ID NO: 1929185 - RNA, 13 nt, Shigella flexneri 2a str. 2457T
uccaucacuucau

SEQ ID NO: 1929186 - RNA, 14 nt, Shigella flexneri 2a str. 2457T
uccaucacuucauc

SEQ ID NO: 1929187 - RNA, 18 nt, Shigella flexneri 2a str. 2457T
uccauauggcugcauuca

SEQ ID NO: 1929188 - RNA, 16 nt, Shigella flexneri 2a str. 2457T
uccauauugucuucaa

SEQ ID NO: 1929189 - RNA, 18 nt, Shigella flexneri 2a str. 2457T
uccaucgaccaaccuugc

SEQ ID NO: 1929190 - RNA, 17 nt, Shigella flexneri 2a str. 2457T
uccauccggcaacauca

SEQ ID NO: 1929191 - RNA, 17 nt, Shigella flexneri 2a str. 2457T
uccaucggcauuaaucu

SEQ ID NO: 1929192 - RNA, 13 nt, Shigella flexneri 2a str. 2457T
uccauccagcaac

SEQ ID NO: 1929193 - RNA, 20 nt, Shigella flexneri 2a str. 2457T
uccauccagcaacaacagcg

SEQ ID NO: 1929194 - RNA, 14 nt, Shigella flexneri 2a str. 2457T
uccauaaaacaucc

SEQ ID NO: 1929195 - RNA, 15 nt, Shigella flexneri 2a str. 2457T
uccaguuuucaaaua

SEQ ID NO: 1929196 - RNA, 21 nt, Shigella flexneri 2a str. 2457T
uccaguuuucaaauaucuauu

SEQ ID NO: 1929197 - RNA, 15 nt, Shigella flexneri 2a str. 2457T
uccauacaucuucau

SEQ ID NO: 1929198 - RNA, 22 nt, Shigella flexneri 2a str. 2457T
uccauacagcucagguucaacc

SEQ ID NO: 1929199 - RNA, 13 nt, Shigella flexneri 2a str. 2457T
uccauaagguccu

SEQ ID NO: 1929200 - RNA, 15 nt, Shigella flexneri 2a str. 2457T
uccauaagauugcau

SEQ ID NO: 1929201 - RNA, 13 nt, Shigella flexneri 2a str. 2457T
uccauaccggacu

SEQ ID NO: 1929202 - RNA, 16 nt, Shigella flexneri 2a str. 2457T
ucauuuucucuuucag

SEQ ID NO: 1929203 - RNA, 15 nt, Shigella flexneri 2a str. 2457T
ucauuucuggaagca

SEQ ID NO: 1929204 - RNA, 15 nt, Shigella flexneri 2a str. 2457T
ucauuucuguauaau

SEQ ID NO: 1929205 - RNA, 21 nt, Shigella flexneri 2a str. 2457T
ucauuucuguauaaucaccaa

SEQ ID NO: 1929206 - RNA, 13 nt, Shigella flexneri 2a str. 2457T
ucauuucugccau

SEQ ID NO: 1929207 - RNA, 12 nt, Shigella flexneri 2a str. 2457T
ucauuucaauca

SEQ ID NO: 1929208 - RNA, 19 nt, Shigella flexneri 2a str. 2457T
ucauugcggcaacaaugcu

SEQ ID NO: 1929209 - RNA, 23 nt, Shigella flexneri 2a str. 2457T
ucauugucgggccgcacgcugua

SEQ ID NO: 1929210 - RNA, 12 nt, Shigella flexneri 2a str. 2457T
ucauuguuaacg

SEQ ID NO: 1929211 - RNA, 14 nt, Shigella flexneri 2a str. 2457T
ucauuuauuaccuu

SEQ ID NO: 1929212 - RNA, 21 nt, Shigella flexneri 2a str. 2457T
ucauuuacaucacgcagcugc

SEQ ID NO: 1929213 - RNA, 15 nt, Shigella flexneri 2a str. 2457T
uccaaaaaacaaacc

SEQ ID NO: 1929214 - RNA, 22 nt, Shigella flexneri 2a str. 2457T
ucauuuuuuuaaucgucaguuu

SEQ ID NO: 1929215 - RNA, 21 nt, Shigella flexneri 2a str. 2457T
ucauuuuuucgguuuagugua

SEQ ID NO: 1929216 - RNA, 18 nt, Shigella flexneri 2a str. 2457T
uccaaaccgacugccugc

SEQ ID NO: 1929217 - RNA, 20 nt, Shigella flexneri 2a str. 2457T
uccaacccgcgaauaucagc

SEQ ID NO: 1929218 - RNA, 20 nt, Shigella flexneri 2a str. 2457T
ucauuaaccguuuacgucau

SEQ ID NO: 1929219 - RNA, 13 nt, Shigella flexneri 2a str. 2457T
ucauuaaaaauau

SEQ ID NO: 1929220 - RNA, 15 nt, Shigella flexneri 2a str. 2457T
ucauuacgccaguca

SEQ ID NO: 1929221 - RNA, 13 nt, Shigella flexneri 2a str. 2457T
ucauuaccuucaa

SEQ ID NO: 1929222 - RNA, 17 nt, Shigella flexneri 2a str. 2457T
ucauuacgccagucacg

SEQ ID NO: 1929223 - RNA, 17 nt, Shigella flexneri 2a str. 2457T
ucauggcugacugucgc

SEQ ID NO: 1929224 - RNA, 20 nt, Shigella flexneri 2a str. 2457T
ucaugguuacgccggugauu

SEQ ID NO: 1929225 - RNA, 19 nt, Shigella flexneri 2a str. 2457T
ucauguuaaauuccggcuc

SEQ ID NO: 1929226 - RNA, 15 nt, Shigella flexneri 2a str. 2457T
ucauguuaaauuccg

SEQ ID NO: 1929227 - RNA, 21 nt, Shigella flexneri 2a str. 2457T
ucaugucacccacugugguau

SEQ ID NO: 1929228 - RNA, 17 nt, Shigella flexneri 2a str. 2457T
ucaugucggcagugauu

SEQ ID NO: 1929229 - RNA, 22 nt, Shigella flexneri 2a str. 2457T
ucauucgcaguugcaguaccag

SEQ ID NO: 1929230 - RNA, 19 nt, Shigella flexneri 2a str. 2457T
ucauucgucuccuggccgu

SEQ ID NO: 1929231 - RNA, 23 nt, Shigella flexneri 2a str. 2457T
ucauucagugacagguugcucau

SEQ ID NO: 1929232 - RNA, 22 nt, Shigella flexneri 2a str. 2457T
ucauugaacgggugauuucccc

SEQ ID NO: 1929233 - RNA, 20 nt, Shigella flexneri 2a str. 2457T
ucauucugcaaggcaaaaua

SEQ ID NO: 1929234 - RNA, 19 nt, Shigella flexneri 2a str. 2457T
ucauugccaguccuaaaaa

SEQ ID NO: 1929235 - RNA, 13 nt, Shigella flexneri 2a str. 2457T
ucauuaugcugga

SEQ ID NO: 1929236 - RNA, 16 nt, Shigella flexneri 2a str. 2457T
ucauuaggccauuuga

SEQ ID NO: 1929237 - RNA, 17 nt, Shigella flexneri 2a str. 2457T
ucauuauuuucagaagg

SEQ ID NO: 1929238 - RNA, 18 nt, Shigella flexneri 2a str. 2457T
ucauucaacgucuugcug

SEQ ID NO: 1929239 - RNA, 15 nt, Shigella flexneri 2a str. 2457T
ucauuauugucggug

SEQ ID NO: 1929240 - RNA, 21 nt, Shigella flexneri 2a str. 2457T
ucauuaugaucaaaaucauau

SEQ ID NO: 1929241 - RNA, 13 nt, Shigella flexneri 2a str. 2457T
ucauuauuaauuu

SEQ ID NO: 1929242 - RNA, 16 nt, Shigella flexneri 2a str. 2457T
ucauuauuaauauuca

SEQ ID NO: 1929243 - RNA, 17 nt, Shigella flexneri 2a str. 2457T
ucaugauacagccgaca

SEQ ID NO: 1929244 - RNA, 16 nt, Shigella flexneri 2a str. 2457T
ucaugacuacacuaaa

SEQ ID NO: 1929245 - RNA, 17 nt, Shigella flexneri 2a str. 2457T
ucaucuuuccaaaccuc

SEQ ID NO: 1929246 - RNA, 20 nt, Shigella flexneri 2a str. 2457T
ucaugaauauauaauuaaaa

SEQ ID NO: 1929247 - RNA, 15 nt, Shigella flexneri 2a str. 2457T
ucaugcguuuguagg

SEQ ID NO: 1929248 - RNA, 22 nt, Shigella flexneri 2a str. 2457T
ucaugccggccagcgccaccac

SEQ ID NO: 1929249 - RNA, 21 nt, Shigella flexneri 2a str. 2457T
ucaugcgccagguaacgaaga

SEQ ID NO: 1929250 - RNA, 12 nt, Shigella flexneri 2a str. 2457T
ucaugcaauaaa

SEQ ID NO: 1929251 - RNA, 14 nt, Shigella flexneri 2a str. 2457T
ucaugccaaaaaua

SEQ ID NO: 1929252 - RNA, 17 nt, Shigella flexneri 2a str. 2457T
ucaugcaucauaaccug

SEQ ID NO: 1929253 - RNA, 19 nt, Shigella flexneri 2a str. 2457T
ucaugccgauaacucauau

SEQ ID NO: 1929254 - RNA, 18 nt, Shigella flexneri 2a str. 2457T
ucaugccaaaaauaaucu

SEQ ID NO: 1929255 - RNA, 21 nt, Shigella flexneri 2a str. 2457T
ucaugccgccgcagaaaaaga

SEQ ID NO: 1929256 - RNA, 20 nt, Shigella flexneri 2a str. 2457T
ucaugccgggcaaaagucac

SEQ ID NO: 1929257 - RNA, 15 nt, Shigella flexneri 2a str. 2457T
ucaucuuguaggccu

SEQ ID NO: 1929258 - RNA, 17 nt, Shigella flexneri 2a str. 2457T
ucaucucgcucaaaaau

SEQ ID NO: 1929259 - RNA, 22 nt, Shigella flexneri 2a str. 2457T
ucaucucuuccggcaccacaaa

SEQ ID NO: 1929260 - RNA, 14 nt, Shigella flexneri 2a str. 2457T
ucaucucuccuuuc

SEQ ID NO: 1929261 - RNA, 15 nt, Shigella flexneri 2a str. 2457T
ucaucucuccuuucg

SEQ ID NO: 1929262 - RNA, 23 nt, Shigella flexneri 2a str. 2457T
ucaucggguuacugauuuuauug

SEQ ID NO: 1929263 - RNA, 23 nt, Shigella flexneri 2a str. 2457T
ucaucggucagcgcagugacauu

SEQ ID NO: 1929264 - RNA, 16 nt, Shigella flexneri 2a str. 2457T
ucaucggguuacugau

SEQ ID NO: 1929265 - RNA, 19 nt, Shigella flexneri 2a str. 2457T
ucaucgggaagaggaucug

SEQ ID NO: 1929266 - RNA, 23 nt, Shigella flexneri 2a str. 2457T
ucaucgcuuucggaaagaucgcc

SEQ ID NO: 1929267 - RNA, 17 nt, Shigella flexneri 2a str. 2457T
ucaucucccacgcggca

SEQ ID NO: 1929268 - RNA, 15 nt, Shigella flexneri 2a str. 2457T
ucaucacugaauuuc

SEQ ID NO: 1929269 - RNA, 18 nt, Shigella flexneri 2a str. 2457T
ucaucaggggcagcacca

SEQ ID NO: 1929270 - RNA, 17 nt, Shigella flexneri 2a str. 2457T
ucaucaggccuacaaaa

SEQ ID NO: 1929271 - RNA, 18 nt, Shigella flexneri 2a str. 2457T
ucaucaggccuacaaaau

SEQ ID NO: 1929272 - RNA, 22 nt, Shigella flexneri 2a str. 2457T
ucaucaggccuacaaaaucuau

SEQ ID NO: 1929273 - RNA, 19 nt, Shigella flexneri 2a str. 2457T
ucaucagcggcgaagccua

SEQ ID NO: 1929274 - RNA, 19 nt, Shigella flexneri 2a str. 2457T
ucaucagcauaaucaccag

SEQ ID NO: 1929275 - RNA, 17 nt, Shigella flexneri 2a str. 2457T
ucaucacgcaggcugua

SEQ ID NO: 1929276 - RNA, 15 nt, Shigella flexneri 2a str. 2457T
ucaucacgcaucacu

SEQ ID NO: 1929277 - RNA, 17 nt, Shigella flexneri 2a str. 2457T
ucaucaccggggauaac

SEQ ID NO: 1929278 - RNA, 19 nt, Shigella flexneri 2a str. 2457T
ucaucaccggggauaacgu

SEQ ID NO: 1929279 - RNA, 21 nt, Shigella flexneri 2a str. 2457T
ucaucaccugagcuggcagac

SEQ ID NO: 1929280 - RNA, 17 nt, Shigella flexneri 2a str. 2457T
ucaucacguuggucugg

SEQ ID NO: 1929281 - RNA, 14 nt, Shigella flexneri 2a str. 2457T
ucaucacgaaaauc

SEQ ID NO: 1929282 - RNA, 19 nt, Shigella flexneri 2a str. 2457T
ucaucacgcgguuacgcac

SEQ ID NO: 1929283 - RNA, 21 nt, Shigella flexneri 2a str. 2457T
ucaucacgcgguuacgcaccg

SEQ ID NO: 1929284 - RNA, 12 nt, Shigella flexneri 2a str. 2457T
ucaucaccagaa

SEQ ID NO: 1929285 - RNA, 16 nt, Shigella flexneri 2a str. 2457T
ucaucacaucccagca

SEQ ID NO: 1929286 - RNA, 22 nt, Shigella flexneri 2a str. 2457T
ucaucacccaacgccuuucgcu

SEQ ID NO: 1929287 - RNA, 21 nt, Shigella flexneri 2a str. 2457T
ucaucaccccgcgcucacacc

SEQ ID NO: 1929288 - RNA, 19 nt, Shigella flexneri 2a str. 2457T
ucaucaucaggaacauccc

SEQ ID NO: 1929289 - RNA, 13 nt, Shigella flexneri 2a str. 2457T
ucaucaucagcau

SEQ ID NO: 1929290 - RNA, 13 nt, Shigella flexneri 2a str. 2457T
ucaucauccagca

SEQ ID NO: 1929291 - RNA, 22 nt, Shigella flexneri 2a str. 2457T
ucaucaucgcagauuucuucug

SEQ ID NO: 1929292 - RNA, 17 nt, Shigella flexneri 2a str. 2457T
ucaucaguuucaaaugg

SEQ ID NO: 1929293 - RNA, 12 nt, Shigella flexneri 2a str. 2457T
ucauccaacaau

SEQ ID NO: 1929294 - RNA, 16 nt, Shigella flexneri 2a str. 2457T
ucaucauguggcugga

SEQ ID NO: 1929295 - RNA, 19 nt, Shigella flexneri 2a str. 2457T
ucaucgcagauuucuucug

SEQ ID NO: 1929296 - RNA, 17 nt, Shigella flexneri 2a str. 2457T
ucaucgaugagaugacg

SEQ ID NO: 1929297 - RNA, 15 nt, Shigella flexneri 2a str. 2457T
ucaucgcccaggcaa

SEQ ID NO: 1929298 - RNA, 20 nt, Shigella flexneri 2a str. 2457T
ucaucgcccuuuuuucaggu

SEQ ID NO: 1929299 - RNA, 19 nt, Shigella flexneri 2a str. 2457T
ucaucgcgcccaaaccacc

SEQ ID NO: 1929300 - RNA, 17 nt, Shigella flexneri 2a str. 2457T
ucaucgcggcacacagc

SEQ ID NO: 1929301 - RNA, 15 nt, Shigella flexneri 2a str. 2457T
ucaucgcuacaccaa

SEQ ID NO: 1929302 - RNA, 16 nt, Shigella flexneri 2a str. 2457T
ucaucgaugcgaucau

SEQ ID NO: 1929303 - RNA, 13 nt, Shigella flexneri 2a str. 2457T
ucaucgacaucaa

SEQ ID NO: 1929304 - RNA, 22 nt, Shigella flexneri 2a str. 2457T
ucauccuguacgacaaaagaau

SEQ ID NO: 1929305 - RNA, 12 nt, Shigella flexneri 2a str. 2457T
ucauccuucagu

SEQ ID NO: 1929306 - RNA, 15 nt, Shigella flexneri 2a str. 2457T
ucauccuucagugcc

SEQ ID NO: 1929307 - RNA, 21 nt, Shigella flexneri 2a str. 2457T
ucauccagcacggugaagaag

SEQ ID NO: 1929308 - RNA, 23 nt, Shigella flexneri 2a str. 2457T
ucauccagcacuugcaggaacag

SEQ ID NO: 1929309 - RNA, 13 nt, Shigella flexneri 2a str. 2457T
ucauccagcauca

SEQ ID NO: 1929310 - RNA, 22 nt, Shigella flexneri 2a str. 2457T
ucauccagacugcucagcuccu

SEQ ID NO: 1929311 - RNA, 16 nt, Shigella flexneri 2a str. 2457T
ucauccauaaauaccu

SEQ ID NO: 1929312 - RNA, 23 nt, Shigella flexneri 2a str. 2457T
ucauccccccacgcguacucacu

SEQ ID NO: 1929313 - RNA, 18 nt, Shigella flexneri 2a str. 2457T
ucauccgcacaaucccuu

SEQ ID NO: 1929314 - RNA, 19 nt, Shigella flexneri 2a str. 2457T
ucaucccucucauccacgu

SEQ ID NO: 1929315 - RNA, 16 nt, Shigella flexneri 2a str. 2457T
ucaucccuacagguaa

SEQ ID NO: 1929316 - RNA, 15 nt, Shigella flexneri 2a str. 2457T
ucauccggcuguucc

SEQ ID NO: 1929317 - RNA, 17 nt, Shigella flexneri 2a str. 2457T
ucauccgguguggcaug

SEQ ID NO: 1929318 - RNA, 23 nt, Shigella flexneri 2a str. 2457T
ucauccgucaccggaauaaugau

SEQ ID NO: 1929319 - RNA, 16 nt, Shigella flexneri 2a str. 2457T
ucauccguuucucugu

SEQ ID NO: 1929320 - RNA, 18 nt, Shigella flexneri 2a str. 2457T
ucauaggccgcugaugcc

SEQ ID NO: 1929321 - RNA, 16 nt, Shigella flexneri 2a str. 2457T
ucauagacuucccucc

SEQ ID NO: 1929322 - RNA, 20 nt, Shigella flexneri 2a str. 2457T
ucauacgcguaaaacagcca

SEQ ID NO: 1929323 - RNA, 14 nt, Shigella flexneri 2a str. 2457T
ucauaccugagugg

SEQ ID NO: 1929324 - RNA, 17 nt, Shigella flexneri 2a str. 2457T
ucauacgaacgccugcu

SEQ ID NO: 1929325 - RNA, 22 nt, Shigella flexneri 2a str. 2457T
ucauaacucuccuguuuaauau

SEQ ID NO: 1929326 - RNA, 15 nt, Shigella flexneri 2a str. 2457T
ucauaagacuuacca

SEQ ID NO: 1929327 - RNA, 16 nt, Shigella flexneri 2a str. 2457T
ucauaccgaucaccga

SEQ ID NO: 1929328 - RNA, 18 nt, Shigella flexneri 2a str. 2457T
ucauacagcggacagcca

SEQ ID NO: 1929329 - RNA, 21 nt, Shigella flexneri 2a str. 2457T
ucauacaucgcgcuuaucgcc

SEQ ID NO: 1929330 - RNA, 21 nt, Shigella flexneri 2a str. 2457T
ucauacagaugcugcucuuca

SEQ ID NO: 1929331 - RNA, 16 nt, Shigella flexneri 2a str. 2457T
ucauacagccgguaca

SEQ ID NO: 1929332 - RNA, 20 nt, Shigella flexneri 2a str. 2457T
ucauacagccgguacauucc

SEQ ID NO: 1929333 - RNA, 23 nt, Shigella flexneri 2a str. 2457T
ucauaaugauggggucacagguu

SEQ ID NO: 1929334 - RNA, 14 nt, Shigella flexneri 2a str. 2457T
ucauacacuucaca

SEQ ID NO: 1929335 - RNA, 16 nt, Shigella flexneri 2a str. 2457T
ucauaugauaggcuuc

SEQ ID NO: 1929336 - RNA, 12 nt, Shigella flexneri 2a str. 2457T
ucauauucacca

SEQ ID NO: 1929337 - RNA, 14 nt, Shigella flexneri 2a str. 2457T
ucauauuaaauuuu

SEQ ID NO: 1929338 - RNA, 15 nt, Shigella flexneri 2a str. 2457T
ucauauuaaauuuuu

SEQ ID NO: 1929339 - RNA, 16 nt, Shigella flexneri 2a str. 2457T
ucauauuaaauuuuuu

SEQ ID NO: 1929340 - RNA, 15 nt, Shigella flexneri 2a str. 2457T
ucauauuaucuaucg

SEQ ID NO: 1929341 - RNA, 15 nt, Shigella flexneri 2a str. 2457T
ucauauaccgcauca

SEQ ID NO: 1929342 - RNA, 14 nt, Shigella flexneri 2a str. 2457T
ucauauaacgcagg

SEQ ID NO: 1929343 - RNA, 16 nt, Shigella flexneri 2a str. 2457T
ucauaucacaaauucu

SEQ ID NO: 1929344 - RNA, 17 nt, Shigella flexneri 2a str. 2457T
ucauauagccgccuugu

SEQ ID NO: 1929345 - RNA, 17 nt, Shigella flexneri 2a str. 2457T
ucaucaaaaucaucauu

SEQ ID NO: 1929346 - RNA, 22 nt, Shigella flexneri 2a str. 2457T
ucaucaacugacuauccuggac

SEQ ID NO: 1929347 - RNA, 21 nt, Shigella flexneri 2a str. 2457T
ucaucaacuggcaaccagaag

SEQ ID NO: 1929348 - RNA, 18 nt, Shigella flexneri 2a str. 2457T
ucaucaagcugugccuga

SEQ ID NO: 1929349 - RNA, 16 nt, Shigella flexneri 2a str. 2457T
ucaucaagcuguucuu

SEQ ID NO: 1929350 - RNA, 19 nt, Shigella flexneri 2a str. 2457T
ucaucaagcuguucuuccc

SEQ ID NO: 1929351 - RNA, 20 nt, Shigella flexneri 2a str. 2457T
ucaucaaauuacgauaauca

SEQ ID NO: 1929352 - RNA, 13 nt, Shigella flexneri 2a str. 2457T
ucaucaaagccaa

SEQ ID NO: 1929353 - RNA, 19 nt, Shigella flexneri 2a str. 2457T
ucauaaagcagccuauuuc

SEQ ID NO: 1929354 - RNA, 23 nt, Shigella flexneri 2a str. 2457T
ucauaaauacagagcacgcaagg

SEQ ID NO: 1929355 - RNA, 22 nt, Shigella flexneri 2a str. 2457T
ucaguuuuuguugauaaacaaa

SEQ ID NO: 1929356 - RNA, 16 nt, Shigella flexneri 2a str. 2457T
ucaguuuuacucuuuc

SEQ ID NO: 1929357 - RNA, 15 nt, Shigella flexneri 2a str. 2457T
ucaguuugcaaaccc

SEQ ID NO: 1929358 - RNA, 14 nt, Shigella flexneri 2a str. 2457T
ucaguuaccugaau

SEQ ID NO: 1929359 - RNA, 13 nt, Shigella flexneri 2a str. 2457T
ucaguuaacggca

SEQ ID NO: 1929360 - RNA, 14 nt, Shigella flexneri 2a str. 2457T
ucaguuccgcugca

SEQ ID NO: 1929361 - RNA, 18 nt, Shigella flexneri 2a str. 2457T
ucaguuccgggaucacca

SEQ ID NO: 1929362 - RNA, 13 nt, Shigella flexneri 2a str. 2457T
ucaguucaaauuc

SEQ ID NO: 1929363 - RNA, 15 nt, Shigella flexneri 2a str. 2457T
ucaguuccagcagcg

SEQ ID NO: 1929364 - RNA, 22 nt, Shigella flexneri 2a str. 2457T
ucaguucagcgauauccagcga

SEQ ID NO: 1929365 - RNA, 22 nt, Shigella flexneri 2a str. 2457T
ucaguugguuagagcacaucac

SEQ ID NO: 1929366 - RNA, 14 nt, Shigella flexneri 2a str. 2457T
ucaguuggggaaaa

SEQ ID NO: 1929367 - RNA, 20 nt, Shigella flexneri 2a str. 2457T
ucaguuggggaaaaguuggc

SEQ ID NO: 1929368 - RNA, 21 nt, Shigella flexneri 2a str. 2457T
ucaguugcaccugauccagcu

SEQ ID NO: 1929369 - RNA, 23 nt, Shigella flexneri 2a str. 2457T
ucaguucguuuuacgcacuucuu

SEQ ID NO: 1929370 - RNA, 22 nt, Shigella flexneri 2a str. 2457T
ucaguggaagacguugauucac

SEQ ID NO: 1929371 - RNA, 17 nt, Shigella flexneri 2a str. 2457T
ucagugguguagggcag

SEQ ID NO: 1929372 - RNA, 14 nt, Shigella flexneri 2a str. 2457T
ucagugucgcagua

SEQ ID NO: 1929373 - RNA, 17 nt, Shigella flexneri 2a str. 2457T
ucagugucgcaguagcc

SEQ ID NO: 1929374 - RNA, 20 nt, Shigella flexneri 2a str. 2457T
ucagugucuuaucuggcauu

SEQ ID NO: 1929375 - RNA, 16 nt, Shigella flexneri 2a str. 2457T
ucagucuagcccgaug

SEQ ID NO: 1929376 - RNA, 13 nt, Shigella flexneri 2a str. 2457T
ucagucucaaacc

SEQ ID NO: 1929377 - RNA, 12 nt, Shigella flexneri 2a str. 2457T
ucagucagcagu

SEQ ID NO: 1929378 - RNA, 19 nt, Shigella flexneri 2a str. 2457T
ucaguauggaucaaaucuc

SEQ ID NO: 1929379 - RNA, 13 nt, Shigella flexneri 2a str. 2457T
ucaguauggucga

SEQ ID NO: 1929380 - RNA, 15 nt, Shigella flexneri 2a str. 2457T
ucaguauaacuacug

SEQ ID NO: 1929381 - RNA, 21 nt, Shigella flexneri 2a str. 2457T
ucaguagcgcaaucaccacca

SEQ ID NO: 1929382 - RNA, 22 nt, Shigella flexneri 2a str. 2457T
ucaguagcgcaaucaccaccac

SEQ ID NO: 1929383 - RNA, 15 nt, Shigella flexneri 2a str. 2457T
ucaguagaauaaucu

SEQ ID NO: 1929384 - RNA, 18 nt, Shigella flexneri 2a str. 2457T
ucagguuuuucagcugcc

SEQ ID NO: 1929385 - RNA, 20 nt, Shigella flexneri 2a str. 2457T
ucagguuguuuucuggcuga

SEQ ID NO: 1929386 - RNA, 19 nt, Shigella flexneri 2a str. 2457T
ucaguaaccgcuuuuucaa

SEQ ID NO: 1929387 - RNA, 19 nt, Shigella flexneri 2a str. 2457T
ucaguaauccuuucucaau

SEQ ID NO: 1929388 - RNA, 14 nt, Shigella flexneri 2a str. 2457T
ucagcugccagggc

SEQ ID NO: 1929389 - RNA, 17 nt, Shigella flexneri 2a str. 2457T
ucagcugcacacagggc

SEQ ID NO: 1929390 - RNA, 19 nt, Shigella flexneri 2a str. 2457T
ucagcuccacaagaaugcc

SEQ ID NO: 1929391 - RNA, 19 nt, Shigella flexneri 2a str. 2457T
ucagcuccggcagcugcuc

SEQ ID NO: 1929392 - RNA, 13 nt, Shigella flexneri 2a str. 2457T
ucagcuccucuuu

SEQ ID NO: 1929393 - RNA, 16 nt, Shigella flexneri 2a str. 2457T
ucagcuccucuuucau

SEQ ID NO: 1929394 - RNA, 15 nt, Shigella flexneri 2a str. 2457T
ucagcucauccagcg

SEQ ID NO: 1929395 - RNA, 14 nt, Shigella flexneri 2a str. 2457T
ucagcucauuaaaa

SEQ ID NO: 1929396 - RNA, 17 nt, Shigella flexneri 2a str. 2457T
ucagcuugcguccauaa

SEQ ID NO: 1929397 - RNA, 12 nt, Shigella flexneri 2a str. 2457T
ucaggaaauaaa

SEQ ID NO: 1929398 - RNA, 20 nt, Shigella flexneri 2a str. 2457T
ucaggaacuguuucaccauu

SEQ ID NO: 1929399 - RNA, 19 nt, Shigella flexneri 2a str. 2457T
ucaggaacaccgcacgcag

SEQ ID NO: 1929400 - RNA, 22 nt, Shigella flexneri 2a str. 2457T
ucaggaaccacaaccacuuugu

SEQ ID NO: 1929401 - RNA, 17 nt, Shigella flexneri 2a str. 2457T
ucaggagcaacuggagu

SEQ ID NO: 1929402 - RNA, 15 nt, Shigella flexneri 2a str. 2457T
ucagcgccugcugca

SEQ ID NO: 1929403 - RNA, 14 nt, Shigella flexneri 2a str. 2457T
ucagcgccaggcuu

SEQ ID NO: 1929404 - RNA, 15 nt, Shigella flexneri 2a str. 2457T
uaucuucccagccca

SEQ ID NO: 1929405 - RNA, 13 nt, Shigella flexneri 2a str. 2457T
uaucuucccagcg

SEQ ID NO: 1929406 - RNA, 18 nt, Shigella flexneri 2a str. 2457T
uaucuucaccguucguga

SEQ ID NO: 1929407 - RNA, 10 nt, Shigella flexneri 2a str. 2457T
uaucuucaca

SEQ ID NO: 1929408 - RNA, 14 nt, Shigella flexneri 2a str. 2457T
ucagcgcagcgcga

SEQ ID NO: 1929409 - RNA, 13 nt, Shigella flexneri 2a str. 2457T
ucagcgcagcacc

SEQ ID NO: 1929410 - RNA, 16 nt, Shigella flexneri 2a str. 2457T
ucagcgcagcacccag

SEQ ID NO: 1929411 - RNA, 16 nt, Shigella flexneri 2a str. 2457T
ucagcgucgccuggug

SEQ ID NO: 1929412 - RNA, 19 nt, Shigella flexneri 2a str. 2457T
ucagcggugccgcgauacc

SEQ ID NO: 1929413 - RNA, 16 nt, Shigella flexneri 2a str. 2457T
ucagcgguggugaaaa

SEQ ID NO: 1929414 - RNA, 14 nt, Shigella flexneri 2a str. 2457T
ucagcgguuuugcc

SEQ ID NO: 1929415 - RNA, 13 nt, Shigella flexneri 2a str. 2457T
ucagcgugcccac

SEQ ID NO: 1929416 - RNA, 14 nt, Shigella flexneri 2a str. 2457T
ucagcguuccccag

SEQ ID NO: 1929417 - RNA, 15 nt, Shigella flexneri 2a str. 2457T
ucagcguuccccaga

SEQ ID NO: 1929418 - RNA, 16 nt, Shigella flexneri 2a str. 2457T
ucagcggcaauucuuu

SEQ ID NO: 1929419 - RNA, 15 nt, Shigella flexneri 2a str. 2457T
ucagcgggcagggca

SEQ ID NO: 1929420 - RNA, 12 nt, Shigella flexneri 2a str. 2457T
ucaggccaggau

SEQ ID NO: 1929421 - RNA, 20 nt, Shigella flexneri 2a str. 2457T
ucaggcccgcauagagaaaa

SEQ ID NO: 1929422 - RNA, 17 nt, Shigella flexneri 2a str. 2457T
ucaggcauuacugugca

SEQ ID NO: 1929423 - RNA, 20 nt, Shigella flexneri 2a str. 2457T
ucaggcauucucgaauuaau

SEQ ID NO: 1929424 - RNA, 21 nt, Shigella flexneri 2a str. 2457T
ucaggccacgucuuaauguaa

SEQ ID NO: 1929425 - RNA, 15 nt, Shigella flexneri 2a str. 2457T
ucaggccggaauaac

SEQ ID NO: 1929426 - RNA, 15 nt, Shigella flexneri 2a str. 2457T
ucaggccgauuucau

SEQ ID NO: 1929427 - RNA, 22 nt, Shigella flexneri 2a str. 2457T
ucaggcgcugaaagaagcggug

SEQ ID NO: 1929428 - RNA, 12 nt, Shigella flexneri 2a str. 2457T
ucaggcgcugca

SEQ ID NO: 1929429 - RNA, 15 nt, Shigella flexneri 2a str. 2457T
ucaggcggcucaccu

SEQ ID NO: 1929430 - RNA, 16 nt, Shigella flexneri 2a str. 2457T
ucaggccuacaggauu

SEQ ID NO: 1929431 - RNA, 14 nt, Shigella flexneri 2a str. 2457T
ucaggccuaccggu

SEQ ID NO: 1929432 - RNA, 15 nt, Shigella flexneri 2a str. 2457T
ucaggccuacaaaau

SEQ ID NO: 1929433 - RNA, 17 nt, Shigella flexneri 2a str. 2457T
ucaggauauuuauauuu

SEQ ID NO: 1929434 - RNA, 16 nt, Shigella flexneri 2a str. 2457T
ucaggaguuuaaucuc

SEQ ID NO: 1929435 - RNA, 13 nt, Shigella flexneri 2a str. 2457T
ucaggaguuuaau

SEQ ID NO: 1929436 - RNA, 16 nt, Shigella flexneri 2a str. 2457T
ucaggagcuggaugcc

SEQ ID NO: 1929437 - RNA, 22 nt, Shigella flexneri 2a str. 2457T
ucaggcaaaaaaaugcacauau

SEQ ID NO: 1929438 - RNA, 21 nt, Shigella flexneri 2a str. 2457T
ucaggaucagccauuuugcac

SEQ ID NO: 1929439 - RNA, 16 nt, Shigella flexneri 2a str. 2457T
ucaggaucugacaucc

SEQ ID NO: 1929440 - RNA, 17 nt, Shigella flexneri 2a str. 2457T
ucaggcaggucuuucac

SEQ ID NO: 1929441 - RNA, 12 nt, Shigella flexneri 2a str. 2457T
ucaggcagucug

SEQ ID NO: 1929442 - RNA, 18 nt, Shigella flexneri 2a str. 2457T
ucaggcaggucuuucacc

SEQ ID NO: 1929443 - RNA, 13 nt, Shigella flexneri 2a str. 2457T
ucaggcaucaugc

SEQ ID NO: 1929444 - RNA, 20 nt, Shigella flexneri 2a str. 2457T
ucaggcaucgugcaccaauu

SEQ ID NO: 1929445 - RNA, 23 nt, Shigella flexneri 2a str. 2457T
ucaggcaaugggcaaacgcucuc

SEQ ID NO: 1929446 - RNA, 22 nt, Shigella flexneri 2a str. 2457T
ucagguaagcgauaaaaauacc

SEQ ID NO: 1929447 - RNA, 16 nt, Shigella flexneri 2a str. 2457T
ucagggucuuccagca

SEQ ID NO: 1929448 - RNA, 18 nt, Shigella flexneri 2a str. 2457T
ucagggucuuccagcaaa

SEQ ID NO: 1929449 - RNA, 21 nt, Shigella flexneri 2a str. 2457T
ucagggucuuccagcaaaucc

SEQ ID NO: 1929450 - RNA, 17 nt, Shigella flexneri 2a str. 2457T
ucaggucgcuggcggua

SEQ ID NO: 1929451 - RNA, 14 nt, Shigella flexneri 2a str. 2457T
ucaggucagcgaau

SEQ ID NO: 1929452 - RNA, 17 nt, Shigella flexneri 2a str. 2457T
ucaggggcagcaccauc

SEQ ID NO: 1929453 - RNA, 22 nt, Shigella flexneri 2a str. 2457T
ucagggcgacaaucaucgccuu

SEQ ID NO: 1929454 - RNA, 20 nt, Shigella flexneri 2a str. 2457T
ucagggagucuugcuggaug

SEQ ID NO: 1929455 - RNA, 18 nt, Shigella flexneri 2a str. 2457T
ucaggcgugauucauaca

SEQ ID NO: 1929456 - RNA, 15 nt, Shigella flexneri 2a str. 2457T
ucaggcuucuguacc

SEQ ID NO: 1929457 - RNA, 15 nt, Shigella flexneri 2a str. 2457T
ggauugcuucugcuu

SEQ ID NO: 1929458 - RNA, 19 nt, Shigella flexneri 2a str. 2457T
ggauugcuauuuaacaguu

SEQ ID NO: 1929459 - RNA, 13 nt, Shigella flexneri 2a str. 2457T
ggauguugcugca

SEQ ID NO: 1929460 - RNA, 15 nt, Shigella flexneri 2a str. 2457T
ggauuacaaauaaau

SEQ ID NO: 1929461 - RNA, 23 nt, Shigella flexneri 2a str. 2457T
ggauuacgacucaaccccagcca

SEQ ID NO: 1929462 - RNA, 13 nt, Shigella flexneri 2a str. 2457T
ggauggccgggca

SEQ ID NO: 1929463 - RNA, 19 nt, Shigella flexneri 2a str. 2457T
ggauggcuggccgugcaga

SEQ ID NO: 1929464 - RNA, 17 nt, Shigella flexneri 2a str. 2457T
ggaucucagcucauuaa

SEQ ID NO: 1929465 - RNA, 17 nt, Shigella flexneri 2a str. 2457T
ggaucacuccccgccgu

SEQ ID NO: 1929466 - RNA, 14 nt, Shigella flexneri 2a str. 2457T
ggaucuccagcucc

SEQ ID NO: 1929467 - RNA, 20 nt, Shigella flexneri 2a str. 2457T
ggaucacaucauaaauaaga

SEQ ID NO: 1929468 - RNA, 19 nt, Shigella flexneri 2a str. 2457T
ggaucaccugcacaugcaa

SEQ ID NO: 1929469 - RNA, 21 nt, Shigella flexneri 2a str. 2457T
ggaucaccagaccaauggcuu

SEQ ID NO: 1929470 - RNA, 18 nt, Shigella flexneri 2a str. 2457T
ggaucuggcuugccagca

SEQ ID NO: 1929471 - RNA, 18 nt, Shigella flexneri 2a str. 2457T
ggaucugaugggauuaga

SEQ ID NO: 1929472 - RNA, 20 nt, Shigella flexneri 2a str. 2457T
ggaucugcggguuagucugc

SEQ ID NO: 1929473 - RNA, 23 nt, Shigella flexneri 2a str. 2457T
ggaucugcggguuagucugcauu

SEQ ID NO: 1929474 - RNA, 17 nt, Shigella flexneri 2a str. 2457T
ggaugcccccagguugu

SEQ ID NO: 1929475 - RNA, 16 nt, Shigella flexneri 2a str. 2457T
ggcaaccagcagaugu

SEQ ID NO: 1929476 - RNA, 20 nt, Shigella flexneri 2a str. 2457T
ggcaaaugcaucagugacaa

SEQ ID NO: 1929477 - RNA, 14 nt, Shigella flexneri 2a str. 2457T
ggcaaccgcugagc

SEQ ID NO: 1929478 - RNA, 18 nt, Shigella flexneri 2a str. 2457T
ggcaacgacugcgagcaa

SEQ ID NO: 1929479 - RNA, 20 nt, Shigella flexneri 2a str. 2457T
ggcaacgacugcgagcaaaa

SEQ ID NO: 1929480 - RNA, 18 nt, Shigella flexneri 2a str. 2457T
ggcaacgacccgaagggc

SEQ ID NO: 1929481 - RNA, 13 nt, Shigella flexneri 2a str. 2457T
ggauuuuuuauug

SEQ ID NO: 1929482 - RNA, 12 nt, Shigella flexneri 2a str. 2457T
ggcaaaaaaguc

SEQ ID NO: 1929483 - RNA, 11 nt, Shigella flexneri 2a str. 2457T
ggcaaaaaaau

SEQ ID NO: 1929484 - RNA, 21 nt, Shigella flexneri 2a str. 2457T
ggauuucugauuauggcggcg

SEQ ID NO: 1929485 - RNA, 14 nt, Shigella flexneri 2a str. 2457T
ggauuucauauccg

SEQ ID NO: 1929486 - RNA, 17 nt, Shigella flexneri 2a str. 2457T
ggcaaagugaauacaga

SEQ ID NO: 1929487 - RNA, 15 nt, Shigella flexneri 2a str. 2457T
ggcaaaaaucggcaa

SEQ ID NO: 1929488 - RNA, 14 nt, Shigella flexneri 2a str. 2457T
ggcaagauacugca

SEQ ID NO: 1929489 - RNA, 23 nt, Shigella flexneri 2a str. 2457T
ggcaagaucgcgaugggucgccg

SEQ ID NO: 1929490 - RNA, 15 nt, Shigella flexneri 2a str. 2457T
ggcaagaauuacuuc

SEQ ID NO: 1929491 - RNA, 13 nt, Shigella flexneri 2a str. 2457T
ggcaagccagcau

SEQ ID NO: 1929492 - RNA, 23 nt, Shigella flexneri 2a str. 2457T
ggcaagcagcaaauagccgagcg

SEQ ID NO: 1929493 - RNA, 16 nt, Shigella flexneri 2a str. 2457T
ggcaagcauaugacga

SEQ ID NO: 1929494 - RNA, 15 nt, Shigella flexneri 2a str. 2457T
ggcaaucggugcaaa

SEQ ID NO: 1929495 - RNA, 14 nt, Shigella flexneri 2a str. 2457T
ggcaaucugcuggc

SEQ ID NO: 1929496 - RNA, 23 nt, Shigella flexneri 2a str. 2457T
ggcaaugacccguaugaugugcg

SEQ ID NO: 1929497 - RNA, 23 nt, Shigella flexneri 2a str. 2457T
ggcaaucucacuccggccagagc

SEQ ID NO: 1929498 - RNA, 17 nt, Shigella flexneri 2a str. 2457T
ggcaaucauucccagac

SEQ ID NO: 1929499 - RNA, 17 nt, Shigella flexneri 2a str. 2457T
ggcaauccccgccagca

SEQ ID NO: 1929500 - RNA, 23 nt, Shigella flexneri 2a str. 2457T
ggcaaucaucaccggucggccuu

SEQ ID NO: 1929501 - RNA, 22 nt, Shigella flexneri 2a str. 2457T
ggcaauacgauccugagcagcc

SEQ ID NO: 1929502 - RNA, 16 nt, Shigella flexneri 2a str. 2457T
ggcaauauucauuaaa

SEQ ID NO: 1929503 - RNA, 17 nt, Shigella flexneri 2a str. 2457T
ggcaauauucauuaaaa

SEQ ID NO: 1929504 - RNA, 22 nt, Shigella flexneri 2a str. 2457T
ggcaauauagauaucaugcucu

SEQ ID NO: 1929505 - RNA, 23 nt, Shigella flexneri 2a str. 2457T
ggcaaguaacuucuccacugcug

SEQ ID NO: 1929506 - RNA, 15 nt, Shigella flexneri 2a str. 2457T
ggcaaguagcgccau

SEQ ID NO: 1929507 - RNA, 19 nt, Shigella flexneri 2a str. 2457T
ggcaagugugaugguauuc

SEQ ID NO: 1929508 - RNA, 17 nt, Shigella flexneri 2a str. 2457T
ggcaaugucgagugaau

SEQ ID NO: 1929509 - RNA, 13 nt, Shigella flexneri 2a str. 2457T
ggcaaugcccggu

SEQ ID NO: 1929510 - RNA, 15 nt, Shigella flexneri 2a str. 2457T
ggcaaugcugucggu

SEQ ID NO: 1929511 - RNA, 20 nt, Shigella flexneri 2a str. 2457T
ggcaaugcgggugcaaucaa

SEQ ID NO: 1929512 - RNA, 22 nt, Shigella flexneri 2a str. 2457T
ggcaaugcguagcugagcaaca

SEQ ID NO: 1929513 - RNA, 12 nt, Shigella flexneri 2a str. 2457T
ggcacaaagcug

SEQ ID NO: 1929514 - RNA, 17 nt, Shigella flexneri 2a str. 2457T
ggcaauuuuuaccgguc

SEQ ID NO: 1929515 - RNA, 21 nt, Shigella flexneri 2a str. 2457T
ggcaauuuuuaccggucagga

SEQ ID NO: 1929516 - RNA, 17 nt, Shigella flexneri 2a str. 2457T
ggcacaacucggcggcu

SEQ ID NO: 1929517 - RNA, 22 nt, Shigella flexneri 2a str. 2457T
ggcacaagcauuaaggcaagaa

SEQ ID NO: 1929518 - RNA, 15 nt, Shigella flexneri 2a str. 2457T
ggcaccuucgccucc

SEQ ID NO: 1929519 - RNA, 19 nt, Shigella flexneri 2a str. 2457T
ggcaccuguaccagcccgc

SEQ ID NO: 1929520 - RNA, 16 nt, Shigella flexneri 2a str. 2457T
ggaguggcgaaauugg

SEQ ID NO: 1929521 - RNA, 15 nt, Shigella flexneri 2a str. 2457T
ggauagcgcugcugc

SEQ ID NO: 1929522 - RNA, 22 nt, Shigella flexneri 2a str. 2457T
ggauaggcuucuauaccaauga

SEQ ID NO: 1929523 - RNA, 17 nt, Shigella flexneri 2a str. 2457T
ggauauuuuuuugcaug

SEQ ID NO: 1929524 - RNA, 18 nt, Shigella flexneri 2a str. 2457T
ggauagagcucauuucau

SEQ ID NO: 1929525 - RNA, 14 nt, Shigella flexneri 2a str. 2457T
ggagguguucauaa

SEQ ID NO: 1929526 - RNA, 20 nt, Shigella flexneri 2a str. 2457T
ggagcgcuuuuuuccugccg

SEQ ID NO: 1929527 - RNA, 17 nt, Shigella flexneri 2a str. 2457T
ggagcgaauacuccccu

SEQ ID NO: 1929528 - RNA, 21 nt, Shigella flexneri 2a str. 2457T
ggagcgauuaugaaacaagaa

SEQ ID NO: 1929529 - RNA, 21 nt, Shigella flexneri 2a str. 2457T
ggaggagagugcaaugaaaaa

SEQ ID NO: 1929530 - RNA, 13 nt, Shigella flexneri 2a str. 2457T
ggagaguugaaag

SEQ ID NO: 1929531 - RNA, 14 nt, Shigella flexneri 2a str. 2457T
ggagaguugaaagc

SEQ ID NO: 1929532 - RNA, 18 nt, Shigella flexneri 2a str. 2457T
ggacuuguuuuugaucuc

SEQ ID NO: 1929533 - RNA, 13 nt, Shigella flexneri 2a str. 2457T
ggacuuuuuauuu

SEQ ID NO: 1929534 - RNA, 19 nt, Shigella flexneri 2a str. 2457T
ggacuuaaggucacagaag

SEQ ID NO: 1929535 - RNA, 22 nt, Shigella flexneri 2a str. 2457T
ggacgugcaccgucacuucuuc

SEQ ID NO: 1929536 - RNA, 16 nt, Shigella flexneri 2a str. 2457T
ggacgaucgcagauga

SEQ ID NO: 1929537 - RNA, 16 nt, Shigella flexneri 2a str. 2457T
ggacaaccauaaauuu

SEQ ID NO: 1929538 - RNA, 21 nt, Shigella flexneri 2a str. 2457T
ggaaugagcuguacggagcgg

SEQ ID NO: 1929539 - RNA, 14 nt, Shigella flexneri 2a str. 2457T
ggaauaccacuuuc

SEQ ID NO: 1929540 - RNA, 19 nt, Shigella flexneri 2a str. 2457T
ggaauacauauauuacaac

SEQ ID NO: 1929541 - RNA, 19 nt, Shigella flexneri 2a str. 2457T
ggaauagcggcaagcccag

SEQ ID NO: 1929542 - RNA, 20 nt, Shigella flexneri 2a str. 2457T
ggaauagcuuuacccaaauc

SEQ ID NO: 1929543 - RNA, 16 nt, Shigella flexneri 2a str. 2457T
ggaauccgggucugua

SEQ ID NO: 1929544 - RNA, 18 nt, Shigella flexneri 2a str. 2457T
ggaaguaccaauggcaau

SEQ ID NO: 1929545 - RNA, 21 nt, Shigella flexneri 2a str. 2457T
ggaaguauuucaauauggaag

SEQ ID NO: 1929546 - RNA, 13 nt, Shigella flexneri 2a str. 2457T
ggaaguuacucaa

SEQ ID NO: 1929547 - RNA, 18 nt, Shigella flexneri 2a str. 2457T
ggaccuuucugaugcaua

SEQ ID NO: 1929548 - RNA, 18 nt, Shigella flexneri 2a str. 2457T
ggacgaacaguucaacgc

SEQ ID NO: 1929549 - RNA, 18 nt, Shigella flexneri 2a str. 2457T
ggacccgcgaucgccugc

SEQ ID NO: 1929550 - RNA, 17 nt, Shigella flexneri 2a str. 2457T
ggacccgcgaucgccug

SEQ ID NO: 1929551 - RNA, 22 nt, Shigella flexneri 2a str. 2457T
ggaccauucacacuccaguccc

SEQ ID NO: 1929552 - RNA, 20 nt, Shigella flexneri 2a str. 2457T
ggacccuuaaagggucaggg

SEQ ID NO: 1929553 - RNA, 23 nt, Shigella flexneri 2a str. 2457T
ggaccgauggguucagaaucaag

SEQ ID NO: 1929554 - RNA, 16 nt, Shigella flexneri 2a str. 2457T
ggacagacuggcuauu

SEQ ID NO: 1929555 - RNA, 18 nt, Shigella flexneri 2a str. 2457T
ggacagacuggcuauuaa

SEQ ID NO: 1929556 - RNA, 21 nt, Shigella flexneri 2a str. 2457T
ggacacugcuuacaggcuggu

SEQ ID NO: 1929557 - RNA, 16 nt, Shigella flexneri 2a str. 2457T
ggacagcguugccagc

SEQ ID NO: 1929558 - RNA, 18 nt, Shigella flexneri 2a str. 2457T
ggaccaaagaaugacacu

SEQ ID NO: 1929559 - RNA, 13 nt, Shigella flexneri 2a str. 2457T
ggaccagcaacaa

SEQ ID NO: 1929560 - RNA, 12 nt, Shigella flexneri 2a str. 2457T
ggcaucaguaug

SEQ ID NO: 1929561 - RNA, 13 nt, Shigella flexneri 2a str. 2457T
ggcaucagcagaa

SEQ ID NO: 1929562 - RNA, 23 nt, Shigella flexneri 2a str. 2457T
ggcaucagacaaaugucacugcu

SEQ ID NO: 1929563 - RNA, 16 nt, Shigella flexneri 2a str. 2457T
ggcauccagagaucgc

SEQ ID NO: 1929564 - RNA, 20 nt, Shigella flexneri 2a str. 2457T
ggcauccagguuucuuccag

SEQ ID NO: 1929565 - RNA, 16 nt, Shigella flexneri 2a str. 2457T
ggcaguucgugcagug

SEQ ID NO: 1929566 - RNA, 20 nt, Shigella flexneri 2a str. 2457T
ggcaguucgucuuuggguuc

SEQ ID NO: 1929567 - RNA, 20 nt, Shigella flexneri 2a str. 2457T
ggcaggcuucaacacaggcc

SEQ ID NO: 1929568 - RNA, 22 nt, Shigella flexneri 2a str. 2457T
ggcaggcuucaacacaggccgg

SEQ ID NO: 1929569 - RNA, 22 nt, Shigella flexneri 2a str. 2457T
ggcagaaugguaacaccagagu

SEQ ID NO: 1929570 - RNA, 19 nt, Shigella flexneri 2a str. 2457T
ggcaggcucugguguucuu

SEQ ID NO: 1929571 - RNA, 22 nt, Shigella flexneri 2a str. 2457T
ggcacuuucaucgcggucagcu

SEQ ID NO: 1929572 - RNA, 16 nt, Shigella flexneri 2a str. 2457T
ggcacugguacucaac

SEQ ID NO: 1929573 - RNA, 13 nt, Shigella flexneri 2a str. 2457T
ggcagaacagaac

SEQ ID NO: 1929574 - RNA, 20 nt, Shigella flexneri 2a str. 2457T
ggcaggucaugugucgccgc

SEQ ID NO: 1929575 - RNA, 22 nt, Shigella flexneri 2a str. 2457T
ggcaggguggugacaccaugcc

SEQ ID NO: 1929576 - RNA, 22 nt, Shigella flexneri 2a str. 2457T
ggcaggucuuucaccugauuac

SEQ ID NO: 1929577 - RNA, 19 nt, Shigella flexneri 2a str. 2457T
ggcauugcaaugacgccga

SEQ ID NO: 1929578 - RNA, 18 nt, Shigella flexneri 2a str. 2457T
ggcauucucacuccagcc

SEQ ID NO: 1929579 - RNA, 15 nt, Shigella flexneri 2a str. 2457T
ggcauucagugcaaa

SEQ ID NO: 1929580 - RNA, 17 nt, Shigella flexneri 2a str. 2457T
ggcauuaucucuugcca

SEQ ID NO: 1929581 - RNA, 16 nt, Shigella flexneri 2a str. 2457T
ggcaugacgcaggucg

SEQ ID NO: 1929582 - RNA, 19 nt, Shigella flexneri 2a str. 2457T
ggcauccugaucguccugc

SEQ ID NO: 1929583 - RNA, 14 nt, Shigella flexneri 2a str. 2457T
ggcaugaaugguca

SEQ ID NO: 1929584 - RNA, 22 nt, Shigella flexneri 2a str. 2457T
ggccaaaaccacagugacccgc

SEQ ID NO: 1929585 - RNA, 17 nt, Shigella flexneri 2a str. 2457T
ggccaaagccgccgagc

SEQ ID NO: 1929586 - RNA, 15 nt, Shigella flexneri 2a str. 2457T
ggccaaagaccagga

SEQ ID NO: 1929587 - RNA, 16 nt, Shigella flexneri 2a str. 2457T
ggcauuuugugcacga

SEQ ID NO: 1929588 - RNA, 16 nt, Shigella flexneri 2a str. 2457T
ggccaacuggcaaaag

SEQ ID NO: 1929589 - RNA, 18 nt, Shigella flexneri 2a str. 2457T
ggccaugaccgccgcagc

SEQ ID NO: 1929590 - RNA, 23 nt, Shigella flexneri 2a str. 2457T
ggcccaacuguugauccaggagc

SEQ ID NO: 1929591 - RNA, 13 nt, Shigella flexneri 2a str. 2457T
ggccaguccaggu

SEQ ID NO: 1929592 - RNA, 22 nt, Shigella flexneri 2a str. 2457T
ggccaguaagcaguccagcgcc

SEQ ID NO: 1929593 - RNA, 12 nt, Shigella flexneri 2a str. 2457T
ggccagccgccg

SEQ ID NO: 1929594 - RNA, 12 nt, Shigella flexneri 2a str. 2457T
ggccagaaaaaa

SEQ ID NO: 1929595 - RNA, 14 nt, Shigella flexneri 2a str. 2457T
ggccacagcgccag

SEQ ID NO: 1929596 - RNA, 14 nt, Shigella flexneri 2a str. 2457T
ggccaauuuggcug

SEQ ID NO: 1929597 - RNA, 16 nt, Shigella flexneri 2a str. 2457T
ggccaauuggcuggcc

SEQ ID NO: 1929598 - RNA, 16 nt, Shigella flexneri 2a str. 2457T
ggccaauuuggcugcc

SEQ ID NO: 1929599 - RNA, 20 nt, Shigella flexneri 2a str. 2457T
ggccacaaacgacgggccag

SEQ ID NO: 1929600 - RNA, 19 nt, Shigella flexneri 2a str. 2457T
ggccaauugcugugccgga

SEQ ID NO: 1929601 - RNA, 13 nt, Shigella flexneri 2a str. 2457T
ggccaauuggcug

SEQ ID NO: 1929602 - RNA, 17 nt, Shigella flexneri 2a str. 2457T
ggccaauccagcccugc

SEQ ID NO: 1929603 - RNA, 17 nt, Shigella flexneri 2a str. 2457T
ggccaaucagcaauaaa

SEQ ID NO: 1929604 - RNA, 21 nt, Shigella flexneri 2a str. 2457T
ggcccuuccccuucucgucgg

SEQ ID NO: 1929605 - RNA, 18 nt, Shigella flexneri 2a str. 2457T
ggcccgacgaugaccgca

SEQ ID NO: 1929606 - RNA, 15 nt, Shigella flexneri 2a str. 2457T
ggccgcaguaaagcg

SEQ ID NO: 1929607 - RNA, 19 nt, Shigella flexneri 2a str. 2457T
ggccgcgccgacugcgcca

SEQ ID NO: 1929608 - RNA, 22 nt, Shigella flexneri 2a str. 2457T
ggccgguaacgcuuucucacca

SEQ ID NO: 1929609 - RNA, 18 nt, Shigella flexneri 2a str. 2457T
ggccggguuuucucccuc

SEQ ID NO: 1929610 - RNA, 20 nt, Shigella flexneri 2a str. 2457T
ggccggguuuucucccucgc

SEQ ID NO: 1929611 - RNA, 15 nt, Shigella flexneri 2a str. 2457T
ggccguacccagcug

SEQ ID NO: 1929612 - RNA, 16 nt, Shigella flexneri 2a str. 2457T
ggccgcguaccgcagc

SEQ ID NO: 1929613 - RNA, 20 nt, Shigella flexneri 2a str. 2457T
ggccgcuuucugagcggccu

SEQ ID NO: 1929614 - RNA, 19 nt, Shigella flexneri 2a str. 2457T
ggccgcuuucugagcggcc

SEQ ID NO: 1929615 - RNA, 22 nt, Shigella flexneri 2a str. 2457T
ggccggcauauaccucagcaga

SEQ ID NO: 1929616 - RNA, 15 nt, Shigella flexneri 2a str. 2457T
ggccggaugacagac

SEQ ID NO: 1929617 - RNA, 13 nt, Shigella flexneri 2a str. 2457T
ggccggagccagc

SEQ ID NO: 1929618 - RNA, 14 nt, Shigella flexneri 2a str. 2457T
ggcgaugcggggug

SEQ ID NO: 1929619 - RNA, 15 nt, Shigella flexneri 2a str. 2457T
ggcgauacucugcca

SEQ ID NO: 1929620 - RNA, 18 nt, Shigella flexneri 2a str. 2457T
ggcgauaaucagcgccag

SEQ ID NO: 1929621 - RNA, 17 nt, Shigella flexneri 2a str. 2457T
ggcgaguucagaucagg

SEQ ID NO: 1929622 - RNA, 23 nt, Shigella flexneri 2a str. 2457T
ggcgaguauucuugcugauacuc

SEQ ID NO: 1929623 - RNA, 18 nt, Shigella flexneri 2a str. 2457T
ggcgagguaggcagucau

SEQ ID NO: 1929624 - RNA, 18 nt, Shigella flexneri 2a str. 2457T
ggcgagggaaccguccgc

SEQ ID NO: 1929625 - RNA, 18 nt, Shigella flexneri 2a str. 2457T
ggcgaggggaccgccccu

SEQ ID NO: 1929626 - RNA, 17 nt, Shigella flexneri 2a str. 2457T
ggcgauauccagcgcgg

SEQ ID NO: 1929627 - RNA, 20 nt, Shigella flexneri 2a str. 2457T
ggcgcauguuggcgcgguga

SEQ ID NO: 1929628 - RNA, 17 nt, Shigella flexneri 2a str. 2457T
ggcgcauguuggcgcgg

SEQ ID NO: 1929629 - RNA, 22 nt, Shigella flexneri 2a str. 2457T
ggcgcaucggucgaugaaagcg

SEQ ID NO: 1929630 - RNA, 13 nt, Shigella flexneri 2a str. 2457T
ggcgcaggccaau

SEQ ID NO: 1929631 - RNA, 23 nt, Shigella flexneri 2a str. 2457T
ggcgcacguucugucgcucugcu

SEQ ID NO: 1929632 - RNA, 16 nt, Shigella flexneri 2a str. 2457T
ggcgcaagggugccgg

SEQ ID NO: 1929633 - RNA, 16 nt, Shigella flexneri 2a str. 2457T
ggcgcaauggcgcaau

SEQ ID NO: 1929634 - RNA, 13 nt, Shigella flexneri 2a str. 2457T
ggcgcaauucccg

SEQ ID NO: 1929635 - RNA, 17 nt, Shigella flexneri 2a str. 2457T
ggcgcaccaguucgccg

SEQ ID NO: 1929636 - RNA, 16 nt, Shigella flexneri 2a str. 2457T
ggcgcgauucggcucc

SEQ ID NO: 1929637 - RNA, 19 nt, Shigella flexneri 2a str. 2457T
ggcgcgcagaaagaggcgg

SEQ ID NO: 1929638 - RNA, 14 nt, Shigella flexneri 2a str. 2457T
ggccuccugcagcg

SEQ ID NO: 1929639 - RNA, 16 nt, Shigella flexneri 2a str. 2457T
ggccuccccugauuca

SEQ ID NO: 1929640 - RNA, 16 nt, Shigella flexneri 2a str. 2457T
ggccucucuggccgcu

SEQ ID NO: 1929641 - RNA, 20 nt, Shigella flexneri 2a str. 2457T
ggccucucuggccgcuucca

SEQ ID NO: 1929642 - RNA, 12 nt, Shigella flexneri 2a str. 2457T
ggccugaaagcu

SEQ ID NO: 1929643 - RNA, 19 nt, Shigella flexneri 2a str. 2457T
ggccuacaauguuucugca

SEQ ID NO: 1929644 - RNA, 19 nt, Shigella flexneri 2a str. 2457T
ggccuacaugauuucugca

SEQ ID NO: 1929645 - RNA, 18 nt, Shigella flexneri 2a str. 2457T
ggccguuccauucaaacg

SEQ ID NO: 1929646 - RNA, 13 nt, Shigella flexneri 2a str. 2457T
ggccuugccguug

SEQ ID NO: 1929647 - RNA, 22 nt, Shigella flexneri 2a str. 2457T
ggccuggaauuacugauugcuc

SEQ ID NO: 1929648 - RNA, 14 nt, Shigella flexneri 2a str. 2457T
ggccugcucaagcg

SEQ ID NO: 1929649 - RNA, 15 nt, Shigella flexneri 2a str. 2457T
ggccugcgcgaccuc

SEQ ID NO: 1929650 - RNA, 21 nt, Shigella flexneri 2a str. 2457T
ggccugauaagcgcagcgcau

SEQ ID NO: 1929651 - RNA, 23 nt, Shigella flexneri 2a str. 2457T
ggccugauaagcguagcgcauca

SEQ ID NO: 1929652 - RNA, 19 nt, Shigella flexneri 2a str. 2457T
ggccugagacugaugacaa

SEQ ID NO: 1929653 - RNA, 11 nt, Shigella flexneri 2a str. 2457T
ggccugccgcu

SEQ ID NO: 1929654 - RNA, 21 nt, Shigella flexneri 2a str. 2457T
ggccugcccacgggcaggcuu

SEQ ID NO: 1929655 - RNA, 19 nt, Shigella flexneri 2a str. 2457T
ggcgagcaacgcagcggcg

SEQ ID NO: 1929656 - RNA, 14 nt, Shigella flexneri 2a str. 2457T
ggcgacuucugcuu

SEQ ID NO: 1929657 - RNA, 15 nt, Shigella flexneri 2a str. 2457T
ggcgacuucugcuuu

SEQ ID NO: 1929658 - RNA, 15 nt, Shigella flexneri 2a str. 2457T
ggcgagccagcgcau

SEQ ID NO: 1929659 - RNA, 11 nt, Shigella flexneri 2a str. 2457T
ggcgagcgcca

SEQ ID NO: 1929660 - RNA, 13 nt, Shigella flexneri 2a str. 2457T
ggcgaggcggggc

SEQ ID NO: 1929661 - RNA, 17 nt, Shigella flexneri 2a str. 2457T
ggcgaggcggggccaau

SEQ ID NO: 1929662 - RNA, 17 nt, Shigella flexneri 2a str. 2457T
ggcgacggcuggcaaaa

SEQ ID NO: 1929663 - RNA, 18 nt, Shigella flexneri 2a str. 2457T
ggcgaccguucgccaggu

SEQ ID NO: 1929664 - RNA, 22 nt, Shigella flexneri 2a str. 2457T
ggcgacaaggcguugauuggcg

SEQ ID NO: 1929665 - RNA, 14 nt, Shigella flexneri 2a str. 2457T
ggcgaaaagcuucu

SEQ ID NO: 1929666 - RNA, 17 nt, Shigella flexneri 2a str. 2457T
ggccuuuuccuuucaga

SEQ ID NO: 1929667 - RNA, 18 nt, Shigella flexneri 2a str. 2457T
ggccuuuuuggcaagcag

SEQ ID NO: 1929668 - RNA, 13 nt, Shigella flexneri 2a str. 2457T
ggcgaaagaaaag

SEQ ID NO: 1929669 - RNA, 23 nt, Shigella flexneri 2a str. 2457T
ggcgaagauacccgcgaggcgca

SEQ ID NO: 1929670 - RNA, 23 nt, Shigella flexneri 2a str. 2457T
ggcuauuagaaauuccuaugcaa

SEQ ID NO: 1929671 - RNA, 12 nt, Shigella flexneri 2a str. 2457T
ggcuaucccaaa

SEQ ID NO: 1929672 - RNA, 23 nt, Shigella flexneri 2a str. 2457T
ggcuaauucuguuuuaucagacc

SEQ ID NO: 1929673 - RNA, 18 nt, Shigella flexneri 2a str. 2457T
ggcuaaucgucaucgaca

SEQ ID NO: 1929674 - RNA, 15 nt, Shigella flexneri 2a str. 2457T
ggcuaaugccaguca

SEQ ID NO: 1929675 - RNA, 16 nt, Shigella flexneri 2a str. 2457T
ggcuaaugccagucag

SEQ ID NO: 1929676 - RNA, 14 nt, Shigella flexneri 2a str. 2457T
ggcuaccgcaguga

SEQ ID NO: 1929677 - RNA, 23 nt, Shigella flexneri 2a str. 2457T
ggcguuuugauuuucaccagcau

SEQ ID NO: 1929678 - RNA, 17 nt, Shigella flexneri 2a str. 2457T
ggcuaaccgcuuuucca

SEQ ID NO: 1929679 - RNA, 20 nt, Shigella flexneri 2a str. 2457T
ggcuaaccgucugugugccu

SEQ ID NO: 1929680 - RNA, 21 nt, Shigella flexneri 2a str. 2457T
ggcuaaccuuaugguguucag

SEQ ID NO: 1929681 - RNA, 18 nt, Shigella flexneri 2a str. 2457T
ggcuaaacguguaguauu

SEQ ID NO: 1929682 - RNA, 14 nt, Shigella flexneri 2a str. 2457T
ggcguuuccagcuc

SEQ ID NO: 1929683 - RNA, 18 nt, Shigella flexneri 2a str. 2457T
ggcguuuacgccgcauca

SEQ ID NO: 1929684 - RNA, 17 nt, Shigella flexneri 2a str. 2457T
ggcguuucacuucugag

SEQ ID NO: 1929685 - RNA, 16 nt, Shigella flexneri 2a str. 2457T
ggcguuauggcaaucu

SEQ ID NO: 1929686 - RNA, 19 nt, Shigella flexneri 2a str. 2457T
ggcgucgcauccggcacua

SEQ ID NO: 1929687 - RNA, 13 nt, Shigella flexneri 2a str. 2457T
ggcgucuccaccu

SEQ ID NO: 1929688 - RNA, 20 nt, Shigella flexneri 2a str. 2457T
ggcguggcccuaggcauaga

SEQ ID NO: 1929689 - RNA, 22 nt, Shigella flexneri 2a str. 2457T
ggcgugagaucgcgcgggagca

SEQ ID NO: 1929690 - RNA, 20 nt, Shigella flexneri 2a str. 2457T
ggcgugauucauacagcggc

SEQ ID NO: 1929691 - RNA, 21 nt, Shigella flexneri 2a str. 2457T
ggcgugauucauacagcggcc

SEQ ID NO: 1929692 - RNA, 18 nt, Shigella flexneri 2a str. 2457T
ggcgugagaucgcgcggg

SEQ ID NO: 1929693 - RNA, 17 nt, Shigella flexneri 2a str. 2457T
ggcgguuaauaaugauu

SEQ ID NO: 1929694 - RNA, 12 nt, Shigella flexneri 2a str. 2457T
ggcguaaacgcc

SEQ ID NO: 1929695 - RNA, 18 nt, Shigella flexneri 2a str. 2457T
ggcguaaacgccuuaucc

SEQ ID NO: 1929696 - RNA, 15 nt, Shigella flexneri 2a str. 2457T
ggcguaaugccuggg

SEQ ID NO: 1929697 - RNA, 24 nt, Shigella flexneri 2a str. 2457T
ggcgucagcguuccacgugcggcc

SEQ ID NO: 1929698 - RNA, 20 nt, Shigella flexneri 2a str. 2457T
ggcgggacagcauggggcug

SEQ ID NO: 1929699 - RNA, 12 nt, Shigella flexneri 2a str. 2457T
ggcgggaaaaau

SEQ ID NO: 1929700 - RNA, 21 nt, Shigella flexneri 2a str. 2457T
ggcgggaucaccugcacaugc

SEQ ID NO: 1929701 - RNA, 22 nt, Shigella flexneri 2a str. 2457T
ggcgggaucaccugcacaugca

SEQ ID NO: 1929702 - RNA, 18 nt, Shigella flexneri 2a str. 2457T
ggcggcuggguuggcaau

SEQ ID NO: 1929703 - RNA, 19 nt, Shigella flexneri 2a str. 2457T
ggcggcuuagcugaucgac

SEQ ID NO: 1929704 - RNA, 23 nt, Shigella flexneri 2a str. 2457T
ggcgggcuuuuuuugccccagaa

SEQ ID NO: 1929705 - RNA, 22 nt, Shigella flexneri 2a str. 2457T
ggcggguuaaccagcaccagcu

SEQ ID NO: 1929706 - RNA, 21 nt, Shigella flexneri 2a str. 2457T
ggcgguauagaucagacgaca

SEQ ID NO: 1929707 - RNA, 17 nt, Shigella flexneri 2a str. 2457T
ggcgcugaugagcaaau

SEQ ID NO: 1929708 - RNA, 16 nt, Shigella flexneri 2a str. 2457T
ggcgcugauaaauccc

SEQ ID NO: 1929709 - RNA, 22 nt, Shigella flexneri 2a str. 2457T
ggcgcguuaucagcaacuggca

SEQ ID NO: 1929710 - RNA, 23 nt, Shigella flexneri 2a str. 2457T
ggcgcguguuccagagaacgacc

SEQ ID NO: 1929711 - RNA, 21 nt, Shigella flexneri 2a str. 2457T
ggcgcugcuguacuuuuuccu

SEQ ID NO: 1929712 - RNA, 19 nt, Shigella flexneri 2a str. 2457T
ggcgcugcuuuccugcugc

SEQ ID NO: 1929713 - RNA, 20 nt, Shigella flexneri 2a str. 2457T
ggcggaaaucagagauuugc

SEQ ID NO: 1929714 - RNA, 19 nt, Shigella flexneri 2a str. 2457T
ggcgcggaaagcaccugcg

SEQ ID NO: 1929715 - RNA, 16 nt, Shigella flexneri 2a str. 2457T
ggcgcgggcaacagaa

SEQ ID NO: 1929716 - RNA, 15 nt, Shigella flexneri 2a str. 2457T
ggcggcgcgccaggc

SEQ ID NO: 1929717 - RNA, 15 nt, Shigella flexneri 2a str. 2457T
ggcggcucaccugca

SEQ ID NO: 1929718 - RNA, 13 nt, Shigella flexneri 2a str. 2457T
ggcggcgggcgca

SEQ ID NO: 1929719 - RNA, 15 nt, Shigella flexneri 2a str. 2457T
ggcggcgcgaggcga

SEQ ID NO: 1929720 - RNA, 24 nt, Shigella flexneri 2a str. 2457T
ggcggccggaugacagacuccgcu

SEQ ID NO: 1929721 - RNA, 14 nt, Shigella flexneri 2a str. 2457T
ggcggcaaugaaag

SEQ ID NO: 1929722 - RNA, 14 nt, Shigella flexneri 2a str. 2457T
ggcggauggcgaau

SEQ ID NO: 1929723 - RNA, 12 nt, Shigella flexneri 2a str. 2457T
gucaguaaugag

SEQ ID NO: 1929724 - RNA, 18 nt, Shigella flexneri 2a str. 2457T
gucaguaaccgcuuuuuc

SEQ ID NO: 1929725 - RNA, 20 nt, Shigella flexneri 2a str. 2457T
gucaguaaccgcuuuuucaa

SEQ ID NO: 1929726 - RNA, 21 nt, Shigella flexneri 2a str. 2457T
gucaguagcgcaaucaccacc

SEQ ID NO: 1929727 - RNA, 12 nt, Shigella flexneri 2a str. 2457T
gucagguaacaa

SEQ ID NO: 1929728 - RNA, 17 nt, Shigella flexneri 2a str. 2457T
gucagugucuuaucugg

SEQ ID NO: 1929729 - RNA, 19 nt, Shigella flexneri 2a str. 2457T
gucagugucuuaucuggca

SEQ ID NO: 1929730 - RNA, 13 nt, Shigella flexneri 2a str. 2457T
gucaguuaagcaa

SEQ ID NO: 1929731 - RNA, 16 nt, Shigella flexneri 2a str. 2457T
gucaguucccagggcu

SEQ ID NO: 1929732 - RNA, 19 nt, Shigella flexneri 2a str. 2457T
gucaugacgacaaggcagg

SEQ ID NO: 1929733 - RNA, 12 nt, Shigella flexneri 2a str. 2457T
gucaugcagcuc

SEQ ID NO: 1929734 - RNA, 22 nt, Shigella flexneri 2a str. 2457T
gucaguuuuucacgagagauac

SEQ ID NO: 1929735 - RNA, 20 nt, Shigella flexneri 2a str. 2457T
gucauaacacagguaacuua

SEQ ID NO: 1929736 - RNA, 19 nt, Shigella flexneri 2a str. 2457T
gucauaacuggucaucaaa

SEQ ID NO: 1929737 - RNA, 21 nt, Shigella flexneri 2a str. 2457T
gucauacuccagucgcugcug

SEQ ID NO: 1929738 - RNA, 19 nt, Shigella flexneri 2a str. 2457T
gucagcagguguccagcca

SEQ ID NO: 1929739 - RNA, 17 nt, Shigella flexneri 2a str. 2457T
gucagcacaaacaauuu

SEQ ID NO: 1929740 - RNA, 16 nt, Shigella flexneri 2a str. 2457T
gucagcaaccugcuua

SEQ ID NO: 1929741 - RNA, 18 nt, Shigella flexneri 2a str. 2457T
gucagcaccagagaacug

SEQ ID NO: 1929742 - RNA, 17 nt, Shigella flexneri 2a str. 2457T
gucagcguuccacgugc

SEQ ID NO: 1929743 - RNA, 15 nt, Shigella flexneri 2a str. 2457T
gucagcguuucaaca

SEQ ID NO: 1929744 - RNA, 13 nt, Shigella flexneri 2a str. 2457T
gucagccgcccgc

SEQ ID NO: 1929745 - RNA, 23 nt, Shigella flexneri 2a str. 2457T
gucagcgccaggcuuuccgucag

SEQ ID NO: 1929746 - RNA, 20 nt, Shigella flexneri 2a str. 2457T
gucaggcaaccgcugagcga

SEQ ID NO: 1929747 - RNA, 15 nt, Shigella flexneri 2a str. 2457T
gucaggcaaccgcug

SEQ ID NO: 1929748 - RNA, 15 nt, Shigella flexneri 2a str. 2457T
gucaggauggccggg

SEQ ID NO: 1929749 - RNA, 17 nt, Shigella flexneri 2a str. 2457T
gucaggagcuggaugcc

SEQ ID NO: 1929750 - RNA, 18 nt, Shigella flexneri 2a str. 2457T
gucagcucacaaauacgc

SEQ ID NO: 1929751 - RNA, 15 nt, Shigella flexneri 2a str. 2457T
gucagcucauccagc

SEQ ID NO: 1929752 - RNA, 20 nt, Shigella flexneri 2a str. 2457T
gucagcucucagccagcugg

SEQ ID NO: 1929753 - RNA, 20 nt, Shigella flexneri 2a str. 2457T
gucaggcaagccgcuaacag

SEQ ID NO: 1929754 - RNA, 14 nt, Shigella flexneri 2a str. 2457T
gucacaaauaaaaa

SEQ ID NO: 1929755 - RNA, 15 nt, Shigella flexneri 2a str. 2457T
gucaccgccagguga

SEQ ID NO: 1929756 - RNA, 16 nt, Shigella flexneri 2a str. 2457T
gucaccggaauaauga

SEQ ID NO: 1929757 - RNA, 18 nt, Shigella flexneri 2a str. 2457T
gucaccggaauaaugaug

SEQ ID NO: 1929758 - RNA, 15 nt, Shigella flexneri 2a str. 2457T
gucacggaaucccgu

SEQ ID NO: 1929759 - RNA, 14 nt, Shigella flexneri 2a str. 2457T
gucacugacuauuu

SEQ ID NO: 1929760 - RNA, 16 nt, Shigella flexneri 2a str. 2457T
gucacugcaucuuccg

SEQ ID NO: 1929761 - RNA, 23 nt, Shigella flexneri 2a str. 2457T
gucacuggugugucaucugcgac

SEQ ID NO: 1929762 - RNA, 16 nt, Shigella flexneri 2a str. 2457T
gucagaccaaaacgcg

SEQ ID NO: 1929763 - RNA, 23 nt, Shigella flexneri 2a str. 2457T
gucagaaaaaucaauauuuucaa

SEQ ID NO: 1929764 - RNA, 18 nt, Shigella flexneri 2a str. 2457T
gucagacgaagucaacaa

SEQ ID NO: 1929765 - RNA, 18 nt, Shigella flexneri 2a str. 2457T
gucagagagccagcccca

SEQ ID NO: 1929766 - RNA, 14 nt, Shigella flexneri 2a str. 2457T
gucagacuuaagcc

SEQ ID NO: 1929767 - RNA, 21 nt, Shigella flexneri 2a str. 2457T
gucagcaaaauacugaacagg

SEQ ID NO: 1929768 - RNA, 14 nt, Shigella flexneri 2a str. 2457T
gucagauuucaauc

SEQ ID NO: 1929769 - RNA, 22 nt, Shigella flexneri 2a str. 2457T
gucagaucgccccggucaucaa

SEQ ID NO: 1929770 - RNA, 13 nt, Shigella flexneri 2a str. 2457T
gucagauccgcca

SEQ ID NO: 1929771 - RNA, 13 nt, Shigella flexneri 2a str. 2457T
gucagagcauuac

SEQ ID NO: 1929772 - RNA, 12 nt, Shigella flexneri 2a str. 2457T
gucaacagggca

SEQ ID NO: 1929773 - RNA, 16 nt, Shigella flexneri 2a str. 2457T
gucaacagggcagaca

SEQ ID NO: 1929774 - RNA, 17 nt, Shigella flexneri 2a str. 2457T
gucaacaguucaugguu

SEQ ID NO: 1929775 - RNA, 20 nt, Shigella flexneri 2a str. 2457T
gucaaugccgucaccagcau

SEQ ID NO: 1929776 - RNA, 11 nt, Shigella flexneri 2a str. 2457T
gucaaucugac

SEQ ID NO: 1929777 - RNA, 15 nt, Shigella flexneri 2a str. 2457T
guauacgccacauca

SEQ ID NO: 1929778 - RNA, 13 nt, Shigella flexneri 2a str. 2457T
guauacgcuggcg

SEQ ID NO: 1929779 - RNA, 17 nt, Shigella flexneri 2a str. 2457T
guauacgggcuuuuuaa

SEQ ID NO: 1929780 - RNA, 14 nt, Shigella flexneri 2a str. 2457T
guauauaaaaaaca

SEQ ID NO: 1929781 - RNA, 14 nt, Shigella flexneri 2a str. 2457T
guauaccauuucug

SEQ ID NO: 1929782 - RNA, 21 nt, Shigella flexneri 2a str. 2457T
gucaaaagauugaauuauuca

SEQ ID NO: 1929783 - RNA, 16 nt, Shigella flexneri 2a str. 2457T
gucaaaaaaugaaacu

SEQ ID NO: 1929784 - RNA, 12 nt, Shigella flexneri 2a str. 2457T
guccguugaaaa

SEQ ID NO: 1929785 - RNA, 16 nt, Shigella flexneri 2a str. 2457T
guccguugaaaaugcu

SEQ ID NO: 1929786 - RNA, 14 nt, Shigella flexneri 2a str. 2457T
guccugcaaggugg

SEQ ID NO: 1929787 - RNA, 16 nt, Shigella flexneri 2a str. 2457T
guccugcaaggugguc

SEQ ID NO: 1929788 - RNA, 17 nt, Shigella flexneri 2a str. 2457T
guccggcagcagaaagc

SEQ ID NO: 1929789 - RNA, 20 nt, Shigella flexneri 2a str. 2457T
guccgcaauacaucaaagcg

SEQ ID NO: 1929790 - RNA, 14 nt, Shigella flexneri 2a str. 2457T
guccgccauggcuu

SEQ ID NO: 1929791 - RNA, 21 nt, Shigella flexneri 2a str. 2457T
gucccggaacaggcagggcca

SEQ ID NO: 1929792 - RNA, 22 nt, Shigella flexneri 2a str. 2457T
guccgauuaaaaacccugcaga

SEQ ID NO: 1929793 - RNA, 20 nt, Shigella flexneri 2a str. 2457T
gucccagccuugccagaugu

SEQ ID NO: 1929794 - RNA, 17 nt, Shigella flexneri 2a str. 2457T
gucccaugaugcgcggc

SEQ ID NO: 1929795 - RNA, 19 nt, Shigella flexneri 2a str. 2457T
guccccuggggagugaccu

SEQ ID NO: 1929796 - RNA, 23 nt, Shigella flexneri 2a str. 2457T
gucccgaccccgaccgucugcug

SEQ ID NO: 1929797 - RNA, 19 nt, Shigella flexneri 2a str. 2457T
guccccgagcacaugcagu

SEQ ID NO: 1929798 - RNA, 23 nt, Shigella flexneri 2a str. 2457T
guccccgagcacaugcagugccg

SEQ ID NO: 1929799 - RNA, 17 nt, Shigella flexneri 2a str. 2457T
guccccgagcacaugca

SEQ ID NO: 1929800 - RNA, 18 nt, Shigella flexneri 2a str. 2457T
gucccauuuuaaacguca

SEQ ID NO: 1929801 - RNA, 15 nt, Shigella flexneri 2a str. 2457T
gucauuuuuucgaca

SEQ ID NO: 1929802 - RNA, 20 nt, Shigella flexneri 2a str. 2457T
guccaaaagguccuucaggc

SEQ ID NO: 1929803 - RNA, 21 nt, Shigella flexneri 2a str. 2457T
gucauuucccaucucaauauu

SEQ ID NO: 1929804 - RNA, 13 nt, Shigella flexneri 2a str. 2457T
gucauuaugucug

SEQ ID NO: 1929805 - RNA, 14 nt, Shigella flexneri 2a str. 2457T
gucgauuucugggu

SEQ ID NO: 1929806 - RNA, 22 nt, Shigella flexneri 2a str. 2457T
gucgcaagacgaaaaaugaaua

SEQ ID NO: 1929807 - RNA, 13 nt, Shigella flexneri 2a str. 2457T
gucgcagccagcg

SEQ ID NO: 1929808 - RNA, 14 nt, Shigella flexneri 2a str. 2457T
gucgcagccagcgc

SEQ ID NO: 1929809 - RNA, 21 nt, Shigella flexneri 2a str. 2457T
gucgcacugcugauuuggaaa

SEQ ID NO: 1929810 - RNA, 20 nt, Shigella flexneri 2a str. 2457T
gucgaggccaauuuggcugc

SEQ ID NO: 1929811 - RNA, 21 nt, Shigella flexneri 2a str. 2457T
gucgagguacgcuccagcagg

SEQ ID NO: 1929812 - RNA, 16 nt, Shigella flexneri 2a str. 2457T
guccuguaaugagaau

SEQ ID NO: 1929813 - RNA, 18 nt, Shigella flexneri 2a str. 2457T
guccuucaauaucauuac

SEQ ID NO: 1929814 - RNA, 14 nt, Shigella flexneri 2a str. 2457T
guccuucuaccagc

SEQ ID NO: 1929815 - RNA, 19 nt, Shigella flexneri 2a str. 2457T
gucgccgggaugcuggggc

SEQ ID NO: 1929816 - RNA, 16 nt, Shigella flexneri 2a str. 2457T
gucgccguaccgggug

SEQ ID NO: 1929817 - RNA, 20 nt, Shigella flexneri 2a str. 2457T
gucgcaucuggcauaaacaa

SEQ ID NO: 1929818 - RNA, 20 nt, Shigella flexneri 2a str. 2457T
gucgcauccggcaugaacaa

SEQ ID NO: 1929819 - RNA, 13 nt, Shigella flexneri 2a str. 2457T
gucgccauccaga

SEQ ID NO: 1929820 - RNA, 16 nt, Shigella flexneri 2a str. 2457T
gucgccagucccuuuc

SEQ ID NO: 1929821 - RNA, 15 nt, Shigella flexneri 2a str. 2457T
gucgccgccuguucc

SEQ ID NO: 1929822 - RNA, 21 nt, Shigella flexneri 2a str. 2457T
gucgcccccgcgccagcgggc

SEQ ID NO: 1929823 - RNA, 15 nt, Shigella flexneri 2a str. 2457T
guauaacgcaaaaau

SEQ ID NO: 1929824 - RNA, 21 nt, Shigella flexneri 2a str. 2457T
guaguuuggugagaacaccaa

SEQ ID NO: 1929825 - RNA, 17 nt, Shigella flexneri 2a str. 2457T
guaguuuggcuucgugu

SEQ ID NO: 1929826 - RNA, 23 nt, Shigella flexneri 2a str. 2457T
guaguucuuucucugcaaauauu

SEQ ID NO: 1929827 - RNA, 14 nt, Shigella flexneri 2a str. 2457T
guaguugcugucga

SEQ ID NO: 1929828 - RNA, 16 nt, Shigella flexneri 2a str. 2457T
guaguugcccuuuuca

SEQ ID NO: 1929829 - RNA, 11 nt, Shigella flexneri 2a str. 2457T
guagguuuugg

SEQ ID NO: 1929830 - RNA, 22 nt, Shigella flexneri 2a str. 2457T
guaguauuugaguucacugccg

SEQ ID NO: 1929831 - RNA, 16 nt, Shigella flexneri 2a str. 2457T
guaguauuugaguuca

SEQ ID NO: 1929832 - RNA, 22 nt, Shigella flexneri 2a str. 2457T
guaguauccgugccgagguggu

SEQ ID NO: 1929833 - RNA, 15 nt, Shigella flexneri 2a str. 2457T
guagugccgucagca

SEQ ID NO: 1929834 - RNA, 18 nt, Shigella flexneri 2a str. 2457T
guagugauuuuaauaaau

SEQ ID NO: 1929835 - RNA, 19 nt, Shigella flexneri 2a str. 2457T
guagagguuauaaauaaaa

SEQ ID NO: 1929836 - RNA, 15 nt, Shigella flexneri 2a str. 2457T
guagccucgccgagc

SEQ ID NO: 1929837 - RNA, 15 nt, Shigella flexneri 2a str. 2457T
guagaucuugauuua

SEQ ID NO: 1929838 - RNA, 14 nt, Shigella flexneri 2a str. 2457T
guagcucagcugga

SEQ ID NO: 1929839 - RNA, 17 nt, Shigella flexneri 2a str. 2457T
guagcguuaccagcaaa

SEQ ID NO: 1929840 - RNA, 20 nt, Shigella flexneri 2a str. 2457T
guagcuaccuugcucggcgc

SEQ ID NO: 1929841 - RNA, 15 nt, Shigella flexneri 2a str. 2457T
guagcgucgccagca

SEQ ID NO: 1929842 - RNA, 21 nt, Shigella flexneri 2a str. 2457T
guagcgaugacagucuggaag

SEQ ID NO: 1929843 - RNA, 22 nt, Shigella flexneri 2a str. 2457T
guagcgaugacagucuggaagc

SEQ ID NO: 1929844 - RNA, 17 nt, Shigella flexneri 2a str. 2457T
guaggccugagaagcgc

SEQ ID NO: 1929845 - RNA, 23 nt, Shigella flexneri 2a str. 2457T
guagcugaaaaucagauccgcac

SEQ ID NO: 1929846 - RNA, 14 nt, Shigella flexneri 2a str. 2457T
guagcucuggguaa

SEQ ID NO: 1929847 - RNA, 22 nt, Shigella flexneri 2a str. 2457T
guaggcgcguuucugcgcuucu

SEQ ID NO: 1929848 - RNA, 17 nt, Shigella flexneri 2a str. 2457T
guaccucuucgcuggca

SEQ ID NO: 1929849 - RNA, 12 nt, Shigella flexneri 2a str. 2457T
guacgggaaacc

SEQ ID NO: 1929850 - RNA, 14 nt, Shigella flexneri 2a str. 2457T
guaccguugcugcc

SEQ ID NO: 1929851 - RNA, 12 nt, Shigella flexneri 2a str. 2457T
guaccuccuuca

SEQ ID NO: 1929852 - RNA, 19 nt, Shigella flexneri 2a str. 2457T
guacgguacugaaaccuga

SEQ ID NO: 1929853 - RNA, 14 nt, Shigella flexneri 2a str. 2457T
guacuccagcagac

SEQ ID NO: 1929854 - RNA, 19 nt, Shigella flexneri 2a str. 2457T
guagaccugauacauagca

SEQ ID NO: 1929855 - RNA, 13 nt, Shigella flexneri 2a str. 2457T
guagagcagcacg

SEQ ID NO: 1929856 - RNA, 14 nt, Shigella flexneri 2a str. 2457T
guagagaauccagu

SEQ ID NO: 1929857 - RNA, 18 nt, Shigella flexneri 2a str. 2457T
guacuccaucucgccauc

SEQ ID NO: 1929858 - RNA, 13 nt, Shigella flexneri 2a str. 2457T
guacuguuucacu

SEQ ID NO: 1929859 - RNA, 21 nt, Shigella flexneri 2a str. 2457T
guaccggacaugauuacugca

SEQ ID NO: 1929860 - RNA, 18 nt, Shigella flexneri 2a str. 2457T
guaccggacccuggucag

SEQ ID NO: 1929861 - RNA, 17 nt, Shigella flexneri 2a str. 2457T
guaccgccagcaggaac

SEQ ID NO: 1929862 - RNA, 18 nt, Shigella flexneri 2a str. 2457T
guacccggccuguuuauc

SEQ ID NO: 1929863 - RNA, 18 nt, Shigella flexneri 2a str. 2457T
guaccaugcgcaucaucg

SEQ ID NO: 1929864 - RNA, 16 nt, Shigella flexneri 2a str. 2457T
guaccaugauccugca

SEQ ID NO: 1929865 - RNA, 19 nt, Shigella flexneri 2a str. 2457T
guaccaucguccagcagca

SEQ ID NO: 1929866 - RNA, 16 nt, Shigella flexneri 2a str. 2457T
guacauggugcacauu

SEQ ID NO: 1929867 - RNA, 15 nt, Shigella flexneri 2a str. 2457T
guacauuguuuucca

SEQ ID NO: 1929868 - RNA, 18 nt, Shigella flexneri 2a str. 2457T
guacauuguuuuccagac

SEQ ID NO: 1929869 - RNA, 18 nt, Shigella flexneri 2a str. 2457T
guaccaaccgcaauugcu

SEQ ID NO: 1929870 - RNA, 22 nt, Shigella flexneri 2a str. 2457T
guaaugcucgacgagaauuucc

SEQ ID NO: 1929871 - RNA, 19 nt, Shigella flexneri 2a str. 2457T
guaauccuucccccaccac

SEQ ID NO: 1929872 - RNA, 17 nt, Shigella flexneri 2a str. 2457T
guaaucggcgaaaccgc

SEQ ID NO: 1929873 - RNA, 17 nt, Shigella flexneri 2a str. 2457T
guaaucguauucaacgg

SEQ ID NO: 1929874 - RNA, 22 nt, Shigella flexneri 2a str. 2457T
guaaaauucuacagaaaugaaa

SEQ ID NO: 1929875 - RNA, 23 nt, Shigella flexneri 2a str. 2457T
guaaaauuuggguguaucuucag

SEQ ID NO: 1929876 - RNA, 15 nt, Shigella flexneri 2a str. 2457T
guaaacaacuggcgc

SEQ ID NO: 1929877 - RNA, 17 nt, Shigella flexneri 2a str. 2457T
guaaaauaacagcggca

SEQ ID NO: 1929878 - RNA, 17 nt, Shigella flexneri 2a str. 2457T
gguuaaccuuuaaucag

SEQ ID NO: 1929879 - RNA, 20 nt, Shigella flexneri 2a str. 2457T
gguuaacaaucacaauagaa

SEQ ID NO: 1929880 - RNA, 14 nt, Shigella flexneri 2a str. 2457T
guaaacgccuuauc

SEQ ID NO: 1929881 - RNA, 21 nt, Shigella flexneri 2a str. 2457T
guaaacgccuuauccagccua

SEQ ID NO: 1929882 - RNA, 18 nt, Shigella flexneri 2a str. 2457T
guaaaccacccaccagcg

SEQ ID NO: 1929883 - RNA, 18 nt, Shigella flexneri 2a str. 2457T
guaaaccagagagaagcu

SEQ ID NO: 1929884 - RNA, 20 nt, Shigella flexneri 2a str. 2457T
guaaaccaccaguccuucua

SEQ ID NO: 1929885 - RNA, 16 nt, Shigella flexneri 2a str. 2457T
guaaacgcagcaucau

SEQ ID NO: 1929886 - RNA, 17 nt, Shigella flexneri 2a str. 2457T
guaaaccguuaucaccu

SEQ ID NO: 1929887 - RNA, 19 nt, Shigella flexneri 2a str. 2457T
guaaacccuaacaucaucc

SEQ ID NO: 1929888 - RNA, 17 nt, Shigella flexneri 2a str. 2457T
guaaaccgucagcacca

SEQ ID NO: 1929889 - RNA, 13 nt, Shigella flexneri 2a str. 2457T
guaaaugaacuca

SEQ ID NO: 1929890 - RNA, 19 nt, Shigella flexneri 2a str. 2457T
guaaauucucaauaucauc

SEQ ID NO: 1929891 - RNA, 15 nt, Shigella flexneri 2a str. 2457T
guaaauucaauaaau

SEQ ID NO: 1929892 - RNA, 20 nt, Shigella flexneri 2a str. 2457T
guaaauugcaaaccucagga

SEQ ID NO: 1929893 - RNA, 22 nt, Shigella flexneri 2a str. 2457T
guaaauugcaaaccucaggaau

SEQ ID NO: 1929894 - RNA, 15 nt, Shigella flexneri 2a str. 2457T
guaaauugcagcaca

SEQ ID NO: 1929895 - RNA, 16 nt, Shigella flexneri 2a str. 2457T
guaacagagcaucggu

SEQ ID NO: 1929896 - RNA, 19 nt, Shigella flexneri 2a str. 2457T
guaacaauauuugcagagg

SEQ ID NO: 1929897 - RNA, 16 nt, Shigella flexneri 2a str. 2457T
guaacaggaagcagcu

SEQ ID NO: 1929898 - RNA, 16 nt, Shigella flexneri 2a str. 2457T
guaacauacuccaccc

SEQ ID NO: 1929899 - RNA, 20 nt, Shigella flexneri 2a str. 2457T
guaaaucugucagguaacaa

SEQ ID NO: 1929900 - RNA, 23 nt, Shigella flexneri 2a str. 2457T
guaaauauggcgaacuggucugc

SEQ ID NO: 1929901 - RNA, 18 nt, Shigella flexneri 2a str. 2457T
guaaauacgccccacaga

SEQ ID NO: 1929902 - RNA, 23 nt, Shigella flexneri 2a str. 2457T
guaaaguuaccuucgaagaacuc

SEQ ID NO: 1929903 - RNA, 22 nt, Shigella flexneri 2a str. 2457T
guaaaggcggcagaacagaaca

SEQ ID NO: 1929904 - RNA, 19 nt, Shigella flexneri 2a str. 2457T
guaaagcgcgucaccaccu

SEQ ID NO: 1929905 - RNA, 20 nt, Shigella flexneri 2a str. 2457T
guaaagcggcgaguauucuu

SEQ ID NO: 1929906 - RNA, 23 nt, Shigella flexneri 2a str. 2457T
guaaccaaacguggucgccagca

SEQ ID NO: 1929907 - RNA, 22 nt, Shigella flexneri 2a str. 2457T
guaacauccagaucacgcagca

SEQ ID NO: 1929908 - RNA, 18 nt, Shigella flexneri 2a str. 2457T
guaacccccaaauaaccc

SEQ ID NO: 1929909 - RNA, 12 nt, Shigella flexneri 2a str. 2457T
guaaccuucacc

SEQ ID NO: 1929910 - RNA, 22 nt, Shigella flexneri 2a str. 2457T
guaaccuuuaucgcgcagcaga

SEQ ID NO: 1929911 - RNA, 16 nt, Shigella flexneri 2a str. 2457T
guaacgaugcaugaca

SEQ ID NO: 1929912 - RNA, 22 nt, Shigella flexneri 2a str. 2457T
guaacgccagcggucauaacgc

SEQ ID NO: 1929913 - RNA, 14 nt, Shigella flexneri 2a str. 2457T
guaacggcagauga

SEQ ID NO: 1929914 - RNA, 20 nt, Shigella flexneri 2a str. 2457T
guaacgccuuuuccagcgcg

SEQ ID NO: 1929915 - RNA, 21 nt, Shigella flexneri 2a str. 2457T
guaacguagcgggaagugaaa

SEQ ID NO: 1929916 - RNA, 22 nt, Shigella flexneri 2a str. 2457T
guaacugcugcucaaucugcgc

SEQ ID NO: 1929917 - RNA, 18 nt, Shigella flexneri 2a str. 2457T
guaagaaaguggcaggcu

SEQ ID NO: 1929918 - RNA, 16 nt, Shigella flexneri 2a str. 2457T
guaagagaacagauag

SEQ ID NO: 1929919 - RNA, 21 nt, Shigella flexneri 2a str. 2457T
guaaguuacauuuuaauaaug

SEQ ID NO: 1929920 - RNA, 15 nt, Shigella flexneri 2a str. 2457T
guaauaacaauacau

SEQ ID NO: 1929921 - RNA, 22 nt, Shigella flexneri 2a str. 2457T
guaauaacaauacaucuuuuca

SEQ ID NO: 1929922 - RNA, 20 nt, Shigella flexneri 2a str. 2457T
guaauaggcaggcaucauca

SEQ ID NO: 1929923 - RNA, 22 nt, Shigella flexneri 2a str. 2457T
guaauaugugcgccacgcagcg

SEQ ID NO: 1929924 - RNA, 22 nt, Shigella flexneri 2a str. 2457T
guaauauuucucggcaaauuca

SEQ ID NO: 1929925 - RNA, 14 nt, Shigella flexneri 2a str. 2457T
guaaggcaucuucu

SEQ ID NO: 1929926 - RNA, 12 nt, Shigella flexneri 2a str. 2457T
guaaguaaugac

SEQ ID NO: 1929927 - RNA, 22 nt, Shigella flexneri 2a str. 2457T
guaaguacauuaaaauuggcuu

SEQ ID NO: 1929928 - RNA, 15 nt, Shigella flexneri 2a str. 2457T
guaagcgccagggca

SEQ ID NO: 1929929 - RNA, 16 nt, Shigella flexneri 2a str. 2457T
guaagcgccagggcau

SEQ ID NO: 1929930 - RNA, 13 nt, Shigella flexneri 2a str. 2457T
ggucgugcagaac

SEQ ID NO: 1929931 - RNA, 16 nt, Shigella flexneri 2a str. 2457T
ggucgucuuuuacagc

SEQ ID NO: 1929932 - RNA, 12 nt, Shigella flexneri 2a str. 2457T
ggugaaaaaaag

SEQ ID NO: 1929933 - RNA, 13 nt, Shigella flexneri 2a str. 2457T
ggugaaaaaccaa

SEQ ID NO: 1929934 - RNA, 17 nt, Shigella flexneri 2a str. 2457T
ggugaaaguaaaaaaga

SEQ ID NO: 1929935 - RNA, 14 nt, Shigella flexneri 2a str. 2457T
ggugacgcauuuua

SEQ ID NO: 1929936 - RNA, 21 nt, Shigella flexneri 2a str. 2457T
ggugaguuguaucgcucggca

SEQ ID NO: 1929937 - RNA, 19 nt, Shigella flexneri 2a str. 2457T
ggugacgcaaccgcaaaug

SEQ ID NO: 1929938 - RNA, 18 nt, Shigella flexneri 2a str. 2457T
ggugaccuguaacguugc

SEQ ID NO: 1929939 - RNA, 18 nt, Shigella flexneri 2a str. 2457T
ggugaccgaucgcccgcc

SEQ ID NO: 1929940 - RNA, 13 nt, Shigella flexneri 2a str. 2457T
ggugaaccagaga

SEQ ID NO: 1929941 - RNA, 18 nt, Shigella flexneri 2a str. 2457T
ggugaaaguaaaaaagaa

SEQ ID NO: 1929942 - RNA, 18 nt, Shigella flexneri 2a str. 2457T
ggugaaaguaacaaagcc

SEQ ID NO: 1929943 - RNA, 14 nt, Shigella flexneri 2a str. 2457T
ggucgacagcagcc

SEQ ID NO: 1929944 - RNA, 12 nt, Shigella flexneri 2a str. 2457T
gguccuuuugcc

SEQ ID NO: 1929945 - RNA, 18 nt, Shigella flexneri 2a str. 2457T
ggucaguaaugagcacag

SEQ ID NO: 1929946 - RNA, 19 nt, Shigella flexneri 2a str. 2457T
ggucagguauuuugucagc

SEQ ID NO: 1929947 - RNA, 16 nt, Shigella flexneri 2a str. 2457T
ggucaggcuaaagaaa

SEQ ID NO: 1929948 - RNA, 14 nt, Shigella flexneri 2a str. 2457T
ggucagcggccagu

SEQ ID NO: 1929949 - RNA, 18 nt, Shigella flexneri 2a str. 2457T
ggucgcacugcucuuuuu

SEQ ID NO: 1929950 - RNA, 16 nt, Shigella flexneri 2a str. 2457T
ggucgcaucauuuaaa

SEQ ID NO: 1929951 - RNA, 16 nt, Shigella flexneri 2a str. 2457T
ggucgccagaagguga

SEQ ID NO: 1929952 - RNA, 18 nt, Shigella flexneri 2a str. 2457T
ggugcgaccaaacugcuc

SEQ ID NO: 1929953 - RNA, 22 nt, Shigella flexneri 2a str. 2457T
ggugccgcagccccagagccug

SEQ ID NO: 1929954 - RNA, 13 nt, Shigella flexneri 2a str. 2457T
ggugaucacccag

SEQ ID NO: 1929955 - RNA, 17 nt, Shigella flexneri 2a str. 2457T
ggugcaacccgccaggu

SEQ ID NO: 1929956 - RNA, 22 nt, Shigella flexneri 2a str. 2457T
ggugcaagaaaugacagaguuc

SEQ ID NO: 1929957 - RNA, 22 nt, Shigella flexneri 2a str. 2457T
ggugcagacaugacgcccggca

SEQ ID NO: 1929958 - RNA, 15 nt, Shigella flexneri 2a str. 2457T
ggugcguugaagaua

SEQ ID NO: 1929959 - RNA, 22 nt, Shigella flexneri 2a str. 2457T
ggugcucaucagcccggcaaug

SEQ ID NO: 1929960 - RNA, 21 nt, Shigella flexneri 2a str. 2457T
ggugucgccuuccacuucugc

SEQ ID NO: 1929961 - RNA, 19 nt, Shigella flexneri 2a str. 2457T
ggugucguuacgccgcaga

SEQ ID NO: 1929962 - RNA, 13 nt, Shigella flexneri 2a str. 2457T
ggucaccaguuca

SEQ ID NO: 1929963 - RNA, 21 nt, Shigella flexneri 2a str. 2457T
gguaucuuuaaucgagauacg

SEQ ID NO: 1929964 - RNA, 18 nt, Shigella flexneri 2a str. 2457T
gguauggucacggugagg

SEQ ID NO: 1929965 - RNA, 15 nt, Shigella flexneri 2a str. 2457T
gguagggauaucuuc

SEQ ID NO: 1929966 - RNA, 22 nt, Shigella flexneri 2a str. 2457T
gguagcugcccccgcucuucca

SEQ ID NO: 1929967 - RNA, 20 nt, Shigella flexneri 2a str. 2457T
gguagcaaaacaauuuggug

SEQ ID NO: 1929968 - RNA, 18 nt, Shigella flexneri 2a str. 2457T
gguaucgggcaguuuacc

SEQ ID NO: 1929969 - RNA, 17 nt, Shigella flexneri 2a str. 2457T
gguaucgcacagaugcg

SEQ ID NO: 1929970 - RNA, 15 nt, Shigella flexneri 2a str. 2457T
gguauacgucccggu

SEQ ID NO: 1929971 - RNA, 13 nt, Shigella flexneri 2a str. 2457T
gguaguuucuccc

SEQ ID NO: 1929972 - RNA, 16 nt, Shigella flexneri 2a str. 2457T
gguagucgcgguccgg

SEQ ID NO: 1929973 - RNA, 16 nt, Shigella flexneri 2a str. 2457T
gguaauggcaauacug

SEQ ID NO: 1929974 - RNA, 14 nt, Shigella flexneri 2a str. 2457T
gguaaugccaguca

SEQ ID NO: 1929975 - RNA, 21 nt, Shigella flexneri 2a str. 2457T
gguaaguucacgcagguuaga

SEQ ID NO: 1929976 - RNA, 17 nt, Shigella flexneri 2a str. 2457T
gguaauaaugcagaucu

SEQ ID NO: 1929977 - RNA, 15 nt, Shigella flexneri 2a str. 2457T
gguaauaggcaggca

SEQ ID NO: 1929978 - RNA, 14 nt, Shigella flexneri 2a str. 2457T
gguacaaacaucau

SEQ ID NO: 1929979 - RNA, 16 nt, Shigella flexneri 2a str. 2457T
gguacaaagccaacag

SEQ ID NO: 1929980 - RNA, 22 nt, Shigella flexneri 2a str. 2457T
gguaccguugaccaguccggcu

SEQ ID NO: 1929981 - RNA, 19 nt, Shigella flexneri 2a str. 2457T
gguacgccuuaguuauaaa

SEQ ID NO: 1929982 - RNA, 22 nt, Shigella flexneri 2a str. 2457T
gguacgcaauuccagcaagcca

SEQ ID NO: 1929983 - RNA, 16 nt, Shigella flexneri 2a str. 2457T
gguacuuucacaggga

SEQ ID NO: 1929984 - RNA, 18 nt, Shigella flexneri 2a str. 2457T
gguacuaucagcguaaag

SEQ ID NO: 1929985 - RNA, 15 nt, Shigella flexneri 2a str. 2457T
gguagagaaguuuga

SEQ ID NO: 1929986 - RNA, 23 nt, Shigella flexneri 2a str. 2457T
gguagagguuauaaauaaaaauu

SEQ ID NO: 1929987 - RNA, 15 nt, Shigella flexneri 2a str. 2457T
gguagagguuauaaa

SEQ ID NO: 1929988 - RNA, 17 nt, Shigella flexneri 2a str. 2457T
gguaacauacuccaccc

SEQ ID NO: 1929989 - RNA, 13 nt, Shigella flexneri 2a str. 2457T
gguaaggauaaaa

SEQ ID NO: 1929990 - RNA, 18 nt, Shigella flexneri 2a str. 2457T
gguaaaaccgacuuaaaa

SEQ ID NO: 1929991 - RNA, 17 nt, Shigella flexneri 2a str. 2457T
gguaaacaacaugcuau

SEQ ID NO: 1929992 - RNA, 17 nt, Shigella flexneri 2a str. 2457T
ggguucaaaaacuaauu

SEQ ID NO: 1929993 - RNA, 21 nt, Shigella flexneri 2a str. 2457T
gggugcgaauaagcugcguga

SEQ ID NO: 1929994 - RNA, 14 nt, Shigella flexneri 2a str. 2457T
gggcaucagcagca

SEQ ID NO: 1929995 - RNA, 18 nt, Shigella flexneri 2a str. 2457T
gggcauggugucaccacc

SEQ ID NO: 1929996 - RNA, 19 nt, Shigella flexneri 2a str. 2457T
gggcauguguuagcccugu

SEQ ID NO: 1929997 - RNA, 15 nt, Shigella flexneri 2a str. 2457T
gggcaucucaggcag

SEQ ID NO: 1929998 - RNA, 23 nt, Shigella flexneri 2a str. 2457T
gggcaggcuucaacacaggccgg

SEQ ID NO: 1929999 - RNA, 18 nt, Shigella flexneri 2a str. 2457T
gggcaggggcuucuuccg

SEQ ID NO: 1930000 - RNA, 17 nt, Shigella flexneri 2a str. 2457T
gggccaacuggcaaaag

SEQ ID NO: 1930001 - RNA, 19 nt, Shigella flexneri 2a str. 2457T
gggauaaagcccccgcaac

SEQ ID NO: 1930002 - RNA, 15 nt, Shigella flexneri 2a str. 2457T
gggauaaagcccccg

SEQ ID NO: 1930003 - RNA, 22 nt, Shigella flexneri 2a str. 2457T
gggaucugauucugauccugca

SEQ ID NO: 1930004 - RNA, 22 nt, Shigella flexneri 2a str. 2457T
gggcaauuucacguucacccau

SEQ ID NO: 1930005 - RNA, 21 nt, Shigella flexneri 2a str. 2457T
gggcaaugcgggugcaaucaa

SEQ ID NO: 1930006 - RNA, 19 nt, Shigella flexneri 2a str. 2457T
gggaugccgaaaaaaguca

SEQ ID NO: 1930007 - RNA, 20 nt, Shigella flexneri 2a str. 2457T
gggaugcucuuuucuuuauc

SEQ ID NO: 1930008 - RNA, 11 nt, Shigella flexneri 2a str. 2457T
gggaugcugau

SEQ ID NO: 1930009 - RNA, 14 nt, Shigella flexneri 2a str. 2457T
gggaugcuggggcc

SEQ ID NO: 1930010 - RNA, 23 nt, Shigella flexneri 2a str. 2457T
gggagcgcuuuuuuccugccgcu

SEQ ID NO: 1930011 - RNA, 13 nt, Shigella flexneri 2a str. 2457T
gggaguccacaac

SEQ ID NO: 1930012 - RNA, 12 nt, Shigella flexneri 2a str. 2457T
gggaacagaggc

SEQ ID NO: 1930013 - RNA, 15 nt, Shigella flexneri 2a str. 2457T
gggaaaucaccacca

SEQ ID NO: 1930014 - RNA, 22 nt, Shigella flexneri 2a str. 2457T
gggaacaguacauuguuuucca

SEQ ID NO: 1930015 - RNA, 18 nt, Shigella flexneri 2a str. 2457T
gggcgagguggauauaaa

SEQ ID NO: 1930016 - RNA, 13 nt, Shigella flexneri 2a str. 2457T
gggcgauccggca

SEQ ID NO: 1930017 - RNA, 14 nt, Shigella flexneri 2a str. 2457T
gggcgauuuccuuc

SEQ ID NO: 1930018 - RNA, 17 nt, Shigella flexneri 2a str. 2457T
gggcgacaaucaucgcc

SEQ ID NO: 1930019 - RNA, 15 nt, Shigella flexneri 2a str. 2457T
gggcgaccaaucaaa

SEQ ID NO: 1930020 - RNA, 22 nt, Shigella flexneri 2a str. 2457T
gggcuuuucagaaauuuggcuc

SEQ ID NO: 1930021 - RNA, 17 nt, Shigella flexneri 2a str. 2457T
gggcuuuuuuauuucau

SEQ ID NO: 1930022 - RNA, 22 nt, Shigella flexneri 2a str. 2457T
gggcuuuuuaauuccugccgcg

SEQ ID NO: 1930023 - RNA, 12 nt, Shigella flexneri 2a str. 2457T
gggcuggccaau

SEQ ID NO: 1930024 - RNA, 19 nt, Shigella flexneri 2a str. 2457T
gggcuggccaauuggcugg

SEQ ID NO: 1930025 - RNA, 19 nt, Shigella flexneri 2a str. 2457T
gggcgcguccggcgucgcu

SEQ ID NO: 1930026 - RNA, 20 nt, Shigella flexneri 2a str. 2457T
ggcuuuaauaccugccuggu

SEQ ID NO: 1930027 - RNA, 13 nt, Shigella flexneri 2a str. 2457T
ggcuuuuuuauug

SEQ ID NO: 1930028 - RNA, 19 nt, Shigella flexneri 2a str. 2457T
ggcuuuuuuacaucaucag

SEQ ID NO: 1930029 - RNA, 19 nt, Shigella flexneri 2a str. 2457T
gggaaaacgcuggcagcau

SEQ ID NO: 1930030 - RNA, 15 nt, Shigella flexneri 2a str. 2457T
ggcuucguccaugcu

SEQ ID NO: 1930031 - RNA, 13 nt, Shigella flexneri 2a str. 2457T
ggcuucgacgcuc

SEQ ID NO: 1930032 - RNA, 18 nt, Shigella flexneri 2a str. 2457T
ggcuucgacgauugcuuu

SEQ ID NO: 1930033 - RNA, 13 nt, Shigella flexneri 2a str. 2457T
ggcuucgccuccu

SEQ ID NO: 1930034 - RNA, 18 nt, Shigella flexneri 2a str. 2457T
ggcuuaaacgcagagaca

SEQ ID NO: 1930035 - RNA, 13 nt, Shigella flexneri 2a str. 2457T
ggcuuaauugccc

SEQ ID NO: 1930036 - RNA, 16 nt, Shigella flexneri 2a str. 2457T
ggcuuaccaaauaaac

SEQ ID NO: 1930037 - RNA, 20 nt, Shigella flexneri 2a str. 2457T
ggcuguucccacgcacagaa

SEQ ID NO: 1930038 - RNA, 19 nt, Shigella flexneri 2a str. 2457T
ggcugugguacugccggcg

SEQ ID NO: 1930039 - RNA, 20 nt, Shigella flexneri 2a str. 2457T
ggcuguugauguccaguucc

SEQ ID NO: 1930040 - RNA, 20 nt, Shigella flexneri 2a str. 2457T
ggcuguuucaggaacaccgc

SEQ ID NO: 1930041 - RNA, 18 nt, Shigella flexneri 2a str. 2457T
ggcugugggguauuucca

SEQ ID NO: 1930042 - RNA, 18 nt, Shigella flexneri 2a str. 2457T
ggcugguuacucaccagc

SEQ ID NO: 1930043 - RNA, 18 nt, Shigella flexneri 2a str. 2457T
ggcugguuuucagcgaaa

SEQ ID NO: 1930044 - RNA, 18 nt, Shigella flexneri 2a str. 2457T
ggcuggaagcuggauuaa

SEQ ID NO: 1930045 - RNA, 14 nt, Shigella flexneri 2a str. 2457T
ggcuggaucagacg

SEQ ID NO: 1930046 - RNA, 16 nt, Shigella flexneri 2a str. 2457T
ggcuggaucagacgca

SEQ ID NO: 1930047 - RNA, 13 nt, Shigella flexneri 2a str. 2457T
ggcuggcuguucu

SEQ ID NO: 1930048 - RNA, 19 nt, Shigella flexneri 2a str. 2457T
ggcuggccccgucagcaaa

SEQ ID NO: 1930049 - RNA, 15 nt, Shigella flexneri 2a str. 2457T
ggcuggcgcauacca

SEQ ID NO: 1930050 - RNA, 20 nt, Shigella flexneri 2a str. 2457T
ggcugccggaaggcagccuu

SEQ ID NO: 1930051 - RNA, 24 nt, Shigella flexneri 2a str. 2457T
ggcugccagaucaucguuuccgau

SEQ ID NO: 1930052 - RNA, 10 nt, Shigella flexneri 2a str. 2457T
ggcugcagca

SEQ ID NO: 1930053 - RNA, 20 nt, Shigella flexneri 2a str. 2457T
ggcugcugauguucgccaga

SEQ ID NO: 1930054 - RNA, 23 nt, Shigella flexneri 2a str. 2457T
ggcugcgggaguugcuccacugc

SEQ ID NO: 1930055 - RNA, 17 nt, Shigella flexneri 2a str. 2457T
ggcugcagaauacggau

SEQ ID NO: 1930056 - RNA, 22 nt, Shigella flexneri 2a str. 2457T
ggcugauuccgguuggccugcc

SEQ ID NO: 1930057 - RNA, 13 nt, Shigella flexneri 2a str. 2457T
ggcugaagaagua

SEQ ID NO: 1930058 - RNA, 18 nt, Shigella flexneri 2a str. 2457T
ggcugacauuaucagaca

SEQ ID NO: 1930059 - RNA, 14 nt, Shigella flexneri 2a str. 2457T
ggcugacaaaucag

SEQ ID NO: 1930060 - RNA, 21 nt, Shigella flexneri 2a str. 2457T
ggcugacacuauucgccagca

SEQ ID NO: 1930061 - RNA, 19 nt, Shigella flexneri 2a str. 2457T
ggcugacguuaagaaaacg

SEQ ID NO: 1930062 - RNA, 10 nt, Shigella flexneri 2a str. 2457T
ggcugacugu

SEQ ID NO: 1930063 - RNA, 21 nt, Shigella flexneri 2a str. 2457T
ggcugacugucgcagccagcg

SEQ ID NO: 1930064 - RNA, 23 nt, Shigella flexneri 2a str. 2457T
ggcugagauuuaugacaaacgca

SEQ ID NO: 1930065 - RNA, 20 nt, Shigella flexneri 2a str. 2457T
ggcugagcaaacaguucugc

SEQ ID NO: 1930066 - RNA, 14 nt, Shigella flexneri 2a str. 2457T
ggcucuuuaaacag

SEQ ID NO: 1930067 - RNA, 19 nt, Shigella flexneri 2a str. 2457T
ggcucugguguucuuuuac

SEQ ID NO: 1930068 - RNA, 22 nt, Shigella flexneri 2a str. 2457T
ggcucgccuuucggcugcagca

SEQ ID NO: 1930069 - RNA, 21 nt, Shigella flexneri 2a str. 2457T
ggcuccgggaaaacgcuggca

SEQ ID NO: 1930070 - RNA, 21 nt, Shigella flexneri 2a str. 2457T
ggcucauugccauucgccagu

SEQ ID NO: 1930071 - RNA, 23 nt, Shigella flexneri 2a str. 2457T
ggcucaucaccccgcgcucacac

SEQ ID NO: 1930072 - RNA, 20 nt, Shigella flexneri 2a str. 2457T
ggcucauccccugaugcugu

SEQ ID NO: 1930073 - RNA, 21 nt, Shigella flexneri 2a str. 2457T
ggcucaucucuucgguuggca

SEQ ID NO: 1930074 - RNA, 12 nt, Shigella flexneri 2a str. 2457T
ggcucagcucug

SEQ ID NO: 1930075 - RNA, 15 nt, Shigella flexneri 2a str. 2457T
ggcucauaccuucca

SEQ ID NO: 1930076 - RNA, 16 nt, Shigella flexneri 2a str. 2457T
ggcucauaccuuccac

SEQ ID NO: 1930077 - RNA, 12 nt, Shigella flexneri 2a str. 2457T
uaauuagcuguu

SEQ ID NO: 1930078 - RNA, 15 nt, Shigella flexneri 2a str. 2457T
uaauuagugcugcug

SEQ ID NO: 1930079 - RNA, 13 nt, Shigella flexneri 2a str. 2457T
uaauucauuugcu

SEQ ID NO: 1930080 - RNA, 21 nt, Shigella flexneri 2a str. 2457T
uaauucccugcgccagcggca

SEQ ID NO: 1930081 - RNA, 23 nt, Shigella flexneri 2a str. 2457T
uaauuccucccguuaugaucagc

SEQ ID NO: 1930082 - RNA, 15 nt, Shigella flexneri 2a str. 2457T
uaauuccugcgcugc

SEQ ID NO: 1930083 - RNA, 13 nt, Shigella flexneri 2a str. 2457T
uaauugagaacca

SEQ ID NO: 1930084 - RNA, 19 nt, Shigella flexneri 2a str. 2457T
uaauugagaaccacaauga

SEQ ID NO: 1930085 - RNA, 19 nt, Shigella flexneri 2a str. 2457T
uaauugaccagaucuucau

SEQ ID NO: 1930086 - RNA, 19 nt, Shigella flexneri 2a str. 2457T
uaauuggaguaucaccauc

SEQ ID NO: 1930087 - RNA, 18 nt, Shigella flexneri 2a str. 2457T
uaauuggaguaucaccau

SEQ ID NO: 1930088 - RNA, 20 nt, Shigella flexneri 2a str. 2457T
uaauuggaauacauauauua

SEQ ID NO: 1930089 - RNA, 13 nt, Shigella flexneri 2a str. 2457T
uaauugcuuuuac

SEQ ID NO: 1930090 - RNA, 17 nt, Shigella flexneri 2a str. 2457T
uaauugcuccauccauu

SEQ ID NO: 1930091 - RNA, 18 nt, Shigella flexneri 2a str. 2457T
uaauuacugcuuaaaugc

SEQ ID NO: 1930092 - RNA, 20 nt, Shigella flexneri 2a str. 2457T
uaaugugucugaaagcagac

SEQ ID NO: 1930093 - RNA, 13 nt, Shigella flexneri 2a str. 2457T
uaaucuuuaaaaa

SEQ ID NO: 1930094 - RNA, 20 nt, Shigella flexneri 2a str. 2457T
uaaucuuuaaaaaaagcauu

SEQ ID NO: 1930095 - RNA, 14 nt, Shigella flexneri 2a str. 2457T
uaaucuuuucauau

SEQ ID NO: 1930096 - RNA, 23 nt, Shigella flexneri 2a str. 2457T
uaauggcaauacugacaucagca

SEQ ID NO: 1930097 - RNA, 12 nt, Shigella flexneri 2a str. 2457T
uaauggaaaacu

SEQ ID NO: 1930098 - RNA, 23 nt, Shigella flexneri 2a str. 2457T
uaaucugaauggcugcauuccuu

SEQ ID NO: 1930099 - RNA, 12 nt, Shigella flexneri 2a str. 2457T
uaaucugccagc

SEQ ID NO: 1930100 - RNA, 22 nt, Shigella flexneri 2a str. 2457T
uaaucuggauguucggcgucuu

SEQ ID NO: 1930101 - RNA, 22 nt, Shigella flexneri 2a str. 2457T
uaaucugguaucgaguggcgca

SEQ ID NO: 1930102 - RNA, 14 nt, Shigella flexneri 2a str. 2457T
uaaucuguacugug

SEQ ID NO: 1930103 - RNA, 17 nt, Shigella flexneri 2a str. 2457T
uaaucuguuucaucucu

SEQ ID NO: 1930104 - RNA, 19 nt, Shigella flexneri 2a str. 2457T
uaaucuuagguaaugacuc

SEQ ID NO: 1930105 - RNA, 22 nt, Shigella flexneri 2a str. 2457T
uaaucguuggcagacguuuuuu

SEQ ID NO: 1930106 - RNA, 13 nt, Shigella flexneri 2a str. 2457T
uaaucgugaaaag

SEQ ID NO: 1930107 - RNA, 14 nt, Shigella flexneri 2a str. 2457T
uaaucgugaaaagc

SEQ ID NO: 1930108 - RNA, 14 nt, Shigella flexneri 2a str. 2457T
uaaucguugucuua

SEQ ID NO: 1930109 - RNA, 14 nt, Shigella flexneri 2a str. 2457T
uaaucuauauuucu

SEQ ID NO: 1930110 - RNA, 16 nt, Shigella flexneri 2a str. 2457T
uaaucgcucagcgcau

SEQ ID NO: 1930111 - RNA, 18 nt, Shigella flexneri 2a str. 2457T
uaaucgucaguuuuucac

SEQ ID NO: 1930112 - RNA, 18 nt, Shigella flexneri 2a str. 2457T
uaaucgccuuaauaaccc

SEQ ID NO: 1930113 - RNA, 14 nt, Shigella flexneri 2a str. 2457T
uaaucgccuuaccc

SEQ ID NO: 1930114 - RNA, 22 nt, Shigella flexneri 2a str. 2457T
uaaucgccagcaaaaucaccau

SEQ ID NO: 1930115 - RNA, 16 nt, Shigella flexneri 2a str. 2457T
uaaucgcccggauauc

SEQ ID NO: 1930116 - RNA, 15 nt, Shigella flexneri 2a str. 2457T
uaauccagccuacaa

SEQ ID NO: 1930117 - RNA, 20 nt, Shigella flexneri 2a str. 2457T
uaaucgcauugguuuuuugg

SEQ ID NO: 1930118 - RNA, 22 nt, Shigella flexneri 2a str. 2457T
uaauaugcugguuccugacucc

SEQ ID NO: 1930119 - RNA, 21 nt, Shigella flexneri 2a str. 2457T
uaauaugcucaacaauaaacu

SEQ ID NO: 1930120 - RNA, 14 nt, Shigella flexneri 2a str. 2457T
uaauaugcaauuca

SEQ ID NO: 1930121 - RNA, 16 nt, Shigella flexneri 2a str. 2457T
uaaucauauuaaauuu

SEQ ID NO: 1930122 - RNA, 17 nt, Shigella flexneri 2a str. 2457T
uaauccacuuucuuaaa

SEQ ID NO: 1930123 - RNA, 21 nt, Shigella flexneri 2a str. 2457T
uaaucaucacgccaauaccgc

SEQ ID NO: 1930124 - RNA, 13 nt, Shigella flexneri 2a str. 2457T
uaaucauauuaaa

SEQ ID NO: 1930125 - RNA, 14 nt, Shigella flexneri 2a str. 2457T
uaaucaggcuaucu

SEQ ID NO: 1930126 - RNA, 16 nt, Shigella flexneri 2a str. 2457T
uaaucagcuuuuccau

SEQ ID NO: 1930127 - RNA, 21 nt, Shigella flexneri 2a str. 2457T
uaaucaacgcaccgacaaauu

SEQ ID NO: 1930128 - RNA, 14 nt, Shigella flexneri 2a str. 2457T
uaaucaagcccugg

SEQ ID NO: 1930129 - RNA, 17 nt, Shigella flexneri 2a str. 2457T
uaaucaauaaaaauaca

SEQ ID NO: 1930130 - RNA, 20 nt, Shigella flexneri 2a str. 2457T
uaaucaaucuuuacacacaa

SEQ ID NO: 1930131 - RNA, 13 nt, Shigella flexneri 2a str. 2457T
uaaggauaaaaaa

SEQ ID NO: 1930132 - RNA, 15 nt, Shigella flexneri 2a str. 2457T
uaaggguaaaaggau

SEQ ID NO: 1930133 - RNA, 22 nt, Shigella flexneri 2a str. 2457T
uaaggcgcgagguuuuccuuca

SEQ ID NO: 1930134 - RNA, 12 nt, Shigella flexneri 2a str. 2457T
uaaggcguucac

SEQ ID NO: 1930135 - RNA, 20 nt, Shigella flexneri 2a str. 2457T
uaaggcgcaauaaucagugc

SEQ ID NO: 1930136 - RNA, 18 nt, Shigella flexneri 2a str. 2457T
uaaggcugaugaagcaag

SEQ ID NO: 1930137 - RNA, 14 nt, Shigella flexneri 2a str. 2457T
uaaggcuucaauca

SEQ ID NO: 1930138 - RNA, 13 nt, Shigella flexneri 2a str. 2457T
uaaguacauuaag

SEQ ID NO: 1930139 - RNA, 19 nt, Shigella flexneri 2a str. 2457T
uaagguguuuacaccgcau

SEQ ID NO: 1930140 - RNA, 23 nt, Shigella flexneri 2a str. 2457T
uaaggucagacgaagucaacaag

SEQ ID NO: 1930141 - RNA, 18 nt, Shigella flexneri 2a str. 2457T
uaagguucacuuaaucuc

SEQ ID NO: 1930142 - RNA, 21 nt, Shigella flexneri 2a str. 2457T
uaagguuaagccucacgguuc

SEQ ID NO: 1930143 - RNA, 18 nt, Shigella flexneri 2a str. 2457T
uaagucggucaaguaauu

SEQ ID NO: 1930144 - RNA, 21 nt, Shigella flexneri 2a str. 2457T
uaaguguuucacuuucaucac

SEQ ID NO: 1930145 - RNA, 22 nt, Shigella flexneri 2a str. 2457T
uaagugauacccaucaucgcau

SEQ ID NO: 1930146 - RNA, 13 nt, Shigella flexneri 2a str. 2457T
uaagucugcgcca

SEQ ID NO: 1930147 - RNA, 18 nt, Shigella flexneri 2a str. 2457T
uaaguuacauuuuaauaa

SEQ ID NO: 1930148 - RNA, 21 nt, Shigella flexneri 2a str. 2457T
uaaguuacauuuuaauaauga

SEQ ID NO: 1930149 - RNA, 21 nt, Shigella flexneri 2a str. 2457T
uaaguucaguaugaucuugcc

SEQ ID NO: 1930150 - RNA, 19 nt, Shigella flexneri 2a str. 2457T
uaaguucaaguuugcuuca

SEQ ID NO: 1930151 - RNA, 23 nt, Shigella flexneri 2a str. 2457T
uaaguuuaucccaauuaucugga

SEQ ID NO: 1930152 - RNA, 15 nt, Shigella flexneri 2a str. 2457T
uaauaacaauacauc

SEQ ID NO: 1930153 - RNA, 17 nt, Shigella flexneri 2a str. 2457T
uaauaacaauacaucuu

SEQ ID NO: 1930154 - RNA, 21 nt, Shigella flexneri 2a str. 2457T
uaauaaauuugguucaauuug

SEQ ID NO: 1930155 - RNA, 19 nt, Shigella flexneri 2a str. 2457T
uaauaaaugccggaagcug

SEQ ID NO: 1930156 - RNA, 21 nt, Shigella flexneri 2a str. 2457T
uaauaaaugccggaagcugca

SEQ ID NO: 1930157 - RNA, 20 nt, Shigella flexneri 2a str. 2457T
uaauaaauguggagauaaac

SEQ ID NO: 1930158 - RNA, 22 nt, Shigella flexneri 2a str. 2457T
uaauaaagcccccuguuugucu

SEQ ID NO: 1930159 - RNA, 20 nt, Shigella flexneri 2a str. 2457T
uaauaaaauuuacaguauaa

SEQ ID NO: 1930160 - RNA, 15 nt, Shigella flexneri 2a str. 2457T
uaauaaacaucagcu

SEQ ID NO: 1930161 - RNA, 21 nt, Shigella flexneri 2a str. 2457T
uaauaagguucauugagcgca

SEQ ID NO: 1930162 - RNA, 20 nt, Shigella flexneri 2a str. 2457T
uaauaauugccccuuggcau

SEQ ID NO: 1930163 - RNA, 15 nt, Shigella flexneri 2a str. 2457T
uaauaaugagcagaa

SEQ ID NO: 1930164 - RNA, 22 nt, Shigella flexneri 2a str. 2457T
uaauaaugagcagaaaaaccca

SEQ ID NO: 1930165 - RNA, 21 nt, Shigella flexneri 2a str. 2457T
uaauacacuaacagaacaaua

SEQ ID NO: 1930166 - RNA, 18 nt, Shigella flexneri 2a str. 2457T
uaauaauuucugcacauc

SEQ ID NO: 1930167 - RNA, 13 nt, Shigella flexneri 2a str. 2457T
uaauaccaucggc

SEQ ID NO: 1930168 - RNA, 21 nt, Shigella flexneri 2a str. 2457T
uaauaccgacuccguagaacc

SEQ ID NO: 1930169 - RNA, 15 nt, Shigella flexneri 2a str. 2457T
uaauaccugccuggu

SEQ ID NO: 1930170 - RNA, 20 nt, Shigella flexneri 2a str. 2457T
uaauacgccggucacgcccg

SEQ ID NO: 1930171 - RNA, 15 nt, Shigella flexneri 2a str. 2457T
uaauacgcucaucug

SEQ ID NO: 1930172 - RNA, 23 nt, Shigella flexneri 2a str. 2457T
uaauacguagcaccgacgucgau

SEQ ID NO: 1930173 - RNA, 17 nt, Shigella flexneri 2a str. 2457T
uacuaaaugugcaauca

SEQ ID NO: 1930174 - RNA, 22 nt, Shigella flexneri 2a str. 2457T
uacguugcauuuccauaaauug

SEQ ID NO: 1930175 - RNA, 22 nt, Shigella flexneri 2a str. 2457T
uacguucauggcgcgacauggc

SEQ ID NO: 1930176 - RNA, 18 nt, Shigella flexneri 2a str. 2457T
uacgguacugaaaccuga

SEQ ID NO: 1930177 - RNA, 15 nt, Shigella flexneri 2a str. 2457T
uacgugcacaggcaa

SEQ ID NO: 1930178 - RNA, 13 nt, Shigella flexneri 2a str. 2457T
uacguaauucacc

SEQ ID NO: 1930179 - RNA, 17 nt, Shigella flexneri 2a str. 2457T
uacguaaugcucauucu

SEQ ID NO: 1930180 - RNA, 15 nt, Shigella flexneri 2a str. 2457T
uacguguuguuccag

SEQ ID NO: 1930181 - RNA, 17 nt, Shigella flexneri 2a str. 2457T
uacgcugcauuuucggc

SEQ ID NO: 1930182 - RNA, 16 nt, Shigella flexneri 2a str. 2457T
uacgcucaucaggccu

SEQ ID NO: 1930183 - RNA, 23 nt, Shigella flexneri 2a str. 2457T
uacgcucaucaggccuacaaaau

SEQ ID NO: 1930184 - RNA, 18 nt, Shigella flexneri 2a str. 2457T
uacgcgcaauauccugcg

SEQ ID NO: 1930185 - RNA, 15 nt, Shigella flexneri 2a str. 2457T
uacgcucacugcaaa

SEQ ID NO: 1930186 - RNA, 12 nt, Shigella flexneri 2a str. 2457T
uacgcucaucug

SEQ ID NO: 1930187 - RNA, 13 nt, Shigella flexneri 2a str. 2457T
uacgcuccagcag

SEQ ID NO: 1930188 - RNA, 19 nt, Shigella flexneri 2a str. 2457T
uacggguucaagucccguc

SEQ ID NO: 1930189 - RNA, 23 nt, Shigella flexneri 2a str. 2457T
uacgcuuaucaggccuacaaaau

SEQ ID NO: 1930190 - RNA, 17 nt, Shigella flexneri 2a str. 2457T
uaccugguccuucaucu

SEQ ID NO: 1930191 - RNA, 22 nt, Shigella flexneri 2a str. 2457T
uaccuguauaaacuauccugug

SEQ ID NO: 1930192 - RNA, 18 nt, Shigella flexneri 2a str. 2457T
uaccuguccguuuucagu

SEQ ID NO: 1930193 - RNA, 16 nt, Shigella flexneri 2a str. 2457T
uacgacacgccuccug

SEQ ID NO: 1930194 - RNA, 14 nt, Shigella flexneri 2a str. 2457T
uacgcaaaaaacau

SEQ ID NO: 1930195 - RNA, 11 nt, Shigella flexneri 2a str. 2457T
uacgcaaaaaa

SEQ ID NO: 1930196 - RNA, 22 nt, Shigella flexneri 2a str. 2457T
uacgagucgccuguacuuccug

SEQ ID NO: 1930197 - RNA, 16 nt, Shigella flexneri 2a str. 2457T
uacgcccaucauucag

SEQ ID NO: 1930198 - RNA, 21 nt, Shigella flexneri 2a str. 2457T
uacgcgccaaucggcaauuca

SEQ ID NO: 1930199 - RNA, 14 nt, Shigella flexneri 2a str. 2457T
uacgcaagucauac

SEQ ID NO: 1930200 - RNA, 21 nt, Shigella flexneri 2a str. 2457T
uacgcaaucaaaaucuccugc

SEQ ID NO: 1930201 - RNA, 21 nt, Shigella flexneri 2a str. 2457T
uacgcaacugccaguaaagca

SEQ ID NO: 1930202 - RNA, 13 nt, Shigella flexneri 2a str. 2457T
uacgccagucacg

SEQ ID NO: 1930203 - RNA, 20 nt, Shigella flexneri 2a str. 2457T
uacgccagucacggugcagc

SEQ ID NO: 1930204 - RNA, 21 nt, Shigella flexneri 2a str. 2457T
uacgccaucgccagcagccau

SEQ ID NO: 1930205 - RNA, 13 nt, Shigella flexneri 2a str. 2457T
uacgccacaucau

SEQ ID NO: 1930206 - RNA, 15 nt, Shigella flexneri 2a str. 2457T
uacccauauuuaauc

SEQ ID NO: 1930207 - RNA, 15 nt, Shigella flexneri 2a str. 2457T
uaccauuaucaccaa

SEQ ID NO: 1930208 - RNA, 12 nt, Shigella flexneri 2a str. 2457T
uaccauuuguuc

SEQ ID NO: 1930209 - RNA, 17 nt, Shigella flexneri 2a str. 2457T
uacccagcagcagcggu

SEQ ID NO: 1930210 - RNA, 21 nt, Shigella flexneri 2a str. 2457T
uacccgcucgaaguuuuccuc

SEQ ID NO: 1930211 - RNA, 15 nt, Shigella flexneri 2a str. 2457T
uacccgaugcaaaaa

SEQ ID NO: 1930212 - RNA, 19 nt, Shigella flexneri 2a str. 2457T
uaccaguucgcuuuccguu

SEQ ID NO: 1930213 - RNA, 13 nt, Shigella flexneri 2a str. 2457T
uaccaguugauca

SEQ ID NO: 1930214 - RNA, 13 nt, Shigella flexneri 2a str. 2457T
uaccaccagugcc

SEQ ID NO: 1930215 - RNA, 12 nt, Shigella flexneri 2a str. 2457T
uaccaguccuac

SEQ ID NO: 1930216 - RNA, 18 nt, Shigella flexneri 2a str. 2457T
uaccacagacaaaauccu

SEQ ID NO: 1930217 - RNA, 21 nt, Shigella flexneri 2a str. 2457T
uaccacagacaaaauccugcc

SEQ ID NO: 1930218 - RNA, 11 nt, Shigella flexneri 2a str. 2457T
uaccacaucaa

SEQ ID NO: 1930219 - RNA, 21 nt, Shigella flexneri 2a str. 2457T
uaccuaaaagcacgccagaca

SEQ ID NO: 1930220 - RNA, 21 nt, Shigella flexneri 2a str. 2457T
uaccucacgaucacagcaguc

SEQ ID NO: 1930221 - RNA, 15 nt, Shigella flexneri 2a str. 2457T
uaccucauggagaua

SEQ ID NO: 1930222 - RNA, 20 nt, Shigella flexneri 2a str. 2457T
uaccugccuggcaguggaau

SEQ ID NO: 1930223 - RNA, 18 nt, Shigella flexneri 2a str. 2457T
uaccugaugagaugcugg

SEQ ID NO: 1930224 - RNA, 21 nt, Shigella flexneri 2a str. 2457T
uaccucuuguucgucgucuuu

SEQ ID NO: 1930225 - RNA, 12 nt, Shigella flexneri 2a str. 2457T
uaccgagcagcc

SEQ ID NO: 1930226 - RNA, 17 nt, Shigella flexneri 2a str. 2457T
uaccggacuccagacac

SEQ ID NO: 1930227 - RNA, 17 nt, Shigella flexneri 2a str. 2457T
uaccgaagaguaaccaa

SEQ ID NO: 1930228 - RNA, 18 nt, Shigella flexneri 2a str. 2457T
uaccgugcuguacagcag

SEQ ID NO: 1930229 - RNA, 15 nt, Shigella flexneri 2a str. 2457T
uaccgugcugacuca

SEQ ID NO: 1930230 - RNA, 15 nt, Shigella flexneri 2a str. 2457T
uaccguucucuuuaa

SEQ ID NO: 1930231 - RNA, 13 nt, Shigella flexneri 2a str. 2457T
uaccgucuguaac

SEQ ID NO: 1930232 - RNA, 13 nt, Shigella flexneri 2a str. 2457T
uaccggcaaacuu

SEQ ID NO: 1930233 - RNA, 14 nt, Shigella flexneri 2a str. 2457T
uacauauauuacaa

SEQ ID NO: 1930234 - RNA, 17 nt, Shigella flexneri 2a str. 2457T
uacaggcugguuucucu

SEQ ID NO: 1930235 - RNA, 19 nt, Shigella flexneri 2a str. 2457T
uacaggcaacgaccagaaa

SEQ ID NO: 1930236 - RNA, 15 nt, Shigella flexneri 2a str. 2457T
uacaggcagcuuaga

SEQ ID NO: 1930237 - RNA, 16 nt, Shigella flexneri 2a str. 2457T
uacaggcagcuuagaa

SEQ ID NO: 1930238 - RNA, 16 nt, Shigella flexneri 2a str. 2457T
uacagcggacagccau

SEQ ID NO: 1930239 - RNA, 18 nt, Shigella flexneri 2a str. 2457T
uacauccucucuuuccuu

SEQ ID NO: 1930240 - RNA, 18 nt, Shigella flexneri 2a str. 2457T
uacaucuuccacuuugau

SEQ ID NO: 1930241 - RNA, 15 nt, Shigella flexneri 2a str. 2457T
uacaucuucaucauc

SEQ ID NO: 1930242 - RNA, 16 nt, Shigella flexneri 2a str. 2457T
uacaugaagcacugca

SEQ ID NO: 1930243 - RNA, 20 nt, Shigella flexneri 2a str. 2457T
uacauguguuaaauauuuaa

SEQ ID NO: 1930244 - RNA, 23 nt, Shigella flexneri 2a str. 2457T
uacauguaaaaggcgcuaaaaau

SEQ ID NO: 1930245 - RNA, 12 nt, Shigella flexneri 2a str. 2457T
uacaugcagggc

SEQ ID NO: 1930246 - RNA, 12 nt, Shigella flexneri 2a str. 2457T
uacaugcugcuu

SEQ ID NO: 1930247 - RNA, 17 nt, Shigella flexneri 2a str. 2457T
uacaugcgcgacaaaaa

SEQ ID NO: 1930248 - RNA, 20 nt, Shigella flexneri 2a str. 2457T
uacaugcgcgacaaaaauua

SEQ ID NO: 1930249 - RNA, 16 nt, Shigella flexneri 2a str. 2457T
uacauuaguaauuucc

SEQ ID NO: 1930250 - RNA, 21 nt, Shigella flexneri 2a str. 2457T
uacauuaucgcgucuaaauuu

SEQ ID NO: 1930251 - RNA, 22 nt, Shigella flexneri 2a str. 2457T
uacauuaaacgccguucuucag

SEQ ID NO: 1930252 - RNA, 17 nt, Shigella flexneri 2a str. 2457T
uacauugccgacauggc

SEQ ID NO: 1930253 - RNA, 20 nt, Shigella flexneri 2a str. 2457T
uacauugauauacagcccgg

SEQ ID NO: 1930254 - RNA, 19 nt, Shigella flexneri 2a str. 2457T
uacauugcguaaccaauca

SEQ ID NO: 1930255 - RNA, 13 nt, Shigella flexneri 2a str. 2457T
uacauugccgggc

SEQ ID NO: 1930256 - RNA, 11 nt, Shigella flexneri 2a str. 2457T
uacauuuugac

SEQ ID NO: 1930257 - RNA, 14 nt, Shigella flexneri 2a str. 2457T
uacauuuuaauaau

SEQ ID NO: 1930258 - RNA, 15 nt, Shigella flexneri 2a str. 2457T
uacauuuuaauaaug

SEQ ID NO: 1930259 - RNA, 15 nt, Shigella flexneri 2a str. 2457T
uaccaauaaucaauu

SEQ ID NO: 1930260 - RNA, 21 nt, Shigella flexneri 2a str. 2457T
uaccaaaaucaucaauugcca

SEQ ID NO: 1930261 - RNA, 18 nt, Shigella flexneri 2a str. 2457T
uaccaaauuggcaaaauu

SEQ ID NO: 1930262 - RNA, 16 nt, Shigella flexneri 2a str. 2457T
uacaaucaggccaauc

SEQ ID NO: 1930263 - RNA, 16 nt, Shigella flexneri 2a str. 2457T
uacaauaugaauuacu

SEQ ID NO: 1930264 - RNA, 18 nt, Shigella flexneri 2a str. 2457T
uacaacgcaauauccgcc

SEQ ID NO: 1930265 - RNA, 19 nt, Shigella flexneri 2a str. 2457T
uacaacgccguuuaauauu

SEQ ID NO: 1930266 - RNA, 23 nt, Shigella flexneri 2a str. 2457T
uacaaccgcaaagguugcugcgc

SEQ ID NO: 1930267 - RNA, 19 nt, Shigella flexneri 2a str. 2457T
uacaacucgcuuaagccau

SEQ ID NO: 1930268 - RNA, 22 nt, Shigella flexneri 2a str. 2457T
uacaaauuugugcaaauucaau

SEQ ID NO: 1930269 - RNA, 18 nt, Shigella flexneri 2a str. 2457T
uacaacaucguaucuggc

SEQ ID NO: 1930270 - RNA, 21 nt, Shigella flexneri 2a str. 2457T
uacaaccaaaucugauuaaua

SEQ ID NO: 1930271 - RNA, 19 nt, Shigella flexneri 2a str. 2457T
uacaaagggcuaacgugca

SEQ ID NO: 1930272 - RNA, 15 nt, Shigella flexneri 2a str. 2457T
uacagccgccagaca

SEQ ID NO: 1930273 - RNA, 13 nt, Shigella flexneri 2a str. 2457T
uacagccggaacg

SEQ ID NO: 1930274 - RNA, 16 nt, Shigella flexneri 2a str. 2457T
uacagccggacccaca

SEQ ID NO: 1930275 - RNA, 16 nt, Shigella flexneri 2a str. 2457T
uacagccgccagacaa

SEQ ID NO: 1930276 - RNA, 14 nt, Shigella flexneri 2a str. 2457T
uacagcgcgggcug

SEQ ID NO: 1930277 - RNA, 19 nt, Shigella flexneri 2a str. 2457T
uacagcgcccgccagcacc

SEQ ID NO: 1930278 - RNA, 18 nt, Shigella flexneri 2a str. 2457T
uacagccgacaaugccac

SEQ ID NO: 1930279 - RNA, 18 nt, Shigella flexneri 2a str. 2457T
uacagcccagacaaauga

SEQ ID NO: 1930280 - RNA, 16 nt, Shigella flexneri 2a str. 2457T
uacagagggcaggcaa

SEQ ID NO: 1930281 - RNA, 22 nt, Shigella flexneri 2a str. 2457T
uacagauccgccauuucuccuc

SEQ ID NO: 1930282 - RNA, 16 nt, Shigella flexneri 2a str. 2457T
uacacagacgguuuuu

SEQ ID NO: 1930283 - RNA, 17 nt, Shigella flexneri 2a str. 2457T
uacacacuuuccaggcg

SEQ ID NO: 1930284 - RNA, 15 nt, Shigella flexneri 2a str. 2457T
uacagacucaaacca

SEQ ID NO: 1930285 - RNA, 15 nt, Shigella flexneri 2a str. 2457T
uacagaagcaccgua

SEQ ID NO: 1930286 - RNA, 17 nt, Shigella flexneri 2a str. 2457T
uacagaaaugaaaaaau

SEQ ID NO: 1930287 - RNA, 14 nt, Shigella flexneri 2a str. 2457T
uacagaaaugaaaa

SEQ ID NO: 1930288 - RNA, 23 nt, Shigella flexneri 2a str. 2457T
uagaaugccaaguaauagaacua

SEQ ID NO: 1930289 - RNA, 19 nt, Shigella flexneri 2a str. 2457T
uagaauggcaucagaagga

SEQ ID NO: 1930290 - RNA, 20 nt, Shigella flexneri 2a str. 2457T
uagaauuguaaucuauugaa

SEQ ID NO: 1930291 - RNA, 16 nt, Shigella flexneri 2a str. 2457T
uagaaccuaagaacca

SEQ ID NO: 1930292 - RNA, 16 nt, Shigella flexneri 2a str. 2457T
uagaagccagucagcu

SEQ ID NO: 1930293 - RNA, 19 nt, Shigella flexneri 2a str. 2457T
uagaagccauuaaacacca

SEQ ID NO: 1930294 - RNA, 11 nt, Shigella flexneri 2a str. 2457T
uacuaucugcu

SEQ ID NO: 1930295 - RNA, 16 nt, Shigella flexneri 2a str. 2457T
uacuaugauuuuccug

SEQ ID NO: 1930296 - RNA, 21 nt, Shigella flexneri 2a str. 2457T
uacuaugauuuuccugaggag

SEQ ID NO: 1930297 - RNA, 21 nt, Shigella flexneri 2a str. 2457T
uagaaacgagguauguuucug

SEQ ID NO: 1930298 - RNA, 18 nt, Shigella flexneri 2a str. 2457T
uagaaacagucuggagca

SEQ ID NO: 1930299 - RNA, 21 nt, Shigella flexneri 2a str. 2457T
uacuauaaguguaaaauucua

SEQ ID NO: 1930300 - RNA, 13 nt, Shigella flexneri 2a str. 2457T
uagaaaucauuca

SEQ ID NO: 1930301 - RNA, 12 nt, Shigella flexneri 2a str. 2457T
uagaaagggaag

SEQ ID NO: 1930302 - RNA, 22 nt, Shigella flexneri 2a str. 2457T
uagauacccggauacaacucgc

SEQ ID NO: 1930303 - RNA, 13 nt, Shigella flexneri 2a str. 2457T
uagauagcguucu

SEQ ID NO: 1930304 - RNA, 15 nt, Shigella flexneri 2a str. 2457T
uagauaaaaaugaag

SEQ ID NO: 1930305 - RNA, 14 nt, Shigella flexneri 2a str. 2457T
uagagguuauaaau

SEQ ID NO: 1930306 - RNA, 13 nt, Shigella flexneri 2a str. 2457T
uagagcacaucac

SEQ ID NO: 1930307 - RNA, 22 nt, Shigella flexneri 2a str. 2457T
uagagauuuuuccccaccucau

SEQ ID NO: 1930308 - RNA, 21 nt, Shigella flexneri 2a str. 2457T
uagagcgcggcgcaggcaaua

SEQ ID NO: 1930309 - RNA, 22 nt, Shigella flexneri 2a str. 2457T
uagagccgguuuugguuuucug

SEQ ID NO: 1930310 - RNA, 16 nt, Shigella flexneri 2a str. 2457T
uagagggaauggcaga

SEQ ID NO: 1930311 - RNA, 17 nt, Shigella flexneri 2a str. 2457T
uagagggaauggcagau

SEQ ID NO: 1930312 - RNA, 22 nt, Shigella flexneri 2a str. 2457T
uagagaaaguaaaccaccaguc

SEQ ID NO: 1930313 - RNA, 20 nt, Shigella flexneri 2a str. 2457T
uagacuuuagcgcaaucgca

SEQ ID NO: 1930314 - RNA, 13 nt, Shigella flexneri 2a str. 2457T
uagagaauuaauc

SEQ ID NO: 1930315 - RNA, 16 nt, Shigella flexneri 2a str. 2457T
uagacgcuuucacccg

SEQ ID NO: 1930316 - RNA, 14 nt, Shigella flexneri 2a str. 2457T
uagacauuacgcau

SEQ ID NO: 1930317 - RNA, 23 nt, Shigella flexneri 2a str. 2457T
uagacauuacgcauuugcgcgua

SEQ ID NO: 1930318 - RNA, 16 nt, Shigella flexneri 2a str. 2457T
uagaccugauacauag

SEQ ID NO: 1930319 - RNA, 20 nt, Shigella flexneri 2a str. 2457T
uagacgaacguuuaauaaaa

SEQ ID NO: 1930320 - RNA, 14 nt, Shigella flexneri 2a str. 2457T
uagaccugauacau

SEQ ID NO: 1930321 - RNA, 16 nt, Shigella flexneri 2a str. 2457T
uagaccggaccugucg

SEQ ID NO: 1930322 - RNA, 12 nt, Shigella flexneri 2a str. 2457T
uagaccagagcu

SEQ ID NO: 1930323 - RNA, 17 nt, Shigella flexneri 2a str. 2457T
uaggagguuuccggguc

SEQ ID NO: 1930324 - RNA, 11 nt, Shigella flexneri 2a str. 2457T
uaggagccacc

SEQ ID NO: 1930325 - RNA, 22 nt, Shigella flexneri 2a str. 2457T
uaggaagccggaauuuuccuuc

SEQ ID NO: 1930326 - RNA, 18 nt, Shigella flexneri 2a str. 2457T
uaggccgcugaugccagg

SEQ ID NO: 1930327 - RNA, 12 nt, Shigella flexneri 2a str. 2457T
uaggccggauaa

SEQ ID NO: 1930328 - RNA, 15 nt, Shigella flexneri 2a str. 2457T
uagggaugcagaaug

SEQ ID NO: 1930329 - RNA, 14 nt, Shigella flexneri 2a str. 2457T
uagggaguuuaauc

SEQ ID NO: 1930330 - RNA, 13 nt, Shigella flexneri 2a str. 2457T
uagggacaaagaa

SEQ ID NO: 1930331 - RNA, 19 nt, Shigella flexneri 2a str. 2457T
uaggcggcaaacaguuucu

SEQ ID NO: 1930332 - RNA, 16 nt, Shigella flexneri 2a str. 2457T
uagguaaacaucacau

SEQ ID NO: 1930333 - RNA, 12 nt, Shigella flexneri 2a str. 2457T
uaggguaaauua

SEQ ID NO: 1930334 - RNA, 22 nt, Shigella flexneri 2a str. 2457T
uagcucugccacugguuuuccu

SEQ ID NO: 1930335 - RNA, 15 nt, Shigella flexneri 2a str. 2457T
uagcuggauuuucau

SEQ ID NO: 1930336 - RNA, 18 nt, Shigella flexneri 2a str. 2457T
uagcgaccgaacagauca

SEQ ID NO: 1930337 - RNA, 18 nt, Shigella flexneri 2a str. 2457T
uagcgugauggccagaua

SEQ ID NO: 1930338 - RNA, 18 nt, Shigella flexneri 2a str. 2457T
uagcguuaaucaucaacu

SEQ ID NO: 1930339 - RNA, 21 nt, Shigella flexneri 2a str. 2457T
uagcuaaucaucuguugugcc

SEQ ID NO: 1930340 - RNA, 10 nt, Shigella flexneri 2a str. 2457T
uagcuaauca

SEQ ID NO: 1930341 - RNA, 11 nt, Shigella flexneri 2a str. 2457T
uagcaaggcga

SEQ ID NO: 1930342 - RNA, 16 nt, Shigella flexneri 2a str. 2457T
uagcacaaacccaggg

SEQ ID NO: 1930343 - RNA, 16 nt, Shigella flexneri 2a str. 2457T
uagauagcguucuuua

SEQ ID NO: 1930344 - RNA, 14 nt, Shigella flexneri 2a str. 2457T
uagauaucaugcuc

SEQ ID NO: 1930345 - RNA, 21 nt, Shigella flexneri 2a str. 2457T
uagaucuaaaugccacugaau

SEQ ID NO: 1930346 - RNA, 15 nt, Shigella flexneri 2a str. 2457T
uagcauaaaaacucg

SEQ ID NO: 1930347 - RNA, 14 nt, Shigella flexneri 2a str. 2457T
uagcaucagcgcca

SEQ ID NO: 1930348 - RNA, 18 nt, Shigella flexneri 2a str. 2457T
uagccaaagcaccacucc

SEQ ID NO: 1930349 - RNA, 18 nt, Shigella flexneri 2a str. 2457T
uagcacacggauauugcu

SEQ ID NO: 1930350 - RNA, 16 nt, Shigella flexneri 2a str. 2457T
uagcacgucaucugca

SEQ ID NO: 1930351 - RNA, 13 nt, Shigella flexneri 2a str. 2457T
uagcaguuccagc

SEQ ID NO: 1930352 - RNA, 17 nt, Shigella flexneri 2a str. 2457T
uagcaguuccagcaucu

SEQ ID NO: 1930353 - RNA, 22 nt, Shigella flexneri 2a str. 2457T
uagccgcccccgacuccagcag

SEQ ID NO: 1930354 - RNA, 23 nt, Shigella flexneri 2a str. 2457T
uagccgcuuuuucugcgcacaca

SEQ ID NO: 1930355 - RNA, 17 nt, Shigella flexneri 2a str. 2457T
uagccgcuucugcagcu

SEQ ID NO: 1930356 - RNA, 12 nt, Shigella flexneri 2a str. 2457T
uagccaucugcc

SEQ ID NO: 1930357 - RNA, 14 nt, Shigella flexneri 2a str. 2457T
uagccagcaacuga

SEQ ID NO: 1930358 - RNA, 18 nt, Shigella flexneri 2a str. 2457T
uagccaaucauucccauu

SEQ ID NO: 1930359 - RNA, 16 nt, Shigella flexneri 2a str. 2457T
uagccaguaccacccc

SEQ ID NO: 1930360 - RNA, 22 nt, Shigella flexneri 2a str. 2457T
uagcgaagaagacugaugacaa

SEQ ID NO: 1930361 - RNA, 21 nt, Shigella flexneri 2a str. 2457T
uagcgaauaaucccggcacca

SEQ ID NO: 1930362 - RNA, 14 nt, Shigella flexneri 2a str. 2457T
uagccuucaucaga

SEQ ID NO: 1930363 - RNA, 12 nt, Shigella flexneri 2a str. 2457T
uagccugccaga

SEQ ID NO: 1930364 - RNA, 14 nt, Shigella flexneri 2a str. 2457T
uagccucucggcau

SEQ ID NO: 1930365 - RNA, 23 nt, Shigella flexneri 2a str. 2457T
uagccucacuuuguacugacccc

SEQ ID NO: 1930366 - RNA, 22 nt, Shigella flexneri 2a str. 2457T
uagccguggcaaccuucuucuu

SEQ ID NO: 1930367 - RNA, 15 nt, Shigella flexneri 2a str. 2457T
uagccgguuuuucaa

SEQ ID NO: 1930368 - RNA, 16 nt, Shigella flexneri 2a str. 2457T
uaucuaccacugccug

SEQ ID NO: 1930369 - RNA, 12 nt, Shigella flexneri 2a str. 2457T
uaucuuauagac

SEQ ID NO: 1930370 - RNA, 20 nt, Shigella flexneri 2a str. 2457T
uaucuaucaggacgaaaaau

SEQ ID NO: 1930371 - RNA, 17 nt, Shigella flexneri 2a str. 2457T
uauccagcaaagcguca

SEQ ID NO: 1930372 - RNA, 21 nt, Shigella flexneri 2a str. 2457T
uauccagcgauaccggugcac

SEQ ID NO: 1930373 - RNA, 20 nt, Shigella flexneri 2a str. 2457T
uauccaggcuaauccagucu

SEQ ID NO: 1930374 - RNA, 19 nt, Shigella flexneri 2a str. 2457T
uaucaugcucugccagcgu

SEQ ID NO: 1930375 - RNA, 20 nt, Shigella flexneri 2a str. 2457T
uaucaucggucagcgcagug

SEQ ID NO: 1930376 - RNA, 13 nt, Shigella flexneri 2a str. 2457T
uaucaucagcaug

SEQ ID NO: 1930377 - RNA, 21 nt, Shigella flexneri 2a str. 2457T
uauccgccagugccaaagcca

SEQ ID NO: 1930378 - RNA, 15 nt, Shigella flexneri 2a str. 2457T
uauccgaaaaaggau

SEQ ID NO: 1930379 - RNA, 16 nt, Shigella flexneri 2a str. 2457T
uaucccugcuguccug

SEQ ID NO: 1930380 - RNA, 13 nt, Shigella flexneri 2a str. 2457T
uaucccuguuaaa

SEQ ID NO: 1930381 - RNA, 16 nt, Shigella flexneri 2a str. 2457T
uaucgacgcgccagca

SEQ ID NO: 1930382 - RNA, 18 nt, Shigella flexneri 2a str. 2457T
uauccuucugcguuuuug

SEQ ID NO: 1930383 - RNA, 14 nt, Shigella flexneri 2a str. 2457T
uauccuucacacau

SEQ ID NO: 1930384 - RNA, 17 nt, Shigella flexneri 2a str. 2457T
uauagcggggaacauca

SEQ ID NO: 1930385 - RNA, 22 nt, Shigella flexneri 2a str. 2457T
uauagcguugcccgauugguuc

SEQ ID NO: 1930386 - RNA, 19 nt, Shigella flexneri 2a str. 2457T
uauaucucagauaaaugca

SEQ ID NO: 1930387 - RNA, 22 nt, Shigella flexneri 2a str. 2457T
uauaucucagauaaaugcaaac

SEQ ID NO: 1930388 - RNA, 22 nt, Shigella flexneri 2a str. 2457T
uauaucugacgccgccgguguc

SEQ ID NO: 1930389 - RNA, 20 nt, Shigella flexneri 2a str. 2457T
uauauuacgaauauaaauau

SEQ ID NO: 1930390 - RNA, 23 nt, Shigella flexneri 2a str. 2457T
uauauuacgaauauaaauauuuu

SEQ ID NO: 1930391 - RNA, 22 nt, Shigella flexneri 2a str. 2457T
uauauuacgagucacaaacauc

SEQ ID NO: 1930392 - RNA, 21 nt, Shigella flexneri 2a str. 2457T
uauauuccccggucagcagca

SEQ ID NO: 1930393 - RNA, 22 nt, Shigella flexneri 2a str. 2457T
uauauugaauuagcaauauuuu

SEQ ID NO: 1930394 - RNA, 19 nt, Shigella flexneri 2a str. 2457T
uauauuccuuacucauaaa

SEQ ID NO: 1930395 - RNA, 14 nt, Shigella flexneri 2a str. 2457T
uauauucucuuuug

SEQ ID NO: 1930396 - RNA, 16 nt, Shigella flexneri 2a str. 2457T
uauauugaauuugcau

SEQ ID NO: 1930397 - RNA, 19 nt, Shigella flexneri 2a str. 2457T
uaucagcgccaccacaaaa

SEQ ID NO: 1930398 - RNA, 13 nt, Shigella flexneri 2a str. 2457T
uaucaggccaggu

SEQ ID NO: 1930399 - RNA, 21 nt, Shigella flexneri 2a str. 2457T
uaucaggcauucuuuuucauu

SEQ ID NO: 1930400 - RNA, 15 nt, Shigella flexneri 2a str. 2457T
uaucaggcaaaaaaa

SEQ ID NO: 1930401 - RNA, 18 nt, Shigella flexneri 2a str. 2457T
uaucaggccuacaacucc

SEQ ID NO: 1930402 - RNA, 14 nt, Shigella flexneri 2a str. 2457T
uaucaggccuacaa

SEQ ID NO: 1930403 - RNA, 21 nt, Shigella flexneri 2a str. 2457T
uaucaggccuacaaaaucuau

SEQ ID NO: 1930404 - RNA, 22 nt, Shigella flexneri 2a str. 2457T
uaucaguauacgccacaucauu

SEQ ID NO: 1930405 - RNA, 21 nt, Shigella flexneri 2a str. 2457T
uaucaguuggggaaaaguugg

SEQ ID NO: 1930406 - RNA, 20 nt, Shigella flexneri 2a str. 2457T
uaucagugauauauuuuuaa

SEQ ID NO: 1930407 - RNA, 16 nt, Shigella flexneri 2a str. 2457T
uaguuaugaaaauagg

SEQ ID NO: 1930408 - RNA, 20 nt, Shigella flexneri 2a str. 2457T
uaguuagcguugucaauacu

SEQ ID NO: 1930409 - RNA, 19 nt, Shigella flexneri 2a str. 2457T
uaguuugauaauuuuagau

SEQ ID NO: 1930410 - RNA, 19 nt, Shigella flexneri 2a str. 2457T
uaguuuuauacucagucag

SEQ ID NO: 1930411 - RNA, 21 nt, Shigella flexneri 2a str. 2457T
uaguuuuuacaaacaagaucc

SEQ ID NO: 1930412 - RNA, 14 nt, Shigella flexneri 2a str. 2457T
uauaaauauuuucu

SEQ ID NO: 1930413 - RNA, 14 nt, Shigella flexneri 2a str. 2457T
uauaaauaaaaaga

SEQ ID NO: 1930414 - RNA, 13 nt, Shigella flexneri 2a str. 2457T
uauaaauaaaaau

SEQ ID NO: 1930415 - RNA, 16 nt, Shigella flexneri 2a str. 2457T
uaguuaaacuuucaua

SEQ ID NO: 1930416 - RNA, 23 nt, Shigella flexneri 2a str. 2457T
uaguguuggaucugauccaacaa

SEQ ID NO: 1930417 - RNA, 15 nt, Shigella flexneri 2a str. 2457T
uaguggaacaaagaa

SEQ ID NO: 1930418 - RNA, 13 nt, Shigella flexneri 2a str. 2457T
uagugugaucagc

SEQ ID NO: 1930419 - RNA, 13 nt, Shigella flexneri 2a str. 2457T
uaguguuccugcg

SEQ ID NO: 1930420 - RNA, 12 nt, Shigella flexneri 2a str. 2457T
uagugucuuauc

SEQ ID NO: 1930421 - RNA, 18 nt, Shigella flexneri 2a str. 2457T
uagucugguugagcagua

SEQ ID NO: 1930422 - RNA, 17 nt, Shigella flexneri 2a str. 2457T
uagucugaccucuucua

SEQ ID NO: 1930423 - RNA, 20 nt, Shigella flexneri 2a str. 2457T
uagugaaaaagcucccuaaa

SEQ ID NO: 1930424 - RNA, 20 nt, Shigella flexneri 2a str. 2457T
uagguacaaagccaacagca

SEQ ID NO: 1930425 - RNA, 12 nt, Shigella flexneri 2a str. 2457T
uauaauaucuuu

SEQ ID NO: 1930426 - RNA, 18 nt, Shigella flexneri 2a str. 2457T
uauaauugaccagaucuu

SEQ ID NO: 1930427 - RNA, 15 nt, Shigella flexneri 2a str. 2457T
uauaauuaaaaauag

SEQ ID NO: 1930428 - RNA, 16 nt, Shigella flexneri 2a str. 2457T
uauaauugguauucug

SEQ ID NO: 1930429 - RNA, 17 nt, Shigella flexneri 2a str. 2457T
uauacagacucaaacca

SEQ ID NO: 1930430 - RNA, 19 nt, Shigella flexneri 2a str. 2457T
uauacauaaagucuuucuu

SEQ ID NO: 1930431 - RNA, 16 nt, Shigella flexneri 2a str. 2457T
uauacaccuguuccau

SEQ ID NO: 1930432 - RNA, 17 nt, Shigella flexneri 2a str. 2457T
uauacaaccagauaacc

SEQ ID NO: 1930433 - RNA, 21 nt, Shigella flexneri 2a str. 2457T
uauaccauggaagaaaaauau

SEQ ID NO: 1930434 - RNA, 22 nt, Shigella flexneri 2a str. 2457T
uauaccauggaagaaaaauaua

SEQ ID NO: 1930435 - RNA, 15 nt, Shigella flexneri 2a str. 2457T
uauacccuucucagc

SEQ ID NO: 1930436 - RNA, 22 nt, Shigella flexneri 2a str. 2457T
uauaccggaccaauaacgcuuu

SEQ ID NO: 1930437 - RNA, 22 nt, Shigella flexneri 2a str. 2457T
uauacgccucacagggcucuua

SEQ ID NO: 1930438 - RNA, 20 nt, Shigella flexneri 2a str. 2457T
uauacggcguuuccagcucg

SEQ ID NO: 1930439 - RNA, 15 nt, Shigella flexneri 2a str. 2457T
uauagaucagacgac

SEQ ID NO: 1930440 - RNA, 13 nt, Shigella flexneri 2a str. 2457T
uauagcauagcgu

SEQ ID NO: 1930441 - RNA, 15 nt, Shigella flexneri 2a str. 2457T
uauagcaucauaaga

SEQ ID NO: 1930442 - RNA, 20 nt, Shigella flexneri 2a str. 2457T
uaagagcuggcaucagcaaa

SEQ ID NO: 1930443 - RNA, 18 nt, Shigella flexneri 2a str. 2457T
uaagagcgggacaacaaa

SEQ ID NO: 1930444 - RNA, 21 nt, Shigella flexneri 2a str. 2457T
uaagaggcuaaccuuauggug

SEQ ID NO: 1930445 - RNA, 20 nt, Shigella flexneri 2a str. 2457T
uaagaucagaagcguaaccg

SEQ ID NO: 1930446 - RNA, 22 nt, Shigella flexneri 2a str. 2457T
uaagaucaucggccagauaaua

SEQ ID NO: 1930447 - RNA, 19 nt, Shigella flexneri 2a str. 2457T
uaagauaccccagcgcaag

SEQ ID NO: 1930448 - RNA, 14 nt, Shigella flexneri 2a str. 2457T
uaagauaaaagcaa

SEQ ID NO: 1930449 - RNA, 17 nt, Shigella flexneri 2a str. 2457T
uaagaauugauaaaaaa

SEQ ID NO: 1930450 - RNA, 14 nt, Shigella flexneri 2a str. 2457T
uaagaauuuuauac

SEQ ID NO: 1930451 - RNA, 22 nt, Shigella flexneri 2a str. 2457T
uaagaauuuuauacuuuuucgc

SEQ ID NO: 1930452 - RNA, 24 nt, Shigella flexneri 2a str. 2457T
uaagaauuuuauacuuuuucgcca

SEQ ID NO: 1930453 - RNA, 22 nt, Shigella flexneri 2a str. 2457T
uaagacgcgcagcgucgcauca

SEQ ID NO: 1930454 - RNA, 15 nt, Shigella flexneri 2a str. 2457T
uaacuuuaauuuugu

SEQ ID NO: 1930455 - RNA, 15 nt, Shigella flexneri 2a str. 2457T
uaacuuaauaaacau

SEQ ID NO: 1930456 - RNA, 17 nt, Shigella flexneri 2a str. 2457T
uaacuuaauaaacauca

SEQ ID NO: 1930457 - RNA, 19 nt, Shigella flexneri 2a str. 2457T
uaacuucccgcauccagaa

SEQ ID NO: 1930458 - RNA, 15 nt, Shigella flexneri 2a str. 2457T
uaacuuaucuguaau

SEQ ID NO: 1930459 - RNA, 17 nt, Shigella flexneri 2a str. 2457T
uaagaagccuuuaucug

SEQ ID NO: 1930460 - RNA, 23 nt, Shigella flexneri 2a str. 2457T
uaagaacugacuuccacuuccug

SEQ ID NO: 1930461 - RNA, 20 nt, Shigella flexneri 2a str. 2457T
uaagaacuccugaaagcgaa

SEQ ID NO: 1930462 - RNA, 17 nt, Shigella flexneri 2a str. 2457T
uaacuuugaagcccagu

SEQ ID NO: 1930463 - RNA, 18 nt, Shigella flexneri 2a str. 2457T
uaagaaaacggaagcuca

SEQ ID NO: 1930464 - RNA, 16 nt, Shigella flexneri 2a str. 2457T
uaagcaacgcgcaccg

SEQ ID NO: 1930465 - RNA, 15 nt, Shigella flexneri 2a str. 2457T
uaagcaaaaaaacau

SEQ ID NO: 1930466 - RNA, 16 nt, Shigella flexneri 2a str. 2457T
uaagcaaaaaaacaua

SEQ ID NO: 1930467 - RNA, 14 nt, Shigella flexneri 2a str. 2457T
uaagcaaacagcgc

SEQ ID NO: 1930468 - RNA, 22 nt, Shigella flexneri 2a str. 2457T
uaagcaaagcggucuucuguga

SEQ ID NO: 1930469 - RNA, 15 nt, Shigella flexneri 2a str. 2457T
uaagaugcuacaaca

SEQ ID NO: 1930470 - RNA, 20 nt, Shigella flexneri 2a str. 2457T
uaagaugcuacaacaucgua

SEQ ID NO: 1930471 - RNA, 17 nt, Shigella flexneri 2a str. 2457T
uaagaugcgaguaaaca

SEQ ID NO: 1930472 - RNA, 17 nt, Shigella flexneri 2a str. 2457T
uaagcaguccagcgccu

SEQ ID NO: 1930473 - RNA, 23 nt, Shigella flexneri 2a str. 2457T
uaagcaacugacuggcucuuuuu

SEQ ID NO: 1930474 - RNA, 20 nt, Shigella flexneri 2a str. 2457T
uaagccaaauccagcgccac

SEQ ID NO: 1930475 - RNA, 16 nt, Shigella flexneri 2a str. 2457T
uaagcaugaauaucaa

SEQ ID NO: 1930476 - RNA, 17 nt, Shigella flexneri 2a str. 2457T
uaagccauuuaacucac

SEQ ID NO: 1930477 - RNA, 16 nt, Shigella flexneri 2a str. 2457T
uaagcguuacgcagca

SEQ ID NO: 1930478 - RNA, 14 nt, Shigella flexneri 2a str. 2457T
uaagcgucgguaca

SEQ ID NO: 1930479 - RNA, 16 nt, Shigella flexneri 2a str. 2457T
uaagcguucauccaac

SEQ ID NO: 1930480 - RNA, 22 nt, Shigella flexneri 2a str. 2457T
uaagcguugugcaucaggcaaa

SEQ ID NO: 1930481 - RNA, 21 nt, Shigella flexneri 2a str. 2457T
uaagcguaaaaccucacgcau

SEQ ID NO: 1930482 - RNA, 20 nt, Shigella flexneri 2a str. 2457T
uaagcgcagucaccagcauc

SEQ ID NO: 1930483 - RNA, 23 nt, Shigella flexneri 2a str. 2457T
uaagccuuccgcugacagcgcgu

SEQ ID NO: 1930484 - RNA, 12 nt, Shigella flexneri 2a str. 2457T
uaagccuuccgc

SEQ ID NO: 1930485 - RNA, 15 nt, Shigella flexneri 2a str. 2457T
uaagccuuccgcuga

SEQ ID NO: 1930486 - RNA, 22 nt, Shigella flexneri 2a str. 2457T
uaagccggcguaaacgccuaau

SEQ ID NO: 1930487 - RNA, 15 nt, Shigella flexneri 2a str. 2457T
uaagccggaucggag

SEQ ID NO: 1930488 - RNA, 13 nt, Shigella flexneri 2a str. 2457T
uaagccgucccua

SEQ ID NO: 1930489 - RNA, 18 nt, Shigella flexneri 2a str. 2457T
uaagccauguuuaacucc

SEQ ID NO: 1930490 - RNA, 24 nt, Shigella flexneri 2a str. 2457T
uaagcgacgggcgacaaacgcugu

SEQ ID NO: 1930491 - RNA, 20 nt, Shigella flexneri 2a str. 2457T
uaagcgauaaaaauaccgag

SEQ ID NO: 1930492 - RNA, 15 nt, Shigella flexneri 2a str. 2457T
uaaggaaauucagca

SEQ ID NO: 1930493 - RNA, 22 nt, Shigella flexneri 2a str. 2457T
uaaggaacggggguuuuacuuu

SEQ ID NO: 1930494 - RNA, 14 nt, Shigella flexneri 2a str. 2457T
uaaggaauucacgc

SEQ ID NO: 1930495 - RNA, 18 nt, Shigella flexneri 2a str. 2457T
uaacccauuuuguuuuau

SEQ ID NO: 1930496 - RNA, 14 nt, Shigella flexneri 2a str. 2457T
uaaccagccaaaua

SEQ ID NO: 1930497 - RNA, 18 nt, Shigella flexneri 2a str. 2457T
uaaccagccaaauaaaau

SEQ ID NO: 1930498 - RNA, 15 nt, Shigella flexneri 2a str. 2457T
uaaccagcgcagaca

SEQ ID NO: 1930499 - RNA, 22 nt, Shigella flexneri 2a str. 2457T
uaacgcagggcuguuuaucgug

SEQ ID NO: 1930500 - RNA, 17 nt, Shigella flexneri 2a str. 2457T
uaacgccauauugcugu

SEQ ID NO: 1930501 - RNA, 23 nt, Shigella flexneri 2a str. 2457T
uaacgccaauucauuccuugaaa

SEQ ID NO: 1930502 - RNA, 17 nt, Shigella flexneri 2a str. 2457T
uaaccuucuucauuaug

SEQ ID NO: 1930503 - RNA, 12 nt, Shigella flexneri 2a str. 2457T
uaaccugagagu

SEQ ID NO: 1930504 - RNA, 20 nt, Shigella flexneri 2a str. 2457T
uaacggcagcaaggcuauuc

SEQ ID NO: 1930505 - RNA, 19 nt, Shigella flexneri 2a str. 2457T
uaacgccuucccuuucagc

SEQ ID NO: 1930506 - RNA, 15 nt, Shigella flexneri 2a str. 2457T
uaacgccuuuuccag

SEQ ID NO: 1930507 - RNA, 16 nt, Shigella flexneri 2a str. 2457T
uaacgccuuuuccagc

SEQ ID NO: 1930508 - RNA, 16 nt, Shigella flexneri 2a str. 2457T
uaacgccuucccuuuc

SEQ ID NO: 1930509 - RNA, 15 nt, Shigella flexneri 2a str. 2457T
uaacgccccaaucca

SEQ ID NO: 1930510 - RNA, 12 nt, Shigella flexneri 2a str. 2457T
uaacgccccaca

SEQ ID NO: 1930511 - RNA, 15 nt, Shigella flexneri 2a str. 2457T
uaacgccccacaaac

SEQ ID NO: 1930512 - RNA, 16 nt, Shigella flexneri 2a str. 2457T
uaacgccccacaaacc

SEQ ID NO: 1930513 - RNA, 22 nt, Shigella flexneri 2a str. 2457T
uaacggcucacgcccaucagca

SEQ ID NO: 1930514 - RNA, 22 nt, Shigella flexneri 2a str. 2457T
uaacguuuuuucgucaguucau

SEQ ID NO: 1930515 - RNA, 17 nt, Shigella flexneri 2a str. 2457T
uaacgguucaauuuaag

SEQ ID NO: 1930516 - RNA, 21 nt, Shigella flexneri 2a str. 2457T
uaacgguucaauuuaaggaau

SEQ ID NO: 1930517 - RNA, 19 nt, Shigella flexneri 2a str. 2457T
uaacguaaaaacccgcuuc

SEQ ID NO: 1930518 - RNA, 12 nt, Shigella flexneri 2a str. 2457T
uaacucaccauc

SEQ ID NO: 1930519 - RNA, 14 nt, Shigella flexneri 2a str. 2457T
uaacucaccaucaa

SEQ ID NO: 1930520 - RNA, 15 nt, Shigella flexneri 2a str. 2457T
uaacucaauaccuga

SEQ ID NO: 1930521 - RNA, 17 nt, Shigella flexneri 2a str. 2457T
uaacucccccuuucuga

SEQ ID NO: 1930522 - RNA, 20 nt, Shigella flexneri 2a str. 2457T
uaacuauaaccguaauaguu

SEQ ID NO: 1930523 - RNA, 17 nt, Shigella flexneri 2a str. 2457T
uaacuaggcgaacauuc

SEQ ID NO: 1930524 - RNA, 22 nt, Shigella flexneri 2a str. 2457T
uaacugauggcaaaugcagcau

SEQ ID NO: 1930525 - RNA, 17 nt, Shigella flexneri 2a str. 2457T
uaacugacuuccgcuag

SEQ ID NO: 1930526 - RNA, 20 nt, Shigella flexneri 2a str. 2457T
uaacucuuucaaugcuuuuu

SEQ ID NO: 1930527 - RNA, 14 nt, Shigella flexneri 2a str. 2457T
uaacucuuucaaug

SEQ ID NO: 1930528 - RNA, 19 nt, Shigella flexneri 2a str. 2457T
uaacugccgucaaugcgca

SEQ ID NO: 1930529 - RNA, 19 nt, Shigella flexneri 2a str. 2457T
uaacugcgcgauuaucauu

SEQ ID NO: 1930530 - RNA, 15 nt, Shigella flexneri 2a str. 2457T
uaacuggucaucaaa

SEQ ID NO: 1930531 - RNA, 17 nt, Shigella flexneri 2a str. 2457T
uaacuggcgggcuuuuu

SEQ ID NO: 1930532 - RNA, 12 nt, Shigella flexneri 2a str. 2457T
uaaccaaucacg

SEQ ID NO: 1930533 - RNA, 16 nt, Shigella flexneri 2a str. 2457T
uaaccaccaguaaauu

SEQ ID NO: 1930534 - RNA, 20 nt, Shigella flexneri 2a str. 2457T
uaaccagagagcuuauccag

SEQ ID NO: 1930535 - RNA, 15 nt, Shigella flexneri 2a str. 2457T
uaaccagcaccagcu

SEQ ID NO: 1930536 - RNA, 22 nt, Shigella flexneri 2a str. 2457T
uaaccagcacguugaacugacu

SEQ ID NO: 1930537 - RNA, 21 nt, Shigella flexneri 2a str. 2457T
uaaccagaugucgcgcacugg

SEQ ID NO: 1930538 - RNA, 18 nt, Shigella flexneri 2a str. 2457T
uaaccaaaagcugggaug

SEQ ID NO: 1930539 - RNA, 17 nt, Shigella flexneri 2a str. 2457T
uaaccaaauaaaauaag

SEQ ID NO: 1930540 - RNA, 16 nt, Shigella flexneri 2a str. 2457T
uaaccaacaauaaaau

SEQ ID NO: 1930541 - RNA, 17 nt, Shigella flexneri 2a str. 2457T
uaaccaacaauaaaauu

SEQ ID NO: 1930542 - RNA, 21 nt, Shigella flexneri 2a str. 2457T
uaaccaacggcgagccagcgc

SEQ ID NO: 1930543 - RNA, 21 nt, Shigella flexneri 2a str. 2457T
uaacagcguccacagccaaca

SEQ ID NO: 1930544 - RNA, 15 nt, Shigella flexneri 2a str. 2457T
uaacaggauuuucua

SEQ ID NO: 1930545 - RNA, 22 nt, Shigella flexneri 2a str. 2457T
uaacaggauuuucuaauauuag

SEQ ID NO: 1930546 - RNA, 17 nt, Shigella flexneri 2a str. 2457T
uaacagggaaugugaug

SEQ ID NO: 1930547 - RNA, 23 nt, Shigella flexneri 2a str. 2457T
uaacagggaaugugaugaaaaaa

SEQ ID NO: 1930548 - RNA, 21 nt, Shigella flexneri 2a str. 2457T
uaacagguuuugauuauucaa

SEQ ID NO: 1930549 - RNA, 16 nt, Shigella flexneri 2a str. 2457T
uaacaacgugguuuuc

SEQ ID NO: 1930550 - RNA, 22 nt, Shigella flexneri 2a str. 2457T
uaacaacgugugcuuuguucau

SEQ ID NO: 1930551 - RNA, 16 nt, Shigella flexneri 2a str. 2457T
uaacaacgggcuaaac

SEQ ID NO: 1930552 - RNA, 20 nt, Shigella flexneri 2a str. 2457T
uaacaaaauaaccuauaaaa

SEQ ID NO: 1930553 - RNA, 13 nt, Shigella flexneri 2a str. 2457T
uaacaaaacucag

SEQ ID NO: 1930554 - RNA, 23 nt, Shigella flexneri 2a str. 2457T
uaaauuuuuucacuguucugaua

SEQ ID NO: 1930555 - RNA, 20 nt, Shigella flexneri 2a str. 2457T
uaacacgcccguuguuuuau

SEQ ID NO: 1930556 - RNA, 22 nt, Shigella flexneri 2a str. 2457T
uaacacgcucuggcaggcuuca

SEQ ID NO: 1930557 - RNA, 19 nt, Shigella flexneri 2a str. 2457T
uaacacgcucuggcaggcu

SEQ ID NO: 1930558 - RNA, 22 nt, Shigella flexneri 2a str. 2457T
uaacaacuggcggucaugacga

SEQ ID NO: 1930559 - RNA, 16 nt, Shigella flexneri 2a str. 2457T
uaacaauacgcccacg

SEQ ID NO: 1930560 - RNA, 23 nt, Shigella flexneri 2a str. 2457T
uaacaauagcgaacagacaaaaa

SEQ ID NO: 1930561 - RNA, 20 nt, Shigella flexneri 2a str. 2457T
uaaacuuacugacaucaaac

SEQ ID NO: 1930562 - RNA, 14 nt, Shigella flexneri 2a str. 2457T
uaaacuuuuucgcg

SEQ ID NO: 1930563 - RNA, 22 nt, Shigella flexneri 2a str. 2457T
uaaagaacucgaggauaaauuu

SEQ ID NO: 1930564 - RNA, 13 nt, Shigella flexneri 2a str. 2457T
uaaagaaaguaau

SEQ ID NO: 1930565 - RNA, 23 nt, Shigella flexneri 2a str. 2457T
uaaagaaaguaaucuauauuucu

SEQ ID NO: 1930566 - RNA, 16 nt, Shigella flexneri 2a str. 2457T
uaaagaguucaaagcc

SEQ ID NO: 1930567 - RNA, 23 nt, Shigella flexneri 2a str. 2457T
uaaagaguuuaucuguuaaucug

SEQ ID NO: 1930568 - RNA, 10 nt, Shigella flexneri 2a str. 2457T
uaaagaagag

SEQ ID NO: 1930569 - RNA, 15 nt, Shigella flexneri 2a str. 2457T
uaaagcaaaaaaaga

SEQ ID NO: 1930570 - RNA, 17 nt, Shigella flexneri 2a str. 2457T
uaaagcuaauaccguuu

SEQ ID NO: 1930571 - RNA, 11 nt, Shigella flexneri 2a str. 2457T
uaaagcaauga

SEQ ID NO: 1930572 - RNA, 15 nt, Shigella flexneri 2a str. 2457T
uaaagcugaucacau

SEQ ID NO: 1930573 - RNA, 15 nt, Shigella flexneri 2a str. 2457T
uaaacucugccgcaa

SEQ ID NO: 1930574 - RNA, 12 nt, Shigella flexneri 2a str. 2457T
uaaacucaaagu

SEQ ID NO: 1930575 - RNA, 19 nt, Shigella flexneri 2a str. 2457T
uaaacgccggaugacacau

SEQ ID NO: 1930576 - RNA, 22 nt, Shigella flexneri 2a str. 2457T
uaaacgccggaugacacaucac

SEQ ID NO: 1930577 - RNA, 12 nt, Shigella flexneri 2a str. 2457T
uaaacgccaggu

SEQ ID NO: 1930578 - RNA, 20 nt, Shigella flexneri 2a str. 2457T
uaaacggcguaaaauucaca

SEQ ID NO: 1930579 - RNA, 18 nt, Shigella flexneri 2a str. 2457T
uaaacgcgcgcuggaagg

SEQ ID NO: 1930580 - RNA, 15 nt, Shigella flexneri 2a str. 2457T
uaaacgcuauuugcc

SEQ ID NO: 1930581 - RNA, 14 nt, Shigella flexneri 2a str. 2457T
uaaacgccuuaucc

SEQ ID NO: 1930582 - RNA, 20 nt, Shigella flexneri 2a str. 2457T
uaaacgccuuauccggccua

SEQ ID NO: 1930583 - RNA, 22 nt, Shigella flexneri 2a str. 2457T
uaaacgggcguauaacacgccc

SEQ ID NO: 1930584 - RNA, 15 nt, Shigella flexneri 2a str. 2457T
uaaacaguuuucgca

SEQ ID NO: 1930585 - RNA, 18 nt, Shigella flexneri 2a str. 2457T
uaaacaggaugacacuga

SEQ ID NO: 1930586 - RNA, 19 nt, Shigella flexneri 2a str. 2457T
uaaacaggaucugguauua

SEQ ID NO: 1930587 - RNA, 17 nt, Shigella flexneri 2a str. 2457T
uaaacagguaaagacca

SEQ ID NO: 1930588 - RNA, 23 nt, Shigella flexneri 2a str. 2457T
uaaacagguaaagaccauaaaua

SEQ ID NO: 1930589 - RNA, 18 nt, Shigella flexneri 2a str. 2457T
uaaacccuaacaucaucc

SEQ ID NO: 1930590 - RNA, 22 nt, Shigella flexneri 2a str. 2457T
uaaacgcagagacaucaccaau

SEQ ID NO: 1930591 - RNA, 21 nt, Shigella flexneri 2a str. 2457T
uaaagggacagauaauggaau

SEQ ID NO: 1930592 - RNA, 20 nt, Shigella flexneri 2a str. 2457T
uaaagggaucaauaaugaug

SEQ ID NO: 1930593 - RNA, 17 nt, Shigella flexneri 2a str. 2457T
uaaaggcggcagaacag

SEQ ID NO: 1930594 - RNA, 14 nt, Shigella flexneri 2a str. 2457T
uaaaguagugucua

SEQ ID NO: 1930595 - RNA, 22 nt, Shigella flexneri 2a str. 2457T
uaaagucagcguuauagcgcau

SEQ ID NO: 1930596 - RNA, 15 nt, Shigella flexneri 2a str. 2457T
uaaaguauguaauaa

SEQ ID NO: 1930597 - RNA, 19 nt, Shigella flexneri 2a str. 2457T
uaaagucuaaaaaugugcc

SEQ ID NO: 1930598 - RNA, 19 nt, Shigella flexneri 2a str. 2457T
uaaaguuaccuguggcgua

SEQ ID NO: 1930599 - RNA, 24 nt, Shigella flexneri 2a str. 2457T
uaaaguguuaccccucuauccagc

SEQ ID NO: 1930600 - RNA, 18 nt, Shigella flexneri 2a str. 2457T
uaaauacgccccacagac

SEQ ID NO: 1930601 - RNA, 21 nt, Shigella flexneri 2a str. 2457T
uaaauacgccucuucauacau

SEQ ID NO: 1930602 - RNA, 23 nt, Shigella flexneri 2a str. 2457T
uaaauacgccccacagacccagg

SEQ ID NO: 1930603 - RNA, 22 nt, Shigella flexneri 2a str. 2457T
uaaauaccguucauuaacgccc

SEQ ID NO: 1930604 - RNA, 18 nt, Shigella flexneri 2a str. 2457T
uaaauaguggcaaauucu

SEQ ID NO: 1930605 - RNA, 22 nt, Shigella flexneri 2a str. 2457T
uaaauacagcuuaaucaccagc

SEQ ID NO: 1930606 - RNA, 14 nt, Shigella flexneri 2a str. 2457T
uaaauaauaucccc

SEQ ID NO: 1930607 - RNA, 11 nt, Shigella flexneri 2a str. 2457T
uaaauacagag

SEQ ID NO: 1930608 - RNA, 13 nt, Shigella flexneri 2a str. 2457T
uaaauacagagca

SEQ ID NO: 1930609 - RNA, 20 nt, Shigella flexneri 2a str. 2457T
uaaauaaggugguagcugcc

SEQ ID NO: 1930610 - RNA, 11 nt, Shigella flexneri 2a str. 2457T
uaaaucagauc

SEQ ID NO: 1930611 - RNA, 21 nt, Shigella flexneri 2a str. 2457T
uaaauauuaaggguaaaagga

SEQ ID NO: 1930612 - RNA, 21 nt, Shigella flexneri 2a str. 2457T
uaaauauuaauacaacaacac

SEQ ID NO: 1930613 - RNA, 14 nt, Shigella flexneri 2a str. 2457T
uaaauccauaagau

SEQ ID NO: 1930614 - RNA, 16 nt, Shigella flexneri 2a str. 2457T
uaaaucccaggcuuca

SEQ ID NO: 1930615 - RNA, 20 nt, Shigella flexneri 2a str. 2457T
uaaaucccagugccugcaua

SEQ ID NO: 1930616 - RNA, 15 nt, Shigella flexneri 2a str. 2457T
uaaauccugaaacca

SEQ ID NO: 1930617 - RNA, 14 nt, Shigella flexneri 2a str. 2457T
uaaauccuuuguac

SEQ ID NO: 1930618 - RNA, 16 nt, Shigella flexneri 2a str. 2457T
uaaaucgguauuucca

SEQ ID NO: 1930619 - RNA, 18 nt, Shigella flexneri 2a str. 2457T
uaaaucgguauuuccauu

SEQ ID NO: 1930620 - RNA, 12 nt, Shigella flexneri 2a str. 2457T
uaaaauaucuuc

SEQ ID NO: 1930621 - RNA, 21 nt, Shigella flexneri 2a str. 2457T
uaaaauaucuuccacuucacg

SEQ ID NO: 1930622 - RNA, 12 nt, Shigella flexneri 2a str. 2457T
uaaaauauugaa

SEQ ID NO: 1930623 - RNA, 20 nt, Shigella flexneri 2a str. 2457T
uaaaaggcgccauuuucaua

SEQ ID NO: 1930624 - RNA, 14 nt, Shigella flexneri 2a str. 2457T
uaaaaggagauaaa

SEQ ID NO: 1930625 - RNA, 18 nt, Shigella flexneri 2a str. 2457T
uaaaaucgacaucugcaa

SEQ ID NO: 1930626 - RNA, 13 nt, Shigella flexneri 2a str. 2457T
uaaaauguacaug

SEQ ID NO: 1930627 - RNA, 13 nt, Shigella flexneri 2a str. 2457T
uaaaauuuaacau

SEQ ID NO: 1930628 - RNA, 22 nt, Shigella flexneri 2a str. 2457T
uaaaauuauccagcuuuuccca

SEQ ID NO: 1930629 - RNA, 21 nt, Shigella flexneri 2a str. 2457T
uaaaauuaucgccucuaaagu

SEQ ID NO: 1930630 - RNA, 22 nt, Shigella flexneri 2a str. 2457T
uaaaauuggcuucguuauugaa

SEQ ID NO: 1930631 - RNA, 16 nt, Shigella flexneri 2a str. 2457T
uaaaauucuacagaaa

SEQ ID NO: 1930632 - RNA, 20 nt, Shigella flexneri 2a str. 2457T
uaaaauucuacagaaaugaa

SEQ ID NO: 1930633 - RNA, 19 nt, Shigella flexneri 2a str. 2457T
uaaacaccuucauccagca

SEQ ID NO: 1930634 - RNA, 21 nt, Shigella flexneri 2a str. 2457T
uaaacaccugggcaaugguga

SEQ ID NO: 1930635 - RNA, 12 nt, Shigella flexneri 2a str. 2457T
uaaacaccuuca

SEQ ID NO: 1930636 - RNA, 17 nt, Shigella flexneri 2a str. 2457T
uaaacaccuucauccag

SEQ ID NO: 1930637 - RNA, 18 nt, Shigella flexneri 2a str. 2457T
uaaacaccuucauccagc

SEQ ID NO: 1930638 - RNA, 15 nt, Shigella flexneri 2a str. 2457T
uaaacagacaguaau

SEQ ID NO: 1930639 - RNA, 20 nt, Shigella flexneri 2a str. 2457T
uaaacaaagcgcacuuuacu

SEQ ID NO: 1930640 - RNA, 23 nt, Shigella flexneri 2a str. 2457T
uaaacaaagugcacuuugucaau

SEQ ID NO: 1930641 - RNA, 20 nt, Shigella flexneri 2a str. 2457T
uaaacaagcguacaaaauua

SEQ ID NO: 1930642 - RNA, 19 nt, Shigella flexneri 2a str. 2457T
uaaaacaacggaacgaaaa

SEQ ID NO: 1930643 - RNA, 22 nt, Shigella flexneri 2a str. 2457T
uaaaacaacggaacgaaaaaaa

SEQ ID NO: 1930644 - RNA, 16 nt, Shigella flexneri 2a str. 2457T
uaaaaccaucguacag

SEQ ID NO: 1930645 - RNA, 22 nt, Shigella flexneri 2a str. 2457T
uaaaaauuuuaguuuaaacauu

SEQ ID NO: 1930646 - RNA, 20 nt, Shigella flexneri 2a str. 2457T
uaaaacgguuuauccccaag

SEQ ID NO: 1930647 - RNA, 22 nt, Shigella flexneri 2a str. 2457T
uaaaacgcgcccucagcccaca

SEQ ID NO: 1930648 - RNA, 16 nt, Shigella flexneri 2a str. 2457T
uaaaaccgacuuaaaa

SEQ ID NO: 1930649 - RNA, 19 nt, Shigella flexneri 2a str. 2457T
uaaaacccuugugcucaau

SEQ ID NO: 1930650 - RNA, 15 nt, Shigella flexneri 2a str. 2457T
uaaaaccgacuuaaa

SEQ ID NO: 1930651 - RNA, 14 nt, Shigella flexneri 2a str. 2457T
uaaaacgugccauu

SEQ ID NO: 1930652 - RNA, 19 nt, Shigella flexneri 2a str. 2457T
uaaaagaaggcgauguucu

SEQ ID NO: 1930653 - RNA, 22 nt, Shigella flexneri 2a str. 2457T
uaaaagcgugaaacaaaucacu

SEQ ID NO: 1930654 - RNA, 12 nt, Shigella flexneri 2a str. 2457T
uaaaaggaaaca

SEQ ID NO: 1930655 - RNA, 19 nt, Shigella flexneri 2a str. 2457T
uaaaaaguaagaauugaua

SEQ ID NO: 1930656 - RNA, 13 nt, Shigella flexneri 2a str. 2457T
uaaaaagauaaac

SEQ ID NO: 1930657 - RNA, 15 nt, Shigella flexneri 2a str. 2457T
uaaaaagccuaacaa

SEQ ID NO: 1930658 - RNA, 23 nt, Shigella flexneri 2a str. 2457T
uaaaaauacauacgcaaaaaaca

SEQ ID NO: 1930659 - RNA, 21 nt, Shigella flexneri 2a str. 2457T
uaaaaaguuauaaauaaaaag

SEQ ID NO: 1930660 - RNA, 21 nt, Shigella flexneri 2a str. 2457T
guuugaugcgugagguaacaa

SEQ ID NO: 1930661 - RNA, 16 nt, Shigella flexneri 2a str. 2457T
guuugaucacuuccag

SEQ ID NO: 1930662 - RNA, 11 nt, Shigella flexneri 2a str. 2457T
uaaaaaccaga

SEQ ID NO: 1930663 - RNA, 19 nt, Shigella flexneri 2a str. 2457T
guuugauucacuggcaaaa

SEQ ID NO: 1930664 - RNA, 21 nt, Shigella flexneri 2a str. 2457T
guuugauucacuggcaaaagc

SEQ ID NO: 1930665 - RNA, 13 nt, Shigella flexneri 2a str. 2457T
uaaaaagaaaaaa

SEQ ID NO: 1930666 - RNA, 12 nt, Shigella flexneri 2a str. 2457T
guuguugcugcc

SEQ ID NO: 1930667 - RNA, 15 nt, Shigella flexneri 2a str. 2457T
guuguuuucagaagc

SEQ ID NO: 1930668 - RNA, 14 nt, Shigella flexneri 2a str. 2457T
guuguaaugacaac

SEQ ID NO: 1930669 - RNA, 14 nt, Shigella flexneri 2a str. 2457T
guuguacauuacca

SEQ ID NO: 1930670 - RNA, 16 nt, Shigella flexneri 2a str. 2457T
guuguaugcguuucac

SEQ ID NO: 1930671 - RNA, 17 nt, Shigella flexneri 2a str. 2457T
guugucacugcaucuuc

SEQ ID NO: 1930672 - RNA, 21 nt, Shigella flexneri 2a str. 2457T
guuguucugcgacgcgcggug

SEQ ID NO: 1930673 - RNA, 14 nt, Shigella flexneri 2a str. 2457T
guuuaccagcagcc

SEQ ID NO: 1930674 - RNA, 12 nt, Shigella flexneri 2a str. 2457T
guuuaccagcag

SEQ ID NO: 1930675 - RNA, 22 nt, Shigella flexneri 2a str. 2457T
guuuaacgccuucccuuucagc

SEQ ID NO: 1930676 - RNA, 14 nt, Shigella flexneri 2a str. 2457T
guuuaaccaucagg

SEQ ID NO: 1930677 - RNA, 14 nt, Shigella flexneri 2a str. 2457T
guuuaaccaacaca

SEQ ID NO: 1930678 - RNA, 20 nt, Shigella flexneri 2a str. 2457T
guuuauaacggugcugcaca

SEQ ID NO: 1930679 - RNA, 14 nt, Shigella flexneri 2a str. 2457T
guuuaucaggccac

SEQ ID NO: 1930680 - RNA, 20 nt, Shigella flexneri 2a str. 2457T
guuuagccgcuucugcagcu

SEQ ID NO: 1930681 - RNA, 13 nt, Shigella flexneri 2a str. 2457T
guuucucuuucuu

SEQ ID NO: 1930682 - RNA, 13 nt, Shigella flexneri 2a str. 2457T
guuucuccacgau

SEQ ID NO: 1930683 - RNA, 15 nt, Shigella flexneri 2a str. 2457T
guuucgccuuuugau

SEQ ID NO: 1930684 - RNA, 22 nt, Shigella flexneri 2a str. 2457T
guuucgccuuuugauacucugu

SEQ ID NO: 1930685 - RNA, 19 nt, Shigella flexneri 2a str. 2457T
guuucgcuucuucagccug

SEQ ID NO: 1930686 - RNA, 15 nt, Shigella flexneri 2a str. 2457T
guuucgcgguuggug

SEQ ID NO: 1930687 - RNA, 21 nt, Shigella flexneri 2a str. 2457T
guuugacccggaacgugguuu

SEQ ID NO: 1930688 - RNA, 14 nt, Shigella flexneri 2a str. 2457T
guuugaaauaccag

SEQ ID NO: 1930689 - RNA, 16 nt, Shigella flexneri 2a str. 2457T
guuugaaaaaaccugc

SEQ ID NO: 1930690 - RNA, 21 nt, Shigella flexneri 2a str. 2457T
guuucugaauuucagcgccug

SEQ ID NO: 1930691 - RNA, 20 nt, Shigella flexneri 2a str. 2457T
guuucugacauuuuuacucc

SEQ ID NO: 1930692 - RNA, 19 nt, Shigella flexneri 2a str. 2457T
guuucugauacagcucaug

SEQ ID NO: 1930693 - RNA, 16 nt, Shigella flexneri 2a str. 2457T
guuucugauacugcuc

SEQ ID NO: 1930694 - RNA, 12 nt, Shigella flexneri 2a str. 2457T
guuucucuucug

SEQ ID NO: 1930695 - RNA, 22 nt, Shigella flexneri 2a str. 2457T
guuucuuugccgaggaagacaa

SEQ ID NO: 1930696 - RNA, 13 nt, Shigella flexneri 2a str. 2457T
guuuccauucgcu

SEQ ID NO: 1930697 - RNA, 22 nt, Shigella flexneri 2a str. 2457T
guuuccagcucggcaaucuguu

SEQ ID NO: 1930698 - RNA, 14 nt, Shigella flexneri 2a str. 2457T
guuuaucuucccag

SEQ ID NO: 1930699 - RNA, 13 nt, Shigella flexneri 2a str. 2457T
guuuauccauccc

SEQ ID NO: 1930700 - RNA, 23 nt, Shigella flexneri 2a str. 2457T
guuucgaauuacacagccacagg

SEQ ID NO: 1930701 - RNA, 17 nt, Shigella flexneri 2a str. 2457T
guuucgaauuacacagc

SEQ ID NO: 1930702 - RNA, 20 nt, Shigella flexneri 2a str. 2457T
guuucgaauuacacagccac

SEQ ID NO: 1930703 - RNA, 21 nt, Shigella flexneri 2a str. 2457T
guuucgaucagcaauuucucc

SEQ ID NO: 1930704 - RNA, 22 nt, Shigella flexneri 2a str. 2457T
guuucgaacaggccgacuggca

SEQ ID NO: 1930705 - RNA, 20 nt, Shigella flexneri 2a str. 2457T
guuggcgcguguuccagaga

SEQ ID NO: 1930706 - RNA, 15 nt, Shigella flexneri 2a str. 2457T
guuggcucaucaagc

SEQ ID NO: 1930707 - RNA, 18 nt, Shigella flexneri 2a str. 2457T
guugggcgcuggcggcug

SEQ ID NO: 1930708 - RNA, 14 nt, Shigella flexneri 2a str. 2457T
guugguaaccaaau

SEQ ID NO: 1930709 - RNA, 14 nt, Shigella flexneri 2a str. 2457T
guuggguuagccaa

SEQ ID NO: 1930710 - RNA, 12 nt, Shigella flexneri 2a str. 2457T
guugguuaaucu

SEQ ID NO: 1930711 - RNA, 17 nt, Shigella flexneri 2a str. 2457T
guuggucucaagcaagu

SEQ ID NO: 1930712 - RNA, 21 nt, Shigella flexneri 2a str. 2457T
guugcuggcagauaaauuacu

SEQ ID NO: 1930713 - RNA, 19 nt, Shigella flexneri 2a str. 2457T
guugcugccuugcgggcug

SEQ ID NO: 1930714 - RNA, 14 nt, Shigella flexneri 2a str. 2457T
guugcuggaaagag

SEQ ID NO: 1930715 - RNA, 18 nt, Shigella flexneri 2a str. 2457T
guuggaaaucccgugacg

SEQ ID NO: 1930716 - RNA, 14 nt, Shigella flexneri 2a str. 2457T
guugcuucaucuca

SEQ ID NO: 1930717 - RNA, 22 nt, Shigella flexneri 2a str. 2457T
guuggcaagauaggcaucccgc

SEQ ID NO: 1930718 - RNA, 16 nt, Shigella flexneri 2a str. 2457T
guuggcaccaaagggc

SEQ ID NO: 1930719 - RNA, 13 nt, Shigella flexneri 2a str. 2457T
guuggcaggccaa

SEQ ID NO: 1930720 - RNA, 21 nt, Shigella flexneri 2a str. 2457T
guugcccuuuucaccaugggc

SEQ ID NO: 1930721 - RNA, 17 nt, Shigella flexneri 2a str. 2457T
guugcauuuccauaaau

SEQ ID NO: 1930722 - RNA, 22 nt, Shigella flexneri 2a str. 2457T
guugccauuguuggcaggccaa

SEQ ID NO: 1930723 - RNA, 21 nt, Shigella flexneri 2a str. 2457T
guugccauuucugcugccacu

SEQ ID NO: 1930724 - RNA, 17 nt, Shigella flexneri 2a str. 2457T
guugccccucuaacucu

SEQ ID NO: 1930725 - RNA, 22 nt, Shigella flexneri 2a str. 2457T
guugcgccaguaaauuuaucaa

SEQ ID NO: 1930726 - RNA, 16 nt, Shigella flexneri 2a str. 2457T
guugcgaucgaccugc

SEQ ID NO: 1930727 - RNA, 17 nt, Shigella flexneri 2a str. 2457T
guugcgaucgaccugcg

SEQ ID NO: 1930728 - RNA, 18 nt, Shigella flexneri 2a str. 2457T
guugcggcugcccaucau

SEQ ID NO: 1930729 - RNA, 22 nt, Shigella flexneri 2a str. 2457T
guugcuccccagaauccaggaa

SEQ ID NO: 1930730 - RNA, 15 nt, Shigella flexneri 2a str. 2457T
guugcugaaauucca

SEQ ID NO: 1930731 - RNA, 14 nt, Shigella flexneri 2a str. 2457T
guugcuaugcugaa

SEQ ID NO: 1930732 - RNA, 16 nt, Shigella flexneri 2a str. 2457T
guugcgucgccgccug

SEQ ID NO: 1930733 - RNA, 15 nt, Shigella flexneri 2a str. 2457T
guugcuaacggccac

SEQ ID NO: 1930734 - RNA, 16 nt, Shigella flexneri 2a str. 2457T
guugcguugaaacguu

SEQ ID NO: 1930735 - RNA, 19 nt, Shigella flexneri 2a str. 2457T
guugcguuuuuaucuucac

SEQ ID NO: 1930736 - RNA, 21 nt, Shigella flexneri 2a str. 2457T
guugcgucucgacaaacuccg

SEQ ID NO: 1930737 - RNA, 18 nt, Shigella flexneri 2a str. 2457T
guugcguaacugaucgua

SEQ ID NO: 1930738 - RNA, 13 nt, Shigella flexneri 2a str. 2457T
guugcaccagcaa

SEQ ID NO: 1930739 - RNA, 19 nt, Shigella flexneri 2a str. 2457T
guugcaccgaguucuucac

SEQ ID NO: 1930740 - RNA, 23 nt, Shigella flexneri 2a str. 2457T
guugcaauacaccuccggcuggg

SEQ ID NO: 1930741 - RNA, 22 nt, Shigella flexneri 2a str. 2457T
guugcacgucaauggugagaug

SEQ ID NO: 1930742 - RNA, 15 nt, Shigella flexneri 2a str. 2457T
guugcagacccgcca

SEQ ID NO: 1930743 - RNA, 19 nt, Shigella flexneri 2a str. 2457T
guugauuuuucguuuuaau

SEQ ID NO: 1930744 - RNA, 16 nt, Shigella flexneri 2a str. 2457T
guugauuuuauaauca

SEQ ID NO: 1930745 - RNA, 19 nt, Shigella flexneri 2a str. 2457T
guugagagguaaaaccuga

SEQ ID NO: 1930746 - RNA, 16 nt, Shigella flexneri 2a str. 2457T
guugagagaagaaacg

SEQ ID NO: 1930747 - RNA, 14 nt, Shigella flexneri 2a str. 2457T
guugaccuggaagg

SEQ ID NO: 1930748 - RNA, 18 nt, Shigella flexneri 2a str. 2457T
guugaggaacucaaacca

SEQ ID NO: 1930749 - RNA, 15 nt, Shigella flexneri 2a str. 2457T
guugaucuauaccac

SEQ ID NO: 1930750 - RNA, 14 nt, Shigella flexneri 2a str. 2457T
guugaucauaaaaa

SEQ ID NO: 1930751 - RNA, 15 nt, Shigella flexneri 2a str. 2457T
guugaucauaaaaau

SEQ ID NO: 1930752 - RNA, 14 nt, Shigella flexneri 2a str. 2457T
guugauccaggagc

SEQ ID NO: 1930753 - RNA, 16 nt, Shigella flexneri 2a str. 2457T
guugauacaggaacag

SEQ ID NO: 1930754 - RNA, 14 nt, Shigella flexneri 2a str. 2457T
guugaggccaacgc

SEQ ID NO: 1930755 - RNA, 19 nt, Shigella flexneri 2a str. 2457T
guugaggccaacguccaua

SEQ ID NO: 1930756 - RNA, 13 nt, Shigella flexneri 2a str. 2457T
guugacaaagugc

SEQ ID NO: 1930757 - RNA, 13 nt, Shigella flexneri 2a str. 2457T
guugaaguuuaua

SEQ ID NO: 1930758 - RNA, 18 nt, Shigella flexneri 2a str. 2457T
guugaauuccgaauuuca

SEQ ID NO: 1930759 - RNA, 13 nt, Shigella flexneri 2a str. 2457T
guugaaaaaccag

SEQ ID NO: 1930760 - RNA, 12 nt, Shigella flexneri 2a str. 2457T
guucuuuuaaau

SEQ ID NO: 1930761 - RNA, 19 nt, Shigella flexneri 2a str. 2457T
guugaacgguuuggugaug

SEQ ID NO: 1930762 - RNA, 17 nt, Shigella flexneri 2a str. 2457T
guucguugaucacuuuc

SEQ ID NO: 1930763 - RNA, 16 nt, Shigella flexneri 2a str. 2457T
guucguugauaauaaa

SEQ ID NO: 1930764 - RNA, 16 nt, Shigella flexneri 2a str. 2457T
guucuacaaucugccc

SEQ ID NO: 1930765 - RNA, 15 nt, Shigella flexneri 2a str. 2457T
guucuaccgcagggg

SEQ ID NO: 1930766 - RNA, 22 nt, Shigella flexneri 2a str. 2457T
guucuucuuuauugauuaaagg

SEQ ID NO: 1930767 - RNA, 22 nt, Shigella flexneri 2a str. 2457T
guucauauauuccuuacucaua

SEQ ID NO: 1930768 - RNA, 16 nt, Shigella flexneri 2a str. 2457T
guucaugguuagccug

SEQ ID NO: 1930769 - RNA, 21 nt, Shigella flexneri 2a str. 2457T
guucauuaaugccguuauaca

SEQ ID NO: 1930770 - RNA, 22 nt, Shigella flexneri 2a str. 2457T
guucagcgucggcgucaucgac

SEQ ID NO: 1930771 - RNA, 18 nt, Shigella flexneri 2a str. 2457T
guucagcgggcagggcau

SEQ ID NO: 1930772 - RNA, 18 nt, Shigella flexneri 2a str. 2457T
guucacucaucaacguuu

SEQ ID NO: 1930773 - RNA, 23 nt, Shigella flexneri 2a str. 2457T
guuagcacgaaccgucccucgcc

SEQ ID NO: 1930774 - RNA, 21 nt, Shigella flexneri 2a str. 2457T
guuagcaaugccuucuggaaa

SEQ ID NO: 1930775 - RNA, 14 nt, Shigella flexneri 2a str. 2457T
guuagaaaacgccu

SEQ ID NO: 1930776 - RNA, 18 nt, Shigella flexneri 2a str. 2457T
guuagacgcguuuacaga

SEQ ID NO: 1930777 - RNA, 18 nt, Shigella flexneri 2a str. 2457T
guuacuuuuuaugucauu

SEQ ID NO: 1930778 - RNA, 19 nt, Shigella flexneri 2a str. 2457T
guucacugccguacaggca

SEQ ID NO: 1930779 - RNA, 22 nt, Shigella flexneri 2a str. 2457T
guucacugccguacaggcagcu

SEQ ID NO: 1930780 - RNA, 14 nt, Shigella flexneri 2a str. 2457T
guucacugugcugg

SEQ ID NO: 1930781 - RNA, 15 nt, Shigella flexneri 2a str. 2457T
guucacugugcuggu

SEQ ID NO: 1930782 - RNA, 19 nt, Shigella flexneri 2a str. 2457T
guucacuuuugcugcaaaa

SEQ ID NO: 1930783 - RNA, 15 nt, Shigella flexneri 2a str. 2457T
guucagcaguucugc

SEQ ID NO: 1930784 - RNA, 23 nt, Shigella flexneri 2a str. 2457T
guucagccagugaccuuaaucag

SEQ ID NO: 1930785 - RNA, 17 nt, Shigella flexneri 2a str. 2457T
guucagcgcaacuugca

SEQ ID NO: 1930786 - RNA, 22 nt, Shigella flexneri 2a str. 2457T
guuccaccgcguuuuccaguuc

SEQ ID NO: 1930787 - RNA, 18 nt, Shigella flexneri 2a str. 2457T
guuccaccgcguuuucca

SEQ ID NO: 1930788 - RNA, 15 nt, Shigella flexneri 2a str. 2457T
guuccccucaacaug

SEQ ID NO: 1930789 - RNA, 16 nt, Shigella flexneri 2a str. 2457T
guucgccugcaccaug

SEQ ID NO: 1930790 - RNA, 14 nt, Shigella flexneri 2a str. 2457T
guucgagcaucaca

SEQ ID NO: 1930791 - RNA, 19 nt, Shigella flexneri 2a str. 2457T
guuccugccagauuugcug

SEQ ID NO: 1930792 - RNA, 15 nt, Shigella flexneri 2a str. 2457T
guuccugcaacuucu

SEQ ID NO: 1930793 - RNA, 14 nt, Shigella flexneri 2a str. 2457T
guucgauuucccag

SEQ ID NO: 1930794 - RNA, 19 nt, Shigella flexneri 2a str. 2457T
guucgccccaaaaaagcga

SEQ ID NO: 1930795 - RNA, 17 nt, Shigella flexneri 2a str. 2457T
guuacgugaagucucaa

SEQ ID NO: 1930796 - RNA, 21 nt, Shigella flexneri 2a str. 2457T
guuacugagcggaugcuuaac

SEQ ID NO: 1930797 - RNA, 18 nt, Shigella flexneri 2a str. 2457T
guuacugcuggcaacaug

SEQ ID NO: 1930798 - RNA, 21 nt, Shigella flexneri 2a str. 2457T
guuacuuaucgauaaacggca

SEQ ID NO: 1930799 - RNA, 15 nt, Shigella flexneri 2a str. 2457T
guuacacaucauuag

SEQ ID NO: 1930800 - RNA, 17 nt, Shigella flexneri 2a str. 2457T
guuaccucauggagaua

SEQ ID NO: 1930801 - RNA, 19 nt, Shigella flexneri 2a str. 2457T
guuaccuucggccccaucg

SEQ ID NO: 1930802 - RNA, 22 nt, Shigella flexneri 2a str. 2457T
guuacgcauaaaaccagcaaac

SEQ ID NO: 1930803 - RNA, 17 nt, Shigella flexneri 2a str. 2457T
guuacgccccaacacaa

SEQ ID NO: 1930804 - RNA, 16 nt, Shigella flexneri 2a str. 2457T
guuacgcauaaaacca

SEQ ID NO: 1930805 - RNA, 20 nt, Shigella flexneri 2a str. 2457T
guuacgcaaaaccucuucca

SEQ ID NO: 1930806 - RNA, 21 nt, Shigella flexneri 2a str. 2457T
guuacgcaaaaccucuuccag

SEQ ID NO: 1930807 - RNA, 14 nt, Shigella flexneri 2a str. 2457T
gugugacaccaacc

SEQ ID NO: 1930808 - RNA, 13 nt, Shigella flexneri 2a str. 2457T
gugugugcugauu

SEQ ID NO: 1930809 - RNA, 21 nt, Shigella flexneri 2a str. 2457T
gugugguuauugggugacugg

SEQ ID NO: 1930810 - RNA, 17 nt, Shigella flexneri 2a str. 2457T
gugugcaaucacuuccu

SEQ ID NO: 1930811 - RNA, 19 nt, Shigella flexneri 2a str. 2457T
guguggucuuuucaacagu

SEQ ID NO: 1930812 - RNA, 21 nt, Shigella flexneri 2a str. 2457T
guguaacgcguacccagcagc

SEQ ID NO: 1930813 - RNA, 15 nt, Shigella flexneri 2a str. 2457T
gugucuuaucaggcc

SEQ ID NO: 1930814 - RNA, 13 nt, Shigella flexneri 2a str. 2457T
gugugaaaccuuu

SEQ ID NO: 1930815 - RNA, 17 nt, Shigella flexneri 2a str. 2457T
guguugcuccccagaau

SEQ ID NO: 1930816 - RNA, 17 nt, Shigella flexneri 2a str. 2457T
guguugcguuuaaacca

SEQ ID NO: 1930817 - RNA, 15 nt, Shigella flexneri 2a str. 2457T
guguugcaggaaaag

SEQ ID NO: 1930818 - RNA, 22 nt, Shigella flexneri 2a str. 2457T
guguuuugacauuggcauccgu

SEQ ID NO: 1930819 - RNA, 16 nt, Shigella flexneri 2a str. 2457T
guuaaacccgcucaaa

SEQ ID NO: 1930820 - RNA, 21 nt, Shigella flexneri 2a str. 2457T
guuaaaauucaagacaucaau

SEQ ID NO: 1930821 - RNA, 20 nt, Shigella flexneri 2a str. 2457T
gugguuaacgaccagcggaa

SEQ ID NO: 1930822 - RNA, 12 nt, Shigella flexneri 2a str. 2457T
guggugauuuuc

SEQ ID NO: 1930823 - RNA, 21 nt, Shigella flexneri 2a str. 2457T
guggugcguaccaggcgugga

SEQ ID NO: 1930824 - RNA, 18 nt, Shigella flexneri 2a str. 2457T
guggugagauugcugcgu

SEQ ID NO: 1930825 - RNA, 14 nt, Shigella flexneri 2a str. 2457T
guggugaucaccca

SEQ ID NO: 1930826 - RNA, 16 nt, Shigella flexneri 2a str. 2457T
guggugaucacccaga

SEQ ID NO: 1930827 - RNA, 17 nt, Shigella flexneri 2a str. 2457T
guggugaucacccagac

SEQ ID NO: 1930828 - RNA, 23 nt, Shigella flexneri 2a str. 2457T
guggcuuuuuuauugcuucacca

SEQ ID NO: 1930829 - RNA, 15 nt, Shigella flexneri 2a str. 2457T
guggcugcguuucau

SEQ ID NO: 1930830 - RNA, 20 nt, Shigella flexneri 2a str. 2457T
gugggucugucccauuuuaa

SEQ ID NO: 1930831 - RNA, 19 nt, Shigella flexneri 2a str. 2457T
guggguauauuucaggcca

SEQ ID NO: 1930832 - RNA, 13 nt, Shigella flexneri 2a str. 2457T
gugguagcggcuc

SEQ ID NO: 1930833 - RNA, 16 nt, Shigella flexneri 2a str. 2457T
guggcccagccuuucc

SEQ ID NO: 1930834 - RNA, 20 nt, Shigella flexneri 2a str. 2457T
guggcgauucauaugcgcca

SEQ ID NO: 1930835 - RNA, 13 nt, Shigella flexneri 2a str. 2457T
gugcuucacucaa

SEQ ID NO: 1930836 - RNA, 14 nt, Shigella flexneri 2a str. 2457T
gugcugugacagau

SEQ ID NO: 1930837 - RNA, 21 nt, Shigella flexneri 2a str. 2457T
gugcuuaucgcgaugauuuuc

SEQ ID NO: 1930838 - RNA, 15 nt, Shigella flexneri 2a str. 2457T
guggauucuggugau

SEQ ID NO: 1930839 - RNA, 14 nt, Shigella flexneri 2a str. 2457T
guggauguuuuacu

SEQ ID NO: 1930840 - RNA, 16 nt, Shigella flexneri 2a str. 2457T
guggcaaucguagccc

SEQ ID NO: 1930841 - RNA, 21 nt, Shigella flexneri 2a str. 2457T
gugcccguaaaaaauggcugg

SEQ ID NO: 1930842 - RNA, 17 nt, Shigella flexneri 2a str. 2457T
gugcccgggucagcgcc

SEQ ID NO: 1930843 - RNA, 16 nt, Shigella flexneri 2a str. 2457T
gugccaggaccauuca

SEQ ID NO: 1930844 - RNA, 15 nt, Shigella flexneri 2a str. 2457T
gugcccgaccacuuc

SEQ ID NO: 1930845 - RNA, 14 nt, Shigella flexneri 2a str. 2457T
gugcauugaguccc

SEQ ID NO: 1930846 - RNA, 21 nt, Shigella flexneri 2a str. 2457T
gugcauuucucacuuuucacc

SEQ ID NO: 1930847 - RNA, 14 nt, Shigella flexneri 2a str. 2457T
gugcagccaaaaau

SEQ ID NO: 1930848 - RNA, 22 nt, Shigella flexneri 2a str. 2457T
gugcagagcccguuuggugguu

SEQ ID NO: 1930849 - RNA, 21 nt, Shigella flexneri 2a str. 2457T
gugcagacaugacgcccggca

SEQ ID NO: 1930850 - RNA, 17 nt, Shigella flexneri 2a str. 2457T
gugccagaccaaacagc

SEQ ID NO: 1930851 - RNA, 17 nt, Shigella flexneri 2a str. 2457T
gugccacaccagcuuuc

SEQ ID NO: 1930852 - RNA, 13 nt, Shigella flexneri 2a str. 2457T
gugaugguggugg

SEQ ID NO: 1930853 - RNA, 17 nt, Shigella flexneri 2a str. 2457T
gugauugguuucaaaga

SEQ ID NO: 1930854 - RNA, 22 nt, Shigella flexneri 2a str. 2457T
gugauugccgcaacgguugcgg

SEQ ID NO: 1930855 - RNA, 15 nt, Shigella flexneri 2a str. 2457T
gugauugccgcagaa

SEQ ID NO: 1930856 - RNA, 21 nt, Shigella flexneri 2a str. 2457T
gugauuccgccaguugcggcu

SEQ ID NO: 1930857 - RNA, 19 nt, Shigella flexneri 2a str. 2457T
gugauucauaguaagcaga

SEQ ID NO: 1930858 - RNA, 15 nt, Shigella flexneri 2a str. 2457T
gugauuaacuguucu

SEQ ID NO: 1930859 - RNA, 17 nt, Shigella flexneri 2a str. 2457T
gugcaagaaaugacaga

SEQ ID NO: 1930860 - RNA, 16 nt, Shigella flexneri 2a str. 2457T
gugcaaggaaauaaua

SEQ ID NO: 1930861 - RNA, 11 nt, Shigella flexneri 2a str. 2457T
gugauuucaac

SEQ ID NO: 1930862 - RNA, 22 nt, Shigella flexneri 2a str. 2457T
gugcaauaccauggcucaccag

SEQ ID NO: 1930863 - RNA, 16 nt, Shigella flexneri 2a str. 2457T
gugcacaguugauuga

SEQ ID NO: 1930864 - RNA, 14 nt, Shigella flexneri 2a str. 2457T
gugcaccauaugag

SEQ ID NO: 1930865 - RNA, 20 nt, Shigella flexneri 2a str. 2457T
gugcacaacaaucugcaaau

SEQ ID NO: 1930866 - RNA, 20 nt, Shigella flexneri 2a str. 2457T
gugcaccagaaaguuuuuca

SEQ ID NO: 1930867 - RNA, 19 nt, Shigella flexneri 2a str. 2457T
gugcagaaucaaucucagc

SEQ ID NO: 1930868 - RNA, 15 nt, Shigella flexneri 2a str. 2457T
gugauggcuauuaga

SEQ ID NO: 1930869 - RNA, 21 nt, Shigella flexneri 2a str. 2457T
gucgcuuaauugaccugccgg

SEQ ID NO: 1930870 - RNA, 17 nt, Shigella flexneri 2a str. 2457T
gucgcugacgcacuguu

SEQ ID NO: 1930871 - RNA, 15 nt, Shigella flexneri 2a str. 2457T
gugcguugucaucga

SEQ ID NO: 1930872 - RNA, 12 nt, Shigella flexneri 2a str. 2457T
gugcgucagggc

SEQ ID NO: 1930873 - RNA, 16 nt, Shigella flexneri 2a str. 2457T
gugcuccagugcgcuu

SEQ ID NO: 1930874 - RNA, 13 nt, Shigella flexneri 2a str. 2457T
gugcuccaggagc

SEQ ID NO: 1930875 - RNA, 15 nt, Shigella flexneri 2a str. 2457T
gugcucauccuucag

SEQ ID NO: 1930876 - RNA, 16 nt, Shigella flexneri 2a str. 2457T
gugcucaaugagcacc

SEQ ID NO: 1930877 - RNA, 12 nt, Shigella flexneri 2a str. 2457T
gugcugauuuug

SEQ ID NO: 1930878 - RNA, 24 nt, Shigella flexneri 2a str. 2457T
gugcugcaauaaacaagauaacag

SEQ ID NO: 1930879 - RNA, 16 nt, Shigella flexneri 2a str. 2457T
gugcugaaaucacagc

SEQ ID NO: 1930880 - RNA, 14 nt, Shigella flexneri 2a str. 2457T
gugccugucgggac

SEQ ID NO: 1930881 - RNA, 20 nt, Shigella flexneri 2a str. 2457T
gugccgcgauaccacccgca

SEQ ID NO: 1930882 - RNA, 15 nt, Shigella flexneri 2a str. 2457T
gugccuuuuuuauuu

SEQ ID NO: 1930883 - RNA, 20 nt, Shigella flexneri 2a str. 2457T
gugcgaaugcgauggcaaaa

SEQ ID NO: 1930884 - RNA, 22 nt, Shigella flexneri 2a str. 2457T
gugccuuuaauaccaucggcag

SEQ ID NO: 1930885 - RNA, 19 nt, Shigella flexneri 2a str. 2457T
gugccuuuuuuauuuaugc

SEQ ID NO: 1930886 - RNA, 13 nt, Shigella flexneri 2a str. 2457T
gugcgccaugcuu

SEQ ID NO: 1930887 - RNA, 16 nt, Shigella flexneri 2a str. 2457T
gugcggcacaagaaaa

SEQ ID NO: 1930888 - RNA, 12 nt, Shigella flexneri 2a str. 2457T
gugcggcagggg

SEQ ID NO: 1930889 - RNA, 13 nt, Shigella flexneri 2a str. 2457T
gugcgcgccagga

SEQ ID NO: 1930890 - RNA, 23 nt, Shigella flexneri 2a str. 2457T
gugcgcgauagauagcguucuuu

SEQ ID NO: 1930891 - RNA, 15 nt, Shigella flexneri 2a str. 2457T
gugcgggcacaggcg

SEQ ID NO: 1930892 - RNA, 16 nt, Shigella flexneri 2a str. 2457T
gugcggguaaccagcc

SEQ ID NO: 1930893 - RNA, 14 nt, Shigella flexneri 2a str. 2457T
gugcgguaagcugc

SEQ ID NO: 1930894 - RNA, 15 nt, Shigella flexneri 2a str. 2457T
gugcggcaucgcugu

SEQ ID NO: 1930895 - RNA, 18 nt, Shigella flexneri 2a str. 2457T
gccuucggcgucuccacc

SEQ ID NO: 1930896 - RNA, 19 nt, Shigella flexneri 2a str. 2457T
gccuucggcgucuccaccu

SEQ ID NO: 1930897 - RNA, 21 nt, Shigella flexneri 2a str. 2457T
gccuucgcaaaaaaccauccc

SEQ ID NO: 1930898 - RNA, 17 nt, Shigella flexneri 2a str. 2457T
gccuuccgucagcaaag

SEQ ID NO: 1930899 - RNA, 15 nt, Shigella flexneri 2a str. 2457T
gccuucccuuucagc

SEQ ID NO: 1930900 - RNA, 18 nt, Shigella flexneri 2a str. 2457T
gccuuccgcaaacaggcg

SEQ ID NO: 1930901 - RNA, 15 nt, Shigella flexneri 2a str. 2457T
gccuuccagcgaugc

SEQ ID NO: 1930902 - RNA, 17 nt, Shigella flexneri 2a str. 2457T
gccuucagguuuuucag

SEQ ID NO: 1930903 - RNA, 21 nt, Shigella flexneri 2a str. 2457T
gccuucauucaggccaaagcc

SEQ ID NO: 1930904 - RNA, 18 nt, Shigella flexneri 2a str. 2457T
gccuucacggcuuuguca

SEQ ID NO: 1930905 - RNA, 15 nt, Shigella flexneri 2a str. 2457T
gccuucacuuccggc

SEQ ID NO: 1930906 - RNA, 14 nt, Shigella flexneri 2a str. 2457T
gccuuauccggccu

SEQ ID NO: 1930907 - RNA, 21 nt, Shigella flexneri 2a str. 2457T
gccuuauccggcuuaccgcuc

SEQ ID NO: 1930908 - RNA, 15 nt, Shigella flexneri 2a str. 2457T
gccuuauccagcaga

SEQ ID NO: 1930909 - RNA, 14 nt, Shigella flexneri 2a str. 2457T
gccuuauccagccu

SEQ ID NO: 1930910 - RNA, 18 nt, Shigella flexneri 2a str. 2457T
gccuuauccgaugguuua

SEQ ID NO: 1930911 - RNA, 13 nt, Shigella flexneri 2a str. 2457T
gccuuaaaaacca

SEQ ID NO: 1930912 - RNA, 12 nt, Shigella flexneri 2a str. 2457T
gccuuaaacuca

SEQ ID NO: 1930913 - RNA, 16 nt, Shigella flexneri 2a str. 2457T
gccuguucgccgccgc

SEQ ID NO: 1930914 - RNA, 17 nt, Shigella flexneri 2a str. 2457T
gccuguugcgucgccgc

SEQ ID NO: 1930915 - RNA, 20 nt, Shigella flexneri 2a str. 2457T
gccuugcgauuacgcucggc

SEQ ID NO: 1930916 - RNA, 16 nt, Shigella flexneri 2a str. 2457T
gccuugaacaaacaau

SEQ ID NO: 1930917 - RNA, 19 nt, Shigella flexneri 2a str. 2457T
gccuucgugcggcugcauc

SEQ ID NO: 1930918 - RNA, 20 nt, Shigella flexneri 2a str. 2457T
gccuucuccggcuuacaaca

SEQ ID NO: 1930919 - RNA, 21 nt, Shigella flexneri 2a str. 2457T
gccuucugcgccgccucugcg

SEQ ID NO: 1930920 - RNA, 12 nt, Shigella flexneri 2a str. 2457T
gccuucugcggu

SEQ ID NO: 1930921 - RNA, 15 nt, Shigella flexneri 2a str. 2457T
gccuucuucauccag

SEQ ID NO: 1930922 - RNA, 16 nt, Shigella flexneri 2a str. 2457T
gccuucuucauccagc

SEQ ID NO: 1930923 - RNA, 18 nt, Shigella flexneri 2a str. 2457T
gcgacagauuuugccagc

SEQ ID NO: 1930924 - RNA, 16 nt, Shigella flexneri 2a str. 2457T
gcgaccauacagcagc

SEQ ID NO: 1930925 - RNA, 20 nt, Shigella flexneri 2a str. 2457T
gcgaccagcgucgcaucagg

SEQ ID NO: 1930926 - RNA, 20 nt, Shigella flexneri 2a str. 2457T
gcgaccuacacgccuucucc

SEQ ID NO: 1930927 - RNA, 16 nt, Shigella flexneri 2a str. 2457T
gcgaccuguucuccug

SEQ ID NO: 1930928 - RNA, 12 nt, Shigella flexneri 2a str. 2457T
gcgacaccagcc

SEQ ID NO: 1930929 - RNA, 15 nt, Shigella flexneri 2a str. 2457T
gcgacaaucccugca

SEQ ID NO: 1930930 - RNA, 14 nt, Shigella flexneri 2a str. 2457T
gcgacaaucccugc

SEQ ID NO: 1930931 - RNA, 12 nt, Shigella flexneri 2a str. 2457T
gcgaauuuuuuc

SEQ ID NO: 1930932 - RNA, 22 nt, Shigella flexneri 2a str. 2457T
gcgaauaaaguagaaauuauuu

SEQ ID NO: 1930933 - RNA, 16 nt, Shigella flexneri 2a str. 2457T
gcgaaggcgcacugau

SEQ ID NO: 1930934 - RNA, 15 nt, Shigella flexneri 2a str. 2457T
gcgaaggccagaacc

SEQ ID NO: 1930935 - RNA, 13 nt, Shigella flexneri 2a str. 2457T
gcgaacucuuccg

SEQ ID NO: 1930936 - RNA, 16 nt, Shigella flexneri 2a str. 2457T
gcgaagggcugucggu

SEQ ID NO: 1930937 - RNA, 13 nt, Shigella flexneri 2a str. 2457T
gccuuucucagaa

SEQ ID NO: 1930938 - RNA, 21 nt, Shigella flexneri 2a str. 2457T
gccuuuauuaaugacauucag

SEQ ID NO: 1930939 - RNA, 16 nt, Shigella flexneri 2a str. 2457T
gccuuuaccgccacag

SEQ ID NO: 1930940 - RNA, 17 nt, Shigella flexneri 2a str. 2457T
gccuuuaccgccacagc

SEQ ID NO: 1930941 - RNA, 21 nt, Shigella flexneri 2a str. 2457T
gccuuuaccgcgcucgaagcg

SEQ ID NO: 1930942 - RNA, 14 nt, Shigella flexneri 2a str. 2457T
gccuuguuucuuca

SEQ ID NO: 1930943 - RNA, 14 nt, Shigella flexneri 2a str. 2457T
gccuuguuugauca

SEQ ID NO: 1930944 - RNA, 21 nt, Shigella flexneri 2a str. 2457T
gccuuuuaaugcgcuuccugc

SEQ ID NO: 1930945 - RNA, 23 nt, Shigella flexneri 2a str. 2457T
gccuuugaaaauaacaucgccag

SEQ ID NO: 1930946 - RNA, 18 nt, Shigella flexneri 2a str. 2457T
gccuuuuccuuucagagu

SEQ ID NO: 1930947 - RNA, 15 nt, Shigella flexneri 2a str. 2457T
gcgaacgggauaaac

SEQ ID NO: 1930948 - RNA, 13 nt, Shigella flexneri 2a str. 2457T
gcgaacuaaacaa

SEQ ID NO: 1930949 - RNA, 14 nt, Shigella flexneri 2a str. 2457T
gcgaacuaaacaac

SEQ ID NO: 1930950 - RNA, 14 nt, Shigella flexneri 2a str. 2457T
gcgaaauugguaga

SEQ ID NO: 1930951 - RNA, 20 nt, Shigella flexneri 2a str. 2457T
gcgaacagcacaucagccag

SEQ ID NO: 1930952 - RNA, 16 nt, Shigella flexneri 2a str. 2457T
gcgaaagcuggcacug

SEQ ID NO: 1930953 - RNA, 22 nt, Shigella flexneri 2a str. 2457T
gccuuuuuuguacuccagcaga

SEQ ID NO: 1930954 - RNA, 22 nt, Shigella flexneri 2a str. 2457T
gcgcaauauccugcgcuuccug

SEQ ID NO: 1930955 - RNA, 12 nt, Shigella flexneri 2a str. 2457T
gcgcaauaauca

SEQ ID NO: 1930956 - RNA, 22 nt, Shigella flexneri 2a str. 2457T
gcgcaacauauuccgcaccugc

SEQ ID NO: 1930957 - RNA, 20 nt, Shigella flexneri 2a str. 2457T
gcgcaacaaauaaaagcaaa

SEQ ID NO: 1930958 - RNA, 21 nt, Shigella flexneri 2a str. 2457T
gcgcaaaucagauugccacag

SEQ ID NO: 1930959 - RNA, 15 nt, Shigella flexneri 2a str. 2457T
gcgcaacaaauaaaa

SEQ ID NO: 1930960 - RNA, 21 nt, Shigella flexneri 2a str. 2457T
gcgcaaauccacguuccagau

SEQ ID NO: 1930961 - RNA, 16 nt, Shigella flexneri 2a str. 2457T
gcgcaaaggccagcaa

SEQ ID NO: 1930962 - RNA, 16 nt, Shigella flexneri 2a str. 2457T
gcgcaaacuuaucgug

SEQ ID NO: 1930963 - RNA, 17 nt, Shigella flexneri 2a str. 2457T
gcgauugugacacgcgc

SEQ ID NO: 1930964 - RNA, 12 nt, Shigella flexneri 2a str. 2457T
gcgauuuccuuc

SEQ ID NO: 1930965 - RNA, 13 nt, Shigella flexneri 2a str. 2457T
gcgauuuccuuca

SEQ ID NO: 1930966 - RNA, 17 nt, Shigella flexneri 2a str. 2457T
gcgaugggcguuucacu

SEQ ID NO: 1930967 - RNA, 20 nt, Shigella flexneri 2a str. 2457T
gcgauggguuaacaucaugu

SEQ ID NO: 1930968 - RNA, 22 nt, Shigella flexneri 2a str. 2457T
gcgaugguacuucaaucgccac

SEQ ID NO: 1930969 - RNA, 22 nt, Shigella flexneri 2a str. 2457T
gcgaugguguuccagaauuacg

SEQ ID NO: 1930970 - RNA, 16 nt, Shigella flexneri 2a str. 2457T
gcgauggcggcagccu

SEQ ID NO: 1930971 - RNA, 19 nt, Shigella flexneri 2a str. 2457T
gcgauucauaugcgccagc

SEQ ID NO: 1930972 - RNA, 23 nt, Shigella flexneri 2a str. 2457T
gcgauugccguuggcguugcacc

SEQ ID NO: 1930973 - RNA, 23 nt, Shigella flexneri 2a str. 2457T
gcgauucccguuuauggucgggu

SEQ ID NO: 1930974 - RNA, 15 nt, Shigella flexneri 2a str. 2457T
gcgauucggcuccgu

SEQ ID NO: 1930975 - RNA, 17 nt, Shigella flexneri 2a str. 2457T
gcgcagcugagaaaaag

SEQ ID NO: 1930976 - RNA, 17 nt, Shigella flexneri 2a str. 2457T
gcgcaauucgcgucggc

SEQ ID NO: 1930977 - RNA, 24 nt, Shigella flexneri 2a str. 2457T
gcgcaauggcuggccccgucagca

SEQ ID NO: 1930978 - RNA, 13 nt, Shigella flexneri 2a str. 2457T
gcgcaaucgccag

SEQ ID NO: 1930979 - RNA, 12 nt, Shigella flexneri 2a str. 2457T
gcgcaaucacca

SEQ ID NO: 1930980 - RNA, 18 nt, Shigella flexneri 2a str. 2457T
gcgcacuaugugccagcu

SEQ ID NO: 1930981 - RNA, 15 nt, Shigella flexneri 2a str. 2457T
gcgcacgucagccuc

SEQ ID NO: 1930982 - RNA, 23 nt, Shigella flexneri 2a str. 2457T
gcgcacguacaucccgcgaacga

SEQ ID NO: 1930983 - RNA, 13 nt, Shigella flexneri 2a str. 2457T
gcgcagcacccag

SEQ ID NO: 1930984 - RNA, 22 nt, Shigella flexneri 2a str. 2457T
gcgcagcaagucggcaucgcca

SEQ ID NO: 1930985 - RNA, 15 nt, Shigella flexneri 2a str. 2457T
gcgcagcagcgcgcc

SEQ ID NO: 1930986 - RNA, 22 nt, Shigella flexneri 2a str. 2457T
gcgacgaccacccaccgcagcc

SEQ ID NO: 1930987 - RNA, 21 nt, Shigella flexneri 2a str. 2457T
gcgacgaccacccaccgcagc

SEQ ID NO: 1930988 - RNA, 17 nt, Shigella flexneri 2a str. 2457T
gcgacugaggcugucau

SEQ ID NO: 1930989 - RNA, 15 nt, Shigella flexneri 2a str. 2457T
gcgacugcgggcgca

SEQ ID NO: 1930990 - RNA, 15 nt, Shigella flexneri 2a str. 2457T
gcgacugccagcauc

SEQ ID NO: 1930991 - RNA, 20 nt, Shigella flexneri 2a str. 2457T
gcgagcgauaacccagcgca

SEQ ID NO: 1930992 - RNA, 23 nt, Shigella flexneri 2a str. 2457T
gcgagccuguaccacaaccugca

SEQ ID NO: 1930993 - RNA, 19 nt, Shigella flexneri 2a str. 2457T
gcgagauuccgccgccauu

SEQ ID NO: 1930994 - RNA, 20 nt, Shigella flexneri 2a str. 2457T
gcgaugaaaaucaccggaug

SEQ ID NO: 1930995 - RNA, 19 nt, Shigella flexneri 2a str. 2457T
gcgaugacuguacagaucc

SEQ ID NO: 1930996 - RNA, 13 nt, Shigella flexneri 2a str. 2457T
gcgaugaugccaa

SEQ ID NO: 1930997 - RNA, 17 nt, Shigella flexneri 2a str. 2457T
gcgauggacgcagacca

SEQ ID NO: 1930998 - RNA, 18 nt, Shigella flexneri 2a str. 2457T
gcgaucccagagcgggca

SEQ ID NO: 1930999 - RNA, 21 nt, Shigella flexneri 2a str. 2457T
gcgauccgguacuggcguggg

SEQ ID NO: 1931000 - RNA, 20 nt, Shigella flexneri 2a str. 2457T
gcgaucgaccugcgccugca

SEQ ID NO: 1931001 - RNA, 18 nt, Shigella flexneri 2a str. 2457T
gcgaucgaccugcgccug

SEQ ID NO: 1931002 - RNA, 16 nt, Shigella flexneri 2a str. 2457T
gcgagguaggcaguca

SEQ ID NO: 1931003 - RNA, 13 nt, Shigella flexneri 2a str. 2457T
gcgauacacugaa

SEQ ID NO: 1931004 - RNA, 19 nt, Shigella flexneri 2a str. 2457T
gcgagggagaaaacccggc

SEQ ID NO: 1931005 - RNA, 12 nt, Shigella flexneri 2a str. 2457T
gcgagggagaaa

SEQ ID NO: 1931006 - RNA, 18 nt, Shigella flexneri 2a str. 2457T
gcgauagauuagcuggcc

SEQ ID NO: 1931007 - RNA, 15 nt, Shigella flexneri 2a str. 2457T
gcgauacuuuuucaa

SEQ ID NO: 1931008 - RNA, 19 nt, Shigella flexneri 2a str. 2457T
gcgauacccccaguaaaug

SEQ ID NO: 1931009 - RNA, 17 nt, Shigella flexneri 2a str. 2457T
gcgccagauagccgacc

SEQ ID NO: 1931010 - RNA, 19 nt, Shigella flexneri 2a str. 2457T
gcgccagagcgcggcguga

SEQ ID NO: 1931011 - RNA, 15 nt, Shigella flexneri 2a str. 2457T
gcgccagaagggaca

SEQ ID NO: 1931012 - RNA, 15 nt, Shigella flexneri 2a str. 2457T
gcgcaggauaaccuu

SEQ ID NO: 1931013 - RNA, 15 nt, Shigella flexneri 2a str. 2457T
gcgccagcgucauca

SEQ ID NO: 1931014 - RNA, 21 nt, Shigella flexneri 2a str. 2457T
gcgccagcgggcuccacggaa

SEQ ID NO: 1931015 - RNA, 13 nt, Shigella flexneri 2a str. 2457T
gcgccaggcgcug

SEQ ID NO: 1931016 - RNA, 21 nt, Shigella flexneri 2a str. 2457T
gcgccagguguuuaaccaaca

SEQ ID NO: 1931017 - RNA, 13 nt, Shigella flexneri 2a str. 2457T
gcgccauuuucau

SEQ ID NO: 1931018 - RNA, 20 nt, Shigella flexneri 2a str. 2457T
gcgccauugauguaauuauc

SEQ ID NO: 1931019 - RNA, 21 nt, Shigella flexneri 2a str. 2457T
gcgcccggaaacgggcgcuga

SEQ ID NO: 1931020 - RNA, 12 nt, Shigella flexneri 2a str. 2457T
gcgcccuguucu

SEQ ID NO: 1931021 - RNA, 13 nt, Shigella flexneri 2a str. 2457T
gcgcccgccagca

SEQ ID NO: 1931022 - RNA, 15 nt, Shigella flexneri 2a str. 2457T
gcgcccgccagcauc

SEQ ID NO: 1931023 - RNA, 20 nt, Shigella flexneri 2a str. 2457T
gcgccgugcaacugcggcgc

SEQ ID NO: 1931024 - RNA, 23 nt, Shigella flexneri 2a str. 2457T
gcgccgugaacguggccaugagc

SEQ ID NO: 1931025 - RNA, 19 nt, Shigella flexneri 2a str. 2457T
gcgccgugcaacugcggcg

SEQ ID NO: 1931026 - RNA, 20 nt, Shigella flexneri 2a str. 2457T
gcgccgcaucgggggaagcu

SEQ ID NO: 1931027 - RNA, 14 nt, Shigella flexneri 2a str. 2457T
gcgccgccacugcc

SEQ ID NO: 1931028 - RNA, 21 nt, Shigella flexneri 2a str. 2457T
gcgcucguugugaucgcugcc

SEQ ID NO: 1931029 - RNA, 13 nt, Shigella flexneri 2a str. 2457T
gcgcuccuguucc

SEQ ID NO: 1931030 - RNA, 19 nt, Shigella flexneri 2a str. 2457T
gcgcucgaagcgggcgcgc

SEQ ID NO: 1931031 - RNA, 15 nt, Shigella flexneri 2a str. 2457T
gcgcucgacuuuagu

SEQ ID NO: 1931032 - RNA, 16 nt, Shigella flexneri 2a str. 2457T
gcgcucauuuucucuu

SEQ ID NO: 1931033 - RNA, 21 nt, Shigella flexneri 2a str. 2457T
gcgcucauuuucucuuucagc

SEQ ID NO: 1931034 - RNA, 13 nt, Shigella flexneri 2a str. 2457T
gcgcuccaggagu

SEQ ID NO: 1931035 - RNA, 14 nt, Shigella flexneri 2a str. 2457T
gcgcucccgcagga

SEQ ID NO: 1931036 - RNA, 21 nt, Shigella flexneri 2a str. 2457T
gcgcugccucucuucgcugcu

SEQ ID NO: 1931037 - RNA, 12 nt, Shigella flexneri 2a str. 2457T
gcgcugccagaa

SEQ ID NO: 1931038 - RNA, 22 nt, Shigella flexneri 2a str. 2457T
gcgcguuuuucuucagccccuc

SEQ ID NO: 1931039 - RNA, 13 nt, Shigella flexneri 2a str. 2457T
gcgcuaacucauc

SEQ ID NO: 1931040 - RNA, 14 nt, Shigella flexneri 2a str. 2457T
gcgcuaaccgccug

SEQ ID NO: 1931041 - RNA, 18 nt, Shigella flexneri 2a str. 2457T
gcgcuaaaaauagcgacu

SEQ ID NO: 1931042 - RNA, 17 nt, Shigella flexneri 2a str. 2457T
gcgcuaaaagcauagcc

SEQ ID NO: 1931043 - RNA, 19 nt, Shigella flexneri 2a str. 2457T
gcgcuacgcuaucagaccu

SEQ ID NO: 1931044 - RNA, 21 nt, Shigella flexneri 2a str. 2457T
gcgcguuaaagaagcggcgcg

SEQ ID NO: 1931045 - RNA, 13 nt, Shigella flexneri 2a str. 2457T
gcgcguuaacucc

SEQ ID NO: 1931046 - RNA, 12 nt, Shigella flexneri 2a str. 2457T
gcgcgugaagug

SEQ ID NO: 1931047 - RNA, 17 nt, Shigella flexneri 2a str. 2457T
gcgcguccgcagacacu

SEQ ID NO: 1931048 - RNA, 22 nt, Shigella flexneri 2a str. 2457T
gcgcggaaagcaccugcgcagg

SEQ ID NO: 1931049 - RNA, 16 nt, Shigella flexneri 2a str. 2457T
gcgcggcgcaggcgcu

SEQ ID NO: 1931050 - RNA, 14 nt, Shigella flexneri 2a str. 2457T
gcgcggcagccacc

SEQ ID NO: 1931051 - RNA, 21 nt, Shigella flexneri 2a str. 2457T
gcgcggcaauuagcggccagc

SEQ ID NO: 1931052 - RNA, 20 nt, Shigella flexneri 2a str. 2457T
gcgcggccuuuaccuucgcc

SEQ ID NO: 1931053 - RNA, 17 nt, Shigella flexneri 2a str. 2457T
gcgcggcauuacgcccg

SEQ ID NO: 1931054 - RNA, 15 nt, Shigella flexneri 2a str. 2457T
gcgcgaacugucggu

SEQ ID NO: 1931055 - RNA, 20 nt, Shigella flexneri 2a str. 2457T
gcgcgaacugucgguuugua

SEQ ID NO: 1931056 - RNA, 20 nt, Shigella flexneri 2a str. 2457T
gcgcgaagcuggcggcggcg

SEQ ID NO: 1931057 - RNA, 22 nt, Shigella flexneri 2a str. 2457T
gcgcgaauggaaagcccgcccc

SEQ ID NO: 1931058 - RNA, 19 nt, Shigella flexneri 2a str. 2457T
gcgcgaauggaaagcccgc

SEQ ID NO: 1931059 - RNA, 21 nt, Shigella flexneri 2a str. 2457T
gcgcgaauggaaagcccgccc

SEQ ID NO: 1931060 - RNA, 13 nt, Shigella flexneri 2a str. 2457T
gcgcgaccaaugu

SEQ ID NO: 1931061 - RNA, 22 nt, Shigella flexneri 2a str. 2457T
gcgcgaccaucggaucggccau

SEQ ID NO: 1931062 - RNA, 15 nt, Shigella flexneri 2a str. 2457T
gcgcgaacagcacau

SEQ ID NO: 1931063 - RNA, 22 nt, Shigella flexneri 2a str. 2457T
gcgccgugucggugcucaucag

SEQ ID NO: 1931064 - RNA, 17 nt, Shigella flexneri 2a str. 2457T
gcgccguuuuuuuucug

SEQ ID NO: 1931065 - RNA, 14 nt, Shigella flexneri 2a str. 2457T
gcgcgacuuuuucc

SEQ ID NO: 1931066 - RNA, 18 nt, Shigella flexneri 2a str. 2457T
gcgcgagccauaaacuga

SEQ ID NO: 1931067 - RNA, 15 nt, Shigella flexneri 2a str. 2457T
gcgcgccaagcccgu

SEQ ID NO: 1931068 - RNA, 17 nt, Shigella flexneri 2a str. 2457T
gcguuuccagcaccagu

SEQ ID NO: 1931069 - RNA, 23 nt, Shigella flexneri 2a str. 2457T
gcguucugguaaaccuuccacac

SEQ ID NO: 1931070 - RNA, 22 nt, Shigella flexneri 2a str. 2457T
gcguucugucgauaaacucaug

SEQ ID NO: 1931071 - RNA, 15 nt, Shigella flexneri 2a str. 2457T
gcguuuguccgccgg

SEQ ID NO: 1931072 - RNA, 11 nt, Shigella flexneri 2a str. 2457T
gcguuuuccag

SEQ ID NO: 1931073 - RNA, 19 nt, Shigella flexneri 2a str. 2457T
gcguuuugccaguucguug

SEQ ID NO: 1931074 - RNA, 23 nt, Shigella flexneri 2a str. 2457T
gcguuuugauuuucaccagcauc

SEQ ID NO: 1931075 - RNA, 13 nt, Shigella flexneri 2a str. 2457T
gcguuuuucuuca

SEQ ID NO: 1931076 - RNA, 23 nt, Shigella flexneri 2a str. 2457T
gcguuuuucuucagccccuccac

SEQ ID NO: 1931077 - RNA, 20 nt, Shigella flexneri 2a str. 2457T
gcguuuuuugauaguuuacu

SEQ ID NO: 1931078 - RNA, 23 nt, Shigella flexneri 2a str. 2457T
gcguuuuuucgauaucaagccau

SEQ ID NO: 1931079 - RNA, 14 nt, Shigella flexneri 2a str. 2457T
gcuaaaaacaucau

SEQ ID NO: 1931080 - RNA, 16 nt, Shigella flexneri 2a str. 2457T
gcuaaaaacaucauga

SEQ ID NO: 1931081 - RNA, 19 nt, Shigella flexneri 2a str. 2457T
gcguuacucuggcgcugga

SEQ ID NO: 1931082 - RNA, 20 nt, Shigella flexneri 2a str. 2457T
gcguuacccauucaagauca

SEQ ID NO: 1931083 - RNA, 22 nt, Shigella flexneri 2a str. 2457T
gcguuagauagcggcugacggu

SEQ ID NO: 1931084 - RNA, 18 nt, Shigella flexneri 2a str. 2457T
gcguuagacgcguuuaca

SEQ ID NO: 1931085 - RNA, 16 nt, Shigella flexneri 2a str. 2457T
gcguuacagcuggagu

SEQ ID NO: 1931086 - RNA, 14 nt, Shigella flexneri 2a str. 2457T
gcguuaccagcaaa

SEQ ID NO: 1931087 - RNA, 14 nt, Shigella flexneri 2a str. 2457T
gcguuaacuuguug

SEQ ID NO: 1931088 - RNA, 17 nt, Shigella flexneri 2a str. 2457T
gcguuauccgcuuuuuc

SEQ ID NO: 1931089 - RNA, 23 nt, Shigella flexneri 2a str. 2457T
gcguucccguccgcacgcuggag

SEQ ID NO: 1931090 - RNA, 16 nt, Shigella flexneri 2a str. 2457T
gcgucuuaucuggccu

SEQ ID NO: 1931091 - RNA, 17 nt, Shigella flexneri 2a str. 2457T
gcgucuuaucuggccua

SEQ ID NO: 1931092 - RNA, 16 nt, Shigella flexneri 2a str. 2457T
gcgucuuccgugccug

SEQ ID NO: 1931093 - RNA, 19 nt, Shigella flexneri 2a str. 2457T
gcgugaacgugcaaaauca

SEQ ID NO: 1931094 - RNA, 18 nt, Shigella flexneri 2a str. 2457T
gcgucuggcccaugccag

SEQ ID NO: 1931095 - RNA, 15 nt, Shigella flexneri 2a str. 2457T
gcgucuuaucaggcc

SEQ ID NO: 1931096 - RNA, 14 nt, Shigella flexneri 2a str. 2457T
gcgucuuaucaggc

SEQ ID NO: 1931097 - RNA, 16 nt, Shigella flexneri 2a str. 2457T
gcguagugaaggcaaa

SEQ ID NO: 1931098 - RNA, 15 nt, Shigella flexneri 2a str. 2457T
gcguaucgcccugcc

SEQ ID NO: 1931099 - RNA, 22 nt, Shigella flexneri 2a str. 2457T
gcgugauucauacagcggccag

SEQ ID NO: 1931100 - RNA, 14 nt, Shigella flexneri 2a str. 2457T
gcgugaaucaacac

SEQ ID NO: 1931101 - RNA, 14 nt, Shigella flexneri 2a str. 2457T
gcguggacggucaa

SEQ ID NO: 1931102 - RNA, 22 nt, Shigella flexneri 2a str. 2457T
gcuaccggacaguuugaucagu

SEQ ID NO: 1931103 - RNA, 23 nt, Shigella flexneri 2a str. 2457T
gcuacgaucgauaaccaucuucu

SEQ ID NO: 1931104 - RNA, 15 nt, Shigella flexneri 2a str. 2457T
gcuaccgcccugagc

SEQ ID NO: 1931105 - RNA, 17 nt, Shigella flexneri 2a str. 2457T
gcuacgcuuaucaggcc

SEQ ID NO: 1931106 - RNA, 13 nt, Shigella flexneri 2a str. 2457T
gcuacgccagcaa

SEQ ID NO: 1931107 - RNA, 17 nt, Shigella flexneri 2a str. 2457T
gcuacaaaaaugcccga

SEQ ID NO: 1931108 - RNA, 15 nt, Shigella flexneri 2a str. 2457T
gcuacagccugguga

SEQ ID NO: 1931109 - RNA, 15 nt, Shigella flexneri 2a str. 2457T
gcuacauaacgcagc

SEQ ID NO: 1931110 - RNA, 15 nt, Shigella flexneri 2a str. 2457T
gcuacauacuuaaau

SEQ ID NO: 1931111 - RNA, 16 nt, Shigella flexneri 2a str. 2457T
gcuacccacuuccccu

SEQ ID NO: 1931112 - RNA, 13 nt, Shigella flexneri 2a str. 2457T
gcuaccaaaaaau

SEQ ID NO: 1931113 - RNA, 17 nt, Shigella flexneri 2a str. 2457T
gcuacauacuuaaauaa

SEQ ID NO: 1931114 - RNA, 21 nt, Shigella flexneri 2a str. 2457T
gcuaaccgcuuuuccagcaua

SEQ ID NO: 1931115 - RNA, 19 nt, Shigella flexneri 2a str. 2457T
gcuaaaguacguaaaacaa

SEQ ID NO: 1931116 - RNA, 20 nt, Shigella flexneri 2a str. 2457T
gcuaaaaauagcgacuuggg

SEQ ID NO: 1931117 - RNA, 22 nt, Shigella flexneri 2a str. 2457T
gcuaacgcccgccgugaucugg

SEQ ID NO: 1931118 - RNA, 21 nt, Shigella flexneri 2a str. 2457T
gcuaacugguggcaggaaaac

SEQ ID NO: 1931119 - RNA, 18 nt, Shigella flexneri 2a str. 2457T
gcuaaucucuucaccaua

SEQ ID NO: 1931120 - RNA, 23 nt, Shigella flexneri 2a str. 2457T
gcuaauaccgucgaugccaauaa

SEQ ID NO: 1931121 - RNA, 13 nt, Shigella flexneri 2a str. 2457T
gcuaaguugaauc

SEQ ID NO: 1931122 - RNA, 13 nt, Shigella flexneri 2a str. 2457T
gcucaggguuuuc

SEQ ID NO: 1931123 - RNA, 15 nt, Shigella flexneri 2a str. 2457T
gcucaguugguuaga

SEQ ID NO: 1931124 - RNA, 21 nt, Shigella flexneri 2a str. 2457T
gcucagucggcgcuuuugcau

SEQ ID NO: 1931125 - RNA, 15 nt, Shigella flexneri 2a str. 2457T
gcucaucaagcuguu

SEQ ID NO: 1931126 - RNA, 15 nt, Shigella flexneri 2a str. 2457T
gcucauauuccugca

SEQ ID NO: 1931127 - RNA, 17 nt, Shigella flexneri 2a str. 2457T
gcucaguugcaucgucu

SEQ ID NO: 1931128 - RNA, 18 nt, Shigella flexneri 2a str. 2457T
gcucaguugcaucgucug

SEQ ID NO: 1931129 - RNA, 19 nt, Shigella flexneri 2a str. 2457T
gcucaucaggccuacaaaa

SEQ ID NO: 1931130 - RNA, 21 nt, Shigella flexneri 2a str. 2457T
gcucaucagcggcgaagccua

SEQ ID NO: 1931131 - RNA, 22 nt, Shigella flexneri 2a str. 2457T
gcuccagauuacuuaaguuaua

SEQ ID NO: 1931132 - RNA, 20 nt, Shigella flexneri 2a str. 2457T
gcuccagcaaaaagcggcuc

SEQ ID NO: 1931133 - RNA, 18 nt, Shigella flexneri 2a str. 2457T
gcuccagugcauccagca

SEQ ID NO: 1931134 - RNA, 20 nt, Shigella flexneri 2a str. 2457T
gcucauugguccaucuuuuu

SEQ ID NO: 1931135 - RNA, 14 nt, Shigella flexneri 2a str. 2457T
gcucauucuuccuc

SEQ ID NO: 1931136 - RNA, 15 nt, Shigella flexneri 2a str. 2457T
gcuccagacgccaga

SEQ ID NO: 1931137 - RNA, 13 nt, Shigella flexneri 2a str. 2457T
gcucaccgccagc

SEQ ID NO: 1931138 - RNA, 13 nt, Shigella flexneri 2a str. 2457T
gcucaccagcagc

SEQ ID NO: 1931139 - RNA, 18 nt, Shigella flexneri 2a str. 2457T
gcucaccagcagcggucg

SEQ ID NO: 1931140 - RNA, 23 nt, Shigella flexneri 2a str. 2457T
gcucaccaaaaccgagaagcagc

SEQ ID NO: 1931141 - RNA, 21 nt, Shigella flexneri 2a str. 2457T
gcucagaagacgcuccagugu

SEQ ID NO: 1931142 - RNA, 19 nt, Shigella flexneri 2a str. 2457T
gcucacugcaaaacagguc

SEQ ID NO: 1931143 - RNA, 23 nt, Shigella flexneri 2a str. 2457T
gcucacuucgcuuacgccugcca

SEQ ID NO: 1931144 - RNA, 15 nt, Shigella flexneri 2a str. 2457T
gcuacuucaaacaaa

SEQ ID NO: 1931145 - RNA, 16 nt, Shigella flexneri 2a str. 2457T
gcuacuucaaacaaaa

SEQ ID NO: 1931146 - RNA, 19 nt, Shigella flexneri 2a str. 2457T
gcuacuggcaauccagcuc

SEQ ID NO: 1931147 - RNA, 15 nt, Shigella flexneri 2a str. 2457T
gcuaguaaguuacau

SEQ ID NO: 1931148 - RNA, 17 nt, Shigella flexneri 2a str. 2457T
gcucaauauccugaccu

SEQ ID NO: 1931149 - RNA, 15 nt, Shigella flexneri 2a str. 2457T
gcucaaugucuguca

SEQ ID NO: 1931150 - RNA, 23 nt, Shigella flexneri 2a str. 2457T
gcucaaucguaugaucauccgcc

SEQ ID NO: 1931151 - RNA, 18 nt, Shigella flexneri 2a str. 2457T
gcuccauaauugccagcu

SEQ ID NO: 1931152 - RNA, 16 nt, Shigella flexneri 2a str. 2457T
gcuccauaauugccag

SEQ ID NO: 1931153 - RNA, 15 nt, Shigella flexneri 2a str. 2457T
gcuccaguguggcca

SEQ ID NO: 1931154 - RNA, 17 nt, Shigella flexneri 2a str. 2457T
gcucccuucggggcggc

SEQ ID NO: 1931155 - RNA, 18 nt, Shigella flexneri 2a str. 2457T
gcucccuggcccaucgcc

SEQ ID NO: 1931156 - RNA, 18 nt, Shigella flexneri 2a str. 2457T
gcuccguccagccaccgc

SEQ ID NO: 1931157 - RNA, 14 nt, Shigella flexneri 2a str. 2457T
gcuccguuccccuc

SEQ ID NO: 1931158 - RNA, 22 nt, Shigella flexneri 2a str. 2457T
gcuccgggugugacaacaacau

SEQ ID NO: 1931159 - RNA, 15 nt, Shigella flexneri 2a str. 2457T
gcuccguccagccac

SEQ ID NO: 1931160 - RNA, 13 nt, Shigella flexneri 2a str. 2457T
gcuccguaaaccc

SEQ ID NO: 1931161 - RNA, 14 nt, Shigella flexneri 2a str. 2457T
gcuccguaaacccc

SEQ ID NO: 1931162 - RNA, 15 nt, Shigella flexneri 2a str. 2457T
gcuccgcaagcgaau

SEQ ID NO: 1931163 - RNA, 19 nt, Shigella flexneri 2a str. 2457T
gcuccgggcugguuuucag

SEQ ID NO: 1931164 - RNA, 19 nt, Shigella flexneri 2a str. 2457T
gcuccucgaguccuuccag

SEQ ID NO: 1931165 - RNA, 18 nt, Shigella flexneri 2a str. 2457T
gcucgaacagcugguuga

SEQ ID NO: 1931166 - RNA, 13 nt, Shigella flexneri 2a str. 2457T
gcuccucuuucau

SEQ ID NO: 1931167 - RNA, 18 nt, Shigella flexneri 2a str. 2457T
gcucgacgagaauuuccu

SEQ ID NO: 1931168 - RNA, 15 nt, Shigella flexneri 2a str. 2457T
gcucgaacgccucug

SEQ ID NO: 1931169 - RNA, 13 nt, Shigella flexneri 2a str. 2457T
gcucgacagcgcu

SEQ ID NO: 1931170 - RNA, 12 nt, Shigella flexneri 2a str. 2457T
gcucgcacuuuc

SEQ ID NO: 1931171 - RNA, 23 nt, Shigella flexneri 2a str. 2457T
gcucgccuuucggcugcagcagu

SEQ ID NO: 1931172 - RNA, 22 nt, Shigella flexneri 2a str. 2457T
gcucgcgcuugcggaagcaacc

SEQ ID NO: 1931173 - RNA, 15 nt, Shigella flexneri 2a str. 2457T
gcucgcuggcaggcc

SEQ ID NO: 1931174 - RNA, 16 nt, Shigella flexneri 2a str. 2457T
gcucgcuggcaggccg

SEQ ID NO: 1931175 - RNA, 21 nt, Shigella flexneri 2a str. 2457T
gcucgcguucgauggcgcgcc

SEQ ID NO: 1931176 - RNA, 16 nt, Shigella flexneri 2a str. 2457T
gcggcauuacgcccga

SEQ ID NO: 1931177 - RNA, 24 nt, Shigella flexneri 2a str. 2457T
gcggcauugcaaugacgccgagga

SEQ ID NO: 1931178 - RNA, 22 nt, Shigella flexneri 2a str. 2457T
gcggccagccauccgucaucca

SEQ ID NO: 1931179 - RNA, 21 nt, Shigella flexneri 2a str. 2457T
gcggcccagugagucggggcc

SEQ ID NO: 1931180 - RNA, 18 nt, Shigella flexneri 2a str. 2457T
gcggcacuguuucgccag

SEQ ID NO: 1931181 - RNA, 17 nt, Shigella flexneri 2a str. 2457T
gcggcagcaauggcacu

SEQ ID NO: 1931182 - RNA, 20 nt, Shigella flexneri 2a str. 2457T
gcggcagcaggaucuccagc

SEQ ID NO: 1931183 - RNA, 22 nt, Shigella flexneri 2a str. 2457T
gcgcuggugacaucgccagaga

SEQ ID NO: 1931184 - RNA, 18 nt, Shigella flexneri 2a str. 2457T
gcgcugguaaucaccacc

SEQ ID NO: 1931185 - RNA, 19 nt, Shigella flexneri 2a str. 2457T
gcggcaguauagcggcaug

SEQ ID NO: 1931186 - RNA, 21 nt, Shigella flexneri 2a str. 2457T
gcggcauccagguuucuucca

SEQ ID NO: 1931187 - RNA, 15 nt, Shigella flexneri 2a str. 2457T
gcggcaguaaauauu

SEQ ID NO: 1931188 - RNA, 19 nt, Shigella flexneri 2a str. 2457T
gcggcagguugaugaugac

SEQ ID NO: 1931189 - RNA, 17 nt, Shigella flexneri 2a str. 2457T
gcggcaggacgcgcgcu

SEQ ID NO: 1931190 - RNA, 17 nt, Shigella flexneri 2a str. 2457T
gcggcagcucgcguucg

SEQ ID NO: 1931191 - RNA, 21 nt, Shigella flexneri 2a str. 2457T
gcggcagcuuguacugcucgc

SEQ ID NO: 1931192 - RNA, 14 nt, Shigella flexneri 2a str. 2457T
gcggccguuccauu

SEQ ID NO: 1931193 - RNA, 22 nt, Shigella flexneri 2a str. 2457T
gcggccuuuaccuucgccgccc

SEQ ID NO: 1931194 - RNA, 22 nt, Shigella flexneri 2a str. 2457T
gcggcgaacugccgaucaccac

SEQ ID NO: 1931195 - RNA, 18 nt, Shigella flexneri 2a str. 2457T
gcggcgaaccagccguug

SEQ ID NO: 1931196 - RNA, 19 nt, Shigella flexneri 2a str. 2457T
gcggcgaagauacccgcga

SEQ ID NO: 1931197 - RNA, 14 nt, Shigella flexneri 2a str. 2457T
gcggcgaaggugcc

SEQ ID NO: 1931198 - RNA, 21 nt, Shigella flexneri 2a str. 2457T
gcggcgauaauauugaugcac

SEQ ID NO: 1931199 - RNA, 17 nt, Shigella flexneri 2a str. 2457T
gcggcgauauccagcgc

SEQ ID NO: 1931200 - RNA, 18 nt, Shigella flexneri 2a str. 2457T
gcggcgaucuuuuaauaa

SEQ ID NO: 1931201 - RNA, 14 nt, Shigella flexneri 2a str. 2457T
gcguaaaucaaacc

SEQ ID NO: 1931202 - RNA, 17 nt, Shigella flexneri 2a str. 2457T
gcgguugacggaaagca

SEQ ID NO: 1931203 - RNA, 13 nt, Shigella flexneri 2a str. 2457T
gcguacaccaaca

SEQ ID NO: 1931204 - RNA, 12 nt, Shigella flexneri 2a str. 2457T
gcguacagcgcg

SEQ ID NO: 1931205 - RNA, 13 nt, Shigella flexneri 2a str. 2457T
gcguacagcgagg

SEQ ID NO: 1931206 - RNA, 15 nt, Shigella flexneri 2a str. 2457T
gcguacaccaacauc

SEQ ID NO: 1931207 - RNA, 15 nt, Shigella flexneri 2a str. 2457T
gcguaguaaagccuu

SEQ ID NO: 1931208 - RNA, 17 nt, Shigella flexneri 2a str. 2457T
gcggucguaaucgcccg

SEQ ID NO: 1931209 - RNA, 16 nt, Shigella flexneri 2a str. 2457T
gcgguggcuucgccuu

SEQ ID NO: 1931210 - RNA, 16 nt, Shigella flexneri 2a str. 2457T
gcgguggucgaugccc

SEQ ID NO: 1931211 - RNA, 13 nt, Shigella flexneri 2a str. 2457T
gcggucaaccauc

SEQ ID NO: 1931212 - RNA, 17 nt, Shigella flexneri 2a str. 2457T
gcggguuaaccagcacc

SEQ ID NO: 1931213 - RNA, 13 nt, Shigella flexneri 2a str. 2457T
gcggguuagucug

SEQ ID NO: 1931214 - RNA, 14 nt, Shigella flexneri 2a str. 2457T
gcgggcaguaaacg

SEQ ID NO: 1931215 - RNA, 18 nt, Shigella flexneri 2a str. 2457T
gcggcuuauucauuacuc

SEQ ID NO: 1931216 - RNA, 15 nt, Shigella flexneri 2a str. 2457T
gcggcuuccaccgcc

SEQ ID NO: 1931217 - RNA, 19 nt, Shigella flexneri 2a str. 2457T
gcggcucucuuucuccagc

SEQ ID NO: 1931218 - RNA, 23 nt, Shigella flexneri 2a str. 2457T
gcggcucuccugaacuuucuccc

SEQ ID NO: 1931219 - RNA, 22 nt, Shigella flexneri 2a str. 2457T
gcggcuuagcugaucgacaaaa

SEQ ID NO: 1931220 - RNA, 17 nt, Shigella flexneri 2a str. 2457T
gcggcggaaaaagcgga

SEQ ID NO: 1931221 - RNA, 13 nt, Shigella flexneri 2a str. 2457T
gcggcggcgggcg

SEQ ID NO: 1931222 - RNA, 15 nt, Shigella flexneri 2a str. 2457T
gcggcggcgggcgca

SEQ ID NO: 1931223 - RNA, 15 nt, Shigella flexneri 2a str. 2457T
gcgggucaguauucc

SEQ ID NO: 1931224 - RNA, 21 nt, Shigella flexneri 2a str. 2457T
gcggggaucacuccccgccgu

SEQ ID NO: 1931225 - RNA, 18 nt, Shigella flexneri 2a str. 2457T
gcgggggagucgcugguu

SEQ ID NO: 1931226 - RNA, 17 nt, Shigella flexneri 2a str. 2457T
gcgggcaucaucuuccg

SEQ ID NO: 1931227 - RNA, 21 nt, Shigella flexneri 2a str. 2457T
gcgggccauccaccagugacu

SEQ ID NO: 1931228 - RNA, 22 nt, Shigella flexneri 2a str. 2457T
gccugcuuccgguuguucaacc

SEQ ID NO: 1931229 - RNA, 14 nt, Shigella flexneri 2a str. 2457T
gccugcuucgucca

SEQ ID NO: 1931230 - RNA, 22 nt, Shigella flexneri 2a str. 2457T
gccugcuggcuagccucccugc

SEQ ID NO: 1931231 - RNA, 15 nt, Shigella flexneri 2a str. 2457T
gccuggaauuacuga

SEQ ID NO: 1931232 - RNA, 18 nt, Shigella flexneri 2a str. 2457T
gccuggcccauagacagg

SEQ ID NO: 1931233 - RNA, 16 nt, Shigella flexneri 2a str. 2457T
gccuggauggcuugcu

SEQ ID NO: 1931234 - RNA, 16 nt, Shigella flexneri 2a str. 2457T
gccugcuccucgguga

SEQ ID NO: 1931235 - RNA, 21 nt, Shigella flexneri 2a str. 2457T
gccugcuccagugcauccagc

SEQ ID NO: 1931236 - RNA, 16 nt, Shigella flexneri 2a str. 2457T
gccugcggcgcaugca

SEQ ID NO: 1931237 - RNA, 20 nt, Shigella flexneri 2a str. 2457T
gccugguuauagcaguaauu

SEQ ID NO: 1931238 - RNA, 22 nt, Shigella flexneri 2a str. 2457T
gccugguggucgaaaaucugcc

SEQ ID NO: 1931239 - RNA, 16 nt, Shigella flexneri 2a str. 2457T
gccugguaccagcacc

SEQ ID NO: 1931240 - RNA, 19 nt, Shigella flexneri 2a str. 2457T
gccugggcgauuuccuuca

SEQ ID NO: 1931241 - RNA, 15 nt, Shigella flexneri 2a str. 2457T
gccuggggagauguu

SEQ ID NO: 1931242 - RNA, 18 nt, Shigella flexneri 2a str. 2457T
gccuguacggcagugaac

SEQ ID NO: 1931243 - RNA, 19 nt, Shigella flexneri 2a str. 2457T
gccuguaccacaaccugca

SEQ ID NO: 1931244 - RNA, 20 nt, Shigella flexneri 2a str. 2457T
gccuguaccacaaccugcac

SEQ ID NO: 1931245 - RNA, 19 nt, Shigella flexneri 2a str. 2457T
gccuguccaccacgcugca

SEQ ID NO: 1931246 - RNA, 18 nt, Shigella flexneri 2a str. 2457T
gccuguuccagacgcugc

SEQ ID NO: 1931247 - RNA, 21 nt, Shigella flexneri 2a str. 2457T
gccuguuacauaugcgcuggc

SEQ ID NO: 1931248 - RNA, 16 nt, Shigella flexneri 2a str. 2457T
gccugugccugagccg

SEQ ID NO: 1931249 - RNA, 14 nt, Shigella flexneri 2a str. 2457T
gccugugcagcgac

SEQ ID NO: 1931250 - RNA, 16 nt, Shigella flexneri 2a str. 2457T
gccugugccacggcuu

SEQ ID NO: 1931251 - RNA, 13 nt, Shigella flexneri 2a str. 2457T
gccucuauuaaaa

SEQ ID NO: 1931252 - RNA, 16 nt, Shigella flexneri 2a str. 2457T
gccucugaaacgccag

SEQ ID NO: 1931253 - RNA, 16 nt, Shigella flexneri 2a str. 2457T
gccugaauauccagau

SEQ ID NO: 1931254 - RNA, 23 nt, Shigella flexneri 2a str. 2457T
gccugaaaguauuugacuguucu

SEQ ID NO: 1931255 - RNA, 17 nt, Shigella flexneri 2a str. 2457T
gccugaaauaaugcagc

SEQ ID NO: 1931256 - RNA, 14 nt, Shigella flexneri 2a str. 2457T
gccugaaggaccuu

SEQ ID NO: 1931257 - RNA, 14 nt, Shigella flexneri 2a str. 2457T
gccugaagguguuu

SEQ ID NO: 1931258 - RNA, 22 nt, Shigella flexneri 2a str. 2457T
gccucuuuuaaccucagcgaac

SEQ ID NO: 1931259 - RNA, 14 nt, Shigella flexneri 2a str. 2457T
gccucuuuauaaau

SEQ ID NO: 1931260 - RNA, 22 nt, Shigella flexneri 2a str. 2457T
gccugauacagccaaaucauca

SEQ ID NO: 1931261 - RNA, 15 nt, Shigella flexneri 2a str. 2457T
gccugacggacgcgc

SEQ ID NO: 1931262 - RNA, 20 nt, Shigella flexneri 2a str. 2457T
gccugacagcacgccccggc

SEQ ID NO: 1931263 - RNA, 13 nt, Shigella flexneri 2a str. 2457T
gccugaccgcaca

SEQ ID NO: 1931264 - RNA, 17 nt, Shigella flexneri 2a str. 2457T
gccugaccgcacacccc

SEQ ID NO: 1931265 - RNA, 20 nt, Shigella flexneri 2a str. 2457T
gccugaccgcacaccccggc

SEQ ID NO: 1931266 - RNA, 21 nt, Shigella flexneri 2a str. 2457T
gccugacagggaagggagcgc

SEQ ID NO: 1931267 - RNA, 16 nt, Shigella flexneri 2a str. 2457T
gccugaccauuaucaa

SEQ ID NO: 1931268 - RNA, 12 nt, Shigella flexneri 2a str. 2457T
gccugaugcgcu

SEQ ID NO: 1931269 - RNA, 19 nt, Shigella flexneri 2a str. 2457T
gccugaugcgacgcuggcg

SEQ ID NO: 1931270 - RNA, 24 nt, Shigella flexneri 2a str. 2457T
gccugaugcgacgcugcgcgucuu

SEQ ID NO: 1931271 - RNA, 21 nt, Shigella flexneri 2a str. 2457T
gccugauacaggaaggccgga

SEQ ID NO: 1931272 - RNA, 13 nt, Shigella flexneri 2a str. 2457T
gccugcaaauaaa

SEQ ID NO: 1931273 - RNA, 14 nt, Shigella flexneri 2a str. 2457T
gccugcaaauaaau

SEQ ID NO: 1931274 - RNA, 22 nt, Shigella flexneri 2a str. 2457T
gccugcgacgucucggcaugga

SEQ ID NO: 1931275 - RNA, 16 nt, Shigella flexneri 2a str. 2457T
gccugcgacgugggca

SEQ ID NO: 1931276 - RNA, 21 nt, Shigella flexneri 2a str. 2457T
gccugcgacagggaucucuuc

SEQ ID NO: 1931277 - RNA, 15 nt, Shigella flexneri 2a str. 2457T
gccugccugcagcug

SEQ ID NO: 1931278 - RNA, 14 nt, Shigella flexneri 2a str. 2457T
gccugccgccagca

SEQ ID NO: 1931279 - RNA, 21 nt, Shigella flexneri 2a str. 2457T
gccugcacggagauauccagc

SEQ ID NO: 1931280 - RNA, 15 nt, Shigella flexneri 2a str. 2457T
gccugcaccauugcu

SEQ ID NO: 1931281 - RNA, 19 nt, Shigella flexneri 2a str. 2457T
gccugcaccauugcugccg

SEQ ID NO: 1931282 - RNA, 12 nt, Shigella flexneri 2a str. 2457T
gccugcaucacc

SEQ ID NO: 1931283 - RNA, 17 nt, Shigella flexneri 2a str. 2457T
gccugcacugcaggccg

SEQ ID NO: 1931284 - RNA, 16 nt, Shigella flexneri 2a str. 2457T
gccugcaggaucagca

SEQ ID NO: 1931285 - RNA, 15 nt, Shigella flexneri 2a str. 2457T
gccugccagucaauc

SEQ ID NO: 1931286 - RNA, 18 nt, Shigella flexneri 2a str. 2457T
gccugccagucaaucauc

SEQ ID NO: 1931287 - RNA, 23 nt, Shigella flexneri 2a str. 2457T
gccugcccagccgguaaggccga

SEQ ID NO: 1931288 - RNA, 22 nt, Shigella flexneri 2a str. 2457T
gccugccauuggcaggcucugg

SEQ ID NO: 1931289 - RNA, 18 nt, Shigella flexneri 2a str. 2457T
gccuaacgacaaaucaua

SEQ ID NO: 1931290 - RNA, 14 nt, Shigella flexneri 2a str. 2457T
gccuaacaccauca

SEQ ID NO: 1931291 - RNA, 15 nt, Shigella flexneri 2a str. 2457T
gccuaacaccaucag

SEQ ID NO: 1931292 - RNA, 17 nt, Shigella flexneri 2a str. 2457T
gccuaagccauuuaacu

SEQ ID NO: 1931293 - RNA, 17 nt, Shigella flexneri 2a str. 2457T
gccuacaaaaucuauug

SEQ ID NO: 1931294 - RNA, 14 nt, Shigella flexneri 2a str. 2457T
gccuacaaaaugug

SEQ ID NO: 1931295 - RNA, 21 nt, Shigella flexneri 2a str. 2457T
gccuacacauuaucucaacac

SEQ ID NO: 1931296 - RNA, 20 nt, Shigella flexneri 2a str. 2457T
gccuacaaguccguugaaaa

SEQ ID NO: 1931297 - RNA, 12 nt, Shigella flexneri 2a str. 2457T
gccuacaggauu

SEQ ID NO: 1931298 - RNA, 14 nt, Shigella flexneri 2a str. 2457T
gccuacagaugauu

SEQ ID NO: 1931299 - RNA, 13 nt, Shigella flexneri 2a str. 2457T
gccuagaugcuca

SEQ ID NO: 1931300 - RNA, 15 nt, Shigella flexneri 2a str. 2457T
gccuacggcauucug

SEQ ID NO: 1931301 - RNA, 16 nt, Shigella flexneri 2a str. 2457T
gccucaaccauugaaa

SEQ ID NO: 1931302 - RNA, 19 nt, Shigella flexneri 2a str. 2457T
gccucaacccuuuuuuaaa

SEQ ID NO: 1931303 - RNA, 22 nt, Shigella flexneri 2a str. 2457T
gccucaacccuuuuuuaaacau

SEQ ID NO: 1931304 - RNA, 16 nt, Shigella flexneri 2a str. 2457T
gccuauggugaagcuu

SEQ ID NO: 1931305 - RNA, 14 nt, Shigella flexneri 2a str. 2457T
gccucaagcacccg

SEQ ID NO: 1931306 - RNA, 22 nt, Shigella flexneri 2a str. 2457T
gccucacagggcucuuaagcac

SEQ ID NO: 1931307 - RNA, 22 nt, Shigella flexneri 2a str. 2457T
gccgguaacgcuuucucaccau

SEQ ID NO: 1931308 - RNA, 17 nt, Shigella flexneri 2a str. 2457T
gccgguaaaucaccagc

SEQ ID NO: 1931309 - RNA, 13 nt, Shigella flexneri 2a str. 2457T
gccguucuucagc

SEQ ID NO: 1931310 - RNA, 23 nt, Shigella flexneri 2a str. 2457T
gccucaguggcugcguuucaugu

SEQ ID NO: 1931311 - RNA, 22 nt, Shigella flexneri 2a str. 2457T
gccuccuguucugugcgccaug

SEQ ID NO: 1931312 - RNA, 18 nt, Shigella flexneri 2a str. 2457T
gccuccucagaaaagagu

SEQ ID NO: 1931313 - RNA, 15 nt, Shigella flexneri 2a str. 2457T
gccucccauuuccug

SEQ ID NO: 1931314 - RNA, 15 nt, Shigella flexneri 2a str. 2457T
gccucgcaaauucca

SEQ ID NO: 1931315 - RNA, 21 nt, Shigella flexneri 2a str. 2457T
gccucuaacagaucauccauc

SEQ ID NO: 1931316 - RNA, 17 nt, Shigella flexneri 2a str. 2457T
gccucguucuucccucc

SEQ ID NO: 1931317 - RNA, 15 nt, Shigella flexneri 2a str. 2457T
gccgcuaacagcagc

SEQ ID NO: 1931318 - RNA, 13 nt, Shigella flexneri 2a str. 2457T
gccgcggucuggg

SEQ ID NO: 1931319 - RNA, 20 nt, Shigella flexneri 2a str. 2457T
gccgcgguaucaaacacagg

SEQ ID NO: 1931320 - RNA, 20 nt, Shigella flexneri 2a str. 2457T
gccgcggcucaggcgcacgc

SEQ ID NO: 1931321 - RNA, 23 nt, Shigella flexneri 2a str. 2457T
gccggaggcaaguuuccuccggc

SEQ ID NO: 1931322 - RNA, 20 nt, Shigella flexneri 2a str. 2457T
gccggaugacagacuccgcu

SEQ ID NO: 1931323 - RNA, 21 nt, Shigella flexneri 2a str. 2457T
gccggaugacacaucaccucc

SEQ ID NO: 1931324 - RNA, 17 nt, Shigella flexneri 2a str. 2457T
gccggaugacagacucc

SEQ ID NO: 1931325 - RNA, 22 nt, Shigella flexneri 2a str. 2457T
gccggcauauaccucagcagac

SEQ ID NO: 1931326 - RNA, 17 nt, Shigella flexneri 2a str. 2457T
gccggacccacaccccc

SEQ ID NO: 1931327 - RNA, 21 nt, Shigella flexneri 2a str. 2457T
gccgcuuuaugugcuucuacc

SEQ ID NO: 1931328 - RNA, 15 nt, Shigella flexneri 2a str. 2457T
gccgcuguaauacca

SEQ ID NO: 1931329 - RNA, 13 nt, Shigella flexneri 2a str. 2457T
gccgcuuuuucug

SEQ ID NO: 1931330 - RNA, 15 nt, Shigella flexneri 2a str. 2457T
gccgcuuuccaggca

SEQ ID NO: 1931331 - RNA, 16 nt, Shigella flexneri 2a str. 2457T
gccgcuuuccaggcau

SEQ ID NO: 1931332 - RNA, 14 nt, Shigella flexneri 2a str. 2457T
gccgggcgcaguuu

SEQ ID NO: 1931333 - RNA, 21 nt, Shigella flexneri 2a str. 2457T
gccggggagauauuccccaga

SEQ ID NO: 1931334 - RNA, 23 nt, Shigella flexneri 2a str. 2457T
gccggccccgucucccgaugcca

SEQ ID NO: 1931335 - RNA, 15 nt, Shigella flexneri 2a str. 2457T
gccgaucgucugggc

SEQ ID NO: 1931336 - RNA, 20 nt, Shigella flexneri 2a str. 2457T
gccgauaccaucacaccucg

SEQ ID NO: 1931337 - RNA, 21 nt, Shigella flexneri 2a str. 2457T
gccgcaccaggaucuuuuguc

SEQ ID NO: 1931338 - RNA, 21 nt, Shigella flexneri 2a str. 2457T
gccgcacauuucccggccacg

SEQ ID NO: 1931339 - RNA, 23 nt, Shigella flexneri 2a str. 2457T
gccgcagcggcgauuucuuuauc

SEQ ID NO: 1931340 - RNA, 15 nt, Shigella flexneri 2a str. 2457T
gccgcagccaucagc

SEQ ID NO: 1931341 - RNA, 16 nt, Shigella flexneri 2a str. 2457T
gccgcagccccagagc

SEQ ID NO: 1931342 - RNA, 13 nt, Shigella flexneri 2a str. 2457T
gccgcagcaaccg

SEQ ID NO: 1931343 - RNA, 16 nt, Shigella flexneri 2a str. 2457T
gccgcauccugcacca

SEQ ID NO: 1931344 - RNA, 20 nt, Shigella flexneri 2a str. 2457T
gccgcauccggcaaugguga

SEQ ID NO: 1931345 - RNA, 22 nt, Shigella flexneri 2a str. 2457T
gccgcauccggcaauucucucu

SEQ ID NO: 1931346 - RNA, 20 nt, Shigella flexneri 2a str. 2457T
gccgcauccggcagccgugc

SEQ ID NO: 1931347 - RNA, 13 nt, Shigella flexneri 2a str. 2457T
gccgcauccggca

SEQ ID NO: 1931348 - RNA, 16 nt, Shigella flexneri 2a str. 2457T
gccgcaguaaagcgca

SEQ ID NO: 1931349 - RNA, 18 nt, Shigella flexneri 2a str. 2457T
gccgcaggcuguuacccc

SEQ ID NO: 1931350 - RNA, 18 nt, Shigella flexneri 2a str. 2457T
gccgcauugguaaagccg

SEQ ID NO: 1931351 - RNA, 23 nt, Shigella flexneri 2a str. 2457T
gccgcauuuucagcaaccggagg

SEQ ID NO: 1931352 - RNA, 13 nt, Shigella flexneri 2a str. 2457T
gccgcaucuggca

SEQ ID NO: 1931353 - RNA, 19 nt, Shigella flexneri 2a str. 2457T
gccgcauggaaccaguuca

SEQ ID NO: 1931354 - RNA, 13 nt, Shigella flexneri 2a str. 2457T
gccgccagaaaug

SEQ ID NO: 1931355 - RNA, 20 nt, Shigella flexneri 2a str. 2457T
gccgccagacguccggcgcu

SEQ ID NO: 1931356 - RNA, 13 nt, Shigella flexneri 2a str. 2457T
gccgccgcaaccg

SEQ ID NO: 1931357 - RNA, 13 nt, Shigella flexneri 2a str. 2457T
gccgccucccuuc

SEQ ID NO: 1931358 - RNA, 20 nt, Shigella flexneri 2a str. 2457T
gccgccucccuucgcugcug

SEQ ID NO: 1931359 - RNA, 16 nt, Shigella flexneri 2a str. 2457T
gccgccguuagcuuca

SEQ ID NO: 1931360 - RNA, 16 nt, Shigella flexneri 2a str. 2457T
gccgcgacgcccccug

SEQ ID NO: 1931361 - RNA, 16 nt, Shigella flexneri 2a str. 2457T
gccgccccaggccagc

SEQ ID NO: 1931362 - RNA, 18 nt, Shigella flexneri 2a str. 2457T
gccgccaguacgcgcccg

SEQ ID NO: 1931363 - RNA, 19 nt, Shigella flexneri 2a str. 2457T
gccgccagcucuuuaaaca

SEQ ID NO: 1931364 - RNA, 21 nt, Shigella flexneri 2a str. 2457T
gccgccauccugaaucaccug

SEQ ID NO: 1931365 - RNA, 13 nt, Shigella flexneri 2a str. 2457T
gccgccaucaucg

SEQ ID NO: 1931366 - RNA, 23 nt, Shigella flexneri 2a str. 2457T
gccaccggcuuucgcuucaacca

SEQ ID NO: 1931367 - RNA, 15 nt, Shigella flexneri 2a str. 2457T
gccaccgcccagaga

SEQ ID NO: 1931368 - RNA, 13 nt, Shigella flexneri 2a str. 2457T
gccaccucuuuca

SEQ ID NO: 1931369 - RNA, 22 nt, Shigella flexneri 2a str. 2457T
gccaccuuucuguuccauaauc

SEQ ID NO: 1931370 - RNA, 19 nt, Shigella flexneri 2a str. 2457T
gccacgaaacugcuggcuu

SEQ ID NO: 1931371 - RNA, 23 nt, Shigella flexneri 2a str. 2457T
gccacgcacgccugcaucucuuc

SEQ ID NO: 1931372 - RNA, 13 nt, Shigella flexneri 2a str. 2457T
gccacgcaaacuu

SEQ ID NO: 1931373 - RNA, 19 nt, Shigella flexneri 2a str. 2457T
gccacgccacagccgagcg

SEQ ID NO: 1931374 - RNA, 18 nt, Shigella flexneri 2a str. 2457T
gccacauuagauaaaaau

SEQ ID NO: 1931375 - RNA, 13 nt, Shigella flexneri 2a str. 2457T
gccacauccggcu

SEQ ID NO: 1931376 - RNA, 15 nt, Shigella flexneri 2a str. 2457T
gccacauccggcuuu

SEQ ID NO: 1931377 - RNA, 21 nt, Shigella flexneri 2a str. 2457T
gccacauccgcgguaucgccg

SEQ ID NO: 1931378 - RNA, 18 nt, Shigella flexneri 2a str. 2457T
gccaccagcgucagaaac

SEQ ID NO: 1931379 - RNA, 13 nt, Shigella flexneri 2a str. 2457T
gccaccaggccac

SEQ ID NO: 1931380 - RNA, 16 nt, Shigella flexneri 2a str. 2457T
gcauagcgcaauaaca

SEQ ID NO: 1931381 - RNA, 12 nt, Shigella flexneri 2a str. 2457T
gcauagcuggcg

SEQ ID NO: 1931382 - RNA, 22 nt, Shigella flexneri 2a str. 2457T
gcauagcuaauccccuccagcg

SEQ ID NO: 1931383 - RNA, 13 nt, Shigella flexneri 2a str. 2457T
gcauaggcauuaa

SEQ ID NO: 1931384 - RNA, 17 nt, Shigella flexneri 2a str. 2457T
gcauaggcauuaaacau

SEQ ID NO: 1931385 - RNA, 23 nt, Shigella flexneri 2a str. 2457T
gcauaggcggcaaacaguuucug

SEQ ID NO: 1931386 - RNA, 13 nt, Shigella flexneri 2a str. 2457T
gcauaccuucaca

SEQ ID NO: 1931387 - RNA, 16 nt, Shigella flexneri 2a str. 2457T
gcauagccccagcgca

SEQ ID NO: 1931388 - RNA, 17 nt, Shigella flexneri 2a str. 2457T
gcauagcagcacaccac

SEQ ID NO: 1931389 - RNA, 19 nt, Shigella flexneri 2a str. 2457T
gcauacaacgccaugaaga

SEQ ID NO: 1931390 - RNA, 22 nt, Shigella flexneri 2a str. 2457T
gcauacccagaacuaucauacu

SEQ ID NO: 1931391 - RNA, 17 nt, Shigella flexneri 2a str. 2457T
gccagauaauggcuguu

SEQ ID NO: 1931392 - RNA, 13 nt, Shigella flexneri 2a str. 2457T
gccagauaagaca

SEQ ID NO: 1931393 - RNA, 15 nt, Shigella flexneri 2a str. 2457T
gccagauaagacacu

SEQ ID NO: 1931394 - RNA, 19 nt, Shigella flexneri 2a str. 2457T
gccagauacaucagcgaca

SEQ ID NO: 1931395 - RNA, 19 nt, Shigella flexneri 2a str. 2457T
gccagauaaauauuauugg

SEQ ID NO: 1931396 - RNA, 21 nt, Shigella flexneri 2a str. 2457T
gccagauaaauauuauuggca

SEQ ID NO: 1931397 - RNA, 17 nt, Shigella flexneri 2a str. 2457T
gccagaugccuugccaa

SEQ ID NO: 1931398 - RNA, 14 nt, Shigella flexneri 2a str. 2457T
gccagauggcaucc

SEQ ID NO: 1931399 - RNA, 16 nt, Shigella flexneri 2a str. 2457T
gccagauggcauccag

SEQ ID NO: 1931400 - RNA, 18 nt, Shigella flexneri 2a str. 2457T
gccagauguugucucaga

SEQ ID NO: 1931401 - RNA, 19 nt, Shigella flexneri 2a str. 2457T
gccagcaaaaucaccauca

SEQ ID NO: 1931402 - RNA, 14 nt, Shigella flexneri 2a str. 2457T
gccagaaucaccuc

SEQ ID NO: 1931403 - RNA, 14 nt, Shigella flexneri 2a str. 2457T
gccagaauagcgcc

SEQ ID NO: 1931404 - RNA, 21 nt, Shigella flexneri 2a str. 2457T
gccagaauagccgcagccauc

SEQ ID NO: 1931405 - RNA, 17 nt, Shigella flexneri 2a str. 2457T
gccacugcccgagaaca

SEQ ID NO: 1931406 - RNA, 21 nt, Shigella flexneri 2a str. 2457T
gccagaaccgcguagggcgga

SEQ ID NO: 1931407 - RNA, 19 nt, Shigella flexneri 2a str. 2457T
gccagaacagcuacagcau

SEQ ID NO: 1931408 - RNA, 21 nt, Shigella flexneri 2a str. 2457T
gccagaacagcuacagcauca

SEQ ID NO: 1931409 - RNA, 13 nt, Shigella flexneri 2a str. 2457T
gccagaaauccag

SEQ ID NO: 1931410 - RNA, 18 nt, Shigella flexneri 2a str. 2457T
gccagaaauggcccaaaa

SEQ ID NO: 1931411 - RNA, 17 nt, Shigella flexneri 2a str. 2457T
gccagaccaaacagcau

SEQ ID NO: 1931412 - RNA, 19 nt, Shigella flexneri 2a str. 2457T
gccagaccacugcgccgcu

SEQ ID NO: 1931413 - RNA, 20 nt, Shigella flexneri 2a str. 2457T
gccagaccacugcgccgcuc

SEQ ID NO: 1931414 - RNA, 17 nt, Shigella flexneri 2a str. 2457T
gccagaauuuucucacc

SEQ ID NO: 1931415 - RNA, 17 nt, Shigella flexneri 2a str. 2457T
gccagacaaaccacgcc

SEQ ID NO: 1931416 - RNA, 19 nt, Shigella flexneri 2a str. 2457T
gccagaccuccguuuuucu

SEQ ID NO: 1931417 - RNA, 22 nt, Shigella flexneri 2a str. 2457T
gccagaccuaccaucuccugca

SEQ ID NO: 1931418 - RNA, 17 nt, Shigella flexneri 2a str. 2457T
gccacucgauaccagau

SEQ ID NO: 1931419 - RNA, 20 nt, Shigella flexneri 2a str. 2457T
gccacucggacaccucacca

SEQ ID NO: 1931420 - RNA, 21 nt, Shigella flexneri 2a str. 2457T
gccacgguaucaagcccgccg

SEQ ID NO: 1931421 - RNA, 15 nt, Shigella flexneri 2a str. 2457T
gccacgguaaaaccg

SEQ ID NO: 1931422 - RNA, 13 nt, Shigella flexneri 2a str. 2457T
gccacgguaaaac

SEQ ID NO: 1931423 - RNA, 13 nt, Shigella flexneri 2a str. 2457T
gccacgucaucag

SEQ ID NO: 1931424 - RNA, 19 nt, Shigella flexneri 2a str. 2457T
gccacguacauuaaacgcc

SEQ ID NO: 1931425 - RNA, 13 nt, Shigella flexneri 2a str. 2457T
gccacgcgucguc

SEQ ID NO: 1931426 - RNA, 15 nt, Shigella flexneri 2a str. 2457T
gccacgcuucaaucu

SEQ ID NO: 1931427 - RNA, 20 nt, Shigella flexneri 2a str. 2457T
gccacgcugccgcgcaggga

SEQ ID NO: 1931428 - RNA, 23 nt, Shigella flexneri 2a str. 2457T
gccacggauauauccguggcuuu

SEQ ID NO: 1931429 - RNA, 17 nt, Shigella flexneri 2a str. 2457T
gccacggcaugaaagcg

SEQ ID NO: 1931430 - RNA, 14 nt, Shigella flexneri 2a str. 2457T
gccacggcgcagcu

SEQ ID NO: 1931431 - RNA, 13 nt, Shigella flexneri 2a str. 2457T
gccauccgcguga

SEQ ID NO: 1931432 - RNA, 21 nt, Shigella flexneri 2a str. 2457T
gccauccgcgugacgcuggca

SEQ ID NO: 1931433 - RNA, 15 nt, Shigella flexneri 2a str. 2457T
gccauccgcugcggu

SEQ ID NO: 1931434 - RNA, 16 nt, Shigella flexneri 2a str. 2457T
gccaucgccagcagcc

SEQ ID NO: 1931435 - RNA, 23 nt, Shigella flexneri 2a str. 2457T
gccaucgggaugccauuugccag

SEQ ID NO: 1931436 - RNA, 18 nt, Shigella flexneri 2a str. 2457T
gccaugcccgugcugaca

SEQ ID NO: 1931437 - RNA, 12 nt, Shigella flexneri 2a str. 2457T
gccaugcauauc

SEQ ID NO: 1931438 - RNA, 16 nt, Shigella flexneri 2a str. 2457T
gccaugcacgcaagaa

SEQ ID NO: 1931439 - RNA, 19 nt, Shigella flexneri 2a str. 2457T
gccauaccaugcaccaacc

SEQ ID NO: 1931440 - RNA, 16 nt, Shigella flexneri 2a str. 2457T
gccauaauaaucauca

SEQ ID NO: 1931441 - RNA, 22 nt, Shigella flexneri 2a str. 2457T
gccauaacggcuguccauacgu

SEQ ID NO: 1931442 - RNA, 17 nt, Shigella flexneri 2a str. 2457T
gccauaaauguugccgu

SEQ ID NO: 1931443 - RNA, 18 nt, Shigella flexneri 2a str. 2457T
gccaucccuaccgcccgc

SEQ ID NO: 1931444 - RNA, 14 nt, Shigella flexneri 2a str. 2457T
gccauccagcagac

SEQ ID NO: 1931445 - RNA, 18 nt, Shigella flexneri 2a str. 2457T
gccauccaucaacgccag

SEQ ID NO: 1931446 - RNA, 13 nt, Shigella flexneri 2a str. 2457T
gccauauaaauuu

SEQ ID NO: 1931447 - RNA, 19 nt, Shigella flexneri 2a str. 2457T
gccauauuguuucaacaca

SEQ ID NO: 1931448 - RNA, 20 nt, Shigella flexneri 2a str. 2457T
gccauauuguuucaacacag

SEQ ID NO: 1931449 - RNA, 17 nt, Shigella flexneri 2a str. 2457T
gccauauuuaaagaaga

SEQ ID NO: 1931450 - RNA, 18 nt, Shigella flexneri 2a str. 2457T
gccauauuuaaagaagag

SEQ ID NO: 1931451 - RNA, 20 nt, Shigella flexneri 2a str. 2457T
gccagucgcacacaacagac

SEQ ID NO: 1931452 - RNA, 15 nt, Shigella flexneri 2a str. 2457T
gccaguaccagcagc

SEQ ID NO: 1931453 - RNA, 14 nt, Shigella flexneri 2a str. 2457T
gccaguaccagcag

SEQ ID NO: 1931454 - RNA, 20 nt, Shigella flexneri 2a str. 2457T
gccaguaaucggcugaacgu

SEQ ID NO: 1931455 - RNA, 16 nt, Shigella flexneri 2a str. 2457T
gccaguaaucuggcca

SEQ ID NO: 1931456 - RNA, 19 nt, Shigella flexneri 2a str. 2457T
gccaguaaucuggccaaug

SEQ ID NO: 1931457 - RNA, 20 nt, Shigella flexneri 2a str. 2457T
gccaguaaucuggccaaugc

SEQ ID NO: 1931458 - RNA, 15 nt, Shigella flexneri 2a str. 2457T
gccaguaaucuucaa

SEQ ID NO: 1931459 - RNA, 15 nt, Shigella flexneri 2a str. 2457T
gccagugccgguggc

SEQ ID NO: 1931460 - RNA, 15 nt, Shigella flexneri 2a str. 2457T
gccagugccaaagcc

SEQ ID NO: 1931461 - RNA, 16 nt, Shigella flexneri 2a str. 2457T
gccagugccaaagcca

SEQ ID NO: 1931462 - RNA, 17 nt, Shigella flexneri 2a str. 2457T
gccagugccacacgcuc

SEQ ID NO: 1931463 - RNA, 13 nt, Shigella flexneri 2a str. 2457T
gccaguugcggcu

SEQ ID NO: 1931464 - RNA, 22 nt, Shigella flexneri 2a str. 2457T
gccaguuuacugucugcuucug

SEQ ID NO: 1931465 - RNA, 22 nt, Shigella flexneri 2a str. 2457T
gccaguuuuucagcgccagcgc

SEQ ID NO: 1931466 - RNA, 17 nt, Shigella flexneri 2a str. 2457T
gccaguuugcgcgugcu

SEQ ID NO: 1931467 - RNA, 14 nt, Shigella flexneri 2a str. 2457T
gccauaaacagcag

SEQ ID NO: 1931468 - RNA, 23 nt, Shigella flexneri 2a str. 2457T
gccaguuuggucuggcaaaaaua

SEQ ID NO: 1931469 - RNA, 22 nt, Shigella flexneri 2a str. 2457T
gccaguuuggucuggcaaaaau

SEQ ID NO: 1931470 - RNA, 12 nt, Shigella flexneri 2a str. 2457T
gccaguuccccc

SEQ ID NO: 1931471 - RNA, 13 nt, Shigella flexneri 2a str. 2457T
gccaguucuucca

SEQ ID NO: 1931472 - RNA, 22 nt, Shigella flexneri 2a str. 2457T
gccaguguuaaccagauaagcc

SEQ ID NO: 1931473 - RNA, 14 nt, Shigella flexneri 2a str. 2457T
gccaguucucacca

SEQ ID NO: 1931474 - RNA, 21 nt, Shigella flexneri 2a str. 2457T
gccaguucauuugaacuggcu

SEQ ID NO: 1931475 - RNA, 12 nt, Shigella flexneri 2a str. 2457T
gccaguuauugg

SEQ ID NO: 1931476 - RNA, 13 nt, Shigella flexneri 2a str. 2457T
gccaguucaaagu

SEQ ID NO: 1931477 - RNA, 21 nt, Shigella flexneri 2a str. 2457T
gccagcuugcgauccugcaga

SEQ ID NO: 1931478 - RNA, 17 nt, Shigella flexneri 2a str. 2457T
gccagcuuucaccugcg

SEQ ID NO: 1931479 - RNA, 16 nt, Shigella flexneri 2a str. 2457T
gccaggcaucgaugga

SEQ ID NO: 1931480 - RNA, 23 nt, Shigella flexneri 2a str. 2457T
gccaggaaccaccgaugcacagc

SEQ ID NO: 1931481 - RNA, 17 nt, Shigella flexneri 2a str. 2457T
gccaggacgcaguccag

SEQ ID NO: 1931482 - RNA, 16 nt, Shigella flexneri 2a str. 2457T
gccaggucagagagcc

SEQ ID NO: 1931483 - RNA, 23 nt, Shigella flexneri 2a str. 2457T
gccaggguuucggcuuuuuccug

SEQ ID NO: 1931484 - RNA, 21 nt, Shigella flexneri 2a str. 2457T
gccaguaaauuuaucaaugca

SEQ ID NO: 1931485 - RNA, 21 nt, Shigella flexneri 2a str. 2457T
gccaggcuuuccgucagcggc

SEQ ID NO: 1931486 - RNA, 23 nt, Shigella flexneri 2a str. 2457T
gccagcgcgccuucauucaggcc

SEQ ID NO: 1931487 - RNA, 14 nt, Shigella flexneri 2a str. 2457T
gccagcgcaccagc

SEQ ID NO: 1931488 - RNA, 12 nt, Shigella flexneri 2a str. 2457T
gccagcggcggc

SEQ ID NO: 1931489 - RNA, 15 nt, Shigella flexneri 2a str. 2457T
gccagcagagcaaaa

SEQ ID NO: 1931490 - RNA, 18 nt, Shigella flexneri 2a str. 2457T
gccagcagagggauaucu

SEQ ID NO: 1931491 - RNA, 20 nt, Shigella flexneri 2a str. 2457T
gccagcagggcaaacagcac

SEQ ID NO: 1931492 - RNA, 17 nt, Shigella flexneri 2a str. 2457T
gccagcagggcaaacag

SEQ ID NO: 1931493 - RNA, 10 nt, Shigella flexneri 2a str. 2457T
gccagccuca

SEQ ID NO: 1931494 - RNA, 22 nt, Shigella flexneri 2a str. 2457T
gcccccugaagcaguuucacca

SEQ ID NO: 1931495 - RNA, 21 nt, Shigella flexneri 2a str. 2457T
gcccccucacaugaguugcug

SEQ ID NO: 1931496 - RNA, 15 nt, Shigella flexneri 2a str. 2457T
gcccccgggccuccc

SEQ ID NO: 1931497 - RNA, 15 nt, Shigella flexneri 2a str. 2457T
gccccgagaaaaaua

SEQ ID NO: 1931498 - RNA, 13 nt, Shigella flexneri 2a str. 2457T
gccccaguaccug

SEQ ID NO: 1931499 - RNA, 12 nt, Shigella flexneri 2a str. 2457T
gccccaguuccg

SEQ ID NO: 1931500 - RNA, 22 nt, Shigella flexneri 2a str. 2457T
gccccaucaacgccaucgccag

SEQ ID NO: 1931501 - RNA, 19 nt, Shigella flexneri 2a str. 2457T
gccccaggccagcagcaga

SEQ ID NO: 1931502 - RNA, 16 nt, Shigella flexneri 2a str. 2457T
gccccagauugccgau

SEQ ID NO: 1931503 - RNA, 16 nt, Shigella flexneri 2a str. 2457T
gccccacagacccagg

SEQ ID NO: 1931504 - RNA, 13 nt, Shigella flexneri 2a str. 2457T
gccccagacacag

SEQ ID NO: 1931505 - RNA, 16 nt, Shigella flexneri 2a str. 2457T
gccccagaauucacgc

SEQ ID NO: 1931506 - RNA, 17 nt, Shigella flexneri 2a str. 2457T
gccccagaauucacgca

SEQ ID NO: 1931507 - RNA, 21 nt, Shigella flexneri 2a str. 2457T
gccccaaccgaacccagcagg

SEQ ID NO: 1931508 - RNA, 13 nt, Shigella flexneri 2a str. 2457T
gcccauuuugcca

SEQ ID NO: 1931509 - RNA, 14 nt, Shigella flexneri 2a str. 2457T
gcccauuuugccac

SEQ ID NO: 1931510 - RNA, 19 nt, Shigella flexneri 2a str. 2457T
gcccauuauugacagaccg

SEQ ID NO: 1931511 - RNA, 17 nt, Shigella flexneri 2a str. 2457T
gcccauuauugacagac

SEQ ID NO: 1931512 - RNA, 17 nt, Shigella flexneri 2a str. 2457T
gcccaugauagugucca

SEQ ID NO: 1931513 - RNA, 22 nt, Shigella flexneri 2a str. 2457T
gcccagccgaagggaaagagcg

SEQ ID NO: 1931514 - RNA, 20 nt, Shigella flexneri 2a str. 2457T
gcccagcgacugcgggcgca

SEQ ID NO: 1931515 - RNA, 22 nt, Shigella flexneri 2a str. 2457T
gcccagcgcguaaauaucggca

SEQ ID NO: 1931516 - RNA, 22 nt, Shigella flexneri 2a str. 2457T
gcccagcguuccggcguccacc

SEQ ID NO: 1931517 - RNA, 17 nt, Shigella flexneri 2a str. 2457T
gcccacuuucugcgcaa

SEQ ID NO: 1931518 - RNA, 13 nt, Shigella flexneri 2a str. 2457T
gcccacuccagcu

SEQ ID NO: 1931519 - RNA, 22 nt, Shigella flexneri 2a str. 2457T
gccaugcguuuuaccgccucgc

SEQ ID NO: 1931520 - RNA, 15 nt, Shigella flexneri 2a str. 2457T
gcccagucacggcuu

SEQ ID NO: 1931521 - RNA, 19 nt, Shigella flexneri 2a str. 2457T
gcccagugccgagaguaac

SEQ ID NO: 1931522 - RNA, 14 nt, Shigella flexneri 2a str. 2457T
gcccagugccagca

SEQ ID NO: 1931523 - RNA, 15 nt, Shigella flexneri 2a str. 2457T
gcccagugccagcac

SEQ ID NO: 1931524 - RNA, 16 nt, Shigella flexneri 2a str. 2457T
gcccagugaccaaagg

SEQ ID NO: 1931525 - RNA, 17 nt, Shigella flexneri 2a str. 2457T
gcccagugaccaaaggc

SEQ ID NO: 1931526 - RNA, 15 nt, Shigella flexneri 2a str. 2457T
gcccaguucagcggc

SEQ ID NO: 1931527 - RNA, 21 nt, Shigella flexneri 2a str. 2457T
gcccagguuauacaccuguuc

SEQ ID NO: 1931528 - RNA, 21 nt, Shigella flexneri 2a str. 2457T
gcccaggugugucucaagucg

SEQ ID NO: 1931529 - RNA, 20 nt, Shigella flexneri 2a str. 2457T
gcccaggcgaccaggccggu

SEQ ID NO: 1931530 - RNA, 15 nt, Shigella flexneri 2a str. 2457T
gcccauccaggguuu

SEQ ID NO: 1931531 - RNA, 18 nt, Shigella flexneri 2a str. 2457T
gcccaucaugcgccaggu

SEQ ID NO: 1931532 - RNA, 15 nt, Shigella flexneri 2a str. 2457T
gcccaucaucuggcu

SEQ ID NO: 1931533 - RNA, 15 nt, Shigella flexneri 2a str. 2457T
gcccaucauccgcgc

SEQ ID NO: 1931534 - RNA, 19 nt, Shigella flexneri 2a str. 2457T
gcccaucagcaucccaccu

SEQ ID NO: 1931535 - RNA, 19 nt, Shigella flexneri 2a str. 2457T
gcccagugagucggggcca

SEQ ID NO: 1931536 - RNA, 14 nt, Shigella flexneri 2a str. 2457T
gcccauaccacagc

SEQ ID NO: 1931537 - RNA, 14 nt, Shigella flexneri 2a str. 2457T
gcccugcuaugcaa

SEQ ID NO: 1931538 - RNA, 19 nt, Shigella flexneri 2a str. 2457T
gcccugcuccagcaacuca

SEQ ID NO: 1931539 - RNA, 17 nt, Shigella flexneri 2a str. 2457T
gcccuggcucguggcug

SEQ ID NO: 1931540 - RNA, 13 nt, Shigella flexneri 2a str. 2457T
gcccucucaaccg

SEQ ID NO: 1931541 - RNA, 15 nt, Shigella flexneri 2a str. 2457T
gcccguugccaggac

SEQ ID NO: 1931542 - RNA, 21 nt, Shigella flexneri 2a str. 2457T
gcccguuuucaccuuacuucc

SEQ ID NO: 1931543 - RNA, 19 nt, Shigella flexneri 2a str. 2457T
gcccguuuucuccagcgcc

SEQ ID NO: 1931544 - RNA, 19 nt, Shigella flexneri 2a str. 2457T
gcccguuaaccgcucugcg

SEQ ID NO: 1931545 - RNA, 22 nt, Shigella flexneri 2a str. 2457T
gcccuccugauaacacagaggc

SEQ ID NO: 1931546 - RNA, 15 nt, Shigella flexneri 2a str. 2457T
gcccgcugccgcaga

SEQ ID NO: 1931547 - RNA, 13 nt, Shigella flexneri 2a str. 2457T
gcccgccgccauc

SEQ ID NO: 1931548 - RNA, 13 nt, Shigella flexneri 2a str. 2457T
gcccgccagcacc

SEQ ID NO: 1931549 - RNA, 18 nt, Shigella flexneri 2a str. 2457T
gcccgccagcaccggagg

SEQ ID NO: 1931550 - RNA, 23 nt, Shigella flexneri 2a str. 2457T
gcccgcgauaaaaauccuguucc

SEQ ID NO: 1931551 - RNA, 18 nt, Shigella flexneri 2a str. 2457T
gcccgacgauaccgccgc

SEQ ID NO: 1931552 - RNA, 21 nt, Shigella flexneri 2a str. 2457T
gcccgacgauaccgccgcaca

SEQ ID NO: 1931553 - RNA, 12 nt, Shigella flexneri 2a str. 2457T
gcccgagcgcca

SEQ ID NO: 1931554 - RNA, 16 nt, Shigella flexneri 2a str. 2457T
gcccgcauagagaaaa

SEQ ID NO: 1931555 - RNA, 23 nt, Shigella flexneri 2a str. 2457T
gccccgcuucccgauaagggagc

SEQ ID NO: 1931556 - RNA, 18 nt, Shigella flexneri 2a str. 2457T
gccccgccuaaagaagcc

SEQ ID NO: 1931557 - RNA, 22 nt, Shigella flexneri 2a str. 2457T
gccccgccuaaagaagccgcca

SEQ ID NO: 1931558 - RNA, 21 nt, Shigella flexneri 2a str. 2457T
gccccgcgcggcgcaggcgcu

SEQ ID NO: 1931559 - RNA, 20 nt, Shigella flexneri 2a str. 2457T
gccccgcgcggcgcaggcgc

SEQ ID NO: 1931560 - RNA, 19 nt, Shigella flexneri 2a str. 2457T
gccccggcugcgcgacggc

SEQ ID NO: 1931561 - RNA, 20 nt, Shigella flexneri 2a str. 2457T
gccccuggucauaggccgcu

SEQ ID NO: 1931562 - RNA, 18 nt, Shigella flexneri 2a str. 2457T
gccccugguuaucuucca

SEQ ID NO: 1931563 - RNA, 16 nt, Shigella flexneri 2a str. 2457T
gccccugcgccagcgc

SEQ ID NO: 1931564 - RNA, 21 nt, Shigella flexneri 2a str. 2457T
gccccuggaaaaagugcccca

SEQ ID NO: 1931565 - RNA, 21 nt, Shigella flexneri 2a str. 2457T
gcccgacgaggcgcuggcgca

SEQ ID NO: 1931566 - RNA, 16 nt, Shigella flexneri 2a str. 2457T
gcccgacaaagcauga

SEQ ID NO: 1931567 - RNA, 21 nt, Shigella flexneri 2a str. 2457T
gcaaccgcauccagauucuca

SEQ ID NO: 1931568 - RNA, 14 nt, Shigella flexneri 2a str. 2457T
gcaaccgagcgccc

SEQ ID NO: 1931569 - RNA, 17 nt, Shigella flexneri 2a str. 2457T
gcaaccgguaaagaaga

SEQ ID NO: 1931570 - RNA, 19 nt, Shigella flexneri 2a str. 2457T
gcaaccgguaaagaagagc

SEQ ID NO: 1931571 - RNA, 14 nt, Shigella flexneri 2a str. 2457T
gcaaccggcgcggc

SEQ ID NO: 1931572 - RNA, 14 nt, Shigella flexneri 2a str. 2457T
gcaacccgccaggu

SEQ ID NO: 1931573 - RNA, 17 nt, Shigella flexneri 2a str. 2457T
gcaacccagaagaaagc

SEQ ID NO: 1931574 - RNA, 22 nt, Shigella flexneri 2a str. 2457T
gcaacgagacgguuaaaaacag

SEQ ID NO: 1931575 - RNA, 21 nt, Shigella flexneri 2a str. 2457T
gcaacgacaccguuaaauaac

SEQ ID NO: 1931576 - RNA, 19 nt, Shigella flexneri 2a str. 2457T
gcaacgaacuaaccgcgcu

SEQ ID NO: 1931577 - RNA, 20 nt, Shigella flexneri 2a str. 2457T
gcaacgccccuucugccgca

SEQ ID NO: 1931578 - RNA, 22 nt, Shigella flexneri 2a str. 2457T
gcaacgccuuugucgggcaggc

SEQ ID NO: 1931579 - RNA, 17 nt, Shigella flexneri 2a str. 2457T
gcaacgccguaagcgcg

SEQ ID NO: 1931580 - RNA, 16 nt, Shigella flexneri 2a str. 2457T
gcaacgccuaaacuaa

SEQ ID NO: 1931581 - RNA, 12 nt, Shigella flexneri 2a str. 2457T
gcaacaggccag

SEQ ID NO: 1931582 - RNA, 16 nt, Shigella flexneri 2a str. 2457T
gcaacaugcuggccuu

SEQ ID NO: 1931583 - RNA, 19 nt, Shigella flexneri 2a str. 2457T
gcaacaugaaacagaaaau

SEQ ID NO: 1931584 - RNA, 15 nt, Shigella flexneri 2a str. 2457T
gcaacauacugcccg

SEQ ID NO: 1931585 - RNA, 22 nt, Shigella flexneri 2a str. 2457T
gcaaccaacgccagcagcagcg

SEQ ID NO: 1931586 - RNA, 14 nt, Shigella flexneri 2a str. 2457T
gcaaccacaacgca

SEQ ID NO: 1931587 - RNA, 18 nt, Shigella flexneri 2a str. 2457T
gcaaccacaaaacacucu

SEQ ID NO: 1931588 - RNA, 13 nt, Shigella flexneri 2a str. 2457T
gcaaccagcaccg

SEQ ID NO: 1931589 - RNA, 15 nt, Shigella flexneri 2a str. 2457T
gcaaccagcggcugc

SEQ ID NO: 1931590 - RNA, 22 nt, Shigella flexneri 2a str. 2457T
gcaacauugcgccucaccggau

SEQ ID NO: 1931591 - RNA, 20 nt, Shigella flexneri 2a str. 2457T
gcaacauggauucgaugauc

SEQ ID NO: 1931592 - RNA, 18 nt, Shigella flexneri 2a str. 2457T
gcaacauguugaaucuuc

SEQ ID NO: 1931593 - RNA, 17 nt, Shigella flexneri 2a str. 2457T
gcaacagaacgcgccuu

SEQ ID NO: 1931594 - RNA, 18 nt, Shigella flexneri 2a str. 2457T
gcaacagaauuacuggca

SEQ ID NO: 1931595 - RNA, 22 nt, Shigella flexneri 2a str. 2457T
gcaacaaugcucucuucgccaa

SEQ ID NO: 1931596 - RNA, 17 nt, Shigella flexneri 2a str. 2457T
gcaacaaucgggaaaau

SEQ ID NO: 1931597 - RNA, 16 nt, Shigella flexneri 2a str. 2457T
gcaacaacugaaaaaa

SEQ ID NO: 1931598 - RNA, 12 nt, Shigella flexneri 2a str. 2457T
gcaacaacagcg

SEQ ID NO: 1931599 - RNA, 20 nt, Shigella flexneri 2a str. 2457T
gcaaaaccuaggucauuaaa

SEQ ID NO: 1931600 - RNA, 14 nt, Shigella flexneri 2a str. 2457T
gcaaaaccugguug

SEQ ID NO: 1931601 - RNA, 14 nt, Shigella flexneri 2a str. 2457T
gcaauaccaucacc

SEQ ID NO: 1931602 - RNA, 17 nt, Shigella flexneri 2a str. 2457T
gcaaucauucccagacc

SEQ ID NO: 1931603 - RNA, 16 nt, Shigella flexneri 2a str. 2457T
gcaaucaucguacugu

SEQ ID NO: 1931604 - RNA, 22 nt, Shigella flexneri 2a str. 2457T
gcaaucaucuuguaggccugau

SEQ ID NO: 1931605 - RNA, 12 nt, Shigella flexneri 2a str. 2457T
gcaaucaguggc

SEQ ID NO: 1931606 - RNA, 21 nt, Shigella flexneri 2a str. 2457T
gcaaucagauaaaauacacuu

SEQ ID NO: 1931607 - RNA, 20 nt, Shigella flexneri 2a str. 2457T
gcaaucacugccagaauagc

SEQ ID NO: 1931608 - RNA, 20 nt, Shigella flexneri 2a str. 2457T
gcaaucggugcaaaugccag

SEQ ID NO: 1931609 - RNA, 13 nt, Shigella flexneri 2a str. 2457T
gcaaucgccucca

SEQ ID NO: 1931610 - RNA, 16 nt, Shigella flexneri 2a str. 2457T
gcaaucgcauagccag

SEQ ID NO: 1931611 - RNA, 20 nt, Shigella flexneri 2a str. 2457T
gcaaucgagcccagaugccg

SEQ ID NO: 1931612 - RNA, 22 nt, Shigella flexneri 2a str. 2457T
gcaauccgccgucgggucagcu

SEQ ID NO: 1931613 - RNA, 14 nt, Shigella flexneri 2a str. 2457T
gcaauccaguccac

SEQ ID NO: 1931614 - RNA, 16 nt, Shigella flexneri 2a str. 2457T
gcaagggccgcagcuu

SEQ ID NO: 1931615 - RNA, 20 nt, Shigella flexneri 2a str. 2457T
gcaaggcuuucacgucagga

SEQ ID NO: 1931616 - RNA, 19 nt, Shigella flexneri 2a str. 2457T
gcaaggcuauucagcaguu

SEQ ID NO: 1931617 - RNA, 21 nt, Shigella flexneri 2a str. 2457T
gcaaggcgagcgcggcuggcu

SEQ ID NO: 1931618 - RNA, 14 nt, Shigella flexneri 2a str. 2457T
gcaaggccauccgc

SEQ ID NO: 1931619 - RNA, 13 nt, Shigella flexneri 2a str. 2457T
gcaaggcgcgggu

SEQ ID NO: 1931620 - RNA, 19 nt, Shigella flexneri 2a str. 2457T
gcaauaaaauaucuuccac

SEQ ID NO: 1931621 - RNA, 20 nt, Shigella flexneri 2a str. 2457T
gcaauaaacaagauaacaga

SEQ ID NO: 1931622 - RNA, 14 nt, Shigella flexneri 2a str. 2457T
gcaauaaaacaggg

SEQ ID NO: 1931623 - RNA, 22 nt, Shigella flexneri 2a str. 2457T
gcaauaacucuuugaugaaaca

SEQ ID NO: 1931624 - RNA, 15 nt, Shigella flexneri 2a str. 2457T
gcaauaaucucuaca

SEQ ID NO: 1931625 - RNA, 20 nt, Shigella flexneri 2a str. 2457T
gcaauaauccccgccaggau

SEQ ID NO: 1931626 - RNA, 12 nt, Shigella flexneri 2a str. 2457T
gcaacugauuua

SEQ ID NO: 1931627 - RNA, 16 nt, Shigella flexneri 2a str. 2457T
gcaacuggagcaggaa

SEQ ID NO: 1931628 - RNA, 13 nt, Shigella flexneri 2a str. 2457T
gcaacugcggcgc

SEQ ID NO: 1931629 - RNA, 19 nt, Shigella flexneri 2a str. 2457T
gcaacugacugacuucaac

SEQ ID NO: 1931630 - RNA, 16 nt, Shigella flexneri 2a str. 2457T
gcaacucgaugcugcc

SEQ ID NO: 1931631 - RNA, 15 nt, Shigella flexneri 2a str. 2457T
gcaacucgacuggag

SEQ ID NO: 1931632 - RNA, 14 nt, Shigella flexneri 2a str. 2457T
gcaacuaccagcag

SEQ ID NO: 1931633 - RNA, 14 nt, Shigella flexneri 2a str. 2457T
gcaacguuccagca

SEQ ID NO: 1931634 - RNA, 15 nt, Shigella flexneri 2a str. 2457T
gcaacuaccagcagu

SEQ ID NO: 1931635 - RNA, 13 nt, Shigella flexneri 2a str. 2457T
gcaacuccagcuu

SEQ ID NO: 1931636 - RNA, 15 nt, Shigella flexneri 2a str. 2457T
gcaacgucaguaacc

SEQ ID NO: 1931637 - RNA, 14 nt, Shigella flexneri 2a str. 2457T
gcaacggugcggcu

SEQ ID NO: 1931638 - RNA, 22 nt, Shigella flexneri 2a str. 2457T
gcaacguuaccguaaccauaac

SEQ ID NO: 1931639 - RNA, 13 nt, Shigella flexneri 2a str. 2457T
gcaacguuccagc

SEQ ID NO: 1931640 - RNA, 15 nt, Shigella flexneri 2a str. 2457T
gcaagaccgcgacca

SEQ ID NO: 1931641 - RNA, 17 nt, Shigella flexneri 2a str. 2457T
gcaagacgaaaaaugaa

SEQ ID NO: 1931642 - RNA, 21 nt, Shigella flexneri 2a str. 2457T
gcaagacgaugacauuaucug

SEQ ID NO: 1931643 - RNA, 14 nt, Shigella flexneri 2a str. 2457T
gcaagagcaaauaa

SEQ ID NO: 1931644 - RNA, 17 nt, Shigella flexneri 2a str. 2457T
gcaaggaaagccacugu

SEQ ID NO: 1931645 - RNA, 13 nt, Shigella flexneri 2a str. 2457T
gcaaggaaauaau

SEQ ID NO: 1931646 - RNA, 21 nt, Shigella flexneri 2a str. 2457T
gcaagaggguuauuuguucag

SEQ ID NO: 1931647 - RNA, 18 nt, Shigella flexneri 2a str. 2457T
gcacaucgcugugcugcu

SEQ ID NO: 1931648 - RNA, 20 nt, Shigella flexneri 2a str. 2457T
gcacaucgacggugacacuu

SEQ ID NO: 1931649 - RNA, 18 nt, Shigella flexneri 2a str. 2457T
gcaccaaucaccgccagc

SEQ ID NO: 1931650 - RNA, 17 nt, Shigella flexneri 2a str. 2457T
gcaccaccaaaaacgcc

SEQ ID NO: 1931651 - RNA, 15 nt, Shigella flexneri 2a str. 2457T
gcaccaguucacccu

SEQ ID NO: 1931652 - RNA, 24 nt, Shigella flexneri 2a str. 2457T
gcaccaguggucuuuagacugcca

SEQ ID NO: 1931653 - RNA, 21 nt, Shigella flexneri 2a str. 2457T
gcaccaguucgccguacugac

SEQ ID NO: 1931654 - RNA, 19 nt, Shigella flexneri 2a str. 2457T
gcaccagccccuggaaaaa

SEQ ID NO: 1931655 - RNA, 23 nt, Shigella flexneri 2a str. 2457T
gcaccaugucccggaacaggcag

SEQ ID NO: 1931656 - RNA, 17 nt, Shigella flexneri 2a str. 2457T
gcaccauugcugccgcc

SEQ ID NO: 1931657 - RNA, 17 nt, Shigella flexneri 2a str. 2457T
gcaccauuuaaaucaau

SEQ ID NO: 1931658 - RNA, 17 nt, Shigella flexneri 2a str. 2457T
gcaccaucccuaugcau

SEQ ID NO: 1931659 - RNA, 20 nt, Shigella flexneri 2a str. 2457T
gcacaccccgcgcagcugag

SEQ ID NO: 1931660 - RNA, 16 nt, Shigella flexneri 2a str. 2457T
gcacaaauagccagca

SEQ ID NO: 1931661 - RNA, 12 nt, Shigella flexneri 2a str. 2457T
gcacaacaggcu

SEQ ID NO: 1931662 - RNA, 18 nt, Shigella flexneri 2a str. 2457T
gcaaucguagcccagcuc

SEQ ID NO: 1931663 - RNA, 18 nt, Shigella flexneri 2a str. 2457T
gcaaugaguggugaaaaa

SEQ ID NO: 1931664 - RNA, 23 nt, Shigella flexneri 2a str. 2457T
gcaaugagagggcgauaaaucuc

SEQ ID NO: 1931665 - RNA, 14 nt, Shigella flexneri 2a str. 2457T
gcaaugaucucaau

SEQ ID NO: 1931666 - RNA, 13 nt, Shigella flexneri 2a str. 2457T
gcaaugcaggcac

SEQ ID NO: 1931667 - RNA, 14 nt, Shigella flexneri 2a str. 2457T
gcacaggcaucacu

SEQ ID NO: 1931668 - RNA, 18 nt, Shigella flexneri 2a str. 2457T
gcacccgcuucagugacu

SEQ ID NO: 1931669 - RNA, 15 nt, Shigella flexneri 2a str. 2457T
gcaccgaagcccauc

SEQ ID NO: 1931670 - RNA, 16 nt, Shigella flexneri 2a str. 2457T
gcaccgacaauccggu

SEQ ID NO: 1931671 - RNA, 17 nt, Shigella flexneri 2a str. 2457T
gcaccgaccaucggcac

SEQ ID NO: 1931672 - RNA, 20 nt, Shigella flexneri 2a str. 2457T
gcacccauuuauccagcggc

SEQ ID NO: 1931673 - RNA, 12 nt, Shigella flexneri 2a str. 2457T
gcacccagcaau

SEQ ID NO: 1931674 - RNA, 14 nt, Shigella flexneri 2a str. 2457T
gcaccuacagccau

SEQ ID NO: 1931675 - RNA, 19 nt, Shigella flexneri 2a str. 2457T
gcaccuaauaacucuccuc

SEQ ID NO: 1931676 - RNA, 15 nt, Shigella flexneri 2a str. 2457T
gcaccggacacugcu

SEQ ID NO: 1931677 - RNA, 17 nt, Shigella flexneri 2a str. 2457T
gcacgcaggccacgaau

SEQ ID NO: 1931678 - RNA, 22 nt, Shigella flexneri 2a str. 2457T
gcaguaaaccgucagcaccagg

SEQ ID NO: 1931679 - RNA, 19 nt, Shigella flexneri 2a str. 2457T
gcaguaaccaaaagcuggg

SEQ ID NO: 1931680 - RNA, 17 nt, Shigella flexneri 2a str. 2457T
gcagguuccacggcaug

SEQ ID NO: 1931681 - RNA, 13 nt, Shigella flexneri 2a str. 2457T
gcaggucaaagca

SEQ ID NO: 1931682 - RNA, 19 nt, Shigella flexneri 2a str. 2457T
gcaggucauccggcacgcu

SEQ ID NO: 1931683 - RNA, 15 nt, Shigella flexneri 2a str. 2457T
gcagguacgguacug

SEQ ID NO: 1931684 - RNA, 20 nt, Shigella flexneri 2a str. 2457T
gcagggcggcaggcagcgcc

SEQ ID NO: 1931685 - RNA, 17 nt, Shigella flexneri 2a str. 2457T
gcagggcuguuuaucgu

SEQ ID NO: 1931686 - RNA, 19 nt, Shigella flexneri 2a str. 2457T
gcaggguacugcgcgccgc

SEQ ID NO: 1931687 - RNA, 22 nt, Shigella flexneri 2a str. 2457T
gcauaacccguauguucccacc

SEQ ID NO: 1931688 - RNA, 13 nt, Shigella flexneri 2a str. 2457T
gcauaaaccacag

SEQ ID NO: 1931689 - RNA, 14 nt, Shigella flexneri 2a str. 2457T
gcauacaacgccau

SEQ ID NO: 1931690 - RNA, 16 nt, Shigella flexneri 2a str. 2457T
gcauacaacgccauga

SEQ ID NO: 1931691 - RNA, 14 nt, Shigella flexneri 2a str. 2457T
gcaguucgacaaaa

SEQ ID NO: 1931692 - RNA, 23 nt, Shigella flexneri 2a str. 2457T
gcaguuaucugccgaacaggcug

SEQ ID NO: 1931693 - RNA, 16 nt, Shigella flexneri 2a str. 2457T
gcaguucccuacucuc

SEQ ID NO: 1931694 - RNA, 23 nt, Shigella flexneri 2a str. 2457T
gcaguugcaacucgacuggagcc

SEQ ID NO: 1931695 - RNA, 18 nt, Shigella flexneri 2a str. 2457T
gcaguucugccaggcugg

SEQ ID NO: 1931696 - RNA, 17 nt, Shigella flexneri 2a str. 2457T
gcaguugcaguaccagu

SEQ ID NO: 1931697 - RNA, 19 nt, Shigella flexneri 2a str. 2457T
gcagugguuaacaaucaca

SEQ ID NO: 1931698 - RNA, 17 nt, Shigella flexneri 2a str. 2457T
gcagugggccagaaaaa

SEQ ID NO: 1931699 - RNA, 18 nt, Shigella flexneri 2a str. 2457T
gcaguggguaagccagac

SEQ ID NO: 1931700 - RNA, 19 nt, Shigella flexneri 2a str. 2457T
gcaguggguaaugcuguga

SEQ ID NO: 1931701 - RNA, 18 nt, Shigella flexneri 2a str. 2457T
gcaguuaaacgccuugcg

SEQ ID NO: 1931702 - RNA, 23 nt, Shigella flexneri 2a str. 2457T
gcagucuggacaaagagcuuuca

SEQ ID NO: 1931703 - RNA, 14 nt, Shigella flexneri 2a str. 2457T
gcagugacucacga

SEQ ID NO: 1931704 - RNA, 18 nt, Shigella flexneri 2a str. 2457T
gcaguaaggaaauguucc

SEQ ID NO: 1931705 - RNA, 18 nt, Shigella flexneri 2a str. 2457T
gcaguaauaccagaccuu

SEQ ID NO: 1931706 - RNA, 17 nt, Shigella flexneri 2a str. 2457T
gcaguaccuccuucaca

SEQ ID NO: 1931707 - RNA, 22 nt, Shigella flexneri 2a str. 2457T
gcaguaccacgguacgccagag

SEQ ID NO: 1931708 - RNA, 13 nt, Shigella flexneri 2a str. 2457T
gcaguacgccacc

SEQ ID NO: 1931709 - RNA, 17 nt, Shigella flexneri 2a str. 2457T
gcaguacggcagcaauc

SEQ ID NO: 1931710 - RNA, 19 nt, Shigella flexneri 2a str. 2457T
gcaguaccuccuucacagu

SEQ ID NO: 1931711 - RNA, 21 nt, Shigella flexneri 2a str. 2457T
gcaggaaauuauggaucacca

SEQ ID NO: 1931712 - RNA, 23 nt, Shigella flexneri 2a str. 2457T
gcagcuucucgugaaacucacgc

SEQ ID NO: 1931713 - RNA, 17 nt, Shigella flexneri 2a str. 2457T
gcagcuucuuauccagc

SEQ ID NO: 1931714 - RNA, 15 nt, Shigella flexneri 2a str. 2457T
gcagcuuaucuuuuu

SEQ ID NO: 1931715 - RNA, 20 nt, Shigella flexneri 2a str. 2457T
gcagcuuaaucauaauguug

SEQ ID NO: 1931716 - RNA, 12 nt, Shigella flexneri 2a str. 2457T
gcaggaacugcu

SEQ ID NO: 1931717 - RNA, 18 nt, Shigella flexneri 2a str. 2457T
gcaggaauguuguccagg

SEQ ID NO: 1931718 - RNA, 18 nt, Shigella flexneri 2a str. 2457T
gcaggacgcgcgcgccuu

SEQ ID NO: 1931719 - RNA, 12 nt, Shigella flexneri 2a str. 2457T
gcagcguuuauu

SEQ ID NO: 1931720 - RNA, 19 nt, Shigella flexneri 2a str. 2457T
gcagcgugcucucaaauau

SEQ ID NO: 1931721 - RNA, 23 nt, Shigella flexneri 2a str. 2457T
gcagcguucauaaauacagagca

SEQ ID NO: 1931722 - RNA, 18 nt, Shigella flexneri 2a str. 2457T
gcagcgugcucucaaaua

SEQ ID NO: 1931723 - RNA, 12 nt, Shigella flexneri 2a str. 2457T
gcagcuccagcc

SEQ ID NO: 1931724 - RNA, 16 nt, Shigella flexneri 2a str. 2457T
gcagcguuuccagcca

SEQ ID NO: 1931725 - RNA, 16 nt, Shigella flexneri 2a str. 2457T
gcagcucaucaagcug

SEQ ID NO: 1931726 - RNA, 13 nt, Shigella flexneri 2a str. 2457T
gcaggccggagac

SEQ ID NO: 1931727 - RNA, 23 nt, Shigella flexneri 2a str. 2457T
gcaggaucgacugcaaaccauga

SEQ ID NO: 1931728 - RNA, 23 nt, Shigella flexneri 2a str. 2457T
gcaggaugacaaaggugccgccc

SEQ ID NO: 1931729 - RNA, 16 nt, Shigella flexneri 2a str. 2457T
gcaggauguuccggca

SEQ ID NO: 1931730 - RNA, 19 nt, Shigella flexneri 2a str. 2457T
gcaggauguuccggcaaag

SEQ ID NO: 1931731 - RNA, 18 nt, Shigella flexneri 2a str. 2457T
gcaggcggauugcuucug

SEQ ID NO: 1931732 - RNA, 14 nt, Shigella flexneri 2a str. 2457T
gcaggcuucaacac

SEQ ID NO: 1931733 - RNA, 17 nt, Shigella flexneri 2a str. 2457T
gcagcacuacaccccag

SEQ ID NO: 1931734 - RNA, 21 nt, Shigella flexneri 2a str. 2457T
gcagcaggaucuccagcuccc

SEQ ID NO: 1931735 - RNA, 16 nt, Shigella flexneri 2a str. 2457T
gcagcaaucacugcca

SEQ ID NO: 1931736 - RNA, 21 nt, Shigella flexneri 2a str. 2457T
gcagcaaggcuauucagcagu

SEQ ID NO: 1931737 - RNA, 17 nt, Shigella flexneri 2a str. 2457T
gcagcaacucuuuuucc

SEQ ID NO: 1931738 - RNA, 14 nt, Shigella flexneri 2a str. 2457T
gcagauccugauuu

SEQ ID NO: 1931739 - RNA, 15 nt, Shigella flexneri 2a str. 2457T
gcagauccagugcuc

SEQ ID NO: 1931740 - RNA, 19 nt, Shigella flexneri 2a str. 2457T
gcagauauucguucagaua

SEQ ID NO: 1931741 - RNA, 16 nt, Shigella flexneri 2a str. 2457T
gcagaucaaauucaau

SEQ ID NO: 1931742 - RNA, 15 nt, Shigella flexneri 2a str. 2457T
gcagauaccacauca

SEQ ID NO: 1931743 - RNA, 18 nt, Shigella flexneri 2a str. 2457T
gcagauacauugccacca

SEQ ID NO: 1931744 - RNA, 23 nt, Shigella flexneri 2a str. 2457T
gcagauacauugccaccaccagc

SEQ ID NO: 1931745 - RNA, 23 nt, Shigella flexneri 2a str. 2457T
gcagauaaucguauucuggcuuc

SEQ ID NO: 1931746 - RNA, 16 nt, Shigella flexneri 2a str. 2457T
gcagauaaauaucaau

SEQ ID NO: 1931747 - RNA, 21 nt, Shigella flexneri 2a str. 2457T
gcagauaaauaucaaucccau

SEQ ID NO: 1931748 - RNA, 15 nt, Shigella flexneri 2a str. 2457T
gcagauccugauuua

SEQ ID NO: 1931749 - RNA, 19 nt, Shigella flexneri 2a str. 2457T
gcagccgguauccagcgcg

SEQ ID NO: 1931750 - RNA, 19 nt, Shigella flexneri 2a str. 2457T
gcagccgugcccaacugcc

SEQ ID NO: 1931751 - RNA, 19 nt, Shigella flexneri 2a str. 2457T
gcagccaucugaugauauu

SEQ ID NO: 1931752 - RNA, 19 nt, Shigella flexneri 2a str. 2457T
gcagccaucaccacgcuga

SEQ ID NO: 1931753 - RNA, 18 nt, Shigella flexneri 2a str. 2457T
gcagccccagagccugaa

SEQ ID NO: 1931754 - RNA, 18 nt, Shigella flexneri 2a str. 2457T
gcagcccauucuccgagg

SEQ ID NO: 1931755 - RNA, 21 nt, Shigella flexneri 2a str. 2457T
gcacuugcaggaacagugccu

SEQ ID NO: 1931756 - RNA, 14 nt, Shigella flexneri 2a str. 2457T
gcacgcgcuucaca

SEQ ID NO: 1931757 - RNA, 20 nt, Shigella flexneri 2a str. 2457T
gcacgcguagagaauccagu

SEQ ID NO: 1931758 - RNA, 14 nt, Shigella flexneri 2a str. 2457T
gcacuuccagcggc

SEQ ID NO: 1931759 - RNA, 13 nt, Shigella flexneri 2a str. 2457T
gcacuuuguccgc

SEQ ID NO: 1931760 - RNA, 17 nt, Shigella flexneri 2a str. 2457T
gcagaagcccagcgacu

SEQ ID NO: 1931761 - RNA, 23 nt, Shigella flexneri 2a str. 2457T
gcagaagcgauaaccuucaccgu

SEQ ID NO: 1931762 - RNA, 23 nt, Shigella flexneri 2a str. 2457T
gcagaagcaaucaucccagugga

SEQ ID NO: 1931763 - RNA, 15 nt, Shigella flexneri 2a str. 2457T
gcagaagcauuuuac

SEQ ID NO: 1931764 - RNA, 20 nt, Shigella flexneri 2a str. 2457T
gcagaaguuguccaugugcu

SEQ ID NO: 1931765 - RNA, 14 nt, Shigella flexneri 2a str. 2457T
gcagaacaucagcu

SEQ ID NO: 1931766 - RNA, 12 nt, Shigella flexneri 2a str. 2457T
gcagaacaucca

SEQ ID NO: 1931767 - RNA, 17 nt, Shigella flexneri 2a str. 2457T
gcagaaauugaccccag

SEQ ID NO: 1931768 - RNA, 17 nt, Shigella flexneri 2a str. 2457T
gcagagucucuggcuuc

SEQ ID NO: 1931769 - RNA, 15 nt, Shigella flexneri 2a str. 2457T
gcagaguugccaccc

SEQ ID NO: 1931770 - RNA, 21 nt, Shigella flexneri 2a str. 2457T
gcagacuuuuugcggcagcaa

SEQ ID NO: 1931771 - RNA, 20 nt, Shigella flexneri 2a str. 2457T
gcagagaaacgccagcagca

SEQ ID NO: 1931772 - RNA, 18 nt, Shigella flexneri 2a str. 2457T
gcagagaaaccacaucaa

SEQ ID NO: 1931773 - RNA, 19 nt, Shigella flexneri 2a str. 2457T
gcagacgccacaaucucac

SEQ ID NO: 1931774 - RNA, 23 nt, Shigella flexneri 2a str. 2457T
gcagagaucauacagaugcugcu

SEQ ID NO: 1931775 - RNA, 19 nt, Shigella flexneri 2a str. 2457T
gcagagaaacgccagcagc

SEQ ID NO: 1931776 - RNA, 17 nt, Shigella flexneri 2a str. 2457T
gcagagaucgccccggc

SEQ ID NO: 1931777 - RNA, 20 nt, Shigella flexneri 2a str. 2457T
gcagagcauccuuguacucu

SEQ ID NO: 1931778 - RNA, 16 nt, Shigella flexneri 2a str. 2457T
gcagagcaaucaccag

SEQ ID NO: 1931779 - RNA, 19 nt, Shigella flexneri 2a str. 2457T
gcagacggcucaucacccc

SEQ ID NO: 1931780 - RNA, 15 nt, Shigella flexneri 2a str. 2457T
gcagacggcucaucu

SEQ ID NO: 1931781 - RNA, 23 nt, Shigella flexneri 2a str. 2457T
gcagacguuuuuucugccccagu

SEQ ID NO: 1931782 - RNA, 13 nt, Shigella flexneri 2a str. 2457T
gcagaccugcuuu

SEQ ID NO: 1931783 - RNA, 14 nt, Shigella flexneri 2a str. 2457T
gcagacacuuuccc

SEQ ID NO: 1931784 - RNA, 13 nt, Shigella flexneri 2a str. 2457T
gcagacaacccac

SEQ ID NO: 1931785 - RNA, 17 nt, Shigella flexneri 2a str. 2457T
gcagacaaucacaucac

SEQ ID NO: 1931786 - RNA, 20 nt, Shigella flexneri 2a str. 2457T
gcagaaugguaacaccagag

SEQ ID NO: 1931787 - RNA, 16 nt, Shigella flexneri 2a str. 2457T
gaguuggggccagcau

SEQ ID NO: 1931788 - RNA, 19 nt, Shigella flexneri 2a str. 2457T
gaguugccaucaucaccag

SEQ ID NO: 1931789 - RNA, 12 nt, Shigella flexneri 2a str. 2457T
gaguugcagauu

SEQ ID NO: 1931790 - RNA, 15 nt, Shigella flexneri 2a str. 2457T
gaguugcaccagcaa

SEQ ID NO: 1931791 - RNA, 22 nt, Shigella flexneri 2a str. 2457T
gaguugcaccagcaacaagcca

SEQ ID NO: 1931792 - RNA, 12 nt, Shigella flexneri 2a str. 2457T
gaguuguaugcg

SEQ ID NO: 1931793 - RNA, 13 nt, Shigella flexneri 2a str. 2457T
gaguguuccucug

SEQ ID NO: 1931794 - RNA, 17 nt, Shigella flexneri 2a str. 2457T
gaguggcgaaauuggua

SEQ ID NO: 1931795 - RNA, 15 nt, Shigella flexneri 2a str. 2457T
gaguggcccagguua

SEQ ID NO: 1931796 - RNA, 18 nt, Shigella flexneri 2a str. 2457T
gagugauacguaaaccac

SEQ ID NO: 1931797 - RNA, 23 nt, Shigella flexneri 2a str. 2457T
gagugauacguaaaccacugaca

SEQ ID NO: 1931798 - RNA, 22 nt, Shigella flexneri 2a str. 2457T
gagugacgucauagcaguaccu

SEQ ID NO: 1931799 - RNA, 21 nt, Shigella flexneri 2a str. 2457T
gagugacuucgccgugaaagu

SEQ ID NO: 1931800 - RNA, 19 nt, Shigella flexneri 2a str. 2457T
gagugaccgccaauaaccg

SEQ ID NO: 1931801 - RNA, 11 nt, Shigella flexneri 2a str. 2457T
gagugaacacg

SEQ ID NO: 1931802 - RNA, 19 nt, Shigella flexneri 2a str. 2457T
gagugaaaaugccucagag

SEQ ID NO: 1931803 - RNA, 13 nt, Shigella flexneri 2a str. 2457T
gagugaaaaugcc

SEQ ID NO: 1931804 - RNA, 12 nt, Shigella flexneri 2a str. 2457T
gagucuugcugg

SEQ ID NO: 1931805 - RNA, 16 nt, Shigella flexneri 2a str. 2457T
gaguuuuucaguccac

SEQ ID NO: 1931806 - RNA, 17 nt, Shigella flexneri 2a str. 2457T
gauaaaccuccagcauc

SEQ ID NO: 1931807 - RNA, 17 nt, Shigella flexneri 2a str. 2457T
gauaaacggcaggagau

SEQ ID NO: 1931808 - RNA, 16 nt, Shigella flexneri 2a str. 2457T
gauaaacggcaggaga

SEQ ID NO: 1931809 - RNA, 12 nt, Shigella flexneri 2a str. 2457T
gauaaaucucau

SEQ ID NO: 1931810 - RNA, 15 nt, Shigella flexneri 2a str. 2457T
gauaaaucuccauuu

SEQ ID NO: 1931811 - RNA, 18 nt, Shigella flexneri 2a str. 2457T
gauaaaucuccauuucau

SEQ ID NO: 1931812 - RNA, 15 nt, Shigella flexneri 2a str. 2457T
gauaaauccaucggg

SEQ ID NO: 1931813 - RNA, 22 nt, Shigella flexneri 2a str. 2457T
gauaaaucccgccgcuucacca

SEQ ID NO: 1931814 - RNA, 21 nt, Shigella flexneri 2a str. 2457T
gauaaacguauaguggaauug

SEQ ID NO: 1931815 - RNA, 19 nt, Shigella flexneri 2a str. 2457T
gauaaccacguucauuuca

SEQ ID NO: 1931816 - RNA, 19 nt, Shigella flexneri 2a str. 2457T
gauaaccaucuucuucacu

SEQ ID NO: 1931817 - RNA, 16 nt, Shigella flexneri 2a str. 2457T
gauaacucaaaaauaa

SEQ ID NO: 1931818 - RNA, 17 nt, Shigella flexneri 2a str. 2457T
gauaacccggcggcgga

SEQ ID NO: 1931819 - RNA, 14 nt, Shigella flexneri 2a str. 2457T
gauaacccagcgca

SEQ ID NO: 1931820 - RNA, 17 nt, Shigella flexneri 2a str. 2457T
gauaagaugcuacaaca

SEQ ID NO: 1931821 - RNA, 17 nt, Shigella flexneri 2a str. 2457T
gauaagaugcgccagca

SEQ ID NO: 1931822 - RNA, 14 nt, Shigella flexneri 2a str. 2457T
gaguaaucgccagc

SEQ ID NO: 1931823 - RNA, 12 nt, Shigella flexneri 2a str. 2457T
gaguaaucaggc

SEQ ID NO: 1931824 - RNA, 12 nt, Shigella flexneri 2a str. 2457T
gaguacauccac

SEQ ID NO: 1931825 - RNA, 22 nt, Shigella flexneri 2a str. 2457T
gagguuggcucaucaagcacaa

SEQ ID NO: 1931826 - RNA, 13 nt, Shigella flexneri 2a str. 2457T
gaguaaagcccgc

SEQ ID NO: 1931827 - RNA, 23 nt, Shigella flexneri 2a str. 2457T
gaguaaagcccgccaucgcccau

SEQ ID NO: 1931828 - RNA, 15 nt, Shigella flexneri 2a str. 2457T
gaguaaacggcagag

SEQ ID NO: 1931829 - RNA, 14 nt, Shigella flexneri 2a str. 2457T
gaggucaaaaucca

SEQ ID NO: 1931830 - RNA, 12 nt, Shigella flexneri 2a str. 2457T
gaggucacgucc

SEQ ID NO: 1931831 - RNA, 15 nt, Shigella flexneri 2a str. 2457T
gaggcguuucaacuc

SEQ ID NO: 1931832 - RNA, 19 nt, Shigella flexneri 2a str. 2457T
gaggcguaauuuccacgcc

SEQ ID NO: 1931833 - RNA, 18 nt, Shigella flexneri 2a str. 2457T
gaggcuagcggcuuuuua

SEQ ID NO: 1931834 - RNA, 17 nt, Shigella flexneri 2a str. 2457T
gagggaaauagagaaau

SEQ ID NO: 1931835 - RNA, 18 nt, Shigella flexneri 2a str. 2457T
gagggaauccagcaauaa

SEQ ID NO: 1931836 - RNA, 19 nt, Shigella flexneri 2a str. 2457T
gagggaaccuguucaacaa

SEQ ID NO: 1931837 - RNA, 18 nt, Shigella flexneri 2a str. 2457T
gaggcuuuaauaccugcc

SEQ ID NO: 1931838 - RNA, 23 nt, Shigella flexneri 2a str. 2457T
gaggcuuuaauaccugccuggua

SEQ ID NO: 1931839 - RNA, 15 nt, Shigella flexneri 2a str. 2457T
gaggcuuauccggca

SEQ ID NO: 1931840 - RNA, 17 nt, Shigella flexneri 2a str. 2457T
gaggcuuauccggcaug

SEQ ID NO: 1931841 - RNA, 18 nt, Shigella flexneri 2a str. 2457T
gagggaucgacagauccc

SEQ ID NO: 1931842 - RNA, 22 nt, Shigella flexneri 2a str. 2457T
gagggauaucuucccgccguug

SEQ ID NO: 1931843 - RNA, 18 nt, Shigella flexneri 2a str. 2457T
gagguacgcuccagcagg

SEQ ID NO: 1931844 - RNA, 19 nt, Shigella flexneri 2a str. 2457T
gagguacaaccgcaaaggu

SEQ ID NO: 1931845 - RNA, 19 nt, Shigella flexneri 2a str. 2457T
gaggggcugacgcaacugg

SEQ ID NO: 1931846 - RNA, 12 nt, Shigella flexneri 2a str. 2457T
gauagccaggcg

SEQ ID NO: 1931847 - RNA, 20 nt, Shigella flexneri 2a str. 2457T
gauagagagcagucagguuc

SEQ ID NO: 1931848 - RNA, 17 nt, Shigella flexneri 2a str. 2457T
gauagagagcagucagg

SEQ ID NO: 1931849 - RNA, 19 nt, Shigella flexneri 2a str. 2457T
gauagaaccacgcaaaggc

SEQ ID NO: 1931850 - RNA, 20 nt, Shigella flexneri 2a str. 2457T
gauagaacaucucuucccau

SEQ ID NO: 1931851 - RNA, 22 nt, Shigella flexneri 2a str. 2457T
gauagaauauuucuauauccuc

SEQ ID NO: 1931852 - RNA, 18 nt, Shigella flexneri 2a str. 2457T
gauagaaugccaaguaau

SEQ ID NO: 1931853 - RNA, 13 nt, Shigella flexneri 2a str. 2457T
gauaccuaacauu

SEQ ID NO: 1931854 - RNA, 20 nt, Shigella flexneri 2a str. 2457T
gauacgguuuuuugaacaga

SEQ ID NO: 1931855 - RNA, 20 nt, Shigella flexneri 2a str. 2457T
gauaagcguagcgcaucagg

SEQ ID NO: 1931856 - RNA, 23 nt, Shigella flexneri 2a str. 2457T
gauaagguaucgcgaaaaaaaga

SEQ ID NO: 1931857 - RNA, 18 nt, Shigella flexneri 2a str. 2457T
gauaaggcaacgccccuu

SEQ ID NO: 1931858 - RNA, 15 nt, Shigella flexneri 2a str. 2457T
gauaaguucaaguuu

SEQ ID NO: 1931859 - RNA, 14 nt, Shigella flexneri 2a str. 2457T
gauaaguuaacccc

SEQ ID NO: 1931860 - RNA, 18 nt, Shigella flexneri 2a str. 2457T
gauaccgccgcacaauac

SEQ ID NO: 1931861 - RNA, 22 nt, Shigella flexneri 2a str. 2457T
gauaccgccgccaugcuugaag

SEQ ID NO: 1931862 - RNA, 22 nt, Shigella flexneri 2a str. 2457T
gauaccggugcaccuucaagua

SEQ ID NO: 1931863 - RNA, 16 nt, Shigella flexneri 2a str. 2457T
gauaccuaacauuuua

SEQ ID NO: 1931864 - RNA, 17 nt, Shigella flexneri 2a str. 2457T
gauauaccgugcugacu

SEQ ID NO: 1931865 - RNA, 22 nt, Shigella flexneri 2a str. 2457T
gauauaauaaaccugccuuaca

SEQ ID NO: 1931866 - RNA, 17 nt, Shigella flexneri 2a str. 2457T
gauaguuaaaauucaag

SEQ ID NO: 1931867 - RNA, 18 nt, Shigella flexneri 2a str. 2457T
gauaguguugguaaauaa

SEQ ID NO: 1931868 - RNA, 14 nt, Shigella flexneri 2a str. 2457T
gauaguuggcagcg

SEQ ID NO: 1931869 - RNA, 20 nt, Shigella flexneri 2a str. 2457T
gauagugcugccaucuucuu

SEQ ID NO: 1931870 - RNA, 16 nt, Shigella flexneri 2a str. 2457T
gauagucaugaugacg

SEQ ID NO: 1931871 - RNA, 19 nt, Shigella flexneri 2a str. 2457T
gauagcguagcgccucagg

SEQ ID NO: 1931872 - RNA, 19 nt, Shigella flexneri 2a str. 2457T
gauagccgaccgcaaggaa

SEQ ID NO: 1931873 - RNA, 14 nt, Shigella flexneri 2a str. 2457T
gauaggaauuaaaa

SEQ ID NO: 1931874 - RNA, 23 nt, Shigella flexneri 2a str. 2457T
gaucagauugccgugaaccugcg

SEQ ID NO: 1931875 - RNA, 17 nt, Shigella flexneri 2a str. 2457T
gaucagaguugaaaaac

SEQ ID NO: 1931876 - RNA, 17 nt, Shigella flexneri 2a str. 2457T
gaucauacugaacuuau

SEQ ID NO: 1931877 - RNA, 23 nt, Shigella flexneri 2a str. 2457T
gaucagacgacaaucaaccagca

SEQ ID NO: 1931878 - RNA, 16 nt, Shigella flexneri 2a str. 2457T
gaucacuuccagcagu

SEQ ID NO: 1931879 - RNA, 14 nt, Shigella flexneri 2a str. 2457T
gaucacuuccagca

SEQ ID NO: 1931880 - RNA, 19 nt, Shigella flexneri 2a str. 2457T
gaucacgcggucaaugguc

SEQ ID NO: 1931881 - RNA, 19 nt, Shigella flexneri 2a str. 2457T
gaucaucauuacguucuua

SEQ ID NO: 1931882 - RNA, 15 nt, Shigella flexneri 2a str. 2457T
gaucaucauccagca

SEQ ID NO: 1931883 - RNA, 12 nt, Shigella flexneri 2a str. 2457T
gaucauccgccu

SEQ ID NO: 1931884 - RNA, 20 nt, Shigella flexneri 2a str. 2457T
gaucaucgacaguaccagca

SEQ ID NO: 1931885 - RNA, 15 nt, Shigella flexneri 2a str. 2457T
gauccagcgcaauac

SEQ ID NO: 1931886 - RNA, 16 nt, Shigella flexneri 2a str. 2457T
gauccagcucuucuuc

SEQ ID NO: 1931887 - RNA, 18 nt, Shigella flexneri 2a str. 2457T
gauccagcucuucuucac

SEQ ID NO: 1931888 - RNA, 17 nt, Shigella flexneri 2a str. 2457T
gauccaggagcuccagg

SEQ ID NO: 1931889 - RNA, 16 nt, Shigella flexneri 2a str. 2457T
gauccauacucuuucc

SEQ ID NO: 1931890 - RNA, 21 nt, Shigella flexneri 2a str. 2457T
gauccauacucuuucccggca

SEQ ID NO: 1931891 - RNA, 13 nt, Shigella flexneri 2a str. 2457T
gauauuccccaga

SEQ ID NO: 1931892 - RNA, 23 nt, Shigella flexneri 2a str. 2457T
gauauuccccagacgagagugac

SEQ ID NO: 1931893 - RNA, 14 nt, Shigella flexneri 2a str. 2457T
gauauuccugaaug

SEQ ID NO: 1931894 - RNA, 16 nt, Shigella flexneri 2a str. 2457T
gauauucuccagcuuc

SEQ ID NO: 1931895 - RNA, 21 nt, Shigella flexneri 2a str. 2457T
gauauuuucccaacgugacca

SEQ ID NO: 1931896 - RNA, 22 nt, Shigella flexneri 2a str. 2457T
gauauucaggcguugaaaaauc

SEQ ID NO: 1931897 - RNA, 16 nt, Shigella flexneri 2a str. 2457T
gauauucaucuccagc

SEQ ID NO: 1931898 - RNA, 20 nt, Shigella flexneri 2a str. 2457T
gauauucaucuccagcacgu

SEQ ID NO: 1931899 - RNA, 19 nt, Shigella flexneri 2a str. 2457T
gaucaaggcauauaccaca

SEQ ID NO: 1931900 - RNA, 13 nt, Shigella flexneri 2a str. 2457T
gaucaaacgaagc

SEQ ID NO: 1931901 - RNA, 16 nt, Shigella flexneri 2a str. 2457T
gaucaaauacuucaau

SEQ ID NO: 1931902 - RNA, 14 nt, Shigella flexneri 2a str. 2457T
gaucaaauaaccgg

SEQ ID NO: 1931903 - RNA, 20 nt, Shigella flexneri 2a str. 2457T
gaucacagcaguccagcgcg

SEQ ID NO: 1931904 - RNA, 21 nt, Shigella flexneri 2a str. 2457T
gaucuggaauggaaacagcac

SEQ ID NO: 1931905 - RNA, 15 nt, Shigella flexneri 2a str. 2457T
gaucuggaguuccug

SEQ ID NO: 1931906 - RNA, 14 nt, Shigella flexneri 2a str. 2457T
gaucuguuuaucac

SEQ ID NO: 1931907 - RNA, 21 nt, Shigella flexneri 2a str. 2457T
gaucuugcgaccgcucuuuuu

SEQ ID NO: 1931908 - RNA, 23 nt, Shigella flexneri 2a str. 2457T
gaugaaaaaaccagaaagggaag

SEQ ID NO: 1931909 - RNA, 13 nt, Shigella flexneri 2a str. 2457T
gaucuuucacgcc

SEQ ID NO: 1931910 - RNA, 16 nt, Shigella flexneri 2a str. 2457T
gaugaaauaguugcau

SEQ ID NO: 1931911 - RNA, 14 nt, Shigella flexneri 2a str. 2457T
gaugaaagaaaaaa

SEQ ID NO: 1931912 - RNA, 14 nt, Shigella flexneri 2a str. 2457T
gaucguugaccuga

SEQ ID NO: 1931913 - RNA, 16 nt, Shigella flexneri 2a str. 2457T
gaucguguggcggcgu

SEQ ID NO: 1931914 - RNA, 23 nt, Shigella flexneri 2a str. 2457T
gaucccacggcggugucgccaga

SEQ ID NO: 1931915 - RNA, 22 nt, Shigella flexneri 2a str. 2457T
gauccccugcgcggcgacuucc

SEQ ID NO: 1931916 - RNA, 16 nt, Shigella flexneri 2a str. 2457T
gaucuaccgcuucccu

SEQ ID NO: 1931917 - RNA, 20 nt, Shigella flexneri 2a str. 2457T
gaucuaugucgcauccggca

SEQ ID NO: 1931918 - RNA, 17 nt, Shigella flexneri 2a str. 2457T
gaucuccucaccauucc

SEQ ID NO: 1931919 - RNA, 12 nt, Shigella flexneri 2a str. 2457T
gaucucuuccag

SEQ ID NO: 1931920 - RNA, 23 nt, Shigella flexneri 2a str. 2457T
gaucucuuccagugccucaagaa

SEQ ID NO: 1931921 - RNA, 17 nt, Shigella flexneri 2a str. 2457T
gaucucuucgccugccu

SEQ ID NO: 1931922 - RNA, 14 nt, Shigella flexneri 2a str. 2457T
gaucugauucugau

SEQ ID NO: 1931923 - RNA, 18 nt, Shigella flexneri 2a str. 2457T
gaugaacggugcgcaggc

SEQ ID NO: 1931924 - RNA, 14 nt, Shigella flexneri 2a str. 2457T
gaugaguugaaaac

SEQ ID NO: 1931925 - RNA, 22 nt, Shigella flexneri 2a str. 2457T
gaugauaaccccgcaauuucau

SEQ ID NO: 1931926 - RNA, 23 nt, Shigella flexneri 2a str. 2457T
gaugaggcaccuguaguguguug

SEQ ID NO: 1931927 - RNA, 17 nt, Shigella flexneri 2a str. 2457T
gaugacgacgacuggcc

SEQ ID NO: 1931928 - RNA, 14 nt, Shigella flexneri 2a str. 2457T
gaugauauggucaa

SEQ ID NO: 1931929 - RNA, 14 nt, Shigella flexneri 2a str. 2457T
gaugaucaacagca

SEQ ID NO: 1931930 - RNA, 15 nt, Shigella flexneri 2a str. 2457T
gaugcagcaucaugu

SEQ ID NO: 1931931 - RNA, 21 nt, Shigella flexneri 2a str. 2457T
gaugcacugggagaacgcugc

SEQ ID NO: 1931932 - RNA, 18 nt, Shigella flexneri 2a str. 2457T
gaugccagcgaagaagug

SEQ ID NO: 1931933 - RNA, 23 nt, Shigella flexneri 2a str. 2457T
gaugccagaaagcguauccauca

SEQ ID NO: 1931934 - RNA, 18 nt, Shigella flexneri 2a str. 2457T
gaugccaguaauccggcu

SEQ ID NO: 1931935 - RNA, 13 nt, Shigella flexneri 2a str. 2457T
gauggcccggcgg

SEQ ID NO: 1931936 - RNA, 21 nt, Shigella flexneri 2a str. 2457T
gauggcccacgacgucuccau

SEQ ID NO: 1931937 - RNA, 21 nt, Shigella flexneri 2a str. 2457T
gaugcggcgugaacgccuuau

SEQ ID NO: 1931938 - RNA, 15 nt, Shigella flexneri 2a str. 2457T
gaugcggcguaaacg

SEQ ID NO: 1931939 - RNA, 21 nt, Shigella flexneri 2a str. 2457T
gaugcuccacgcugcaucgcc

SEQ ID NO: 1931940 - RNA, 22 nt, Shigella flexneri 2a str. 2457T
gaugcucgccaggcguuugaaa

SEQ ID NO: 1931941 - RNA, 15 nt, Shigella flexneri 2a str. 2457T
gauggcauucucacu

SEQ ID NO: 1931942 - RNA, 17 nt, Shigella flexneri 2a str. 2457T
gaugcucuuuucugaag

SEQ ID NO: 1931943 - RNA, 19 nt, Shigella flexneri 2a str. 2457T
gaugccugcuuccgccacc

SEQ ID NO: 1931944 - RNA, 21 nt, Shigella flexneri 2a str. 2457T
gaugccgucuuugucggugga

SEQ ID NO: 1931945 - RNA, 19 nt, Shigella flexneri 2a str. 2457T
gaugccugauguacaacca

SEQ ID NO: 1931946 - RNA, 17 nt, Shigella flexneri 2a str. 2457T
gaugccauuugccagac

SEQ ID NO: 1931947 - RNA, 11 nt, Shigella flexneri 2a str. 2457T
gaugccccagu

SEQ ID NO: 1931948 - RNA, 22 nt, Shigella flexneri 2a str. 2457T
gauugcagacaaagugagcuuu

SEQ ID NO: 1931949 - RNA, 23 nt, Shigella flexneri 2a str. 2457T
gauugccagcauaaucaccauca

SEQ ID NO: 1931950 - RNA, 20 nt, Shigella flexneri 2a str. 2457T
gauugcaccaccagacgagc

SEQ ID NO: 1931951 - RNA, 23 nt, Shigella flexneri 2a str. 2457T
gauucgucaauaucgagacgggc

SEQ ID NO: 1931952 - RNA, 17 nt, Shigella flexneri 2a str. 2457T
gauuuaugauauuuuuu

SEQ ID NO: 1931953 - RNA, 14 nt, Shigella flexneri 2a str. 2457T
gauuuauaaaagaa

SEQ ID NO: 1931954 - RNA, 21 nt, Shigella flexneri 2a str. 2457T
gauuuauguaccgucaucgcc

SEQ ID NO: 1931955 - RNA, 20 nt, Shigella flexneri 2a str. 2457T
gauuuaucccaaccuaaaaa

SEQ ID NO: 1931956 - RNA, 14 nt, Shigella flexneri 2a str. 2457T
gauuuacuauuauu

SEQ ID NO: 1931957 - RNA, 17 nt, Shigella flexneri 2a str. 2457T
gauuuaccguuaagcug

SEQ ID NO: 1931958 - RNA, 16 nt, Shigella flexneri 2a str. 2457T
gauuuacgcucuucca

SEQ ID NO: 1931959 - RNA, 14 nt, Shigella flexneri 2a str. 2457T
gauuguagaaaauc

SEQ ID NO: 1931960 - RNA, 15 nt, Shigella flexneri 2a str. 2457T
gauugggauuaaagc

SEQ ID NO: 1931961 - RNA, 16 nt, Shigella flexneri 2a str. 2457T
gauugccgcgagaacu

SEQ ID NO: 1931962 - RNA, 23 nt, Shigella flexneri 2a str. 2457T
gauuugcggaaguaguucaucaa

SEQ ID NO: 1931963 - RNA, 13 nt, Shigella flexneri 2a str. 2457T
gauuugucagcag

SEQ ID NO: 1931964 - RNA, 17 nt, Shigella flexneri 2a str. 2457T
gauuucgccacccagcg

SEQ ID NO: 1931965 - RNA, 19 nt, Shigella flexneri 2a str. 2457T
gauuucgccacccagcgcc

SEQ ID NO: 1931966 - RNA, 19 nt, Shigella flexneri 2a str. 2457T
gauuucguagacugcagcg

SEQ ID NO: 1931967 - RNA, 12 nt, Shigella flexneri 2a str. 2457T
gauuuccagcuc

SEQ ID NO: 1931968 - RNA, 11 nt, Shigella flexneri 2a str. 2457T
gauuucauuca

SEQ ID NO: 1931969 - RNA, 13 nt, Shigella flexneri 2a str. 2457T
gauuuuuuuaaua

SEQ ID NO: 1931970 - RNA, 15 nt, Shigella flexneri 2a str. 2457T
gcaaaaaaaugcaca

SEQ ID NO: 1931971 - RNA, 15 nt, Shigella flexneri 2a str. 2457T
gauuuugcugugcuu

SEQ ID NO: 1931972 - RNA, 16 nt, Shigella flexneri 2a str. 2457T
gauuuucaucuucuuc

SEQ ID NO: 1931973 - RNA, 18 nt, Shigella flexneri 2a str. 2457T
gauucccauuauuucaac

SEQ ID NO: 1931974 - RNA, 15 nt, Shigella flexneri 2a str. 2457T
gauuccgccaguucu

SEQ ID NO: 1931975 - RNA, 24 nt, Shigella flexneri 2a str. 2457T
gauuccugcgcuuccagcuccauc

SEQ ID NO: 1931976 - RNA, 20 nt, Shigella flexneri 2a str. 2457T
gauuccugcgcuuccagcuc

SEQ ID NO: 1931977 - RNA, 20 nt, Shigella flexneri 2a str. 2457T
gauuccucucauuuaaaauc

SEQ ID NO: 1931978 - RNA, 12 nt, Shigella flexneri 2a str. 2457T
gauucaugcugc

SEQ ID NO: 1931979 - RNA, 23 nt, Shigella flexneri 2a str. 2457T
gauucauccguuucucuguucag

SEQ ID NO: 1931980 - RNA, 16 nt, Shigella flexneri 2a str. 2457T
gauucaucucuucuuc

SEQ ID NO: 1931981 - RNA, 18 nt, Shigella flexneri 2a str. 2457T
gauucaucucuucuuccg

SEQ ID NO: 1931982 - RNA, 19 nt, Shigella flexneri 2a str. 2457T
gauucauccguuucccugu

SEQ ID NO: 1931983 - RNA, 19 nt, Shigella flexneri 2a str. 2457T
gauucccagucauccggcu

SEQ ID NO: 1931984 - RNA, 15 nt, Shigella flexneri 2a str. 2457T
gauuccacucauuaa

SEQ ID NO: 1931985 - RNA, 13 nt, Shigella flexneri 2a str. 2457T
gauuccacucauu

SEQ ID NO: 1931986 - RNA, 17 nt, Shigella flexneri 2a str. 2457T
gauuagucuuuaucugc

SEQ ID NO: 1931987 - RNA, 20 nt, Shigella flexneri 2a str. 2457T
gauuagcccccguuuuguug

SEQ ID NO: 1931988 - RNA, 18 nt, Shigella flexneri 2a str. 2457T
gauucacgccaaccagcu

SEQ ID NO: 1931989 - RNA, 18 nt, Shigella flexneri 2a str. 2457T
gauucagcaccuuaccuc

SEQ ID NO: 1931990 - RNA, 23 nt, Shigella flexneri 2a str. 2457T
gauucagauaauccccaaugacc

SEQ ID NO: 1931991 - RNA, 21 nt, Shigella flexneri 2a str. 2457T
gauucagcgucgucagcaguu

SEQ ID NO: 1931992 - RNA, 17 nt, Shigella flexneri 2a str. 2457T
gauucacauuuaaacaa

SEQ ID NO: 1931993 - RNA, 15 nt, Shigella flexneri 2a str. 2457T
gauucacaguuaagu

SEQ ID NO: 1931994 - RNA, 17 nt, Shigella flexneri 2a str. 2457T
gauggcguuacauuucc

SEQ ID NO: 1931995 - RNA, 21 nt, Shigella flexneri 2a str. 2457T
gauggcuauuacuuuaagccu

SEQ ID NO: 1931996 - RNA, 23 nt, Shigella flexneri 2a str. 2457T
gauggcuauuacuuuaagccuuc

SEQ ID NO: 1931997 - RNA, 18 nt, Shigella flexneri 2a str. 2457T
gaugucggcauaaagcug

SEQ ID NO: 1931998 - RNA, 14 nt, Shigella flexneri 2a str. 2457T
gaugugaacccuga

SEQ ID NO: 1931999 - RNA, 18 nt, Shigella flexneri 2a str. 2457T
gaugugcaguuccugcaa

SEQ ID NO: 1932000 - RNA, 14 nt, Shigella flexneri 2a str. 2457T
gaugugauccauca

SEQ ID NO: 1932001 - RNA, 21 nt, Shigella flexneri 2a str. 2457T
gaugugaugcccggucgcucc

SEQ ID NO: 1932002 - RNA, 18 nt, Shigella flexneri 2a str. 2457T
gaugugggcaaucucacu

SEQ ID NO: 1932003 - RNA, 17 nt, Shigella flexneri 2a str. 2457T
gauuacuuuauuuauau

SEQ ID NO: 1932004 - RNA, 21 nt, Shigella flexneri 2a str. 2457T
gauuaccaauaucaaauaaaa

SEQ ID NO: 1932005 - RNA, 18 nt, Shigella flexneri 2a str. 2457T
gauguuguacaugcugcu

SEQ ID NO: 1932006 - RNA, 18 nt, Shigella flexneri 2a str. 2457T
gauguuguuuuuaaccaa

SEQ ID NO: 1932007 - RNA, 13 nt, Shigella flexneri 2a str. 2457T
gauguuccgccau

SEQ ID NO: 1932008 - RNA, 22 nt, Shigella flexneri 2a str. 2457T
gauguguuccgcaaucaaauga

SEQ ID NO: 1932009 - RNA, 14 nt, Shigella flexneri 2a str. 2457T
gagccgcuggcggu

SEQ ID NO: 1932010 - RNA, 22 nt, Shigella flexneri 2a str. 2457T
gagccgcuacggaagaugaaaa

SEQ ID NO: 1932011 - RNA, 17 nt, Shigella flexneri 2a str. 2457T
gagccggaugccucucc

SEQ ID NO: 1932012 - RNA, 21 nt, Shigella flexneri 2a str. 2457T
gagccauugcccgaugcgcaa

SEQ ID NO: 1932013 - RNA, 22 nt, Shigella flexneri 2a str. 2457T
gagcccaucacaauggcacaaa

SEQ ID NO: 1932014 - RNA, 14 nt, Shigella flexneri 2a str. 2457T
gagcccagaugccg

SEQ ID NO: 1932015 - RNA, 15 nt, Shigella flexneri 2a str. 2457T
gagccagcuucccaa

SEQ ID NO: 1932016 - RNA, 18 nt, Shigella flexneri 2a str. 2457T
gagcaucgcccaggcgac

SEQ ID NO: 1932017 - RNA, 17 nt, Shigella flexneri 2a str. 2457T
gagcaucgguaucuucc

SEQ ID NO: 1932018 - RNA, 22 nt, Shigella flexneri 2a str. 2457T
gagccaacguuucgcugugauu

SEQ ID NO: 1932019 - RNA, 17 nt, Shigella flexneri 2a str. 2457T
gagccaaacgcccagcu

SEQ ID NO: 1932020 - RNA, 21 nt, Shigella flexneri 2a str. 2457T
gagcauggcuggaaugcaacu

SEQ ID NO: 1932021 - RNA, 22 nt, Shigella flexneri 2a str. 2457T
gagcauuacuuucggugacuuc

SEQ ID NO: 1932022 - RNA, 19 nt, Shigella flexneri 2a str. 2457T
gagcauucccgccaucguu

SEQ ID NO: 1932023 - RNA, 13 nt, Shigella flexneri 2a str. 2457T
gagcaggccgggu

SEQ ID NO: 1932024 - RNA, 21 nt, Shigella flexneri 2a str. 2457T
gagaucguuggucgcgcacug

SEQ ID NO: 1932025 - RNA, 16 nt, Shigella flexneri 2a str. 2457T
gagauguccccugcgg

SEQ ID NO: 1932026 - RNA, 13 nt, Shigella flexneri 2a str. 2457T
gagauguugcaaa

SEQ ID NO: 1932027 - RNA, 18 nt, Shigella flexneri 2a str. 2457T
gagauucgguaaccaucc

SEQ ID NO: 1932028 - RNA, 22 nt, Shigella flexneri 2a str. 2457T
gagaucgaccggguuagucugg

SEQ ID NO: 1932029 - RNA, 21 nt, Shigella flexneri 2a str. 2457T
gagaucauuauuaaacagaca

SEQ ID NO: 1932030 - RNA, 15 nt, Shigella flexneri 2a str. 2457T
gagaucacgccacaa

SEQ ID NO: 1932031 - RNA, 15 nt, Shigella flexneri 2a str. 2457T
gagauauuccccaga

SEQ ID NO: 1932032 - RNA, 16 nt, Shigella flexneri 2a str. 2457T
gagauauuccccagac

SEQ ID NO: 1932033 - RNA, 15 nt, Shigella flexneri 2a str. 2457T
gagauaacguuuugc

SEQ ID NO: 1932034 - RNA, 16 nt, Shigella flexneri 2a str. 2457T
gagauaaccacguuca

SEQ ID NO: 1932035 - RNA, 22 nt, Shigella flexneri 2a str. 2457T
gagauaaccacguucauuucau

SEQ ID NO: 1932036 - RNA, 19 nt, Shigella flexneri 2a str. 2457T
gagagugacgucauagcag

SEQ ID NO: 1932037 - RNA, 16 nt, Shigella flexneri 2a str. 2457T
gagcaaaccacaggcc

SEQ ID NO: 1932038 - RNA, 19 nt, Shigella flexneri 2a str. 2457T
gagcaaacaguucugcagc

SEQ ID NO: 1932039 - RNA, 16 nt, Shigella flexneri 2a str. 2457T
gagauuugcuccagcg

SEQ ID NO: 1932040 - RNA, 22 nt, Shigella flexneri 2a str. 2457T
gagauuuuacccaugacuuuga

SEQ ID NO: 1932041 - RNA, 23 nt, Shigella flexneri 2a str. 2457T
gagcaauaaaaacuccgccgcau

SEQ ID NO: 1932042 - RNA, 12 nt, Shigella flexneri 2a str. 2457T
gagcacaugcag

SEQ ID NO: 1932043 - RNA, 19 nt, Shigella flexneri 2a str. 2457T
gagcaauguaaggugcauc

SEQ ID NO: 1932044 - RNA, 21 nt, Shigella flexneri 2a str. 2457T
gagcaaugaucucaauaguuc

SEQ ID NO: 1932045 - RNA, 21 nt, Shigella flexneri 2a str. 2457T
gagcagagaaacgccagcagc

SEQ ID NO: 1932046 - RNA, 17 nt, Shigella flexneri 2a str. 2457T
gagcacuuuucugguca

SEQ ID NO: 1932047 - RNA, 16 nt, Shigella flexneri 2a str. 2457T
gagcaccuuuuuucug

SEQ ID NO: 1932048 - RNA, 22 nt, Shigella flexneri 2a str. 2457T
gaggaaggcacguacaugcagg

SEQ ID NO: 1932049 - RNA, 21 nt, Shigella flexneri 2a str. 2457T
gaggagagugcaaugaaaaac

SEQ ID NO: 1932050 - RNA, 16 nt, Shigella flexneri 2a str. 2457T
gaggagccaucaccau

SEQ ID NO: 1932051 - RNA, 23 nt, Shigella flexneri 2a str. 2457T
gagcugucgacuaaccugagagu

SEQ ID NO: 1932052 - RNA, 18 nt, Shigella flexneri 2a str. 2457T
gagcuucacccgcagcac

SEQ ID NO: 1932053 - RNA, 21 nt, Shigella flexneri 2a str. 2457T
gagcuuauuuguugagcugga

SEQ ID NO: 1932054 - RNA, 14 nt, Shigella flexneri 2a str. 2457T
gagcuucggcggcg

SEQ ID NO: 1932055 - RNA, 17 nt, Shigella flexneri 2a str. 2457T
gaggcagcaaggaaaac

SEQ ID NO: 1932056 - RNA, 16 nt, Shigella flexneri 2a str. 2457T
gaggcaaccagcacgc

SEQ ID NO: 1932057 - RNA, 12 nt, Shigella flexneri 2a str. 2457T
gaggaucaccag

SEQ ID NO: 1932058 - RNA, 18 nt, Shigella flexneri 2a str. 2457T
gaggauaugcaucaugaa

SEQ ID NO: 1932059 - RNA, 23 nt, Shigella flexneri 2a str. 2457T
gaggagagugcaaugaaaaaccg

SEQ ID NO: 1932060 - RNA, 13 nt, Shigella flexneri 2a str. 2457T
gaggaguuuaugg

SEQ ID NO: 1932061 - RNA, 22 nt, Shigella flexneri 2a str. 2457T
gaggcgcuggcgcauguuggcg

SEQ ID NO: 1932062 - RNA, 20 nt, Shigella flexneri 2a str. 2457T
gaggccgcggcucaggcgca

SEQ ID NO: 1932063 - RNA, 17 nt, Shigella flexneri 2a str. 2457T
gaggcauuggcaaauuu

SEQ ID NO: 1932064 - RNA, 21 nt, Shigella flexneri 2a str. 2457T
gaggccaaaaccacagugacc

SEQ ID NO: 1932065 - RNA, 17 nt, Shigella flexneri 2a str. 2457T
gaggccaauuuggcugc

SEQ ID NO: 1932066 - RNA, 17 nt, Shigella flexneri 2a str. 2457T
gagccugaauaaacgcc

SEQ ID NO: 1932067 - RNA, 13 nt, Shigella flexneri 2a str. 2457T
gagcggccagggc

SEQ ID NO: 1932068 - RNA, 14 nt, Shigella flexneri 2a str. 2457T
gagcguuucaaaaa

SEQ ID NO: 1932069 - RNA, 22 nt, Shigella flexneri 2a str. 2457T
gagcguuucaaaaacaaagaac

SEQ ID NO: 1932070 - RNA, 19 nt, Shigella flexneri 2a str. 2457T
gagcguuacccgcagccau

SEQ ID NO: 1932071 - RNA, 18 nt, Shigella flexneri 2a str. 2457T
gagcgucauauagccgcc

SEQ ID NO: 1932072 - RNA, 23 nt, Shigella flexneri 2a str. 2457T
gagcguauccagcauaccuucca

SEQ ID NO: 1932073 - RNA, 23 nt, Shigella flexneri 2a str. 2457T
gagcgguaaagaacugagcgccg

SEQ ID NO: 1932074 - RNA, 16 nt, Shigella flexneri 2a str. 2457T
gagcucaauacaaccc

SEQ ID NO: 1932075 - RNA, 14 nt, Shigella flexneri 2a str. 2457T
gagcuccagguccu

SEQ ID NO: 1932076 - RNA, 15 nt, Shigella flexneri 2a str. 2457T
gagcuaccggcagga

SEQ ID NO: 1932077 - RNA, 20 nt, Shigella flexneri 2a str. 2457T
gagcuauaccaugccguucu

SEQ ID NO: 1932078 - RNA, 13 nt, Shigella flexneri 2a str. 2457T
gagcuaucucccu

SEQ ID NO: 1932079 - RNA, 13 nt, Shigella flexneri 2a str. 2457T
gagcugcaaggca

SEQ ID NO: 1932080 - RNA, 22 nt, Shigella flexneri 2a str. 2457T
gacgggaaacucugcuggcgga

SEQ ID NO: 1932081 - RNA, 20 nt, Shigella flexneri 2a str. 2457T
gacggcugauaugccagacu

SEQ ID NO: 1932082 - RNA, 13 nt, Shigella flexneri 2a str. 2457T
gacggcguucuuu

SEQ ID NO: 1932083 - RNA, 23 nt, Shigella flexneri 2a str. 2457T
gacgggcauuucgucuugcagga

SEQ ID NO: 1932084 - RNA, 18 nt, Shigella flexneri 2a str. 2457T
gacgucacaggccaucac

SEQ ID NO: 1932085 - RNA, 21 nt, Shigella flexneri 2a str. 2457T
gacguaaugauguaaaaauac

SEQ ID NO: 1932086 - RNA, 19 nt, Shigella flexneri 2a str. 2457T
gacgguggagcaacaggga

SEQ ID NO: 1932087 - RNA, 14 nt, Shigella flexneri 2a str. 2457T
gacgucauagcagu

SEQ ID NO: 1932088 - RNA, 14 nt, Shigella flexneri 2a str. 2457T
gacgucucggcaug

SEQ ID NO: 1932089 - RNA, 18 nt, Shigella flexneri 2a str. 2457T
gacgucucaaucaccacc

SEQ ID NO: 1932090 - RNA, 21 nt, Shigella flexneri 2a str. 2457T
gacgugcgggcgcaagggugc

SEQ ID NO: 1932091 - RNA, 20 nt, Shigella flexneri 2a str. 2457T
gacgugcaccgucacuucuu

SEQ ID NO: 1932092 - RNA, 15 nt, Shigella flexneri 2a str. 2457T
gacguuaagaaaacg

SEQ ID NO: 1932093 - RNA, 14 nt, Shigella flexneri 2a str. 2457T
gacguucuuccugu

SEQ ID NO: 1932094 - RNA, 13 nt, Shigella flexneri 2a str. 2457T
gacguucugccaa

SEQ ID NO: 1932095 - RNA, 14 nt, Shigella flexneri 2a str. 2457T
gacguucugccaaa

SEQ ID NO: 1932096 - RNA, 12 nt, Shigella flexneri 2a str. 2457T
gacguucagcca

SEQ ID NO: 1932097 - RNA, 17 nt, Shigella flexneri 2a str. 2457T
gacguucaugccggucg

SEQ ID NO: 1932098 - RNA, 22 nt, Shigella flexneri 2a str. 2457T
gacguuguuuucaugccgccgc

SEQ ID NO: 1932099 - RNA, 14 nt, Shigella flexneri 2a str. 2457T
gacuaacuucugau

SEQ ID NO: 1932100 - RNA, 21 nt, Shigella flexneri 2a str. 2457T
gacuaaauuucacugcuuaau

SEQ ID NO: 1932101 - RNA, 11 nt, Shigella flexneri 2a str. 2457T
gacuaaaaccc

SEQ ID NO: 1932102 - RNA, 20 nt, Shigella flexneri 2a str. 2457T
gacguuuuacagcaacgggc

SEQ ID NO: 1932103 - RNA, 22 nt, Shigella flexneri 2a str. 2457T
gacguuuuagccauaaacgggc

SEQ ID NO: 1932104 - RNA, 18 nt, Shigella flexneri 2a str. 2457T
gacucaauggcauccgcc

SEQ ID NO: 1932105 - RNA, 19 nt, Shigella flexneri 2a str. 2457T
gacucaaaccccgcagcaa

SEQ ID NO: 1932106 - RNA, 13 nt, Shigella flexneri 2a str. 2457T
gacuauuucuuca

SEQ ID NO: 1932107 - RNA, 17 nt, Shigella flexneri 2a str. 2457T
gacuagcgccauaauaa

SEQ ID NO: 1932108 - RNA, 15 nt, Shigella flexneri 2a str. 2457T
gacuacgccaacaga

SEQ ID NO: 1932109 - RNA, 15 nt, Shigella flexneri 2a str. 2457T
gacuaauuucucgcc

SEQ ID NO: 1932110 - RNA, 15 nt, Shigella flexneri 2a str. 2457T
gacuaccauccgagu

SEQ ID NO: 1932111 - RNA, 18 nt, Shigella flexneri 2a str. 2457T
gacucccgcgccgcagcc

SEQ ID NO: 1932112 - RNA, 18 nt, Shigella flexneri 2a str. 2457T
gacucgaggagcuggagg

SEQ ID NO: 1932113 - RNA, 15 nt, Shigella flexneri 2a str. 2457T
gacuccagcgccagc

SEQ ID NO: 1932114 - RNA, 14 nt, Shigella flexneri 2a str. 2457T
gacuccaacuuacu

SEQ ID NO: 1932115 - RNA, 15 nt, Shigella flexneri 2a str. 2457T
gacugcgccgugucg

SEQ ID NO: 1932116 - RNA, 22 nt, Shigella flexneri 2a str. 2457T
gacugcgccacuucccagccuu

SEQ ID NO: 1932117 - RNA, 18 nt, Shigella flexneri 2a str. 2457T
gacugcgccacuucccag

SEQ ID NO: 1932118 - RNA, 20 nt, Shigella flexneri 2a str. 2457T
gacugcggcgugggcgcugu

SEQ ID NO: 1932119 - RNA, 17 nt, Shigella flexneri 2a str. 2457T
gacugcucagcuccucu

SEQ ID NO: 1932120 - RNA, 23 nt, Shigella flexneri 2a str. 2457T
gacuggaauaagccaaauccagc

SEQ ID NO: 1932121 - RNA, 22 nt, Shigella flexneri 2a str. 2457T
gacugcgagaaguucugcagcc

SEQ ID NO: 1932122 - RNA, 14 nt, Shigella flexneri 2a str. 2457T
gacugcccgcgagc

SEQ ID NO: 1932123 - RNA, 21 nt, Shigella flexneri 2a str. 2457T
gacugaugugauccaucaggu

SEQ ID NO: 1932124 - RNA, 17 nt, Shigella flexneri 2a str. 2457T
gacugaugacaaacaca

SEQ ID NO: 1932125 - RNA, 19 nt, Shigella flexneri 2a str. 2457T
gacugauaucugcccgcac

SEQ ID NO: 1932126 - RNA, 18 nt, Shigella flexneri 2a str. 2457T
gacugaaaguacuucaca

SEQ ID NO: 1932127 - RNA, 12 nt, Shigella flexneri 2a str. 2457T
gacugaauacgc

SEQ ID NO: 1932128 - RNA, 19 nt, Shigella flexneri 2a str. 2457T
gacugaauacgcuggcgcg

SEQ ID NO: 1932129 - RNA, 14 nt, Shigella flexneri 2a str. 2457T
gacucugaaacucg

SEQ ID NO: 1932130 - RNA, 17 nt, Shigella flexneri 2a str. 2457T
gacucuuacucuuucaa

SEQ ID NO: 1932131 - RNA, 14 nt, Shigella flexneri 2a str. 2457T
gagacaaucgccac

SEQ ID NO: 1932132 - RNA, 15 nt, Shigella flexneri 2a str. 2457T
gagacaacaacauca

SEQ ID NO: 1932133 - RNA, 19 nt, Shigella flexneri 2a str. 2457T
gagacagccgaaaagguag

SEQ ID NO: 1932134 - RNA, 23 nt, Shigella flexneri 2a str. 2457T
gagacauugugugaaaucagcac

SEQ ID NO: 1932135 - RNA, 21 nt, Shigella flexneri 2a str. 2457T
gagacauuccuuuacuuagaa

SEQ ID NO: 1932136 - RNA, 18 nt, Shigella flexneri 2a str. 2457T
gagaaucgauaugucuuu

SEQ ID NO: 1932137 - RNA, 18 nt, Shigella flexneri 2a str. 2457T
gagaaucguacucaccag

SEQ ID NO: 1932138 - RNA, 16 nt, Shigella flexneri 2a str. 2457T
gagaaucaguuuuuuc

SEQ ID NO: 1932139 - RNA, 16 nt, Shigella flexneri 2a str. 2457T
gagaauuccggcagag

SEQ ID NO: 1932140 - RNA, 22 nt, Shigella flexneri 2a str. 2457T
gagaacggacccgcgaucgccu

SEQ ID NO: 1932141 - RNA, 17 nt, Shigella flexneri 2a str. 2457T
gagaacggcgcaccaga

SEQ ID NO: 1932142 - RNA, 12 nt, Shigella flexneri 2a str. 2457T
gagaacgaugcu

SEQ ID NO: 1932143 - RNA, 18 nt, Shigella flexneri 2a str. 2457T
gagaaccacaaugaagaa

SEQ ID NO: 1932144 - RNA, 20 nt, Shigella flexneri 2a str. 2457T
gagaacgaccaucagcugcc

SEQ ID NO: 1932145 - RNA, 18 nt, Shigella flexneri 2a str. 2457T
gagaagguugccauaucu

SEQ ID NO: 1932146 - RNA, 16 nt, Shigella flexneri 2a str. 2457T
gagaagccaccgcgcc

SEQ ID NO: 1932147 - RNA, 21 nt, Shigella flexneri 2a str. 2457T
gagaagcacguucaucccacu

SEQ ID NO: 1932148 - RNA, 13 nt, Shigella flexneri 2a str. 2457T
gagaagcaccgcc

SEQ ID NO: 1932149 - RNA, 14 nt, Shigella flexneri 2a str. 2457T
gagaagcuggaagg

SEQ ID NO: 1932150 - RNA, 15 nt, Shigella flexneri 2a str. 2457T
gagaagcuggaaggg

SEQ ID NO: 1932151 - RNA, 15 nt, Shigella flexneri 2a str. 2457T
gagagcaugaaauga

SEQ ID NO: 1932152 - RNA, 16 nt, Shigella flexneri 2a str. 2457T
gagagcaugaaaugaa

SEQ ID NO: 1932153 - RNA, 13 nt, Shigella flexneri 2a str. 2457T
gagagagaaaaua

SEQ ID NO: 1932154 - RNA, 15 nt, Shigella flexneri 2a str. 2457T
gagaggccuucgccu

SEQ ID NO: 1932155 - RNA, 22 nt, Shigella flexneri 2a str. 2457T
gagaggcugaaggcgcuccccu

SEQ ID NO: 1932156 - RNA, 19 nt, Shigella flexneri 2a str. 2457T
gagaggguuagggugaggg

SEQ ID NO: 1932157 - RNA, 17 nt, Shigella flexneri 2a str. 2457T
gagagguaaaaccugac

SEQ ID NO: 1932158 - RNA, 22 nt, Shigella flexneri 2a str. 2457T
gagagguaaaaccugacaacaa

SEQ ID NO: 1932159 - RNA, 13 nt, Shigella flexneri 2a str. 2457T
gagagaagaaacg

SEQ ID NO: 1932160 - RNA, 20 nt, Shigella flexneri 2a str. 2457T
gagagaagcacguucauccc

SEQ ID NO: 1932161 - RNA, 14 nt, Shigella flexneri 2a str. 2457T
gagacucaaacccc

SEQ ID NO: 1932162 - RNA, 13 nt, Shigella flexneri 2a str. 2457T
gagacgcagcguu

SEQ ID NO: 1932163 - RNA, 16 nt, Shigella flexneri 2a str. 2457T
gagaaagcaaaaauaa

SEQ ID NO: 1932164 - RNA, 18 nt, Shigella flexneri 2a str. 2457T
gagaaaccacaucaaucc

SEQ ID NO: 1932165 - RNA, 14 nt, Shigella flexneri 2a str. 2457T
gagaaaaauagcau

SEQ ID NO: 1932166 - RNA, 11 nt, Shigella flexneri 2a str. 2457T
gagaaaaauag

SEQ ID NO: 1932167 - RNA, 21 nt, Shigella flexneri 2a str. 2457T
gagaaaaccgaugcagugcgg

SEQ ID NO: 1932168 - RNA, 19 nt, Shigella flexneri 2a str. 2457T
gagaaaaugccgcacauca

SEQ ID NO: 1932169 - RNA, 18 nt, Shigella flexneri 2a str. 2457T
gagaacaucaauccaaac

SEQ ID NO: 1932170 - RNA, 19 nt, Shigella flexneri 2a str. 2457T
gagaacaagauugccugau

SEQ ID NO: 1932171 - RNA, 17 nt, Shigella flexneri 2a str. 2457T
gagaacaaggcuuuaau

SEQ ID NO: 1932172 - RNA, 22 nt, Shigella flexneri 2a str. 2457T
gagaacaccaccugccagagcu

SEQ ID NO: 1932173 - RNA, 14 nt, Shigella flexneri 2a str. 2457T
gagaaauaccaccc

SEQ ID NO: 1932174 - RNA, 22 nt, Shigella flexneri 2a str. 2457T
gagaaaguaaaccaccaguccu

SEQ ID NO: 1932175 - RNA, 23 nt, Shigella flexneri 2a str. 2457T
gagaaaguaaaccaccaguccuu

SEQ ID NO: 1932176 - RNA, 22 nt, Shigella flexneri 2a str. 2457T
gacuuuuuccugcucaaugucu

SEQ ID NO: 1932177 - RNA, 14 nt, Shigella flexneri 2a str. 2457T
gagaaaaagcgaag

SEQ ID NO: 1932178 - RNA, 23 nt, Shigella flexneri 2a str. 2457T
gacuuuuuccaguccacguucaa

SEQ ID NO: 1932179 - RNA, 15 nt, Shigella flexneri 2a str. 2457T
gacuuuugcccggca

SEQ ID NO: 1932180 - RNA, 18 nt, Shigella flexneri 2a str. 2457T
gacuuugccuggcggcag

SEQ ID NO: 1932181 - RNA, 23 nt, Shigella flexneri 2a str. 2457T
gacuuuaaucaccugccagggag

SEQ ID NO: 1932182 - RNA, 12 nt, Shigella flexneri 2a str. 2457T
gacugucagaug

SEQ ID NO: 1932183 - RNA, 19 nt, Shigella flexneri 2a str. 2457T
gacuguacagauccgccau

SEQ ID NO: 1932184 - RNA, 20 nt, Shigella flexneri 2a str. 2457T
gacuuaccagcccuaauaaa

SEQ ID NO: 1932185 - RNA, 15 nt, Shigella flexneri 2a str. 2457T
gacuuauaagucuca

SEQ ID NO: 1932186 - RNA, 12 nt, Shigella flexneri 2a str. 2457T
gacuguuccagc

SEQ ID NO: 1932187 - RNA, 21 nt, Shigella flexneri 2a str. 2457T
gacuguuauugcgcaggcgcg

SEQ ID NO: 1932188 - RNA, 18 nt, Shigella flexneri 2a str. 2457T
gacugucagaugcggcuu

SEQ ID NO: 1932189 - RNA, 18 nt, Shigella flexneri 2a str. 2457T
gacugucgcagccagcgc

SEQ ID NO: 1932190 - RNA, 14 nt, Shigella flexneri 2a str. 2457T
gacuucagauaaau

SEQ ID NO: 1932191 - RNA, 17 nt, Shigella flexneri 2a str. 2457T
gacuucaugcgcagcau

SEQ ID NO: 1932192 - RNA, 14 nt, Shigella flexneri 2a str. 2457T
gacuuauucuucaa

SEQ ID NO: 1932193 - RNA, 23 nt, Shigella flexneri 2a str. 2457T
gacuugcucaggaguaaacuuuc

SEQ ID NO: 1932194 - RNA, 12 nt, Shigella flexneri 2a str. 2457T
gacuucugcuuu

SEQ ID NO: 1932195 - RNA, 14 nt, Shigella flexneri 2a str. 2457T
gacuucuucauuca

SEQ ID NO: 1932196 - RNA, 17 nt, Shigella flexneri 2a str. 2457T
gacuucuucauucaucc

SEQ ID NO: 1932197 - RNA, 22 nt, Shigella flexneri 2a str. 2457T
gacauaaaauaaccaaauaaaa

SEQ ID NO: 1932198 - RNA, 16 nt, Shigella flexneri 2a str. 2457T
gacauaaacaccagca

SEQ ID NO: 1932199 - RNA, 18 nt, Shigella flexneri 2a str. 2457T
gacauaaacauuccacuu

SEQ ID NO: 1932200 - RNA, 17 nt, Shigella flexneri 2a str. 2457T
gacaguuucaccugcug

SEQ ID NO: 1932201 - RNA, 17 nt, Shigella flexneri 2a str. 2457T
gacaguuaucaaauuca

SEQ ID NO: 1932202 - RNA, 20 nt, Shigella flexneri 2a str. 2457T
gacagugggauuaaaaagua

SEQ ID NO: 1932203 - RNA, 16 nt, Shigella flexneri 2a str. 2457T
gacauaguagccagcc

SEQ ID NO: 1932204 - RNA, 16 nt, Shigella flexneri 2a str. 2457T
gacauauaaccggcaa

SEQ ID NO: 1932205 - RNA, 18 nt, Shigella flexneri 2a str. 2457T
gacaucaauaaacaauga

SEQ ID NO: 1932206 - RNA, 13 nt, Shigella flexneri 2a str. 2457T
gacaucaagaaau

SEQ ID NO: 1932207 - RNA, 17 nt, Shigella flexneri 2a str. 2457T
gacaucaacgaugccuu

SEQ ID NO: 1932208 - RNA, 19 nt, Shigella flexneri 2a str. 2457T
gacaggcggcccagugagu

SEQ ID NO: 1932209 - RNA, 19 nt, Shigella flexneri 2a str. 2457T
gacagggugagcagggcac

SEQ ID NO: 1932210 - RNA, 18 nt, Shigella flexneri 2a str. 2457T
gacagggaucucuuccag

SEQ ID NO: 1932211 - RNA, 17 nt, Shigella flexneri 2a str. 2457T
gacaggcgaaacccgcu

SEQ ID NO: 1932212 - RNA, 13 nt, Shigella flexneri 2a str. 2457T
gacaguaaaguuu

SEQ ID NO: 1932213 - RNA, 15 nt, Shigella flexneri 2a str. 2457T
gacaggucaaaguaa

SEQ ID NO: 1932214 - RNA, 22 nt, Shigella flexneri 2a str. 2457T
gacaggucagcgccuggcugca

SEQ ID NO: 1932215 - RNA, 19 nt, Shigella flexneri 2a str. 2457T
gacaggucagcgccuggcu

SEQ ID NO: 1932216 - RNA, 18 nt, Shigella flexneri 2a str. 2457T
gacaguaccagcaguaca

SEQ ID NO: 1932217 - RNA, 16 nt, Shigella flexneri 2a str. 2457T
gacaguacccagauuc

SEQ ID NO: 1932218 - RNA, 19 nt, Shigella flexneri 2a str. 2457T
gacaguaucaucauuauua

SEQ ID NO: 1932219 - RNA, 14 nt, Shigella flexneri 2a str. 2457T
gacaguaucaucau

SEQ ID NO: 1932220 - RNA, 19 nt, Shigella flexneri 2a str. 2457T
gacagugacuuccguccca

SEQ ID NO: 1932221 - RNA, 15 nt, Shigella flexneri 2a str. 2457T
gacagucuggaagcc

SEQ ID NO: 1932222 - RNA, 22 nt, Shigella flexneri 2a str. 2457T
gacaguccccucgccccuccgg

SEQ ID NO: 1932223 - RNA, 23 nt, Shigella flexneri 2a str. 2457T
gacaucgccacggcaugaaagcg

SEQ ID NO: 1932224 - RNA, 18 nt, Shigella flexneri 2a str. 2457T
gacaucccggcagagaaa

SEQ ID NO: 1932225 - RNA, 22 nt, Shigella flexneri 2a str. 2457T
gacaugaucuuuuuauugaaga

SEQ ID NO: 1932226 - RNA, 13 nt, Shigella flexneri 2a str. 2457T
gacaugacccggc

SEQ ID NO: 1932227 - RNA, 23 nt, Shigella flexneri 2a str. 2457T
gacaucuuucugcgcaucuuccc

SEQ ID NO: 1932228 - RNA, 22 nt, Shigella flexneri 2a str. 2457T
gacaucuuucugcgcaucuucc

SEQ ID NO: 1932229 - RNA, 21 nt, Shigella flexneri 2a str. 2457T
gacauguggauuaaauugcgc

SEQ ID NO: 1932230 - RNA, 22 nt, Shigella flexneri 2a str. 2457T
gacauuaaguguccgccaauuu

SEQ ID NO: 1932231 - RNA, 12 nt, Shigella flexneri 2a str. 2457T
gacaugauucau

SEQ ID NO: 1932232 - RNA, 22 nt, Shigella flexneri 2a str. 2457T
gacaugcaucacgcgcaucugu

SEQ ID NO: 1932233 - RNA, 19 nt, Shigella flexneri 2a str. 2457T
gacauucgcgcacggugca

SEQ ID NO: 1932234 - RNA, 15 nt, Shigella flexneri 2a str. 2457T
gacauucugacuggu

SEQ ID NO: 1932235 - RNA, 20 nt, Shigella flexneri 2a str. 2457T
gacauugcguuuaguuacac

SEQ ID NO: 1932236 - RNA, 22 nt, Shigella flexneri 2a str. 2457T
gacauugaguuuacgcagcaga

SEQ ID NO: 1932237 - RNA, 18 nt, Shigella flexneri 2a str. 2457T
gacauuguuuccauaugu

SEQ ID NO: 1932238 - RNA, 14 nt, Shigella flexneri 2a str. 2457T
gacauuuuggacaa

SEQ ID NO: 1932239 - RNA, 16 nt, Shigella flexneri 2a str. 2457T
gaccaggccaucagca

SEQ ID NO: 1932240 - RNA, 16 nt, Shigella flexneri 2a str. 2457T
gaccaggcaaaccagu

SEQ ID NO: 1932241 - RNA, 23 nt, Shigella flexneri 2a str. 2457T
gaccagcugccgacgccaguucu

SEQ ID NO: 1932242 - RNA, 19 nt, Shigella flexneri 2a str. 2457T
gaccagcugccgacgccag

SEQ ID NO: 1932243 - RNA, 16 nt, Shigella flexneri 2a str. 2457T
gaccaggaaacccaac

SEQ ID NO: 1932244 - RNA, 15 nt, Shigella flexneri 2a str. 2457T
gaccagcaacaaaua

SEQ ID NO: 1932245 - RNA, 16 nt, Shigella flexneri 2a str. 2457T
gaccagcaacaaauaa

SEQ ID NO: 1932246 - RNA, 22 nt, Shigella flexneri 2a str. 2457T
gaccagcgauaaaaauccgcca

SEQ ID NO: 1932247 - RNA, 17 nt, Shigella flexneri 2a str. 2457T
gaccagccgcuaccagc

SEQ ID NO: 1932248 - RNA, 22 nt, Shigella flexneri 2a str. 2457T
gaccagcgccgcaacuaccagc

SEQ ID NO: 1932249 - RNA, 16 nt, Shigella flexneri 2a str. 2457T
gaccagcuccagcaga

SEQ ID NO: 1932250 - RNA, 20 nt, Shigella flexneri 2a str. 2457T
gaccagcgucgcaucaggca

SEQ ID NO: 1932251 - RNA, 21 nt, Shigella flexneri 2a str. 2457T
gaccagcgucgcaucaggcau

SEQ ID NO: 1932252 - RNA, 13 nt, Shigella flexneri 2a str. 2457T
gaccaauccgcca

SEQ ID NO: 1932253 - RNA, 20 nt, Shigella flexneri 2a str. 2457T
gaccaaucacacaaccaugc

SEQ ID NO: 1932254 - RNA, 14 nt, Shigella flexneri 2a str. 2457T
gaccaaucaccacu

SEQ ID NO: 1932255 - RNA, 13 nt, Shigella flexneri 2a str. 2457T
gaccaauccagcc

SEQ ID NO: 1932256 - RNA, 13 nt, Shigella flexneri 2a str. 2457T
gaccaccagcacg

SEQ ID NO: 1932257 - RNA, 20 nt, Shigella flexneri 2a str. 2457T
gaccaaaggcgaugcuguau

SEQ ID NO: 1932258 - RNA, 18 nt, Shigella flexneri 2a str. 2457T
gaccacggccacagccag

SEQ ID NO: 1932259 - RNA, 23 nt, Shigella flexneri 2a str. 2457T
gaccacuuuccucaucagaaaga

SEQ ID NO: 1932260 - RNA, 15 nt, Shigella flexneri 2a str. 2457T
gaccacuucaugccc

SEQ ID NO: 1932261 - RNA, 19 nt, Shigella flexneri 2a str. 2457T
gaccaccauauucgccacc

SEQ ID NO: 1932262 - RNA, 17 nt, Shigella flexneri 2a str. 2457T
gaccacccaccgcagcc

SEQ ID NO: 1932263 - RNA, 21 nt, Shigella flexneri 2a str. 2457T
gaccacccaccgcagcccaga

SEQ ID NO: 1932264 - RNA, 13 nt, Shigella flexneri 2a str. 2457T
gaccaccgcgcua

SEQ ID NO: 1932265 - RNA, 23 nt, Shigella flexneri 2a str. 2457T
cuuuggggaggggucguuuuuua

SEQ ID NO: 1932266 - RNA, 21 nt, Shigella flexneri 2a str. 2457T
gaauuugucgauuuccaucuc

SEQ ID NO: 1932267 - RNA, 14 nt, Shigella flexneri 2a str. 2457T
gacaaaaauaccac

SEQ ID NO: 1932268 - RNA, 15 nt, Shigella flexneri 2a str. 2457T
gaauuuuccuucgga

SEQ ID NO: 1932269 - RNA, 12 nt, Shigella flexneri 2a str. 2457T
gaauuuuccuuc

SEQ ID NO: 1932270 - RNA, 14 nt, Shigella flexneri 2a str. 2457T
gaauuuuuccguug

SEQ ID NO: 1932271 - RNA, 19 nt, Shigella flexneri 2a str. 2457T
gaauuuuuccguugcugau

SEQ ID NO: 1932272 - RNA, 23 nt, Shigella flexneri 2a str. 2457T
gacaacaaacgcaaacaccagcg

SEQ ID NO: 1932273 - RNA, 15 nt, Shigella flexneri 2a str. 2457T
gacaaagacaucaaa

SEQ ID NO: 1932274 - RNA, 12 nt, Shigella flexneri 2a str. 2457T
gacaaagcauga

SEQ ID NO: 1932275 - RNA, 13 nt, Shigella flexneri 2a str. 2457T
gacaaaauguucg

SEQ ID NO: 1932276 - RNA, 12 nt, Shigella flexneri 2a str. 2457T
gacaaaauccug

SEQ ID NO: 1932277 - RNA, 17 nt, Shigella flexneri 2a str. 2457T
gacaaaaucggaaacaa

SEQ ID NO: 1932278 - RNA, 23 nt, Shigella flexneri 2a str. 2457T
gacaaacacgguuaguucaaugc

SEQ ID NO: 1932279 - RNA, 21 nt, Shigella flexneri 2a str. 2457T
gacaaacacaauauucauagu

SEQ ID NO: 1932280 - RNA, 20 nt, Shigella flexneri 2a str. 2457T
gacaaacaccgaaccagaga

SEQ ID NO: 1932281 - RNA, 19 nt, Shigella flexneri 2a str. 2457T
gacaaacaggaaguuucag

SEQ ID NO: 1932282 - RNA, 13 nt, Shigella flexneri 2a str. 2457T
gacaagaauacaa

SEQ ID NO: 1932283 - RNA, 13 nt, Shigella flexneri 2a str. 2457T
gacaagcuuacgu

SEQ ID NO: 1932284 - RNA, 17 nt, Shigella flexneri 2a str. 2457T
gacaagcgucgcaucag

SEQ ID NO: 1932285 - RNA, 21 nt, Shigella flexneri 2a str. 2457T
gacaagcuuacguuacccagc

SEQ ID NO: 1932286 - RNA, 19 nt, Shigella flexneri 2a str. 2457T
gacaagcguaugauugccu

SEQ ID NO: 1932287 - RNA, 17 nt, Shigella flexneri 2a str. 2457T
gacaagauacugccgau

SEQ ID NO: 1932288 - RNA, 22 nt, Shigella flexneri 2a str. 2457T
gacaaggcaggcaucaaugaaa

SEQ ID NO: 1932289 - RNA, 21 nt, Shigella flexneri 2a str. 2457T
gacaaccugaccuuuuuucag

SEQ ID NO: 1932290 - RNA, 18 nt, Shigella flexneri 2a str. 2457T
gacaaccagcuucaacga

SEQ ID NO: 1932291 - RNA, 19 nt, Shigella flexneri 2a str. 2457T
gacaacgcuuuuugguuca

SEQ ID NO: 1932292 - RNA, 20 nt, Shigella flexneri 2a str. 2457T
gacaacgccuuguucgcccu

SEQ ID NO: 1932293 - RNA, 15 nt, Shigella flexneri 2a str. 2457T
gacaaugcaguucca

SEQ ID NO: 1932294 - RNA, 15 nt, Shigella flexneri 2a str. 2457T
gacaaucacaucacu

SEQ ID NO: 1932295 - RNA, 17 nt, Shigella flexneri 2a str. 2457T
gacaaucaccaggucac

SEQ ID NO: 1932296 - RNA, 21 nt, Shigella flexneri 2a str. 2457T
gacaauaauacccagcaccgc

SEQ ID NO: 1932297 - RNA, 12 nt, Shigella flexneri 2a str. 2457T
gacaauaauauc

SEQ ID NO: 1932298 - RNA, 16 nt, Shigella flexneri 2a str. 2457T
gacaaucaaccagcac

SEQ ID NO: 1932299 - RNA, 19 nt, Shigella flexneri 2a str. 2457T
gacaauaugcucuccacca

SEQ ID NO: 1932300 - RNA, 20 nt, Shigella flexneri 2a str. 2457T
gacagagguggucgcagcgg

SEQ ID NO: 1932301 - RNA, 22 nt, Shigella flexneri 2a str. 2457T
gacagagauucgguaaccaucc

SEQ ID NO: 1932302 - RNA, 22 nt, Shigella flexneri 2a str. 2457T
gacagauuuugccagcaugacu

SEQ ID NO: 1932303 - RNA, 15 nt, Shigella flexneri 2a str. 2457T
gacagauucaugcug

SEQ ID NO: 1932304 - RNA, 20 nt, Shigella flexneri 2a str. 2457T
gacagauucaugcugcggcu

SEQ ID NO: 1932305 - RNA, 21 nt, Shigella flexneri 2a str. 2457T
gacagaacucguucagcgcau

SEQ ID NO: 1932306 - RNA, 22 nt, Shigella flexneri 2a str. 2457T
gacacugacgcgucuuaucugg

SEQ ID NO: 1932307 - RNA, 23 nt, Shigella flexneri 2a str. 2457T
gacacuuuaucuaucaggacgaa

SEQ ID NO: 1932308 - RNA, 16 nt, Shigella flexneri 2a str. 2457T
gacacugcugauaauc

SEQ ID NO: 1932309 - RNA, 18 nt, Shigella flexneri 2a str. 2457T
gacacugccggaagagag

SEQ ID NO: 1932310 - RNA, 19 nt, Shigella flexneri 2a str. 2457T
gacagaccaaaacgugcag

SEQ ID NO: 1932311 - RNA, 23 nt, Shigella flexneri 2a str. 2457T
gacagacgacgacgcgcgcgggu

SEQ ID NO: 1932312 - RNA, 12 nt, Shigella flexneri 2a str. 2457T
gacagacuggcu

SEQ ID NO: 1932313 - RNA, 18 nt, Shigella flexneri 2a str. 2457T
gacagcgccuuuucuuua

SEQ ID NO: 1932314 - RNA, 17 nt, Shigella flexneri 2a str. 2457T
gacagccgaaaagguag

SEQ ID NO: 1932315 - RNA, 12 nt, Shigella flexneri 2a str. 2457T
gacagcaugggg

SEQ ID NO: 1932316 - RNA, 18 nt, Shigella flexneri 2a str. 2457T
gacagcaucguccgccag

SEQ ID NO: 1932317 - RNA, 20 nt, Shigella flexneri 2a str. 2457T
gacagccauccgucauccau

SEQ ID NO: 1932318 - RNA, 16 nt, Shigella flexneri 2a str. 2457T
gacacgcgcgcauggu

SEQ ID NO: 1932319 - RNA, 22 nt, Shigella flexneri 2a str. 2457T
gacacgggaaaccaacuccagc

SEQ ID NO: 1932320 - RNA, 18 nt, Shigella flexneri 2a str. 2457T
gacacugaaugacgacgu

SEQ ID NO: 1932321 - RNA, 13 nt, Shigella flexneri 2a str. 2457T
gacacuccuuccu

SEQ ID NO: 1932322 - RNA, 18 nt, Shigella flexneri 2a str. 2457T
gacaccagcucagugacc

SEQ ID NO: 1932323 - RNA, 14 nt, Shigella flexneri 2a str. 2457T
gacaccauaacaga

SEQ ID NO: 1932324 - RNA, 20 nt, Shigella flexneri 2a str. 2457T
gacaccauaacagaggccac

SEQ ID NO: 1932325 - RNA, 16 nt, Shigella flexneri 2a str. 2457T
gacaccagcacaucau

SEQ ID NO: 1932326 - RNA, 17 nt, Shigella flexneri 2a str. 2457T
gacaccaaggaacugug

SEQ ID NO: 1932327 - RNA, 17 nt, Shigella flexneri 2a str. 2457T
gacaccccuucauucag

SEQ ID NO: 1932328 - RNA, 18 nt, Shigella flexneri 2a str. 2457T
gacaccccacagcucuug

SEQ ID NO: 1932329 - RNA, 21 nt, Shigella flexneri 2a str. 2457T
gacaauuuaccgacgcugcuc

SEQ ID NO: 1932330 - RNA, 13 nt, Shigella flexneri 2a str. 2457T
gacaauuugccca

SEQ ID NO: 1932331 - RNA, 18 nt, Shigella flexneri 2a str. 2457T
gacaauuuguuggcgaaa

SEQ ID NO: 1932332 - RNA, 15 nt, Shigella flexneri 2a str. 2457T
gacacaacuggcgca

SEQ ID NO: 1932333 - RNA, 14 nt, Shigella flexneri 2a str. 2457T
gacacaggcagcaa

SEQ ID NO: 1932334 - RNA, 22 nt, Shigella flexneri 2a str. 2457T
gacgacuggccgaaaaaggauc

SEQ ID NO: 1932335 - RNA, 17 nt, Shigella flexneri 2a str. 2457T
gacgauagaaccuucca

SEQ ID NO: 1932336 - RNA, 22 nt, Shigella flexneri 2a str. 2457T
gacgauuguagaaaaucucaau

SEQ ID NO: 1932337 - RNA, 14 nt, Shigella flexneri 2a str. 2457T
gacgauugugcugg

SEQ ID NO: 1932338 - RNA, 15 nt, Shigella flexneri 2a str. 2457T
gacgauugugcuggu

SEQ ID NO: 1932339 - RNA, 17 nt, Shigella flexneri 2a str. 2457T
gacgcaaaguagcggcc

SEQ ID NO: 1932340 - RNA, 12 nt, Shigella flexneri 2a str. 2457T
gacgcagcaugc

SEQ ID NO: 1932341 - RNA, 23 nt, Shigella flexneri 2a str. 2457T
gacgcagaccaaagucaaacugg

SEQ ID NO: 1932342 - RNA, 17 nt, Shigella flexneri 2a str. 2457T
gacgaaagucugggccg

SEQ ID NO: 1932343 - RNA, 13 nt, Shigella flexneri 2a str. 2457T
gacgaaccggcac

SEQ ID NO: 1932344 - RNA, 18 nt, Shigella flexneri 2a str. 2457T
gacgaacguuuaauaaaa

SEQ ID NO: 1932345 - RNA, 14 nt, Shigella flexneri 2a str. 2457T
gacgaacuggcgca

SEQ ID NO: 1932346 - RNA, 15 nt, Shigella flexneri 2a str. 2457T
gacgaacuucacggu

SEQ ID NO: 1932347 - RNA, 17 nt, Shigella flexneri 2a str. 2457T
gaccuuaucgaagaggg

SEQ ID NO: 1932348 - RNA, 15 nt, Shigella flexneri 2a str. 2457T
gaccuucugccagac

SEQ ID NO: 1932349 - RNA, 18 nt, Shigella flexneri 2a str. 2457T
gaccuuucgaacccaacc

SEQ ID NO: 1932350 - RNA, 17 nt, Shigella flexneri 2a str. 2457T
gaccuucuucagcaaua

SEQ ID NO: 1932351 - RNA, 15 nt, Shigella flexneri 2a str. 2457T
gacgacaggcaagca

SEQ ID NO: 1932352 - RNA, 12 nt, Shigella flexneri 2a str. 2457T
gacgacaggcaa

SEQ ID NO: 1932353 - RNA, 13 nt, Shigella flexneri 2a str. 2457T
gacgacaccaucu

SEQ ID NO: 1932354 - RNA, 19 nt, Shigella flexneri 2a str. 2457T
gacgacaaucaaccagcac

SEQ ID NO: 1932355 - RNA, 15 nt, Shigella flexneri 2a str. 2457T
gacgaccugauuuug

SEQ ID NO: 1932356 - RNA, 15 nt, Shigella flexneri 2a str. 2457T
gacgacgacgcgcgc

SEQ ID NO: 1932357 - RNA, 20 nt, Shigella flexneri 2a str. 2457T
gacgcuccaguguggccaga

SEQ ID NO: 1932358 - RNA, 18 nt, Shigella flexneri 2a str. 2457T
gacgcgugcgccaaguuu

SEQ ID NO: 1932359 - RNA, 22 nt, Shigella flexneri 2a str. 2457T
gacgcggcauuuuuacugcgcg

SEQ ID NO: 1932360 - RNA, 19 nt, Shigella flexneri 2a str. 2457T
gacggaaaucgggagagau

SEQ ID NO: 1932361 - RNA, 16 nt, Shigella flexneri 2a str. 2457T
gacgcuggcagaaagu

SEQ ID NO: 1932362 - RNA, 16 nt, Shigella flexneri 2a str. 2457T
gacggaauaaacccac

SEQ ID NO: 1932363 - RNA, 14 nt, Shigella flexneri 2a str. 2457T
gacgcccccaaacu

SEQ ID NO: 1932364 - RNA, 21 nt, Shigella flexneri 2a str. 2457T
gacgccccggccuugccuguu

SEQ ID NO: 1932365 - RNA, 12 nt, Shigella flexneri 2a str. 2457T
gacgccagcgcu

SEQ ID NO: 1932366 - RNA, 17 nt, Shigella flexneri 2a str. 2457T
gacgccauucacuggca

SEQ ID NO: 1932367 - RNA, 12 nt, Shigella flexneri 2a str. 2457T
gacgcaguccag

SEQ ID NO: 1932368 - RNA, 13 nt, Shigella flexneri 2a str. 2457T
gacgcagucaugc

SEQ ID NO: 1932369 - RNA, 13 nt, Shigella flexneri 2a str. 2457T
gacgcgccagcac

SEQ ID NO: 1932370 - RNA, 14 nt, Shigella flexneri 2a str. 2457T
gacgcgccagcacc

SEQ ID NO: 1932371 - RNA, 14 nt, Shigella flexneri 2a str. 2457T
gacgcgauccgccg

SEQ ID NO: 1932372 - RNA, 12 nt, Shigella flexneri 2a str. 2457T
gaccauaaaagg

SEQ ID NO: 1932373 - RNA, 17 nt, Shigella flexneri 2a str. 2457T
gaccauaaauaugguga

SEQ ID NO: 1932374 - RNA, 16 nt, Shigella flexneri 2a str. 2457T
gaccauauuagccgcc

SEQ ID NO: 1932375 - RNA, 17 nt, Shigella flexneri 2a str. 2457T
gaccauauuagccgcca

SEQ ID NO: 1932376 - RNA, 18 nt, Shigella flexneri 2a str. 2457T
gaccaucuuccaguugca

SEQ ID NO: 1932377 - RNA, 19 nt, Shigella flexneri 2a str. 2457T
gaccaucuccuuacugccc

SEQ ID NO: 1932378 - RNA, 20 nt, Shigella flexneri 2a str. 2457T
gacccagcaccaguaccauu

SEQ ID NO: 1932379 - RNA, 15 nt, Shigella flexneri 2a str. 2457T
gaccauuaucauuac

SEQ ID NO: 1932380 - RNA, 18 nt, Shigella flexneri 2a str. 2457T
gacccagccagacgccag

SEQ ID NO: 1932381 - RNA, 17 nt, Shigella flexneri 2a str. 2457T
gacccaucugccagcgc

SEQ ID NO: 1932382 - RNA, 17 nt, Shigella flexneri 2a str. 2457T
gaccgauugauucccaa

SEQ ID NO: 1932383 - RNA, 18 nt, Shigella flexneri 2a str. 2457T
gaccgauggguucagaau

SEQ ID NO: 1932384 - RNA, 17 nt, Shigella flexneri 2a str. 2457T
gaccgaugucgucccuu

SEQ ID NO: 1932385 - RNA, 12 nt, Shigella flexneri 2a str. 2457T
gaccgccaggca

SEQ ID NO: 1932386 - RNA, 14 nt, Shigella flexneri 2a str. 2457T
gaccgccaccggcc

SEQ ID NO: 1932387 - RNA, 13 nt, Shigella flexneri 2a str. 2457T
gaccgccagcgcc

SEQ ID NO: 1932388 - RNA, 14 nt, Shigella flexneri 2a str. 2457T
gaccgaaugcaguc

SEQ ID NO: 1932389 - RNA, 15 nt, Shigella flexneri 2a str. 2457T
gacccgcagccagca

SEQ ID NO: 1932390 - RNA, 15 nt, Shigella flexneri 2a str. 2457T
gacccggcggcgcgc

SEQ ID NO: 1932391 - RNA, 19 nt, Shigella flexneri 2a str. 2457T
gacccguuuacggcuaaaa

SEQ ID NO: 1932392 - RNA, 18 nt, Shigella flexneri 2a str. 2457T
gaccugaauuugcuccag

SEQ ID NO: 1932393 - RNA, 19 nt, Shigella flexneri 2a str. 2457T
gaccugaauuugcuccaga

SEQ ID NO: 1932394 - RNA, 23 nt, Shigella flexneri 2a str. 2457T
gaccucuuaaugcaggcagcacu

SEQ ID NO: 1932395 - RNA, 16 nt, Shigella flexneri 2a str. 2457T
gaccugauuuugcaac

SEQ ID NO: 1932396 - RNA, 19 nt, Shigella flexneri 2a str. 2457T
gaccugcccaaucaugaac

SEQ ID NO: 1932397 - RNA, 21 nt, Shigella flexneri 2a str. 2457T
gaccugcgucaccacauccag

SEQ ID NO: 1932398 - RNA, 16 nt, Shigella flexneri 2a str. 2457T
gaccuggcgcuucacu

SEQ ID NO: 1932399 - RNA, 14 nt, Shigella flexneri 2a str. 2457T
gaccuaccaucucc

SEQ ID NO: 1932400 - RNA, 18 nt, Shigella flexneri 2a str. 2457T
gaccuacgcgcccgcgca

SEQ ID NO: 1932401 - RNA, 18 nt, Shigella flexneri 2a str. 2457T
gaccuaaacguuuaaaaa

SEQ ID NO: 1932402 - RNA, 15 nt, Shigella flexneri 2a str. 2457T
gaccguuuucaccag

SEQ ID NO: 1932403 - RNA, 22 nt, Shigella flexneri 2a str. 2457T
gaccguuagcauauugcaggcu

SEQ ID NO: 1932404 - RNA, 24 nt, Shigella flexneri 2a str. 2457T
gaccguugauuuuauuggcauggu

SEQ ID NO: 1932405 - RNA, 18 nt, Shigella flexneri 2a str. 2457T
gaccguuccauucaaacg

SEQ ID NO: 1932406 - RNA, 19 nt, Shigella flexneri 2a str. 2457T
gaccgugaucguggccaug

SEQ ID NO: 1932407 - RNA, 14 nt, Shigella flexneri 2a str. 2457T
gaccucaacaaaau

SEQ ID NO: 1932408 - RNA, 14 nt, Shigella flexneri 2a str. 2457T
gaccuagcaaacua

SEQ ID NO: 1932409 - RNA, 15 nt, Shigella flexneri 2a str. 2457T
gaccucacuuucugg

SEQ ID NO: 1932410 - RNA, 22 nt, Shigella flexneri 2a str. 2457T
gaccucacuuucuggcagcugc

SEQ ID NO: 1932411 - RNA, 16 nt, Shigella flexneri 2a str. 2457T
gaccguccaggcgguc

SEQ ID NO: 1932412 - RNA, 22 nt, Shigella flexneri 2a str. 2457T
gaccggcaaucgcgccagaaca

SEQ ID NO: 1932413 - RNA, 18 nt, Shigella flexneri 2a str. 2457T
gaccggaaaagguguuca

SEQ ID NO: 1932414 - RNA, 20 nt, Shigella flexneri 2a str. 2457T
gaccggcgucgcauccggca

SEQ ID NO: 1932415 - RNA, 23 nt, Shigella flexneri 2a str. 2457T
gaccgcuucaaaguucugugucu

SEQ ID NO: 1932416 - RNA, 20 nt, Shigella flexneri 2a str. 2457T
cguuaguucgcguaacugcu

SEQ ID NO: 1932417 - RNA, 20 nt, Shigella flexneri 2a str. 2457T
cguuauccggcuaacaaaau

SEQ ID NO: 1932418 - RNA, 12 nt, Shigella flexneri 2a str. 2457T
cguuaucaccug

SEQ ID NO: 1932419 - RNA, 17 nt, Shigella flexneri 2a str. 2457T
cguuaucagcaacuggc

SEQ ID NO: 1932420 - RNA, 19 nt, Shigella flexneri 2a str. 2457T
cguuaucccaucccacuca

SEQ ID NO: 1932421 - RNA, 21 nt, Shigella flexneri 2a str. 2457T
cgucaugguauagagauagca

SEQ ID NO: 1932422 - RNA, 20 nt, Shigella flexneri 2a str. 2457T
cgucauuucgaagaaaccga

SEQ ID NO: 1932423 - RNA, 13 nt, Shigella flexneri 2a str. 2457T
cguccacacggca

SEQ ID NO: 1932424 - RNA, 19 nt, Shigella flexneri 2a str. 2457T
cguuccuacaacugggaca

SEQ ID NO: 1932425 - RNA, 13 nt, Shigella flexneri 2a str. 2457T
cguuccugcaacg

SEQ ID NO: 1932426 - RNA, 14 nt, Shigella flexneri 2a str. 2457T
cguuccuggggaaa

SEQ ID NO: 1932427 - RNA, 15 nt, Shigella flexneri 2a str. 2457T
cguucgaacuggaua

SEQ ID NO: 1932428 - RNA, 16 nt, Shigella flexneri 2a str. 2457T
cguucauuaacgcccc

SEQ ID NO: 1932429 - RNA, 20 nt, Shigella flexneri 2a str. 2457T
cguuccaccacguuuuucaa

SEQ ID NO: 1932430 - RNA, 16 nt, Shigella flexneri 2a str. 2457T
cguuauguaacaacug

SEQ ID NO: 1932431 - RNA, 15 nt, Shigella flexneri 2a str. 2457T
cguuaugucucccgc

SEQ ID NO: 1932432 - RNA, 15 nt, Shigella flexneri 2a str. 2457T
cguucagucgccggg

SEQ ID NO: 1932433 - RNA, 17 nt, Shigella flexneri 2a str. 2457T
cguugcgcgucaacugu

SEQ ID NO: 1932434 - RNA, 17 nt, Shigella flexneri 2a str. 2457T
cguugcgcuucucaggc

SEQ ID NO: 1932435 - RNA, 17 nt, Shigella flexneri 2a str. 2457T
cguugcccggagcagca

SEQ ID NO: 1932436 - RNA, 18 nt, Shigella flexneri 2a str. 2457T
cguugcccggagcagcag

SEQ ID NO: 1932437 - RNA, 21 nt, Shigella flexneri 2a str. 2457T
cguugauuuugucauggcgca

SEQ ID NO: 1932438 - RNA, 19 nt, Shigella flexneri 2a str. 2457T
cguucguagaaaaaacagc

SEQ ID NO: 1932439 - RNA, 14 nt, Shigella flexneri 2a str. 2457T
cguugaccaccaua

SEQ ID NO: 1932440 - RNA, 15 nt, Shigella flexneri 2a str. 2457T
cguugaauuucaggu

SEQ ID NO: 1932441 - RNA, 22 nt, Shigella flexneri 2a str. 2457T
cguugaggauggcgucgauaau

SEQ ID NO: 1932442 - RNA, 20 nt, Shigella flexneri 2a str. 2457T
cguugagaauggccaaucac

SEQ ID NO: 1932443 - RNA, 20 nt, Shigella flexneri 2a str. 2457T
cguugaugccgugcagcacg

SEQ ID NO: 1932444 - RNA, 21 nt, Shigella flexneri 2a str. 2457T
cguugaucacccacaucagcg

SEQ ID NO: 1932445 - RNA, 13 nt, Shigella flexneri 2a str. 2457T
cguugaucgcuuu

SEQ ID NO: 1932446 - RNA, 15 nt, Shigella flexneri 2a str. 2457T
cuaaacgcuggcagg

SEQ ID NO: 1932447 - RNA, 16 nt, Shigella flexneri 2a str. 2457T
cuaaaguuguuuucuu

SEQ ID NO: 1932448 - RNA, 18 nt, Shigella flexneri 2a str. 2457T
cuaaaguacguaaaacaa

SEQ ID NO: 1932449 - RNA, 17 nt, Shigella flexneri 2a str. 2457T
cuaaaggcaaaaugcca

SEQ ID NO: 1932450 - RNA, 14 nt, Shigella flexneri 2a str. 2457T
cuaaagccugcuuu

SEQ ID NO: 1932451 - RNA, 18 nt, Shigella flexneri 2a str. 2457T
cuaaagccuuuugccagu

SEQ ID NO: 1932452 - RNA, 18 nt, Shigella flexneri 2a str. 2457T
cuaaacguuuaaaaacuu

SEQ ID NO: 1932453 - RNA, 17 nt, Shigella flexneri 2a str. 2457T
cuaaacguuuaaaaacu

SEQ ID NO: 1932454 - RNA, 16 nt, Shigella flexneri 2a str. 2457T
cguuuuggcagacaac

SEQ ID NO: 1932455 - RNA, 20 nt, Shigella flexneri 2a str. 2457T
cguuuuggugaagugagaau

SEQ ID NO: 1932456 - RNA, 19 nt, Shigella flexneri 2a str. 2457T
cguuuucguuacuccgcca

SEQ ID NO: 1932457 - RNA, 17 nt, Shigella flexneri 2a str. 2457T
cguuucuucuacaggcu

SEQ ID NO: 1932458 - RNA, 13 nt, Shigella flexneri 2a str. 2457T
cguuucugcuggu

SEQ ID NO: 1932459 - RNA, 15 nt, Shigella flexneri 2a str. 2457T
cguuucuuucaucag

SEQ ID NO: 1932460 - RNA, 22 nt, Shigella flexneri 2a str. 2457T
cguuugauuaacgccagauuac

SEQ ID NO: 1932461 - RNA, 22 nt, Shigella flexneri 2a str. 2457T
cguuuucagguuacgcccuuca

SEQ ID NO: 1932462 - RNA, 23 nt, Shigella flexneri 2a str. 2457T
cguugugcaucaggcaaacuuca

SEQ ID NO: 1932463 - RNA, 16 nt, Shigella flexneri 2a str. 2457T
cguuguuaaggguaaa

SEQ ID NO: 1932464 - RNA, 13 nt, Shigella flexneri 2a str. 2457T
cguugcucuucuc

SEQ ID NO: 1932465 - RNA, 16 nt, Shigella flexneri 2a str. 2457T
cguugucagcaaccug

SEQ ID NO: 1932466 - RNA, 18 nt, Shigella flexneri 2a str. 2457T
cguuucagcgguuugaaa

SEQ ID NO: 1932467 - RNA, 20 nt, Shigella flexneri 2a str. 2457T
cguuucacugccggacguuc

SEQ ID NO: 1932468 - RNA, 12 nt, Shigella flexneri 2a str. 2457T
cguuuauuuccc

SEQ ID NO: 1932469 - RNA, 20 nt, Shigella flexneri 2a str. 2457T
cguuucuacaagcagagaga

SEQ ID NO: 1932470 - RNA, 19 nt, Shigella flexneri 2a str. 2457T
cguuuauugucguuaucgc

SEQ ID NO: 1932471 - RNA, 15 nt, Shigella flexneri 2a str. 2457T
cguuucaaaaacaaa

SEQ ID NO: 1932472 - RNA, 14 nt, Shigella flexneri 2a str. 2457T
cguuucaaaaacaa

SEQ ID NO: 1932473 - RNA, 19 nt, Shigella flexneri 2a str. 2457T
cguuguuccuuccagcugg

SEQ ID NO: 1932474 - RNA, 15 nt, Shigella flexneri 2a str. 2457T
cuaauaaugagcaga

SEQ ID NO: 1932475 - RNA, 16 nt, Shigella flexneri 2a str. 2457T
cuaauaaugagcagaa

SEQ ID NO: 1932476 - RNA, 15 nt, Shigella flexneri 2a str. 2457T
cuaagcaggcuggcu

SEQ ID NO: 1932477 - RNA, 17 nt, Shigella flexneri 2a str. 2457T
cuaaggucaccaguuca

SEQ ID NO: 1932478 - RNA, 16 nt, Shigella flexneri 2a str. 2457T
cuaaaucacaccauug

SEQ ID NO: 1932479 - RNA, 15 nt, Shigella flexneri 2a str. 2457T
cuaaucagcuuuucc

SEQ ID NO: 1932480 - RNA, 20 nt, Shigella flexneri 2a str. 2457T
cuaaucagcuuuuccauauc

SEQ ID NO: 1932481 - RNA, 15 nt, Shigella flexneri 2a str. 2457T
cuaaucaucaucagu

SEQ ID NO: 1932482 - RNA, 17 nt, Shigella flexneri 2a str. 2457T
cuaaucuugaaaccaga

SEQ ID NO: 1932483 - RNA, 11 nt, Shigella flexneri 2a str. 2457T
cuaaucugaau

SEQ ID NO: 1932484 - RNA, 15 nt, Shigella flexneri 2a str. 2457T
cuaauccugaagacg

SEQ ID NO: 1932485 - RNA, 17 nt, Shigella flexneri 2a str. 2457T
cuaaucgcuuuauagca

SEQ ID NO: 1932486 - RNA, 17 nt, Shigella flexneri 2a str. 2457T
cuaaucgcacaaaauca

SEQ ID NO: 1932487 - RNA, 23 nt, Shigella flexneri 2a str. 2457T
cuaaucguccgauuaaaaacccu

SEQ ID NO: 1932488 - RNA, 15 nt, Shigella flexneri 2a str. 2457T
cuaaugccugagaca

SEQ ID NO: 1932489 - RNA, 15 nt, Shigella flexneri 2a str. 2457T
cuacacacuggaucu

SEQ ID NO: 1932490 - RNA, 21 nt, Shigella flexneri 2a str. 2457T
cuacacauuaucucaacacac

SEQ ID NO: 1932491 - RNA, 17 nt, Shigella flexneri 2a str. 2457T
cuacaccaugccgguga

SEQ ID NO: 1932492 - RNA, 15 nt, Shigella flexneri 2a str. 2457T
cuacacccagccccg

SEQ ID NO: 1932493 - RNA, 14 nt, Shigella flexneri 2a str. 2457T
cuacaccccagcgu

SEQ ID NO: 1932494 - RNA, 22 nt, Shigella flexneri 2a str. 2457T
cuacaaauuugugcaaauucaa

SEQ ID NO: 1932495 - RNA, 23 nt, Shigella flexneri 2a str. 2457T
cuacaaauuugugcaaauucaau

SEQ ID NO: 1932496 - RNA, 22 nt, Shigella flexneri 2a str. 2457T
cuacaacuccguugaaauugcu

SEQ ID NO: 1932497 - RNA, 13 nt, Shigella flexneri 2a str. 2457T
cuacaagcagaga

SEQ ID NO: 1932498 - RNA, 22 nt, Shigella flexneri 2a str. 2457T
cuacaaguccguugaaaaugcu

SEQ ID NO: 1932499 - RNA, 18 nt, Shigella flexneri 2a str. 2457T
cuacaagcagagagacaa

SEQ ID NO: 1932500 - RNA, 20 nt, Shigella flexneri 2a str. 2457T
cuaauuuuucccucuucaau

SEQ ID NO: 1932501 - RNA, 19 nt, Shigella flexneri 2a str. 2457T
cuacaaacguugcugacug

SEQ ID NO: 1932502 - RNA, 23 nt, Shigella flexneri 2a str. 2457T
cuacaaaaucgugcaaauucaau

SEQ ID NO: 1932503 - RNA, 22 nt, Shigella flexneri 2a str. 2457T
cuaauuucgccgaggcgcuggc

SEQ ID NO: 1932504 - RNA, 20 nt, Shigella flexneri 2a str. 2457T
cuaauuuagugaccaaucau

SEQ ID NO: 1932505 - RNA, 14 nt, Shigella flexneri 2a str. 2457T
cuaccacaugauua

SEQ ID NO: 1932506 - RNA, 11 nt, Shigella flexneri 2a str. 2457T
cuaccagcacc

SEQ ID NO: 1932507 - RNA, 13 nt, Shigella flexneri 2a str. 2457T
cuaccagcugcca

SEQ ID NO: 1932508 - RNA, 23 nt, Shigella flexneri 2a str. 2457T
cuaccaugaccugcaaauucaau

SEQ ID NO: 1932509 - RNA, 13 nt, Shigella flexneri 2a str. 2457T
cuaccaucaaugg

SEQ ID NO: 1932510 - RNA, 23 nt, Shigella flexneri 2a str. 2457T
cuaccaucagguaauaggcaggc

SEQ ID NO: 1932511 - RNA, 19 nt, Shigella flexneri 2a str. 2457T
cuaccauuuguucuuuuuu

SEQ ID NO: 1932512 - RNA, 23 nt, Shigella flexneri 2a str. 2457T
cuacagagcgagggagaaaaccc

SEQ ID NO: 1932513 - RNA, 20 nt, Shigella flexneri 2a str. 2457T
cuacagccaugcgaaugcca

SEQ ID NO: 1932514 - RNA, 14 nt, Shigella flexneri 2a str. 2457T
cuacagccugguga

SEQ ID NO: 1932515 - RNA, 23 nt, Shigella flexneri 2a str. 2457T
cuacaggcaacgaccagaaaugc

SEQ ID NO: 1932516 - RNA, 17 nt, Shigella flexneri 2a str. 2457T
cuacaggauaucuggca

SEQ ID NO: 1932517 - RNA, 17 nt, Shigella flexneri 2a str. 2457T
cuacauauuuuucauau

SEQ ID NO: 1932518 - RNA, 19 nt, Shigella flexneri 2a str. 2457T
cucauagggugugacgaca

SEQ ID NO: 1932519 - RNA, 16 nt, Shigella flexneri 2a str. 2457T
cucauaauacaggcua

SEQ ID NO: 1932520 - RNA, 20 nt, Shigella flexneri 2a str. 2457T
cucaguuccgggaucaccag

SEQ ID NO: 1932521 - RNA, 18 nt, Shigella flexneri 2a str. 2457T
cucauaaauucaaagugu

SEQ ID NO: 1932522 - RNA, 22 nt, Shigella flexneri 2a str. 2457T
cucaggcgcacgccgacaaaga

SEQ ID NO: 1932523 - RNA, 22 nt, Shigella flexneri 2a str. 2457T
cucaggccuacaaaaucuugca

SEQ ID NO: 1932524 - RNA, 19 nt, Shigella flexneri 2a str. 2457T
cucaggccuacaaaaucuu

SEQ ID NO: 1932525 - RNA, 18 nt, Shigella flexneri 2a str. 2457T
cucaggcaguacgcggcg

SEQ ID NO: 1932526 - RNA, 19 nt, Shigella flexneri 2a str. 2457T
cucaggccgauuucaugaa

SEQ ID NO: 1932527 - RNA, 23 nt, Shigella flexneri 2a str. 2457T
cucaggccgauuucaugaagcug

SEQ ID NO: 1932528 - RNA, 23 nt, Shigella flexneri 2a str. 2457T
cucaggcgcacgccgacaaagau

SEQ ID NO: 1932529 - RNA, 13 nt, Shigella flexneri 2a str. 2457T
cucagucgcccag

SEQ ID NO: 1932530 - RNA, 16 nt, Shigella flexneri 2a str. 2457T
cucagcgccugcugca

SEQ ID NO: 1932531 - RNA, 14 nt, Shigella flexneri 2a str. 2457T
cucacuguucacuu

SEQ ID NO: 1932532 - RNA, 16 nt, Shigella flexneri 2a str. 2457T
cucacuguucacuuuu

SEQ ID NO: 1932533 - RNA, 20 nt, Shigella flexneri 2a str. 2457T
cucacugcgaaguuuuuccg

SEQ ID NO: 1932534 - RNA, 12 nt, Shigella flexneri 2a str. 2457T
cucauccaucaa

SEQ ID NO: 1932535 - RNA, 14 nt, Shigella flexneri 2a str. 2457T
cucauaugcagcau

SEQ ID NO: 1932536 - RNA, 18 nt, Shigella flexneri 2a str. 2457T
cucaucaggccuacaaaa

SEQ ID NO: 1932537 - RNA, 12 nt, Shigella flexneri 2a str. 2457T
cucaucaggccu

SEQ ID NO: 1932538 - RNA, 19 nt, Shigella flexneri 2a str. 2457T
cucaucagcgguaaaacgc

SEQ ID NO: 1932539 - RNA, 13 nt, Shigella flexneri 2a str. 2457T
cucauuuaaaauc

SEQ ID NO: 1932540 - RNA, 20 nt, Shigella flexneri 2a str. 2457T
cucauuuaaaaucgccccuc

SEQ ID NO: 1932541 - RNA, 13 nt, Shigella flexneri 2a str. 2457T
cucauuuaauauu

SEQ ID NO: 1932542 - RNA, 15 nt, Shigella flexneri 2a str. 2457T
cucauuguuagaugu

SEQ ID NO: 1932543 - RNA, 20 nt, Shigella flexneri 2a str. 2457T
cucauugguccaucuuuuug

SEQ ID NO: 1932544 - RNA, 22 nt, Shigella flexneri 2a str. 2457T
cuccaaggucuccgcccagcgu

SEQ ID NO: 1932545 - RNA, 14 nt, Shigella flexneri 2a str. 2457T
cuccaacuuacuga

SEQ ID NO: 1932546 - RNA, 21 nt, Shigella flexneri 2a str. 2457T
cucaacgccuaaugccagcga

SEQ ID NO: 1932547 - RNA, 11 nt, Shigella flexneri 2a str. 2457T
cucaacaaaau

SEQ ID NO: 1932548 - RNA, 12 nt, Shigella flexneri 2a str. 2457T
cucaacaggccc

SEQ ID NO: 1932549 - RNA, 15 nt, Shigella flexneri 2a str. 2457T
cucaagaaugaccgc

SEQ ID NO: 1932550 - RNA, 13 nt, Shigella flexneri 2a str. 2457T
cucaagcgcgucg

SEQ ID NO: 1932551 - RNA, 12 nt, Shigella flexneri 2a str. 2457T
cuauugcaacau

SEQ ID NO: 1932552 - RNA, 21 nt, Shigella flexneri 2a str. 2457T
cuauuguaguuggaugacauu

SEQ ID NO: 1932553 - RNA, 14 nt, Shigella flexneri 2a str. 2457T
cucaaaaucacugg

SEQ ID NO: 1932554 - RNA, 17 nt, Shigella flexneri 2a str. 2457T
cucacaaccccggcaaa

SEQ ID NO: 1932555 - RNA, 23 nt, Shigella flexneri 2a str. 2457T
cucacagaguauuuccagcucaa

SEQ ID NO: 1932556 - RNA, 21 nt, Shigella flexneri 2a str. 2457T
cucacagggcucuuaagcacc

SEQ ID NO: 1932557 - RNA, 21 nt, Shigella flexneri 2a str. 2457T
cucacaucaugcgucaccaac

SEQ ID NO: 1932558 - RNA, 22 nt, Shigella flexneri 2a str. 2457T
cucacaucaugcgucaccaaca

SEQ ID NO: 1932559 - RNA, 21 nt, Shigella flexneri 2a str. 2457T
cucaagcucguugguuccacg

SEQ ID NO: 1932560 - RNA, 24 nt, Shigella flexneri 2a str. 2457T
cucaagcucguugguuccacggca

SEQ ID NO: 1932561 - RNA, 14 nt, Shigella flexneri 2a str. 2457T
cucaaguugcgaaa

SEQ ID NO: 1932562 - RNA, 20 nt, Shigella flexneri 2a str. 2457T
cucaauaccugaugagaugc

SEQ ID NO: 1932563 - RNA, 15 nt, Shigella flexneri 2a str. 2457T
cucaauacaacccac

SEQ ID NO: 1932564 - RNA, 17 nt, Shigella flexneri 2a str. 2457T
cucaauauuagcauuaa

SEQ ID NO: 1932565 - RNA, 16 nt, Shigella flexneri 2a str. 2457T
cucaauaucaucauuu

SEQ ID NO: 1932566 - RNA, 21 nt, Shigella flexneri 2a str. 2457T
cucaaguugcgaaagcgagca

SEQ ID NO: 1932567 - RNA, 13 nt, Shigella flexneri 2a str. 2457T
cucacguuccaga

SEQ ID NO: 1932568 - RNA, 12 nt, Shigella flexneri 2a str. 2457T
cucacuccagcc

SEQ ID NO: 1932569 - RNA, 14 nt, Shigella flexneri 2a str. 2457T
cucacucaccgcag

SEQ ID NO: 1932570 - RNA, 21 nt, Shigella flexneri 2a str. 2457T
cucacuauccgccccauuuuu

SEQ ID NO: 1932571 - RNA, 22 nt, Shigella flexneri 2a str. 2457T
cucacuaauugcaaacagagcg

SEQ ID NO: 1932572 - RNA, 20 nt, Shigella flexneri 2a str. 2457T
cucaccgccauauuuaaaga

SEQ ID NO: 1932573 - RNA, 19 nt, Shigella flexneri 2a str. 2457T
cucacccuaacccucuccc

SEQ ID NO: 1932574 - RNA, 18 nt, Shigella flexneri 2a str. 2457T
cucacccggaggaaagca

SEQ ID NO: 1932575 - RNA, 21 nt, Shigella flexneri 2a str. 2457T
cucacccggaggaaagcaccu

SEQ ID NO: 1932576 - RNA, 14 nt, Shigella flexneri 2a str. 2457T
cuauagucuuuucg

SEQ ID NO: 1932577 - RNA, 22 nt, Shigella flexneri 2a str. 2457T
cuauauuacgagucacaaacau

SEQ ID NO: 1932578 - RNA, 18 nt, Shigella flexneri 2a str. 2457T
cuauagugaggcuauucc

SEQ ID NO: 1932579 - RNA, 18 nt, Shigella flexneri 2a str. 2457T
cuaguuuugccgacuggc

SEQ ID NO: 1932580 - RNA, 15 nt, Shigella flexneri 2a str. 2457T
cuaucaaacugaccu

SEQ ID NO: 1932581 - RNA, 17 nt, Shigella flexneri 2a str. 2457T
cuaucaaccugaggcuc

SEQ ID NO: 1932582 - RNA, 12 nt, Shigella flexneri 2a str. 2457T
cuaucagcgcca

SEQ ID NO: 1932583 - RNA, 14 nt, Shigella flexneri 2a str. 2457T
cuaucauacucauu

SEQ ID NO: 1932584 - RNA, 18 nt, Shigella flexneri 2a str. 2457T
cuaucagauuggcuucau

SEQ ID NO: 1932585 - RNA, 16 nt, Shigella flexneri 2a str. 2457T
cuauccagcucaucca

SEQ ID NO: 1932586 - RNA, 13 nt, Shigella flexneri 2a str. 2457T
cuaucaucagcau

SEQ ID NO: 1932587 - RNA, 21 nt, Shigella flexneri 2a str. 2457T
cuauuauuuuucauauggaua

SEQ ID NO: 1932588 - RNA, 18 nt, Shigella flexneri 2a str. 2457T
cuauuaaaaagcuucuca

SEQ ID NO: 1932589 - RNA, 20 nt, Shigella flexneri 2a str. 2457T
cuauuaaaaagcuucucaga

SEQ ID NO: 1932590 - RNA, 22 nt, Shigella flexneri 2a str. 2457T
cuaugugaucuuuaucacacag

SEQ ID NO: 1932591 - RNA, 20 nt, Shigella flexneri 2a str. 2457T
cuauuccguuacucuccgga

SEQ ID NO: 1932592 - RNA, 12 nt, Shigella flexneri 2a str. 2457T
cuauucagcagu

SEQ ID NO: 1932593 - RNA, 17 nt, Shigella flexneri 2a str. 2457T
cuaugcggaugccauuc

SEQ ID NO: 1932594 - RNA, 15 nt, Shigella flexneri 2a str. 2457T
cuaugguuuugaaga

SEQ ID NO: 1932595 - RNA, 21 nt, Shigella flexneri 2a str. 2457T
cuaucggcagaguugagcagu

SEQ ID NO: 1932596 - RNA, 21 nt, Shigella flexneri 2a str. 2457T
cuaucucaccccauuugccac

SEQ ID NO: 1932597 - RNA, 22 nt, Shigella flexneri 2a str. 2457T
cuagaugugcaguuccugcaac

SEQ ID NO: 1932598 - RNA, 15 nt, Shigella flexneri 2a str. 2457T
cuagcggcuuuuuac

SEQ ID NO: 1932599 - RNA, 23 nt, Shigella flexneri 2a str. 2457T
cuagugcagauaguugauuaauu

SEQ ID NO: 1932600 - RNA, 16 nt, Shigella flexneri 2a str. 2457T
cuagguugaccuggaa

SEQ ID NO: 1932601 - RNA, 17 nt, Shigella flexneri 2a str. 2457T
cuagguugaccuggaag

SEQ ID NO: 1932602 - RNA, 21 nt, Shigella flexneri 2a str. 2457T
cuacuuuuuucacccacacuu

SEQ ID NO: 1932603 - RNA, 21 nt, Shigella flexneri 2a str. 2457T
cuacuuuuuaauucaggaaau

SEQ ID NO: 1932604 - RNA, 14 nt, Shigella flexneri 2a str. 2457T
cuacuuuuuuaaga

SEQ ID NO: 1932605 - RNA, 19 nt, Shigella flexneri 2a str. 2457T
cuagacagcgacucucuga

SEQ ID NO: 1932606 - RNA, 22 nt, Shigella flexneri 2a str. 2457T
cuacuuugcgagucugcuccag

SEQ ID NO: 1932607 - RNA, 20 nt, Shigella flexneri 2a str. 2457T
cuacucccaguagugcuuuc

SEQ ID NO: 1932608 - RNA, 17 nt, Shigella flexneri 2a str. 2457T
cuacuccccaaaauccc

SEQ ID NO: 1932609 - RNA, 14 nt, Shigella flexneri 2a str. 2457T
cuacugaaucccug

SEQ ID NO: 1932610 - RNA, 14 nt, Shigella flexneri 2a str. 2457T
cuacucguuuauua

SEQ ID NO: 1932611 - RNA, 18 nt, Shigella flexneri 2a str. 2457T
cuacuggcaauccagcuc

SEQ ID NO: 1932612 - RNA, 15 nt, Shigella flexneri 2a str. 2457T
cuacccggugaaucg

SEQ ID NO: 1932613 - RNA, 16 nt, Shigella flexneri 2a str. 2457T
cuacccauauuuaauc

SEQ ID NO: 1932614 - RNA, 19 nt, Shigella flexneri 2a str. 2457T
cuaccgauccggcaccaau

SEQ ID NO: 1932615 - RNA, 12 nt, Shigella flexneri 2a str. 2457T
cucuuuuuucaa

SEQ ID NO: 1932616 - RNA, 21 nt, Shigella flexneri 2a str. 2457T
cugaaaaaaaauuacaaaaag

SEQ ID NO: 1932617 - RNA, 14 nt, Shigella flexneri 2a str. 2457T
cugaaaacuucuug

SEQ ID NO: 1932618 - RNA, 15 nt, Shigella flexneri 2a str. 2457T
cugaaaagaguagua

SEQ ID NO: 1932619 - RNA, 15 nt, Shigella flexneri 2a str. 2457T
cucuuuuccagccau

SEQ ID NO: 1932620 - RNA, 20 nt, Shigella flexneri 2a str. 2457T
cucuuuugacgcccccaaac

SEQ ID NO: 1932621 - RNA, 15 nt, Shigella flexneri 2a str. 2457T
cucuuucuggcauca

SEQ ID NO: 1932622 - RNA, 18 nt, Shigella flexneri 2a str. 2457T
cucuuucuaugagaaaau

SEQ ID NO: 1932623 - RNA, 21 nt, Shigella flexneri 2a str. 2457T
cucuuugaacagccagaagcc

SEQ ID NO: 1932624 - RNA, 16 nt, Shigella flexneri 2a str. 2457T
cucuuugaacagccag

SEQ ID NO: 1932625 - RNA, 16 nt, Shigella flexneri 2a str. 2457T
cucuuucuucagcacg

SEQ ID NO: 1932626 - RNA, 21 nt, Shigella flexneri 2a str. 2457T
cugaaaagcgggcugagacug

SEQ ID NO: 1932627 - RNA, 14 nt, Shigella flexneri 2a str. 2457T
cugaaaaggucacu

SEQ ID NO: 1932628 - RNA, 20 nt, Shigella flexneri 2a str. 2457T
cugaaacaauuuaccgaccu

SEQ ID NO: 1932629 - RNA, 19 nt, Shigella flexneri 2a str. 2457T
cugaaagcgccgggaaugc

SEQ ID NO: 1932630 - RNA, 20 nt, Shigella flexneri 2a str. 2457T
cugaaagaagcggugaaaaa

SEQ ID NO: 1932631 - RNA, 19 nt, Shigella flexneri 2a str. 2457T
cugaaacucgaccagcagc

SEQ ID NO: 1932632 - RNA, 19 nt, Shigella flexneri 2a str. 2457T
cugaagauugaacagcaga

SEQ ID NO: 1932633 - RNA, 21 nt, Shigella flexneri 2a str. 2457T
cugaagauugaacagcagaac

SEQ ID NO: 1932634 - RNA, 15 nt, Shigella flexneri 2a str. 2457T
cugaagaucaacguc

SEQ ID NO: 1932635 - RNA, 21 nt, Shigella flexneri 2a str. 2457T
cugaagcaguuucaccagcag

SEQ ID NO: 1932636 - RNA, 14 nt, Shigella flexneri 2a str. 2457T
cugaacugaacaaa

SEQ ID NO: 1932637 - RNA, 16 nt, Shigella flexneri 2a str. 2457T
cugaacugaacaaaaa

SEQ ID NO: 1932638 - RNA, 20 nt, Shigella flexneri 2a str. 2457T
cugaagaaguaaaacagucg

SEQ ID NO: 1932639 - RNA, 19 nt, Shigella flexneri 2a str. 2457T
cugaacguugcgcuucccg

SEQ ID NO: 1932640 - RNA, 14 nt, Shigella flexneri 2a str. 2457T
cugaaaucacagcg

SEQ ID NO: 1932641 - RNA, 14 nt, Shigella flexneri 2a str. 2457T
cugaacaagaauac

SEQ ID NO: 1932642 - RNA, 17 nt, Shigella flexneri 2a str. 2457T
cugaacaagcaagagug

SEQ ID NO: 1932643 - RNA, 22 nt, Shigella flexneri 2a str. 2457T
cugaacaacaguuuuaucucca

SEQ ID NO: 1932644 - RNA, 12 nt, Shigella flexneri 2a str. 2457T
cugaacaaaaaa

SEQ ID NO: 1932645 - RNA, 22 nt, Shigella flexneri 2a str. 2457T
cugaacauuuucuucugccagg

SEQ ID NO: 1932646 - RNA, 16 nt, Shigella flexneri 2a str. 2457T
cugaacaggcaacaac

SEQ ID NO: 1932647 - RNA, 17 nt, Shigella flexneri 2a str. 2457T
cugaacagcuuuuuccu

SEQ ID NO: 1932648 - RNA, 11 nt, Shigella flexneri 2a str. 2457T
cugaacagcuu

SEQ ID NO: 1932649 - RNA, 19 nt, Shigella flexneri 2a str. 2457T
cugaaccaucgacguccaa

SEQ ID NO: 1932650 - RNA, 24 nt, Shigella flexneri 2a str. 2457T
cugaaccaucgacguccaaucagc

SEQ ID NO: 1932651 - RNA, 16 nt, Shigella flexneri 2a str. 2457T
cugaaccgaaauggcu

SEQ ID NO: 1932652 - RNA, 17 nt, Shigella flexneri 2a str. 2457T
cugaacgagaaaagcca

SEQ ID NO: 1932653 - RNA, 15 nt, Shigella flexneri 2a str. 2457T
cugaacgcaccuucc

SEQ ID NO: 1932654 - RNA, 22 nt, Shigella flexneri 2a str. 2457T
cucuucuucgcgauaaaucaga

SEQ ID NO: 1932655 - RNA, 17 nt, Shigella flexneri 2a str. 2457T
cucuucguuuucaacgu

SEQ ID NO: 1932656 - RNA, 12 nt, Shigella flexneri 2a str. 2457T
cucuuucaacuu

SEQ ID NO: 1932657 - RNA, 15 nt, Shigella flexneri 2a str. 2457T
cucuuuauugcaaac

SEQ ID NO: 1932658 - RNA, 18 nt, Shigella flexneri 2a str. 2457T
cucuuuagcauucagagu

SEQ ID NO: 1932659 - RNA, 22 nt, Shigella flexneri 2a str. 2457T
cucuugcuggcauuacaagaau

SEQ ID NO: 1932660 - RNA, 18 nt, Shigella flexneri 2a str. 2457T
cucuuuaacccauuuugu

SEQ ID NO: 1932661 - RNA, 15 nt, Shigella flexneri 2a str. 2457T
cucuuuaaaaaguaa

SEQ ID NO: 1932662 - RNA, 21 nt, Shigella flexneri 2a str. 2457T
cucuuccauuucaucgccagc

SEQ ID NO: 1932663 - RNA, 15 nt, Shigella flexneri 2a str. 2457T
cucuucccagaccca

SEQ ID NO: 1932664 - RNA, 16 nt, Shigella flexneri 2a str. 2457T
cucuuccggcaccaca

SEQ ID NO: 1932665 - RNA, 16 nt, Shigella flexneri 2a str. 2457T
cucuucaacacggcgc

SEQ ID NO: 1932666 - RNA, 18 nt, Shigella flexneri 2a str. 2457T
cucuucaacuucagcagc

SEQ ID NO: 1932667 - RNA, 14 nt, Shigella flexneri 2a str. 2457T
cucuucaaugguca

SEQ ID NO: 1932668 - RNA, 17 nt, Shigella flexneri 2a str. 2457T
cucuucaccgguacgga

SEQ ID NO: 1932669 - RNA, 17 nt, Shigella flexneri 2a str. 2457T
cucuucacugacuuuuc

SEQ ID NO: 1932670 - RNA, 11 nt, Shigella flexneri 2a str. 2457T
cucuucacacc

SEQ ID NO: 1932671 - RNA, 18 nt, Shigella flexneri 2a str. 2457T
cucuucaucgcuaaaaua

SEQ ID NO: 1932672 - RNA, 19 nt, Shigella flexneri 2a str. 2457T
cucuucaucgcuaaaauac

SEQ ID NO: 1932673 - RNA, 20 nt, Shigella flexneri 2a str. 2457T
cucuucauuaaaccagugcc

SEQ ID NO: 1932674 - RNA, 13 nt, Shigella flexneri 2a str. 2457T
cucuucagccccg

SEQ ID NO: 1932675 - RNA, 21 nt, Shigella flexneri 2a str. 2457T
cucuguuuucucacuggagga

SEQ ID NO: 1932676 - RNA, 18 nt, Shigella flexneri 2a str. 2457T
cucuuaaugcaggcagca

SEQ ID NO: 1932677 - RNA, 16 nt, Shigella flexneri 2a str. 2457T
cucuuaccguaggcca

SEQ ID NO: 1932678 - RNA, 15 nt, Shigella flexneri 2a str. 2457T
cucugguguucuuuu

SEQ ID NO: 1932679 - RNA, 19 nt, Shigella flexneri 2a str. 2457T
cucuguaaacuccuuucug

SEQ ID NO: 1932680 - RNA, 13 nt, Shigella flexneri 2a str. 2457T
cucuguaauugga

SEQ ID NO: 1932681 - RNA, 20 nt, Shigella flexneri 2a str. 2457T
cucugucugaugauaaucag

SEQ ID NO: 1932682 - RNA, 23 nt, Shigella flexneri 2a str. 2457T
cucuguaauuggaguaucaccau

SEQ ID NO: 1932683 - RNA, 12 nt, Shigella flexneri 2a str. 2457T
cucuguucugcg

SEQ ID NO: 1932684 - RNA, 18 nt, Shigella flexneri 2a str. 2457T
cugagccugccauuggca

SEQ ID NO: 1932685 - RNA, 22 nt, Shigella flexneri 2a str. 2457T
cugagcaucacauaaucgaaaa

SEQ ID NO: 1932686 - RNA, 14 nt, Shigella flexneri 2a str. 2457T
cugagccagugccg

SEQ ID NO: 1932687 - RNA, 17 nt, Shigella flexneri 2a str. 2457T
cugagccaguuuuucuu

SEQ ID NO: 1932688 - RNA, 20 nt, Shigella flexneri 2a str. 2457T
cugagcgauaaaaucagaaa

SEQ ID NO: 1932689 - RNA, 14 nt, Shigella flexneri 2a str. 2457T
cugagauggcuuca

SEQ ID NO: 1932690 - RNA, 17 nt, Shigella flexneri 2a str. 2457T
cugagaucaaacucuuu

SEQ ID NO: 1932691 - RNA, 15 nt, Shigella flexneri 2a str. 2457T
cugagaagcuggaag

SEQ ID NO: 1932692 - RNA, 14 nt, Shigella flexneri 2a str. 2457T
cugacuuugcccca

SEQ ID NO: 1932693 - RNA, 21 nt, Shigella flexneri 2a str. 2457T
cugagaacaagauugccugau

SEQ ID NO: 1932694 - RNA, 21 nt, Shigella flexneri 2a str. 2457T
cugagauacucaagcagccag

SEQ ID NO: 1932695 - RNA, 18 nt, Shigella flexneri 2a str. 2457T
cugagacagacagccuca

SEQ ID NO: 1932696 - RNA, 14 nt, Shigella flexneri 2a str. 2457T
cugacugagcuggu

SEQ ID NO: 1932697 - RNA, 13 nt, Shigella flexneri 2a str. 2457T
cugacuauuuccg

SEQ ID NO: 1932698 - RNA, 17 nt, Shigella flexneri 2a str. 2457T
cugacuggcucuuuuuc

SEQ ID NO: 1932699 - RNA, 15 nt, Shigella flexneri 2a str. 2457T
cugacuguuccagca

SEQ ID NO: 1932700 - RNA, 20 nt, Shigella flexneri 2a str. 2457T
cugacuuucguuugaaaacu

SEQ ID NO: 1932701 - RNA, 17 nt, Shigella flexneri 2a str. 2457T
cugacugucgcagccag

SEQ ID NO: 1932702 - RNA, 16 nt, Shigella flexneri 2a str. 2457T
cugacuuccacuuccu

SEQ ID NO: 1932703 - RNA, 14 nt, Shigella flexneri 2a str. 2457T
cugacuuccacuuc

SEQ ID NO: 1932704 - RNA, 17 nt, Shigella flexneri 2a str. 2457T
cugacuguuccagcacg

SEQ ID NO: 1932705 - RNA, 20 nt, Shigella flexneri 2a str. 2457T
cugacgaaucaaauaaaaau

SEQ ID NO: 1932706 - RNA, 21 nt, Shigella flexneri 2a str. 2457T
cugacgaggcgucagcguucc

SEQ ID NO: 1932707 - RNA, 22 nt, Shigella flexneri 2a str. 2457T
cugacgaggcgucagcguucca

SEQ ID NO: 1932708 - RNA, 16 nt, Shigella flexneri 2a str. 2457T
cugacgccugcgggca

SEQ ID NO: 1932709 - RNA, 13 nt, Shigella flexneri 2a str. 2457T
cugaccuuuuuuc

SEQ ID NO: 1932710 - RNA, 15 nt, Shigella flexneri 2a str. 2457T
cugaccuuuuuucag

SEQ ID NO: 1932711 - RNA, 17 nt, Shigella flexneri 2a str. 2457T
cugaccuugcuuugcaa

SEQ ID NO: 1932712 - RNA, 13 nt, Shigella flexneri 2a str. 2457T
cugaccuucuuca

SEQ ID NO: 1932713 - RNA, 15 nt, Shigella flexneri 2a str. 2457T
cugaccguuaauuuc

SEQ ID NO: 1932714 - RNA, 17 nt, Shigella flexneri 2a str. 2457T
cugaccugcccaaucau

SEQ ID NO: 1932715 - RNA, 20 nt, Shigella flexneri 2a str. 2457T
cugaccugaauuaaugccuc

SEQ ID NO: 1932716 - RNA, 16 nt, Shigella flexneri 2a str. 2457T
cugacggcguucuuua

SEQ ID NO: 1932717 - RNA, 21 nt, Shigella flexneri 2a str. 2457T
cugacggugauaaucauccca

SEQ ID NO: 1932718 - RNA, 14 nt, Shigella flexneri 2a str. 2457T
cugacguaacgacc

SEQ ID NO: 1932719 - RNA, 22 nt, Shigella flexneri 2a str. 2457T
cugacguaacgaccaccaccgc

SEQ ID NO: 1932720 - RNA, 21 nt, Shigella flexneri 2a str. 2457T
cugacggugauacagcaaaau

SEQ ID NO: 1932721 - RNA, 13 nt, Shigella flexneri 2a str. 2457T
cugacggccuucg

SEQ ID NO: 1932722 - RNA, 21 nt, Shigella flexneri 2a str. 2457T
cugacggccuucggugcgaca

SEQ ID NO: 1932723 - RNA, 15 nt, Shigella flexneri 2a str. 2457T
cugacggauagccuu

SEQ ID NO: 1932724 - RNA, 19 nt, Shigella flexneri 2a str. 2457T
cugacgcuuaucuucugua

SEQ ID NO: 1932725 - RNA, 24 nt, Shigella flexneri 2a str. 2457T
cugacuagaugugcaguuccugca

SEQ ID NO: 1932726 - RNA, 20 nt, Shigella flexneri 2a str. 2457T
cugacuagaugugcaguucc

SEQ ID NO: 1932727 - RNA, 14 nt, Shigella flexneri 2a str. 2457T
cugacgugauuuag

SEQ ID NO: 1932728 - RNA, 18 nt, Shigella flexneri 2a str. 2457T
cugaaggucuucgguaag

SEQ ID NO: 1932729 - RNA, 15 nt, Shigella flexneri 2a str. 2457T
cugaaggcugccggg

SEQ ID NO: 1932730 - RNA, 19 nt, Shigella flexneri 2a str. 2457T
cugaaggaauauucaggcu

SEQ ID NO: 1932731 - RNA, 17 nt, Shigella flexneri 2a str. 2457T
cugaauauccugacuuu

SEQ ID NO: 1932732 - RNA, 23 nt, Shigella flexneri 2a str. 2457T
cugaauaucaucccccugcgauu

SEQ ID NO: 1932733 - RNA, 20 nt, Shigella flexneri 2a str. 2457T
cugaauauucggcuccagau

SEQ ID NO: 1932734 - RNA, 15 nt, Shigella flexneri 2a str. 2457T
cugaauaucuuucuc

SEQ ID NO: 1932735 - RNA, 20 nt, Shigella flexneri 2a str. 2457T
cugaauaugagucguaaaca

SEQ ID NO: 1932736 - RNA, 24 nt, Shigella flexneri 2a str. 2457T
cugaauauucggcuccagauuacu

SEQ ID NO: 1932737 - RNA, 15 nt, Shigella flexneri 2a str. 2457T
cugaaucauucaggu

SEQ ID NO: 1932738 - RNA, 15 nt, Shigella flexneri 2a str. 2457T
cugaaugauaacuuc

SEQ ID NO: 1932739 - RNA, 12 nt, Shigella flexneri 2a str. 2457T
cugaauuuaucg

SEQ ID NO: 1932740 - RNA, 19 nt, Shigella flexneri 2a str. 2457T
cugaauuucagcgccugau

SEQ ID NO: 1932741 - RNA, 21 nt, Shigella flexneri 2a str. 2457T
cugaauuucagcgccugauac

SEQ ID NO: 1932742 - RNA, 18 nt, Shigella flexneri 2a str. 2457T
cugaauuucaucaccagc

SEQ ID NO: 1932743 - RNA, 20 nt, Shigella flexneri 2a str. 2457T
cugaccgucaccccauugaa

SEQ ID NO: 1932744 - RNA, 23 nt, Shigella flexneri 2a str. 2457T
cugaccgcccgcuaugagcagau

SEQ ID NO: 1932745 - RNA, 15 nt, Shigella flexneri 2a str. 2457T
cugaccgcacacccc

SEQ ID NO: 1932746 - RNA, 13 nt, Shigella flexneri 2a str. 2457T
cugaccgaccaga

SEQ ID NO: 1932747 - RNA, 16 nt, Shigella flexneri 2a str. 2457T
cugaccaucagcagcg

SEQ ID NO: 1932748 - RNA, 18 nt, Shigella flexneri 2a str. 2457T
cugacccaguagacgagc

SEQ ID NO: 1932749 - RNA, 13 nt, Shigella flexneri 2a str. 2457T
cugacccagcacc

SEQ ID NO: 1932750 - RNA, 15 nt, Shigella flexneri 2a str. 2457T
cugaccaccagcacg

SEQ ID NO: 1932751 - RNA, 17 nt, Shigella flexneri 2a str. 2457T
cugaccaccagcacgcu

SEQ ID NO: 1932752 - RNA, 17 nt, Shigella flexneri 2a str. 2457T
cugaccaaauacacgca

SEQ ID NO: 1932753 - RNA, 19 nt, Shigella flexneri 2a str. 2457T
cugacauuuuggacaaugc

SEQ ID NO: 1932754 - RNA, 23 nt, Shigella flexneri 2a str. 2457T
cugaccacuucgguacccagacg

SEQ ID NO: 1932755 - RNA, 15 nt, Shigella flexneri 2a str. 2457T
cugaccacuucggua

SEQ ID NO: 1932756 - RNA, 15 nt, Shigella flexneri 2a str. 2457T
cugaccacggccaca

SEQ ID NO: 1932757 - RNA, 19 nt, Shigella flexneri 2a str. 2457T
cugaccacggccacagcca

SEQ ID NO: 1932758 - RNA, 20 nt, Shigella flexneri 2a str. 2457T
cugaccacggccacagccag

SEQ ID NO: 1932759 - RNA, 21 nt, Shigella flexneri 2a str. 2457T
cugacagauguaaacuuuuuc

SEQ ID NO: 1932760 - RNA, 14 nt, Shigella flexneri 2a str. 2457T
cugacagcaaauac

SEQ ID NO: 1932761 - RNA, 21 nt, Shigella flexneri 2a str. 2457T
cugacagcgcgucuuguacuu

SEQ ID NO: 1932762 - RNA, 13 nt, Shigella flexneri 2a str. 2457T
cugacauaaacac

SEQ ID NO: 1932763 - RNA, 21 nt, Shigella flexneri 2a str. 2457T
cugacagggugagcagggcac

SEQ ID NO: 1932764 - RNA, 19 nt, Shigella flexneri 2a str. 2457T
cugacauauuuuuguugaa

SEQ ID NO: 1932765 - RNA, 18 nt, Shigella flexneri 2a str. 2457T
cugacauuuuuacuccuu

SEQ ID NO: 1932766 - RNA, 17 nt, Shigella flexneri 2a str. 2457T
cugacauuaucagacac

SEQ ID NO: 1932767 - RNA, 23 nt, Shigella flexneri 2a str. 2457T
cugacaaucgcugcggcaauaau

SEQ ID NO: 1932768 - RNA, 20 nt, Shigella flexneri 2a str. 2457T
cugacaacgcugaauggcga

SEQ ID NO: 1932769 - RNA, 12 nt, Shigella flexneri 2a str. 2457T
cugacaaaucag

SEQ ID NO: 1932770 - RNA, 14 nt, Shigella flexneri 2a str. 2457T
cugaauuugcucca

SEQ ID NO: 1932771 - RNA, 16 nt, Shigella flexneri 2a str. 2457T
cugaauuugcuccaga

SEQ ID NO: 1932772 - RNA, 21 nt, Shigella flexneri 2a str. 2457T
cugacagaaguaaucuacugc

SEQ ID NO: 1932773 - RNA, 21 nt, Shigella flexneri 2a str. 2457T
cugacacggaacaacggcaaa

SEQ ID NO: 1932774 - RNA, 21 nt, Shigella flexneri 2a str. 2457T
cugacacuauucgccagcacg

SEQ ID NO: 1932775 - RNA, 18 nt, Shigella flexneri 2a str. 2457T
cugacacaggcagcaauc

SEQ ID NO: 1932776 - RNA, 14 nt, Shigella flexneri 2a str. 2457T
cugacaauuugccc

SEQ ID NO: 1932777 - RNA, 18 nt, Shigella flexneri 2a str. 2457T
cucucaaccgagagggcu

SEQ ID NO: 1932778 - RNA, 23 nt, Shigella flexneri 2a str. 2457T
cucucagcacaccauaaaacaaa

SEQ ID NO: 1932779 - RNA, 19 nt, Shigella flexneri 2a str. 2457T
cucucagccagcuggcaga

SEQ ID NO: 1932780 - RNA, 22 nt, Shigella flexneri 2a str. 2457T
cucucccgaaugaccgccccug

SEQ ID NO: 1932781 - RNA, 17 nt, Shigella flexneri 2a str. 2457T
cucucaugucugccgca

SEQ ID NO: 1932782 - RNA, 21 nt, Shigella flexneri 2a str. 2457T
cucucaucuuugaaaucacgc

SEQ ID NO: 1932783 - RNA, 15 nt, Shigella flexneri 2a str. 2457T
cucucaucacuacag

SEQ ID NO: 1932784 - RNA, 15 nt, Shigella flexneri 2a str. 2457T
cucucagucuuuccc

SEQ ID NO: 1932785 - RNA, 23 nt, Shigella flexneri 2a str. 2457T
cucucugaaguagccaguaccac

SEQ ID NO: 1932786 - RNA, 11 nt, Shigella flexneri 2a str. 2457T
cucucugagcc

SEQ ID NO: 1932787 - RNA, 13 nt, Shigella flexneri 2a str. 2457T
cucucugcuauuc

SEQ ID NO: 1932788 - RNA, 16 nt, Shigella flexneri 2a str. 2457T
cucucuggccgcuucc

SEQ ID NO: 1932789 - RNA, 23 nt, Shigella flexneri 2a str. 2457T
cucuccuguuuaauaugcaauuc

SEQ ID NO: 1932790 - RNA, 12 nt, Shigella flexneri 2a str. 2457T
cucuccuuuacc

SEQ ID NO: 1932791 - RNA, 22 nt, Shigella flexneri 2a str. 2457T
cucuccucgcgagaggcuuuuu

SEQ ID NO: 1932792 - RNA, 18 nt, Shigella flexneri 2a str. 2457T
cucucgcauggggagacc

SEQ ID NO: 1932793 - RNA, 19 nt, Shigella flexneri 2a str. 2457T
cucucgggaaggcccuucc

SEQ ID NO: 1932794 - RNA, 19 nt, Shigella flexneri 2a str. 2457T
cucugccagacuccaggcg

SEQ ID NO: 1932795 - RNA, 17 nt, Shigella flexneri 2a str. 2457T
cucugcaaauauuaaua

SEQ ID NO: 1932796 - RNA, 14 nt, Shigella flexneri 2a str. 2457T
cucugcaaauauua

SEQ ID NO: 1932797 - RNA, 15 nt, Shigella flexneri 2a str. 2457T
cucugcaaauauuaa

SEQ ID NO: 1932798 - RNA, 18 nt, Shigella flexneri 2a str. 2457T
cucugcaacgucuucccg

SEQ ID NO: 1932799 - RNA, 11 nt, Shigella flexneri 2a str. 2457T
cucucuuucuc

SEQ ID NO: 1932800 - RNA, 16 nt, Shigella flexneri 2a str. 2457T
cucucuuucuccagcg

SEQ ID NO: 1932801 - RNA, 15 nt, Shigella flexneri 2a str. 2457T
cucugaaauucgcuu

SEQ ID NO: 1932802 - RNA, 20 nt, Shigella flexneri 2a str. 2457T
cucugacgcgcauacucucc

SEQ ID NO: 1932803 - RNA, 21 nt, Shigella flexneri 2a str. 2457T
cucugacgcgcauacucuccu

SEQ ID NO: 1932804 - RNA, 17 nt, Shigella flexneri 2a str. 2457T
cucugggcuaacacccg

SEQ ID NO: 1932805 - RNA, 20 nt, Shigella flexneri 2a str. 2457T
cucugcuggcggaacaucgc

SEQ ID NO: 1932806 - RNA, 23 nt, Shigella flexneri 2a str. 2457T
cucugcuguaguuguucaacagu

SEQ ID NO: 1932807 - RNA, 13 nt, Shigella flexneri 2a str. 2457T
cucuggcaggcuu

SEQ ID NO: 1932808 - RNA, 14 nt, Shigella flexneri 2a str. 2457T
cucuggcacaugca

SEQ ID NO: 1932809 - RNA, 21 nt, Shigella flexneri 2a str. 2457T
cucuggauuuauauaaauaua

SEQ ID NO: 1932810 - RNA, 12 nt, Shigella flexneri 2a str. 2457T
cucugcggcaag

SEQ ID NO: 1932811 - RNA, 19 nt, Shigella flexneri 2a str. 2457T
cucugcucccggcaaugcg

SEQ ID NO: 1932812 - RNA, 18 nt, Shigella flexneri 2a str. 2457T
cucugcgucauuccggag

SEQ ID NO: 1932813 - RNA, 13 nt, Shigella flexneri 2a str. 2457T
cucugcugccaca

SEQ ID NO: 1932814 - RNA, 15 nt, Shigella flexneri 2a str. 2457T
cucugcgcgugcagu

SEQ ID NO: 1932815 - RNA, 17 nt, Shigella flexneri 2a str. 2457T
cucuaacccguauaaau

SEQ ID NO: 1932816 - RNA, 19 nt, Shigella flexneri 2a str. 2457T
cucguugacgaccaggccg

SEQ ID NO: 1932817 - RNA, 14 nt, Shigella flexneri 2a str. 2457T
cucguucacauauu

SEQ ID NO: 1932818 - RNA, 14 nt, Shigella flexneri 2a str. 2457T
cucguuauuggugg

SEQ ID NO: 1932819 - RNA, 18 nt, Shigella flexneri 2a str. 2457T
cucguuaccagcgccgcc

SEQ ID NO: 1932820 - RNA, 19 nt, Shigella flexneri 2a str. 2457T
cucguuaccccuucaucca

SEQ ID NO: 1932821 - RNA, 16 nt, Shigella flexneri 2a str. 2457T
cucuacaauauccuca

SEQ ID NO: 1932822 - RNA, 17 nt, Shigella flexneri 2a str. 2457T
cucuacaauauccucaa

SEQ ID NO: 1932823 - RNA, 12 nt, Shigella flexneri 2a str. 2457T
cucgucgcgcac

SEQ ID NO: 1932824 - RNA, 20 nt, Shigella flexneri 2a str. 2457T
cucgucgcgacgaccaccca

SEQ ID NO: 1932825 - RNA, 21 nt, Shigella flexneri 2a str. 2457T
cucgucgcgacgaccacccac

SEQ ID NO: 1932826 - RNA, 21 nt, Shigella flexneri 2a str. 2457T
cucguagguuucugccagcgu

SEQ ID NO: 1932827 - RNA, 16 nt, Shigella flexneri 2a str. 2457T
cucguacuccaucucg

SEQ ID NO: 1932828 - RNA, 23 nt, Shigella flexneri 2a str. 2457T
cucguacuccaucucgccauccu

SEQ ID NO: 1932829 - RNA, 15 nt, Shigella flexneri 2a str. 2457T
cucggcagaugagac

SEQ ID NO: 1932830 - RNA, 16 nt, Shigella flexneri 2a str. 2457T
cucgcgaaccgccugg

SEQ ID NO: 1932831 - RNA, 20 nt, Shigella flexneri 2a str. 2457T
cucgcgaaccgccuggcgcu

SEQ ID NO: 1932832 - RNA, 12 nt, Shigella flexneri 2a str. 2457T
cucggcauggau

SEQ ID NO: 1932833 - RNA, 20 nt, Shigella flexneri 2a str. 2457T
cucggcgagcaacgcagcgg

SEQ ID NO: 1932834 - RNA, 20 nt, Shigella flexneri 2a str. 2457T
cucgguaaaacuaacgccag

SEQ ID NO: 1932835 - RNA, 20 nt, Shigella flexneri 2a str. 2457T
cucgguaaaaucaacgccgc

SEQ ID NO: 1932836 - RNA, 16 nt, Shigella flexneri 2a str. 2457T
cucgcaagccacgccg

SEQ ID NO: 1932837 - RNA, 21 nt, Shigella flexneri 2a str. 2457T
cucgcccauuuuucaugaucu

SEQ ID NO: 1932838 - RNA, 16 nt, Shigella flexneri 2a str. 2457T
cucgcaucagggcgcu

SEQ ID NO: 1932839 - RNA, 14 nt, Shigella flexneri 2a str. 2457T
cucgcauccucuuu

SEQ ID NO: 1932840 - RNA, 16 nt, Shigella flexneri 2a str. 2457T
cucgccccgugaugaa

SEQ ID NO: 1932841 - RNA, 20 nt, Shigella flexneri 2a str. 2457T
cucgcccccuuggggagagg

SEQ ID NO: 1932842 - RNA, 19 nt, Shigella flexneri 2a str. 2457T
cucgccccgagaaaaauag

SEQ ID NO: 1932843 - RNA, 14 nt, Shigella flexneri 2a str. 2457T
cucgccccuccggg

SEQ ID NO: 1932844 - RNA, 15 nt, Shigella flexneri 2a str. 2457T
cucgccgcagagauc

SEQ ID NO: 1932845 - RNA, 20 nt, Shigella flexneri 2a str. 2457T
cuccuguaccuucacgcgcu

SEQ ID NO: 1932846 - RNA, 13 nt, Shigella flexneri 2a str. 2457T
cuccugucuuccc

SEQ ID NO: 1932847 - RNA, 14 nt, Shigella flexneri 2a str. 2457T
cuccugucuucccu

SEQ ID NO: 1932848 - RNA, 16 nt, Shigella flexneri 2a str. 2457T
cuccugucuucccugc

SEQ ID NO: 1932849 - RNA, 14 nt, Shigella flexneri 2a str. 2457T
cuccuucacucuau

SEQ ID NO: 1932850 - RNA, 14 nt, Shigella flexneri 2a str. 2457T
cuccuuccugaaau

SEQ ID NO: 1932851 - RNA, 13 nt, Shigella flexneri 2a str. 2457T
cuccuuucggcca

SEQ ID NO: 1932852 - RNA, 17 nt, Shigella flexneri 2a str. 2457T
cucgacgcccagcuuca

SEQ ID NO: 1932853 - RNA, 16 nt, Shigella flexneri 2a str. 2457T
cucgaacgccucugca

SEQ ID NO: 1932854 - RNA, 19 nt, Shigella flexneri 2a str. 2457T
cuccucuucacguuuuucg

SEQ ID NO: 1932855 - RNA, 13 nt, Shigella flexneri 2a str. 2457T
cuccugcucauca

SEQ ID NO: 1932856 - RNA, 14 nt, Shigella flexneri 2a str. 2457T
cuccugcggcugca

SEQ ID NO: 1932857 - RNA, 20 nt, Shigella flexneri 2a str. 2457T
cuccugcgccucuccacacg

SEQ ID NO: 1932858 - RNA, 14 nt, Shigella flexneri 2a str. 2457T
cuccugaaacaauu

SEQ ID NO: 1932859 - RNA, 18 nt, Shigella flexneri 2a str. 2457T
cuccgcugagacgcgcuu

SEQ ID NO: 1932860 - RNA, 19 nt, Shigella flexneri 2a str. 2457T
cuccgcucucaaucucuuu

SEQ ID NO: 1932861 - RNA, 14 nt, Shigella flexneri 2a str. 2457T
cuccggacuccgca

SEQ ID NO: 1932862 - RNA, 16 nt, Shigella flexneri 2a str. 2457T
cuccucaacaaucguc

SEQ ID NO: 1932863 - RNA, 17 nt, Shigella flexneri 2a str. 2457T
cuccucaacaaucguca

SEQ ID NO: 1932864 - RNA, 13 nt, Shigella flexneri 2a str. 2457T
cuccguuccccuc

SEQ ID NO: 1932865 - RNA, 15 nt, Shigella flexneri 2a str. 2457T
cuccgaccagaagcg

SEQ ID NO: 1932866 - RNA, 22 nt, Shigella flexneri 2a str. 2457T
cucccguuccugguuuuccaga

SEQ ID NO: 1932867 - RNA, 18 nt, Shigella flexneri 2a str. 2457T
cucccguucauucaacuu

SEQ ID NO: 1932868 - RNA, 16 nt, Shigella flexneri 2a str. 2457T
cucccguuucccuguc

SEQ ID NO: 1932869 - RNA, 15 nt, Shigella flexneri 2a str. 2457T
cucccgucgcccaca

SEQ ID NO: 1932870 - RNA, 18 nt, Shigella flexneri 2a str. 2457T
cuccgccugugcgcguca

SEQ ID NO: 1932871 - RNA, 21 nt, Shigella flexneri 2a str. 2457T
cuccgccucgguaagcaaagc

SEQ ID NO: 1932872 - RNA, 14 nt, Shigella flexneri 2a str. 2457T
cuccgaucccugcg

SEQ ID NO: 1932873 - RNA, 22 nt, Shigella flexneri 2a str. 2457T
cuccacacggaguaaugccagu

SEQ ID NO: 1932874 - RNA, 13 nt, Shigella flexneri 2a str. 2457T
cuccacaccggca

SEQ ID NO: 1932875 - RNA, 21 nt, Shigella flexneri 2a str. 2457T
cuccacaccggcaccauggcu

SEQ ID NO: 1932876 - RNA, 20 nt, Shigella flexneri 2a str. 2457T
cuccacaagaaugccugcca

SEQ ID NO: 1932877 - RNA, 17 nt, Shigella flexneri 2a str. 2457T
cuccccgccguugcucu

SEQ ID NO: 1932878 - RNA, 18 nt, Shigella flexneri 2a str. 2457T
cuccccuuucuuauuuuu

SEQ ID NO: 1932879 - RNA, 16 nt, Shigella flexneri 2a str. 2457T
cucccggcaaugcgcc

SEQ ID NO: 1932880 - RNA, 14 nt, Shigella flexneri 2a str. 2457T
cugugguagcggcu

SEQ ID NO: 1932881 - RNA, 21 nt, Shigella flexneri 2a str. 2457T
cugugcuuuacaccaugccac

SEQ ID NO: 1932882 - RNA, 19 nt, Shigella flexneri 2a str. 2457T
cugugcucugggccaugau

SEQ ID NO: 1932883 - RNA, 20 nt, Shigella flexneri 2a str. 2457T
cugugcugguacuggugcaa

SEQ ID NO: 1932884 - RNA, 16 nt, Shigella flexneri 2a str. 2457T
cuguguggccugcuuu

SEQ ID NO: 1932885 - RNA, 16 nt, Shigella flexneri 2a str. 2457T
cuguguaaugcggcug

SEQ ID NO: 1932886 - RNA, 20 nt, Shigella flexneri 2a str. 2457T
cugugucaggccggcauaua

SEQ ID NO: 1932887 - RNA, 13 nt, Shigella flexneri 2a str. 2457T
cuguucagccuga

SEQ ID NO: 1932888 - RNA, 16 nt, Shigella flexneri 2a str. 2457T
cuguucacuuuugcug

SEQ ID NO: 1932889 - RNA, 13 nt, Shigella flexneri 2a str. 2457T
cuguucaaacauu

SEQ ID NO: 1932890 - RNA, 15 nt, Shigella flexneri 2a str. 2457T
cuguucauccucuuc

SEQ ID NO: 1932891 - RNA, 16 nt, Shigella flexneri 2a str. 2457T
cuguucaucgacagaa

SEQ ID NO: 1932892 - RNA, 15 nt, Shigella flexneri 2a str. 2457T
cuguuacucaacuga

SEQ ID NO: 1932893 - RNA, 20 nt, Shigella flexneri 2a str. 2457T
cuguuacggugcgcagccgc

SEQ ID NO: 1932894 - RNA, 17 nt, Shigella flexneri 2a str. 2457T
cuguuacgccagaacag

SEQ ID NO: 1932895 - RNA, 20 nt, Shigella flexneri 2a str. 2457T
cuguuaucacuuaacccauu

SEQ ID NO: 1932896 - RNA, 12 nt, Shigella flexneri 2a str. 2457T
cuguuacaaacc

SEQ ID NO: 1932897 - RNA, 19 nt, Shigella flexneri 2a str. 2457T
cuguuaauguuguaagcuu

SEQ ID NO: 1932898 - RNA, 19 nt, Shigella flexneri 2a str. 2457T
cuguuacauaugcgcuggc

SEQ ID NO: 1932899 - RNA, 19 nt, Shigella flexneri 2a str. 2457T
cugugccguaaaucccagu

SEQ ID NO: 1932900 - RNA, 15 nt, Shigella flexneri 2a str. 2457T
cugugccgcugacau

SEQ ID NO: 1932901 - RNA, 16 nt, Shigella flexneri 2a str. 2457T
cugugcaaccuuuucc

SEQ ID NO: 1932902 - RNA, 15 nt, Shigella flexneri 2a str. 2457T
cugugcacccgcuuc

SEQ ID NO: 1932903 - RNA, 18 nt, Shigella flexneri 2a str. 2457T
cugugcagccaaaaauga

SEQ ID NO: 1932904 - RNA, 12 nt, Shigella flexneri 2a str. 2457T
cugugcaccaga

SEQ ID NO: 1932905 - RNA, 17 nt, Shigella flexneri 2a str. 2457T
cugugcaauauuacuuc

SEQ ID NO: 1932906 - RNA, 23 nt, Shigella flexneri 2a str. 2457T
cugugcauuuggcgcaucgguca

SEQ ID NO: 1932907 - RNA, 13 nt, Shigella flexneri 2a str. 2457T
cugugccagugcc

SEQ ID NO: 1932908 - RNA, 13 nt, Shigella flexneri 2a str. 2457T
cugucgaggccaa

SEQ ID NO: 1932909 - RNA, 23 nt, Shigella flexneri 2a str. 2457T
cugucgacaaagccgcaggcgug

SEQ ID NO: 1932910 - RNA, 12 nt, Shigella flexneri 2a str. 2457T
cugucuuccugu

SEQ ID NO: 1932911 - RNA, 12 nt, Shigella flexneri 2a str. 2457T
cugucuucccug

SEQ ID NO: 1932912 - RNA, 22 nt, Shigella flexneri 2a str. 2457T
cugucuucccugcugaaucccc

SEQ ID NO: 1932913 - RNA, 23 nt, Shigella flexneri 2a str. 2457T
cuguccgcgucuuaucaggccua

SEQ ID NO: 1932914 - RNA, 16 nt, Shigella flexneri 2a str. 2457T
cuguccgcuucaccac

SEQ ID NO: 1932915 - RNA, 18 nt, Shigella flexneri 2a str. 2457T
cuguccgcuucaccaccg

SEQ ID NO: 1932916 - RNA, 19 nt, Shigella flexneri 2a str. 2457T
cuguccgggcacauuuuua

SEQ ID NO: 1932917 - RNA, 13 nt, Shigella flexneri 2a str. 2457T
cuguccggcacca

SEQ ID NO: 1932918 - RNA, 22 nt, Shigella flexneri 2a str. 2457T
cuguccucuucagcaucaauga

SEQ ID NO: 1932919 - RNA, 17 nt, Shigella flexneri 2a str. 2457T
cugugacgacuuuuucc

SEQ ID NO: 1932920 - RNA, 18 nt, Shigella flexneri 2a str. 2457T
cugugaacucaggcugcc

SEQ ID NO: 1932921 - RNA, 19 nt, Shigella flexneri 2a str. 2457T
cugugaagauggcuaacua

SEQ ID NO: 1932922 - RNA, 14 nt, Shigella flexneri 2a str. 2457T
cugugacagauuuu

SEQ ID NO: 1932923 - RNA, 19 nt, Shigella flexneri 2a str. 2457T
cugugacagauuuugccag

SEQ ID NO: 1932924 - RNA, 18 nt, Shigella flexneri 2a str. 2457T
cuguagagcuaccggcag

SEQ ID NO: 1932925 - RNA, 21 nt, Shigella flexneri 2a str. 2457T
cuguagagcuaccggcaggaa

SEQ ID NO: 1932926 - RNA, 13 nt, Shigella flexneri 2a str. 2457T
cuguacuuccugu

SEQ ID NO: 1932927 - RNA, 17 nt, Shigella flexneri 2a str. 2457T
cuguacuugagcccugg

SEQ ID NO: 1932928 - RNA, 21 nt, Shigella flexneri 2a str. 2457T
cuguaacggugucguauucuc

SEQ ID NO: 1932929 - RNA, 23 nt, Shigella flexneri 2a str. 2457T
cuguaauaccagccuucuucauc

SEQ ID NO: 1932930 - RNA, 14 nt, Shigella flexneri 2a str. 2457T
cuguaauccucuuu

SEQ ID NO: 1932931 - RNA, 13 nt, Shigella flexneri 2a str. 2457T
cuguaaugagaau

SEQ ID NO: 1932932 - RNA, 22 nt, Shigella flexneri 2a str. 2457T
cuguaaugucaucucuggcacg

SEQ ID NO: 1932933 - RNA, 23 nt, Shigella flexneri 2a str. 2457T
cuguaucccaguucgauuuccca

SEQ ID NO: 1932934 - RNA, 20 nt, Shigella flexneri 2a str. 2457T
cuguaucaggcugaaaaucu

SEQ ID NO: 1932935 - RNA, 14 nt, Shigella flexneri 2a str. 2457T
cuguaucccagccc

SEQ ID NO: 1932936 - RNA, 20 nt, Shigella flexneri 2a str. 2457T
cugguggugcgugcggcaaa

SEQ ID NO: 1932937 - RNA, 22 nt, Shigella flexneri 2a str. 2457T
cuggugucagcgugacuggcag

SEQ ID NO: 1932938 - RNA, 19 nt, Shigella flexneri 2a str. 2457T
cuggugggcggcgugauug

SEQ ID NO: 1932939 - RNA, 14 nt, Shigella flexneri 2a str. 2457T
cuggugcuuuuuca

SEQ ID NO: 1932940 - RNA, 17 nt, Shigella flexneri 2a str. 2457T
cugguggaaaggacagu

SEQ ID NO: 1932941 - RNA, 22 nt, Shigella flexneri 2a str. 2457T
cuggugcggcaaaaacccuucu

SEQ ID NO: 1932942 - RNA, 15 nt, Shigella flexneri 2a str. 2457T
cugguaacagugcac

SEQ ID NO: 1932943 - RNA, 16 nt, Shigella flexneri 2a str. 2457T
cugguaaaccuuccac

SEQ ID NO: 1932944 - RNA, 20 nt, Shigella flexneri 2a str. 2457T
cugguaaaaaaugauuuccu

SEQ ID NO: 1932945 - RNA, 14 nt, Shigella flexneri 2a str. 2457T
cuggguauucagcg

SEQ ID NO: 1932946 - RNA, 19 nt, Shigella flexneri 2a str. 2457T
cuggguuucgccugccaga

SEQ ID NO: 1932947 - RNA, 20 nt, Shigella flexneri 2a str. 2457T
cuggguuucgccugccagau

SEQ ID NO: 1932948 - RNA, 21 nt, Shigella flexneri 2a str. 2457T
cuggguuggguucacuuuccc

SEQ ID NO: 1932949 - RNA, 19 nt, Shigella flexneri 2a str. 2457T
cugguguugcccgaugacu

SEQ ID NO: 1932950 - RNA, 19 nt, Shigella flexneri 2a str. 2457T
cugguguugcuccccagaa

SEQ ID NO: 1932951 - RNA, 23 nt, Shigella flexneri 2a str. 2457T
cugguguucuuuuacgcuaccau

SEQ ID NO: 1932952 - RNA, 22 nt, Shigella flexneri 2a str. 2457T
cugguguucgauaaccaucccu

SEQ ID NO: 1932953 - RNA, 16 nt, Shigella flexneri 2a str. 2457T
cugguucaagagagaa

SEQ ID NO: 1932954 - RNA, 22 nt, Shigella flexneri 2a str. 2457T
cugguuaguuuuagcgcgggga

SEQ ID NO: 1932955 - RNA, 16 nt, Shigella flexneri 2a str. 2457T
cugguuauauuucccc

SEQ ID NO: 1932956 - RNA, 23 nt, Shigella flexneri 2a str. 2457T
cugguuauauuuccccuguugca

SEQ ID NO: 1932957 - RNA, 16 nt, Shigella flexneri 2a str. 2457T
cugguuaccaccugcu

SEQ ID NO: 1932958 - RNA, 17 nt, Shigella flexneri 2a str. 2457T
cugguuccugacuccug

SEQ ID NO: 1932959 - RNA, 15 nt, Shigella flexneri 2a str. 2457T
cugguucugcggguu

SEQ ID NO: 1932960 - RNA, 16 nt, Shigella flexneri 2a str. 2457T
cugguuccugacuccu

SEQ ID NO: 1932961 - RNA, 16 nt, Shigella flexneri 2a str. 2457T
cugguucccaacaaca

SEQ ID NO: 1932962 - RNA, 12 nt, Shigella flexneri 2a str. 2457T
cugguucuugcu

SEQ ID NO: 1932963 - RNA, 18 nt, Shigella flexneri 2a str. 2457T
cugguugauucauggcau

SEQ ID NO: 1932964 - RNA, 13 nt, Shigella flexneri 2a str. 2457T
cugguuucucuuc

SEQ ID NO: 1932965 - RNA, 16 nt, Shigella flexneri 2a str. 2457T
cugguuuccgcuguug

SEQ ID NO: 1932966 - RNA, 19 nt, Shigella flexneri 2a str. 2457T
cugggcgcgcucagcgcca

SEQ ID NO: 1932967 - RNA, 16 nt, Shigella flexneri 2a str. 2457T
cuggguaaugacucca

SEQ ID NO: 1932968 - RNA, 17 nt, Shigella flexneri 2a str. 2457T
cuggggguucaucacca

SEQ ID NO: 1932969 - RNA, 13 nt, Shigella flexneri 2a str. 2457T
cugggcugccuga

SEQ ID NO: 1932970 - RNA, 15 nt, Shigella flexneri 2a str. 2457T
cugggcugccugagc

SEQ ID NO: 1932971 - RNA, 23 nt, Shigella flexneri 2a str. 2457T
cuggggcuuugaugucgcuucca

SEQ ID NO: 1932972 - RNA, 19 nt, Shigella flexneri 2a str. 2457T
cugggcauugaaggcagca

SEQ ID NO: 1932973 - RNA, 17 nt, Shigella flexneri 2a str. 2457T
cugggaugaaagugaug

SEQ ID NO: 1932974 - RNA, 19 nt, Shigella flexneri 2a str. 2457T
cugggaugaucaccugcau

SEQ ID NO: 1932975 - RNA, 16 nt, Shigella flexneri 2a str. 2457T
cugggcaauggugaac

SEQ ID NO: 1932976 - RNA, 14 nt, Shigella flexneri 2a str. 2457T
cugggcaaugcugu

SEQ ID NO: 1932977 - RNA, 14 nt, Shigella flexneri 2a str. 2457T
cugggcaacaaaac

SEQ ID NO: 1932978 - RNA, 22 nt, Shigella flexneri 2a str. 2457T
cugggagaugauaaccccgcaa

SEQ ID NO: 1932979 - RNA, 20 nt, Shigella flexneri 2a str. 2457T
cugggagaacggacccgcga

SEQ ID NO: 1932980 - RNA, 15 nt, Shigella flexneri 2a str. 2457T
cugggagaacgcugc

SEQ ID NO: 1932981 - RNA, 16 nt, Shigella flexneri 2a str. 2457T
cugggaaaccuggaua

SEQ ID NO: 1932982 - RNA, 17 nt, Shigella flexneri 2a str. 2457T
cugggaaaccuggauau

SEQ ID NO: 1932983 - RNA, 18 nt, Shigella flexneri 2a str. 2457T
cugggaaaucaccaccag

SEQ ID NO: 1932984 - RNA, 16 nt, Shigella flexneri 2a str. 2457T
cugggaaaucaccacc

SEQ ID NO: 1932985 - RNA, 13 nt, Shigella flexneri 2a str. 2457T
cuggcgucugggc

SEQ ID NO: 1932986 - RNA, 20 nt, Shigella flexneri 2a str. 2457T
cuggcgcacguucugucgcu

SEQ ID NO: 1932987 - RNA, 18 nt, Shigella flexneri 2a str. 2457T
cuggcucaucgccuucca

SEQ ID NO: 1932988 - RNA, 15 nt, Shigella flexneri 2a str. 2457T
cuggcucguggcuga

SEQ ID NO: 1932989 - RNA, 17 nt, Shigella flexneri 2a str. 2457T
cuggcguuuuuccaaaa

SEQ ID NO: 1932990 - RNA, 22 nt, Shigella flexneri 2a str. 2457T
cuggcguuucucgccacuaaag

SEQ ID NO: 1932991 - RNA, 23 nt, Shigella flexneri 2a str. 2457T
cuggcuaagaagccuuuaucugg

SEQ ID NO: 1932992 - RNA, 14 nt, Shigella flexneri 2a str. 2457T
cuggcuaagaagcc

SEQ ID NO: 1932993 - RNA, 17 nt, Shigella flexneri 2a str. 2457T
cuggcuguucugccucu

SEQ ID NO: 1932994 - RNA, 13 nt, Shigella flexneri 2a str. 2457T
cuggcuucccggc

SEQ ID NO: 1932995 - RNA, 14 nt, Shigella flexneri 2a str. 2457T
cuggcuucgcuguu

SEQ ID NO: 1932996 - RNA, 15 nt, Shigella flexneri 2a str. 2457T
cuggcuggcaucuug

SEQ ID NO: 1932997 - RNA, 23 nt, Shigella flexneri 2a str. 2457T
cuggcugcguaagcgccaucuga

SEQ ID NO: 1932998 - RNA, 17 nt, Shigella flexneri 2a str. 2457T
cuggcugcgcucugacu

SEQ ID NO: 1932999 - RNA, 21 nt, Shigella flexneri 2a str. 2457T
cuggcugagcaaacaguucug

SEQ ID NO: 1933000 - RNA, 16 nt, Shigella flexneri 2a str. 2457T
cuggcugcauggcaau

SEQ ID NO: 1933001 - RNA, 21 nt, Shigella flexneri 2a str. 2457T
cuggcugauaaaacucucauc

SEQ ID NO: 1933002 - RNA, 17 nt, Shigella flexneri 2a str. 2457T
cuggcagccauaaucac

SEQ ID NO: 1933003 - RNA, 19 nt, Shigella flexneri 2a str. 2457T
cuggcagcaagugcggcgc

SEQ ID NO: 1933004 - RNA, 13 nt, Shigella flexneri 2a str. 2457T
cuggccacuucug

SEQ ID NO: 1933005 - RNA, 21 nt, Shigella flexneri 2a str. 2457T
cuggccacuucuguuacucca

SEQ ID NO: 1933006 - RNA, 14 nt, Shigella flexneri 2a str. 2457T
cuggcacugggauc

SEQ ID NO: 1933007 - RNA, 19 nt, Shigella flexneri 2a str. 2457T
cuggcagaaauugacccca

SEQ ID NO: 1933008 - RNA, 16 nt, Shigella flexneri 2a str. 2457T
cuggcaacuuauuaaa

SEQ ID NO: 1933009 - RNA, 20 nt, Shigella flexneri 2a str. 2457T
cuggcaccuguaccagcccg

SEQ ID NO: 1933010 - RNA, 13 nt, Shigella flexneri 2a str. 2457T
cuggcacgaccug

SEQ ID NO: 1933011 - RNA, 15 nt, Shigella flexneri 2a str. 2457T
cuggcgacauuuucu

SEQ ID NO: 1933012 - RNA, 19 nt, Shigella flexneri 2a str. 2457T
cuggcgacgccucuauuaa

SEQ ID NO: 1933013 - RNA, 18 nt, Shigella flexneri 2a str. 2457T
cuggccuuuaauaugcca

SEQ ID NO: 1933014 - RNA, 12 nt, Shigella flexneri 2a str. 2457T
cuggccgcuucc

SEQ ID NO: 1933015 - RNA, 20 nt, Shigella flexneri 2a str. 2457T
cuggauagauauucuccagc

SEQ ID NO: 1933016 - RNA, 18 nt, Shigella flexneri 2a str. 2457T
cuggauauugcggaacau

SEQ ID NO: 1933017 - RNA, 16 nt, Shigella flexneri 2a str. 2457T
cuggaucccagaagau

SEQ ID NO: 1933018 - RNA, 12 nt, Shigella flexneri 2a str. 2457T
cugcuucugccg

SEQ ID NO: 1933019 - RNA, 14 nt, Shigella flexneri 2a str. 2457T
cugcuucugccugg

SEQ ID NO: 1933020 - RNA, 24 nt, Shigella flexneri 2a str. 2457T
cugcuuccuuaaucccuggauuug

SEQ ID NO: 1933021 - RNA, 22 nt, Shigella flexneri 2a str. 2457T
cugcuuaguaaaaauagugcgu

SEQ ID NO: 1933022 - RNA, 20 nt, Shigella flexneri 2a str. 2457T
cugcuucacgcccagaucca

SEQ ID NO: 1933023 - RNA, 23 nt, Shigella flexneri 2a str. 2457T
cugcuucagccgcacuuuuuaaa

SEQ ID NO: 1933024 - RNA, 15 nt, Shigella flexneri 2a str. 2457T
cugcuuaaauuucuu

SEQ ID NO: 1933025 - RNA, 15 nt, Shigella flexneri 2a str. 2457T
cugcuuacaggcugg

SEQ ID NO: 1933026 - RNA, 16 nt, Shigella flexneri 2a str. 2457T
cugcuuacaggcuggu

SEQ ID NO: 1933027 - RNA, 16 nt, Shigella flexneri 2a str. 2457T
cugcuuaacugcgcuu

SEQ ID NO: 1933028 - RNA, 18 nt, Shigella flexneri 2a str. 2457T
cugcuuaauaucccuucc

SEQ ID NO: 1933029 - RNA, 23 nt, Shigella flexneri 2a str. 2457T
cugcuuaauaucccuuccucccu

SEQ ID NO: 1933030 - RNA, 12 nt, Shigella flexneri 2a str. 2457T
cugcuuaauauu

SEQ ID NO: 1933031 - RNA, 13 nt, Shigella flexneri 2a str. 2457T
cuggauuucaaua

SEQ ID NO: 1933032 - RNA, 19 nt, Shigella flexneri 2a str. 2457T
cuggauuucaauaacucca

SEQ ID NO: 1933033 - RNA, 23 nt, Shigella flexneri 2a str. 2457T
cuggauuucaauaacuccaucuu

SEQ ID NO: 1933034 - RNA, 17 nt, Shigella flexneri 2a str. 2457T
cuggauuaacgcugggg

SEQ ID NO: 1933035 - RNA, 14 nt, Shigella flexneri 2a str. 2457T
cuggcaaaaauaag

SEQ ID NO: 1933036 - RNA, 22 nt, Shigella flexneri 2a str. 2457T
cuggauuuuugacuaaaguuuc

SEQ ID NO: 1933037 - RNA, 13 nt, Shigella flexneri 2a str. 2457T
cuggcaaaaauaa

SEQ ID NO: 1933038 - RNA, 15 nt, Shigella flexneri 2a str. 2457T
cuggcaaaugacaua

SEQ ID NO: 1933039 - RNA, 16 nt, Shigella flexneri 2a str. 2457T
cuggcaacaauggcau

SEQ ID NO: 1933040 - RNA, 21 nt, Shigella flexneri 2a str. 2457T
cuggaugacccggaacuccug

SEQ ID NO: 1933041 - RNA, 15 nt, Shigella flexneri 2a str. 2457T
cuggaugccagcgaa

SEQ ID NO: 1933042 - RNA, 14 nt, Shigella flexneri 2a str. 2457T
cuggaugucuggca

SEQ ID NO: 1933043 - RNA, 16 nt, Shigella flexneri 2a str. 2457T
cuggaugucuggcaga

SEQ ID NO: 1933044 - RNA, 16 nt, Shigella flexneri 2a str. 2457T
cugcucgcaucaggga

SEQ ID NO: 1933045 - RNA, 16 nt, Shigella flexneri 2a str. 2457T
cugcuccugcggcugc

SEQ ID NO: 1933046 - RNA, 17 nt, Shigella flexneri 2a str. 2457T
cugcuccuguugaugug

SEQ ID NO: 1933047 - RNA, 19 nt, Shigella flexneri 2a str. 2457T
cugcgucgcuuuccagucg

SEQ ID NO: 1933048 - RNA, 16 nt, Shigella flexneri 2a str. 2457T
cugcguauuuccugcc

SEQ ID NO: 1933049 - RNA, 19 nt, Shigella flexneri 2a str. 2457T
cugcgucgacauagccauc

SEQ ID NO: 1933050 - RNA, 18 nt, Shigella flexneri 2a str. 2457T
cugcgucgcgcguaacau

SEQ ID NO: 1933051 - RNA, 23 nt, Shigella flexneri 2a str. 2457T
cugcucccgaaccuuuucucaau

SEQ ID NO: 1933052 - RNA, 13 nt, Shigella flexneri 2a str. 2457T
cugcuccagugca

SEQ ID NO: 1933053 - RNA, 23 nt, Shigella flexneri 2a str. 2457T
cugcucgcgguuaaguuccguga

SEQ ID NO: 1933054 - RNA, 16 nt, Shigella flexneri 2a str. 2457T
cugcucggaaauauuc

SEQ ID NO: 1933055 - RNA, 17 nt, Shigella flexneri 2a str. 2457T
cugcugaccaccagcac

SEQ ID NO: 1933056 - RNA, 15 nt, Shigella flexneri 2a str. 2457T
cugcucuuccggcgu

SEQ ID NO: 1933057 - RNA, 15 nt, Shigella flexneri 2a str. 2457T
cugcucuucaguagu

SEQ ID NO: 1933058 - RNA, 11 nt, Shigella flexneri 2a str. 2457T
cugcugccgcu

SEQ ID NO: 1933059 - RNA, 23 nt, Shigella flexneri 2a str. 2457T
cugcugccggcacaggcaucacu

SEQ ID NO: 1933060 - RNA, 20 nt, Shigella flexneri 2a str. 2457T
cugcugccacauuccucugu

SEQ ID NO: 1933061 - RNA, 18 nt, Shigella flexneri 2a str. 2457T
cugcuguuaauucaggau

SEQ ID NO: 1933062 - RNA, 22 nt, Shigella flexneri 2a str. 2457T
cugcugguucggcaucgccgcu

SEQ ID NO: 1933063 - RNA, 14 nt, Shigella flexneri 2a str. 2457T
cugcugguucugcg

SEQ ID NO: 1933064 - RNA, 16 nt, Shigella flexneri 2a str. 2457T
cugcugguucugcggg

SEQ ID NO: 1933065 - RNA, 14 nt, Shigella flexneri 2a str. 2457T
cugcuggugaugga

SEQ ID NO: 1933066 - RNA, 18 nt, Shigella flexneri 2a str. 2457T
cugcuggguaaagacauc

SEQ ID NO: 1933067 - RNA, 17 nt, Shigella flexneri 2a str. 2457T
cugcgaaucgcuucauu

SEQ ID NO: 1933068 - RNA, 16 nt, Shigella flexneri 2a str. 2457T
cugcgaaaguaccauu

SEQ ID NO: 1933069 - RNA, 17 nt, Shigella flexneri 2a str. 2457T
cugccuuauccagcaga

SEQ ID NO: 1933070 - RNA, 21 nt, Shigella flexneri 2a str. 2457T
cugccgcgcacgucagccucg

SEQ ID NO: 1933071 - RNA, 15 nt, Shigella flexneri 2a str. 2457T
cugccgccaguucuu

SEQ ID NO: 1933072 - RNA, 20 nt, Shigella flexneri 2a str. 2457T
cugcgauaguggaacaaaga

SEQ ID NO: 1933073 - RNA, 21 nt, Shigella flexneri 2a str. 2457T
cugcgauaguggaacaaagaa

SEQ ID NO: 1933074 - RNA, 18 nt, Shigella flexneri 2a str. 2457T
cugcgacgucucggcaug

SEQ ID NO: 1933075 - RNA, 19 nt, Shigella flexneri 2a str. 2457T
cugcgaacgcaaucaaaua

SEQ ID NO: 1933076 - RNA, 19 nt, Shigella flexneri 2a str. 2457T
cugcgaaucgcuucauuua

SEQ ID NO: 1933077 - RNA, 21 nt, Shigella flexneri 2a str. 2457T
cugcgacagggaucucuucca

SEQ ID NO: 1933078 - RNA, 20 nt, Shigella flexneri 2a str. 2457T
cugcgcaaagaugcgaugga

SEQ ID NO: 1933079 - RNA, 14 nt, Shigella flexneri 2a str. 2457T
cugcgaugucugau

SEQ ID NO: 1933080 - RNA, 23 nt, Shigella flexneri 2a str. 2457T
cugcgcacacacgcccagcucaa

SEQ ID NO: 1933081 - RNA, 15 nt, Shigella flexneri 2a str. 2457T
cugcgccacuuccca

SEQ ID NO: 1933082 - RNA, 18 nt, Shigella flexneri 2a str. 2457T
cugcgccacuucccagcc

SEQ ID NO: 1933083 - RNA, 12 nt, Shigella flexneri 2a str. 2457T
cugcgccaauac

SEQ ID NO: 1933084 - RNA, 13 nt, Shigella flexneri 2a str. 2457T
cugcgccaccaca

SEQ ID NO: 1933085 - RNA, 14 nt, Shigella flexneri 2a str. 2457T
cugcgcugacucua

SEQ ID NO: 1933086 - RNA, 14 nt, Shigella flexneri 2a str. 2457T
cugcgcuggaacaa

SEQ ID NO: 1933087 - RNA, 16 nt, Shigella flexneri 2a str. 2457T
cugcgcuuccagcucc

SEQ ID NO: 1933088 - RNA, 21 nt, Shigella flexneri 2a str. 2457T
cugcgcuuaucaggccugcaa

SEQ ID NO: 1933089 - RNA, 14 nt, Shigella flexneri 2a str. 2457T
cugcgcuuccugca

SEQ ID NO: 1933090 - RNA, 21 nt, Shigella flexneri 2a str. 2457T
cugcgcuaaacaggaucuggu

SEQ ID NO: 1933091 - RNA, 23 nt, Shigella flexneri 2a str. 2457T
cugcggcaagaauuacuucuuga

SEQ ID NO: 1933092 - RNA, 14 nt, Shigella flexneri 2a str. 2457T
cugcggccagcagc

SEQ ID NO: 1933093 - RNA, 22 nt, Shigella flexneri 2a str. 2457T
cugcggcgaugaccgccacggu

SEQ ID NO: 1933094 - RNA, 11 nt, Shigella flexneri 2a str. 2457T
cugcguauuuc

SEQ ID NO: 1933095 - RNA, 18 nt, Shigella flexneri 2a str. 2457T
cugcguaucgcccugcca

SEQ ID NO: 1933096 - RNA, 19 nt, Shigella flexneri 2a str. 2457T
cugcggcggcaucgccuuc

SEQ ID NO: 1933097 - RNA, 21 nt, Shigella flexneri 2a str. 2457T
cugcggcgcgcaucuucguua

SEQ ID NO: 1933098 - RNA, 23 nt, Shigella flexneri 2a str. 2457T
cugcggcgugggcgcuguugcac

SEQ ID NO: 1933099 - RNA, 22 nt, Shigella flexneri 2a str. 2457T
cugagcgugccccugaauaauc

SEQ ID NO: 1933100 - RNA, 14 nt, Shigella flexneri 2a str. 2457T
cugaugaagcaagc

SEQ ID NO: 1933101 - RNA, 16 nt, Shigella flexneri 2a str. 2457T
cugaugacaaacacaa

SEQ ID NO: 1933102 - RNA, 19 nt, Shigella flexneri 2a str. 2457T
cugaugacaagcguaugau

SEQ ID NO: 1933103 - RNA, 21 nt, Shigella flexneri 2a str. 2457T
cugaugacaaacacaaaacug

SEQ ID NO: 1933104 - RNA, 20 nt, Shigella flexneri 2a str. 2457T
cugaugacaaacacaaaacu

SEQ ID NO: 1933105 - RNA, 22 nt, Shigella flexneri 2a str. 2457T
cugaugacgcgcuagugcauug

SEQ ID NO: 1933106 - RNA, 19 nt, Shigella flexneri 2a str. 2457T
cugaugcgcugggcaacaa

SEQ ID NO: 1933107 - RNA, 16 nt, Shigella flexneri 2a str. 2457T
cugaugcgcugcgcuu

SEQ ID NO: 1933108 - RNA, 18 nt, Shigella flexneri 2a str. 2457T
cugauggcgggaugugua

SEQ ID NO: 1933109 - RNA, 15 nt, Shigella flexneri 2a str. 2457T
cugaugcgacacugu

SEQ ID NO: 1933110 - RNA, 22 nt, Shigella flexneri 2a str. 2457T
cugaugcgacgcugauagcguc

SEQ ID NO: 1933111 - RNA, 22 nt, Shigella flexneri 2a str. 2457T
cugaugcgacgcuggcgcgucu

SEQ ID NO: 1933112 - RNA, 15 nt, Shigella flexneri 2a str. 2457T
cugauuuucaucuuc

SEQ ID NO: 1933113 - RNA, 23 nt, Shigella flexneri 2a str. 2457T
cugauugacgcguucgcuaaaga

SEQ ID NO: 1933114 - RNA, 17 nt, Shigella flexneri 2a str. 2457T
cugauuuugcaacaacu

SEQ ID NO: 1933115 - RNA, 22 nt, Shigella flexneri 2a str. 2457T
cugaugucagcacuuccagcuc

SEQ ID NO: 1933116 - RNA, 13 nt, Shigella flexneri 2a str. 2457T
cugauucagauaa

SEQ ID NO: 1933117 - RNA, 14 nt, Shigella flexneri 2a str. 2457T
cugauucagauaau

SEQ ID NO: 1933118 - RNA, 16 nt, Shigella flexneri 2a str. 2457T
cugauucgucaauauc

SEQ ID NO: 1933119 - RNA, 21 nt, Shigella flexneri 2a str. 2457T
cugaugguugugcuaacucau

SEQ ID NO: 1933120 - RNA, 20 nt, Shigella flexneri 2a str. 2457T
cugauguaaucaacuccgcc

SEQ ID NO: 1933121 - RNA, 13 nt, Shigella flexneri 2a str. 2457T
cugauguagucac

SEQ ID NO: 1933122 - RNA, 15 nt, Shigella flexneri 2a str. 2457T
cugaugucagcacuu

SEQ ID NO: 1933123 - RNA, 18 nt, Shigella flexneri 2a str. 2457T
cugaugucagcacuucca

SEQ ID NO: 1933124 - RNA, 23 nt, Shigella flexneri 2a str. 2457T
cugcagcagccugcgcuucuuuu

SEQ ID NO: 1933125 - RNA, 20 nt, Shigella flexneri 2a str. 2457T
cugcagcagccugcgcuucu

SEQ ID NO: 1933126 - RNA, 13 nt, Shigella flexneri 2a str. 2457T
cugcacgcccuga

SEQ ID NO: 1933127 - RNA, 19 nt, Shigella flexneri 2a str. 2457T
cugcacccuuuuuuuaaau

SEQ ID NO: 1933128 - RNA, 16 nt, Shigella flexneri 2a str. 2457T
cugcaaaauaccaaua

SEQ ID NO: 1933129 - RNA, 22 nt, Shigella flexneri 2a str. 2457T
cugcaaaauaccaauaaucaau

SEQ ID NO: 1933130 - RNA, 22 nt, Shigella flexneri 2a str. 2457T
cugcaaaucugcgccuacggca

SEQ ID NO: 1933131 - RNA, 14 nt, Shigella flexneri 2a str. 2457T
cugcaaauuauuug

SEQ ID NO: 1933132 - RNA, 15 nt, Shigella flexneri 2a str. 2457T
cugcaaauucaauaa

SEQ ID NO: 1933133 - RNA, 13 nt, Shigella flexneri 2a str. 2457T
cugcaacgagugc

SEQ ID NO: 1933134 - RNA, 13 nt, Shigella flexneri 2a str. 2457T
cugcaacagcugu

SEQ ID NO: 1933135 - RNA, 14 nt, Shigella flexneri 2a str. 2457T
cugccaauacaaaa

SEQ ID NO: 1933136 - RNA, 13 nt, Shigella flexneri 2a str. 2457T
cugcauuuucucg

SEQ ID NO: 1933137 - RNA, 18 nt, Shigella flexneri 2a str. 2457T
cugccaaacgcucccugc

SEQ ID NO: 1933138 - RNA, 13 nt, Shigella flexneri 2a str. 2457T
cugcauugucgga

SEQ ID NO: 1933139 - RNA, 19 nt, Shigella flexneri 2a str. 2457T
cugcaugacggcugaaaug

SEQ ID NO: 1933140 - RNA, 14 nt, Shigella flexneri 2a str. 2457T
cugcauguuggcga

SEQ ID NO: 1933141 - RNA, 13 nt, Shigella flexneri 2a str. 2457T
cugcauucaccag

SEQ ID NO: 1933142 - RNA, 22 nt, Shigella flexneri 2a str. 2457T
cugcauuccgguguaaccauca

SEQ ID NO: 1933143 - RNA, 22 nt, Shigella flexneri 2a str. 2457T
cugcagcuccaguuucuuuugc

SEQ ID NO: 1933144 - RNA, 21 nt, Shigella flexneri 2a str. 2457T
cugcagcggucacauguucca

SEQ ID NO: 1933145 - RNA, 23 nt, Shigella flexneri 2a str. 2457T
cugcagcgcggcgagagcuuucg

SEQ ID NO: 1933146 - RNA, 18 nt, Shigella flexneri 2a str. 2457T
cugcagccagggucaaca

SEQ ID NO: 1933147 - RNA, 21 nt, Shigella flexneri 2a str. 2457T
cugcauacggugaaaguccuc

SEQ ID NO: 1933148 - RNA, 13 nt, Shigella flexneri 2a str. 2457T
cugcauacaaaua

SEQ ID NO: 1933149 - RNA, 16 nt, Shigella flexneri 2a str. 2457T
cugcauccgccaucca

SEQ ID NO: 1933150 - RNA, 13 nt, Shigella flexneri 2a str. 2457T
cugcaucaaccaa

SEQ ID NO: 1933151 - RNA, 16 nt, Shigella flexneri 2a str. 2457T
cugcaucaaccaacac

SEQ ID NO: 1933152 - RNA, 12 nt, Shigella flexneri 2a str. 2457T
cugcaucaccau

SEQ ID NO: 1933153 - RNA, 18 nt, Shigella flexneri 2a str. 2457T
cugcccguugccaggacc

SEQ ID NO: 1933154 - RNA, 22 nt, Shigella flexneri 2a str. 2457T
cugccgcaauggccguuccggc

SEQ ID NO: 1933155 - RNA, 16 nt, Shigella flexneri 2a str. 2457T
cugccgcaguuucuga

SEQ ID NO: 1933156 - RNA, 15 nt, Shigella flexneri 2a str. 2457T
cugccgcacggacaa

SEQ ID NO: 1933157 - RNA, 12 nt, Shigella flexneri 2a str. 2457T
cugccagccagg

SEQ ID NO: 1933158 - RNA, 17 nt, Shigella flexneri 2a str. 2457T
cugccagcgccgacagc

SEQ ID NO: 1933159 - RNA, 13 nt, Shigella flexneri 2a str. 2457T
cugccagcccgcc

SEQ ID NO: 1933160 - RNA, 12 nt, Shigella flexneri 2a str. 2457T
cugccagaugca

SEQ ID NO: 1933161 - RNA, 19 nt, Shigella flexneri 2a str. 2457T
cugccauuggcaggcucug

SEQ ID NO: 1933162 - RNA, 15 nt, Shigella flexneri 2a str. 2457T
cugcccacuccagcu

SEQ ID NO: 1933163 - RNA, 20 nt, Shigella flexneri 2a str. 2457T
cugcccacgcgguauccaua

SEQ ID NO: 1933164 - RNA, 17 nt, Shigella flexneri 2a str. 2457T
cugcccacgggcaggcu

SEQ ID NO: 1933165 - RNA, 13 nt, Shigella flexneri 2a str. 2457T
cugcccacuccag

SEQ ID NO: 1933166 - RNA, 15 nt, Shigella flexneri 2a str. 2457T
cugccagcguggcga

SEQ ID NO: 1933167 - RNA, 23 nt, Shigella flexneri 2a str. 2457T
cuucagacggucagcgagauaac

SEQ ID NO: 1933168 - RNA, 13 nt, Shigella flexneri 2a str. 2457T
cuucaucgucaua

SEQ ID NO: 1933169 - RNA, 15 nt, Shigella flexneri 2a str. 2457T
cuucaucucagugag

SEQ ID NO: 1933170 - RNA, 17 nt, Shigella flexneri 2a str. 2457T
cuucaucucagugagau

SEQ ID NO: 1933171 - RNA, 21 nt, Shigella flexneri 2a str. 2457T
cuucacuuccccgagcucaau

SEQ ID NO: 1933172 - RNA, 15 nt, Shigella flexneri 2a str. 2457T
cuucacuucuuaccg

SEQ ID NO: 1933173 - RNA, 15 nt, Shigella flexneri 2a str. 2457T
cuucacuuuugccag

SEQ ID NO: 1933174 - RNA, 15 nt, Shigella flexneri 2a str. 2457T
cuucacugacuuuuc

SEQ ID NO: 1933175 - RNA, 14 nt, Shigella flexneri 2a str. 2457T
cuucacuggcgaca

SEQ ID NO: 1933176 - RNA, 13 nt, Shigella flexneri 2a str. 2457T
cuucaugaccuuc

SEQ ID NO: 1933177 - RNA, 12 nt, Shigella flexneri 2a str. 2457T
cuuccagcgcca

SEQ ID NO: 1933178 - RNA, 15 nt, Shigella flexneri 2a str. 2457T
cuuccagcggcaggc

SEQ ID NO: 1933179 - RNA, 14 nt, Shigella flexneri 2a str. 2457T
cuuccagcgauaau

SEQ ID NO: 1933180 - RNA, 23 nt, Shigella flexneri 2a str. 2457T
cuuccagaucaccgcagaagcga

SEQ ID NO: 1933181 - RNA, 11 nt, Shigella flexneri 2a str. 2457T
cuuccagcaga

SEQ ID NO: 1933182 - RNA, 19 nt, Shigella flexneri 2a str. 2457T
cuuccagcagaccagcaau

SEQ ID NO: 1933183 - RNA, 19 nt, Shigella flexneri 2a str. 2457T
cuuccagcagaccuucugc

SEQ ID NO: 1933184 - RNA, 20 nt, Shigella flexneri 2a str. 2457T
cuuccagcagaccuucugcc

SEQ ID NO: 1933185 - RNA, 15 nt, Shigella flexneri 2a str. 2457T
cuuccacgccugcau

SEQ ID NO: 1933186 - RNA, 17 nt, Shigella flexneri 2a str. 2457T
cuuccagcaaauccauc

SEQ ID NO: 1933187 - RNA, 21 nt, Shigella flexneri 2a str. 2457T
cuuccagacucugaaacucga

SEQ ID NO: 1933188 - RNA, 16 nt, Shigella flexneri 2a str. 2457T
cuuccacuuccugcgg

SEQ ID NO: 1933189 - RNA, 19 nt, Shigella flexneri 2a str. 2457T
cuuccaccguuucuuuuuc

SEQ ID NO: 1933190 - RNA, 13 nt, Shigella flexneri 2a str. 2457T
cuuccaccacuuc

SEQ ID NO: 1933191 - RNA, 16 nt, Shigella flexneri 2a str. 2457T
cuuccacaauggcaua

SEQ ID NO: 1933192 - RNA, 16 nt, Shigella flexneri 2a str. 2457T
cuuccuggcgcuggcg

SEQ ID NO: 1933193 - RNA, 21 nt, Shigella flexneri 2a str. 2457T
cuuccugggauaugagcgauu

SEQ ID NO: 1933194 - RNA, 16 nt, Shigella flexneri 2a str. 2457T
cuuccuuaaucccugg

SEQ ID NO: 1933195 - RNA, 18 nt, Shigella flexneri 2a str. 2457T
cuuccuugcguacaccaa

SEQ ID NO: 1933196 - RNA, 19 nt, Shigella flexneri 2a str. 2457T
cuuccugccagauccagug

SEQ ID NO: 1933197 - RNA, 21 nt, Shigella flexneri 2a str. 2457T
cuuccuccagcgguuuaucaa

SEQ ID NO: 1933198 - RNA, 16 nt, Shigella flexneri 2a str. 2457T
cuuccucaaccacuuu

SEQ ID NO: 1933199 - RNA, 21 nt, Shigella flexneri 2a str. 2457T
cuuccguuuaaagagcaaccc

SEQ ID NO: 1933200 - RNA, 17 nt, Shigella flexneri 2a str. 2457T
cuuccguuuaaagagca

SEQ ID NO: 1933201 - RNA, 14 nt, Shigella flexneri 2a str. 2457T
cuuccgucacaggc

SEQ ID NO: 1933202 - RNA, 16 nt, Shigella flexneri 2a str. 2457T
cuucccucuacaggaa

SEQ ID NO: 1933203 - RNA, 17 nt, Shigella flexneri 2a str. 2457T
cuuccgguuacgccacc

SEQ ID NO: 1933204 - RNA, 21 nt, Shigella flexneri 2a str. 2457T
cuucccugcugaauccccuuc

SEQ ID NO: 1933205 - RNA, 15 nt, Shigella flexneri 2a str. 2457T
cuuccaggguaaaca

SEQ ID NO: 1933206 - RNA, 22 nt, Shigella flexneri 2a str. 2457T
cuuccaggcucauaccuuccac

SEQ ID NO: 1933207 - RNA, 17 nt, Shigella flexneri 2a str. 2457T
cuuccagcggcaggccg

SEQ ID NO: 1933208 - RNA, 18 nt, Shigella flexneri 2a str. 2457T
cuuccagcguucgccaaa

SEQ ID NO: 1933209 - RNA, 12 nt, Shigella flexneri 2a str. 2457T
cuuccagcucca

SEQ ID NO: 1933210 - RNA, 15 nt, Shigella flexneri 2a str. 2457T
cuuccagcuccagcc

SEQ ID NO: 1933211 - RNA, 16 nt, Shigella flexneri 2a str. 2457T
cuuccccgcuucagcc

SEQ ID NO: 1933212 - RNA, 15 nt, Shigella flexneri 2a str. 2457T
cuucccgcagccacg

SEQ ID NO: 1933213 - RNA, 15 nt, Shigella flexneri 2a str. 2457T
cuucccggcaaucgc

SEQ ID NO: 1933214 - RNA, 22 nt, Shigella flexneri 2a str. 2457T
cuucgucccagucgucauccca

SEQ ID NO: 1933215 - RNA, 16 nt, Shigella flexneri 2a str. 2457T
cuucgguucaaguccc

SEQ ID NO: 1933216 - RNA, 15 nt, Shigella flexneri 2a str. 2457T
cuucguagacgcuuu

SEQ ID NO: 1933217 - RNA, 17 nt, Shigella flexneri 2a str. 2457T
cuucguuuucagcuucg

SEQ ID NO: 1933218 - RNA, 19 nt, Shigella flexneri 2a str. 2457T
cuucguucaucucaaacac

SEQ ID NO: 1933219 - RNA, 12 nt, Shigella flexneri 2a str. 2457T
cuucguucaucu

SEQ ID NO: 1933220 - RNA, 18 nt, Shigella flexneri 2a str. 2457T
cuucguucaucucaaaca

SEQ ID NO: 1933221 - RNA, 20 nt, Shigella flexneri 2a str. 2457T
cuucgucguaguaguucauc

SEQ ID NO: 1933222 - RNA, 16 nt, Shigella flexneri 2a str. 2457T
cuucgucgucuucguc

SEQ ID NO: 1933223 - RNA, 18 nt, Shigella flexneri 2a str. 2457T
cuucgugcggcugcaucu

SEQ ID NO: 1933224 - RNA, 19 nt, Shigella flexneri 2a str. 2457T
cuucgugcguuuguaggcc

SEQ ID NO: 1933225 - RNA, 23 nt, Shigella flexneri 2a str. 2457T
cuucguuaaacagcuuggauucu

SEQ ID NO: 1933226 - RNA, 19 nt, Shigella flexneri 2a str. 2457T
cuucuaacgacauuuucug

SEQ ID NO: 1933227 - RNA, 23 nt, Shigella flexneri 2a str. 2457T
cuucuaacgacauuuucugccca

SEQ ID NO: 1933228 - RNA, 18 nt, Shigella flexneri 2a str. 2457T
cuucuacaggcugcaucu

SEQ ID NO: 1933229 - RNA, 23 nt, Shigella flexneri 2a str. 2457T
cuucuaccuuaacgguaucuuuc

SEQ ID NO: 1933230 - RNA, 14 nt, Shigella flexneri 2a str. 2457T
cuucuauaccaaug

SEQ ID NO: 1933231 - RNA, 19 nt, Shigella flexneri 2a str. 2457T
cuucuagugcuugcacaac

SEQ ID NO: 1933232 - RNA, 14 nt, Shigella flexneri 2a str. 2457T
cuucuauauucugg

SEQ ID NO: 1933233 - RNA, 17 nt, Shigella flexneri 2a str. 2457T
cuucgaaucuuugaguu

SEQ ID NO: 1933234 - RNA, 16 nt, Shigella flexneri 2a str. 2457T
cuucgagauucuuaaa

SEQ ID NO: 1933235 - RNA, 16 nt, Shigella flexneri 2a str. 2457T
cuuccuuuuuuauuua

SEQ ID NO: 1933236 - RNA, 19 nt, Shigella flexneri 2a str. 2457T
cuucgaguacauccacugc

SEQ ID NO: 1933237 - RNA, 16 nt, Shigella flexneri 2a str. 2457T
cuucgauaaaagccau

SEQ ID NO: 1933238 - RNA, 19 nt, Shigella flexneri 2a str. 2457T
cuucgauauugacgaucuc

SEQ ID NO: 1933239 - RNA, 21 nt, Shigella flexneri 2a str. 2457T
cuucgcucauguuaucaagau

SEQ ID NO: 1933240 - RNA, 19 nt, Shigella flexneri 2a str. 2457T
cuucgcuuaucaggccuac

SEQ ID NO: 1933241 - RNA, 19 nt, Shigella flexneri 2a str. 2457T
cuucgcuuacgccugccag

SEQ ID NO: 1933242 - RNA, 16 nt, Shigella flexneri 2a str. 2457T
cuucgcugcugguucu

SEQ ID NO: 1933243 - RNA, 18 nt, Shigella flexneri 2a str. 2457T
cuucggacguuugccaug

SEQ ID NO: 1933244 - RNA, 16 nt, Shigella flexneri 2a str. 2457T
cuucgcuuuacccugg

SEQ ID NO: 1933245 - RNA, 21 nt, Shigella flexneri 2a str. 2457T
cuucgcuucaccgacaucuuu

SEQ ID NO: 1933246 - RNA, 17 nt, Shigella flexneri 2a str. 2457T
cuucggcacugaccacu

SEQ ID NO: 1933247 - RNA, 14 nt, Shigella flexneri 2a str. 2457T
cuucggucagcacg

SEQ ID NO: 1933248 - RNA, 22 nt, Shigella flexneri 2a str. 2457T
cuucgguagcagcuuucagcag

SEQ ID NO: 1933249 - RNA, 19 nt, Shigella flexneri 2a str. 2457T
cuucggcggcguugcuuuu

SEQ ID NO: 1933250 - RNA, 14 nt, Shigella flexneri 2a str. 2457T
cuucaaccacauuc

SEQ ID NO: 1933251 - RNA, 17 nt, Shigella flexneri 2a str. 2457T
cuucaacacaggccggc

SEQ ID NO: 1933252 - RNA, 12 nt, Shigella flexneri 2a str. 2457T
cuucaacacccc

SEQ ID NO: 1933253 - RNA, 13 nt, Shigella flexneri 2a str. 2457T
cuucaacaccccu

SEQ ID NO: 1933254 - RNA, 16 nt, Shigella flexneri 2a str. 2457T
cuucaacacuggcaaa

SEQ ID NO: 1933255 - RNA, 18 nt, Shigella flexneri 2a str. 2457T
cuucaacgauuucucagc

SEQ ID NO: 1933256 - RNA, 18 nt, Shigella flexneri 2a str. 2457T
cuucaaccgucaccagcc

SEQ ID NO: 1933257 - RNA, 23 nt, Shigella flexneri 2a str. 2457T
cuucaaccgucgcgcccuccugc

SEQ ID NO: 1933258 - RNA, 19 nt, Shigella flexneri 2a str. 2457T
cuucaaguguggccgccag

SEQ ID NO: 1933259 - RNA, 15 nt, Shigella flexneri 2a str. 2457T
cuucaagaauuaaaa

SEQ ID NO: 1933260 - RNA, 20 nt, Shigella flexneri 2a str. 2457T
cuucaccugccggaagcccg

SEQ ID NO: 1933261 - RNA, 21 nt, Shigella flexneri 2a str. 2457T
cuucacucucaccacgcucca

SEQ ID NO: 1933262 - RNA, 15 nt, Shigella flexneri 2a str. 2457T
cuucacccgcagcac

SEQ ID NO: 1933263 - RNA, 23 nt, Shigella flexneri 2a str. 2457T
cuucacccauugccgccucugcc

SEQ ID NO: 1933264 - RNA, 22 nt, Shigella flexneri 2a str. 2457T
cuucacccucacgcauucucuu

SEQ ID NO: 1933265 - RNA, 11 nt, Shigella flexneri 2a str. 2457T
cuucaaucgcc

SEQ ID NO: 1933266 - RNA, 14 nt, Shigella flexneri 2a str. 2457T
cuucaauauaugca

SEQ ID NO: 1933267 - RNA, 22 nt, Shigella flexneri 2a str. 2457T
cuucaauauuaaugcugaccga

SEQ ID NO: 1933268 - RNA, 20 nt, Shigella flexneri 2a str. 2457T
cuucaaucaauaacagcgca

SEQ ID NO: 1933269 - RNA, 16 nt, Shigella flexneri 2a str. 2457T
cuucaaucgccaccac

SEQ ID NO: 1933270 - RNA, 19 nt, Shigella flexneri 2a str. 2457T
cuucaaauagugccuggcu

SEQ ID NO: 1933271 - RNA, 12 nt, Shigella flexneri 2a str. 2457T
cuucaaaaauaa

SEQ ID NO: 1933272 - RNA, 14 nt, Shigella flexneri 2a str. 2457T
cuucaaaaaaguca

SEQ ID NO: 1933273 - RNA, 18 nt, Shigella flexneri 2a str. 2457T
cuuauucaaucucuucac

SEQ ID NO: 1933274 - RNA, 13 nt, Shigella flexneri 2a str. 2457T
cuuaugguucacu

SEQ ID NO: 1933275 - RNA, 18 nt, Shigella flexneri 2a str. 2457T
cuuaugccacgugagcuu

SEQ ID NO: 1933276 - RNA, 18 nt, Shigella flexneri 2a str. 2457T
cuuaugcgccguuuuuuu

SEQ ID NO: 1933277 - RNA, 22 nt, Shigella flexneri 2a str. 2457T
cuuauggcucgccauccaguga

SEQ ID NO: 1933278 - RNA, 18 nt, Shigella flexneri 2a str. 2457T
cuuauaaggaaccuccau

SEQ ID NO: 1933279 - RNA, 21 nt, Shigella flexneri 2a str. 2457T
cuuauaaagaaaaucugaauu

SEQ ID NO: 1933280 - RNA, 16 nt, Shigella flexneri 2a str. 2457T
cuuauaaagaaaaucu

SEQ ID NO: 1933281 - RNA, 15 nt, Shigella flexneri 2a str. 2457T
cuuaaauuaagaagu

SEQ ID NO: 1933282 - RNA, 22 nt, Shigella flexneri 2a str. 2457T
cuuaaauuucuuaccacugccg

SEQ ID NO: 1933283 - RNA, 19 nt, Shigella flexneri 2a str. 2457T
cuuaacauccaucgccagc

SEQ ID NO: 1933284 - RNA, 15 nt, Shigella flexneri 2a str. 2457T
cuuaacgcaccaugc

SEQ ID NO: 1933285 - RNA, 12 nt, Shigella flexneri 2a str. 2457T
cuguuccccuca

SEQ ID NO: 1933286 - RNA, 15 nt, Shigella flexneri 2a str. 2457T
cuguuccccucaccc

SEQ ID NO: 1933287 - RNA, 11 nt, Shigella flexneri 2a str. 2457T
cuguuccagca

SEQ ID NO: 1933288 - RNA, 21 nt, Shigella flexneri 2a str. 2457T
cuguuccagacgcugcauuga

SEQ ID NO: 1933289 - RNA, 16 nt, Shigella flexneri 2a str. 2457T
cuguuccggcggcagg

SEQ ID NO: 1933290 - RNA, 21 nt, Shigella flexneri 2a str. 2457T
cuuaaaugcacccgccagaga

SEQ ID NO: 1933291 - RNA, 20 nt, Shigella flexneri 2a str. 2457T
cuguucgcaaccuaaccaaa

SEQ ID NO: 1933292 - RNA, 14 nt, Shigella flexneri 2a str. 2457T
cuguucgccgccgc

SEQ ID NO: 1933293 - RNA, 18 nt, Shigella flexneri 2a str. 2457T
cuguucgccgccgcuuuc

SEQ ID NO: 1933294 - RNA, 20 nt, Shigella flexneri 2a str. 2457T
cuuaaggcuguucccacgca

SEQ ID NO: 1933295 - RNA, 16 nt, Shigella flexneri 2a str. 2457T
cuuaaggcuguuccca

SEQ ID NO: 1933296 - RNA, 14 nt, Shigella flexneri 2a str. 2457T
cuuaaggucacaga

SEQ ID NO: 1933297 - RNA, 17 nt, Shigella flexneri 2a str. 2457T
cuuaagguucacuuaau

SEQ ID NO: 1933298 - RNA, 22 nt, Shigella flexneri 2a str. 2457T
cuuaaguuagucgcuuucauuc

SEQ ID NO: 1933299 - RNA, 14 nt, Shigella flexneri 2a str. 2457T
cuuaaucgcuucuu

SEQ ID NO: 1933300 - RNA, 23 nt, Shigella flexneri 2a str. 2457T
cuuaacgguguuuaguuucguuc

SEQ ID NO: 1933301 - RNA, 13 nt, Shigella flexneri 2a str. 2457T
cuuaacgccuggc

SEQ ID NO: 1933302 - RNA, 14 nt, Shigella flexneri 2a str. 2457T
cuuaacuguaaauc

SEQ ID NO: 1933303 - RNA, 22 nt, Shigella flexneri 2a str. 2457T
cuuaagccgcuguguguaggcc

SEQ ID NO: 1933304 - RNA, 17 nt, Shigella flexneri 2a str. 2457T
cuuaauguaaugcuuug

SEQ ID NO: 1933305 - RNA, 19 nt, Shigella flexneri 2a str. 2457T
cuuaauggucugaaaggua

SEQ ID NO: 1933306 - RNA, 20 nt, Shigella flexneri 2a str. 2457T
cuuaauggucugaaagguau

SEQ ID NO: 1933307 - RNA, 16 nt, Shigella flexneri 2a str. 2457T
cuuaauggaaaacugu

SEQ ID NO: 1933308 - RNA, 18 nt, Shigella flexneri 2a str. 2457T
cuuaauggaaaacuguuu

SEQ ID NO: 1933309 - RNA, 20 nt, Shigella flexneri 2a str. 2457T
cuuaaugcaggcagcacugc

SEQ ID NO: 1933310 - RNA, 17 nt, Shigella flexneri 2a str. 2457T
cuuaccaaauaaacgaa

SEQ ID NO: 1933311 - RNA, 13 nt, Shigella flexneri 2a str. 2457T
cuuaccacugccg

SEQ ID NO: 1933312 - RNA, 16 nt, Shigella flexneri 2a str. 2457T
cuuacccuaaauccgc

SEQ ID NO: 1933313 - RNA, 20 nt, Shigella flexneri 2a str. 2457T
cuuaccggucccuucaaucu

SEQ ID NO: 1933314 - RNA, 17 nt, Shigella flexneri 2a str. 2457T
cuuagguaaugacucca

SEQ ID NO: 1933315 - RNA, 22 nt, Shigella flexneri 2a str. 2457T
cuuagcugaucgacaaaauccc

SEQ ID NO: 1933316 - RNA, 14 nt, Shigella flexneri 2a str. 2457T
cuuucguuccggcu

SEQ ID NO: 1933317 - RNA, 14 nt, Shigella flexneri 2a str. 2457T
cuuucguuaaauuc

SEQ ID NO: 1933318 - RNA, 22 nt, Shigella flexneri 2a str. 2457T
cuuucguuaaauucuucugaau

SEQ ID NO: 1933319 - RNA, 23 nt, Shigella flexneri 2a str. 2457T
cuuucguuaaauucuucugaaug

SEQ ID NO: 1933320 - RNA, 22 nt, Shigella flexneri 2a str. 2457T
cuuucuggaaaucgccucgcau

SEQ ID NO: 1933321 - RNA, 16 nt, Shigella flexneri 2a str. 2457T
cuuucuggcacgaccu

SEQ ID NO: 1933322 - RNA, 18 nt, Shigella flexneri 2a str. 2457T
cuuucuggcaucacuucu

SEQ ID NO: 1933323 - RNA, 14 nt, Shigella flexneri 2a str. 2457T
cuuucuuaaauuaa

SEQ ID NO: 1933324 - RNA, 16 nt, Shigella flexneri 2a str. 2457T
cuuucuuaaauuaaga

SEQ ID NO: 1933325 - RNA, 23 nt, Shigella flexneri 2a str. 2457T
cuuucugcccgcguuuccacgcu

SEQ ID NO: 1933326 - RNA, 18 nt, Shigella flexneri 2a str. 2457T
cuuucugcauccguucuu

SEQ ID NO: 1933327 - RNA, 23 nt, Shigella flexneri 2a str. 2457T
cuuucugcaauuaaggucggcuu

SEQ ID NO: 1933328 - RNA, 18 nt, Shigella flexneri 2a str. 2457T
cuuuccaaaccucagagu

SEQ ID NO: 1933329 - RNA, 17 nt, Shigella flexneri 2a str. 2457T
cuuucauuuucggcagu

SEQ ID NO: 1933330 - RNA, 18 nt, Shigella flexneri 2a str. 2457T
cuuucauuucaauaaauu

SEQ ID NO: 1933331 - RNA, 18 nt, Shigella flexneri 2a str. 2457T
cuuuccaacuguaccagc

SEQ ID NO: 1933332 - RNA, 20 nt, Shigella flexneri 2a str. 2457T
cuuuccaacuguaccagcaa

SEQ ID NO: 1933333 - RNA, 20 nt, Shigella flexneri 2a str. 2457T
cuuucgucugguucgccaaa

SEQ ID NO: 1933334 - RNA, 19 nt, Shigella flexneri 2a str. 2457T
cuuucguggugagggcaaa

SEQ ID NO: 1933335 - RNA, 15 nt, Shigella flexneri 2a str. 2457T
cuuuccagccacagu

SEQ ID NO: 1933336 - RNA, 21 nt, Shigella flexneri 2a str. 2457T
cuuugacugcuuuuacaaaau

SEQ ID NO: 1933337 - RNA, 14 nt, Shigella flexneri 2a str. 2457T
cuuucuucagccgu

SEQ ID NO: 1933338 - RNA, 22 nt, Shigella flexneri 2a str. 2457T
cuuucuuaccccugauuuuguu

SEQ ID NO: 1933339 - RNA, 12 nt, Shigella flexneri 2a str. 2457T
cuuugaauaucu

SEQ ID NO: 1933340 - RNA, 14 nt, Shigella flexneri 2a str. 2457T
cuuugaauaucucc

SEQ ID NO: 1933341 - RNA, 18 nt, Shigella flexneri 2a str. 2457T
cuuugaauaucuccucug

SEQ ID NO: 1933342 - RNA, 13 nt, Shigella flexneri 2a str. 2457T
cuuuggcaucaau

SEQ ID NO: 1933343 - RNA, 17 nt, Shigella flexneri 2a str. 2457T
cuuugcuaccuuccucc

SEQ ID NO: 1933344 - RNA, 14 nt, Shigella flexneri 2a str. 2457T
cuuugcuacagccu

SEQ ID NO: 1933345 - RNA, 20 nt, Shigella flexneri 2a str. 2457T
cuuugcuuuguaaagcgcca

SEQ ID NO: 1933346 - RNA, 14 nt, Shigella flexneri 2a str. 2457T
cuuugcuuccugag

SEQ ID NO: 1933347 - RNA, 16 nt, Shigella flexneri 2a str. 2457T
cuuugcuuccugagua

SEQ ID NO: 1933348 - RNA, 12 nt, Shigella flexneri 2a str. 2457T
cuuugcuguaca

SEQ ID NO: 1933349 - RNA, 17 nt, Shigella flexneri 2a str. 2457T
cuuugcugauucucccu

SEQ ID NO: 1933350 - RNA, 14 nt, Shigella flexneri 2a str. 2457T
cuuugcuggcuggc

SEQ ID NO: 1933351 - RNA, 21 nt, Shigella flexneri 2a str. 2457T
cuuugcgagucugcuccagaa

SEQ ID NO: 1933352 - RNA, 15 nt, Shigella flexneri 2a str. 2457T
cuuugccgucagcca

SEQ ID NO: 1933353 - RNA, 11 nt, Shigella flexneri 2a str. 2457T
cuuugccuggc

SEQ ID NO: 1933354 - RNA, 16 nt, Shigella flexneri 2a str. 2457T
cuuugccuggcggcag

SEQ ID NO: 1933355 - RNA, 15 nt, Shigella flexneri 2a str. 2457T
cuuugccccagcggg

SEQ ID NO: 1933356 - RNA, 24 nt, Shigella flexneri 2a str. 2457T
cuuugcccgcagauccagugcuca

SEQ ID NO: 1933357 - RNA, 15 nt, Shigella flexneri 2a str. 2457T
cuuugauuaaccguu

SEQ ID NO: 1933358 - RNA, 19 nt, Shigella flexneri 2a str. 2457T
cuuugauugaagaaaucag

SEQ ID NO: 1933359 - RNA, 23 nt, Shigella flexneri 2a str. 2457T
cuuugauguacgcugccgcuucu

SEQ ID NO: 1933360 - RNA, 21 nt, Shigella flexneri 2a str. 2457T
cuuugaucugcgucgcuuucc

SEQ ID NO: 1933361 - RNA, 13 nt, Shigella flexneri 2a str. 2457T
cuuugcaagcguu

SEQ ID NO: 1933362 - RNA, 16 nt, Shigella flexneri 2a str. 2457T
cuugucugagccgaaa

SEQ ID NO: 1933363 - RNA, 13 nt, Shigella flexneri 2a str. 2457T
cuugucuacgccu

SEQ ID NO: 1933364 - RNA, 21 nt, Shigella flexneri 2a str. 2457T
cuuuaauggcaccguucuuua

SEQ ID NO: 1933365 - RNA, 23 nt, Shigella flexneri 2a str. 2457T
cuuuacuguuccgauaaguucag

SEQ ID NO: 1933366 - RNA, 18 nt, Shigella flexneri 2a str. 2457T
cuuuagccgguuuuucaa

SEQ ID NO: 1933367 - RNA, 18 nt, Shigella flexneri 2a str. 2457T
cuuuaauuuugugcagca

SEQ ID NO: 1933368 - RNA, 15 nt, Shigella flexneri 2a str. 2457T
cuuuacugacugucc

SEQ ID NO: 1933369 - RNA, 20 nt, Shigella flexneri 2a str. 2457T
cuuuaucuaucaggacgaaa

SEQ ID NO: 1933370 - RNA, 21 nt, Shigella flexneri 2a str. 2457T
cuuuaucugccggacuuaagg

SEQ ID NO: 1933371 - RNA, 23 nt, Shigella flexneri 2a str. 2457T
cuuuaucugauuugauaaugcca

SEQ ID NO: 1933372 - RNA, 13 nt, Shigella flexneri 2a str. 2457T
cuuuaugcagcuc

SEQ ID NO: 1933373 - RNA, 13 nt, Shigella flexneri 2a str. 2457T
cuuuauugcaaac

SEQ ID NO: 1933374 - RNA, 17 nt, Shigella flexneri 2a str. 2457T
cuuuauugcaaacauuu

SEQ ID NO: 1933375 - RNA, 20 nt, Shigella flexneri 2a str. 2457T
cuuuauuuauaucagugaua

SEQ ID NO: 1933376 - RNA, 21 nt, Shigella flexneri 2a str. 2457T
cuuuauucggcauacauaauc

SEQ ID NO: 1933377 - RNA, 19 nt, Shigella flexneri 2a str. 2457T
cuuuauaaucccuccagca

SEQ ID NO: 1933378 - RNA, 15 nt, Shigella flexneri 2a str. 2457T
cuuuaucccuggugg

SEQ ID NO: 1933379 - RNA, 18 nt, Shigella flexneri 2a str. 2457T
cuuuaucgccgcuggaaa

SEQ ID NO: 1933380 - RNA, 13 nt, Shigella flexneri 2a str. 2457T
cuuuauccugacu

SEQ ID NO: 1933381 - RNA, 23 nt, Shigella flexneri 2a str. 2457T
cuuuauccugcccacuccagcua

SEQ ID NO: 1933382 - RNA, 19 nt, Shigella flexneri 2a str. 2457T
cuuucaacguagccugcca

SEQ ID NO: 1933383 - RNA, 14 nt, Shigella flexneri 2a str. 2457T
cuuucacaaaaaua

SEQ ID NO: 1933384 - RNA, 16 nt, Shigella flexneri 2a str. 2457T
cuuucacaaaaauaau

SEQ ID NO: 1933385 - RNA, 12 nt, Shigella flexneri 2a str. 2457T
cuuucacugccc

SEQ ID NO: 1933386 - RNA, 15 nt, Shigella flexneri 2a str. 2457T
cuuucagcaaaccac

SEQ ID NO: 1933387 - RNA, 18 nt, Shigella flexneri 2a str. 2457T
cuuucagaaucagguuga

SEQ ID NO: 1933388 - RNA, 19 nt, Shigella flexneri 2a str. 2457T
cuuucagagaagcaccgcc

SEQ ID NO: 1933389 - RNA, 13 nt, Shigella flexneri 2a str. 2457T
cuuucagcacuua

SEQ ID NO: 1933390 - RNA, 17 nt, Shigella flexneri 2a str. 2457T
cuuucagcaccagcccg

SEQ ID NO: 1933391 - RNA, 16 nt, Shigella flexneri 2a str. 2457T
cuuucagcgaaaaagu

SEQ ID NO: 1933392 - RNA, 18 nt, Shigella flexneri 2a str. 2457T
cuuucagcgaaaaagucc

SEQ ID NO: 1933393 - RNA, 17 nt, Shigella flexneri 2a str. 2457T
cuugccuuuccuccugu

SEQ ID NO: 1933394 - RNA, 17 nt, Shigella flexneri 2a str. 2457T
cuugccgcgucuuauca

SEQ ID NO: 1933395 - RNA, 14 nt, Shigella flexneri 2a str. 2457T
cuugcgacucagcc

SEQ ID NO: 1933396 - RNA, 20 nt, Shigella flexneri 2a str. 2457T
cuugcgagacggcggaaagg

SEQ ID NO: 1933397 - RNA, 15 nt, Shigella flexneri 2a str. 2457T
cuugcugcuccagcg

SEQ ID NO: 1933398 - RNA, 21 nt, Shigella flexneri 2a str. 2457T
cuugcugcuccagcgggcgaa

SEQ ID NO: 1933399 - RNA, 19 nt, Shigella flexneri 2a str. 2457T
cuuggcauuaaacagccaa

SEQ ID NO: 1933400 - RNA, 14 nt, Shigella flexneri 2a str. 2457T
cuugcuuaaaaaau

SEQ ID NO: 1933401 - RNA, 15 nt, Shigella flexneri 2a str. 2457T
cuugcuuaaaauccc

SEQ ID NO: 1933402 - RNA, 15 nt, Shigella flexneri 2a str. 2457T
cuugcuggucacuga

SEQ ID NO: 1933403 - RNA, 16 nt, Shigella flexneri 2a str. 2457T
cuugucacgucucauc

SEQ ID NO: 1933404 - RNA, 20 nt, Shigella flexneri 2a str. 2457T
cuugucaccguaaccaccag

SEQ ID NO: 1933405 - RNA, 17 nt, Shigella flexneri 2a str. 2457T
cuuguauaucaaaccac

SEQ ID NO: 1933406 - RNA, 17 nt, Shigella flexneri 2a str. 2457T
cuuguaggaaucaggca

SEQ ID NO: 1933407 - RNA, 22 nt, Shigella flexneri 2a str. 2457T
cuuggcgggcaacguuccagca

SEQ ID NO: 1933408 - RNA, 16 nt, Shigella flexneri 2a str. 2457T
cuuggcugggauagcu

SEQ ID NO: 1933409 - RNA, 15 nt, Shigella flexneri 2a str. 2457T
cuugccagagcagca

SEQ ID NO: 1933410 - RNA, 16 nt, Shigella flexneri 2a str. 2457T
cuugccagcaggguuu

SEQ ID NO: 1933411 - RNA, 14 nt, Shigella flexneri 2a str. 2457T
cuugccaacgcaaa

SEQ ID NO: 1933412 - RNA, 18 nt, Shigella flexneri 2a str. 2457T
cuugcaagccuguaguac

SEQ ID NO: 1933413 - RNA, 23 nt, Shigella flexneri 2a str. 2457T
cuugcaacuccggcgaaaauccc

SEQ ID NO: 1933414 - RNA, 15 nt, Shigella flexneri 2a str. 2457T
cuugccauuccacaa

SEQ ID NO: 1933415 - RNA, 16 nt, Shigella flexneri 2a str. 2457T
cuugagacauuguuuc

SEQ ID NO: 1933416 - RNA, 18 nt, Shigella flexneri 2a str. 2457T
cuugacucuguagcggga

SEQ ID NO: 1933417 - RNA, 13 nt, Shigella flexneri 2a str. 2457T
cuugaucuuccug

SEQ ID NO: 1933418 - RNA, 17 nt, Shigella flexneri 2a str. 2457T
cuugaucuuccugauaa

SEQ ID NO: 1933419 - RNA, 13 nt, Shigella flexneri 2a str. 2457T
cuugaugaaaaaa

SEQ ID NO: 1933420 - RNA, 19 nt, Shigella flexneri 2a str. 2457T
cuucucagcgguaaugguc

SEQ ID NO: 1933421 - RNA, 16 nt, Shigella flexneri 2a str. 2457T
cuucucauccuucccc

SEQ ID NO: 1933422 - RNA, 17 nt, Shigella flexneri 2a str. 2457T
cuucucaggccuacaaa

SEQ ID NO: 1933423 - RNA, 21 nt, Shigella flexneri 2a str. 2457T
cuucucaaucccuuucucuuc

SEQ ID NO: 1933424 - RNA, 15 nt, Shigella flexneri 2a str. 2457T
cuucucagauauaaa

SEQ ID NO: 1933425 - RNA, 13 nt, Shigella flexneri 2a str. 2457T
cuucucagccaaa

SEQ ID NO: 1933426 - RNA, 17 nt, Shigella flexneri 2a str. 2457T
cuucucaaucccuuucu

SEQ ID NO: 1933427 - RNA, 22 nt, Shigella flexneri 2a str. 2457T
cuucuuuugucgugcccugcgc

SEQ ID NO: 1933428 - RNA, 20 nt, Shigella flexneri 2a str. 2457T
cuucuuuuuaccuucauuug

SEQ ID NO: 1933429 - RNA, 13 nt, Shigella flexneri 2a str. 2457T
cuugaagggcugg

SEQ ID NO: 1933430 - RNA, 23 nt, Shigella flexneri 2a str. 2457T
cuugacgcgucuuaucaggccua

SEQ ID NO: 1933431 - RNA, 21 nt, Shigella flexneri 2a str. 2457T
cuugacgcgucuuaucaggcc

SEQ ID NO: 1933432 - RNA, 17 nt, Shigella flexneri 2a str. 2457T
cuugacgccauuuuuua

SEQ ID NO: 1933433 - RNA, 20 nt, Shigella flexneri 2a str. 2457T
cuugacgccauuuuuuauac

SEQ ID NO: 1933434 - RNA, 12 nt, Shigella flexneri 2a str. 2457T
cgcgaagcuggu

SEQ ID NO: 1933435 - RNA, 13 nt, Shigella flexneri 2a str. 2457T
cgcgaacuggaug

SEQ ID NO: 1933436 - RNA, 18 nt, Shigella flexneri 2a str. 2457T
cgcgaacugucgguuugu

SEQ ID NO: 1933437 - RNA, 13 nt, Shigella flexneri 2a str. 2457T
cgcgaagaaacga

SEQ ID NO: 1933438 - RNA, 21 nt, Shigella flexneri 2a str. 2457T
cgcgaaccgccuggcgcugcu

SEQ ID NO: 1933439 - RNA, 13 nt, Shigella flexneri 2a str. 2457T
cgcgaaccuguga

SEQ ID NO: 1933440 - RNA, 19 nt, Shigella flexneri 2a str. 2457T
cgcgaacggggcugccagc

SEQ ID NO: 1933441 - RNA, 20 nt, Shigella flexneri 2a str. 2457T
cgcgaacuaaacaacgccgc

SEQ ID NO: 1933442 - RNA, 17 nt, Shigella flexneri 2a str. 2457T
cgcgaacuaaacaacgc

SEQ ID NO: 1933443 - RNA, 18 nt, Shigella flexneri 2a str. 2457T
cgcgaacagcacaucagc

SEQ ID NO: 1933444 - RNA, 13 nt, Shigella flexneri 2a str. 2457T
cgccuucuugaac

SEQ ID NO: 1933445 - RNA, 16 nt, Shigella flexneri 2a str. 2457T
cgccuucuacagcuuc

SEQ ID NO: 1933446 - RNA, 22 nt, Shigella flexneri 2a str. 2457T
cgccuuuaauauuaacgccagc

SEQ ID NO: 1933447 - RNA, 20 nt, Shigella flexneri 2a str. 2457T
cgccuuuaaaucccgcuuca

SEQ ID NO: 1933448 - RNA, 20 nt, Shigella flexneri 2a str. 2457T
cgccuuuaauauuaacgcca

SEQ ID NO: 1933449 - RNA, 16 nt, Shigella flexneri 2a str. 2457T
cgccuucacgguuauu

SEQ ID NO: 1933450 - RNA, 17 nt, Shigella flexneri 2a str. 2457T
cgccuucauucaggcca

SEQ ID NO: 1933451 - RNA, 22 nt, Shigella flexneri 2a str. 2457T
cgccuucauucaggccaaagcc

SEQ ID NO: 1933452 - RNA, 14 nt, Shigella flexneri 2a str. 2457T
cgccuuacgcugcg

SEQ ID NO: 1933453 - RNA, 13 nt, Shigella flexneri 2a str. 2457T
cgccuguugcguc

SEQ ID NO: 1933454 - RNA, 12 nt, Shigella flexneri 2a str. 2457T
cgccugcagguu

SEQ ID NO: 1933455 - RNA, 11 nt, Shigella flexneri 2a str. 2457T
cgccugcuucg

SEQ ID NO: 1933456 - RNA, 23 nt, Shigella flexneri 2a str. 2457T
cgccugcggggagaugugauaac

SEQ ID NO: 1933457 - RNA, 20 nt, Shigella flexneri 2a str. 2457T
cgccguuuuuacccagcagc

SEQ ID NO: 1933458 - RNA, 20 nt, Shigella flexneri 2a str. 2457T
cgccucaacgccuaaugcca

SEQ ID NO: 1933459 - RNA, 15 nt, Shigella flexneri 2a str. 2457T
cgccucacagggcuc

SEQ ID NO: 1933460 - RNA, 19 nt, Shigella flexneri 2a str. 2457T
cgccucacuauccgcccca

SEQ ID NO: 1933461 - RNA, 15 nt, Shigella flexneri 2a str. 2457T
cgccuacggcauucu

SEQ ID NO: 1933462 - RNA, 17 nt, Shigella flexneri 2a str. 2457T
cgccgucgauggcgcag

SEQ ID NO: 1933463 - RNA, 14 nt, Shigella flexneri 2a str. 2457T
cgccgugaacgugg

SEQ ID NO: 1933464 - RNA, 18 nt, Shigella flexneri 2a str. 2457T
cgccgugcacaccgaaga

SEQ ID NO: 1933465 - RNA, 20 nt, Shigella flexneri 2a str. 2457T
cgccguuagcuucagccggg

SEQ ID NO: 1933466 - RNA, 19 nt, Shigella flexneri 2a str. 2457T
cgccucguaaugcuccggc

SEQ ID NO: 1933467 - RNA, 13 nt, Shigella flexneri 2a str. 2457T
cgccucggggcca

SEQ ID NO: 1933468 - RNA, 11 nt, Shigella flexneri 2a str. 2457T
cgccucuucca

SEQ ID NO: 1933469 - RNA, 18 nt, Shigella flexneri 2a str. 2457T
cgccugcaccauugcugc

SEQ ID NO: 1933470 - RNA, 13 nt, Shigella flexneri 2a str. 2457T
cgccugcaaauaa

SEQ ID NO: 1933471 - RNA, 15 nt, Shigella flexneri 2a str. 2457T
cgccugaucgcgcag

SEQ ID NO: 1933472 - RNA, 18 nt, Shigella flexneri 2a str. 2457T
cgccucgagaaauuuuua

SEQ ID NO: 1933473 - RNA, 13 nt, Shigella flexneri 2a str. 2457T
cgcgccagcuuag

SEQ ID NO: 1933474 - RNA, 21 nt, Shigella flexneri 2a str. 2457T
cgcgccauuucggcgugcugu

SEQ ID NO: 1933475 - RNA, 13 nt, Shigella flexneri 2a str. 2457T
cgcgcccgcgcag

SEQ ID NO: 1933476 - RNA, 18 nt, Shigella flexneri 2a str. 2457T
cgcgccccacggauugcc

SEQ ID NO: 1933477 - RNA, 17 nt, Shigella flexneri 2a str. 2457T
cgcgcccuccugcagcg

SEQ ID NO: 1933478 - RNA, 15 nt, Shigella flexneri 2a str. 2457T
cgcgccgccaacccc

SEQ ID NO: 1933479 - RNA, 19 nt, Shigella flexneri 2a str. 2457T
cgcgcacgcccaucagcgg

SEQ ID NO: 1933480 - RNA, 16 nt, Shigella flexneri 2a str. 2457T
cgcgcacgucagccuc

SEQ ID NO: 1933481 - RNA, 15 nt, Shigella flexneri 2a str. 2457T
cgcgcaccuacagcc

SEQ ID NO: 1933482 - RNA, 20 nt, Shigella flexneri 2a str. 2457T
cgcgcaccggaacaacccag

SEQ ID NO: 1933483 - RNA, 12 nt, Shigella flexneri 2a str. 2457T
cgcgcagcuuca

SEQ ID NO: 1933484 - RNA, 18 nt, Shigella flexneri 2a str. 2457T
cgcgccaaucagcgcagc

SEQ ID NO: 1933485 - RNA, 15 nt, Shigella flexneri 2a str. 2457T
cgcgcaucagcuccg

SEQ ID NO: 1933486 - RNA, 22 nt, Shigella flexneri 2a str. 2457T
cgcgaccucacuuucuggcagc

SEQ ID NO: 1933487 - RNA, 20 nt, Shigella flexneri 2a str. 2457T
cgcgaccaucggaucggcca

SEQ ID NO: 1933488 - RNA, 12 nt, Shigella flexneri 2a str. 2457T
cgcgaccgccgc

SEQ ID NO: 1933489 - RNA, 20 nt, Shigella flexneri 2a str. 2457T
cgcgacacaauccaugccaa

SEQ ID NO: 1933490 - RNA, 23 nt, Shigella flexneri 2a str. 2457T
cgcgaccagcgucgcaucaggca

SEQ ID NO: 1933491 - RNA, 13 nt, Shigella flexneri 2a str. 2457T
cgcgaccaccagc

SEQ ID NO: 1933492 - RNA, 16 nt, Shigella flexneri 2a str. 2457T
cgcgacucccugacug

SEQ ID NO: 1933493 - RNA, 15 nt, Shigella flexneri 2a str. 2457T
cgcgacuuuuuccug

SEQ ID NO: 1933494 - RNA, 14 nt, Shigella flexneri 2a str. 2457T
cgcgacuuuuuccu

SEQ ID NO: 1933495 - RNA, 14 nt, Shigella flexneri 2a str. 2457T
cgcgauccggcggu

SEQ ID NO: 1933496 - RNA, 14 nt, Shigella flexneri 2a str. 2457T
cgcgaugaccaaaa

SEQ ID NO: 1933497 - RNA, 22 nt, Shigella flexneri 2a str. 2457T
cgcgauaucgcgguacuucuca

SEQ ID NO: 1933498 - RNA, 15 nt, Shigella flexneri 2a str. 2457T
cgcgauacaccagau

SEQ ID NO: 1933499 - RNA, 15 nt, Shigella flexneri 2a str. 2457T
cgcgauaccacccgc

SEQ ID NO: 1933500 - RNA, 14 nt, Shigella flexneri 2a str. 2457T
cgcgagguaacauc

SEQ ID NO: 1933501 - RNA, 21 nt, Shigella flexneri 2a str. 2457T
cgcgcaaucagcaccgcgcgu

SEQ ID NO: 1933502 - RNA, 22 nt, Shigella flexneri 2a str. 2457T
cgccgggaugauggcuuuggcg

SEQ ID NO: 1933503 - RNA, 20 nt, Shigella flexneri 2a str. 2457T
cgccgucaucacgcaggcug

SEQ ID NO: 1933504 - RNA, 18 nt, Shigella flexneri 2a str. 2457T
cgccguauaauaucuuuu

SEQ ID NO: 1933505 - RNA, 21 nt, Shigella flexneri 2a str. 2457T
cgccguacggcguaccgccgc

SEQ ID NO: 1933506 - RNA, 16 nt, Shigella flexneri 2a str. 2457T
cgccgguuccagcuuc

SEQ ID NO: 1933507 - RNA, 17 nt, Shigella flexneri 2a str. 2457T
cgccggugaccaucagc

SEQ ID NO: 1933508 - RNA, 15 nt, Shigella flexneri 2a str. 2457T
cgccggucacgcccg

SEQ ID NO: 1933509 - RNA, 14 nt, Shigella flexneri 2a str. 2457T
cgccgguagucacc

SEQ ID NO: 1933510 - RNA, 13 nt, Shigella flexneri 2a str. 2457T
cgccgcuaccggc

SEQ ID NO: 1933511 - RNA, 19 nt, Shigella flexneri 2a str. 2457T
cgccgcguuugcgcagcca

SEQ ID NO: 1933512 - RNA, 23 nt, Shigella flexneri 2a str. 2457T
cgccgcuucuguuuuaccugcgc

SEQ ID NO: 1933513 - RNA, 15 nt, Shigella flexneri 2a str. 2457T
cgccgcuuaccauaa

SEQ ID NO: 1933514 - RNA, 19 nt, Shigella flexneri 2a str. 2457T
cgccgcugucuaccagcac

SEQ ID NO: 1933515 - RNA, 19 nt, Shigella flexneri 2a str. 2457T
cgccggaaauuugcagugc

SEQ ID NO: 1933516 - RNA, 17 nt, Shigella flexneri 2a str. 2457T
cgccgcgguacagcucg

SEQ ID NO: 1933517 - RNA, 16 nt, Shigella flexneri 2a str. 2457T
cgccgcgacgcccccu

SEQ ID NO: 1933518 - RNA, 15 nt, Shigella flexneri 2a str. 2457T
cgccgcgacacaacg

SEQ ID NO: 1933519 - RNA, 13 nt, Shigella flexneri 2a str. 2457T
cgcccuggaugca

SEQ ID NO: 1933520 - RNA, 23 nt, Shigella flexneri 2a str. 2457T
cgcccuucacccauugccgccuc

SEQ ID NO: 1933521 - RNA, 12 nt, Shigella flexneri 2a str. 2457T
cgcccuccugca

SEQ ID NO: 1933522 - RNA, 22 nt, Shigella flexneri 2a str. 2457T
cgcccugaaccgacgacagauu

SEQ ID NO: 1933523 - RNA, 14 nt, Shigella flexneri 2a str. 2457T
cgcccucacccgua

SEQ ID NO: 1933524 - RNA, 18 nt, Shigella flexneri 2a str. 2457T
cgcccucagcccacaucc

SEQ ID NO: 1933525 - RNA, 19 nt, Shigella flexneri 2a str. 2457T
cgcccgguuuucgcgcgca

SEQ ID NO: 1933526 - RNA, 16 nt, Shigella flexneri 2a str. 2457T
cgccgacaaagaugca

SEQ ID NO: 1933527 - RNA, 18 nt, Shigella flexneri 2a str. 2457T
cgccgaauaacgcgcagc

SEQ ID NO: 1933528 - RNA, 14 nt, Shigella flexneri 2a str. 2457T
cgccgacgcccugc

SEQ ID NO: 1933529 - RNA, 13 nt, Shigella flexneri 2a str. 2457T
cgccgacggcgcu

SEQ ID NO: 1933530 - RNA, 19 nt, Shigella flexneri 2a str. 2457T
cgccgacggguaagaucuu

SEQ ID NO: 1933531 - RNA, 19 nt, Shigella flexneri 2a str. 2457T
cgccgagcaguugcuucau

SEQ ID NO: 1933532 - RNA, 21 nt, Shigella flexneri 2a str. 2457T
cgccgacggucaggcuaauac

SEQ ID NO: 1933533 - RNA, 15 nt, Shigella flexneri 2a str. 2457T
cgccgccacugccac

SEQ ID NO: 1933534 - RNA, 14 nt, Shigella flexneri 2a str. 2457T
cgccgccacugcca

SEQ ID NO: 1933535 - RNA, 22 nt, Shigella flexneri 2a str. 2457T
cgccgccguuagcuucagccgg

SEQ ID NO: 1933536 - RNA, 17 nt, Shigella flexneri 2a str. 2457T
cgccgccgagcaccacg

SEQ ID NO: 1933537 - RNA, 16 nt, Shigella flexneri 2a str. 2457T
cgccgccgcuggcgug

SEQ ID NO: 1933538 - RNA, 22 nt, Shigella flexneri 2a str. 2457T
cgccgcauagcgacaggcuuuc

SEQ ID NO: 1933539 - RNA, 19 nt, Shigella flexneri 2a str. 2457T
cgccgcauccgacacuggc

SEQ ID NO: 1933540 - RNA, 19 nt, Shigella flexneri 2a str. 2457T
cgccgauaucgcuggcaga

SEQ ID NO: 1933541 - RNA, 18 nt, Shigella flexneri 2a str. 2457T
cgccgaucgaagagacgc

SEQ ID NO: 1933542 - RNA, 19 nt, Shigella flexneri 2a str. 2457T
cgccgaucgaagagacgcu

SEQ ID NO: 1933543 - RNA, 11 nt, Shigella flexneri 2a str. 2457T
cgccagcgcca

SEQ ID NO: 1933544 - RNA, 20 nt, Shigella flexneri 2a str. 2457T
cgccagcgaaccaccaaacu

SEQ ID NO: 1933545 - RNA, 13 nt, Shigella flexneri 2a str. 2457T
cgccagcggcagc

SEQ ID NO: 1933546 - RNA, 14 nt, Shigella flexneri 2a str. 2457T
cgccagcggcagcu

SEQ ID NO: 1933547 - RNA, 13 nt, Shigella flexneri 2a str. 2457T
cgccagcgcgcgu

SEQ ID NO: 1933548 - RNA, 15 nt, Shigella flexneri 2a str. 2457T
cgccagcgucugagc

SEQ ID NO: 1933549 - RNA, 17 nt, Shigella flexneri 2a str. 2457T
cgccagcgucucuucaa

SEQ ID NO: 1933550 - RNA, 19 nt, Shigella flexneri 2a str. 2457T
cgccagcgucucuucaauu

SEQ ID NO: 1933551 - RNA, 23 nt, Shigella flexneri 2a str. 2457T
cgccagcggcguuugcuccugcu

SEQ ID NO: 1933552 - RNA, 19 nt, Shigella flexneri 2a str. 2457T
cgccagcuucgcuucccaa

SEQ ID NO: 1933553 - RNA, 23 nt, Shigella flexneri 2a str. 2457T
cgccaggaaccugugacagcagc

SEQ ID NO: 1933554 - RNA, 20 nt, Shigella flexneri 2a str. 2457T
cgccaggaauuugguccuga

SEQ ID NO: 1933555 - RNA, 22 nt, Shigella flexneri 2a str. 2457T
cgccagcucacgggcggcaggu

SEQ ID NO: 1933556 - RNA, 18 nt, Shigella flexneri 2a str. 2457T
cgccagcguuaucccauc

SEQ ID NO: 1933557 - RNA, 13 nt, Shigella flexneri 2a str. 2457T
cgccaggcgcuga

SEQ ID NO: 1933558 - RNA, 18 nt, Shigella flexneri 2a str. 2457T
cgccaggcguuugaaaaa

SEQ ID NO: 1933559 - RNA, 22 nt, Shigella flexneri 2a str. 2457T
cgccaggcuuuccgucagcggc

SEQ ID NO: 1933560 - RNA, 14 nt, Shigella flexneri 2a str. 2457T
cgccaggccagccu

SEQ ID NO: 1933561 - RNA, 16 nt, Shigella flexneri 2a str. 2457T
cgccaggccagccugg

SEQ ID NO: 1933562 - RNA, 19 nt, Shigella flexneri 2a str. 2457T
cgccaggccagccugguua

SEQ ID NO: 1933563 - RNA, 15 nt, Shigella flexneri 2a str. 2457T
cgccagugcgcccca

SEQ ID NO: 1933564 - RNA, 11 nt, Shigella flexneri 2a str. 2457T
cgccaguuuac

SEQ ID NO: 1933565 - RNA, 19 nt, Shigella flexneri 2a str. 2457T
cgccaguuuacugucugcu

SEQ ID NO: 1933566 - RNA, 20 nt, Shigella flexneri 2a str. 2457T
cgccaguuuacugucugcuu

SEQ ID NO: 1933567 - RNA, 14 nt, Shigella flexneri 2a str. 2457T
cgccaguucuucca

SEQ ID NO: 1933568 - RNA, 19 nt, Shigella flexneri 2a str. 2457T
cgccaguucuuccaguucc

SEQ ID NO: 1933569 - RNA, 18 nt, Shigella flexneri 2a str. 2457T
cgccaucaauaaccagcg

SEQ ID NO: 1933570 - RNA, 20 nt, Shigella flexneri 2a str. 2457T
cgccauaccaugcaccaacc

SEQ ID NO: 1933571 - RNA, 18 nt, Shigella flexneri 2a str. 2457T
cgccauaccaugcaccaa

SEQ ID NO: 1933572 - RNA, 16 nt, Shigella flexneri 2a str. 2457T
cgccaguuuuuauacu

SEQ ID NO: 1933573 - RNA, 18 nt, Shigella flexneri 2a str. 2457T
cgccaggucagagagcca

SEQ ID NO: 1933574 - RNA, 22 nt, Shigella flexneri 2a str. 2457T
cgccaggucagagagccagccc

SEQ ID NO: 1933575 - RNA, 16 nt, Shigella flexneri 2a str. 2457T
cgccagggccgcgaau

SEQ ID NO: 1933576 - RNA, 16 nt, Shigella flexneri 2a str. 2457T
cgccaguaccagcagc

SEQ ID NO: 1933577 - RNA, 15 nt, Shigella flexneri 2a str. 2457T
cgccaguacgcgccc

SEQ ID NO: 1933578 - RNA, 14 nt, Shigella flexneri 2a str. 2457T
cgccaccacaacau

SEQ ID NO: 1933579 - RNA, 22 nt, Shigella flexneri 2a str. 2457T
cgccaccaggaacgcgccaaga

SEQ ID NO: 1933580 - RNA, 18 nt, Shigella flexneri 2a str. 2457T
cgccaccauucccuggcg

SEQ ID NO: 1933581 - RNA, 13 nt, Shigella flexneri 2a str. 2457T
cgccaccgcgcgu

SEQ ID NO: 1933582 - RNA, 14 nt, Shigella flexneri 2a str. 2457T
cgccaccucuuuca

SEQ ID NO: 1933583 - RNA, 13 nt, Shigella flexneri 2a str. 2457T
cgccaccacaaca

SEQ ID NO: 1933584 - RNA, 17 nt, Shigella flexneri 2a str. 2457T
cgccacauccggcacaa

SEQ ID NO: 1933585 - RNA, 22 nt, Shigella flexneri 2a str. 2457T
cgccacagcauucucggcccgg

SEQ ID NO: 1933586 - RNA, 22 nt, Shigella flexneri 2a str. 2457T
cgcauaccauccaggagauauu

SEQ ID NO: 1933587 - RNA, 17 nt, Shigella flexneri 2a str. 2457T
cgcauaccccaucagcg

SEQ ID NO: 1933588 - RNA, 21 nt, Shigella flexneri 2a str. 2457T
cgcauaccaaaauccaccagu

SEQ ID NO: 1933589 - RNA, 18 nt, Shigella flexneri 2a str. 2457T
cgcauaacucaccaucaa

SEQ ID NO: 1933590 - RNA, 19 nt, Shigella flexneri 2a str. 2457T
cgccacaacuucaacguug

SEQ ID NO: 1933591 - RNA, 20 nt, Shigella flexneri 2a str. 2457T
cgccagcagcagcgccaacg

SEQ ID NO: 1933592 - RNA, 22 nt, Shigella flexneri 2a str. 2457T
cgccacuaucgccaucaggcag

SEQ ID NO: 1933593 - RNA, 14 nt, Shigella flexneri 2a str. 2457T
cgccacgguguugu

SEQ ID NO: 1933594 - RNA, 20 nt, Shigella flexneri 2a str. 2457T
cgccacgaaauugaggaugc

SEQ ID NO: 1933595 - RNA, 16 nt, Shigella flexneri 2a str. 2457T
cgccagcgaauuccag

SEQ ID NO: 1933596 - RNA, 19 nt, Shigella flexneri 2a str. 2457T
cgccagcagggcaaacagc

SEQ ID NO: 1933597 - RNA, 20 nt, Shigella flexneri 2a str. 2457T
cgccagcaucggcagcgcca

SEQ ID NO: 1933598 - RNA, 21 nt, Shigella flexneri 2a str. 2457T
cgccagccaauugccauauac

SEQ ID NO: 1933599 - RNA, 14 nt, Shigella flexneri 2a str. 2457T
cgccagccauucaa

SEQ ID NO: 1933600 - RNA, 19 nt, Shigella flexneri 2a str. 2457T
cgcccaucgcgcccgccgc

SEQ ID NO: 1933601 - RNA, 15 nt, Shigella flexneri 2a str. 2457T
cgcccaguucuacaa

SEQ ID NO: 1933602 - RNA, 18 nt, Shigella flexneri 2a str. 2457T
cgcccaguugaucaccag

SEQ ID NO: 1933603 - RNA, 13 nt, Shigella flexneri 2a str. 2457T
cgcccagcgcagg

SEQ ID NO: 1933604 - RNA, 18 nt, Shigella flexneri 2a str. 2457T
cgcccagcgcaggaaaga

SEQ ID NO: 1933605 - RNA, 17 nt, Shigella flexneri 2a str. 2457T
cgcccagcguugcacau

SEQ ID NO: 1933606 - RNA, 22 nt, Shigella flexneri 2a str. 2457T
cgcccagcgucagcauaaaaau

SEQ ID NO: 1933607 - RNA, 24 nt, Shigella flexneri 2a str. 2457T
cgcccacgcgcauucccagcgcgu

SEQ ID NO: 1933608 - RNA, 16 nt, Shigella flexneri 2a str. 2457T
cgcccagaccagaaug

SEQ ID NO: 1933609 - RNA, 14 nt, Shigella flexneri 2a str. 2457T
cgcccaccaccagc

SEQ ID NO: 1933610 - RNA, 18 nt, Shigella flexneri 2a str. 2457T
cgccauggcuucucgcca

SEQ ID NO: 1933611 - RNA, 19 nt, Shigella flexneri 2a str. 2457T
cgccauguugccuggggag

SEQ ID NO: 1933612 - RNA, 21 nt, Shigella flexneri 2a str. 2457T
cgccauuaaacaacccaagcg

SEQ ID NO: 1933613 - RNA, 20 nt, Shigella flexneri 2a str. 2457T
cgccaugugcgacgggccaa

SEQ ID NO: 1933614 - RNA, 16 nt, Shigella flexneri 2a str. 2457T
cgccauuuuuuauaca

SEQ ID NO: 1933615 - RNA, 16 nt, Shigella flexneri 2a str. 2457T
cgccauuuugcgcggc

SEQ ID NO: 1933616 - RNA, 21 nt, Shigella flexneri 2a str. 2457T
cgccauuucuucuccggcauc

SEQ ID NO: 1933617 - RNA, 14 nt, Shigella flexneri 2a str. 2457T
cgccauuucuccuc

SEQ ID NO: 1933618 - RNA, 14 nt, Shigella flexneri 2a str. 2457T
cgccaucucuucca

SEQ ID NO: 1933619 - RNA, 19 nt, Shigella flexneri 2a str. 2457T
cgccaugaagacauacccu

SEQ ID NO: 1933620 - RNA, 12 nt, Shigella flexneri 2a str. 2457T
cgccaucgccag

SEQ ID NO: 1933621 - RNA, 14 nt, Shigella flexneri 2a str. 2457T
cgccaucgccagca

SEQ ID NO: 1933622 - RNA, 14 nt, Shigella flexneri 2a str. 2457T
cgccaucgccagga

SEQ ID NO: 1933623 - RNA, 15 nt, Shigella flexneri 2a str. 2457T
cgccauccagccggg

SEQ ID NO: 1933624 - RNA, 14 nt, Shigella flexneri 2a str. 2457T
cgccauccaccagc

SEQ ID NO: 1933625 - RNA, 11 nt, Shigella flexneri 2a str. 2457T
cgcccgccaga

SEQ ID NO: 1933626 - RNA, 22 nt, Shigella flexneri 2a str. 2457T
cgcccggauauccacccgcagc

SEQ ID NO: 1933627 - RNA, 18 nt, Shigella flexneri 2a str. 2457T
cgcccgcuguaagccaag

SEQ ID NO: 1933628 - RNA, 18 nt, Shigella flexneri 2a str. 2457T
cgcccggaaacgggcgcu

SEQ ID NO: 1933629 - RNA, 16 nt, Shigella flexneri 2a str. 2457T
cgcccgcuaugagcag

SEQ ID NO: 1933630 - RNA, 16 nt, Shigella flexneri 2a str. 2457T
cgcccgacgaggcgcu

SEQ ID NO: 1933631 - RNA, 14 nt, Shigella flexneri 2a str. 2457T
cgccccuuccaggc

SEQ ID NO: 1933632 - RNA, 11 nt, Shigella flexneri 2a str. 2457T
cgccccugaca

SEQ ID NO: 1933633 - RNA, 22 nt, Shigella flexneri 2a str. 2457T
cgccccugcacuuaacaggauc

SEQ ID NO: 1933634 - RNA, 16 nt, Shigella flexneri 2a str. 2457T
cgccccgguuucucuu

SEQ ID NO: 1933635 - RNA, 14 nt, Shigella flexneri 2a str. 2457T
cgccccggccuugc

SEQ ID NO: 1933636 - RNA, 17 nt, Shigella flexneri 2a str. 2457T
cgccccggccuugccug

SEQ ID NO: 1933637 - RNA, 13 nt, Shigella flexneri 2a str. 2457T
cgccccgcucgcu

SEQ ID NO: 1933638 - RNA, 18 nt, Shigella flexneri 2a str. 2457T
cgcccccgggccuccccg

SEQ ID NO: 1933639 - RNA, 20 nt, Shigella flexneri 2a str. 2457T
cgccccacaaacccgccaga

SEQ ID NO: 1933640 - RNA, 13 nt, Shigella flexneri 2a str. 2457T
cgcccauugagcc

SEQ ID NO: 1933641 - RNA, 15 nt, Shigella flexneri 2a str. 2457T
cgccccacaccacca

SEQ ID NO: 1933642 - RNA, 20 nt, Shigella flexneri 2a str. 2457T
cgauacuacguucaaucacc

SEQ ID NO: 1933643 - RNA, 17 nt, Shigella flexneri 2a str. 2457T
cgauagagagcagucag

SEQ ID NO: 1933644 - RNA, 14 nt, Shigella flexneri 2a str. 2457T
cgauacuuuuucaa

SEQ ID NO: 1933645 - RNA, 18 nt, Shigella flexneri 2a str. 2457T
cgauaguggaacaaagaa

SEQ ID NO: 1933646 - RNA, 23 nt, Shigella flexneri 2a str. 2457T
cgauauaaaccaucggcgcuggc

SEQ ID NO: 1933647 - RNA, 17 nt, Shigella flexneri 2a str. 2457T
cgauauaaauuccacgc

SEQ ID NO: 1933648 - RNA, 21 nt, Shigella flexneri 2a str. 2457T
cgauaacggaucggaacgcga

SEQ ID NO: 1933649 - RNA, 22 nt, Shigella flexneri 2a str. 2457T
cgauacgacacgccuccuggcu

SEQ ID NO: 1933650 - RNA, 14 nt, Shigella flexneri 2a str. 2457T
cgauacgcugcaca

SEQ ID NO: 1933651 - RNA, 16 nt, Shigella flexneri 2a str. 2457T
cgauaaaccagcaacc

SEQ ID NO: 1933652 - RNA, 13 nt, Shigella flexneri 2a str. 2457T
cgauaaacucaau

SEQ ID NO: 1933653 - RNA, 20 nt, Shigella flexneri 2a str. 2457T
cgauaaauggcgcauccagc

SEQ ID NO: 1933654 - RNA, 20 nt, Shigella flexneri 2a str. 2457T
ccuucauuugccagcuucag

SEQ ID NO: 1933655 - RNA, 12 nt, Shigella flexneri 2a str. 2457T
cgauaaaaccuu

SEQ ID NO: 1933656 - RNA, 14 nt, Shigella flexneri 2a str. 2457T
ccuucaucuucaac

SEQ ID NO: 1933657 - RNA, 16 nt, Shigella flexneri 2a str. 2457T
ccuucaucgcuccugc

SEQ ID NO: 1933658 - RNA, 19 nt, Shigella flexneri 2a str. 2457T
ccuucaucguuucugcugg

SEQ ID NO: 1933659 - RNA, 18 nt, Shigella flexneri 2a str. 2457T
ccuucauccagcaucaua

SEQ ID NO: 1933660 - RNA, 22 nt, Shigella flexneri 2a str. 2457T
ccuucauauuccugacccagca

SEQ ID NO: 1933661 - RNA, 23 nt, Shigella flexneri 2a str. 2457T
ccuucauauuccugacccagcac

SEQ ID NO: 1933662 - RNA, 18 nt, Shigella flexneri 2a str. 2457T
cgaucgcaaauccauuca

SEQ ID NO: 1933663 - RNA, 22 nt, Shigella flexneri 2a str. 2457T
cgaucgccugguaccagcaccg

SEQ ID NO: 1933664 - RNA, 17 nt, Shigella flexneri 2a str. 2457T
cgauccggcgguguucu

SEQ ID NO: 1933665 - RNA, 13 nt, Shigella flexneri 2a str. 2457T
cgaucaucgacag

SEQ ID NO: 1933666 - RNA, 13 nt, Shigella flexneri 2a str. 2457T
cgauccaccaccg

SEQ ID NO: 1933667 - RNA, 17 nt, Shigella flexneri 2a str. 2457T
cgauccaccaccgcaaa

SEQ ID NO: 1933668 - RNA, 22 nt, Shigella flexneri 2a str. 2457T
cgaucauuggccggaauaccac

SEQ ID NO: 1933669 - RNA, 15 nt, Shigella flexneri 2a str. 2457T
cgaucauauuguucc

SEQ ID NO: 1933670 - RNA, 21 nt, Shigella flexneri 2a str. 2457T
cgaucaggaacuguugcaaaa

SEQ ID NO: 1933671 - RNA, 19 nt, Shigella flexneri 2a str. 2457T
cgauauccugaaacgcggc

SEQ ID NO: 1933672 - RNA, 17 nt, Shigella flexneri 2a str. 2457T
cgaucacuuucugcgcc

SEQ ID NO: 1933673 - RNA, 19 nt, Shigella flexneri 2a str. 2457T
cgaucugcgcgucauuuuc

SEQ ID NO: 1933674 - RNA, 19 nt, Shigella flexneri 2a str. 2457T
cgaugaaaaagaagcaaau

SEQ ID NO: 1933675 - RNA, 18 nt, Shigella flexneri 2a str. 2457T
cgaugacagucuggaagc

SEQ ID NO: 1933676 - RNA, 13 nt, Shigella flexneri 2a str. 2457T
cgaugaccgccac

SEQ ID NO: 1933677 - RNA, 19 nt, Shigella flexneri 2a str. 2457T
cgaucucuucgccugccug

SEQ ID NO: 1933678 - RNA, 13 nt, Shigella flexneri 2a str. 2457T
cgaucgucugggc

SEQ ID NO: 1933679 - RNA, 20 nt, Shigella flexneri 2a str. 2457T
cgaucgcgccaaucagcgca

SEQ ID NO: 1933680 - RNA, 22 nt, Shigella flexneri 2a str. 2457T
cgaucggcgagucgcuccugcc

SEQ ID NO: 1933681 - RNA, 22 nt, Shigella flexneri 2a str. 2457T
cgaugcgcucgccaggaugggc

SEQ ID NO: 1933682 - RNA, 17 nt, Shigella flexneri 2a str. 2457T
cgaugccccaguaccug

SEQ ID NO: 1933683 - RNA, 17 nt, Shigella flexneri 2a str. 2457T
cgaugcaaccgagcgcc

SEQ ID NO: 1933684 - RNA, 13 nt, Shigella flexneri 2a str. 2457T
cgaugaucgccau

SEQ ID NO: 1933685 - RNA, 13 nt, Shigella flexneri 2a str. 2457T
cgaugcuaaaaac

SEQ ID NO: 1933686 - RNA, 14 nt, Shigella flexneri 2a str. 2457T
cgauggcaucacca

SEQ ID NO: 1933687 - RNA, 21 nt, Shigella flexneri 2a str. 2457T
cgauggcgcagaauuugucga

SEQ ID NO: 1933688 - RNA, 14 nt, Shigella flexneri 2a str. 2457T
cgauguauccggca

SEQ ID NO: 1933689 - RNA, 14 nt, Shigella flexneri 2a str. 2457T
cgauguaauucagc

SEQ ID NO: 1933690 - RNA, 14 nt, Shigella flexneri 2a str. 2457T
cgcaaacugccguu

SEQ ID NO: 1933691 - RNA, 22 nt, Shigella flexneri 2a str. 2457T
cgcaaaggcuuuuuuauuugcu

SEQ ID NO: 1933692 - RNA, 18 nt, Shigella flexneri 2a str. 2457T
cgcaaaguagcggccuga

SEQ ID NO: 1933693 - RNA, 19 nt, Shigella flexneri 2a str. 2457T
cgcaaaguagcggccugac

SEQ ID NO: 1933694 - RNA, 20 nt, Shigella flexneri 2a str. 2457T
cgcaaaguagcugaaaauca

SEQ ID NO: 1933695 - RNA, 20 nt, Shigella flexneri 2a str. 2457T
cgcaaacguggggugaauaa

SEQ ID NO: 1933696 - RNA, 16 nt, Shigella flexneri 2a str. 2457T
cgcaaaauucacgcca

SEQ ID NO: 1933697 - RNA, 13 nt, Shigella flexneri 2a str. 2457T
cgcaaaauguugu

SEQ ID NO: 1933698 - RNA, 20 nt, Shigella flexneri 2a str. 2457T
cgcaaacaggcgcagaacuu

SEQ ID NO: 1933699 - RNA, 19 nt, Shigella flexneri 2a str. 2457T
cgauucaaaagaugagaaa

SEQ ID NO: 1933700 - RNA, 17 nt, Shigella flexneri 2a str. 2457T
cgauucacauaacggcc

SEQ ID NO: 1933701 - RNA, 15 nt, Shigella flexneri 2a str. 2457T
cgauuauccgccagu

SEQ ID NO: 1933702 - RNA, 20 nt, Shigella flexneri 2a str. 2457T
cgcaacgguugcggaaccca

SEQ ID NO: 1933703 - RNA, 16 nt, Shigella flexneri 2a str. 2457T
cgcaacuccagcuuag

SEQ ID NO: 1933704 - RNA, 14 nt, Shigella flexneri 2a str. 2457T
cgcaacgcgcguga

SEQ ID NO: 1933705 - RNA, 23 nt, Shigella flexneri 2a str. 2457T
cgcaacgcgcgugaaguggcaca

SEQ ID NO: 1933706 - RNA, 14 nt, Shigella flexneri 2a str. 2457T
cgcaacagaccaga

SEQ ID NO: 1933707 - RNA, 21 nt, Shigella flexneri 2a str. 2457T
cgcaacugguccagccccuga

SEQ ID NO: 1933708 - RNA, 11 nt, Shigella flexneri 2a str. 2457T
cgcaagugauc

SEQ ID NO: 1933709 - RNA, 15 nt, Shigella flexneri 2a str. 2457T
cgcaauaaucaucuc

SEQ ID NO: 1933710 - RNA, 19 nt, Shigella flexneri 2a str. 2457T
cgcaauauccugcgcuucc

SEQ ID NO: 1933711 - RNA, 18 nt, Shigella flexneri 2a str. 2457T
cgcaauacgcuuguacuu

SEQ ID NO: 1933712 - RNA, 17 nt, Shigella flexneri 2a str. 2457T
cgcaauagcacugcuuu

SEQ ID NO: 1933713 - RNA, 16 nt, Shigella flexneri 2a str. 2457T
cgcacuauacaaccag

SEQ ID NO: 1933714 - RNA, 20 nt, Shigella flexneri 2a str. 2457T
cgcacuaugugccagcuucc

SEQ ID NO: 1933715 - RNA, 16 nt, Shigella flexneri 2a str. 2457T
cgcacgcgcuucacau

SEQ ID NO: 1933716 - RNA, 14 nt, Shigella flexneri 2a str. 2457T
cgcacgcugguaac

SEQ ID NO: 1933717 - RNA, 12 nt, Shigella flexneri 2a str. 2457T
cgcaccugccag

SEQ ID NO: 1933718 - RNA, 18 nt, Shigella flexneri 2a str. 2457T
cgcacaggugcaaaaaaa

SEQ ID NO: 1933719 - RNA, 19 nt, Shigella flexneri 2a str. 2457T
cgcacaggugcaaaaaaac

SEQ ID NO: 1933720 - RNA, 14 nt, Shigella flexneri 2a str. 2457T
cgcacccguaacau

SEQ ID NO: 1933721 - RNA, 23 nt, Shigella flexneri 2a str. 2457T
cgcaccaggcgaaaacgcugacc

SEQ ID NO: 1933722 - RNA, 16 nt, Shigella flexneri 2a str. 2457T
cgcacuucuuccgggc

SEQ ID NO: 1933723 - RNA, 23 nt, Shigella flexneri 2a str. 2457T
cgcacucguaucaccccgcccga

SEQ ID NO: 1933724 - RNA, 12 nt, Shigella flexneri 2a str. 2457T
cgcacugcugau

SEQ ID NO: 1933725 - RNA, 13 nt, Shigella flexneri 2a str. 2457T
cgcacugcuugaa

SEQ ID NO: 1933726 - RNA, 19 nt, Shigella flexneri 2a str. 2457T
cgcacuuugucaucagucu

SEQ ID NO: 1933727 - RNA, 12 nt, Shigella flexneri 2a str. 2457T
cgcagcauugcu

SEQ ID NO: 1933728 - RNA, 15 nt, Shigella flexneri 2a str. 2457T
cgcagccaguuaacc

SEQ ID NO: 1933729 - RNA, 18 nt, Shigella flexneri 2a str. 2457T
cgcagccaucaaccugug

SEQ ID NO: 1933730 - RNA, 13 nt, Shigella flexneri 2a str. 2457T
cgcagccaucagc

SEQ ID NO: 1933731 - RNA, 15 nt, Shigella flexneri 2a str. 2457T
cgcagccagcacugc

SEQ ID NO: 1933732 - RNA, 17 nt, Shigella flexneri 2a str. 2457T
cgcagccaucagcgaga

SEQ ID NO: 1933733 - RNA, 19 nt, Shigella flexneri 2a str. 2457T
cgcagcccagaugcggcgg

SEQ ID NO: 1933734 - RNA, 16 nt, Shigella flexneri 2a str. 2457T
cgcagccccagagccu

SEQ ID NO: 1933735 - RNA, 17 nt, Shigella flexneri 2a str. 2457T
cgcagccgccagaaaug

SEQ ID NO: 1933736 - RNA, 14 nt, Shigella flexneri 2a str. 2457T
cgcagccgaguaga

SEQ ID NO: 1933737 - RNA, 19 nt, Shigella flexneri 2a str. 2457T
cgcaggauaucguggcacg

SEQ ID NO: 1933738 - RNA, 10 nt, Shigella flexneri 2a str. 2457T
cgcaggaaag

SEQ ID NO: 1933739 - RNA, 15 nt, Shigella flexneri 2a str. 2457T
cgcaggcgguggaag

SEQ ID NO: 1933740 - RNA, 23 nt, Shigella flexneri 2a str. 2457T
cgcagggaucauccacccgcagc

SEQ ID NO: 1933741 - RNA, 23 nt, Shigella flexneri 2a str. 2457T
cgcaggcuguuaccccugcggcc

SEQ ID NO: 1933742 - RNA, 17 nt, Shigella flexneri 2a str. 2457T
cgcaggcuguuaccccu

SEQ ID NO: 1933743 - RNA, 23 nt, Shigella flexneri 2a str. 2457T
cgcaguaaucggcgaaaccgcgc

SEQ ID NO: 1933744 - RNA, 18 nt, Shigella flexneri 2a str. 2457T
cggauaaacuuggcuaua

SEQ ID NO: 1933745 - RNA, 22 nt, Shigella flexneri 2a str. 2457T
cggauaaucgcuggugccgugg

SEQ ID NO: 1933746 - RNA, 18 nt, Shigella flexneri 2a str. 2457T
cggauaagacgcgccagc

SEQ ID NO: 1933747 - RNA, 18 nt, Shigella flexneri 2a str. 2457T
cggagcuucacccgcagc

SEQ ID NO: 1933748 - RNA, 23 nt, Shigella flexneri 2a str. 2457T
cggaguugaccagcuccagcaga

SEQ ID NO: 1933749 - RNA, 23 nt, Shigella flexneri 2a str. 2457T
cggagcucccaggcuccgccaga

SEQ ID NO: 1933750 - RNA, 12 nt, Shigella flexneri 2a str. 2457T
cggaacugaagc

SEQ ID NO: 1933751 - RNA, 16 nt, Shigella flexneri 2a str. 2457T
cggaacuccuggagcg

SEQ ID NO: 1933752 - RNA, 12 nt, Shigella flexneri 2a str. 2457T
cggagcaaccug

SEQ ID NO: 1933753 - RNA, 15 nt, Shigella flexneri 2a str. 2457T
cggagcaaccugcac

SEQ ID NO: 1933754 - RNA, 15 nt, Shigella flexneri 2a str. 2457T
cggaacgaaaaaaau

SEQ ID NO: 1933755 - RNA, 16 nt, Shigella flexneri 2a str. 2457T
cggaacgaaaaaaauc

SEQ ID NO: 1933756 - RNA, 17 nt, Shigella flexneri 2a str. 2457T
cggaaacugucaauaaa

SEQ ID NO: 1933757 - RNA, 21 nt, Shigella flexneri 2a str. 2457T
cggaaagcaccugcgcaggca

SEQ ID NO: 1933758 - RNA, 12 nt, Shigella flexneri 2a str. 2457T
cggaaauauauu

SEQ ID NO: 1933759 - RNA, 21 nt, Shigella flexneri 2a str. 2457T
cggaaaguuuaauugccauuu

SEQ ID NO: 1933760 - RNA, 21 nt, Shigella flexneri 2a str. 2457T
cggaugacagacuccgcuucg

SEQ ID NO: 1933761 - RNA, 15 nt, Shigella flexneri 2a str. 2457T
cggaugcgccgucag

SEQ ID NO: 1933762 - RNA, 17 nt, Shigella flexneri 2a str. 2457T
cggauucaguaaaucca

SEQ ID NO: 1933763 - RNA, 18 nt, Shigella flexneri 2a str. 2457T
cggauucagauugcagac

SEQ ID NO: 1933764 - RNA, 22 nt, Shigella flexneri 2a str. 2457T
cggaugugaugcauccggcaca

SEQ ID NO: 1933765 - RNA, 18 nt, Shigella flexneri 2a str. 2457T
cggauuacgacucaaccc

SEQ ID NO: 1933766 - RNA, 18 nt, Shigella flexneri 2a str. 2457T
cggauguuucuucaacac

SEQ ID NO: 1933767 - RNA, 22 nt, Shigella flexneri 2a str. 2457T
cggauguuucaccggaugccgg

SEQ ID NO: 1933768 - RNA, 12 nt, Shigella flexneri 2a str. 2457T
cggcaaacacgc

SEQ ID NO: 1933769 - RNA, 15 nt, Shigella flexneri 2a str. 2457T
cggcaaaaacaacga

SEQ ID NO: 1933770 - RNA, 13 nt, Shigella flexneri 2a str. 2457T
cggcagaacggug

SEQ ID NO: 1933771 - RNA, 14 nt, Shigella flexneri 2a str. 2457T
cggcagaagcaauc

SEQ ID NO: 1933772 - RNA, 14 nt, Shigella flexneri 2a str. 2457T
cggcagaaaaucca

SEQ ID NO: 1933773 - RNA, 14 nt, Shigella flexneri 2a str. 2457T
cggcacugaccacu

SEQ ID NO: 1933774 - RNA, 15 nt, Shigella flexneri 2a str. 2457T
cggcacuccucuuca

SEQ ID NO: 1933775 - RNA, 15 nt, Shigella flexneri 2a str. 2457T
cggcacgccagucgg

SEQ ID NO: 1933776 - RNA, 17 nt, Shigella flexneri 2a str. 2457T
cggcaccuuuucaucag

SEQ ID NO: 1933777 - RNA, 21 nt, Shigella flexneri 2a str. 2457T
cggcacgauaaauggcucuuc

SEQ ID NO: 1933778 - RNA, 19 nt, Shigella flexneri 2a str. 2457T
cggcaaccacacccacauc

SEQ ID NO: 1933779 - RNA, 18 nt, Shigella flexneri 2a str. 2457T
cggcaacaauauuaacuc

SEQ ID NO: 1933780 - RNA, 23 nt, Shigella flexneri 2a str. 2457T
cggcaaacguaagcgucugcucc

SEQ ID NO: 1933781 - RNA, 15 nt, Shigella flexneri 2a str. 2457T
cggcaaacugcugau

SEQ ID NO: 1933782 - RNA, 19 nt, Shigella flexneri 2a str. 2457T
cggcaacaaauucacgccu

SEQ ID NO: 1933783 - RNA, 17 nt, Shigella flexneri 2a str. 2457T
cggcaaauaacagaccu

SEQ ID NO: 1933784 - RNA, 13 nt, Shigella flexneri 2a str. 2457T
cggcaccacauuc

SEQ ID NO: 1933785 - RNA, 18 nt, Shigella flexneri 2a str. 2457T
cggcaccacauucugcau

SEQ ID NO: 1933786 - RNA, 21 nt, Shigella flexneri 2a str. 2457T
cggcaccauuccaccucccgu

SEQ ID NO: 1933787 - RNA, 19 nt, Shigella flexneri 2a str. 2457T
cggcaguaauaccagaccu

SEQ ID NO: 1933788 - RNA, 17 nt, Shigella flexneri 2a str. 2457T
cggcagguugcagagca

SEQ ID NO: 1933789 - RNA, 16 nt, Shigella flexneri 2a str. 2457T
cggcaguaccugacca

SEQ ID NO: 1933790 - RNA, 11 nt, Shigella flexneri 2a str. 2457T
cggcagugcca

SEQ ID NO: 1933791 - RNA, 16 nt, Shigella flexneri 2a str. 2457T
cggcagugacugcccc

SEQ ID NO: 1933792 - RNA, 20 nt, Shigella flexneri 2a str. 2457T
cggcagucugcugaccaccu

SEQ ID NO: 1933793 - RNA, 18 nt, Shigella flexneri 2a str. 2457T
cggcauaaagcugcggau

SEQ ID NO: 1933794 - RNA, 21 nt, Shigella flexneri 2a str. 2457T
cggcaguggcuaagcaggcug

SEQ ID NO: 1933795 - RNA, 15 nt, Shigella flexneri 2a str. 2457T
cggcaucagcagaau

SEQ ID NO: 1933796 - RNA, 22 nt, Shigella flexneri 2a str. 2457T
cggcaucagcagaaucgcaacc

SEQ ID NO: 1933797 - RNA, 22 nt, Shigella flexneri 2a str. 2457T
cggcauacuuugauuaaccguu

SEQ ID NO: 1933798 - RNA, 19 nt, Shigella flexneri 2a str. 2457T
cggcauagccaccuggcug

SEQ ID NO: 1933799 - RNA, 21 nt, Shigella flexneri 2a str. 2457T
cggcauagccaccuggcugcg

SEQ ID NO: 1933800 - RNA, 19 nt, Shigella flexneri 2a str. 2457T
cggcaggccuaacacaugc

SEQ ID NO: 1933801 - RNA, 22 nt, Shigella flexneri 2a str. 2457T
cggcaggccuaacacaugcaag

SEQ ID NO: 1933802 - RNA, 15 nt, Shigella flexneri 2a str. 2457T
cggcagccugacgcc

SEQ ID NO: 1933803 - RNA, 13 nt, Shigella flexneri 2a str. 2457T
cggcagccuccug

SEQ ID NO: 1933804 - RNA, 16 nt, Shigella flexneri 2a str. 2457T
cggcaggacgcgcgcu

SEQ ID NO: 1933805 - RNA, 20 nt, Shigella flexneri 2a str. 2457T
cggccuacacaugcgucccc

SEQ ID NO: 1933806 - RNA, 18 nt, Shigella flexneri 2a str. 2457T
cggccucuucaaacggca

SEQ ID NO: 1933807 - RNA, 20 nt, Shigella flexneri 2a str. 2457T
cggccugcgcgaugaugcca

SEQ ID NO: 1933808 - RNA, 17 nt, Shigella flexneri 2a str. 2457T
cggcccuuuuuuuacuu

SEQ ID NO: 1933809 - RNA, 20 nt, Shigella flexneri 2a str. 2457T
cggccccgucucccgaugcc

SEQ ID NO: 1933810 - RNA, 15 nt, Shigella flexneri 2a str. 2457T
cggcccggcgacgac

SEQ ID NO: 1933811 - RNA, 16 nt, Shigella flexneri 2a str. 2457T
cggccagcaucgcaac

SEQ ID NO: 1933812 - RNA, 19 nt, Shigella flexneri 2a str. 2457T
cggcaucgcauucaccaga

SEQ ID NO: 1933813 - RNA, 18 nt, Shigella flexneri 2a str. 2457T
cggcaucgcuccacgcca

SEQ ID NO: 1933814 - RNA, 21 nt, Shigella flexneri 2a str. 2457T
cggcaucgcuccacgccauau

SEQ ID NO: 1933815 - RNA, 18 nt, Shigella flexneri 2a str. 2457T
cggcccaccuggcugagc

SEQ ID NO: 1933816 - RNA, 23 nt, Shigella flexneri 2a str. 2457T
cggccaguaagcaguccagcgcc

SEQ ID NO: 1933817 - RNA, 21 nt, Shigella flexneri 2a str. 2457T
cgcguccccugcaauauuuug

SEQ ID NO: 1933818 - RNA, 20 nt, Shigella flexneri 2a str. 2457T
cgcgucauugacgcuggcuu

SEQ ID NO: 1933819 - RNA, 16 nt, Shigella flexneri 2a str. 2457T
cgcgucagucgccccc

SEQ ID NO: 1933820 - RNA, 17 nt, Shigella flexneri 2a str. 2457T
cgcguaaaacagccagc

SEQ ID NO: 1933821 - RNA, 16 nt, Shigella flexneri 2a str. 2457T
cgcguaaaacagccag

SEQ ID NO: 1933822 - RNA, 13 nt, Shigella flexneri 2a str. 2457T
cgcgguagcgggc

SEQ ID NO: 1933823 - RNA, 13 nt, Shigella flexneri 2a str. 2457T
cgcucacgcgucu

SEQ ID NO: 1933824 - RNA, 17 nt, Shigella flexneri 2a str. 2457T
cgcucacgcgcugccuc

SEQ ID NO: 1933825 - RNA, 13 nt, Shigella flexneri 2a str. 2457T
cgcucacugcaaa

SEQ ID NO: 1933826 - RNA, 14 nt, Shigella flexneri 2a str. 2457T
cgcucagcuccucu

SEQ ID NO: 1933827 - RNA, 15 nt, Shigella flexneri 2a str. 2457T
cgcuauccagcgcau

SEQ ID NO: 1933828 - RNA, 13 nt, Shigella flexneri 2a str. 2457T
cgcuacuggcaau

SEQ ID NO: 1933829 - RNA, 18 nt, Shigella flexneri 2a str. 2457T
cgcuacgguggaaaaggc

SEQ ID NO: 1933830 - RNA, 12 nt, Shigella flexneri 2a str. 2457T
cgcuaccgccga

SEQ ID NO: 1933831 - RNA, 16 nt, Shigella flexneri 2a str. 2457T
cgcuaacggugcacgc

SEQ ID NO: 1933832 - RNA, 13 nt, Shigella flexneri 2a str. 2457T
cgcuaaauguuua

SEQ ID NO: 1933833 - RNA, 19 nt, Shigella flexneri 2a str. 2457T
cgcuaaaaaagguaacauu

SEQ ID NO: 1933834 - RNA, 22 nt, Shigella flexneri 2a str. 2457T
cgcgucgcgcacugcguggaga

SEQ ID NO: 1933835 - RNA, 16 nt, Shigella flexneri 2a str. 2457T
cgcgugcgcggcagcc

SEQ ID NO: 1933836 - RNA, 21 nt, Shigella flexneri 2a str. 2457T
cgcgggcgaauuaucggcagc

SEQ ID NO: 1933837 - RNA, 21 nt, Shigella flexneri 2a str. 2457T
cgcgguaaagcgcggcaguga

SEQ ID NO: 1933838 - RNA, 23 nt, Shigella flexneri 2a str. 2457T
cgcgguaagaguaaagcccgcca

SEQ ID NO: 1933839 - RNA, 15 nt, Shigella flexneri 2a str. 2457T
cgcgguaaaagccca

SEQ ID NO: 1933840 - RNA, 14 nt, Shigella flexneri 2a str. 2457T
cgcggauccccugc

SEQ ID NO: 1933841 - RNA, 14 nt, Shigella flexneri 2a str. 2457T
cgcggcccaggcgg

SEQ ID NO: 1933842 - RNA, 15 nt, Shigella flexneri 2a str. 2457T
cgcugucuuccuggu

SEQ ID NO: 1933843 - RNA, 20 nt, Shigella flexneri 2a str. 2457T
cgcugucuggcgucuccugc

SEQ ID NO: 1933844 - RNA, 16 nt, Shigella flexneri 2a str. 2457T
cgcugugagcaggcgu

SEQ ID NO: 1933845 - RNA, 17 nt, Shigella flexneri 2a str. 2457T
cgcugucggugccauca

SEQ ID NO: 1933846 - RNA, 18 nt, Shigella flexneri 2a str. 2457T
cgcuguagccgccgucgu

SEQ ID NO: 1933847 - RNA, 18 nt, Shigella flexneri 2a str. 2457T
cgcuguaauuaccagcgc

SEQ ID NO: 1933848 - RNA, 15 nt, Shigella flexneri 2a str. 2457T
cgcuguugucugaau

SEQ ID NO: 1933849 - RNA, 17 nt, Shigella flexneri 2a str. 2457T
cgcuguugucugaauga

SEQ ID NO: 1933850 - RNA, 23 nt, Shigella flexneri 2a str. 2457T
cgcuuaaucaauugcaggaaggu

SEQ ID NO: 1933851 - RNA, 22 nt, Shigella flexneri 2a str. 2457T
cgcuuaagguuacccgcacggc

SEQ ID NO: 1933852 - RNA, 23 nt, Shigella flexneri 2a str. 2457T
cgcugugcugcugacguagcagc

SEQ ID NO: 1933853 - RNA, 15 nt, Shigella flexneri 2a str. 2457T
cgcuguguaaaccca

SEQ ID NO: 1933854 - RNA, 18 nt, Shigella flexneri 2a str. 2457T
cgcuguguaaacccagcc

SEQ ID NO: 1933855 - RNA, 17 nt, Shigella flexneri 2a str. 2457T
cgcuggcuuugcccugg

SEQ ID NO: 1933856 - RNA, 22 nt, Shigella flexneri 2a str. 2457T
cgcuggcgguauagaucagacg

SEQ ID NO: 1933857 - RNA, 23 nt, Shigella flexneri 2a str. 2457T
cgcuggcgggcguuaucacguug

SEQ ID NO: 1933858 - RNA, 19 nt, Shigella flexneri 2a str. 2457T
cgcuggugaguaacgcgga

SEQ ID NO: 1933859 - RNA, 17 nt, Shigella flexneri 2a str. 2457T
cgcugguuaccaccugc

SEQ ID NO: 1933860 - RNA, 14 nt, Shigella flexneri 2a str. 2457T
cgcuuuaugugcuu

SEQ ID NO: 1933861 - RNA, 14 nt, Shigella flexneri 2a str. 2457T
cgcuuucaggucag

SEQ ID NO: 1933862 - RNA, 18 nt, Shigella flexneri 2a str. 2457T
cgcuuuaucgccuaccaa

SEQ ID NO: 1933863 - RNA, 19 nt, Shigella flexneri 2a str. 2457T
cgcuugccugugccacggc

SEQ ID NO: 1933864 - RNA, 16 nt, Shigella flexneri 2a str. 2457T
cgcuuacacacccggc

SEQ ID NO: 1933865 - RNA, 14 nt, Shigella flexneri 2a str. 2457T
cgcuuaucaggccu

SEQ ID NO: 1933866 - RNA, 14 nt, Shigella flexneri 2a str. 2457T
cgcuuauccggccc

SEQ ID NO: 1933867 - RNA, 14 nt, Shigella flexneri 2a str. 2457T
cggaaagcacaaaa

SEQ ID NO: 1933868 - RNA, 22 nt, Shigella flexneri 2a str. 2457T
cggaaacgacuauuaaacagga

SEQ ID NO: 1933869 - RNA, 13 nt, Shigella flexneri 2a str. 2457T
cgcuuuucagugc

SEQ ID NO: 1933870 - RNA, 19 nt, Shigella flexneri 2a str. 2457T
cgcuuuuuuagguacaaag

SEQ ID NO: 1933871 - RNA, 16 nt, Shigella flexneri 2a str. 2457T
cgcuuuuggcaggaac

SEQ ID NO: 1933872 - RNA, 14 nt, Shigella flexneri 2a str. 2457T
cgcuggcaccgcag

SEQ ID NO: 1933873 - RNA, 15 nt, Shigella flexneri 2a str. 2457T
cgcuggcaacacaga

SEQ ID NO: 1933874 - RNA, 19 nt, Shigella flexneri 2a str. 2457T
cgcugcuuguuccacuuca

SEQ ID NO: 1933875 - RNA, 19 nt, Shigella flexneri 2a str. 2457T
cgcugcuguagcaguucca

SEQ ID NO: 1933876 - RNA, 20 nt, Shigella flexneri 2a str. 2457T
cgcugcuuguuccacuucau

SEQ ID NO: 1933877 - RNA, 23 nt, Shigella flexneri 2a str. 2457T
cgcugcuuuccugcugcgccugu

SEQ ID NO: 1933878 - RNA, 19 nt, Shigella flexneri 2a str. 2457T
cgcuggacguugcguugca

SEQ ID NO: 1933879 - RNA, 13 nt, Shigella flexneri 2a str. 2457T
cgcugcuaauuua

SEQ ID NO: 1933880 - RNA, 14 nt, Shigella flexneri 2a str. 2457T
cgcugcucuucagu

SEQ ID NO: 1933881 - RNA, 15 nt, Shigella flexneri 2a str. 2457T
cgcugcugcacauac

SEQ ID NO: 1933882 - RNA, 17 nt, Shigella flexneri 2a str. 2457T
cgcugcggcgcgcaucu

SEQ ID NO: 1933883 - RNA, 21 nt, Shigella flexneri 2a str. 2457T
cgcugcgcuuacacacccggc

SEQ ID NO: 1933884 - RNA, 16 nt, Shigella flexneri 2a str. 2457T
cgcugagguccggcca

SEQ ID NO: 1933885 - RNA, 23 nt, Shigella flexneri 2a str. 2457T
cgcugacauuacgcgcuucguug

SEQ ID NO: 1933886 - RNA, 17 nt, Shigella flexneri 2a str. 2457T
cgcugauauacccuuca

SEQ ID NO: 1933887 - RNA, 13 nt, Shigella flexneri 2a str. 2457T
cgcugaugccagg

SEQ ID NO: 1933888 - RNA, 16 nt, Shigella flexneri 2a str. 2457T
cgcugcccugcugguu

SEQ ID NO: 1933889 - RNA, 18 nt, Shigella flexneri 2a str. 2457T
cgcugccccugguuaucu

SEQ ID NO: 1933890 - RNA, 19 nt, Shigella flexneri 2a str. 2457T
cgcucaggguaccgauaga

SEQ ID NO: 1933891 - RNA, 20 nt, Shigella flexneri 2a str. 2457T
cgcucucccaguaaccacgc

SEQ ID NO: 1933892 - RNA, 24 nt, Shigella flexneri 2a str. 2457T
cgcugaagaaaauggccagccagc

SEQ ID NO: 1933893 - RNA, 16 nt, Shigella flexneri 2a str. 2457T
cgcugaacgggccauc

SEQ ID NO: 1933894 - RNA, 17 nt, Shigella flexneri 2a str. 2457T
cgcugaacgcaccuucc

SEQ ID NO: 1933895 - RNA, 14 nt, Shigella flexneri 2a str. 2457T
cgggcguccugcuu

SEQ ID NO: 1933896 - RNA, 13 nt, Shigella flexneri 2a str. 2457T
cgggcucaugcug

SEQ ID NO: 1933897 - RNA, 18 nt, Shigella flexneri 2a str. 2457T
cggggugauaacgccugg

SEQ ID NO: 1933898 - RNA, 18 nt, Shigella flexneri 2a str. 2457T
cggggcggcuaucccaaa

SEQ ID NO: 1933899 - RNA, 18 nt, Shigella flexneri 2a str. 2457T
cggcuuuuuuacgccugu

SEQ ID NO: 1933900 - RNA, 21 nt, Shigella flexneri 2a str. 2457T
cgggcacagauuuccaagcgc

SEQ ID NO: 1933901 - RNA, 15 nt, Shigella flexneri 2a str. 2457T
cgggcaucagcagca

SEQ ID NO: 1933902 - RNA, 20 nt, Shigella flexneri 2a str. 2457T
cgggccauaaaaggaagagg

SEQ ID NO: 1933903 - RNA, 18 nt, Shigella flexneri 2a str. 2457T
cgggccaucagagcugga

SEQ ID NO: 1933904 - RNA, 20 nt, Shigella flexneri 2a str. 2457T
cgggcccauaacgccugcuc

SEQ ID NO: 1933905 - RNA, 16 nt, Shigella flexneri 2a str. 2457T
cgggccugaacaagca

SEQ ID NO: 1933906 - RNA, 15 nt, Shigella flexneri 2a str. 2457T
cgggccuccccggau

SEQ ID NO: 1933907 - RNA, 21 nt, Shigella flexneri 2a str. 2457T
cgggccuccccggauucaucc

SEQ ID NO: 1933908 - RNA, 18 nt, Shigella flexneri 2a str. 2457T
cgggccuccccugauuca

SEQ ID NO: 1933909 - RNA, 21 nt, Shigella flexneri 2a str. 2457T
cgggccgcaaaccagcgcaug

SEQ ID NO: 1933910 - RNA, 15 nt, Shigella flexneri 2a str. 2457T
cgggccgcaaaccag

SEQ ID NO: 1933911 - RNA, 15 nt, Shigella flexneri 2a str. 2457T
cgggcgcaagggcug

SEQ ID NO: 1933912 - RNA, 18 nt, Shigella flexneri 2a str. 2457T
cggcuguccggcaccauc

SEQ ID NO: 1933913 - RNA, 14 nt, Shigella flexneri 2a str. 2457T
cggcuguccggcac

SEQ ID NO: 1933914 - RNA, 13 nt, Shigella flexneri 2a str. 2457T
cggcuucgccucc

SEQ ID NO: 1933915 - RNA, 16 nt, Shigella flexneri 2a str. 2457T
cggcuucgccuccugu

SEQ ID NO: 1933916 - RNA, 18 nt, Shigella flexneri 2a str. 2457T
cggcuucgccuccuguuc

SEQ ID NO: 1933917 - RNA, 20 nt, Shigella flexneri 2a str. 2457T
cggcuucgcaucccgguauc

SEQ ID NO: 1933918 - RNA, 20 nt, Shigella flexneri 2a str. 2457T
cggcuucgccuccuguucug

SEQ ID NO: 1933919 - RNA, 13 nt, Shigella flexneri 2a str. 2457T
cggcuuucaaggc

SEQ ID NO: 1933920 - RNA, 20 nt, Shigella flexneri 2a str. 2457T
cggcuuugaauaucuccucu

SEQ ID NO: 1933921 - RNA, 23 nt, Shigella flexneri 2a str. 2457T
cggcuguagagcuaccggcagga

SEQ ID NO: 1933922 - RNA, 14 nt, Shigella flexneri 2a str. 2457T
cggcuguaugaccu

SEQ ID NO: 1933923 - RNA, 21 nt, Shigella flexneri 2a str. 2457T
cggcugggaaaucaccaccag

SEQ ID NO: 1933924 - RNA, 14 nt, Shigella flexneri 2a str. 2457T
cggcugccagccag

SEQ ID NO: 1933925 - RNA, 19 nt, Shigella flexneri 2a str. 2457T
cggcuccgcugacgccugc

SEQ ID NO: 1933926 - RNA, 15 nt, Shigella flexneri 2a str. 2457T
cggcuccguuccgcu

SEQ ID NO: 1933927 - RNA, 21 nt, Shigella flexneri 2a str. 2457T
cggcuaucuacgcguaaaugc

SEQ ID NO: 1933928 - RNA, 18 nt, Shigella flexneri 2a str. 2457T
cggcguacuaucugcugc

SEQ ID NO: 1933929 - RNA, 18 nt, Shigella flexneri 2a str. 2457T
cggcgugcgcgcccauac

SEQ ID NO: 1933930 - RNA, 13 nt, Shigella flexneri 2a str. 2457T
cggcgugggcgcu

SEQ ID NO: 1933931 - RNA, 10 nt, Shigella flexneri 2a str. 2457T
cggcggcgga

SEQ ID NO: 1933932 - RNA, 15 nt, Shigella flexneri 2a str. 2457T
cggcggcggaaaaag

SEQ ID NO: 1933933 - RNA, 22 nt, Shigella flexneri 2a str. 2457T
cggcggcgauguccagacgcgc

SEQ ID NO: 1933934 - RNA, 17 nt, Shigella flexneri 2a str. 2457T
cggcggucagcgccagc

SEQ ID NO: 1933935 - RNA, 15 nt, Shigella flexneri 2a str. 2457T
cggcguaaacgccuu

SEQ ID NO: 1933936 - RNA, 15 nt, Shigella flexneri 2a str. 2457T
cggcgguugacgccc

SEQ ID NO: 1933937 - RNA, 17 nt, Shigella flexneri 2a str. 2457T
cggcgguugacgccccu

SEQ ID NO: 1933938 - RNA, 23 nt, Shigella flexneri 2a str. 2457T
cggcgcguugaugccgugcagca

SEQ ID NO: 1933939 - RNA, 13 nt, Shigella flexneri 2a str. 2457T
cggcgcggcagcu

SEQ ID NO: 1933940 - RNA, 13 nt, Shigella flexneri 2a str. 2457T
cgucaccacuuca

SEQ ID NO: 1933941 - RNA, 14 nt, Shigella flexneri 2a str. 2457T
cgucaccacuucac

SEQ ID NO: 1933942 - RNA, 15 nt, Shigella flexneri 2a str. 2457T
cgucaccuugccagu

SEQ ID NO: 1933943 - RNA, 14 nt, Shigella flexneri 2a str. 2457T
cgucaccugcccgg

SEQ ID NO: 1933944 - RNA, 17 nt, Shigella flexneri 2a str. 2457T
cgucacguucugcgccg

SEQ ID NO: 1933945 - RNA, 17 nt, Shigella flexneri 2a str. 2457T
cgucacgcucauccugg

SEQ ID NO: 1933946 - RNA, 22 nt, Shigella flexneri 2a str. 2457T
cgucacgaagcauugcgccugc

SEQ ID NO: 1933947 - RNA, 18 nt, Shigella flexneri 2a str. 2457T
cgucaaaaaacuucuuca

SEQ ID NO: 1933948 - RNA, 17 nt, Shigella flexneri 2a str. 2457T
cgucaaggguugccgga

SEQ ID NO: 1933949 - RNA, 22 nt, Shigella flexneri 2a str. 2457T
cgucaagcgguaaccauccaua

SEQ ID NO: 1933950 - RNA, 18 nt, Shigella flexneri 2a str. 2457T
cgucaacggugccauuga

SEQ ID NO: 1933951 - RNA, 23 nt, Shigella flexneri 2a str. 2457T
cgucaacuuuguuagcgaauaaa

SEQ ID NO: 1933952 - RNA, 16 nt, Shigella flexneri 2a str. 2457T
cgucaccaccugggug

SEQ ID NO: 1933953 - RNA, 13 nt, Shigella flexneri 2a str. 2457T
cgucacaggccau

SEQ ID NO: 1933954 - RNA, 20 nt, Shigella flexneri 2a str. 2457T
cgucaauuuguuccgccagc

SEQ ID NO: 1933955 - RNA, 22 nt, Shigella flexneri 2a str. 2457T
cgucaauuuuaagcagaucggc

SEQ ID NO: 1933956 - RNA, 20 nt, Shigella flexneri 2a str. 2457T
cgucaaucugcccgaccaga

SEQ ID NO: 1933957 - RNA, 13 nt, Shigella flexneri 2a str. 2457T
cgucaaucugccc

SEQ ID NO: 1933958 - RNA, 19 nt, Shigella flexneri 2a str. 2457T
cgucaucggcguugcccau

SEQ ID NO: 1933959 - RNA, 17 nt, Shigella flexneri 2a str. 2457T
cgucauccguggcgaca

SEQ ID NO: 1933960 - RNA, 22 nt, Shigella flexneri 2a str. 2457T
cgucaucauucaucgccuucuu

SEQ ID NO: 1933961 - RNA, 16 nt, Shigella flexneri 2a str. 2457T
cgucauccagcacuug

SEQ ID NO: 1933962 - RNA, 21 nt, Shigella flexneri 2a str. 2457T
cgucaguacauagccaucugc

SEQ ID NO: 1933963 - RNA, 20 nt, Shigella flexneri 2a str. 2457T
cgucagugucuuaucuggca

SEQ ID NO: 1933964 - RNA, 18 nt, Shigella flexneri 2a str. 2457T
cgucagucacaccgcgcg

SEQ ID NO: 1933965 - RNA, 19 nt, Shigella flexneri 2a str. 2457T
cgucaguacauagccaucu

SEQ ID NO: 1933966 - RNA, 15 nt, Shigella flexneri 2a str. 2457T
cgucauacuccaguc

SEQ ID NO: 1933967 - RNA, 14 nt, Shigella flexneri 2a str. 2457T
cgucauacugcuca

SEQ ID NO: 1933968 - RNA, 18 nt, Shigella flexneri 2a str. 2457T
cgucaucauagacuuccc

SEQ ID NO: 1933969 - RNA, 16 nt, Shigella flexneri 2a str. 2457T
cgucauauuacugcaa

SEQ ID NO: 1933970 - RNA, 15 nt, Shigella flexneri 2a str. 2457T
cgucaucagcaauuu

SEQ ID NO: 1933971 - RNA, 16 nt, Shigella flexneri 2a str. 2457T
cgucagauccgccagu

SEQ ID NO: 1933972 - RNA, 21 nt, Shigella flexneri 2a str. 2457T
cgucagaccggcaaccagcac

SEQ ID NO: 1933973 - RNA, 23 nt, Shigella flexneri 2a str. 2457T
cgucagaaaaaucaauauuuuca

SEQ ID NO: 1933974 - RNA, 17 nt, Shigella flexneri 2a str. 2457T
cgucagcaaaauacuga

SEQ ID NO: 1933975 - RNA, 14 nt, Shigella flexneri 2a str. 2457T
cgucagccgcccgc

SEQ ID NO: 1933976 - RNA, 17 nt, Shigella flexneri 2a str. 2457T
cgucagcgaguugauca

SEQ ID NO: 1933977 - RNA, 15 nt, Shigella flexneri 2a str. 2457T
cgucagccugcucag

SEQ ID NO: 1933978 - RNA, 15 nt, Shigella flexneri 2a str. 2457T
cgucagccagaaaga

SEQ ID NO: 1933979 - RNA, 20 nt, Shigella flexneri 2a str. 2457T
cgucagccacuucuuccagc

SEQ ID NO: 1933980 - RNA, 16 nt, Shigella flexneri 2a str. 2457T
cgucagcauguuuaua

SEQ ID NO: 1933981 - RNA, 23 nt, Shigella flexneri 2a str. 2457T
cgucagcaguucacgcagcuucu

SEQ ID NO: 1933982 - RNA, 14 nt, Shigella flexneri 2a str. 2457T
cgucaggagcugga

SEQ ID NO: 1933983 - RNA, 14 nt, Shigella flexneri 2a str. 2457T
cgucaggauaaacu

SEQ ID NO: 1933984 - RNA, 21 nt, Shigella flexneri 2a str. 2457T
cguauucugacugucagaugc

SEQ ID NO: 1933985 - RNA, 23 nt, Shigella flexneri 2a str. 2457T
cguauuccgcguuacccauucaa

SEQ ID NO: 1933986 - RNA, 18 nt, Shigella flexneri 2a str. 2457T
cguauugguacauaacac

SEQ ID NO: 1933987 - RNA, 14 nt, Shigella flexneri 2a str. 2457T
cguaucuuccaggg

SEQ ID NO: 1933988 - RNA, 12 nt, Shigella flexneri 2a str. 2457T
cguauccaucac

SEQ ID NO: 1933989 - RNA, 23 nt, Shigella flexneri 2a str. 2457T
cguaugguugccgggcuggagag

SEQ ID NO: 1933990 - RNA, 14 nt, Shigella flexneri 2a str. 2457T
cguauuaugcacac

SEQ ID NO: 1933991 - RNA, 21 nt, Shigella flexneri 2a str. 2457T
cguauccgaugaaucaccaca

SEQ ID NO: 1933992 - RNA, 21 nt, Shigella flexneri 2a str. 2457T
cguauaguguccacaggaaaa

SEQ ID NO: 1933993 - RNA, 17 nt, Shigella flexneri 2a str. 2457T
cguaucaccccgcccga

SEQ ID NO: 1933994 - RNA, 16 nt, Shigella flexneri 2a str. 2457T
cguaguucuuucucug

SEQ ID NO: 1933995 - RNA, 17 nt, Shigella flexneri 2a str. 2457T
cguaguucuuucucugc

SEQ ID NO: 1933996 - RNA, 19 nt, Shigella flexneri 2a str. 2457T
cguaguguggggaaugaua

SEQ ID NO: 1933997 - RNA, 18 nt, Shigella flexneri 2a str. 2457T
cguagucugaccucuucu

SEQ ID NO: 1933998 - RNA, 14 nt, Shigella flexneri 2a str. 2457T
cguagacugcagcg

SEQ ID NO: 1933999 - RNA, 14 nt, Shigella flexneri 2a str. 2457T
cguagccaccaucu

SEQ ID NO: 1934000 - RNA, 24 nt, Shigella flexneri 2a str. 2457T
cguagcaccgacgucgauauaauu

SEQ ID NO: 1934001 - RNA, 21 nt, Shigella flexneri 2a str. 2457T
cguagccaugaugaacaaccc

SEQ ID NO: 1934002 - RNA, 19 nt, Shigella flexneri 2a str. 2457T
cguagccccagucuuccug

SEQ ID NO: 1934003 - RNA, 15 nt, Shigella flexneri 2a str. 2457T
cguaggcccagccgu

SEQ ID NO: 1934004 - RNA, 13 nt, Shigella flexneri 2a str. 2457T
cguaggccugaua

SEQ ID NO: 1934005 - RNA, 21 nt, Shigella flexneri 2a str. 2457T
cguaggccagcggcuccccgc

SEQ ID NO: 1934006 - RNA, 14 nt, Shigella flexneri 2a str. 2457T
cguaggccaaccgu

SEQ ID NO: 1934007 - RNA, 14 nt, Shigella flexneri 2a str. 2457T
cguaggccugauaa

SEQ ID NO: 1934008 - RNA, 16 nt, Shigella flexneri 2a str. 2457T
cguagcguuuuuucau

SEQ ID NO: 1934009 - RNA, 21 nt, Shigella flexneri 2a str. 2457T
cguagcuggcggcaaugaaag

SEQ ID NO: 1934010 - RNA, 17 nt, Shigella flexneri 2a str. 2457T
cguagcuguucaggaga

SEQ ID NO: 1934011 - RNA, 23 nt, Shigella flexneri 2a str. 2457T
cggucguaaucgcccgcuuccag

SEQ ID NO: 1934012 - RNA, 20 nt, Shigella flexneri 2a str. 2457T
cggucuaaaucuuccgccgg

SEQ ID NO: 1934013 - RNA, 20 nt, Shigella flexneri 2a str. 2457T
cggucuaccgauccggcacc

SEQ ID NO: 1934014 - RNA, 18 nt, Shigella flexneri 2a str. 2457T
cggugacgcaaccgcaaa

SEQ ID NO: 1934015 - RNA, 22 nt, Shigella flexneri 2a str. 2457T
cggugacgcacaguacgcgccc

SEQ ID NO: 1934016 - RNA, 13 nt, Shigella flexneri 2a str. 2457T
cggugaugaugcu

SEQ ID NO: 1934017 - RNA, 21 nt, Shigella flexneri 2a str. 2457T
cggugauuuccgccgccagca

SEQ ID NO: 1934018 - RNA, 15 nt, Shigella flexneri 2a str. 2457T
cggucggcuucccug

SEQ ID NO: 1934019 - RNA, 19 nt, Shigella flexneri 2a str. 2457T
cggucgaggcaaccagcac

SEQ ID NO: 1934020 - RNA, 18 nt, Shigella flexneri 2a str. 2457T
cggucauuuugaccacac

SEQ ID NO: 1934021 - RNA, 22 nt, Shigella flexneri 2a str. 2457T
cggucauuacgcgguuuauuau

SEQ ID NO: 1934022 - RNA, 15 nt, Shigella flexneri 2a str. 2457T
cggucaucaguucag

SEQ ID NO: 1934023 - RNA, 18 nt, Shigella flexneri 2a str. 2457T
cgguccgguugcagagua

SEQ ID NO: 1934024 - RNA, 18 nt, Shigella flexneri 2a str. 2457T
cgguccuggcgaucgggc

SEQ ID NO: 1934025 - RNA, 23 nt, Shigella flexneri 2a str. 2457T
cggugucgauacgacaacggcag

SEQ ID NO: 1934026 - RNA, 15 nt, Shigella flexneri 2a str. 2457T
cgguggucauaauau

SEQ ID NO: 1934027 - RNA, 15 nt, Shigella flexneri 2a str. 2457T
cgguuacgccgcauc

SEQ ID NO: 1934028 - RNA, 19 nt, Shigella flexneri 2a str. 2457T
cgguuagaauaccugccug

SEQ ID NO: 1934029 - RNA, 20 nt, Shigella flexneri 2a str. 2457T
cgguuagaauaccugccugu

SEQ ID NO: 1934030 - RNA, 17 nt, Shigella flexneri 2a str. 2457T
cgguuaucacucuugac

SEQ ID NO: 1934031 - RNA, 14 nt, Shigella flexneri 2a str. 2457T
cgguuaauaaugau

SEQ ID NO: 1934032 - RNA, 17 nt, Shigella flexneri 2a str. 2457T
cgguuaacaguuuguuu

SEQ ID NO: 1934033 - RNA, 14 nt, Shigella flexneri 2a str. 2457T
cgguuaaaaauaau

SEQ ID NO: 1934034 - RNA, 17 nt, Shigella flexneri 2a str. 2457T
cggugccaucauacagc

SEQ ID NO: 1934035 - RNA, 15 nt, Shigella flexneri 2a str. 2457T
cguaaccauaaccaa

SEQ ID NO: 1934036 - RNA, 21 nt, Shigella flexneri 2a str. 2457T
cguaaacgccuuauccggccu

SEQ ID NO: 1934037 - RNA, 14 nt, Shigella flexneri 2a str. 2457T
cguaacgaccacca

SEQ ID NO: 1934038 - RNA, 23 nt, Shigella flexneri 2a str. 2457T
cguaacgccacgauagagagcag

SEQ ID NO: 1934039 - RNA, 17 nt, Shigella flexneri 2a str. 2457T
cguaacgaccaccaccg

SEQ ID NO: 1934040 - RNA, 12 nt, Shigella flexneri 2a str. 2457T
cguaacgacugc

SEQ ID NO: 1934041 - RNA, 16 nt, Shigella flexneri 2a str. 2457T
cguaacgacugcggau

SEQ ID NO: 1934042 - RNA, 13 nt, Shigella flexneri 2a str. 2457T
cguaacgacugac

SEQ ID NO: 1934043 - RNA, 14 nt, Shigella flexneri 2a str. 2457T
cguaaacaacuggc

SEQ ID NO: 1934044 - RNA, 17 nt, Shigella flexneri 2a str. 2457T
cguaaaccacugacaca

SEQ ID NO: 1934045 - RNA, 16 nt, Shigella flexneri 2a str. 2457T
cgguuucacuauuacc

SEQ ID NO: 1934046 - RNA, 20 nt, Shigella flexneri 2a str. 2457T
cgguuuucgcgccagccagu

SEQ ID NO: 1934047 - RNA, 23 nt, Shigella flexneri 2a str. 2457T
cgguuuugcaggaaaaacugccc

SEQ ID NO: 1934048 - RNA, 13 nt, Shigella flexneri 2a str. 2457T
cgguuugccauuu

SEQ ID NO: 1934049 - RNA, 16 nt, Shigella flexneri 2a str. 2457T
cgguuugccauuuucu

SEQ ID NO: 1934050 - RNA, 23 nt, Shigella flexneri 2a str. 2457T
cgguuguucaaccaccggcacca

SEQ ID NO: 1934051 - RNA, 22 nt, Shigella flexneri 2a str. 2457T
cgguuguucaaccaccggcacc

SEQ ID NO: 1934052 - RNA, 14 nt, Shigella flexneri 2a str. 2457T
cgguuuauccccaa

SEQ ID NO: 1934053 - RNA, 20 nt, Shigella flexneri 2a str. 2457T
cgguucaaauagcaaugucu

SEQ ID NO: 1934054 - RNA, 22 nt, Shigella flexneri 2a str. 2457T
cgguugcugaacagcuuuuucc

SEQ ID NO: 1934055 - RNA, 18 nt, Shigella flexneri 2a str. 2457T
cgguuguagcucggcgca

SEQ ID NO: 1934056 - RNA, 22 nt, Shigella flexneri 2a str. 2457T
cgguuggcaucagaggaaugau

SEQ ID NO: 1934057 - RNA, 18 nt, Shigella flexneri 2a str. 2457T
cgguugcuuuucacaacc

SEQ ID NO: 1934058 - RNA, 17 nt, Shigella flexneri 2a str. 2457T
cccgccguugccgcagc

SEQ ID NO: 1934059 - RNA, 16 nt, Shigella flexneri 2a str. 2457T
cccgccguugccgcag

SEQ ID NO: 1934060 - RNA, 18 nt, Shigella flexneri 2a str. 2457T
cccgcgauaaaaauccug

SEQ ID NO: 1934061 - RNA, 14 nt, Shigella flexneri 2a str. 2457T
cccgcgaucgccug

SEQ ID NO: 1934062 - RNA, 21 nt, Shigella flexneri 2a str. 2457T
cccgccuguugcgucgccgcc

SEQ ID NO: 1934063 - RNA, 15 nt, Shigella flexneri 2a str. 2457T
cccgccagcaccagc

SEQ ID NO: 1934064 - RNA, 19 nt, Shigella flexneri 2a str. 2457T
cccgccagcacgaccgcca

SEQ ID NO: 1934065 - RNA, 18 nt, Shigella flexneri 2a str. 2457T
cccgccaucaucccuaca

SEQ ID NO: 1934066 - RNA, 20 nt, Shigella flexneri 2a str. 2457T
cccgccauaacggcugucca

SEQ ID NO: 1934067 - RNA, 13 nt, Shigella flexneri 2a str. 2457T
cccgcccaaucga

SEQ ID NO: 1934068 - RNA, 14 nt, Shigella flexneri 2a str. 2457T
cccgcagcuccagc

SEQ ID NO: 1934069 - RNA, 12 nt, Shigella flexneri 2a str. 2457T
cccgccacccca

SEQ ID NO: 1934070 - RNA, 20 nt, Shigella flexneri 2a str. 2457T
cccggcacguuuuggcagac

SEQ ID NO: 1934071 - RNA, 19 nt, Shigella flexneri 2a str. 2457T
cccggauuuggcaaaugca

SEQ ID NO: 1934072 - RNA, 23 nt, Shigella flexneri 2a str. 2457T
cccggcaagaaauaccgaagagu

SEQ ID NO: 1934073 - RNA, 21 nt, Shigella flexneri 2a str. 2457T
cccggcaaucaccgccagcgg

SEQ ID NO: 1934074 - RNA, 17 nt, Shigella flexneri 2a str. 2457T
cccggccacagcgccag

SEQ ID NO: 1934075 - RNA, 17 nt, Shigella flexneri 2a str. 2457T
cccggcauucaccucug

SEQ ID NO: 1934076 - RNA, 12 nt, Shigella flexneri 2a str. 2457T
cccggagcagca

SEQ ID NO: 1934077 - RNA, 15 nt, Shigella flexneri 2a str. 2457T
cccggauaucaccac

SEQ ID NO: 1934078 - RNA, 17 nt, Shigella flexneri 2a str. 2457T
cccggauauccacccgc

SEQ ID NO: 1934079 - RNA, 20 nt, Shigella flexneri 2a str. 2457T
cccggacaguccccucgccc

SEQ ID NO: 1934080 - RNA, 14 nt, Shigella flexneri 2a str. 2457T
cccggaacgggaga

SEQ ID NO: 1934081 - RNA, 13 nt, Shigella flexneri 2a str. 2457T
cccggaagccacc

SEQ ID NO: 1934082 - RNA, 23 nt, Shigella flexneri 2a str. 2457T
cccggaagccaccacgccaagaa

SEQ ID NO: 1934083 - RNA, 23 nt, Shigella flexneri 2a str. 2457T
cccggaacgggagaaacccggcc

SEQ ID NO: 1934084 - RNA, 15 nt, Shigella flexneri 2a str. 2457T
cccggaauucucaaa

SEQ ID NO: 1934085 - RNA, 14 nt, Shigella flexneri 2a str. 2457T
cccggaacuccugg

SEQ ID NO: 1934086 - RNA, 23 nt, Shigella flexneri 2a str. 2457T
cccgcuuuggcgucuucugccgg

SEQ ID NO: 1934087 - RNA, 18 nt, Shigella flexneri 2a str. 2457T
cccgcuuccugcagcgug

SEQ ID NO: 1934088 - RNA, 20 nt, Shigella flexneri 2a str. 2457T
cccgcuucguuuucagcuuc

SEQ ID NO: 1934089 - RNA, 12 nt, Shigella flexneri 2a str. 2457T
cccgcguucugg

SEQ ID NO: 1934090 - RNA, 15 nt, Shigella flexneri 2a str. 2457T
cccgcuuccugcagc

SEQ ID NO: 1934091 - RNA, 20 nt, Shigella flexneri 2a str. 2457T
cccgcugccgcagauauucc

SEQ ID NO: 1934092 - RNA, 13 nt, Shigella flexneri 2a str. 2457T
cccgcucaaacac

SEQ ID NO: 1934093 - RNA, 17 nt, Shigella flexneri 2a str. 2457T
cccgucgaagacucuua

SEQ ID NO: 1934094 - RNA, 16 nt, Shigella flexneri 2a str. 2457T
cccguccguuccgcca

SEQ ID NO: 1934095 - RNA, 15 nt, Shigella flexneri 2a str. 2457T
cccgucaccacuuca

SEQ ID NO: 1934096 - RNA, 14 nt, Shigella flexneri 2a str. 2457T
cccgucagcaaaau

SEQ ID NO: 1934097 - RNA, 12 nt, Shigella flexneri 2a str. 2457T
cccguagugugg

SEQ ID NO: 1934098 - RNA, 14 nt, Shigella flexneri 2a str. 2457T
cccguacgcugugg

SEQ ID NO: 1934099 - RNA, 16 nt, Shigella flexneri 2a str. 2457T
cccgguuuuacuuugc

SEQ ID NO: 1934100 - RNA, 15 nt, Shigella flexneri 2a str. 2457T
cccgguuucucuucu

SEQ ID NO: 1934101 - RNA, 14 nt, Shigella flexneri 2a str. 2457T
cccgguugacugcu

SEQ ID NO: 1934102 - RNA, 17 nt, Shigella flexneri 2a str. 2457T
cccgugggcaggccugg

SEQ ID NO: 1934103 - RNA, 18 nt, Shigella flexneri 2a str. 2457T
cccgucugacgcgugccu

SEQ ID NO: 1934104 - RNA, 15 nt, Shigella flexneri 2a str. 2457T
cccgugcacaaauuu

SEQ ID NO: 1934105 - RNA, 14 nt, Shigella flexneri 2a str. 2457T
cccguuuucaccuu

SEQ ID NO: 1934106 - RNA, 16 nt, Shigella flexneri 2a str. 2457T
cccguuaaccacuuca

SEQ ID NO: 1934107 - RNA, 23 nt, Shigella flexneri 2a str. 2457T
cccguuccaccgcguuuuccagu

SEQ ID NO: 1934108 - RNA, 14 nt, Shigella flexneri 2a str. 2457T
cccuaacaucaucc

SEQ ID NO: 1934109 - RNA, 21 nt, Shigella flexneri 2a str. 2457T
cccguuuucuccagcgccgcc

SEQ ID NO: 1934110 - RNA, 16 nt, Shigella flexneri 2a str. 2457T
cccuaaucccgugccg

SEQ ID NO: 1934111 - RNA, 23 nt, Shigella flexneri 2a str. 2457T
cccucccccagcaucuauacuua

SEQ ID NO: 1934112 - RNA, 19 nt, Shigella flexneri 2a str. 2457T
cccucacccuaacccucuc

SEQ ID NO: 1934113 - RNA, 20 nt, Shigella flexneri 2a str. 2457T
cccucacccuaacccucucc

SEQ ID NO: 1934114 - RNA, 22 nt, Shigella flexneri 2a str. 2457T
cccucacccuaacccucucccc

SEQ ID NO: 1934115 - RNA, 16 nt, Shigella flexneri 2a str. 2457T
cccucgaccaucuccu

SEQ ID NO: 1934116 - RNA, 17 nt, Shigella flexneri 2a str. 2457T
cccuccugauaacacag

SEQ ID NO: 1934117 - RNA, 19 nt, Shigella flexneri 2a str. 2457T
cccggcuuuuuuacgccug

SEQ ID NO: 1934118 - RNA, 20 nt, Shigella flexneri 2a str. 2457T
cccgggccuccccggauuca

SEQ ID NO: 1934119 - RNA, 14 nt, Shigella flexneri 2a str. 2457T
cccgguaucaaacc

SEQ ID NO: 1934120 - RNA, 15 nt, Shigella flexneri 2a str. 2457T
cccgguaccuuugaa

SEQ ID NO: 1934121 - RNA, 12 nt, Shigella flexneri 2a str. 2457T
cccgguccuggc

SEQ ID NO: 1934122 - RNA, 23 nt, Shigella flexneri 2a str. 2457T
cccggcgaugguuuucaucccga

SEQ ID NO: 1934123 - RNA, 16 nt, Shigella flexneri 2a str. 2457T
cccggccugcucccga

SEQ ID NO: 1934124 - RNA, 13 nt, Shigella flexneri 2a str. 2457T
cccggcggccgga

SEQ ID NO: 1934125 - RNA, 18 nt, Shigella flexneri 2a str. 2457T
cccggcggccggaugaca

SEQ ID NO: 1934126 - RNA, 18 nt, Shigella flexneri 2a str. 2457T
cccggcgcggugcuggau

SEQ ID NO: 1934127 - RNA, 22 nt, Shigella flexneri 2a str. 2457T
ccauuuauccagcggcagccau

SEQ ID NO: 1934128 - RNA, 18 nt, Shigella flexneri 2a str. 2457T
ccauugccgccucugccg

SEQ ID NO: 1934129 - RNA, 14 nt, Shigella flexneri 2a str. 2457T
ccauuguuagcaac

SEQ ID NO: 1934130 - RNA, 18 nt, Shigella flexneri 2a str. 2457T
ccauuguuagcaacgaca

SEQ ID NO: 1934131 - RNA, 18 nt, Shigella flexneri 2a str. 2457T
ccauugacguuccuuucu

SEQ ID NO: 1934132 - RNA, 13 nt, Shigella flexneri 2a str. 2457T
ccaucuuuuuaag

SEQ ID NO: 1934133 - RNA, 14 nt, Shigella flexneri 2a str. 2457T
ccauugaccagcug

SEQ ID NO: 1934134 - RNA, 19 nt, Shigella flexneri 2a str. 2457T
ccauugaagaauuuuugcg

SEQ ID NO: 1934135 - RNA, 20 nt, Shigella flexneri 2a str. 2457T
ccauuugugcauagcacacu

SEQ ID NO: 1934136 - RNA, 21 nt, Shigella flexneri 2a str. 2457T
ccauuugugcauagcacacuu

SEQ ID NO: 1934137 - RNA, 12 nt, Shigella flexneri 2a str. 2457T
ccauuugccacu

SEQ ID NO: 1934138 - RNA, 17 nt, Shigella flexneri 2a str. 2457T
ccauuucggcgugcugu

SEQ ID NO: 1934139 - RNA, 15 nt, Shigella flexneri 2a str. 2457T
ccauuuccuguaaca

SEQ ID NO: 1934140 - RNA, 19 nt, Shigella flexneri 2a str. 2457T
ccauuucccugacaaauca

SEQ ID NO: 1934141 - RNA, 12 nt, Shigella flexneri 2a str. 2457T
ccauuucugcca

SEQ ID NO: 1934142 - RNA, 12 nt, Shigella flexneri 2a str. 2457T
ccauuuuuucgu

SEQ ID NO: 1934143 - RNA, 12 nt, Shigella flexneri 2a str. 2457T
cccaccaccauc

SEQ ID NO: 1934144 - RNA, 17 nt, Shigella flexneri 2a str. 2457T
cccacgcgguauccaua

SEQ ID NO: 1934145 - RNA, 20 nt, Shigella flexneri 2a str. 2457T
cccacggauagauuuuuaau

SEQ ID NO: 1934146 - RNA, 19 nt, Shigella flexneri 2a str. 2457T
cccacgccgcccagagaac

SEQ ID NO: 1934147 - RNA, 18 nt, Shigella flexneri 2a str. 2457T
cccaaaccacccagcagc

SEQ ID NO: 1934148 - RNA, 15 nt, Shigella flexneri 2a str. 2457T
cccaacaacagcgcg

SEQ ID NO: 1934149 - RNA, 11 nt, Shigella flexneri 2a str. 2457T
cccacacauuu

SEQ ID NO: 1934150 - RNA, 14 nt, Shigella flexneri 2a str. 2457T
cccacaccaccaug

SEQ ID NO: 1934151 - RNA, 15 nt, Shigella flexneri 2a str. 2457T
cccacagaaacaaua

SEQ ID NO: 1934152 - RNA, 12 nt, Shigella flexneri 2a str. 2457T
cccacagacgac

SEQ ID NO: 1934153 - RNA, 14 nt, Shigella flexneri 2a str. 2457T
cccacagcucugcu

SEQ ID NO: 1934154 - RNA, 22 nt, Shigella flexneri 2a str. 2457T
cccacagcucuugcuccacaag

SEQ ID NO: 1934155 - RNA, 14 nt, Shigella flexneri 2a str. 2457T
cccagcccccagca

SEQ ID NO: 1934156 - RNA, 13 nt, Shigella flexneri 2a str. 2457T
cccagcagcgccg

SEQ ID NO: 1934157 - RNA, 12 nt, Shigella flexneri 2a str. 2457T
cccagccgcccu

SEQ ID NO: 1934158 - RNA, 17 nt, Shigella flexneri 2a str. 2457T
cccagcgaagcaaacca

SEQ ID NO: 1934159 - RNA, 12 nt, Shigella flexneri 2a str. 2457T
cccacuccagcu

SEQ ID NO: 1934160 - RNA, 14 nt, Shigella flexneri 2a str. 2457T
cccagcaccaguac

SEQ ID NO: 1934161 - RNA, 16 nt, Shigella flexneri 2a str. 2457T
cccagcaccgcagaga

SEQ ID NO: 1934162 - RNA, 13 nt, Shigella flexneri 2a str. 2457T
cccagcacuucgc

SEQ ID NO: 1934163 - RNA, 15 nt, Shigella flexneri 2a str. 2457T
cccagcagagaucuu

SEQ ID NO: 1934164 - RNA, 19 nt, Shigella flexneri 2a str. 2457T
cccagcagacguaaaaaua

SEQ ID NO: 1934165 - RNA, 12 nt, Shigella flexneri 2a str. 2457T
cccagcagagau

SEQ ID NO: 1934166 - RNA, 16 nt, Shigella flexneri 2a str. 2457T
cccagcacuucgcugg

SEQ ID NO: 1934167 - RNA, 22 nt, Shigella flexneri 2a str. 2457T
cccacgucaucugucauaacac

SEQ ID NO: 1934168 - RNA, 19 nt, Shigella flexneri 2a str. 2457T
cccagcgaauccagcaugc

SEQ ID NO: 1934169 - RNA, 21 nt, Shigella flexneri 2a str. 2457T
cccagcgcgaucgcaccacca

SEQ ID NO: 1934170 - RNA, 20 nt, Shigella flexneri 2a str. 2457T
cccagggcaauguaacaccu

SEQ ID NO: 1934171 - RNA, 15 nt, Shigella flexneri 2a str. 2457T
cccagggccaacugg

SEQ ID NO: 1934172 - RNA, 22 nt, Shigella flexneri 2a str. 2457T
cccagggccaacuggcaaaaga

SEQ ID NO: 1934173 - RNA, 17 nt, Shigella flexneri 2a str. 2457T
cccagcucaucagcauu

SEQ ID NO: 1934174 - RNA, 17 nt, Shigella flexneri 2a str. 2457T
cccagcguugcacaugu

SEQ ID NO: 1934175 - RNA, 17 nt, Shigella flexneri 2a str. 2457T
cccagcgguaaaauggu

SEQ ID NO: 1934176 - RNA, 21 nt, Shigella flexneri 2a str. 2457T
cccagcgucagcauaaaaaua

SEQ ID NO: 1934177 - RNA, 23 nt, Shigella flexneri 2a str. 2457T
cccagcgucagcaucauaccucc

SEQ ID NO: 1934178 - RNA, 22 nt, Shigella flexneri 2a str. 2457T
ccccagaauucacgcacuuccg

SEQ ID NO: 1934179 - RNA, 16 nt, Shigella flexneri 2a str. 2457T
ccccagauugccgaua

SEQ ID NO: 1934180 - RNA, 21 nt, Shigella flexneri 2a str. 2457T
ccccagcaucacgcccgcuuu

SEQ ID NO: 1934181 - RNA, 14 nt, Shigella flexneri 2a str. 2457T
cccccaccccggcc

SEQ ID NO: 1934182 - RNA, 14 nt, Shigella flexneri 2a str. 2457T
cccccaguaaauga

SEQ ID NO: 1934183 - RNA, 18 nt, Shigella flexneri 2a str. 2457T
cccccauugggccacuca

SEQ ID NO: 1934184 - RNA, 19 nt, Shigella flexneri 2a str. 2457T
cccccauugaaacgagugg

SEQ ID NO: 1934185 - RNA, 21 nt, Shigella flexneri 2a str. 2457T
ccccgagaaaaauagcauuaa

SEQ ID NO: 1934186 - RNA, 18 nt, Shigella flexneri 2a str. 2457T
ccccgagaaauacuggcu

SEQ ID NO: 1934187 - RNA, 23 nt, Shigella flexneri 2a str. 2457T
ccccgcacaacggcuacuucuuc

SEQ ID NO: 1934188 - RNA, 23 nt, Shigella flexneri 2a str. 2457T
cccauggacauacgcaccuuuac

SEQ ID NO: 1934189 - RNA, 14 nt, Shigella flexneri 2a str. 2457T
cccauuuuauuuuc

SEQ ID NO: 1934190 - RNA, 21 nt, Shigella flexneri 2a str. 2457T
ccccaccccggcccucucccu

SEQ ID NO: 1934191 - RNA, 13 nt, Shigella flexneri 2a str. 2457T
ccccaccagcaaa

SEQ ID NO: 1934192 - RNA, 13 nt, Shigella flexneri 2a str. 2457T
ccccacagaccca

SEQ ID NO: 1934193 - RNA, 21 nt, Shigella flexneri 2a str. 2457T
ccccacagcucugcugucacc

SEQ ID NO: 1934194 - RNA, 21 nt, Shigella flexneri 2a str. 2457T
ccccacagugcugauuuugca

SEQ ID NO: 1934195 - RNA, 21 nt, Shigella flexneri 2a str. 2457T
ccccaaggcgaggggaccgcc

SEQ ID NO: 1934196 - RNA, 14 nt, Shigella flexneri 2a str. 2457T
ccccacaccaccau

SEQ ID NO: 1934197 - RNA, 17 nt, Shigella flexneri 2a str. 2457T
ccccacaaacccgccag

SEQ ID NO: 1934198 - RNA, 23 nt, Shigella flexneri 2a str. 2457T
ccccaaaaagauuaaaaaaacac

SEQ ID NO: 1934199 - RNA, 17 nt, Shigella flexneri 2a str. 2457T
cccgauggucagcuuca

SEQ ID NO: 1934200 - RNA, 17 nt, Shigella flexneri 2a str. 2457T
cccgaugaugaugggcg

SEQ ID NO: 1934201 - RNA, 13 nt, Shigella flexneri 2a str. 2457T
cccgaugcaaaaa

SEQ ID NO: 1934202 - RNA, 16 nt, Shigella flexneri 2a str. 2457T
cccgcacggccgcaag

SEQ ID NO: 1934203 - RNA, 21 nt, Shigella flexneri 2a str. 2457T
cccgcacgcuuaauugaaccu

SEQ ID NO: 1934204 - RNA, 20 nt, Shigella flexneri 2a str. 2457T
cccgcaaguccccaguaauc

SEQ ID NO: 1934205 - RNA, 16 nt, Shigella flexneri 2a str. 2457T
cccgcacaaagcacgc

SEQ ID NO: 1934206 - RNA, 23 nt, Shigella flexneri 2a str. 2457T
cccgcacagucacuacgcgaccg

SEQ ID NO: 1934207 - RNA, 21 nt, Shigella flexneri 2a str. 2457T
cccgagcggccaaagggagca

SEQ ID NO: 1934208 - RNA, 19 nt, Shigella flexneri 2a str. 2457T
cccgagauacaucaccgcc

SEQ ID NO: 1934209 - RNA, 16 nt, Shigella flexneri 2a str. 2457T
cccgagcucaauacaa

SEQ ID NO: 1934210 - RNA, 15 nt, Shigella flexneri 2a str. 2457T
cccgauaagggagca

SEQ ID NO: 1934211 - RNA, 14 nt, Shigella flexneri 2a str. 2457T
cccgauacgcuugc

SEQ ID NO: 1934212 - RNA, 14 nt, Shigella flexneri 2a str. 2457T
cccgauaaccgcaa

SEQ ID NO: 1934213 - RNA, 23 nt, Shigella flexneri 2a str. 2457T
cccgaugaccuugucaugcagcu

SEQ ID NO: 1934214 - RNA, 19 nt, Shigella flexneri 2a str. 2457T
ccccugacgcuuaucuucu

SEQ ID NO: 1934215 - RNA, 22 nt, Shigella flexneri 2a str. 2457T
ccccugcgauugugacacgcgc

SEQ ID NO: 1934216 - RNA, 17 nt, Shigella flexneri 2a str. 2457T
ccccgcuucgcccgcca

SEQ ID NO: 1934217 - RNA, 12 nt, Shigella flexneri 2a str. 2457T
ccccgcuccggc

SEQ ID NO: 1934218 - RNA, 22 nt, Shigella flexneri 2a str. 2457T
ccccgcgcucacaccacagcag

SEQ ID NO: 1934219 - RNA, 13 nt, Shigella flexneri 2a str. 2457T
cccgaccaaugca

SEQ ID NO: 1934220 - RNA, 22 nt, Shigella flexneri 2a str. 2457T
ccccuuugaccagccagucagu

SEQ ID NO: 1934221 - RNA, 22 nt, Shigella flexneri 2a str. 2457T
cccgaaaccgacuuacuuauuu

SEQ ID NO: 1934222 - RNA, 18 nt, Shigella flexneri 2a str. 2457T
cccgacaaccugaccuuu

SEQ ID NO: 1934223 - RNA, 17 nt, Shigella flexneri 2a str. 2457T
ccagcggauaaagcaga

SEQ ID NO: 1934224 - RNA, 20 nt, Shigella flexneri 2a str. 2457T
ccagcggauaaagcagagca

SEQ ID NO: 1934225 - RNA, 15 nt, Shigella flexneri 2a str. 2457T
ccagcggaugaccca

SEQ ID NO: 1934226 - RNA, 14 nt, Shigella flexneri 2a str. 2457T
ccagcgcguucugu

SEQ ID NO: 1934227 - RNA, 15 nt, Shigella flexneri 2a str. 2457T
ccagcgucagccaga

SEQ ID NO: 1934228 - RNA, 21 nt, Shigella flexneri 2a str. 2457T
ccagcgggcgucaaaaucauc

SEQ ID NO: 1934229 - RNA, 18 nt, Shigella flexneri 2a str. 2457T
ccagcgucagcauaaaaa

SEQ ID NO: 1934230 - RNA, 17 nt, Shigella flexneri 2a str. 2457T
ccagcgucgcacccggc

SEQ ID NO: 1934231 - RNA, 23 nt, Shigella flexneri 2a str. 2457T
ccagcguuagauccccgcucucc

SEQ ID NO: 1934232 - RNA, 17 nt, Shigella flexneri 2a str. 2457T
ccagcguuaucccaucc

SEQ ID NO: 1934233 - RNA, 18 nt, Shigella flexneri 2a str. 2457T
ccagcguuuccagcacca

SEQ ID NO: 1934234 - RNA, 13 nt, Shigella flexneri 2a str. 2457T
ccagcgccgccag

SEQ ID NO: 1934235 - RNA, 13 nt, Shigella flexneri 2a str. 2457T
ccagcgccgcgcc

SEQ ID NO: 1934236 - RNA, 20 nt, Shigella flexneri 2a str. 2457T
ccagcgccaucucuucggca

SEQ ID NO: 1934237 - RNA, 15 nt, Shigella flexneri 2a str. 2457T
ccagcgccaucucuu

SEQ ID NO: 1934238 - RNA, 17 nt, Shigella flexneri 2a str. 2457T
ccagcgccaguaauucu

SEQ ID NO: 1934239 - RNA, 22 nt, Shigella flexneri 2a str. 2457T
ccagcgcgccuucauucaggcc

SEQ ID NO: 1934240 - RNA, 20 nt, Shigella flexneri 2a str. 2457T
ccagcgcgaugcaggccacc

SEQ ID NO: 1934241 - RNA, 13 nt, Shigella flexneri 2a str. 2457T
ccagcgccuggcu

SEQ ID NO: 1934242 - RNA, 19 nt, Shigella flexneri 2a str. 2457T
ccagcgccuggcugauuaa

SEQ ID NO: 1934243 - RNA, 13 nt, Shigella flexneri 2a str. 2457T
ccagcuggcagaa

SEQ ID NO: 1934244 - RNA, 18 nt, Shigella flexneri 2a str. 2457T
ccagcugcucgcgagaac

SEQ ID NO: 1934245 - RNA, 19 nt, Shigella flexneri 2a str. 2457T
ccagcugccgaaccacuga

SEQ ID NO: 1934246 - RNA, 18 nt, Shigella flexneri 2a str. 2457T
ccaggaauuugguccuga

SEQ ID NO: 1934247 - RNA, 23 nt, Shigella flexneri 2a str. 2457T
ccaggaagggcauaucagcaacu

SEQ ID NO: 1934248 - RNA, 23 nt, Shigella flexneri 2a str. 2457T
ccaggaucuggcuugccagcagg

SEQ ID NO: 1934249 - RNA, 18 nt, Shigella flexneri 2a str. 2457T
ccaggccaaauccuucca

SEQ ID NO: 1934250 - RNA, 17 nt, Shigella flexneri 2a str. 2457T
ccaggcaucguguugau

SEQ ID NO: 1934251 - RNA, 11 nt, Shigella flexneri 2a str. 2457T
ccaggcauccc

SEQ ID NO: 1934252 - RNA, 13 nt, Shigella flexneri 2a str. 2457T
ccaggcaaaccag

SEQ ID NO: 1934253 - RNA, 19 nt, Shigella flexneri 2a str. 2457T
ccaggucagagagccagcc

SEQ ID NO: 1934254 - RNA, 15 nt, Shigella flexneri 2a str. 2457T
ccaggucaccagaca

SEQ ID NO: 1934255 - RNA, 19 nt, Shigella flexneri 2a str. 2457T
ccaggccgcguaccgcagc

SEQ ID NO: 1934256 - RNA, 18 nt, Shigella flexneri 2a str. 2457T
ccaggccggugaugaugc

SEQ ID NO: 1934257 - RNA, 18 nt, Shigella flexneri 2a str. 2457T
ccaggccgguaacgcuuu

SEQ ID NO: 1934258 - RNA, 15 nt, Shigella flexneri 2a str. 2457T
ccaggcguucugccu

SEQ ID NO: 1934259 - RNA, 14 nt, Shigella flexneri 2a str. 2457T
ccaggcucgccgcc

SEQ ID NO: 1934260 - RNA, 15 nt, Shigella flexneri 2a str. 2457T
ccaggcucgccgccg

SEQ ID NO: 1934261 - RNA, 14 nt, Shigella flexneri 2a str. 2457T
ccaguccaucggca

SEQ ID NO: 1934262 - RNA, 13 nt, Shigella flexneri 2a str. 2457T
ccagucccuuuca

SEQ ID NO: 1934263 - RNA, 20 nt, Shigella flexneri 2a str. 2457T
ccaguccgcgcuugccgccg

SEQ ID NO: 1934264 - RNA, 12 nt, Shigella flexneri 2a str. 2457T
ccaguccuccgg

SEQ ID NO: 1934265 - RNA, 15 nt, Shigella flexneri 2a str. 2457T
ccagucguucaacca

SEQ ID NO: 1934266 - RNA, 15 nt, Shigella flexneri 2a str. 2457T
ccagucgucauccca

SEQ ID NO: 1934267 - RNA, 23 nt, Shigella flexneri 2a str. 2457T
ccagugaauuucacuucgccaac

SEQ ID NO: 1934268 - RNA, 17 nt, Shigella flexneri 2a str. 2457T
ccagugaauacugcgcg

SEQ ID NO: 1934269 - RNA, 13 nt, Shigella flexneri 2a str. 2457T
ccagugaauacug

SEQ ID NO: 1934270 - RNA, 23 nt, Shigella flexneri 2a str. 2457T
ccaguauugccaugcacgcaaga

SEQ ID NO: 1934271 - RNA, 15 nt, Shigella flexneri 2a str. 2457T
ccaguaucugacagc

SEQ ID NO: 1934272 - RNA, 21 nt, Shigella flexneri 2a str. 2457T
ccaguaucuuauagaaagcaa

SEQ ID NO: 1934273 - RNA, 20 nt, Shigella flexneri 2a str. 2457T
ccaguauccggaugguaagc

SEQ ID NO: 1934274 - RNA, 12 nt, Shigella flexneri 2a str. 2457T
ccagucagguac

SEQ ID NO: 1934275 - RNA, 12 nt, Shigella flexneri 2a str. 2457T
ccaguccaccca

SEQ ID NO: 1934276 - RNA, 16 nt, Shigella flexneri 2a str. 2457T
ccaguucuacaaucug

SEQ ID NO: 1934277 - RNA, 12 nt, Shigella flexneri 2a str. 2457T
ccaguucgauuu

SEQ ID NO: 1934278 - RNA, 20 nt, Shigella flexneri 2a str. 2457T
ccaguucgauuucccagcga

SEQ ID NO: 1934279 - RNA, 12 nt, Shigella flexneri 2a str. 2457T
ccagugcuccac

SEQ ID NO: 1934280 - RNA, 19 nt, Shigella flexneri 2a str. 2457T
ccagugccguuccagccag

SEQ ID NO: 1934281 - RNA, 21 nt, Shigella flexneri 2a str. 2457T
ccagugccacacgcucuucca

SEQ ID NO: 1934282 - RNA, 22 nt, Shigella flexneri 2a str. 2457T
ccagugccacacgcucuuccag

SEQ ID NO: 1934283 - RNA, 21 nt, Shigella flexneri 2a str. 2457T
ccagugcccgaccacuucaug

SEQ ID NO: 1934284 - RNA, 22 nt, Shigella flexneri 2a str. 2457T
ccagugcccgaccacuucaugc

SEQ ID NO: 1934285 - RNA, 16 nt, Shigella flexneri 2a str. 2457T
ccagugccgcccacca

SEQ ID NO: 1934286 - RNA, 17 nt, Shigella flexneri 2a str. 2457T
ccagugccgcccaccac

SEQ ID NO: 1934287 - RNA, 20 nt, Shigella flexneri 2a str. 2457T
ccagugccaaaccagaugaa

SEQ ID NO: 1934288 - RNA, 21 nt, Shigella flexneri 2a str. 2457T
ccagugagucggggccagcau

SEQ ID NO: 1934289 - RNA, 13 nt, Shigella flexneri 2a str. 2457T
ccagugcagcgcc

SEQ ID NO: 1934290 - RNA, 21 nt, Shigella flexneri 2a str. 2457T
ccagugcaggcaccagccccu

SEQ ID NO: 1934291 - RNA, 13 nt, Shigella flexneri 2a str. 2457T
ccagugauuaacg

SEQ ID NO: 1934292 - RNA, 16 nt, Shigella flexneri 2a str. 2457T
ccaguuguucgcgcac

SEQ ID NO: 1934293 - RNA, 22 nt, Shigella flexneri 2a str. 2457T
ccaguugucgguaauugcgccg

SEQ ID NO: 1934294 - RNA, 18 nt, Shigella flexneri 2a str. 2457T
ccaguuuacugucugcuu

SEQ ID NO: 1934295 - RNA, 14 nt, Shigella flexneri 2a str. 2457T
ccaguugaccugcg

SEQ ID NO: 1934296 - RNA, 19 nt, Shigella flexneri 2a str. 2457T
ccauaacgccugcuccagu

SEQ ID NO: 1934297 - RNA, 12 nt, Shigella flexneri 2a str. 2457T
ccaguuucacag

SEQ ID NO: 1934298 - RNA, 17 nt, Shigella flexneri 2a str. 2457T
ccauaaagggaauaaau

SEQ ID NO: 1934299 - RNA, 22 nt, Shigella flexneri 2a str. 2457T
ccauaaagacguuaacuacaau

SEQ ID NO: 1934300 - RNA, 22 nt, Shigella flexneri 2a str. 2457T
ccaguuucaugauauguuuuaa

SEQ ID NO: 1934301 - RNA, 15 nt, Shigella flexneri 2a str. 2457T
ccaucaucaccagaa

SEQ ID NO: 1934302 - RNA, 17 nt, Shigella flexneri 2a str. 2457T
ccaucagugccaguacg

SEQ ID NO: 1934303 - RNA, 14 nt, Shigella flexneri 2a str. 2457T
ccaucauauuuucc

SEQ ID NO: 1934304 - RNA, 20 nt, Shigella flexneri 2a str. 2457T
ccaucauauuuuccaucauu

SEQ ID NO: 1934305 - RNA, 13 nt, Shigella flexneri 2a str. 2457T
ccaucccuucacc

SEQ ID NO: 1934306 - RNA, 16 nt, Shigella flexneri 2a str. 2457T
ccaucccuaccgcccg

SEQ ID NO: 1934307 - RNA, 17 nt, Shigella flexneri 2a str. 2457T
ccaucccgcucuguaag

SEQ ID NO: 1934308 - RNA, 14 nt, Shigella flexneri 2a str. 2457T
ccauccgcccacac

SEQ ID NO: 1934309 - RNA, 16 nt, Shigella flexneri 2a str. 2457T
ccauccgcccacacca

SEQ ID NO: 1934310 - RNA, 21 nt, Shigella flexneri 2a str. 2457T
ccaucgacgaaauggugugca

SEQ ID NO: 1934311 - RNA, 13 nt, Shigella flexneri 2a str. 2457T
ccaucgcauacug

SEQ ID NO: 1934312 - RNA, 15 nt, Shigella flexneri 2a str. 2457T
ccaucgccagcagcc

SEQ ID NO: 1934313 - RNA, 17 nt, Shigella flexneri 2a str. 2457T
ccaucggcaccaccaaa

SEQ ID NO: 1934314 - RNA, 18 nt, Shigella flexneri 2a str. 2457T
ccaucgccauuuaacgca

SEQ ID NO: 1934315 - RNA, 20 nt, Shigella flexneri 2a str. 2457T
ccaucggcauuaaucugcuc

SEQ ID NO: 1934316 - RNA, 15 nt, Shigella flexneri 2a str. 2457T
ccaucuuuccucacu

SEQ ID NO: 1934317 - RNA, 13 nt, Shigella flexneri 2a str. 2457T
ccaucuucuucac

SEQ ID NO: 1934318 - RNA, 19 nt, Shigella flexneri 2a str. 2457T
ccaucuucuucacuucuuc

SEQ ID NO: 1934319 - RNA, 18 nt, Shigella flexneri 2a str. 2457T
ccaucuucuugcagcuua

SEQ ID NO: 1934320 - RNA, 21 nt, Shigella flexneri 2a str. 2457T
ccaucuucuugcagcuuaauc

SEQ ID NO: 1934321 - RNA, 18 nt, Shigella flexneri 2a str. 2457T
ccaucguacaggcacaug

SEQ ID NO: 1934322 - RNA, 15 nt, Shigella flexneri 2a str. 2457T
ccaucagcagcaaca

SEQ ID NO: 1934323 - RNA, 18 nt, Shigella flexneri 2a str. 2457T
ccaucagcgccugaugga

SEQ ID NO: 1934324 - RNA, 19 nt, Shigella flexneri 2a str. 2457T
ccaucaggcagucugcgcc

SEQ ID NO: 1934325 - RNA, 23 nt, Shigella flexneri 2a str. 2457T
ccaucaggcagauacaaccaauc

SEQ ID NO: 1934326 - RNA, 18 nt, Shigella flexneri 2a str. 2457T
ccaucaauugcucacucc

SEQ ID NO: 1934327 - RNA, 20 nt, Shigella flexneri 2a str. 2457T
ccaucaaucacuuugcgcuc

SEQ ID NO: 1934328 - RNA, 13 nt, Shigella flexneri 2a str. 2457T
ccaucaaugccgc

SEQ ID NO: 1934329 - RNA, 13 nt, Shigella flexneri 2a str. 2457T
ccaucaauugcuc

SEQ ID NO: 1934330 - RNA, 23 nt, Shigella flexneri 2a str. 2457T
ccaucaaguagcagguaaucugc

SEQ ID NO: 1934331 - RNA, 19 nt, Shigella flexneri 2a str. 2457T
ccaucacuuucaaaagccc

SEQ ID NO: 1934332 - RNA, 12 nt, Shigella flexneri 2a str. 2457T
ccaucacuucau

SEQ ID NO: 1934333 - RNA, 22 nt, Shigella flexneri 2a str. 2457T
ccaucacaauggcacaaauggc

SEQ ID NO: 1934334 - RNA, 13 nt, Shigella flexneri 2a str. 2457T
ccauaucaagcau

SEQ ID NO: 1934335 - RNA, 14 nt, Shigella flexneri 2a str. 2457T
ccauaccaugcacc

SEQ ID NO: 1934336 - RNA, 19 nt, Shigella flexneri 2a str. 2457T
ccauacaucuucaucaucc

SEQ ID NO: 1934337 - RNA, 19 nt, Shigella flexneri 2a str. 2457T
ccauacaguguccaaccaa

SEQ ID NO: 1934338 - RNA, 20 nt, Shigella flexneri 2a str. 2457T
ccauaucuaugguuuuuucu

SEQ ID NO: 1934339 - RNA, 14 nt, Shigella flexneri 2a str. 2457T
ccauaugaauauau

SEQ ID NO: 1934340 - RNA, 19 nt, Shigella flexneri 2a str. 2457T
ccauaucgccauugccggu

SEQ ID NO: 1934341 - RNA, 18 nt, Shigella flexneri 2a str. 2457T
ccauauggcccaucaucu

SEQ ID NO: 1934342 - RNA, 18 nt, Shigella flexneri 2a str. 2457T
ccauauguugaaaagcca

SEQ ID NO: 1934343 - RNA, 22 nt, Shigella flexneri 2a str. 2457T
ccaucaaguagcagguaaucug

SEQ ID NO: 1934344 - RNA, 14 nt, Shigella flexneri 2a str. 2457T
ccaucaacuucucg

SEQ ID NO: 1934345 - RNA, 18 nt, Shigella flexneri 2a str. 2457T
ccagaugucccaucugau

SEQ ID NO: 1934346 - RNA, 18 nt, Shigella flexneri 2a str. 2457T
ccagauguugucucagau

SEQ ID NO: 1934347 - RNA, 19 nt, Shigella flexneri 2a str. 2457T
ccagauguugucucagauu

SEQ ID NO: 1934348 - RNA, 17 nt, Shigella flexneri 2a str. 2457T
ccagauggcuuuccacc

SEQ ID NO: 1934349 - RNA, 18 nt, Shigella flexneri 2a str. 2457T
ccagauggcuuugcccuu

SEQ ID NO: 1934350 - RNA, 18 nt, Shigella flexneri 2a str. 2457T
ccagauggacaaaagccc

SEQ ID NO: 1934351 - RNA, 15 nt, Shigella flexneri 2a str. 2457T
ccagaucagcuucac

SEQ ID NO: 1934352 - RNA, 20 nt, Shigella flexneri 2a str. 2457T
ccagauugccgauauaaacc

SEQ ID NO: 1934353 - RNA, 17 nt, Shigella flexneri 2a str. 2457T
ccagcaaaaucaccauc

SEQ ID NO: 1934354 - RNA, 18 nt, Shigella flexneri 2a str. 2457T
ccagauuuuucaguauuu

SEQ ID NO: 1934355 - RNA, 22 nt, Shigella flexneri 2a str. 2457T
ccagauugugugauacuucuuc

SEQ ID NO: 1934356 - RNA, 17 nt, Shigella flexneri 2a str. 2457T
ccagauuuaacggcagc

SEQ ID NO: 1934357 - RNA, 19 nt, Shigella flexneri 2a str. 2457T
ccagaauaccuugcugcuc

SEQ ID NO: 1934358 - RNA, 15 nt, Shigella flexneri 2a str. 2457T
ccagaauaaacaacu

SEQ ID NO: 1934359 - RNA, 17 nt, Shigella flexneri 2a str. 2457T
ccagauaaauauuauug

SEQ ID NO: 1934360 - RNA, 18 nt, Shigella flexneri 2a str. 2457T
ccagauaaucaccugccu

SEQ ID NO: 1934361 - RNA, 14 nt, Shigella flexneri 2a str. 2457T
ccagauaagacacu

SEQ ID NO: 1934362 - RNA, 15 nt, Shigella flexneri 2a str. 2457T
ccagauaagacacua

SEQ ID NO: 1934363 - RNA, 13 nt, Shigella flexneri 2a str. 2457T
ccagauagccagg

SEQ ID NO: 1934364 - RNA, 18 nt, Shigella flexneri 2a str. 2457T
ccagauaaugagaaacac

SEQ ID NO: 1934365 - RNA, 20 nt, Shigella flexneri 2a str. 2457T
ccagauauuuuucaauccgc

SEQ ID NO: 1934366 - RNA, 14 nt, Shigella flexneri 2a str. 2457T
ccagaucacgcagc

SEQ ID NO: 1934367 - RNA, 18 nt, Shigella flexneri 2a str. 2457T
ccagaucacgcagcaagc

SEQ ID NO: 1934368 - RNA, 14 nt, Shigella flexneri 2a str. 2457T
ccagcaaauccagc

SEQ ID NO: 1934369 - RNA, 13 nt, Shigella flexneri 2a str. 2457T
ccagcaacaacag

SEQ ID NO: 1934370 - RNA, 17 nt, Shigella flexneri 2a str. 2457T
ccagcaccacuuccggc

SEQ ID NO: 1934371 - RNA, 16 nt, Shigella flexneri 2a str. 2457T
ccagcagauggcagug

SEQ ID NO: 1934372 - RNA, 14 nt, Shigella flexneri 2a str. 2457T
ccagcagcggcaga

SEQ ID NO: 1934373 - RNA, 17 nt, Shigella flexneri 2a str. 2457T
ccagcaggccgucgcgc

SEQ ID NO: 1934374 - RNA, 21 nt, Shigella flexneri 2a str. 2457T
ccagcagcugcucccagcgca

SEQ ID NO: 1934375 - RNA, 18 nt, Shigella flexneri 2a str. 2457T
ccagcagcugcguggcgc

SEQ ID NO: 1934376 - RNA, 14 nt, Shigella flexneri 2a str. 2457T
ccagcagcugcucc

SEQ ID NO: 1934377 - RNA, 22 nt, Shigella flexneri 2a str. 2457T
ccagcgauuacuguacagaucc

SEQ ID NO: 1934378 - RNA, 13 nt, Shigella flexneri 2a str. 2457T
ccagcgcauggcg

SEQ ID NO: 1934379 - RNA, 15 nt, Shigella flexneri 2a str. 2457T
ccagcgcagacacca

SEQ ID NO: 1934380 - RNA, 14 nt, Shigella flexneri 2a str. 2457T
ccagcgagagagcg

SEQ ID NO: 1934381 - RNA, 20 nt, Shigella flexneri 2a str. 2457T
ccagccuguuccagacgcug

SEQ ID NO: 1934382 - RNA, 22 nt, Shigella flexneri 2a str. 2457T
ccagccugaacgagaaaagcca

SEQ ID NO: 1934383 - RNA, 16 nt, Shigella flexneri 2a str. 2457T
ccagccugcaaacgcu

SEQ ID NO: 1934384 - RNA, 16 nt, Shigella flexneri 2a str. 2457T
ccagccuacaggaaac

SEQ ID NO: 1934385 - RNA, 15 nt, Shigella flexneri 2a str. 2457T
ccagccgugaauggu

SEQ ID NO: 1934386 - RNA, 23 nt, Shigella flexneri 2a str. 2457T
ccagcagguuuaaccaucaggca

SEQ ID NO: 1934387 - RNA, 18 nt, Shigella flexneri 2a str. 2457T
ccagcagugacucacgaa

SEQ ID NO: 1934388 - RNA, 20 nt, Shigella flexneri 2a str. 2457T
ccagcauaaccuugcaauag

SEQ ID NO: 1934389 - RNA, 16 nt, Shigella flexneri 2a str. 2457T
ccagcaguucuacugg

SEQ ID NO: 1934390 - RNA, 17 nt, Shigella flexneri 2a str. 2457T
ccagcaguuccagcaua

SEQ ID NO: 1934391 - RNA, 15 nt, Shigella flexneri 2a str. 2457T
ccagcauaccuucca

SEQ ID NO: 1934392 - RNA, 17 nt, Shigella flexneri 2a str. 2457T
ccagcauaaucaccauc

SEQ ID NO: 1934393 - RNA, 13 nt, Shigella flexneri 2a str. 2457T
ccagcauaaucac

SEQ ID NO: 1934394 - RNA, 21 nt, Shigella flexneri 2a str. 2457T
ccagccauuaaccagccacug

SEQ ID NO: 1934395 - RNA, 18 nt, Shigella flexneri 2a str. 2457T
ccagccauuaaccagcca

SEQ ID NO: 1934396 - RNA, 23 nt, Shigella flexneri 2a str. 2457T
ccagcauaguacgggcaauuuca

SEQ ID NO: 1934397 - RNA, 19 nt, Shigella flexneri 2a str. 2457T
ccagcccaugaaucagcaa

SEQ ID NO: 1934398 - RNA, 16 nt, Shigella flexneri 2a str. 2457T
ccagccgcgucugaau

SEQ ID NO: 1934399 - RNA, 11 nt, Shigella flexneri 2a str. 2457T
ccagccgagcc

SEQ ID NO: 1934400 - RNA, 16 nt, Shigella flexneri 2a str. 2457T
ccagccccagaauuca

SEQ ID NO: 1934401 - RNA, 18 nt, Shigella flexneri 2a str. 2457T
ccaccggcaaucugcugg

SEQ ID NO: 1934402 - RNA, 12 nt, Shigella flexneri 2a str. 2457T
ccaccgcccguu

SEQ ID NO: 1934403 - RNA, 20 nt, Shigella flexneri 2a str. 2457T
ccaccgaugcacagcacgcu

SEQ ID NO: 1934404 - RNA, 17 nt, Shigella flexneri 2a str. 2457T
ccacccgcagcaagcgu

SEQ ID NO: 1934405 - RNA, 14 nt, Shigella flexneri 2a str. 2457T
ccaccgcagcccag

SEQ ID NO: 1934406 - RNA, 21 nt, Shigella flexneri 2a str. 2457T
ccaccgcaauaaccaucagcu

SEQ ID NO: 1934407 - RNA, 15 nt, Shigella flexneri 2a str. 2457T
ccaccgcaaaguggg

SEQ ID NO: 1934408 - RNA, 14 nt, Shigella flexneri 2a str. 2457T
ccaccgcaaucgcc

SEQ ID NO: 1934409 - RNA, 17 nt, Shigella flexneri 2a str. 2457T
ccaccgcaaucgccagu

SEQ ID NO: 1934410 - RNA, 22 nt, Shigella flexneri 2a str. 2457T
cauuuuuuugcauuacugcuau

SEQ ID NO: 1934411 - RNA, 18 nt, Shigella flexneri 2a str. 2457T
cauuuuuuugucugcuau

SEQ ID NO: 1934412 - RNA, 13 nt, Shigella flexneri 2a str. 2457T
ccacccgcagcca

SEQ ID NO: 1934413 - RNA, 14 nt, Shigella flexneri 2a str. 2457T
ccacccgcagccau

SEQ ID NO: 1934414 - RNA, 15 nt, Shigella flexneri 2a str. 2457T
ccacccgcagcaagc

SEQ ID NO: 1934415 - RNA, 17 nt, Shigella flexneri 2a str. 2457T
ccacgacaccuuucacg

SEQ ID NO: 1934416 - RNA, 16 nt, Shigella flexneri 2a str. 2457T
ccacgacguguuccug

SEQ ID NO: 1934417 - RNA, 16 nt, Shigella flexneri 2a str. 2457T
ccaccgguuuauuauu

SEQ ID NO: 1934418 - RNA, 16 nt, Shigella flexneri 2a str. 2457T
ccaccgguacaaacau

SEQ ID NO: 1934419 - RNA, 20 nt, Shigella flexneri 2a str. 2457T
ccaccugcgaacuguaauga

SEQ ID NO: 1934420 - RNA, 18 nt, Shigella flexneri 2a str. 2457T
ccacgccaauguguuuau

SEQ ID NO: 1934421 - RNA, 22 nt, Shigella flexneri 2a str. 2457T
ccacgccgaaccaugucaucaa

SEQ ID NO: 1934422 - RNA, 16 nt, Shigella flexneri 2a str. 2457T
ccacgccacaauacug

SEQ ID NO: 1934423 - RNA, 18 nt, Shigella flexneri 2a str. 2457T
ccacgcacagaacaaaau

SEQ ID NO: 1934424 - RNA, 15 nt, Shigella flexneri 2a str. 2457T
ccacugcgccaucaa

SEQ ID NO: 1934425 - RNA, 21 nt, Shigella flexneri 2a str. 2457T
ccacuucacggcugcuaauau

SEQ ID NO: 1934426 - RNA, 15 nt, Shigella flexneri 2a str. 2457T
ccacugucaaaucca

SEQ ID NO: 1934427 - RNA, 20 nt, Shigella flexneri 2a str. 2457T
ccacuggcgcgaauagcuuc

SEQ ID NO: 1934428 - RNA, 21 nt, Shigella flexneri 2a str. 2457T
ccagaacacgcucccagcaga

SEQ ID NO: 1934429 - RNA, 13 nt, Shigella flexneri 2a str. 2457T
ccagaagggcgag

SEQ ID NO: 1934430 - RNA, 15 nt, Shigella flexneri 2a str. 2457T
ccagaaaguuuuuca

SEQ ID NO: 1934431 - RNA, 20 nt, Shigella flexneri 2a str. 2457T
ccagaaauggcccaaaaggc

SEQ ID NO: 1934432 - RNA, 20 nt, Shigella flexneri 2a str. 2457T
ccagaaaucggccuuccaua

SEQ ID NO: 1934433 - RNA, 20 nt, Shigella flexneri 2a str. 2457T
ccagaacacgcucccagcag

SEQ ID NO: 1934434 - RNA, 15 nt, Shigella flexneri 2a str. 2457T
ccacuugcagcucau

SEQ ID NO: 1934435 - RNA, 20 nt, Shigella flexneri 2a str. 2457T
ccacuucuuccagcggcagg

SEQ ID NO: 1934436 - RNA, 13 nt, Shigella flexneri 2a str. 2457T
ccacuucaugccc

SEQ ID NO: 1934437 - RNA, 20 nt, Shigella flexneri 2a str. 2457T
ccacuuccggcaacaaugcc

SEQ ID NO: 1934438 - RNA, 14 nt, Shigella flexneri 2a str. 2457T
ccacuuccccucau

SEQ ID NO: 1934439 - RNA, 16 nt, Shigella flexneri 2a str. 2457T
ccacuuccugcucggu

SEQ ID NO: 1934440 - RNA, 12 nt, Shigella flexneri 2a str. 2457T
ccacgcucagca

SEQ ID NO: 1934441 - RNA, 13 nt, Shigella flexneri 2a str. 2457T
ccacuacccauau

SEQ ID NO: 1934442 - RNA, 15 nt, Shigella flexneri 2a str. 2457T
ccacuacucugaccc

SEQ ID NO: 1934443 - RNA, 14 nt, Shigella flexneri 2a str. 2457T
ccacgucacucuuu

SEQ ID NO: 1934444 - RNA, 22 nt, Shigella flexneri 2a str. 2457T
ccacugacgggaaacucugcug

SEQ ID NO: 1934445 - RNA, 22 nt, Shigella flexneri 2a str. 2457T
ccacugaauagugccacaccag

SEQ ID NO: 1934446 - RNA, 23 nt, Shigella flexneri 2a str. 2457T
ccacucggcacaucgacggugac

SEQ ID NO: 1934447 - RNA, 15 nt, Shigella flexneri 2a str. 2457T
ccacucuuucagcac

SEQ ID NO: 1934448 - RNA, 23 nt, Shigella flexneri 2a str. 2457T
ccuggcugauugauauccagauc

SEQ ID NO: 1934449 - RNA, 13 nt, Shigella flexneri 2a str. 2457T
ccuggcugcccau

SEQ ID NO: 1934450 - RNA, 14 nt, Shigella flexneri 2a str. 2457T
ccuggcugcagaau

SEQ ID NO: 1934451 - RNA, 13 nt, Shigella flexneri 2a str. 2457T
ccugggcaauggu

SEQ ID NO: 1934452 - RNA, 23 nt, Shigella flexneri 2a str. 2457T
ccugggcaccgacguucagcgca

SEQ ID NO: 1934453 - RNA, 13 nt, Shigella flexneri 2a str. 2457T
ccuggucgcugau

SEQ ID NO: 1934454 - RNA, 13 nt, Shigella flexneri 2a str. 2457T
ccugguucucacu

SEQ ID NO: 1934455 - RNA, 17 nt, Shigella flexneri 2a str. 2457T
ccuggcgcagcugcgcu

SEQ ID NO: 1934456 - RNA, 14 nt, Shigella flexneri 2a str. 2457T
ccuggcgcuggcgu

SEQ ID NO: 1934457 - RNA, 16 nt, Shigella flexneri 2a str. 2457T
ccuggcccaucgccag

SEQ ID NO: 1934458 - RNA, 22 nt, Shigella flexneri 2a str. 2457T
ccuggacagcucguuaaucaga

SEQ ID NO: 1934459 - RNA, 19 nt, Shigella flexneri 2a str. 2457T
ccugccagcgccgacagca

SEQ ID NO: 1934460 - RNA, 18 nt, Shigella flexneri 2a str. 2457T
ccugccaucuggcaggcu

SEQ ID NO: 1934461 - RNA, 19 nt, Shigella flexneri 2a str. 2457T
ccugccaucuggcaggcuu

SEQ ID NO: 1934462 - RNA, 15 nt, Shigella flexneri 2a str. 2457T
ccugcccacuccagc

SEQ ID NO: 1934463 - RNA, 20 nt, Shigella flexneri 2a str. 2457T
ccugccagagcugaauauca

SEQ ID NO: 1934464 - RNA, 17 nt, Shigella flexneri 2a str. 2457T
ccugccagcgccgacag

SEQ ID NO: 1934465 - RNA, 12 nt, Shigella flexneri 2a str. 2457T
ccugccagcuug

SEQ ID NO: 1934466 - RNA, 13 nt, Shigella flexneri 2a str. 2457T
ccugcuggguaaa

SEQ ID NO: 1934467 - RNA, 20 nt, Shigella flexneri 2a str. 2457T
ccugcuggaaaggccgcgaa

SEQ ID NO: 1934468 - RNA, 22 nt, Shigella flexneri 2a str. 2457T
ccugcuuugacaaagcucauug

SEQ ID NO: 1934469 - RNA, 22 nt, Shigella flexneri 2a str. 2457T
ccuggaaaaagugccccagcuu

SEQ ID NO: 1934470 - RNA, 15 nt, Shigella flexneri 2a str. 2457T
ccuggaaccaggcgc

SEQ ID NO: 1934471 - RNA, 20 nt, Shigella flexneri 2a str. 2457T
ccuuauccggcuuaccgcuc

SEQ ID NO: 1934472 - RNA, 19 nt, Shigella flexneri 2a str. 2457T
ccuuauccgacauuucugc

SEQ ID NO: 1934473 - RNA, 17 nt, Shigella flexneri 2a str. 2457T
ccuuauugucuuuaaau

SEQ ID NO: 1934474 - RNA, 23 nt, Shigella flexneri 2a str. 2457T
ccuuacccgcgacgcgcuuuuac

SEQ ID NO: 1934475 - RNA, 21 nt, Shigella flexneri 2a str. 2457T
ccuuacgcguucauacuuuuc

SEQ ID NO: 1934476 - RNA, 17 nt, Shigella flexneri 2a str. 2457T
ccuuagcuaauuuuugu

SEQ ID NO: 1934477 - RNA, 23 nt, Shigella flexneri 2a str. 2457T
ccuuaguaacgccagcggucaua

SEQ ID NO: 1934478 - RNA, 12 nt, Shigella flexneri 2a str. 2457T
ccuuacugcccc

SEQ ID NO: 1934479 - RNA, 19 nt, Shigella flexneri 2a str. 2457T
ccuuacuuacacaucaaga

SEQ ID NO: 1934480 - RNA, 23 nt, Shigella flexneri 2a str. 2457T
ccuuagcaaaauagcuguuuauu

SEQ ID NO: 1934481 - RNA, 16 nt, Shigella flexneri 2a str. 2457T
ccuucacuuuugccag

SEQ ID NO: 1934482 - RNA, 13 nt, Shigella flexneri 2a str. 2457T
ccuucacuuuugc

SEQ ID NO: 1934483 - RNA, 16 nt, Shigella flexneri 2a str. 2457T
ccuucacgcgcuccag

SEQ ID NO: 1934484 - RNA, 13 nt, Shigella flexneri 2a str. 2457T
ccuucacccauug

SEQ ID NO: 1934485 - RNA, 13 nt, Shigella flexneri 2a str. 2457T
ccuucaauaucau

SEQ ID NO: 1934486 - RNA, 16 nt, Shigella flexneri 2a str. 2457T
ccuguugaaauuauug

SEQ ID NO: 1934487 - RNA, 18 nt, Shigella flexneri 2a str. 2457T
ccuguugcgucgccgccu

SEQ ID NO: 1934488 - RNA, 24 nt, Shigella flexneri 2a str. 2457T
ccuguugcgucgccgccuguucca

SEQ ID NO: 1934489 - RNA, 15 nt, Shigella flexneri 2a str. 2457T
ccuguugcccuuugc

SEQ ID NO: 1934490 - RNA, 19 nt, Shigella flexneri 2a str. 2457T
ccuguugucuuuccagacu

SEQ ID NO: 1934491 - RNA, 18 nt, Shigella flexneri 2a str. 2457T
ccuguuucggacuucugu

SEQ ID NO: 1934492 - RNA, 19 nt, Shigella flexneri 2a str. 2457T
ccuuaacuucaucagcaaa

SEQ ID NO: 1934493 - RNA, 15 nt, Shigella flexneri 2a str. 2457T
ccuuaaucagaauuu

SEQ ID NO: 1934494 - RNA, 13 nt, Shigella flexneri 2a str. 2457T
ccuuaaacaccug

SEQ ID NO: 1934495 - RNA, 17 nt, Shigella flexneri 2a str. 2457T
ccuuaaaagugaggugu

SEQ ID NO: 1934496 - RNA, 14 nt, Shigella flexneri 2a str. 2457T
ccugugccagccau

SEQ ID NO: 1934497 - RNA, 19 nt, Shigella flexneri 2a str. 2457T
ccugugcaaccuuuuccau

SEQ ID NO: 1934498 - RNA, 17 nt, Shigella flexneri 2a str. 2457T
ccuguuccagacgcugc

SEQ ID NO: 1934499 - RNA, 14 nt, Shigella flexneri 2a str. 2457T
ccuguucgccgccg

SEQ ID NO: 1934500 - RNA, 22 nt, Shigella flexneri 2a str. 2457T
ccuguaaaacgcgcccucagcc

SEQ ID NO: 1934501 - RNA, 22 nt, Shigella flexneri 2a str. 2457T
ccuguaaaaaaguaaugccugc

SEQ ID NO: 1934502 - RNA, 15 nt, Shigella flexneri 2a str. 2457T
ccugucucucagcac

SEQ ID NO: 1934503 - RNA, 15 nt, Shigella flexneri 2a str. 2457T
ccugucuucccugcu

SEQ ID NO: 1934504 - RNA, 22 nt, Shigella flexneri 2a str. 2457T
ccucgagaaauuuuuauuauuu

SEQ ID NO: 1934505 - RNA, 16 nt, Shigella flexneri 2a str. 2457T
ccucgaguccuuccag

SEQ ID NO: 1934506 - RNA, 16 nt, Shigella flexneri 2a str. 2457T
ccucagcgaacaggac

SEQ ID NO: 1934507 - RNA, 13 nt, Shigella flexneri 2a str. 2457T
ccucaggcaccuu

SEQ ID NO: 1934508 - RNA, 15 nt, Shigella flexneri 2a str. 2457T
ccucgccgcuucccu

SEQ ID NO: 1934509 - RNA, 14 nt, Shigella flexneri 2a str. 2457T
ccucgcauuuuugu

SEQ ID NO: 1934510 - RNA, 14 nt, Shigella flexneri 2a str. 2457T
ccucgccccuccgg

SEQ ID NO: 1934511 - RNA, 14 nt, Shigella flexneri 2a str. 2457T
ccucuaacagauca

SEQ ID NO: 1934512 - RNA, 13 nt, Shigella flexneri 2a str. 2457T
ccucuucauuaaa

SEQ ID NO: 1934513 - RNA, 14 nt, Shigella flexneri 2a str. 2457T
ccucuucagcgucc

SEQ ID NO: 1934514 - RNA, 16 nt, Shigella flexneri 2a str. 2457T
ccucuucacguuuuuc

SEQ ID NO: 1934515 - RNA, 20 nt, Shigella flexneri 2a str. 2457T
ccucuucagccgcaaaccug

SEQ ID NO: 1934516 - RNA, 14 nt, Shigella flexneri 2a str. 2457T
ccucugcucccggc

SEQ ID NO: 1934517 - RNA, 15 nt, Shigella flexneri 2a str. 2457T
ccucugcgcccagca

SEQ ID NO: 1934518 - RNA, 18 nt, Shigella flexneri 2a str. 2457T
ccucgucccaaaagcucg

SEQ ID NO: 1934519 - RNA, 19 nt, Shigella flexneri 2a str. 2457T
ccucguaaugcuccggcuc

SEQ ID NO: 1934520 - RNA, 12 nt, Shigella flexneri 2a str. 2457T
ccugccacauau

SEQ ID NO: 1934521 - RNA, 19 nt, Shigella flexneri 2a str. 2457T
ccugauuaacgacacucuc

SEQ ID NO: 1934522 - RNA, 14 nt, Shigella flexneri 2a str. 2457T
ccugauugaccgcc

SEQ ID NO: 1934523 - RNA, 16 nt, Shigella flexneri 2a str. 2457T
ccugcaaaauagucau

SEQ ID NO: 1934524 - RNA, 14 nt, Shigella flexneri 2a str. 2457T
ccugcaaauaaaua

SEQ ID NO: 1934525 - RNA, 12 nt, Shigella flexneri 2a str. 2457T
ccugaucaagca

SEQ ID NO: 1934526 - RNA, 16 nt, Shigella flexneri 2a str. 2457T
ccugaucaagcacaug

SEQ ID NO: 1934527 - RNA, 19 nt, Shigella flexneri 2a str. 2457T
ccugauccagcucuucuuc

SEQ ID NO: 1934528 - RNA, 22 nt, Shigella flexneri 2a str. 2457T
ccugauccagcucuucuucacu

SEQ ID NO: 1934529 - RNA, 13 nt, Shigella flexneri 2a str. 2457T
ccugauccauacu

SEQ ID NO: 1934530 - RNA, 15 nt, Shigella flexneri 2a str. 2457T
ccugauccugcaaca

SEQ ID NO: 1934531 - RNA, 21 nt, Shigella flexneri 2a str. 2457T
ccugaugacaugcaaugauuc

SEQ ID NO: 1934532 - RNA, 19 nt, Shigella flexneri 2a str. 2457T
ccugaucgccauauuucuc

SEQ ID NO: 1934533 - RNA, 21 nt, Shigella flexneri 2a str. 2457T
ccugaucggcgagauaaugcg

SEQ ID NO: 1934534 - RNA, 15 nt, Shigella flexneri 2a str. 2457T
ccugaugagaugcug

SEQ ID NO: 1934535 - RNA, 18 nt, Shigella flexneri 2a str. 2457T
ccugaugcgauauguuua

SEQ ID NO: 1934536 - RNA, 19 nt, Shigella flexneri 2a str. 2457T
ccugaugcgacgcuugacg

SEQ ID NO: 1934537 - RNA, 14 nt, Shigella flexneri 2a str. 2457T
ccugauggcgcgcc

SEQ ID NO: 1934538 - RNA, 16 nt, Shigella flexneri 2a str. 2457T
ccugaugugacgcuug

SEQ ID NO: 1934539 - RNA, 22 nt, Shigella flexneri 2a str. 2457T
ccugaguuaagcaaaaaaacau

SEQ ID NO: 1934540 - RNA, 19 nt, Shigella flexneri 2a str. 2457T
ccugaguuaccgcuauuug

SEQ ID NO: 1934541 - RNA, 21 nt, Shigella flexneri 2a str. 2457T
ccugauacgcgccaaucggca

SEQ ID NO: 1934542 - RNA, 19 nt, Shigella flexneri 2a str. 2457T
ccugauagcccgcacaaag

SEQ ID NO: 1934543 - RNA, 17 nt, Shigella flexneri 2a str. 2457T
ccugacuuugccccagc

SEQ ID NO: 1934544 - RNA, 22 nt, Shigella flexneri 2a str. 2457T
ccugagaauuccggcagagaaa

SEQ ID NO: 1934545 - RNA, 17 nt, Shigella flexneri 2a str. 2457T
ccugagacagacagccu

SEQ ID NO: 1934546 - RNA, 16 nt, Shigella flexneri 2a str. 2457T
ccugagcagccaccac

SEQ ID NO: 1934547 - RNA, 15 nt, Shigella flexneri 2a str. 2457T
ccugagccggaguug

SEQ ID NO: 1934548 - RNA, 22 nt, Shigella flexneri 2a str. 2457T
ccugagcgguuaacacggcagc

SEQ ID NO: 1934549 - RNA, 12 nt, Shigella flexneri 2a str. 2457T
ccugacaacaaa

SEQ ID NO: 1934550 - RNA, 20 nt, Shigella flexneri 2a str. 2457T
ccugacagcacgccccggcu

SEQ ID NO: 1934551 - RNA, 21 nt, Shigella flexneri 2a str. 2457T
ccugacaagguacgaaaaaaa

SEQ ID NO: 1934552 - RNA, 14 nt, Shigella flexneri 2a str. 2457T
ccugacccagcacc

SEQ ID NO: 1934553 - RNA, 16 nt, Shigella flexneri 2a str. 2457T
ccugacccagcaccag

SEQ ID NO: 1934554 - RNA, 20 nt, Shigella flexneri 2a str. 2457T
ccucuuccauuucaucgcca

SEQ ID NO: 1934555 - RNA, 19 nt, Shigella flexneri 2a str. 2457T
ccucuuccauuucaucgcc

SEQ ID NO: 1934556 - RNA, 20 nt, Shigella flexneri 2a str. 2457T
ccugaauuugcuccagaaac

SEQ ID NO: 1934557 - RNA, 16 nt, Shigella flexneri 2a str. 2457T
ccugaauuugcuccag

SEQ ID NO: 1934558 - RNA, 16 nt, Shigella flexneri 2a str. 2457T
ccugacgguuuaccug

SEQ ID NO: 1934559 - RNA, 12 nt, Shigella flexneri 2a str. 2457T
ccugacugguua

SEQ ID NO: 1934560 - RNA, 17 nt, Shigella flexneri 2a str. 2457T
ccugaccugcgaccagu

SEQ ID NO: 1934561 - RNA, 16 nt, Shigella flexneri 2a str. 2457T
ccugaccuuuuuucag

SEQ ID NO: 1934562 - RNA, 16 nt, Shigella flexneri 2a str. 2457T
ccgucccucgccccuu

SEQ ID NO: 1934563 - RNA, 15 nt, Shigella flexneri 2a str. 2457T
ccguccggcaucgca

SEQ ID NO: 1934564 - RNA, 20 nt, Shigella flexneri 2a str. 2457T
ccguccaggcggucaccgaa

SEQ ID NO: 1934565 - RNA, 17 nt, Shigella flexneri 2a str. 2457T
ccgucaucacgcaggcu

SEQ ID NO: 1934566 - RNA, 15 nt, Shigella flexneri 2a str. 2457T
ccgucaugccgguaa

SEQ ID NO: 1934567 - RNA, 19 nt, Shigella flexneri 2a str. 2457T
ccgucacaggcacaccgcc

SEQ ID NO: 1934568 - RNA, 17 nt, Shigella flexneri 2a str. 2457T
ccgucaccggcacaaag

SEQ ID NO: 1934569 - RNA, 19 nt, Shigella flexneri 2a str. 2457T
ccgucaccggcacaaagcu

SEQ ID NO: 1934570 - RNA, 21 nt, Shigella flexneri 2a str. 2457T
ccgucacaggcacaccgccgc

SEQ ID NO: 1934571 - RNA, 19 nt, Shigella flexneri 2a str. 2457T
ccguacaggcagcuuagaa

SEQ ID NO: 1934572 - RNA, 23 nt, Shigella flexneri 2a str. 2457T
ccguaauuuuuacuccacuuccu

SEQ ID NO: 1934573 - RNA, 19 nt, Shigella flexneri 2a str. 2457T
ccguacaaagugccgccag

SEQ ID NO: 1934574 - RNA, 13 nt, Shigella flexneri 2a str. 2457T
ccguacccagcaa

SEQ ID NO: 1934575 - RNA, 22 nt, Shigella flexneri 2a str. 2457T
ccguaccaucguaagcgccagg

SEQ ID NO: 1934576 - RNA, 15 nt, Shigella flexneri 2a str. 2457T
ccguaugaccggaaa

SEQ ID NO: 1934577 - RNA, 19 nt, Shigella flexneri 2a str. 2457T
ccguaugcgguacugacca

SEQ ID NO: 1934578 - RNA, 17 nt, Shigella flexneri 2a str. 2457T
ccgguuacgccaccagc

SEQ ID NO: 1934579 - RNA, 20 nt, Shigella flexneri 2a str. 2457T
ccgguuaaaucgacguucug

SEQ ID NO: 1934580 - RNA, 16 nt, Shigella flexneri 2a str. 2457T
ccgguucggccauauc

SEQ ID NO: 1934581 - RNA, 21 nt, Shigella flexneri 2a str. 2457T
ccgguucggccauauccagcc

SEQ ID NO: 1934582 - RNA, 23 nt, Shigella flexneri 2a str. 2457T
ccgguucgggaaauugcagagcu

SEQ ID NO: 1934583 - RNA, 18 nt, Shigella flexneri 2a str. 2457T
ccgguucgucauacucca

SEQ ID NO: 1934584 - RNA, 15 nt, Shigella flexneri 2a str. 2457T
ccgguuccugcaucg

SEQ ID NO: 1934585 - RNA, 19 nt, Shigella flexneri 2a str. 2457T
ccguaauagauccuuuuuc

SEQ ID NO: 1934586 - RNA, 16 nt, Shigella flexneri 2a str. 2457T
ccguaauuuuuacucc

SEQ ID NO: 1934587 - RNA, 23 nt, Shigella flexneri 2a str. 2457T
ccgguugucaggaagccccagcu

SEQ ID NO: 1934588 - RNA, 22 nt, Shigella flexneri 2a str. 2457T
ccgguuucgugaaacucagcau

SEQ ID NO: 1934589 - RNA, 15 nt, Shigella flexneri 2a str. 2457T
ccgguuucaaaacug

SEQ ID NO: 1934590 - RNA, 14 nt, Shigella flexneri 2a str. 2457T
ccgguggaagggcu

SEQ ID NO: 1934591 - RNA, 13 nt, Shigella flexneri 2a str. 2457T
ccgguggcauccg

SEQ ID NO: 1934592 - RNA, 18 nt, Shigella flexneri 2a str. 2457T
ccggugccgguuucacgu

SEQ ID NO: 1934593 - RNA, 17 nt, Shigella flexneri 2a str. 2457T
ccgguacggaugcgaau

SEQ ID NO: 1934594 - RNA, 21 nt, Shigella flexneri 2a str. 2457T
ccggucuggguuucgccaggc

SEQ ID NO: 1934595 - RNA, 23 nt, Shigella flexneri 2a str. 2457T
ccggucuggguuucgccaggcac

SEQ ID NO: 1934596 - RNA, 22 nt, Shigella flexneri 2a str. 2457T
ccggucuaccgauccggcacca

SEQ ID NO: 1934597 - RNA, 23 nt, Shigella flexneri 2a str. 2457T
ccgggugaacugccacacaggcc

SEQ ID NO: 1934598 - RNA, 14 nt, Shigella flexneri 2a str. 2457T
ccgggugaacugcc

SEQ ID NO: 1934599 - RNA, 14 nt, Shigella flexneri 2a str. 2457T
ccgguaaucaggca

SEQ ID NO: 1934600 - RNA, 16 nt, Shigella flexneri 2a str. 2457T
ccgguaccuuugaacu

SEQ ID NO: 1934601 - RNA, 15 nt, Shigella flexneri 2a str. 2457T
ccgggcgauccggca

SEQ ID NO: 1934602 - RNA, 18 nt, Shigella flexneri 2a str. 2457T
ccgggaucagacgaccca

SEQ ID NO: 1934603 - RNA, 17 nt, Shigella flexneri 2a str. 2457T
ccgggauggucagcgga

SEQ ID NO: 1934604 - RNA, 14 nt, Shigella flexneri 2a str. 2457T
ccgggcacacuuag

SEQ ID NO: 1934605 - RNA, 19 nt, Shigella flexneri 2a str. 2457T
ccucagaguuaaccugaaa

SEQ ID NO: 1934606 - RNA, 10 nt, Shigella flexneri 2a str. 2457T
ccucagagcu

SEQ ID NO: 1934607 - RNA, 21 nt, Shigella flexneri 2a str. 2457T
ccucacuuucuggcagcugcg

SEQ ID NO: 1934608 - RNA, 17 nt, Shigella flexneri 2a str. 2457T
ccucaccuuccacgcgg

SEQ ID NO: 1934609 - RNA, 19 nt, Shigella flexneri 2a str. 2457T
ccucacgcauucucuuuuc

SEQ ID NO: 1934610 - RNA, 20 nt, Shigella flexneri 2a str. 2457T
ccucaauuagcggcucaugu

SEQ ID NO: 1934611 - RNA, 22 nt, Shigella flexneri 2a str. 2457T
ccucaccauuccguuucuccac

SEQ ID NO: 1934612 - RNA, 17 nt, Shigella flexneri 2a str. 2457T
ccuauucgcaucgguga

SEQ ID NO: 1934613 - RNA, 17 nt, Shigella flexneri 2a str. 2457T
ccuauuuuuacccaggc

SEQ ID NO: 1934614 - RNA, 22 nt, Shigella flexneri 2a str. 2457T
ccucaaccauugaaacacuuaa

SEQ ID NO: 1934615 - RNA, 22 nt, Shigella flexneri 2a str. 2457T
ccuacgugcgcaauaacccaga

SEQ ID NO: 1934616 - RNA, 18 nt, Shigella flexneri 2a str. 2457T
ccuacucucgcaugggga

SEQ ID NO: 1934617 - RNA, 14 nt, Shigella flexneri 2a str. 2457T
ccuaggcauagaaa

SEQ ID NO: 1934618 - RNA, 16 nt, Shigella flexneri 2a str. 2457T
ccuagcaaacuaucug

SEQ ID NO: 1934619 - RNA, 15 nt, Shigella flexneri 2a str. 2457T
ccuagaaaucauuca

SEQ ID NO: 1934620 - RNA, 21 nt, Shigella flexneri 2a str. 2457T
ccuacuuuuuaauucaggaaa

SEQ ID NO: 1934621 - RNA, 13 nt, Shigella flexneri 2a str. 2457T
ccuauaguucaau

SEQ ID NO: 1934622 - RNA, 15 nt, Shigella flexneri 2a str. 2457T
ccuaucuucauggag

SEQ ID NO: 1934623 - RNA, 18 nt, Shigella flexneri 2a str. 2457T
ccuaugcaacaacugaaa

SEQ ID NO: 1934624 - RNA, 21 nt, Shigella flexneri 2a str. 2457T
ccgugaugcgcaagggucguc

SEQ ID NO: 1934625 - RNA, 13 nt, Shigella flexneri 2a str. 2457T
ccgugaucuggcg

SEQ ID NO: 1934626 - RNA, 18 nt, Shigella flexneri 2a str. 2457T
ccgugaucguggccauga

SEQ ID NO: 1934627 - RNA, 21 nt, Shigella flexneri 2a str. 2457T
ccgucgcaauacccugaccca

SEQ ID NO: 1934628 - RNA, 12 nt, Shigella flexneri 2a str. 2457T
ccguccuccgua

SEQ ID NO: 1934629 - RNA, 17 nt, Shigella flexneri 2a str. 2457T
ccguuaaguuuaacugc

SEQ ID NO: 1934630 - RNA, 22 nt, Shigella flexneri 2a str. 2457T
ccguucgcuaccuuucagugcg

SEQ ID NO: 1934631 - RNA, 15 nt, Shigella flexneri 2a str. 2457T
ccuaaggaauccagc

SEQ ID NO: 1934632 - RNA, 13 nt, Shigella flexneri 2a str. 2457T
ccuaauuuuuuga

SEQ ID NO: 1934633 - RNA, 13 nt, Shigella flexneri 2a str. 2457T
ccuacaaaaucua

SEQ ID NO: 1934634 - RNA, 14 nt, Shigella flexneri 2a str. 2457T
ccuacaaaaucuug

SEQ ID NO: 1934635 - RNA, 14 nt, Shigella flexneri 2a str. 2457T
ccuaaagggcggca

SEQ ID NO: 1934636 - RNA, 13 nt, Shigella flexneri 2a str. 2457T
ccuaaaggcaaaa

SEQ ID NO: 1934637 - RNA, 20 nt, Shigella flexneri 2a str. 2457T
ccuaaagaagccgccagacc

SEQ ID NO: 1934638 - RNA, 16 nt, Shigella flexneri 2a str. 2457T
ccuaaaguuguuuucu

SEQ ID NO: 1934639 - RNA, 20 nt, Shigella flexneri 2a str. 2457T
ccguugugcgauccacgcca

SEQ ID NO: 1934640 - RNA, 17 nt, Shigella flexneri 2a str. 2457T
ccguuuuuugaaacagg

SEQ ID NO: 1934641 - RNA, 23 nt, Shigella flexneri 2a str. 2457T
ccguugguuaauuuuucaaacuc

SEQ ID NO: 1934642 - RNA, 20 nt, Shigella flexneri 2a str. 2457T
ccguuggcguaaaucaaacc

SEQ ID NO: 1934643 - RNA, 18 nt, Shigella flexneri 2a str. 2457T
ccggcacacguaggccaa

SEQ ID NO: 1934644 - RNA, 22 nt, Shigella flexneri 2a str. 2457T
ccggcaauucucugcuccugau

SEQ ID NO: 1934645 - RNA, 15 nt, Shigella flexneri 2a str. 2457T
ccggcacauuucacu

SEQ ID NO: 1934646 - RNA, 23 nt, Shigella flexneri 2a str. 2457T
ccggcaaagugaauacagaacag

SEQ ID NO: 1934647 - RNA, 20 nt, Shigella flexneri 2a str. 2457T
ccggcaaucugcuggcaaac

SEQ ID NO: 1934648 - RNA, 14 nt, Shigella flexneri 2a str. 2457T
ccggcaaccacacc

SEQ ID NO: 1934649 - RNA, 16 nt, Shigella flexneri 2a str. 2457T
ccggcaaccacaccca

SEQ ID NO: 1934650 - RNA, 19 nt, Shigella flexneri 2a str. 2457T
ccggcauccagccaaacau

SEQ ID NO: 1934651 - RNA, 15 nt, Shigella flexneri 2a str. 2457T
ccggcauacuuugau

SEQ ID NO: 1934652 - RNA, 14 nt, Shigella flexneri 2a str. 2457T
ccggcauauaccuc

SEQ ID NO: 1934653 - RNA, 17 nt, Shigella flexneri 2a str. 2457T
ccggcaucaaccagcac

SEQ ID NO: 1934654 - RNA, 23 nt, Shigella flexneri 2a str. 2457T
ccggcaucguuugcugccuucac

SEQ ID NO: 1934655 - RNA, 12 nt, Shigella flexneri 2a str. 2457T
ccggccagagca

SEQ ID NO: 1934656 - RNA, 13 nt, Shigella flexneri 2a str. 2457T
ccggccagcgccg

SEQ ID NO: 1934657 - RNA, 17 nt, Shigella flexneri 2a str. 2457T
ccggccagcgccgcgcg

SEQ ID NO: 1934658 - RNA, 22 nt, Shigella flexneri 2a str. 2457T
ccgcuugaguauuuaccagaau

SEQ ID NO: 1934659 - RNA, 14 nt, Shigella flexneri 2a str. 2457T
ccgcuucuucuuca

SEQ ID NO: 1934660 - RNA, 15 nt, Shigella flexneri 2a str. 2457T
ccgcuucguuuucag

SEQ ID NO: 1934661 - RNA, 13 nt, Shigella flexneri 2a str. 2457T
ccgcuucugcuuu

SEQ ID NO: 1934662 - RNA, 14 nt, Shigella flexneri 2a str. 2457T
ccgcuucugcuuug

SEQ ID NO: 1934663 - RNA, 19 nt, Shigella flexneri 2a str. 2457T
ccggaccugucggggccag

SEQ ID NO: 1934664 - RNA, 20 nt, Shigella flexneri 2a str. 2457T
ccggacccuggucaguuuca

SEQ ID NO: 1934665 - RNA, 23 nt, Shigella flexneri 2a str. 2457T
ccggagcagcagucaggcgcgcg

SEQ ID NO: 1934666 - RNA, 20 nt, Shigella flexneri 2a str. 2457T
ccggaugacacaucaccucc

SEQ ID NO: 1934667 - RNA, 16 nt, Shigella flexneri 2a str. 2457T
ccggaugcaccaucuc

SEQ ID NO: 1934668 - RNA, 19 nt, Shigella flexneri 2a str. 2457T
ccggaugauucacaucauc

SEQ ID NO: 1934669 - RNA, 15 nt, Shigella flexneri 2a str. 2457T
ccggaugccucuccu

SEQ ID NO: 1934670 - RNA, 15 nt, Shigella flexneri 2a str. 2457T
ccggauuuuuuuucc

SEQ ID NO: 1934671 - RNA, 14 nt, Shigella flexneri 2a str. 2457T
ccggauucagauug

SEQ ID NO: 1934672 - RNA, 19 nt, Shigella flexneri 2a str. 2457T
ccggaugcgacauagaucu

SEQ ID NO: 1934673 - RNA, 22 nt, Shigella flexneri 2a str. 2457T
ccggaugcggcgugaacgccuu

SEQ ID NO: 1934674 - RNA, 19 nt, Shigella flexneri 2a str. 2457T
ccggcggaauggucggcgc

SEQ ID NO: 1934675 - RNA, 19 nt, Shigella flexneri 2a str. 2457T
ccggcgcuaauucaacgcc

SEQ ID NO: 1934676 - RNA, 20 nt, Shigella flexneri 2a str. 2457T
ccggcgacguauugcgcaga

SEQ ID NO: 1934677 - RNA, 15 nt, Shigella flexneri 2a str. 2457T
ccggccuggauggcu

SEQ ID NO: 1934678 - RNA, 16 nt, Shigella flexneri 2a str. 2457T
ccggcgaaagagcugg

SEQ ID NO: 1934679 - RNA, 15 nt, Shigella flexneri 2a str. 2457T
ccgcgccaaugccug

SEQ ID NO: 1934680 - RNA, 16 nt, Shigella flexneri 2a str. 2457T
ccgcgccacgcggagc

SEQ ID NO: 1934681 - RNA, 21 nt, Shigella flexneri 2a str. 2457T
ccgcgcagggacacucgcuga

SEQ ID NO: 1934682 - RNA, 23 nt, Shigella flexneri 2a str. 2457T
ccgcgcguuuuucuucagccccu

SEQ ID NO: 1934683 - RNA, 20 nt, Shigella flexneri 2a str. 2457T
ccgcgcggguaauugcucca

SEQ ID NO: 1934684 - RNA, 20 nt, Shigella flexneri 2a str. 2457T
ccgcgcgguaucaccaccca

SEQ ID NO: 1934685 - RNA, 19 nt, Shigella flexneri 2a str. 2457T
ccgcgcuuucuggcgcaga

SEQ ID NO: 1934686 - RNA, 13 nt, Shigella flexneri 2a str. 2457T
ccgccgccgccac

SEQ ID NO: 1934687 - RNA, 18 nt, Shigella flexneri 2a str. 2457T
ccgccgauguugcaugau

SEQ ID NO: 1934688 - RNA, 11 nt, Shigella flexneri 2a str. 2457T
ccgccgcccgg

SEQ ID NO: 1934689 - RNA, 23 nt, Shigella flexneri 2a str. 2457T
ccgccuggcgcugcucaggcgag

SEQ ID NO: 1934690 - RNA, 15 nt, Shigella flexneri 2a str. 2457T
ccgccuguugcccuu

SEQ ID NO: 1934691 - RNA, 19 nt, Shigella flexneri 2a str. 2457T
ccgccuuugaucucaaacg

SEQ ID NO: 1934692 - RNA, 21 nt, Shigella flexneri 2a str. 2457T
ccgcgaaccggaccagcaaca

SEQ ID NO: 1934693 - RNA, 13 nt, Shigella flexneri 2a str. 2457T
ccgcgcaaaccac

SEQ ID NO: 1934694 - RNA, 21 nt, Shigella flexneri 2a str. 2457T
ccgcgaucgccugcagggcuu

SEQ ID NO: 1934695 - RNA, 15 nt, Shigella flexneri 2a str. 2457T
ccgcgauagcaagcg

SEQ ID NO: 1934696 - RNA, 20 nt, Shigella flexneri 2a str. 2457T
ccgcuguaauaccagccuuc

SEQ ID NO: 1934697 - RNA, 17 nt, Shigella flexneri 2a str. 2457T
ccgcuguaauugccgcu

SEQ ID NO: 1934698 - RNA, 13 nt, Shigella flexneri 2a str. 2457T
ccgcuucgcucac

SEQ ID NO: 1934699 - RNA, 17 nt, Shigella flexneri 2a str. 2457T
ccgcugucuaccagcac

SEQ ID NO: 1934700 - RNA, 21 nt, Shigella flexneri 2a str. 2457T
ccgcugucgcagcgugcucuc

SEQ ID NO: 1934701 - RNA, 13 nt, Shigella flexneri 2a str. 2457T
ccgcuucgcccgc

SEQ ID NO: 1934702 - RNA, 16 nt, Shigella flexneri 2a str. 2457T
ccgcuucgcccgccag

SEQ ID NO: 1934703 - RNA, 21 nt, Shigella flexneri 2a str. 2457T
ccgcugcuucucuucagccaa

SEQ ID NO: 1934704 - RNA, 18 nt, Shigella flexneri 2a str. 2457T
ccgcucgaaguuuuccuc

SEQ ID NO: 1934705 - RNA, 13 nt, Shigella flexneri 2a str. 2457T
ccgcucccagcau

SEQ ID NO: 1934706 - RNA, 23 nt, Shigella flexneri 2a str. 2457T
ccgcuccgccaucuucuugcagc

SEQ ID NO: 1934707 - RNA, 15 nt, Shigella flexneri 2a str. 2457T
ccgcucgaaguuuuc

SEQ ID NO: 1934708 - RNA, 18 nt, Shigella flexneri 2a str. 2457T
ccgcgugcgcuggacgcc

SEQ ID NO: 1934709 - RNA, 20 nt, Shigella flexneri 2a str. 2457T
ccgcgucguugaaaugcggc

SEQ ID NO: 1934710 - RNA, 17 nt, Shigella flexneri 2a str. 2457T
ccgauaauuccucccgu

SEQ ID NO: 1934711 - RNA, 21 nt, Shigella flexneri 2a str. 2457T
ccgauaccaauguagccgcgg

SEQ ID NO: 1934712 - RNA, 13 nt, Shigella flexneri 2a str. 2457T
ccgaucgaagaga

SEQ ID NO: 1934713 - RNA, 16 nt, Shigella flexneri 2a str. 2457T
ccgauccggcaccaau

SEQ ID NO: 1934714 - RNA, 19 nt, Shigella flexneri 2a str. 2457T
ccgaguaaaaaaacaucau

SEQ ID NO: 1934715 - RNA, 16 nt, Shigella flexneri 2a str. 2457T
ccgaggcauucagcca

SEQ ID NO: 1934716 - RNA, 20 nt, Shigella flexneri 2a str. 2457T
ccgagcguucaaaacggcug

SEQ ID NO: 1934717 - RNA, 13 nt, Shigella flexneri 2a str. 2457T
ccgacuuauucuu

SEQ ID NO: 1934718 - RNA, 14 nt, Shigella flexneri 2a str. 2457T
ccgagcagccacug

SEQ ID NO: 1934719 - RNA, 13 nt, Shigella flexneri 2a str. 2457T
ccgagcagccacu

SEQ ID NO: 1934720 - RNA, 18 nt, Shigella flexneri 2a str. 2457T
ccgaccgucugcuggaac

SEQ ID NO: 1934721 - RNA, 15 nt, Shigella flexneri 2a str. 2457T
ccgaccgcaaggaag

SEQ ID NO: 1934722 - RNA, 15 nt, Shigella flexneri 2a str. 2457T
ccgaaggcaccauua

SEQ ID NO: 1934723 - RNA, 21 nt, Shigella flexneri 2a str. 2457T
ccgaagcggcguuccaccgcu

SEQ ID NO: 1934724 - RNA, 20 nt, Shigella flexneri 2a str. 2457T
ccgaagccguuagucaucau

SEQ ID NO: 1934725 - RNA, 17 nt, Shigella flexneri 2a str. 2457T
ccgacauuucugcugcc

SEQ ID NO: 1934726 - RNA, 10 nt, Shigella flexneri 2a str. 2457T
ccgaccacuu

SEQ ID NO: 1934727 - RNA, 12 nt, Shigella flexneri 2a str. 2457T
ccgacagaauau

SEQ ID NO: 1934728 - RNA, 13 nt, Shigella flexneri 2a str. 2457T
ccgacacuggcag

SEQ ID NO: 1934729 - RNA, 13 nt, Shigella flexneri 2a str. 2457T
ccgacagcaggcu

SEQ ID NO: 1934730 - RNA, 15 nt, Shigella flexneri 2a str. 2457T
ccgaaacgcaccuca

SEQ ID NO: 1934731 - RNA, 19 nt, Shigella flexneri 2a str. 2457T
cccuuugucgaaguuacca

SEQ ID NO: 1934732 - RNA, 22 nt, Shigella flexneri 2a str. 2457T
cccuuugucgaaguuaccaccc

SEQ ID NO: 1934733 - RNA, 15 nt, Shigella flexneri 2a str. 2457T
ccgaaauauggcgcu

SEQ ID NO: 1934734 - RNA, 14 nt, Shigella flexneri 2a str. 2457T
ccgaaccgggcgcg

SEQ ID NO: 1934735 - RNA, 16 nt, Shigella flexneri 2a str. 2457T
ccgaaccgggcgcgag

SEQ ID NO: 1934736 - RNA, 15 nt, Shigella flexneri 2a str. 2457T
cccuugucgcagcau

SEQ ID NO: 1934737 - RNA, 16 nt, Shigella flexneri 2a str. 2457T
cccuuggggagagggu

SEQ ID NO: 1934738 - RNA, 14 nt, Shigella flexneri 2a str. 2457T
cccucgccccuccg

SEQ ID NO: 1934739 - RNA, 16 nt, Shigella flexneri 2a str. 2457T
cccucgccgcuucccu

SEQ ID NO: 1934740 - RNA, 21 nt, Shigella flexneri 2a str. 2457T
cccuugcucugguucaccauu

SEQ ID NO: 1934741 - RNA, 19 nt, Shigella flexneri 2a str. 2457T
ccgcauccggcauaaacaa

SEQ ID NO: 1934742 - RNA, 19 nt, Shigella flexneri 2a str. 2457T
ccgcauccugcaccacgac

SEQ ID NO: 1934743 - RNA, 22 nt, Shigella flexneri 2a str. 2457T
ccgcaucuucccagguuucaau

SEQ ID NO: 1934744 - RNA, 19 nt, Shigella flexneri 2a str. 2457T
ccgcaucacuccacaccau

SEQ ID NO: 1934745 - RNA, 23 nt, Shigella flexneri 2a str. 2457T
ccgcaucaggcaucugagcauga

SEQ ID NO: 1934746 - RNA, 14 nt, Shigella flexneri 2a str. 2457T
ccgcaucacgacag

SEQ ID NO: 1934747 - RNA, 15 nt, Shigella flexneri 2a str. 2457T
ccgcaucacgacagc

SEQ ID NO: 1934748 - RNA, 11 nt, Shigella flexneri 2a str. 2457T
ccgcauccaga

SEQ ID NO: 1934749 - RNA, 20 nt, Shigella flexneri 2a str. 2457T
ccgcauccggcaauugugau

SEQ ID NO: 1934750 - RNA, 16 nt, Shigella flexneri 2a str. 2457T
ccgcaucaaugaccuu

SEQ ID NO: 1934751 - RNA, 20 nt, Shigella flexneri 2a str. 2457T
ccgcaucaacagugccaauc

SEQ ID NO: 1934752 - RNA, 11 nt, Shigella flexneri 2a str. 2457T
ccgccaccagg

SEQ ID NO: 1934753 - RNA, 22 nt, Shigella flexneri 2a str. 2457T
ccgcacgcagaaucucugcgcu

SEQ ID NO: 1934754 - RNA, 15 nt, Shigella flexneri 2a str. 2457T
ccgcagaucagacca

SEQ ID NO: 1934755 - RNA, 20 nt, Shigella flexneri 2a str. 2457T
ccgcagcgauugucagcugg

SEQ ID NO: 1934756 - RNA, 21 nt, Shigella flexneri 2a str. 2457T
ccgaugguagcagcgaagaga

SEQ ID NO: 1934757 - RNA, 13 nt, Shigella flexneri 2a str. 2457T
ccgcaaugugcuc

SEQ ID NO: 1934758 - RNA, 15 nt, Shigella flexneri 2a str. 2457T
ccgcacaauacauag

SEQ ID NO: 1934759 - RNA, 18 nt, Shigella flexneri 2a str. 2457T
ccgcaccugaguaauuaa

SEQ ID NO: 1934760 - RNA, 15 nt, Shigella flexneri 2a str. 2457T
ccgcaccugccagcg

SEQ ID NO: 1934761 - RNA, 16 nt, Shigella flexneri 2a str. 2457T
ccgccagcaggaacga

SEQ ID NO: 1934762 - RNA, 13 nt, Shigella flexneri 2a str. 2457T
ccgccagcaggaa

SEQ ID NO: 1934763 - RNA, 19 nt, Shigella flexneri 2a str. 2457T
ccgccagcuucgcuuccca

SEQ ID NO: 1934764 - RNA, 12 nt, Shigella flexneri 2a str. 2457T
ccgccaggcuuc

SEQ ID NO: 1934765 - RNA, 11 nt, Shigella flexneri 2a str. 2457T
ccgccagacca

SEQ ID NO: 1934766 - RNA, 13 nt, Shigella flexneri 2a str. 2457T
ccgccacugccac

SEQ ID NO: 1934767 - RNA, 19 nt, Shigella flexneri 2a str. 2457T
ccgccagaacgacgacugc

SEQ ID NO: 1934768 - RNA, 19 nt, Shigella flexneri 2a str. 2457T
ccgccacuugagccuccag

SEQ ID NO: 1934769 - RNA, 22 nt, Shigella flexneri 2a str. 2457T
ccgccacuugagccuccagcgg

SEQ ID NO: 1934770 - RNA, 23 nt, Shigella flexneri 2a str. 2457T
ccgccacuugagccuccagcgga

SEQ ID NO: 1934771 - RNA, 17 nt, Shigella flexneri 2a str. 2457T
ccgccacgaccugcaga

SEQ ID NO: 1934772 - RNA, 11 nt, Shigella flexneri 2a str. 2457T
ccgccaucauc

SEQ ID NO: 1934773 - RNA, 15 nt, Shigella flexneri 2a str. 2457T
ccgccauagaaagga

SEQ ID NO: 1934774 - RNA, 20 nt, Shigella flexneri 2a str. 2457T
ccgccaguuugucuggcaau

SEQ ID NO: 1934775 - RNA, 21 nt, Shigella flexneri 2a str. 2457T
ccgccaguuuacugucugcuu

SEQ ID NO: 1934776 - RNA, 15 nt, Shigella flexneri 2a str. 2457T
ccgccaguguggcgg

SEQ ID NO: 1934777 - RNA, 12 nt, Shigella flexneri 2a str. 2457T
ccgccaguucuu

SEQ ID NO: 1934778 - RNA, 21 nt, Shigella flexneri 2a str. 2457T
ccgccaguucuuccaguuccg

SEQ ID NO: 1934779 - RNA, 14 nt, Shigella flexneri 2a str. 2457T
ccgcccacaccagu

SEQ ID NO: 1934780 - RNA, 17 nt, Shigella flexneri 2a str. 2457T
ccgccauuucuccuccg

SEQ ID NO: 1934781 - RNA, 22 nt, Shigella flexneri 2a str. 2457T
cauccggucagacaacuucccu

SEQ ID NO: 1934782 - RNA, 14 nt, Shigella flexneri 2a str. 2457T
cauccguuucccug

SEQ ID NO: 1934783 - RNA, 16 nt, Shigella flexneri 2a str. 2457T
cauccuaaaggcaaaa

SEQ ID NO: 1934784 - RNA, 21 nt, Shigella flexneri 2a str. 2457T
cauccuaaaggcaaaaugcca

SEQ ID NO: 1934785 - RNA, 18 nt, Shigella flexneri 2a str. 2457T
cauccggauacagcccca

SEQ ID NO: 1934786 - RNA, 20 nt, Shigella flexneri 2a str. 2457T
cauccagacugcucagcucc

SEQ ID NO: 1934787 - RNA, 13 nt, Shigella flexneri 2a str. 2457T
cauccacugccug

SEQ ID NO: 1934788 - RNA, 21 nt, Shigella flexneri 2a str. 2457T
cauccgcgucggcaaguaccc

SEQ ID NO: 1934789 - RNA, 18 nt, Shigella flexneri 2a str. 2457T
cauccgcgugacgcuggc

SEQ ID NO: 1934790 - RNA, 14 nt, Shigella flexneri 2a str. 2457T
cauccgccauccac

SEQ ID NO: 1934791 - RNA, 18 nt, Shigella flexneri 2a str. 2457T
cauccuucacacugccuc

SEQ ID NO: 1934792 - RNA, 16 nt, Shigella flexneri 2a str. 2457T
cauccuucauuauccu

SEQ ID NO: 1934793 - RNA, 16 nt, Shigella flexneri 2a str. 2457T
cauccucuauauuuca

SEQ ID NO: 1934794 - RNA, 15 nt, Shigella flexneri 2a str. 2457T
cauccuugcuaacca

SEQ ID NO: 1934795 - RNA, 17 nt, Shigella flexneri 2a str. 2457T
caucgaaaacgccaccg

SEQ ID NO: 1934796 - RNA, 16 nt, Shigella flexneri 2a str. 2457T
cauccuuugcuggcaa

SEQ ID NO: 1934797 - RNA, 14 nt, Shigella flexneri 2a str. 2457T
caucgacagcaaau

SEQ ID NO: 1934798 - RNA, 21 nt, Shigella flexneri 2a str. 2457T
caucgcccaguugaucaccag

SEQ ID NO: 1934799 - RNA, 18 nt, Shigella flexneri 2a str. 2457T
caucgccagugccgccca

SEQ ID NO: 1934800 - RNA, 17 nt, Shigella flexneri 2a str. 2457T
caucgccaguuuugcca

SEQ ID NO: 1934801 - RNA, 20 nt, Shigella flexneri 2a str. 2457T
caucgccauaauaagcgcca

SEQ ID NO: 1934802 - RNA, 15 nt, Shigella flexneri 2a str. 2457T
caucgccagcagcca

SEQ ID NO: 1934803 - RNA, 16 nt, Shigella flexneri 2a str. 2457T
caucgccagcagccau

SEQ ID NO: 1934804 - RNA, 16 nt, Shigella flexneri 2a str. 2457T
caucgccagcucaagg

SEQ ID NO: 1934805 - RNA, 17 nt, Shigella flexneri 2a str. 2457T
caucgauauuaucuuca

SEQ ID NO: 1934806 - RNA, 17 nt, Shigella flexneri 2a str. 2457T
caucgauaucaaccagu

SEQ ID NO: 1934807 - RNA, 23 nt, Shigella flexneri 2a str. 2457T
caucgacggcggagucauucucc

SEQ ID NO: 1934808 - RNA, 23 nt, Shigella flexneri 2a str. 2457T
caucgacguagugaaaucgccaa

SEQ ID NO: 1934809 - RNA, 13 nt, Shigella flexneri 2a str. 2457T
caucgacccagaa

SEQ ID NO: 1934810 - RNA, 16 nt, Shigella flexneri 2a str. 2457T
caucgacgccaucauu

SEQ ID NO: 1934811 - RNA, 13 nt, Shigella flexneri 2a str. 2457T
caucgcgcuggug

SEQ ID NO: 1934812 - RNA, 14 nt, Shigella flexneri 2a str. 2457T
caucgccuucuuga

SEQ ID NO: 1934813 - RNA, 16 nt, Shigella flexneri 2a str. 2457T
caucgccuuccagcga

SEQ ID NO: 1934814 - RNA, 15 nt, Shigella flexneri 2a str. 2457T
caucgcgccaacaaa

SEQ ID NO: 1934815 - RNA, 17 nt, Shigella flexneri 2a str. 2457T
caucgcgcccaaaccac

SEQ ID NO: 1934816 - RNA, 19 nt, Shigella flexneri 2a str. 2457T
caucgcgcccaaaccaccc

SEQ ID NO: 1934817 - RNA, 19 nt, Shigella flexneri 2a str. 2457T
caucgcgauuaugccgccg

SEQ ID NO: 1934818 - RNA, 14 nt, Shigella flexneri 2a str. 2457T
caucggcgcuggcg

SEQ ID NO: 1934819 - RNA, 21 nt, Shigella flexneri 2a str. 2457T
caucggcggugaccagcagca

SEQ ID NO: 1934820 - RNA, 20 nt, Shigella flexneri 2a str. 2457T
caucggcggugaccagcagc

SEQ ID NO: 1934821 - RNA, 16 nt, Shigella flexneri 2a str. 2457T
caucgcggucagcugc

SEQ ID NO: 1934822 - RNA, 15 nt, Shigella flexneri 2a str. 2457T
caucgcuacaccaau

SEQ ID NO: 1934823 - RNA, 23 nt, Shigella flexneri 2a str. 2457T
caucuucuugcagcuuaaucaua

SEQ ID NO: 1934824 - RNA, 18 nt, Shigella flexneri 2a str. 2457T
caucuucuucaauuuccg

SEQ ID NO: 1934825 - RNA, 17 nt, Shigella flexneri 2a str. 2457T
caucuucccagguuuca

SEQ ID NO: 1934826 - RNA, 22 nt, Shigella flexneri 2a str. 2457T
caucuucggcguuguaagguua

SEQ ID NO: 1934827 - RNA, 15 nt, Shigella flexneri 2a str. 2457T
caucuuugaaaucac

SEQ ID NO: 1934828 - RNA, 21 nt, Shigella flexneri 2a str. 2457T
caucuuuccaaaccucagagu

SEQ ID NO: 1934829 - RNA, 15 nt, Shigella flexneri 2a str. 2457T
caucuuucagaauca

SEQ ID NO: 1934830 - RNA, 18 nt, Shigella flexneri 2a str. 2457T
caucuuucagaaucaggu

SEQ ID NO: 1934831 - RNA, 15 nt, Shigella flexneri 2a str. 2457T
caucuuuauaugcaa

SEQ ID NO: 1934832 - RNA, 14 nt, Shigella flexneri 2a str. 2457T
caucuguucuuuua

SEQ ID NO: 1934833 - RNA, 23 nt, Shigella flexneri 2a str. 2457T
caucuguucuuuuaacgcaugca

SEQ ID NO: 1934834 - RNA, 20 nt, Shigella flexneri 2a str. 2457T
caucuguuucgaucagcaau

SEQ ID NO: 1934835 - RNA, 21 nt, Shigella flexneri 2a str. 2457T
caucuguucugccguccagcc

SEQ ID NO: 1934836 - RNA, 19 nt, Shigella flexneri 2a str. 2457T
caucuuauccagcaaccag

SEQ ID NO: 1934837 - RNA, 17 nt, Shigella flexneri 2a str. 2457T
caucuucaacugccaug

SEQ ID NO: 1934838 - RNA, 19 nt, Shigella flexneri 2a str. 2457T
caucuucacacugaugaca

SEQ ID NO: 1934839 - RNA, 19 nt, Shigella flexneri 2a str. 2457T
caucuucacuguccgccag

SEQ ID NO: 1934840 - RNA, 13 nt, Shigella flexneri 2a str. 2457T
caucuuccaccac

SEQ ID NO: 1934841 - RNA, 18 nt, Shigella flexneri 2a str. 2457T
caucuuccaccuggaacc

SEQ ID NO: 1934842 - RNA, 15 nt, Shigella flexneri 2a str. 2457T
caucucgcucaaaaa

SEQ ID NO: 1934843 - RNA, 14 nt, Shigella flexneri 2a str. 2457T
caucucuucuuccg

SEQ ID NO: 1934844 - RNA, 23 nt, Shigella flexneri 2a str. 2457T
caucugaaacucgcguaaaucca

SEQ ID NO: 1934845 - RNA, 22 nt, Shigella flexneri 2a str. 2457T
caucucuucuuccggcaccauu

SEQ ID NO: 1934846 - RNA, 12 nt, Shigella flexneri 2a str. 2457T
caucugcuucaa

SEQ ID NO: 1934847 - RNA, 13 nt, Shigella flexneri 2a str. 2457T
caucugccagcca

SEQ ID NO: 1934848 - RNA, 14 nt, Shigella flexneri 2a str. 2457T
caucugccccauug

SEQ ID NO: 1934849 - RNA, 16 nt, Shigella flexneri 2a str. 2457T
caucugccugauccug

SEQ ID NO: 1934850 - RNA, 22 nt, Shigella flexneri 2a str. 2457T
caucgguaucuucccagccaau

SEQ ID NO: 1934851 - RNA, 19 nt, Shigella flexneri 2a str. 2457T
caucgggcagcaucgccag

SEQ ID NO: 1934852 - RNA, 21 nt, Shigella flexneri 2a str. 2457T
caucgggaagaggaucugcuc

SEQ ID NO: 1934853 - RNA, 23 nt, Shigella flexneri 2a str. 2457T
caucggcuuuggcaaauggcgcu

SEQ ID NO: 1934854 - RNA, 17 nt, Shigella flexneri 2a str. 2457T
caucuacgcucucuuca

SEQ ID NO: 1934855 - RNA, 12 nt, Shigella flexneri 2a str. 2457T
caucuauuauug

SEQ ID NO: 1934856 - RNA, 15 nt, Shigella flexneri 2a str. 2457T
caucuauuauuguuu

SEQ ID NO: 1934857 - RNA, 16 nt, Shigella flexneri 2a str. 2457T
caucuauagcacccgc

SEQ ID NO: 1934858 - RNA, 21 nt, Shigella flexneri 2a str. 2457T
caucaccugagcuggcagacc

SEQ ID NO: 1934859 - RNA, 14 nt, Shigella flexneri 2a str. 2457T
caucacgcaaaugu

SEQ ID NO: 1934860 - RNA, 22 nt, Shigella flexneri 2a str. 2457T
caucacgaucgcuucggucugc

SEQ ID NO: 1934861 - RNA, 22 nt, Shigella flexneri 2a str. 2457T
caucacgccaauaauggccuuu

SEQ ID NO: 1934862 - RNA, 15 nt, Shigella flexneri 2a str. 2457T
caucagcgccaccag

SEQ ID NO: 1934863 - RNA, 21 nt, Shigella flexneri 2a str. 2457T
caucagcgauucauugaguaa

SEQ ID NO: 1934864 - RNA, 16 nt, Shigella flexneri 2a str. 2457T
caucacggcagccuga

SEQ ID NO: 1934865 - RNA, 15 nt, Shigella flexneri 2a str. 2457T
caucagcaugacaaa

SEQ ID NO: 1934866 - RNA, 14 nt, Shigella flexneri 2a str. 2457T
caucagccagaugc

SEQ ID NO: 1934867 - RNA, 17 nt, Shigella flexneri 2a str. 2457T
caucagccagaugcacc

SEQ ID NO: 1934868 - RNA, 14 nt, Shigella flexneri 2a str. 2457T
caucauaaauaaga

SEQ ID NO: 1934869 - RNA, 17 nt, Shigella flexneri 2a str. 2457T
caucaguuucaaauggc

SEQ ID NO: 1934870 - RNA, 15 nt, Shigella flexneri 2a str. 2457T
caucagucucaaacc

SEQ ID NO: 1934871 - RNA, 15 nt, Shigella flexneri 2a str. 2457T
caucagugaacccau

SEQ ID NO: 1934872 - RNA, 16 nt, Shigella flexneri 2a str. 2457T
caucagugaacccaua

SEQ ID NO: 1934873 - RNA, 17 nt, Shigella flexneri 2a str. 2457T
caucaguagcauccccg

SEQ ID NO: 1934874 - RNA, 19 nt, Shigella flexneri 2a str. 2457T
caucaggcauuuuuaucac

SEQ ID NO: 1934875 - RNA, 22 nt, Shigella flexneri 2a str. 2457T
caucaggcaucgugcaccaauu

SEQ ID NO: 1934876 - RNA, 13 nt, Shigella flexneri 2a str. 2457T
caucaggcaucug

SEQ ID NO: 1934877 - RNA, 14 nt, Shigella flexneri 2a str. 2457T
caucaggcaucugc

SEQ ID NO: 1934878 - RNA, 21 nt, Shigella flexneri 2a str. 2457T
caucaggcguucgcggcggca

SEQ ID NO: 1934879 - RNA, 18 nt, Shigella flexneri 2a str. 2457T
caucaggggcagcaccau

SEQ ID NO: 1934880 - RNA, 22 nt, Shigella flexneri 2a str. 2457T
caucauucccuacgcgauaaaa

SEQ ID NO: 1934881 - RNA, 22 nt, Shigella flexneri 2a str. 2457T
caucaucuggcugugauccauu

SEQ ID NO: 1934882 - RNA, 22 nt, Shigella flexneri 2a str. 2457T
caucauacccaacguaacaaaa

SEQ ID NO: 1934883 - RNA, 14 nt, Shigella flexneri 2a str. 2457T
caucauaauaauug

SEQ ID NO: 1934884 - RNA, 15 nt, Shigella flexneri 2a str. 2457T
caucauaaccugcuc

SEQ ID NO: 1934885 - RNA, 12 nt, Shigella flexneri 2a str. 2457T
caucauaagacu

SEQ ID NO: 1934886 - RNA, 19 nt, Shigella flexneri 2a str. 2457T
caucauagacuucccuccc

SEQ ID NO: 1934887 - RNA, 12 nt, Shigella flexneri 2a str. 2457T
caucaucaccag

SEQ ID NO: 1934888 - RNA, 19 nt, Shigella flexneri 2a str. 2457T
caucaucagaaaugccagu

SEQ ID NO: 1934889 - RNA, 12 nt, Shigella flexneri 2a str. 2457T
caucaucagaaa

SEQ ID NO: 1934890 - RNA, 13 nt, Shigella flexneri 2a str. 2457T
caucaucgcuuuc

SEQ ID NO: 1934891 - RNA, 16 nt, Shigella flexneri 2a str. 2457T
caucauccucuucagc

SEQ ID NO: 1934892 - RNA, 19 nt, Shigella flexneri 2a str. 2457T
caucauccggcaccuuuuc

SEQ ID NO: 1934893 - RNA, 20 nt, Shigella flexneri 2a str. 2457T
caucauccggcaccuuuuca

SEQ ID NO: 1934894 - RNA, 20 nt, Shigella flexneri 2a str. 2457T
caucaucaggaacaucccuu

SEQ ID NO: 1934895 - RNA, 13 nt, Shigella flexneri 2a str. 2457T
caucaacugacua

SEQ ID NO: 1934896 - RNA, 22 nt, Shigella flexneri 2a str. 2457T
caucaagcuaacgaacgcagug

SEQ ID NO: 1934897 - RNA, 15 nt, Shigella flexneri 2a str. 2457T
caucaagcuguucuu

SEQ ID NO: 1934898 - RNA, 15 nt, Shigella flexneri 2a str. 2457T
caucaacguuuuuuu

SEQ ID NO: 1934899 - RNA, 13 nt, Shigella flexneri 2a str. 2457T
caucaauaaacaa

SEQ ID NO: 1934900 - RNA, 22 nt, Shigella flexneri 2a str. 2457T
caucaaguugauuuuucguuuu

SEQ ID NO: 1934901 - RNA, 15 nt, Shigella flexneri 2a str. 2457T
caucaaguaaccuuu

SEQ ID NO: 1934902 - RNA, 20 nt, Shigella flexneri 2a str. 2457T
caucaaguaaccuuuaucgc

SEQ ID NO: 1934903 - RNA, 15 nt, Shigella flexneri 2a str. 2457T
caucaagucagaugc

SEQ ID NO: 1934904 - RNA, 14 nt, Shigella flexneri 2a str. 2457T
caucaaguagcagg

SEQ ID NO: 1934905 - RNA, 23 nt, Shigella flexneri 2a str. 2457T
caucaauaccauuaucauugaga

SEQ ID NO: 1934906 - RNA, 14 nt, Shigella flexneri 2a str. 2457T
caucaccccgcgcu

SEQ ID NO: 1934907 - RNA, 12 nt, Shigella flexneri 2a str. 2457T
caucaaaaaaug

SEQ ID NO: 1934908 - RNA, 13 nt, Shigella flexneri 2a str. 2457T
caucaaaaaauga

SEQ ID NO: 1934909 - RNA, 21 nt, Shigella flexneri 2a str. 2457T
cauauucaccacgaaaccgac

SEQ ID NO: 1934910 - RNA, 22 nt, Shigella flexneri 2a str. 2457T
cauauauuacaacguauuauau

SEQ ID NO: 1934911 - RNA, 18 nt, Shigella flexneri 2a str. 2457T
cauauaguggguaacaau

SEQ ID NO: 1934912 - RNA, 16 nt, Shigella flexneri 2a str. 2457T
cauauaaugcaacauu

SEQ ID NO: 1934913 - RNA, 13 nt, Shigella flexneri 2a str. 2457T
cauauguuuacgc

SEQ ID NO: 1934914 - RNA, 14 nt, Shigella flexneri 2a str. 2457T
cauauuaaauuuuu

SEQ ID NO: 1934915 - RNA, 18 nt, Shigella flexneri 2a str. 2457T
cauaucguagccccaguc

SEQ ID NO: 1934916 - RNA, 16 nt, Shigella flexneri 2a str. 2457T
cauaucgguaaaugcu

SEQ ID NO: 1934917 - RNA, 13 nt, Shigella flexneri 2a str. 2457T
cauaugccccugu

SEQ ID NO: 1934918 - RNA, 17 nt, Shigella flexneri 2a str. 2457T
cauaugauucauauugc

SEQ ID NO: 1934919 - RNA, 16 nt, Shigella flexneri 2a str. 2457T
cauaugcacaugauga

SEQ ID NO: 1934920 - RNA, 20 nt, Shigella flexneri 2a str. 2457T
cauaugcagcauccaacuga

SEQ ID NO: 1934921 - RNA, 15 nt, Shigella flexneri 2a str. 2457T
cauugcgccugcagg

SEQ ID NO: 1934922 - RNA, 11 nt, Shigella flexneri 2a str. 2457T
cauugccuggc

SEQ ID NO: 1934923 - RNA, 12 nt, Shigella flexneri 2a str. 2457T
cauugccugaug

SEQ ID NO: 1934924 - RNA, 21 nt, Shigella flexneri 2a str. 2457T
cauugccguugauaaagaguu

SEQ ID NO: 1934925 - RNA, 21 nt, Shigella flexneri 2a str. 2457T
cauugccgggcgcaucagauc

SEQ ID NO: 1934926 - RNA, 23 nt, Shigella flexneri 2a str. 2457T
cauugauaauccaucacuucauc

SEQ ID NO: 1934927 - RNA, 20 nt, Shigella flexneri 2a str. 2457T
cauugaugcguuagaugaug

SEQ ID NO: 1934928 - RNA, 15 nt, Shigella flexneri 2a str. 2457T
cauugccgccucugc

SEQ ID NO: 1934929 - RNA, 20 nt, Shigella flexneri 2a str. 2457T
cauugauguuuucacaaccg

SEQ ID NO: 1934930 - RNA, 14 nt, Shigella flexneri 2a str. 2457T
cauugcaacguggu

SEQ ID NO: 1934931 - RNA, 18 nt, Shigella flexneri 2a str. 2457T
cauugcaaccacacaggc

SEQ ID NO: 1934932 - RNA, 20 nt, Shigella flexneri 2a str. 2457T
cauugcuuuuuugauuacag

SEQ ID NO: 1934933 - RNA, 17 nt, Shigella flexneri 2a str. 2457T
cauuggagacugaugac

SEQ ID NO: 1934934 - RNA, 14 nt, Shigella flexneri 2a str. 2457T
cauuggcaggcucu

SEQ ID NO: 1934935 - RNA, 13 nt, Shigella flexneri 2a str. 2457T
cauugucucccac

SEQ ID NO: 1934936 - RNA, 19 nt, Shigella flexneri 2a str. 2457T
cauugucucccacaugcug

SEQ ID NO: 1934937 - RNA, 17 nt, Shigella flexneri 2a str. 2457T
cauugugugaaaucagc

SEQ ID NO: 1934938 - RNA, 20 nt, Shigella flexneri 2a str. 2457T
cauuuaaacaauuucagaau

SEQ ID NO: 1934939 - RNA, 22 nt, Shigella flexneri 2a str. 2457T
cauucuacuuugcgagucugcu

SEQ ID NO: 1934940 - RNA, 12 nt, Shigella flexneri 2a str. 2457T
cauucucacucc

SEQ ID NO: 1934941 - RNA, 18 nt, Shigella flexneri 2a str. 2457T
cauucucaucaccauucc

SEQ ID NO: 1934942 - RNA, 17 nt, Shigella flexneri 2a str. 2457T
cauucgucuccuggccg

SEQ ID NO: 1934943 - RNA, 20 nt, Shigella flexneri 2a str. 2457T
cauuaucagagauucuuuuc

SEQ ID NO: 1934944 - RNA, 12 nt, Shigella flexneri 2a str. 2457T
cauuauccagcg

SEQ ID NO: 1934945 - RNA, 13 nt, Shigella flexneri 2a str. 2457T
cauuauccagcga

SEQ ID NO: 1934946 - RNA, 14 nt, Shigella flexneri 2a str. 2457T
cauuaucagagauu

SEQ ID NO: 1934947 - RNA, 15 nt, Shigella flexneri 2a str. 2457T
cauuaggccauuuga

SEQ ID NO: 1934948 - RNA, 15 nt, Shigella flexneri 2a str. 2457T
cauugaagaauuuuu

SEQ ID NO: 1934949 - RNA, 17 nt, Shigella flexneri 2a str. 2457T
cauugaagaauuuuugc

SEQ ID NO: 1934950 - RNA, 22 nt, Shigella flexneri 2a str. 2457T
cauucuuaccgggucgcacugg

SEQ ID NO: 1934951 - RNA, 23 nt, Shigella flexneri 2a str. 2457T
cauugaacgggugauuuccccua

SEQ ID NO: 1934952 - RNA, 23 nt, Shigella flexneri 2a str. 2457T
cauugagcuugcguguuuuauau

SEQ ID NO: 1934953 - RNA, 19 nt, Shigella flexneri 2a str. 2457T
cauugacgauagcgccgcc

SEQ ID NO: 1934954 - RNA, 14 nt, Shigella flexneri 2a str. 2457T
cauugacgcuggcu

SEQ ID NO: 1934955 - RNA, 14 nt, Shigella flexneri 2a str. 2457T
cauugaguuuacgc

SEQ ID NO: 1934956 - RNA, 21 nt, Shigella flexneri 2a str. 2457T
cauugagucccaucuuuuuaa

SEQ ID NO: 1934957 - RNA, 15 nt, Shigella flexneri 2a str. 2457T
cauugagguugaucu

SEQ ID NO: 1934958 - RNA, 12 nt, Shigella flexneri 2a str. 2457T
cauuugcacaag

SEQ ID NO: 1934959 - RNA, 14 nt, Shigella flexneri 2a str. 2457T
cauuugauucacaa

SEQ ID NO: 1934960 - RNA, 15 nt, Shigella flexneri 2a str. 2457T
cauuuaaaucaauaa

SEQ ID NO: 1934961 - RNA, 17 nt, Shigella flexneri 2a str. 2457T
cauuuaacccuucaaga

SEQ ID NO: 1934962 - RNA, 14 nt, Shigella flexneri 2a str. 2457T
cauuuaagaaaaaa

SEQ ID NO: 1934963 - RNA, 16 nt, Shigella flexneri 2a str. 2457T
cauuuaagaaaaaaga

SEQ ID NO: 1934964 - RNA, 16 nt, Shigella flexneri 2a str. 2457T
cauuugugacauuaac

SEQ ID NO: 1934965 - RNA, 15 nt, Shigella flexneri 2a str. 2457T
cauuugugacauuaa

SEQ ID NO: 1934966 - RNA, 19 nt, Shigella flexneri 2a str. 2457T
cauuugcuccagacgccag

SEQ ID NO: 1934967 - RNA, 18 nt, Shigella flexneri 2a str. 2457T
cauuugcauacccagaac

SEQ ID NO: 1934968 - RNA, 22 nt, Shigella flexneri 2a str. 2457T
cauuugccacuuugcaguuccu

SEQ ID NO: 1934969 - RNA, 19 nt, Shigella flexneri 2a str. 2457T
cauuuggcggggauuuuuu

SEQ ID NO: 1934970 - RNA, 14 nt, Shigella flexneri 2a str. 2457T
cauuuuacguugca

SEQ ID NO: 1934971 - RNA, 13 nt, Shigella flexneri 2a str. 2457T
cauuuuaauaaug

SEQ ID NO: 1934972 - RNA, 15 nt, Shigella flexneri 2a str. 2457T
cauuuucuucagcag

SEQ ID NO: 1934973 - RNA, 21 nt, Shigella flexneri 2a str. 2457T
cauuuucucgcgaaccgccug

SEQ ID NO: 1934974 - RNA, 21 nt, Shigella flexneri 2a str. 2457T
cauuuucucgcggacugccug

SEQ ID NO: 1934975 - RNA, 15 nt, Shigella flexneri 2a str. 2457T
cauuuugcacauucc

SEQ ID NO: 1934976 - RNA, 21 nt, Shigella flexneri 2a str. 2457T
cauuuugaccacacggucuau

SEQ ID NO: 1934977 - RNA, 20 nt, Shigella flexneri 2a str. 2457T
cauuuugacuuuuacagcuu

SEQ ID NO: 1934978 - RNA, 20 nt, Shigella flexneri 2a str. 2457T
cauuuuucggcgucagaacu

SEQ ID NO: 1934979 - RNA, 20 nt, Shigella flexneri 2a str. 2457T
cauuuuucagcguuccccag

SEQ ID NO: 1934980 - RNA, 14 nt, Shigella flexneri 2a str. 2457T
cauuuuucaugauc

SEQ ID NO: 1934981 - RNA, 16 nt, Shigella flexneri 2a str. 2457T
cauuuuucagacguuc

SEQ ID NO: 1934982 - RNA, 23 nt, Shigella flexneri 2a str. 2457T
cauuaaugccguuauacaucgcu

SEQ ID NO: 1934983 - RNA, 15 nt, Shigella flexneri 2a str. 2457T
cauuaaccaaccacc

SEQ ID NO: 1934984 - RNA, 15 nt, Shigella flexneri 2a str. 2457T
cauuaaccagccacu

SEQ ID NO: 1934985 - RNA, 22 nt, Shigella flexneri 2a str. 2457T
cauuaaccgugcgggcaucauc

SEQ ID NO: 1934986 - RNA, 14 nt, Shigella flexneri 2a str. 2457T
cauuaaauccugaa

SEQ ID NO: 1934987 - RNA, 20 nt, Shigella flexneri 2a str. 2457T
cauuaaauccugaaaccaua

SEQ ID NO: 1934988 - RNA, 16 nt, Shigella flexneri 2a str. 2457T
cauuaacgugaucaaa

SEQ ID NO: 1934989 - RNA, 17 nt, Shigella flexneri 2a str. 2457T
cauuaacgccccaauca

SEQ ID NO: 1934990 - RNA, 13 nt, Shigella flexneri 2a str. 2457T
cauuaagaugcau

SEQ ID NO: 1934991 - RNA, 19 nt, Shigella flexneri 2a str. 2457T
cauuacaccaauaccgccc

SEQ ID NO: 1934992 - RNA, 17 nt, Shigella flexneri 2a str. 2457T
cauuacaagaaucaugc

SEQ ID NO: 1934993 - RNA, 18 nt, Shigella flexneri 2a str. 2457T
cauuacaagaaucaugcc

SEQ ID NO: 1934994 - RNA, 13 nt, Shigella flexneri 2a str. 2457T
cauuacaagcccg

SEQ ID NO: 1934995 - RNA, 16 nt, Shigella flexneri 2a str. 2457T
cauuacaagcccgcug

SEQ ID NO: 1934996 - RNA, 18 nt, Shigella flexneri 2a str. 2457T
cauuacaagcccgcugcc

SEQ ID NO: 1934997 - RNA, 12 nt, Shigella flexneri 2a str. 2457T
cauuacaacaag

SEQ ID NO: 1934998 - RNA, 18 nt, Shigella flexneri 2a str. 2457T
cauuaauuuccugauggc

SEQ ID NO: 1934999 - RNA, 19 nt, Shigella flexneri 2a str. 2457T
cauuacuguauacgggcuu

SEQ ID NO: 1935000 - RNA, 13 nt, Shigella flexneri 2a str. 2457T
cauggugucacca

SEQ ID NO: 1935001 - RNA, 23 nt, Shigella flexneri 2a str. 2457T
caugguggaaaucgaacuucccg

SEQ ID NO: 1935002 - RNA, 21 nt, Shigella flexneri 2a str. 2457T
caugguguucagauggccaau

SEQ ID NO: 1935003 - RNA, 19 nt, Shigella flexneri 2a str. 2457T
cauggugucugaugaggca

SEQ ID NO: 1935004 - RNA, 18 nt, Shigella flexneri 2a str. 2457T
cauggucggcagagaguu

SEQ ID NO: 1935005 - RNA, 23 nt, Shigella flexneri 2a str. 2457T
cauggugaauaucaguuauuaca

SEQ ID NO: 1935006 - RNA, 19 nt, Shigella flexneri 2a str. 2457T
caugucugccgcaggaaag

SEQ ID NO: 1935007 - RNA, 17 nt, Shigella flexneri 2a str. 2457T
caugugcgacgggccaa

SEQ ID NO: 1935008 - RNA, 12 nt, Shigella flexneri 2a str. 2457T
cauuaaaauucu

SEQ ID NO: 1935009 - RNA, 15 nt, Shigella flexneri 2a str. 2457T
cauuaaaguuaucgc

SEQ ID NO: 1935010 - RNA, 15 nt, Shigella flexneri 2a str. 2457T
cauguuugaaucaac

SEQ ID NO: 1935011 - RNA, 13 nt, Shigella flexneri 2a str. 2457T
cauguugccuggg

SEQ ID NO: 1935012 - RNA, 21 nt, Shigella flexneri 2a str. 2457T
cauguugaaauucgccagaca

SEQ ID NO: 1935013 - RNA, 20 nt, Shigella flexneri 2a str. 2457T
caugcacgggcgcuuguuau

SEQ ID NO: 1935014 - RNA, 19 nt, Shigella flexneri 2a str. 2457T
caugcaauuaccgccacca

SEQ ID NO: 1935015 - RNA, 19 nt, Shigella flexneri 2a str. 2457T
caugaaagcgaugcugaug

SEQ ID NO: 1935016 - RNA, 12 nt, Shigella flexneri 2a str. 2457T
caugauuucugc

SEQ ID NO: 1935017 - RNA, 17 nt, Shigella flexneri 2a str. 2457T
caugaaagcgaugcuga

SEQ ID NO: 1935018 - RNA, 22 nt, Shigella flexneri 2a str. 2457T
caugaaaaaacuggcuacccug

SEQ ID NO: 1935019 - RNA, 16 nt, Shigella flexneri 2a str. 2457T
caugccgucaaaaaac

SEQ ID NO: 1935020 - RNA, 16 nt, Shigella flexneri 2a str. 2457T
caugccgugaugcgca

SEQ ID NO: 1935021 - RNA, 16 nt, Shigella flexneri 2a str. 2457T
caugcgaauacacccu

SEQ ID NO: 1935022 - RNA, 14 nt, Shigella flexneri 2a str. 2457T
cauggcagaagcau

SEQ ID NO: 1935023 - RNA, 16 nt, Shigella flexneri 2a str. 2457T
cauggcaacuaacuga

SEQ ID NO: 1935024 - RNA, 22 nt, Shigella flexneri 2a str. 2457T
cauggcaacuaacugacuuccg

SEQ ID NO: 1935025 - RNA, 16 nt, Shigella flexneri 2a str. 2457T
cauggauucgaugauc

SEQ ID NO: 1935026 - RNA, 19 nt, Shigella flexneri 2a str. 2457T
cauggggaugcugaaaaga

SEQ ID NO: 1935027 - RNA, 20 nt, Shigella flexneri 2a str. 2457T
caugggagaacgaugcugcu

SEQ ID NO: 1935028 - RNA, 15 nt, Shigella flexneri 2a str. 2457T
caugguaaaaccgac

SEQ ID NO: 1935029 - RNA, 16 nt, Shigella flexneri 2a str. 2457T
caugggguuuuucgag

SEQ ID NO: 1935030 - RNA, 22 nt, Shigella flexneri 2a str. 2457T
caugggucugcggaucauggua

SEQ ID NO: 1935031 - RNA, 16 nt, Shigella flexneri 2a str. 2457T
caugggugaacugcuu

SEQ ID NO: 1935032 - RNA, 16 nt, Shigella flexneri 2a str. 2457T
cauggauaaaauuauc

SEQ ID NO: 1935033 - RNA, 17 nt, Shigella flexneri 2a str. 2457T
cauggacgaaaucuacg

SEQ ID NO: 1935034 - RNA, 17 nt, Shigella flexneri 2a str. 2457T
cauggacauacgcaccu

SEQ ID NO: 1935035 - RNA, 20 nt, Shigella flexneri 2a str. 2457T
caugcguugucgccauccag

SEQ ID NO: 1935036 - RNA, 16 nt, Shigella flexneri 2a str. 2457T
caugcguuuguaggcg

SEQ ID NO: 1935037 - RNA, 19 nt, Shigella flexneri 2a str. 2457T
cauacucuuucccggcaau

SEQ ID NO: 1935038 - RNA, 14 nt, Shigella flexneri 2a str. 2457T
cauacucuuugaca

SEQ ID NO: 1935039 - RNA, 19 nt, Shigella flexneri 2a str. 2457T
cauacucuuugacaacauc

SEQ ID NO: 1935040 - RNA, 17 nt, Shigella flexneri 2a str. 2457T
cauacugcaucagcgcc

SEQ ID NO: 1935041 - RNA, 19 nt, Shigella flexneri 2a str. 2457T
cauacugccgaccaucugu

SEQ ID NO: 1935042 - RNA, 21 nt, Shigella flexneri 2a str. 2457T
cauacugggggcacugaaagc

SEQ ID NO: 1935043 - RNA, 17 nt, Shigella flexneri 2a str. 2457T
cauacguuucaccagca

SEQ ID NO: 1935044 - RNA, 15 nt, Shigella flexneri 2a str. 2457T
cauacguugcauaaa

SEQ ID NO: 1935045 - RNA, 16 nt, Shigella flexneri 2a str. 2457T
cauacucagcgccugc

SEQ ID NO: 1935046 - RNA, 14 nt, Shigella flexneri 2a str. 2457T
cauacucuccucca

SEQ ID NO: 1935047 - RNA, 17 nt, Shigella flexneri 2a str. 2457T
cauaccuaccugcaguu

SEQ ID NO: 1935048 - RNA, 16 nt, Shigella flexneri 2a str. 2457T
cauaccuaccugcagu

SEQ ID NO: 1935049 - RNA, 13 nt, Shigella flexneri 2a str. 2457T
cauaccugagugg

SEQ ID NO: 1935050 - RNA, 18 nt, Shigella flexneri 2a str. 2457T
cauaccuccgcaauaugc

SEQ ID NO: 1935051 - RNA, 18 nt, Shigella flexneri 2a str. 2457T
cauacggguuuuccccuu

SEQ ID NO: 1935052 - RNA, 18 nt, Shigella flexneri 2a str. 2457T
cauacgcguaaaacagcc

SEQ ID NO: 1935053 - RNA, 20 nt, Shigella flexneri 2a str. 2457T
cauacggaaaaucucauuug

SEQ ID NO: 1935054 - RNA, 20 nt, Shigella flexneri 2a str. 2457T
cauacgcguaaaacagccag

SEQ ID NO: 1935055 - RNA, 18 nt, Shigella flexneri 2a str. 2457T
cauacgcaaaaaacauug

SEQ ID NO: 1935056 - RNA, 21 nt, Shigella flexneri 2a str. 2457T
cauacgacgugccgcagcuuc

SEQ ID NO: 1935057 - RNA, 15 nt, Shigella flexneri 2a str. 2457T
cauacgaacgccugc

SEQ ID NO: 1935058 - RNA, 21 nt, Shigella flexneri 2a str. 2457T
cauacccgccagugcugaagg

SEQ ID NO: 1935059 - RNA, 16 nt, Shigella flexneri 2a str. 2457T
cauaccccacauaguu

SEQ ID NO: 1935060 - RNA, 15 nt, Shigella flexneri 2a str. 2457T
cauacagcggacagc

SEQ ID NO: 1935061 - RNA, 19 nt, Shigella flexneri 2a str. 2457T
cauacagcuuuuacagcca

SEQ ID NO: 1935062 - RNA, 17 nt, Shigella flexneri 2a str. 2457T
cauacagcggacagcca

SEQ ID NO: 1935063 - RNA, 21 nt, Shigella flexneri 2a str. 2457T
cauacagcggccagccauccg

SEQ ID NO: 1935064 - RNA, 12 nt, Shigella flexneri 2a str. 2457T
cauacauccucu

SEQ ID NO: 1935065 - RNA, 21 nt, Shigella flexneri 2a str. 2457T
cauacauccucucuuuccuua

SEQ ID NO: 1935066 - RNA, 17 nt, Shigella flexneri 2a str. 2457T
cauacauugcguaacca

SEQ ID NO: 1935067 - RNA, 21 nt, Shigella flexneri 2a str. 2457T
cauacauugcguaaccaauca

SEQ ID NO: 1935068 - RNA, 17 nt, Shigella flexneri 2a str. 2457T
cauaaccugcucugcca

SEQ ID NO: 1935069 - RNA, 18 nt, Shigella flexneri 2a str. 2457T
cauaaccugugcaccaga

SEQ ID NO: 1935070 - RNA, 15 nt, Shigella flexneri 2a str. 2457T
cauaacuccccgaga

SEQ ID NO: 1935071 - RNA, 19 nt, Shigella flexneri 2a str. 2457T
cauaacucuccuguuuaau

SEQ ID NO: 1935072 - RNA, 21 nt, Shigella flexneri 2a str. 2457T
cauaaucgggaugcguaacag

SEQ ID NO: 1935073 - RNA, 22 nt, Shigella flexneri 2a str. 2457T
cauaacuccccgagaaauacug

SEQ ID NO: 1935074 - RNA, 14 nt, Shigella flexneri 2a str. 2457T
caguugcuuuacuc

SEQ ID NO: 1935075 - RNA, 21 nt, Shigella flexneri 2a str. 2457T
caguuggcagaauuugaggaa

SEQ ID NO: 1935076 - RNA, 23 nt, Shigella flexneri 2a str. 2457T
caguugguuagagcacaucacuc

SEQ ID NO: 1935077 - RNA, 19 nt, Shigella flexneri 2a str. 2457T
caguugucagcccuuuuuc

SEQ ID NO: 1935078 - RNA, 20 nt, Shigella flexneri 2a str. 2457T
caguuguucagaaugcccac

SEQ ID NO: 1935079 - RNA, 17 nt, Shigella flexneri 2a str. 2457T
caguuguugcugccgac

SEQ ID NO: 1935080 - RNA, 14 nt, Shigella flexneri 2a str. 2457T
caguuguugcugcc

SEQ ID NO: 1935081 - RNA, 14 nt, Shigella flexneri 2a str. 2457T
caguugcugcguga

SEQ ID NO: 1935082 - RNA, 12 nt, Shigella flexneri 2a str. 2457T
caguugcuucau

SEQ ID NO: 1935083 - RNA, 14 nt, Shigella flexneri 2a str. 2457T
caguugcuucaucu

SEQ ID NO: 1935084 - RNA, 16 nt, Shigella flexneri 2a str. 2457T
caguugcgcgcgcacc

SEQ ID NO: 1935085 - RNA, 21 nt, Shigella flexneri 2a str. 2457T
caguugcaucgucuguuuuau

SEQ ID NO: 1935086 - RNA, 14 nt, Shigella flexneri 2a str. 2457T
caguugcauaauuu

SEQ ID NO: 1935087 - RNA, 19 nt, Shigella flexneri 2a str. 2457T
caguugcagcaagccaucg

SEQ ID NO: 1935088 - RNA, 14 nt, Shigella flexneri 2a str. 2457T
caguugcacgccac

SEQ ID NO: 1935089 - RNA, 16 nt, Shigella flexneri 2a str. 2457T
caguugauucgcgcgu

SEQ ID NO: 1935090 - RNA, 17 nt, Shigella flexneri 2a str. 2457T
caguucuucaaaaauaa

SEQ ID NO: 1935091 - RNA, 17 nt, Shigella flexneri 2a str. 2457T
caguucuuccaguuccg

SEQ ID NO: 1935092 - RNA, 15 nt, Shigella flexneri 2a str. 2457T
caguucuuccuggcu

SEQ ID NO: 1935093 - RNA, 13 nt, Shigella flexneri 2a str. 2457T
caguucuuuuauu

SEQ ID NO: 1935094 - RNA, 16 nt, Shigella flexneri 2a str. 2457T
caguucuacuggaauu

SEQ ID NO: 1935095 - RNA, 22 nt, Shigella flexneri 2a str. 2457T
caguuaaccugcuccucaguuu

SEQ ID NO: 1935096 - RNA, 21 nt, Shigella flexneri 2a str. 2457T
caguuaacgcggauccccugc

SEQ ID NO: 1935097 - RNA, 18 nt, Shigella flexneri 2a str. 2457T
caguucuggaagagauga

SEQ ID NO: 1935098 - RNA, 18 nt, Shigella flexneri 2a str. 2457T
caguucuaccaucaaugg

SEQ ID NO: 1935099 - RNA, 20 nt, Shigella flexneri 2a str. 2457T
cagugugcuacggucugccg

SEQ ID NO: 1935100 - RNA, 22 nt, Shigella flexneri 2a str. 2457T
cauaaagaaaucaccugccgga

SEQ ID NO: 1935101 - RNA, 17 nt, Shigella flexneri 2a str. 2457T
cauaaauacuccauaac

SEQ ID NO: 1935102 - RNA, 17 nt, Shigella flexneri 2a str. 2457T
cauaaacugagccaaac

SEQ ID NO: 1935103 - RNA, 21 nt, Shigella flexneri 2a str. 2457T
cauaaacgccgucaucacacc

SEQ ID NO: 1935104 - RNA, 15 nt, Shigella flexneri 2a str. 2457T
cauaaaccacagacc

SEQ ID NO: 1935105 - RNA, 12 nt, Shigella flexneri 2a str. 2457T
cauaaaaccagc

SEQ ID NO: 1935106 - RNA, 16 nt, Shigella flexneri 2a str. 2457T
cauaaauugcuguaaa

SEQ ID NO: 1935107 - RNA, 11 nt, Shigella flexneri 2a str. 2457T
cauaaaucaau

SEQ ID NO: 1935108 - RNA, 18 nt, Shigella flexneri 2a str. 2457T
cauaacacagguaacuua

SEQ ID NO: 1935109 - RNA, 21 nt, Shigella flexneri 2a str. 2457T
cauaacacagguaacuuaaau

SEQ ID NO: 1935110 - RNA, 22 nt, Shigella flexneri 2a str. 2457T
cauaaauuucugccauuuugcu

SEQ ID NO: 1935111 - RNA, 16 nt, Shigella flexneri 2a str. 2457T
cauaaccaacaauugu

SEQ ID NO: 1935112 - RNA, 23 nt, Shigella flexneri 2a str. 2457T
cauaaccaauaacaggauuuucu

SEQ ID NO: 1935113 - RNA, 17 nt, Shigella flexneri 2a str. 2457T
cauaaccacucaccgcc

SEQ ID NO: 1935114 - RNA, 15 nt, Shigella flexneri 2a str. 2457T
cauaaccagagagcu

SEQ ID NO: 1935115 - RNA, 14 nt, Shigella flexneri 2a str. 2457T
cauaaccaguccau

SEQ ID NO: 1935116 - RNA, 15 nt, Shigella flexneri 2a str. 2457T
caggugcgccagcga

SEQ ID NO: 1935117 - RNA, 20 nt, Shigella flexneri 2a str. 2457T
caggugcucgcauaucuuca

SEQ ID NO: 1935118 - RNA, 18 nt, Shigella flexneri 2a str. 2457T
cagguggcaaugcccggu

SEQ ID NO: 1935119 - RNA, 19 nt, Shigella flexneri 2a str. 2457T
cagguggcguuugccaccu

SEQ ID NO: 1935120 - RNA, 15 nt, Shigella flexneri 2a str. 2457T
caggguugcagaccc

SEQ ID NO: 1935121 - RNA, 17 nt, Shigella flexneri 2a str. 2457T
caggguugcagacccgc

SEQ ID NO: 1935122 - RNA, 20 nt, Shigella flexneri 2a str. 2457T
cagguaaacaccuucaucca

SEQ ID NO: 1935123 - RNA, 19 nt, Shigella flexneri 2a str. 2457T
cagguaaacaccuucaucc

SEQ ID NO: 1935124 - RNA, 22 nt, Shigella flexneri 2a str. 2457T
cagguaaagaccauaaauaugg

SEQ ID NO: 1935125 - RNA, 23 nt, Shigella flexneri 2a str. 2457T
cagguuguacuuuccagccacag

SEQ ID NO: 1935126 - RNA, 17 nt, Shigella flexneri 2a str. 2457T
cagguuuuucagcugcc

SEQ ID NO: 1935127 - RNA, 13 nt, Shigella flexneri 2a str. 2457T
cagguugcucaua

SEQ ID NO: 1935128 - RNA, 13 nt, Shigella flexneri 2a str. 2457T
caguaccagcagc

SEQ ID NO: 1935129 - RNA, 13 nt, Shigella flexneri 2a str. 2457T
caguaccaccgcg

SEQ ID NO: 1935130 - RNA, 23 nt, Shigella flexneri 2a str. 2457T
caguaccagauaaucaccugccu

SEQ ID NO: 1935131 - RNA, 13 nt, Shigella flexneri 2a str. 2457T
caguaccagcaac

SEQ ID NO: 1935132 - RNA, 15 nt, Shigella flexneri 2a str. 2457T
caguaccagcaguac

SEQ ID NO: 1935133 - RNA, 22 nt, Shigella flexneri 2a str. 2457T
caguaccgauugcccauacagg

SEQ ID NO: 1935134 - RNA, 23 nt, Shigella flexneri 2a str. 2457T
caguaccgccgccauaaacagca

SEQ ID NO: 1935135 - RNA, 22 nt, Shigella flexneri 2a str. 2457T
caguacugggccgccuguuuug

SEQ ID NO: 1935136 - RNA, 16 nt, Shigella flexneri 2a str. 2457T
caguaaacgcuuuuuu

SEQ ID NO: 1935137 - RNA, 14 nt, Shigella flexneri 2a str. 2457T
caguaacucauugc

SEQ ID NO: 1935138 - RNA, 14 nt, Shigella flexneri 2a str. 2457T
caguaauaccagac

SEQ ID NO: 1935139 - RNA, 16 nt, Shigella flexneri 2a str. 2457T
caguaauaccagaccu

SEQ ID NO: 1935140 - RNA, 21 nt, Shigella flexneri 2a str. 2457T
caguaaggucaucaaucauuu

SEQ ID NO: 1935141 - RNA, 14 nt, Shigella flexneri 2a str. 2457T
caguaagcgacggg

SEQ ID NO: 1935142 - RNA, 19 nt, Shigella flexneri 2a str. 2457T
caguagcauccccggcaac

SEQ ID NO: 1935143 - RNA, 17 nt, Shigella flexneri 2a str. 2457T
caguauaacgaaacggg

SEQ ID NO: 1935144 - RNA, 16 nt, Shigella flexneri 2a str. 2457T
cagucaccagcaucag

SEQ ID NO: 1935145 - RNA, 22 nt, Shigella flexneri 2a str. 2457T
cagucacaccagcgauguaacc

SEQ ID NO: 1935146 - RNA, 21 nt, Shigella flexneri 2a str. 2457T
cagucacaccgcgcgucccug

SEQ ID NO: 1935147 - RNA, 15 nt, Shigella flexneri 2a str. 2457T
cagucaaucauccau

SEQ ID NO: 1935148 - RNA, 16 nt, Shigella flexneri 2a str. 2457T
cagugacauucaccuc

SEQ ID NO: 1935149 - RNA, 21 nt, Shigella flexneri 2a str. 2457T
cagugacaguguuauucccaa

SEQ ID NO: 1935150 - RNA, 21 nt, Shigella flexneri 2a str. 2457T
cagugacaaauuccgaacaaa

SEQ ID NO: 1935151 - RNA, 21 nt, Shigella flexneri 2a str. 2457T
cagugaauuucacuucgccaa

SEQ ID NO: 1935152 - RNA, 14 nt, Shigella flexneri 2a str. 2457T
cagugauaacucaa

SEQ ID NO: 1935153 - RNA, 19 nt, Shigella flexneri 2a str. 2457T
cagugaguccuguuucgga

SEQ ID NO: 1935154 - RNA, 23 nt, Shigella flexneri 2a str. 2457T
cagugagauaccaguugaucaaa

SEQ ID NO: 1935155 - RNA, 20 nt, Shigella flexneri 2a str. 2457T
cagugacuuccgucccagcc

SEQ ID NO: 1935156 - RNA, 13 nt, Shigella flexneri 2a str. 2457T
cagugaaaguuuu

SEQ ID NO: 1935157 - RNA, 14 nt, Shigella flexneri 2a str. 2457T
cagucuucaucauc

SEQ ID NO: 1935158 - RNA, 15 nt, Shigella flexneri 2a str. 2457T
cagucuucccagccc

SEQ ID NO: 1935159 - RNA, 11 nt, Shigella flexneri 2a str. 2457T
cagugaaccca

SEQ ID NO: 1935160 - RNA, 21 nt, Shigella flexneri 2a str. 2457T
cagugaacgcccccucacccu

SEQ ID NO: 1935161 - RNA, 20 nt, Shigella flexneri 2a str. 2457T
cagugcugauuuugcaacaa

SEQ ID NO: 1935162 - RNA, 12 nt, Shigella flexneri 2a str. 2457T
cagugcugaagg

SEQ ID NO: 1935163 - RNA, 22 nt, Shigella flexneri 2a str. 2457T
cagugccagguagucacgguag

SEQ ID NO: 1935164 - RNA, 16 nt, Shigella flexneri 2a str. 2457T
cagugccagcaccacu

SEQ ID NO: 1935165 - RNA, 14 nt, Shigella flexneri 2a str. 2457T
cagugcauccagca

SEQ ID NO: 1935166 - RNA, 15 nt, Shigella flexneri 2a str. 2457T
cagugccaaagccag

SEQ ID NO: 1935167 - RNA, 17 nt, Shigella flexneri 2a str. 2457T
cagugcaggcaccagcc

SEQ ID NO: 1935168 - RNA, 18 nt, Shigella flexneri 2a str. 2457T
cagugcaggcaccagccc

SEQ ID NO: 1935169 - RNA, 22 nt, Shigella flexneri 2a str. 2457T
cagugcaggcaccagccccugg

SEQ ID NO: 1935170 - RNA, 14 nt, Shigella flexneri 2a str. 2457T
caguguaaaacagc

SEQ ID NO: 1935171 - RNA, 13 nt, Shigella flexneri 2a str. 2457T
caguguccaacca

SEQ ID NO: 1935172 - RNA, 19 nt, Shigella flexneri 2a str. 2457T
caguggacgauaagcaccg

SEQ ID NO: 1935173 - RNA, 18 nt, Shigella flexneri 2a str. 2457T
caguggcgagcuuccugu

SEQ ID NO: 1935174 - RNA, 20 nt, Shigella flexneri 2a str. 2457T
cagucauaaccaguccauua

SEQ ID NO: 1935175 - RNA, 20 nt, Shigella flexneri 2a str. 2457T
cagucaucacuuucagaccg

SEQ ID NO: 1935176 - RNA, 17 nt, Shigella flexneri 2a str. 2457T
cagucagucucaaggga

SEQ ID NO: 1935177 - RNA, 19 nt, Shigella flexneri 2a str. 2457T
cagucauaaccaguccauu

SEQ ID NO: 1935178 - RNA, 16 nt, Shigella flexneri 2a str. 2457T
cagucacuacgcgacc

SEQ ID NO: 1935179 - RNA, 22 nt, Shigella flexneri 2a str. 2457T
cagucacgacaaagacaucaaa

SEQ ID NO: 1935180 - RNA, 14 nt, Shigella flexneri 2a str. 2457T
cagucacuucaaau

SEQ ID NO: 1935181 - RNA, 20 nt, Shigella flexneri 2a str. 2457T
cagucaccugcggugcagcc

SEQ ID NO: 1935182 - RNA, 15 nt, Shigella flexneri 2a str. 2457T
cagucaccugcccuc

SEQ ID NO: 1935183 - RNA, 16 nt, Shigella flexneri 2a str. 2457T
cagucacgacaaagac

SEQ ID NO: 1935184 - RNA, 23 nt, Shigella flexneri 2a str. 2457T
cagucacggcgcgguugcggguu

SEQ ID NO: 1935185 - RNA, 17 nt, Shigella flexneri 2a str. 2457T
cagucgauggucgcguu

SEQ ID NO: 1935186 - RNA, 16 nt, Shigella flexneri 2a str. 2457T
cagucgcgacgcugac

SEQ ID NO: 1935187 - RNA, 16 nt, Shigella flexneri 2a str. 2457T
cagucgucaucccagu

SEQ ID NO: 1935188 - RNA, 17 nt, Shigella flexneri 2a str. 2457T
cagucgggguguugcgu

SEQ ID NO: 1935189 - RNA, 21 nt, Shigella flexneri 2a str. 2457T
cagucuuaaaggggugaaaaa

SEQ ID NO: 1935190 - RNA, 23 nt, Shigella flexneri 2a str. 2457T
cagucuuccaucacaaagugggg

SEQ ID NO: 1935191 - RNA, 16 nt, Shigella flexneri 2a str. 2457T
cagucuagcccgaugg

SEQ ID NO: 1935192 - RNA, 14 nt, Shigella flexneri 2a str. 2457T
cagucucaaaccgg

SEQ ID NO: 1935193 - RNA, 23 nt, Shigella flexneri 2a str. 2457T
cagucucaaaccggcuccagaua

SEQ ID NO: 1935194 - RNA, 13 nt, Shigella flexneri 2a str. 2457T
caggauucacaau

SEQ ID NO: 1935195 - RNA, 17 nt, Shigella flexneri 2a str. 2457T
caggauguuccggcaaa

SEQ ID NO: 1935196 - RNA, 18 nt, Shigella flexneri 2a str. 2457T
caggcacuacguucucac

SEQ ID NO: 1935197 - RNA, 23 nt, Shigella flexneri 2a str. 2457T
caggaucuggcuugccagcaggg

SEQ ID NO: 1935198 - RNA, 21 nt, Shigella flexneri 2a str. 2457T
caggaucuggcuugccagcag

SEQ ID NO: 1935199 - RNA, 22 nt, Shigella flexneri 2a str. 2457T
caggagcuccagguccuccugu

SEQ ID NO: 1935200 - RNA, 19 nt, Shigella flexneri 2a str. 2457T
caggagcgauuaugaaaca

SEQ ID NO: 1935201 - RNA, 19 nt, Shigella flexneri 2a str. 2457T
caggaggcguaauuuccac

SEQ ID NO: 1935202 - RNA, 15 nt, Shigella flexneri 2a str. 2457T
caggacuuugaaagc

SEQ ID NO: 1935203 - RNA, 16 nt, Shigella flexneri 2a str. 2457T
caggaagaccugcagc

SEQ ID NO: 1935204 - RNA, 16 nt, Shigella flexneri 2a str. 2457T
caggaaggccagcagg

SEQ ID NO: 1935205 - RNA, 15 nt, Shigella flexneri 2a str. 2457T
caggaacgccgcgcc

SEQ ID NO: 1935206 - RNA, 19 nt, Shigella flexneri 2a str. 2457T
caggaaccugugacagcag

SEQ ID NO: 1935207 - RNA, 18 nt, Shigella flexneri 2a str. 2457T
caggaacgcgccaagaua

SEQ ID NO: 1935208 - RNA, 18 nt, Shigella flexneri 2a str. 2457T
caggaacgggauugccag

SEQ ID NO: 1935209 - RNA, 13 nt, Shigella flexneri 2a str. 2457T
caggaacugcuca

SEQ ID NO: 1935210 - RNA, 17 nt, Shigella flexneri 2a str. 2457T
caggaacuguugcaaaa

SEQ ID NO: 1935211 - RNA, 18 nt, Shigella flexneri 2a str. 2457T
caggaacuguuucaccau

SEQ ID NO: 1935212 - RNA, 20 nt, Shigella flexneri 2a str. 2457T
caggaccauacugacggauc

SEQ ID NO: 1935213 - RNA, 15 nt, Shigella flexneri 2a str. 2457T
caggaccauucacac

SEQ ID NO: 1935214 - RNA, 18 nt, Shigella flexneri 2a str. 2457T
caggaccguucgcuaccu

SEQ ID NO: 1935215 - RNA, 14 nt, Shigella flexneri 2a str. 2457T
caggacgcagucca

SEQ ID NO: 1935216 - RNA, 19 nt, Shigella flexneri 2a str. 2457T
caggaccuugacgaauacu

SEQ ID NO: 1935217 - RNA, 18 nt, Shigella flexneri 2a str. 2457T
caggacgaaaccgggcaa

SEQ ID NO: 1935218 - RNA, 17 nt, Shigella flexneri 2a str. 2457T
caggacgaguacggauu

SEQ ID NO: 1935219 - RNA, 21 nt, Shigella flexneri 2a str. 2457T
caggaauaaaucuaaaagaug

SEQ ID NO: 1935220 - RNA, 12 nt, Shigella flexneri 2a str. 2457T
caggacagagac

SEQ ID NO: 1935221 - RNA, 17 nt, Shigella flexneri 2a str. 2457T
caggaauucagaaaaau

SEQ ID NO: 1935222 - RNA, 14 nt, Shigella flexneri 2a str. 2457T
cagcugcucccagc

SEQ ID NO: 1935223 - RNA, 15 nt, Shigella flexneri 2a str. 2457T
cagcugcucccagcg

SEQ ID NO: 1935224 - RNA, 16 nt, Shigella flexneri 2a str. 2457T
cagcucgugcagaaca

SEQ ID NO: 1935225 - RNA, 16 nt, Shigella flexneri 2a str. 2457T
cagcucggcaaucugu

SEQ ID NO: 1935226 - RNA, 13 nt, Shigella flexneri 2a str. 2457T
cagcuucacggaa

SEQ ID NO: 1935227 - RNA, 19 nt, Shigella flexneri 2a str. 2457T
cagcuucacgcgccagcuu

SEQ ID NO: 1935228 - RNA, 16 nt, Shigella flexneri 2a str. 2457T
cagcuuauuucuguga

SEQ ID NO: 1935229 - RNA, 18 nt, Shigella flexneri 2a str. 2457T
cagcuucacgcgccagcu

SEQ ID NO: 1935230 - RNA, 21 nt, Shigella flexneri 2a str. 2457T
cagcuucaaaucauuacaguu

SEQ ID NO: 1935231 - RNA, 18 nt, Shigella flexneri 2a str. 2457T
cagcuucaccuuccagua

SEQ ID NO: 1935232 - RNA, 16 nt, Shigella flexneri 2a str. 2457T
cagcuuccaucaacau

SEQ ID NO: 1935233 - RNA, 19 nt, Shigella flexneri 2a str. 2457T
cagcuucuuauccagcugc

SEQ ID NO: 1935234 - RNA, 17 nt, Shigella flexneri 2a str. 2457T
cagcuucauaaggaaaa

SEQ ID NO: 1935235 - RNA, 15 nt, Shigella flexneri 2a str. 2457T
cagcuucaucaucgc

SEQ ID NO: 1935236 - RNA, 15 nt, Shigella flexneri 2a str. 2457T
cagcuguuucugcuu

SEQ ID NO: 1935237 - RNA, 16 nt, Shigella flexneri 2a str. 2457T
cagcuuagaaauucac

SEQ ID NO: 1935238 - RNA, 23 nt, Shigella flexneri 2a str. 2457T
cagcuuacgagugcgcucuucaa

SEQ ID NO: 1935239 - RNA, 19 nt, Shigella flexneri 2a str. 2457T
cagcuuaugccuguccucu

SEQ ID NO: 1935240 - RNA, 14 nt, Shigella flexneri 2a str. 2457T
cagcuuagcgccuu

SEQ ID NO: 1935241 - RNA, 15 nt, Shigella flexneri 2a str. 2457T
cagcggccagcgcac

SEQ ID NO: 1935242 - RNA, 22 nt, Shigella flexneri 2a str. 2457T
cagcuaucguuauccauauggc

SEQ ID NO: 1935243 - RNA, 20 nt, Shigella flexneri 2a str. 2457T
cagcucaaacggcguuuucu

SEQ ID NO: 1935244 - RNA, 16 nt, Shigella flexneri 2a str. 2457T
cagcggcugcugaugu

SEQ ID NO: 1935245 - RNA, 15 nt, Shigella flexneri 2a str. 2457T
cagcggcuccuggcg

SEQ ID NO: 1935246 - RNA, 22 nt, Shigella flexneri 2a str. 2457T
cagcucccacaguuucagcccc

SEQ ID NO: 1935247 - RNA, 22 nt, Shigella flexneri 2a str. 2457T
cagcuccgccagcuccgggcug

SEQ ID NO: 1935248 - RNA, 19 nt, Shigella flexneri 2a str. 2457T
cagcuccgggcucaugcug

SEQ ID NO: 1935249 - RNA, 15 nt, Shigella flexneri 2a str. 2457T
cagcucaugggcuuu

SEQ ID NO: 1935250 - RNA, 15 nt, Shigella flexneri 2a str. 2457T
cagcucauuaaaaau

SEQ ID NO: 1935251 - RNA, 20 nt, Shigella flexneri 2a str. 2457T
cagcucaaucaacuccauua

SEQ ID NO: 1935252 - RNA, 19 nt, Shigella flexneri 2a str. 2457T
cagcuccagcccgcgucgu

SEQ ID NO: 1935253 - RNA, 18 nt, Shigella flexneri 2a str. 2457T
cagggcgcgggcaacaga

SEQ ID NO: 1935254 - RNA, 15 nt, Shigella flexneri 2a str. 2457T
cagggcgauaucuuu

SEQ ID NO: 1935255 - RNA, 18 nt, Shigella flexneri 2a str. 2457T
cagggcgaauucuugccu

SEQ ID NO: 1935256 - RNA, 12 nt, Shigella flexneri 2a str. 2457T
cagggccugaag

SEQ ID NO: 1935257 - RNA, 13 nt, Shigella flexneri 2a str. 2457T
cagggccugaagg

SEQ ID NO: 1935258 - RNA, 17 nt, Shigella flexneri 2a str. 2457T
cagggccugaaggaccu

SEQ ID NO: 1935259 - RNA, 15 nt, Shigella flexneri 2a str. 2457T
cagggaaugaggauc

SEQ ID NO: 1935260 - RNA, 17 nt, Shigella flexneri 2a str. 2457T
cagggaaugugaugaaa

SEQ ID NO: 1935261 - RNA, 19 nt, Shigella flexneri 2a str. 2457T
cagggaaugugaugaaaaa

SEQ ID NO: 1935262 - RNA, 15 nt, Shigella flexneri 2a str. 2457T
caggcucauaccuuc

SEQ ID NO: 1935263 - RNA, 17 nt, Shigella flexneri 2a str. 2457T
cagggccaacuggcaaa

SEQ ID NO: 1935264 - RNA, 16 nt, Shigella flexneri 2a str. 2457T
cagggcaugacacaga

SEQ ID NO: 1935265 - RNA, 22 nt, Shigella flexneri 2a str. 2457T
cagggcaauuaaaaauuucccc

SEQ ID NO: 1935266 - RNA, 18 nt, Shigella flexneri 2a str. 2457T
caggggcggggaauucua

SEQ ID NO: 1935267 - RNA, 14 nt, Shigella flexneri 2a str. 2457T
caggggcagcacca

SEQ ID NO: 1935268 - RNA, 22 nt, Shigella flexneri 2a str. 2457T
cagggcuuucgcaauaaucauc

SEQ ID NO: 1935269 - RNA, 17 nt, Shigella flexneri 2a str. 2457T
cagggugaucaccagua

SEQ ID NO: 1935270 - RNA, 17 nt, Shigella flexneri 2a str. 2457T
cagggugcuggcgcuca

SEQ ID NO: 1935271 - RNA, 17 nt, Shigella flexneri 2a str. 2457T
caggguggugacaccau

SEQ ID NO: 1935272 - RNA, 17 nt, Shigella flexneri 2a str. 2457T
caggguguauucaugcc

SEQ ID NO: 1935273 - RNA, 24 nt, Shigella flexneri 2a str. 2457T
caggguauuaucaauaccgauggc

SEQ ID NO: 1935274 - RNA, 19 nt, Shigella flexneri 2a str. 2457T
caggguauggaucccucuu

SEQ ID NO: 1935275 - RNA, 22 nt, Shigella flexneri 2a str. 2457T
caggguaauuuguaacugucgg

SEQ ID NO: 1935276 - RNA, 19 nt, Shigella flexneri 2a str. 2457T
caggccuacauuuucuccg

SEQ ID NO: 1935277 - RNA, 14 nt, Shigella flexneri 2a str. 2457T
caggccuacaaaau

SEQ ID NO: 1935278 - RNA, 18 nt, Shigella flexneri 2a str. 2457T
caggccuacaaguccguu

SEQ ID NO: 1935279 - RNA, 16 nt, Shigella flexneri 2a str. 2457T
caggcgcucauaacca

SEQ ID NO: 1935280 - RNA, 13 nt, Shigella flexneri 2a str. 2457T
caggcgcgccugg

SEQ ID NO: 1935281 - RNA, 14 nt, Shigella flexneri 2a str. 2457T
caggcgcgccuggu

SEQ ID NO: 1935282 - RNA, 20 nt, Shigella flexneri 2a str. 2457T
caggcguuuacccuucgcac

SEQ ID NO: 1935283 - RNA, 20 nt, Shigella flexneri 2a str. 2457T
caggcguuuguaacccacca

SEQ ID NO: 1935284 - RNA, 15 nt, Shigella flexneri 2a str. 2457T
caggcguuuacccuu

SEQ ID NO: 1935285 - RNA, 15 nt, Shigella flexneri 2a str. 2457T
caggcguucugccug

SEQ ID NO: 1935286 - RNA, 16 nt, Shigella flexneri 2a str. 2457T
caggcuacucccagua

SEQ ID NO: 1935287 - RNA, 15 nt, Shigella flexneri 2a str. 2457T
caggcuacucccagu

SEQ ID NO: 1935288 - RNA, 15 nt, Shigella flexneri 2a str. 2457T
caggcuaaagaaaac

SEQ ID NO: 1935289 - RNA, 17 nt, Shigella flexneri 2a str. 2457T
caggcuaccgcagugaa

SEQ ID NO: 1935290 - RNA, 16 nt, Shigella flexneri 2a str. 2457T
caggcggcgaagcuga

SEQ ID NO: 1935291 - RNA, 18 nt, Shigella flexneri 2a str. 2457T
caggccggagccagccgu

SEQ ID NO: 1935292 - RNA, 13 nt, Shigella flexneri 2a str. 2457T
caggccgcgcagu

SEQ ID NO: 1935293 - RNA, 18 nt, Shigella flexneri 2a str. 2457T
caggccgcguaccgcagc

SEQ ID NO: 1935294 - RNA, 15 nt, Shigella flexneri 2a str. 2457T
caggcaguaaaccgu

SEQ ID NO: 1935295 - RNA, 18 nt, Shigella flexneri 2a str. 2457T
caggcaggucuuucaccu

SEQ ID NO: 1935296 - RNA, 20 nt, Shigella flexneri 2a str. 2457T
caggcagucugcgcccuggg

SEQ ID NO: 1935297 - RNA, 14 nt, Shigella flexneri 2a str. 2457T
caggcagauacaac

SEQ ID NO: 1935298 - RNA, 21 nt, Shigella flexneri 2a str. 2457T
caggcagauacaaccaaucgc

SEQ ID NO: 1935299 - RNA, 15 nt, Shigella flexneri 2a str. 2457T
caggcagcuuagaaa

SEQ ID NO: 1935300 - RNA, 14 nt, Shigella flexneri 2a str. 2457T
caggcagcugccag

SEQ ID NO: 1935301 - RNA, 11 nt, Shigella flexneri 2a str. 2457T
cacuuuacugg

SEQ ID NO: 1935302 - RNA, 14 nt, Shigella flexneri 2a str. 2457T
cacuuucagcacgu

SEQ ID NO: 1935303 - RNA, 15 nt, Shigella flexneri 2a str. 2457T
cacuuuccaguuccg

SEQ ID NO: 1935304 - RNA, 12 nt, Shigella flexneri 2a str. 2457T
cacuugcagacc

SEQ ID NO: 1935305 - RNA, 19 nt, Shigella flexneri 2a str. 2457T
cacuugcagcucauauucc

SEQ ID NO: 1935306 - RNA, 22 nt, Shigella flexneri 2a str. 2457T
cacuugcagucggcuuucucau

SEQ ID NO: 1935307 - RNA, 20 nt, Shigella flexneri 2a str. 2457T
cacuugcaggaacagugccu

SEQ ID NO: 1935308 - RNA, 22 nt, Shigella flexneri 2a str. 2457T
cacuugcggcacccauuuaucc

SEQ ID NO: 1935309 - RNA, 18 nt, Shigella flexneri 2a str. 2457T
cagaaaacgguugauaua

SEQ ID NO: 1935310 - RNA, 22 nt, Shigella flexneri 2a str. 2457T
cacuuuuuucgcugucggcagu

SEQ ID NO: 1935311 - RNA, 15 nt, Shigella flexneri 2a str. 2457T
cacuuuuauuucacc

SEQ ID NO: 1935312 - RNA, 17 nt, Shigella flexneri 2a str. 2457T
cacuuucucgacaucca

SEQ ID NO: 1935313 - RNA, 15 nt, Shigella flexneri 2a str. 2457T
cacuuugcaguuccu

SEQ ID NO: 1935314 - RNA, 23 nt, Shigella flexneri 2a str. 2457T
cacuuugccgucagccacuucuu

SEQ ID NO: 1935315 - RNA, 16 nt, Shigella flexneri 2a str. 2457T
cacuuugaucugcguc

SEQ ID NO: 1935316 - RNA, 22 nt, Shigella flexneri 2a str. 2457T
cacuuccggugccgguuucacg

SEQ ID NO: 1935317 - RNA, 15 nt, Shigella flexneri 2a str. 2457T
cacuuccucaagcgu

SEQ ID NO: 1935318 - RNA, 21 nt, Shigella flexneri 2a str. 2457T
cacuucgcgcaaccaguccuc

SEQ ID NO: 1935319 - RNA, 21 nt, Shigella flexneri 2a str. 2457T
cacuucgccaacgcccagcgc

SEQ ID NO: 1935320 - RNA, 17 nt, Shigella flexneri 2a str. 2457T
cacuucgccaucugcca

SEQ ID NO: 1935321 - RNA, 22 nt, Shigella flexneri 2a str. 2457T
cacuucugaguucggcaugggg

SEQ ID NO: 1935322 - RNA, 12 nt, Shigella flexneri 2a str. 2457T
cacuucuucagc

SEQ ID NO: 1935323 - RNA, 16 nt, Shigella flexneri 2a str. 2457T
cacuucuucagccagu

SEQ ID NO: 1935324 - RNA, 14 nt, Shigella flexneri 2a str. 2457T
cacuucuucagcca

SEQ ID NO: 1935325 - RNA, 15 nt, Shigella flexneri 2a str. 2457T
cacuucaauauuaau

SEQ ID NO: 1935326 - RNA, 14 nt, Shigella flexneri 2a str. 2457T
cacuuccaccagcg

SEQ ID NO: 1935327 - RNA, 22 nt, Shigella flexneri 2a str. 2457T
cacuuccaccagcggcugaaua

SEQ ID NO: 1935328 - RNA, 20 nt, Shigella flexneri 2a str. 2457T
cacuuccaccacuuccugcu

SEQ ID NO: 1935329 - RNA, 16 nt, Shigella flexneri 2a str. 2457T
cacuucaucgucauaa

SEQ ID NO: 1935330 - RNA, 15 nt, Shigella flexneri 2a str. 2457T
cacuuccagcggcca

SEQ ID NO: 1935331 - RNA, 16 nt, Shigella flexneri 2a str. 2457T
cacuucagccaucaaa

SEQ ID NO: 1935332 - RNA, 23 nt, Shigella flexneri 2a str. 2457T
cacuucaucacuaccuucuuccc

SEQ ID NO: 1935333 - RNA, 20 nt, Shigella flexneri 2a str. 2457T
cacuucauacggcacuuuca

SEQ ID NO: 1935334 - RNA, 20 nt, Shigella flexneri 2a str. 2457T
cacuucauagugcgcggugu

SEQ ID NO: 1935335 - RNA, 15 nt, Shigella flexneri 2a str. 2457T
cacuucaucaagcaa

SEQ ID NO: 1935336 - RNA, 15 nt, Shigella flexneri 2a str. 2457T
cacuggguucaaaaa

SEQ ID NO: 1935337 - RNA, 18 nt, Shigella flexneri 2a str. 2457T
cacuggcgauauugccgc

SEQ ID NO: 1935338 - RNA, 18 nt, Shigella flexneri 2a str. 2457T
cacugcugauaauccagu

SEQ ID NO: 1935339 - RNA, 17 nt, Shigella flexneri 2a str. 2457T
cacuggcagccaggcgc

SEQ ID NO: 1935340 - RNA, 14 nt, Shigella flexneri 2a str. 2457T
cacuggcaaaauca

SEQ ID NO: 1935341 - RNA, 23 nt, Shigella flexneri 2a str. 2457T
cacuggaggagucaugcggugga

SEQ ID NO: 1935342 - RNA, 19 nt, Shigella flexneri 2a str. 2457T
cacuggcaaucaguggcuu

SEQ ID NO: 1935343 - RNA, 14 nt, Shigella flexneri 2a str. 2457T
cacuggcaaugacg

SEQ ID NO: 1935344 - RNA, 16 nt, Shigella flexneri 2a str. 2457T
cacuguaagccaccga

SEQ ID NO: 1935345 - RNA, 18 nt, Shigella flexneri 2a str. 2457T
cacuggugccaugaauga

SEQ ID NO: 1935346 - RNA, 18 nt, Shigella flexneri 2a str. 2457T
cacugucaaauccagacu

SEQ ID NO: 1935347 - RNA, 14 nt, Shigella flexneri 2a str. 2457T
cacuguaugaaaca

SEQ ID NO: 1935348 - RNA, 17 nt, Shigella flexneri 2a str. 2457T
cacugugggauugcuuc

SEQ ID NO: 1935349 - RNA, 17 nt, Shigella flexneri 2a str. 2457T
cacugguucccaacaac

SEQ ID NO: 1935350 - RNA, 14 nt, Shigella flexneri 2a str. 2457T
cacuguucauuaaa

SEQ ID NO: 1935351 - RNA, 20 nt, Shigella flexneri 2a str. 2457T
cacuguuaccgcugcuggcg

SEQ ID NO: 1935352 - RNA, 12 nt, Shigella flexneri 2a str. 2457T
cacuuaacugua

SEQ ID NO: 1935353 - RNA, 21 nt, Shigella flexneri 2a str. 2457T
cacuuaacuguaaaucgccau

SEQ ID NO: 1935354 - RNA, 19 nt, Shigella flexneri 2a str. 2457T
cacuuaauuauuaacaaaa

SEQ ID NO: 1935355 - RNA, 17 nt, Shigella flexneri 2a str. 2457T
cacuuaauggucugaaa

SEQ ID NO: 1935356 - RNA, 16 nt, Shigella flexneri 2a str. 2457T
caauguugcgggggcu

SEQ ID NO: 1935357 - RNA, 14 nt, Shigella flexneri 2a str. 2457T
caauguuaccgauc

SEQ ID NO: 1935358 - RNA, 15 nt, Shigella flexneri 2a str. 2457T
caaugucgaaagccc

SEQ ID NO: 1935359 - RNA, 19 nt, Shigella flexneri 2a str. 2457T
caaugucauggcagucuua

SEQ ID NO: 1935360 - RNA, 19 nt, Shigella flexneri 2a str. 2457T
cacugauggaauuucauca

SEQ ID NO: 1935361 - RNA, 22 nt, Shigella flexneri 2a str. 2457T
cacugcaacagcuguugaaaag

SEQ ID NO: 1935362 - RNA, 22 nt, Shigella flexneri 2a str. 2457T
cacugcaaauacccaaaaaaua

SEQ ID NO: 1935363 - RNA, 21 nt, Shigella flexneri 2a str. 2457T
cacugcaaugaccaucauucg

SEQ ID NO: 1935364 - RNA, 14 nt, Shigella flexneri 2a str. 2457T
caauguuucucugg

SEQ ID NO: 1935365 - RNA, 15 nt, Shigella flexneri 2a str. 2457T
cacugcggcauuucc

SEQ ID NO: 1935366 - RNA, 18 nt, Shigella flexneri 2a str. 2457T
cacugcgcauaauccacu

SEQ ID NO: 1935367 - RNA, 18 nt, Shigella flexneri 2a str. 2457T
cacugcgcccgccagcau

SEQ ID NO: 1935368 - RNA, 20 nt, Shigella flexneri 2a str. 2457T
cacugccguacaggcagcuu

SEQ ID NO: 1935369 - RNA, 17 nt, Shigella flexneri 2a str. 2457T
cacugccguacaggcag

SEQ ID NO: 1935370 - RNA, 19 nt, Shigella flexneri 2a str. 2457T
cacugcccacgcgcacgcu

SEQ ID NO: 1935371 - RNA, 13 nt, Shigella flexneri 2a str. 2457T
cacugccagauuc

SEQ ID NO: 1935372 - RNA, 16 nt, Shigella flexneri 2a str. 2457T
cacugcaucauggcau

SEQ ID NO: 1935373 - RNA, 15 nt, Shigella flexneri 2a str. 2457T
cacugcaucaaugcc

SEQ ID NO: 1935374 - RNA, 20 nt, Shigella flexneri 2a str. 2457T
cagaaaugccaguaacucau

SEQ ID NO: 1935375 - RNA, 14 nt, Shigella flexneri 2a str. 2457T
cagaaauggcccaa

SEQ ID NO: 1935376 - RNA, 18 nt, Shigella flexneri 2a str. 2457T
cagaaauggcccaaaagg

SEQ ID NO: 1935377 - RNA, 16 nt, Shigella flexneri 2a str. 2457T
cagaaaucggccuucc

SEQ ID NO: 1935378 - RNA, 13 nt, Shigella flexneri 2a str. 2457T
cagaaaugaaaaa

SEQ ID NO: 1935379 - RNA, 14 nt, Shigella flexneri 2a str. 2457T
cagaaaugaugggg

SEQ ID NO: 1935380 - RNA, 17 nt, Shigella flexneri 2a str. 2457T
cagaacagcuacagcau

SEQ ID NO: 1935381 - RNA, 20 nt, Shigella flexneri 2a str. 2457T
cagaacacgcucccagcaga

SEQ ID NO: 1935382 - RNA, 19 nt, Shigella flexneri 2a str. 2457T
cagaaauuuggcuccucug

SEQ ID NO: 1935383 - RNA, 19 nt, Shigella flexneri 2a str. 2457T
cagaaauugucuccaccaa

SEQ ID NO: 1935384 - RNA, 12 nt, Shigella flexneri 2a str. 2457T
cagaacaacccg

SEQ ID NO: 1935385 - RNA, 13 nt, Shigella flexneri 2a str. 2457T
cagaaagggaaga

SEQ ID NO: 1935386 - RNA, 21 nt, Shigella flexneri 2a str. 2457T
cagaaagucaaaagccuccga

SEQ ID NO: 1935387 - RNA, 16 nt, Shigella flexneri 2a str. 2457T
cagaaagggaagaaca

SEQ ID NO: 1935388 - RNA, 20 nt, Shigella flexneri 2a str. 2457T
cagaaagggggaguuaaccu

SEQ ID NO: 1935389 - RNA, 14 nt, Shigella flexneri 2a str. 2457T
cagaaagucauggc

SEQ ID NO: 1935390 - RNA, 18 nt, Shigella flexneri 2a str. 2457T
cagaaagcgccagcaaga

SEQ ID NO: 1935391 - RNA, 23 nt, Shigella flexneri 2a str. 2457T
cagaaagcggaucaguuccagca

SEQ ID NO: 1935392 - RNA, 15 nt, Shigella flexneri 2a str. 2457T
cagaaagcgccagca

SEQ ID NO: 1935393 - RNA, 21 nt, Shigella flexneri 2a str. 2457T
cagaaagcgacuuugccuggc

SEQ ID NO: 1935394 - RNA, 16 nt, Shigella flexneri 2a str. 2457T
cagaaacuguaauuga

SEQ ID NO: 1935395 - RNA, 18 nt, Shigella flexneri 2a str. 2457T
cagaaacauaauauaaau

SEQ ID NO: 1935396 - RNA, 16 nt, Shigella flexneri 2a str. 2457T
cagaaacgccaccauu

SEQ ID NO: 1935397 - RNA, 16 nt, Shigella flexneri 2a str. 2457T
cagaaacgcucauaaa

SEQ ID NO: 1935398 - RNA, 16 nt, Shigella flexneri 2a str. 2457T
cagaaacacacuuucc

SEQ ID NO: 1935399 - RNA, 17 nt, Shigella flexneri 2a str. 2457T
cagaaacaaacgcaaaa

SEQ ID NO: 1935400 - RNA, 20 nt, Shigella flexneri 2a str. 2457T
cagaaccagggaaaaaagcc

SEQ ID NO: 1935401 - RNA, 17 nt, Shigella flexneri 2a str. 2457T
cagaacgcuuucgcaca

SEQ ID NO: 1935402 - RNA, 16 nt, Shigella flexneri 2a str. 2457T
cagaacuucugguaac

SEQ ID NO: 1935403 - RNA, 16 nt, Shigella flexneri 2a str. 2457T
cagaacguaaacgcag

SEQ ID NO: 1935404 - RNA, 16 nt, Shigella flexneri 2a str. 2457T
cagaacuaaaaucggu

SEQ ID NO: 1935405 - RNA, 16 nt, Shigella flexneri 2a str. 2457T
cagaagcacugccaga

SEQ ID NO: 1935406 - RNA, 24 nt, Shigella flexneri 2a str. 2457T
cagaagcacugccagaaucaaggu

SEQ ID NO: 1935407 - RNA, 15 nt, Shigella flexneri 2a str. 2457T
cagaagcaugaacau

SEQ ID NO: 1935408 - RNA, 23 nt, Shigella flexneri 2a str. 2457T
cagaagcaugaacauugcugcug

SEQ ID NO: 1935409 - RNA, 20 nt, Shigella flexneri 2a str. 2457T
cagaagcauuuuacauccug

SEQ ID NO: 1935410 - RNA, 17 nt, Shigella flexneri 2a str. 2457T
cagaagacgcuccagug

SEQ ID NO: 1935411 - RNA, 23 nt, Shigella flexneri 2a str. 2457T
cagaagacgcuccaguguggcca

SEQ ID NO: 1935412 - RNA, 18 nt, Shigella flexneri 2a str. 2457T
cagaagaugcguucaccu

SEQ ID NO: 1935413 - RNA, 15 nt, Shigella flexneri 2a str. 2457T
cagaagcgacaccag

SEQ ID NO: 1935414 - RNA, 19 nt, Shigella flexneri 2a str. 2457T
cagaaggagcuaauaauga

SEQ ID NO: 1935415 - RNA, 18 nt, Shigella flexneri 2a str. 2457T
cagaaggauaauuaaucu

SEQ ID NO: 1935416 - RNA, 22 nt, Shigella flexneri 2a str. 2457T
cagaaggauaauuaaucuuucu

SEQ ID NO: 1935417 - RNA, 13 nt, Shigella flexneri 2a str. 2457T
cagaagcugcagg

SEQ ID NO: 1935418 - RNA, 17 nt, Shigella flexneri 2a str. 2457T
cagaaguugcacccagu

SEQ ID NO: 1935419 - RNA, 16 nt, Shigella flexneri 2a str. 2457T
cagaaguugcucaagc

SEQ ID NO: 1935420 - RNA, 19 nt, Shigella flexneri 2a str. 2457T
cagaaguugcucaagcuga

SEQ ID NO: 1935421 - RNA, 15 nt, Shigella flexneri 2a str. 2457T
cagaaguugcaccca

SEQ ID NO: 1935422 - RNA, 20 nt, Shigella flexneri 2a str. 2457T
cagaaggccgcaguaaagcg

SEQ ID NO: 1935423 - RNA, 17 nt, Shigella flexneri 2a str. 2457T
cagaaggugacccguuu

SEQ ID NO: 1935424 - RNA, 14 nt, Shigella flexneri 2a str. 2457T
cagaaugcgcuuua

SEQ ID NO: 1935425 - RNA, 16 nt, Shigella flexneri 2a str. 2457T
cagaauggcaucugau

SEQ ID NO: 1935426 - RNA, 20 nt, Shigella flexneri 2a str. 2457T
cagaauuugaggaagcugcc

SEQ ID NO: 1935427 - RNA, 19 nt, Shigella flexneri 2a str. 2457T
cagaauuucgacuuuuuuc

SEQ ID NO: 1935428 - RNA, 16 nt, Shigella flexneri 2a str. 2457T
cagaauuacuggcaga

SEQ ID NO: 1935429 - RNA, 17 nt, Shigella flexneri 2a str. 2457T
cagaauuacuggcagau

SEQ ID NO: 1935430 - RNA, 19 nt, Shigella flexneri 2a str. 2457T
cagacaaucacaucacugc

SEQ ID NO: 1935431 - RNA, 22 nt, Shigella flexneri 2a str. 2457T
cagacaauggccugcgcgaccu

SEQ ID NO: 1935432 - RNA, 17 nt, Shigella flexneri 2a str. 2457T
cagacaaccgcucaaca

SEQ ID NO: 1935433 - RNA, 16 nt, Shigella flexneri 2a str. 2457T
cagaauuuucucaccc

SEQ ID NO: 1935434 - RNA, 19 nt, Shigella flexneri 2a str. 2457T
cagaauuuucucacccgca

SEQ ID NO: 1935435 - RNA, 20 nt, Shigella flexneri 2a str. 2457T
cagacaaaauccugccagcg

SEQ ID NO: 1935436 - RNA, 14 nt, Shigella flexneri 2a str. 2457T
cagacaaaacauac

SEQ ID NO: 1935437 - RNA, 19 nt, Shigella flexneri 2a str. 2457T
cagaauauucgaaaucugu

SEQ ID NO: 1935438 - RNA, 17 nt, Shigella flexneri 2a str. 2457T
cagaauauacggaauga

SEQ ID NO: 1935439 - RNA, 21 nt, Shigella flexneri 2a str. 2457T
cagaauauugccgaagaccag

SEQ ID NO: 1935440 - RNA, 13 nt, Shigella flexneri 2a str. 2457T
cagaaucaagucu

SEQ ID NO: 1935441 - RNA, 16 nt, Shigella flexneri 2a str. 2457T
cagaaucacgccaaca

SEQ ID NO: 1935442 - RNA, 15 nt, Shigella flexneri 2a str. 2457T
cagaaucaccucuuu

SEQ ID NO: 1935443 - RNA, 18 nt, Shigella flexneri 2a str. 2457T
cagaaucacgccaacaaa

SEQ ID NO: 1935444 - RNA, 21 nt, Shigella flexneri 2a str. 2457T
cagaauaacgugaucgaacau

SEQ ID NO: 1935445 - RNA, 15 nt, Shigella flexneri 2a str. 2457T
cagaauaacggcaga

SEQ ID NO: 1935446 - RNA, 22 nt, Shigella flexneri 2a str. 2457T
cagaauaacggcagaagcugca

SEQ ID NO: 1935447 - RNA, 23 nt, Shigella flexneri 2a str. 2457T
cagaauaccuugcugcuccagcg

SEQ ID NO: 1935448 - RNA, 21 nt, Shigella flexneri 2a str. 2457T
cagaauaccuugcugcuccag

SEQ ID NO: 1935449 - RNA, 18 nt, Shigella flexneri 2a str. 2457T
cagaauaccuugcugcuc

SEQ ID NO: 1935450 - RNA, 17 nt, Shigella flexneri 2a str. 2457T
cagaauccaggaaagcc

SEQ ID NO: 1935451 - RNA, 15 nt, Shigella flexneri 2a str. 2457T
cagaaucaggccauu

SEQ ID NO: 1935452 - RNA, 20 nt, Shigella flexneri 2a str. 2457T
cagaaugagacacuuuaucu

SEQ ID NO: 1935453 - RNA, 13 nt, Shigella flexneri 2a str. 2457T
cagaaucguaaag

SEQ ID NO: 1935454 - RNA, 14 nt, Shigella flexneri 2a str. 2457T
cagaaucgggcuga

SEQ ID NO: 1935455 - RNA, 19 nt, Shigella flexneri 2a str. 2457T
cagaccgcugacggcagcg

SEQ ID NO: 1935456 - RNA, 12 nt, Shigella flexneri 2a str. 2457T
cagaccggcaau

SEQ ID NO: 1935457 - RNA, 18 nt, Shigella flexneri 2a str. 2457T
cagaccuccguuuuucug

SEQ ID NO: 1935458 - RNA, 18 nt, Shigella flexneri 2a str. 2457T
cagacccuucaucgcucc

SEQ ID NO: 1935459 - RNA, 14 nt, Shigella flexneri 2a str. 2457T
cagacccauaauca

SEQ ID NO: 1935460 - RNA, 16 nt, Shigella flexneri 2a str. 2457T
cagaccauuccucuuc

SEQ ID NO: 1935461 - RNA, 17 nt, Shigella flexneri 2a str. 2457T
cagaccagcuaccacgc

SEQ ID NO: 1935462 - RNA, 20 nt, Shigella flexneri 2a str. 2457T
cagaccagcuaccacgccga

SEQ ID NO: 1935463 - RNA, 13 nt, Shigella flexneri 2a str. 2457T
cagaccaauggcu

SEQ ID NO: 1935464 - RNA, 13 nt, Shigella flexneri 2a str. 2457T
cagaccacuuucc

SEQ ID NO: 1935465 - RNA, 21 nt, Shigella flexneri 2a str. 2457T
cagaccagaaugcuccgcacc

SEQ ID NO: 1935466 - RNA, 14 nt, Shigella flexneri 2a str. 2457T
cagaccacuuuccu

SEQ ID NO: 1935467 - RNA, 12 nt, Shigella flexneri 2a str. 2457T
cagaccagcaaa

SEQ ID NO: 1935468 - RNA, 13 nt, Shigella flexneri 2a str. 2457T
cagacacuuuccc

SEQ ID NO: 1935469 - RNA, 15 nt, Shigella flexneri 2a str. 2457T
cagacagcacauuuc

SEQ ID NO: 1935470 - RNA, 20 nt, Shigella flexneri 2a str. 2457T
cagacacugcugauaaucca

SEQ ID NO: 1935471 - RNA, 23 nt, Shigella flexneri 2a str. 2457T
cagacaccagaaugguguuaacc

SEQ ID NO: 1935472 - RNA, 16 nt, Shigella flexneri 2a str. 2457T
cagacacgccgccaga

SEQ ID NO: 1935473 - RNA, 19 nt, Shigella flexneri 2a str. 2457T
cagacaccgauugccccug

SEQ ID NO: 1935474 - RNA, 21 nt, Shigella flexneri 2a str. 2457T
cagaccaauccagccggcaaa

SEQ ID NO: 1935475 - RNA, 20 nt, Shigella flexneri 2a str. 2457T
cagaccaaucccgccauaac

SEQ ID NO: 1935476 - RNA, 22 nt, Shigella flexneri 2a str. 2457T
cagaccaauaauccccaauacg

SEQ ID NO: 1935477 - RNA, 15 nt, Shigella flexneri 2a str. 2457T
cagacugaugugauc

SEQ ID NO: 1935478 - RNA, 16 nt, Shigella flexneri 2a str. 2457T
cagacugcucagcucc

SEQ ID NO: 1935479 - RNA, 15 nt, Shigella flexneri 2a str. 2457T
cagacuggagcacug

SEQ ID NO: 1935480 - RNA, 15 nt, Shigella flexneri 2a str. 2457T
cagacuugacgccuu

SEQ ID NO: 1935481 - RNA, 21 nt, Shigella flexneri 2a str. 2457T
cagacuugacgccuuuaccgc

SEQ ID NO: 1935482 - RNA, 15 nt, Shigella flexneri 2a str. 2457T
cagacuuuuugcggc

SEQ ID NO: 1935483 - RNA, 18 nt, Shigella flexneri 2a str. 2457T
cagacuuuuugcggcagc

SEQ ID NO: 1935484 - RNA, 15 nt, Shigella flexneri 2a str. 2457T
cagagaaacgccagc

SEQ ID NO: 1935485 - RNA, 20 nt, Shigella flexneri 2a str. 2457T
cagagaaaccacaucaaucc

SEQ ID NO: 1935486 - RNA, 19 nt, Shigella flexneri 2a str. 2457T
cagagaaagcaaaaauaaa

SEQ ID NO: 1935487 - RNA, 20 nt, Shigella flexneri 2a str. 2457T
cagagaaacgccagcagcag

SEQ ID NO: 1935488 - RNA, 13 nt, Shigella flexneri 2a str. 2457T
cagagaaagcaaa

SEQ ID NO: 1935489 - RNA, 22 nt, Shigella flexneri 2a str. 2457T
cagagaaucgggaaauaacauc

SEQ ID NO: 1935490 - RNA, 21 nt, Shigella flexneri 2a str. 2457T
cagagaauuuagcaaccaaaa

SEQ ID NO: 1935491 - RNA, 23 nt, Shigella flexneri 2a str. 2457T
cagagaucgccccggcaagaaau

SEQ ID NO: 1935492 - RNA, 19 nt, Shigella flexneri 2a str. 2457T
cagagaucagauaauauuu

SEQ ID NO: 1935493 - RNA, 13 nt, Shigella flexneri 2a str. 2457T
cagagaucuuuca

SEQ ID NO: 1935494 - RNA, 15 nt, Shigella flexneri 2a str. 2457T
cagagauucuuuucc

SEQ ID NO: 1935495 - RNA, 13 nt, Shigella flexneri 2a str. 2457T
cagagauuacuuu

SEQ ID NO: 1935496 - RNA, 19 nt, Shigella flexneri 2a str. 2457T
cagagauagaacugcauug

SEQ ID NO: 1935497 - RNA, 18 nt, Shigella flexneri 2a str. 2457T
cagagagcuuauccagca

SEQ ID NO: 1935498 - RNA, 18 nt, Shigella flexneri 2a str. 2457T
cagagagcgaauaucauu

SEQ ID NO: 1935499 - RNA, 14 nt, Shigella flexneri 2a str. 2457T
cagagagcgaauau

SEQ ID NO: 1935500 - RNA, 22 nt, Shigella flexneri 2a str. 2457T
cagagagccagccccacagcag

SEQ ID NO: 1935501 - RNA, 23 nt, Shigella flexneri 2a str. 2457T
cagagagacguucgcguacugcu

SEQ ID NO: 1935502 - RNA, 22 nt, Shigella flexneri 2a str. 2457T
cagagagaaccucaacaggcua

SEQ ID NO: 1935503 - RNA, 19 nt, Shigella flexneri 2a str. 2457T
cagagauuugcuccagcga

SEQ ID NO: 1935504 - RNA, 23 nt, Shigella flexneri 2a str. 2457T
cagagcaaaaaucgacagcagga

SEQ ID NO: 1935505 - RNA, 18 nt, Shigella flexneri 2a str. 2457T
cagacgguuuuucaaguc

SEQ ID NO: 1935506 - RNA, 16 nt, Shigella flexneri 2a str. 2457T
cagacgguacccgcug

SEQ ID NO: 1935507 - RNA, 18 nt, Shigella flexneri 2a str. 2457T
cagacguccggcgcugca

SEQ ID NO: 1935508 - RNA, 15 nt, Shigella flexneri 2a str. 2457T
cagacggcucaucuc

SEQ ID NO: 1935509 - RNA, 12 nt, Shigella flexneri 2a str. 2457T
cagacggcagaa

SEQ ID NO: 1935510 - RNA, 17 nt, Shigella flexneri 2a str. 2457T
cagacggcucaucaccc

SEQ ID NO: 1935511 - RNA, 12 nt, Shigella flexneri 2a str. 2457T
cagacggccaaa

SEQ ID NO: 1935512 - RNA, 15 nt, Shigella flexneri 2a str. 2457T
cagacuauaucgcuc

SEQ ID NO: 1935513 - RNA, 16 nt, Shigella flexneri 2a str. 2457T
cagacguuuuuucugc

SEQ ID NO: 1935514 - RNA, 15 nt, Shigella flexneri 2a str. 2457T
cagacguuuuuucug

SEQ ID NO: 1935515 - RNA, 13 nt, Shigella flexneri 2a str. 2457T
cagacguuuuuuc

SEQ ID NO: 1935516 - RNA, 21 nt, Shigella flexneri 2a str. 2457T
cagacucuuuuucgaaccaca

SEQ ID NO: 1935517 - RNA, 23 nt, Shigella flexneri 2a str. 2457T
cagacucuuuuucgaaccacaaa

SEQ ID NO: 1935518 - RNA, 14 nt, Shigella flexneri 2a str. 2457T
cagacucagucgcc

SEQ ID NO: 1935519 - RNA, 21 nt, Shigella flexneri 2a str. 2457T
cagacucauauaaaaaccggu

SEQ ID NO: 1935520 - RNA, 13 nt, Shigella flexneri 2a str. 2457T
cagacucaacagg

SEQ ID NO: 1935521 - RNA, 16 nt, Shigella flexneri 2a str. 2457T
cagacgcgcagcuuca

SEQ ID NO: 1935522 - RNA, 19 nt, Shigella flexneri 2a str. 2457T
cagacgcaguacgccaccu

SEQ ID NO: 1935523 - RNA, 20 nt, Shigella flexneri 2a str. 2457T
cagacgcgcagcuucacuuc

SEQ ID NO: 1935524 - RNA, 23 nt, Shigella flexneri 2a str. 2457T
cagacgcgcagcuucacuucuua

SEQ ID NO: 1935525 - RNA, 19 nt, Shigella flexneri 2a str. 2457T
cagacgcuuacguuuacgc

SEQ ID NO: 1935526 - RNA, 17 nt, Shigella flexneri 2a str. 2457T
cagacgcucguuaaaac

SEQ ID NO: 1935527 - RNA, 21 nt, Shigella flexneri 2a str. 2457T
cagacgcugaaucaacaggcg

SEQ ID NO: 1935528 - RNA, 23 nt, Shigella flexneri 2a str. 2457T
cagaccuuucgaacccaacccua

SEQ ID NO: 1935529 - RNA, 15 nt, Shigella flexneri 2a str. 2457T
cagaccuucugccag

SEQ ID NO: 1935530 - RNA, 23 nt, Shigella flexneri 2a str. 2457T
cagaccuucauagguaaacauca

SEQ ID NO: 1935531 - RNA, 22 nt, Shigella flexneri 2a str. 2457T
cagaccugcgucaccacaucca

SEQ ID NO: 1935532 - RNA, 17 nt, Shigella flexneri 2a str. 2457T
cagaccugcguucagca

SEQ ID NO: 1935533 - RNA, 20 nt, Shigella flexneri 2a str. 2457T
cagaccugaauuugcuccag

SEQ ID NO: 1935534 - RNA, 17 nt, Shigella flexneri 2a str. 2457T
cagaccugaauuugcuc

SEQ ID NO: 1935535 - RNA, 16 nt, Shigella flexneri 2a str. 2457T
cagacgaagucaacaa

SEQ ID NO: 1935536 - RNA, 13 nt, Shigella flexneri 2a str. 2457T
cagacgagggaaa

SEQ ID NO: 1935537 - RNA, 22 nt, Shigella flexneri 2a str. 2457T
cagacgauuacucgccuuucac

SEQ ID NO: 1935538 - RNA, 14 nt, Shigella flexneri 2a str. 2457T
cagauaguuaccgu

SEQ ID NO: 1935539 - RNA, 14 nt, Shigella flexneri 2a str. 2457T
cagauaguuagucu

SEQ ID NO: 1935540 - RNA, 18 nt, Shigella flexneri 2a str. 2457T
cagauaguugauuaauuu

SEQ ID NO: 1935541 - RNA, 17 nt, Shigella flexneri 2a str. 2457T
cagauaucgcggauaug

SEQ ID NO: 1935542 - RNA, 15 nt, Shigella flexneri 2a str. 2457T
cagaucaacauacuu

SEQ ID NO: 1935543 - RNA, 21 nt, Shigella flexneri 2a str. 2457T
cagauauucguucagauaggc

SEQ ID NO: 1935544 - RNA, 23 nt, Shigella flexneri 2a str. 2457T
cagauccagugcucauccuucag

SEQ ID NO: 1935545 - RNA, 22 nt, Shigella flexneri 2a str. 2457T
cagaucccaauucauuccugga

SEQ ID NO: 1935546 - RNA, 21 nt, Shigella flexneri 2a str. 2457T
cagaucccaauucauuccugg

SEQ ID NO: 1935547 - RNA, 15 nt, Shigella flexneri 2a str. 2457T
cagaucccuucaccu

SEQ ID NO: 1935548 - RNA, 15 nt, Shigella flexneri 2a str. 2457T
cagauccgcacccgc

SEQ ID NO: 1935549 - RNA, 13 nt, Shigella flexneri 2a str. 2457T
cagaucagccacu

SEQ ID NO: 1935550 - RNA, 17 nt, Shigella flexneri 2a str. 2457T
cagaucacgcaucaccc

SEQ ID NO: 1935551 - RNA, 13 nt, Shigella flexneri 2a str. 2457T
cagauaagacacu

SEQ ID NO: 1935552 - RNA, 22 nt, Shigella flexneri 2a str. 2457T
cagauaauggcuguugaaugcc

SEQ ID NO: 1935553 - RNA, 18 nt, Shigella flexneri 2a str. 2457T
cagauaaucaccugccuu

SEQ ID NO: 1935554 - RNA, 14 nt, Shigella flexneri 2a str. 2457T
cagauaacaccaua

SEQ ID NO: 1935555 - RNA, 23 nt, Shigella flexneri 2a str. 2457T
cagauaacccaggggucaguucc

SEQ ID NO: 1935556 - RNA, 14 nt, Shigella flexneri 2a str. 2457T
cagauaagacacug

SEQ ID NO: 1935557 - RNA, 23 nt, Shigella flexneri 2a str. 2457T
cagauagagcgccugcagacggc

SEQ ID NO: 1935558 - RNA, 20 nt, Shigella flexneri 2a str. 2457T
cagauacgauguuguagcau

SEQ ID NO: 1935559 - RNA, 20 nt, Shigella flexneri 2a str. 2457T
cagaggggaaguuuucggau

SEQ ID NO: 1935560 - RNA, 18 nt, Shigella flexneri 2a str. 2457T
cagagggcaaauucuuca

SEQ ID NO: 1935561 - RNA, 14 nt, Shigella flexneri 2a str. 2457T
cagaggucuuuucu

SEQ ID NO: 1935562 - RNA, 19 nt, Shigella flexneri 2a str. 2457T
cagaguauuuccagcucaa

SEQ ID NO: 1935563 - RNA, 13 nt, Shigella flexneri 2a str. 2457T
cagagucauuucu

SEQ ID NO: 1935564 - RNA, 18 nt, Shigella flexneri 2a str. 2457T
cagagucauuucugccuu

SEQ ID NO: 1935565 - RNA, 20 nt, Shigella flexneri 2a str. 2457T
cagauaaaaugcgaaaaaaa

SEQ ID NO: 1935566 - RNA, 20 nt, Shigella flexneri 2a str. 2457T
cagaguugagcaguccccac

SEQ ID NO: 1935567 - RNA, 12 nt, Shigella flexneri 2a str. 2457T
cagaguugcuga

SEQ ID NO: 1935568 - RNA, 17 nt, Shigella flexneri 2a str. 2457T
cagagugaaaaugccuc

SEQ ID NO: 1935569 - RNA, 18 nt, Shigella flexneri 2a str. 2457T
cagagugaaaaugccuca

SEQ ID NO: 1935570 - RNA, 20 nt, Shigella flexneri 2a str. 2457T
cagagcugaauaucacgggc

SEQ ID NO: 1935571 - RNA, 15 nt, Shigella flexneri 2a str. 2457T
cagagcugcguuuga

SEQ ID NO: 1935572 - RNA, 12 nt, Shigella flexneri 2a str. 2457T
cagagcuacaaa

SEQ ID NO: 1935573 - RNA, 22 nt, Shigella flexneri 2a str. 2457T
cagagcgauauccagugccaga

SEQ ID NO: 1935574 - RNA, 13 nt, Shigella flexneri 2a str. 2457T
cagagccugccaa

SEQ ID NO: 1935575 - RNA, 12 nt, Shigella flexneri 2a str. 2457T
cagagccugaau

SEQ ID NO: 1935576 - RNA, 14 nt, Shigella flexneri 2a str. 2457T
cagcaacggccaaa

SEQ ID NO: 1935577 - RNA, 22 nt, Shigella flexneri 2a str. 2457T
cagcaacgcuucguagaagcca

SEQ ID NO: 1935578 - RNA, 18 nt, Shigella flexneri 2a str. 2457T
cagcaacucuuuuuccug

SEQ ID NO: 1935579 - RNA, 24 nt, Shigella flexneri 2a str. 2457T
cagcaacucuuuuuccugcugcau

SEQ ID NO: 1935580 - RNA, 17 nt, Shigella flexneri 2a str. 2457T
cagcaagaccgcgacca

SEQ ID NO: 1935581 - RNA, 12 nt, Shigella flexneri 2a str. 2457T
cagcaagaacca

SEQ ID NO: 1935582 - RNA, 20 nt, Shigella flexneri 2a str. 2457T
cagcaacuguaguuguuaau

SEQ ID NO: 1935583 - RNA, 17 nt, Shigella flexneri 2a str. 2457T
cagcaagagcaaauaaa

SEQ ID NO: 1935584 - RNA, 19 nt, Shigella flexneri 2a str. 2457T
cagcaaggcgcuaaaagca

SEQ ID NO: 1935585 - RNA, 17 nt, Shigella flexneri 2a str. 2457T
cagcaacaaauaaccgc

SEQ ID NO: 1935586 - RNA, 13 nt, Shigella flexneri 2a str. 2457T
cagcaacaacagc

SEQ ID NO: 1935587 - RNA, 19 nt, Shigella flexneri 2a str. 2457T
cagcaacaagcccaccguu

SEQ ID NO: 1935588 - RNA, 21 nt, Shigella flexneri 2a str. 2457T
cagcaaauggcccauuuucuc

SEQ ID NO: 1935589 - RNA, 16 nt, Shigella flexneri 2a str. 2457T
cagcaaacuaucccag

SEQ ID NO: 1935590 - RNA, 18 nt, Shigella flexneri 2a str. 2457T
cagcaaacuaucccagcc

SEQ ID NO: 1935591 - RNA, 14 nt, Shigella flexneri 2a str. 2457T
cagcaaagcaaauu

SEQ ID NO: 1935592 - RNA, 20 nt, Shigella flexneri 2a str. 2457T
cagcaaagcgugcaaauaua

SEQ ID NO: 1935593 - RNA, 23 nt, Shigella flexneri 2a str. 2457T
cagcaaauaccccuugccacccg

SEQ ID NO: 1935594 - RNA, 16 nt, Shigella flexneri 2a str. 2457T
cagcaaauccacaacg

SEQ ID NO: 1935595 - RNA, 17 nt, Shigella flexneri 2a str. 2457T
cagcaaaaucaccauca

SEQ ID NO: 1935596 - RNA, 15 nt, Shigella flexneri 2a str. 2457T
cagcaacgcuucaac

SEQ ID NO: 1935597 - RNA, 23 nt, Shigella flexneri 2a str. 2457T
cagcaacgcuucaaccaacgcac

SEQ ID NO: 1935598 - RNA, 23 nt, Shigella flexneri 2a str. 2457T
cagcaaccugcuuaauaucccuu

SEQ ID NO: 1935599 - RNA, 17 nt, Shigella flexneri 2a str. 2457T
cagcaaccggaggucag

SEQ ID NO: 1935600 - RNA, 14 nt, Shigella flexneri 2a str. 2457T
cagcaaccagguaa

SEQ ID NO: 1935601 - RNA, 14 nt, Shigella flexneri 2a str. 2457T
cagcaccagcaacg

SEQ ID NO: 1935602 - RNA, 17 nt, Shigella flexneri 2a str. 2457T
cagcaccagagaacuga

SEQ ID NO: 1935603 - RNA, 12 nt, Shigella flexneri 2a str. 2457T
cagcaccagaua

SEQ ID NO: 1935604 - RNA, 14 nt, Shigella flexneri 2a str. 2457T
cagcaccagcuccg

SEQ ID NO: 1935605 - RNA, 14 nt, Shigella flexneri 2a str. 2457T
cagcaccaccgccc

SEQ ID NO: 1935606 - RNA, 14 nt, Shigella flexneri 2a str. 2457T
cagcaccagagaac

SEQ ID NO: 1935607 - RNA, 13 nt, Shigella flexneri 2a str. 2457T
cagcaccacuucc

SEQ ID NO: 1935608 - RNA, 19 nt, Shigella flexneri 2a str. 2457T
cagcacaucagccagaugc

SEQ ID NO: 1935609 - RNA, 16 nt, Shigella flexneri 2a str. 2457T
cagcaauaaucagaug

SEQ ID NO: 1935610 - RNA, 18 nt, Shigella flexneri 2a str. 2457T
cagcaauaaucagauggc

SEQ ID NO: 1935611 - RNA, 12 nt, Shigella flexneri 2a str. 2457T
cagcaaucacug

SEQ ID NO: 1935612 - RNA, 12 nt, Shigella flexneri 2a str. 2457T
cagcaaucccaa

SEQ ID NO: 1935613 - RNA, 14 nt, Shigella flexneri 2a str. 2457T
cagcaaucccaaaa

SEQ ID NO: 1935614 - RNA, 13 nt, Shigella flexneri 2a str. 2457T
cagcaauccccag

SEQ ID NO: 1935615 - RNA, 18 nt, Shigella flexneri 2a str. 2457T
cagcaaucucuucaagcu

SEQ ID NO: 1935616 - RNA, 23 nt, Shigella flexneri 2a str. 2457T
cagcaaucgaccaggccaucagc

SEQ ID NO: 1935617 - RNA, 21 nt, Shigella flexneri 2a str. 2457T
cagcaaucgcgccagccguuu

SEQ ID NO: 1935618 - RNA, 19 nt, Shigella flexneri 2a str. 2457T
cagcaauccccagacaaaa

SEQ ID NO: 1935619 - RNA, 14 nt, Shigella flexneri 2a str. 2457T
cagcaauguuucuc

SEQ ID NO: 1935620 - RNA, 15 nt, Shigella flexneri 2a str. 2457T
cagcaauggaaaaag

SEQ ID NO: 1935621 - RNA, 17 nt, Shigella flexneri 2a str. 2457T
cagcaaugcaggcaccu

SEQ ID NO: 1935622 - RNA, 13 nt, Shigella flexneri 2a str. 2457T
cagcaauggaaaa

SEQ ID NO: 1935623 - RNA, 22 nt, Shigella flexneri 2a str. 2457T
cagcaauuuaugaggaugcaga

SEQ ID NO: 1935624 - RNA, 18 nt, Shigella flexneri 2a str. 2457T
cagcaauugucgcagaag

SEQ ID NO: 1935625 - RNA, 23 nt, Shigella flexneri 2a str. 2457T
cagcaauuuacgcuuuucuuccg

SEQ ID NO: 1935626 - RNA, 16 nt, Shigella flexneri 2a str. 2457T
cagcaauguuucucug

SEQ ID NO: 1935627 - RNA, 15 nt, Shigella flexneri 2a str. 2457T
cagcacacauaagag

SEQ ID NO: 1935628 - RNA, 21 nt, Shigella flexneri 2a str. 2457T
cagcacaccacaucgccgacc

SEQ ID NO: 1935629 - RNA, 16 nt, Shigella flexneri 2a str. 2457T
cagauuuugccagcau

SEQ ID NO: 1935630 - RNA, 22 nt, Shigella flexneri 2a str. 2457T
cagcaaaaauuugcgcgaugcc

SEQ ID NO: 1935631 - RNA, 15 nt, Shigella flexneri 2a str. 2457T
cagcaaaacacccgc

SEQ ID NO: 1935632 - RNA, 20 nt, Shigella flexneri 2a str. 2457T
cagauugccgugaaccugcg

SEQ ID NO: 1935633 - RNA, 13 nt, Shigella flexneri 2a str. 2457T
cagauuguugauu

SEQ ID NO: 1935634 - RNA, 20 nt, Shigella flexneri 2a str. 2457T
cagauuuaacggcagcaagg

SEQ ID NO: 1935635 - RNA, 20 nt, Shigella flexneri 2a str. 2457T
cagauuguugauuaacaggc

SEQ ID NO: 1935636 - RNA, 23 nt, Shigella flexneri 2a str. 2457T
cagauuuauuuacuucugcugca

SEQ ID NO: 1935637 - RNA, 16 nt, Shigella flexneri 2a str. 2457T
cagauuuauaaaagaa

SEQ ID NO: 1935638 - RNA, 17 nt, Shigella flexneri 2a str. 2457T
cagauuuauaaaagaaa

SEQ ID NO: 1935639 - RNA, 19 nt, Shigella flexneri 2a str. 2457T
cagauguugucucagauuc

SEQ ID NO: 1935640 - RNA, 23 nt, Shigella flexneri 2a str. 2457T
cagauguugucucagauucagau

SEQ ID NO: 1935641 - RNA, 20 nt, Shigella flexneri 2a str. 2457T
cagaugugcaccuuuuccac

SEQ ID NO: 1935642 - RNA, 18 nt, Shigella flexneri 2a str. 2457T
cagauguaaacuuuuucg

SEQ ID NO: 1935643 - RNA, 17 nt, Shigella flexneri 2a str. 2457T
cagauguagcucaccuu

SEQ ID NO: 1935644 - RNA, 15 nt, Shigella flexneri 2a str. 2457T
cagauguaaugagaa

SEQ ID NO: 1935645 - RNA, 21 nt, Shigella flexneri 2a str. 2457T
cagauucagauuaugucgcuc

SEQ ID NO: 1935646 - RNA, 12 nt, Shigella flexneri 2a str. 2457T
cagauucaggcg

SEQ ID NO: 1935647 - RNA, 21 nt, Shigella flexneri 2a str. 2457T
cagauuauaagccaguaagac

SEQ ID NO: 1935648 - RNA, 23 nt, Shigella flexneri 2a str. 2457T
cagauucucauauaucccuucca

SEQ ID NO: 1935649 - RNA, 17 nt, Shigella flexneri 2a str. 2457T
cagauucggguucaugu

SEQ ID NO: 1935650 - RNA, 16 nt, Shigella flexneri 2a str. 2457T
cagauugauaaaaaua

SEQ ID NO: 1935651 - RNA, 18 nt, Shigella flexneri 2a str. 2457T
cagauugcagacaaagug

SEQ ID NO: 1935652 - RNA, 15 nt, Shigella flexneri 2a str. 2457T
cagaucgcggcccac

SEQ ID NO: 1935653 - RNA, 14 nt, Shigella flexneri 2a str. 2457T
cagaucggcagggc

SEQ ID NO: 1935654 - RNA, 14 nt, Shigella flexneri 2a str. 2457T
cagaucgccaauau

SEQ ID NO: 1935655 - RNA, 18 nt, Shigella flexneri 2a str. 2457T
cagauccgccauuucucc

SEQ ID NO: 1935656 - RNA, 20 nt, Shigella flexneri 2a str. 2457T
cagauccgccauuucuccuc

SEQ ID NO: 1935657 - RNA, 22 nt, Shigella flexneri 2a str. 2457T
cagaucuuucacgaacacagug

SEQ ID NO: 1935658 - RNA, 22 nt, Shigella flexneri 2a str. 2457T
cagaucuaauguuggugugaca

SEQ ID NO: 1935659 - RNA, 21 nt, Shigella flexneri 2a str. 2457T
cagaucgguaauugaucucac

SEQ ID NO: 1935660 - RNA, 21 nt, Shigella flexneri 2a str. 2457T
cagaugauuagucuuuaucug

SEQ ID NO: 1935661 - RNA, 15 nt, Shigella flexneri 2a str. 2457T
cagaugaauagcgca

SEQ ID NO: 1935662 - RNA, 20 nt, Shigella flexneri 2a str. 2457T
cagaugaacgagucaacgcu

SEQ ID NO: 1935663 - RNA, 14 nt, Shigella flexneri 2a str. 2457T
cagaucuucaucac

SEQ ID NO: 1935664 - RNA, 19 nt, Shigella flexneri 2a str. 2457T
cagaugcucuuuucugaag

SEQ ID NO: 1935665 - RNA, 15 nt, Shigella flexneri 2a str. 2457T
cagaugcgcuucaag

SEQ ID NO: 1935666 - RNA, 15 nt, Shigella flexneri 2a str. 2457T
cagaugccuugccaa

SEQ ID NO: 1935667 - RNA, 15 nt, Shigella flexneri 2a str. 2457T
cagccaaauccagcg

SEQ ID NO: 1935668 - RNA, 15 nt, Shigella flexneri 2a str. 2457T
cagccaaccacauga

SEQ ID NO: 1935669 - RNA, 14 nt, Shigella flexneri 2a str. 2457T
cagccaaaaaugac

SEQ ID NO: 1935670 - RNA, 17 nt, Shigella flexneri 2a str. 2457T
cagccaaugcaggcauc

SEQ ID NO: 1935671 - RNA, 15 nt, Shigella flexneri 2a str. 2457T
cagccacaccaauca

SEQ ID NO: 1935672 - RNA, 12 nt, Shigella flexneri 2a str. 2457T
cagccacagggu

SEQ ID NO: 1935673 - RNA, 22 nt, Shigella flexneri 2a str. 2457T
cagccaccgcguuccacgggga

SEQ ID NO: 1935674 - RNA, 14 nt, Shigella flexneri 2a str. 2457T
cagccaccgccagc

SEQ ID NO: 1935675 - RNA, 20 nt, Shigella flexneri 2a str. 2457T
cagcaugugguuaccaucaa

SEQ ID NO: 1935676 - RNA, 14 nt, Shigella flexneri 2a str. 2457T
cagcauguuuauau

SEQ ID NO: 1935677 - RNA, 15 nt, Shigella flexneri 2a str. 2457T
cagcauuagcaaugc

SEQ ID NO: 1935678 - RNA, 18 nt, Shigella flexneri 2a str. 2457T
cagcauuauuuuuaaaca

SEQ ID NO: 1935679 - RNA, 23 nt, Shigella flexneri 2a str. 2457T
cagcauuauuuuuaaacaucaaa

SEQ ID NO: 1935680 - RNA, 15 nt, Shigella flexneri 2a str. 2457T
cagcauuccagauac

SEQ ID NO: 1935681 - RNA, 17 nt, Shigella flexneri 2a str. 2457T
cagcauucccgccagcg

SEQ ID NO: 1935682 - RNA, 16 nt, Shigella flexneri 2a str. 2457T
cagcauuccagauacg

SEQ ID NO: 1935683 - RNA, 20 nt, Shigella flexneri 2a str. 2457T
cagcauuccagauacgaccg

SEQ ID NO: 1935684 - RNA, 20 nt, Shigella flexneri 2a str. 2457T
cagcauucccgccagcggcc

SEQ ID NO: 1935685 - RNA, 17 nt, Shigella flexneri 2a str. 2457T
cagcauucucaucacca

SEQ ID NO: 1935686 - RNA, 19 nt, Shigella flexneri 2a str. 2457T
cagcauucucaucaccauu

SEQ ID NO: 1935687 - RNA, 15 nt, Shigella flexneri 2a str. 2457T
cagcauucucggccc

SEQ ID NO: 1935688 - RNA, 23 nt, Shigella flexneri 2a str. 2457T
cagcauuucucuacgcccucgau

SEQ ID NO: 1935689 - RNA, 23 nt, Shigella flexneri 2a str. 2457T
cagcauugcucaccgccagcauc

SEQ ID NO: 1935690 - RNA, 14 nt, Shigella flexneri 2a str. 2457T
cagcauuuaagcau

SEQ ID NO: 1935691 - RNA, 21 nt, Shigella flexneri 2a str. 2457T
cagcauugucucccacaugcu

SEQ ID NO: 1935692 - RNA, 15 nt, Shigella flexneri 2a str. 2457T
cagcauaccuucaca

SEQ ID NO: 1935693 - RNA, 21 nt, Shigella flexneri 2a str. 2457T
cagcauacugauaucauuaaa

SEQ ID NO: 1935694 - RNA, 15 nt, Shigella flexneri 2a str. 2457T
cagcauaaucaccag

SEQ ID NO: 1935695 - RNA, 16 nt, Shigella flexneri 2a str. 2457T
cagcauaaucaccauc

SEQ ID NO: 1935696 - RNA, 18 nt, Shigella flexneri 2a str. 2457T
cagcauaaucaccaguac

SEQ ID NO: 1935697 - RNA, 17 nt, Shigella flexneri 2a str. 2457T
cagcauaccgccgagga

SEQ ID NO: 1935698 - RNA, 19 nt, Shigella flexneri 2a str. 2457T
cagcauaaucaccaucagc

SEQ ID NO: 1935699 - RNA, 17 nt, Shigella flexneri 2a str. 2457T
cagcauaaucaccauca

SEQ ID NO: 1935700 - RNA, 14 nt, Shigella flexneri 2a str. 2457T
cagcaucaucgcaa

SEQ ID NO: 1935701 - RNA, 22 nt, Shigella flexneri 2a str. 2457T
cagcaucauaccuccgcaauau

SEQ ID NO: 1935702 - RNA, 13 nt, Shigella flexneri 2a str. 2457T
cagcaucccaccu

SEQ ID NO: 1935703 - RNA, 21 nt, Shigella flexneri 2a str. 2457T
cagcauauaguuuugcauggc

SEQ ID NO: 1935704 - RNA, 15 nt, Shigella flexneri 2a str. 2457T
cagcaucacgcccgc

SEQ ID NO: 1935705 - RNA, 15 nt, Shigella flexneri 2a str. 2457T
cagcaugcacccuca

SEQ ID NO: 1935706 - RNA, 21 nt, Shigella flexneri 2a str. 2457T
cagcaucucgcgcucuucuuc

SEQ ID NO: 1935707 - RNA, 15 nt, Shigella flexneri 2a str. 2457T
cagcaugaaacgcca

SEQ ID NO: 1935708 - RNA, 16 nt, Shigella flexneri 2a str. 2457T
cagcaugaccaccggg

SEQ ID NO: 1935709 - RNA, 20 nt, Shigella flexneri 2a str. 2457T
cagcaucuccugcaacaggu

SEQ ID NO: 1935710 - RNA, 19 nt, Shigella flexneri 2a str. 2457T
cagcaucgucaucagcucc

SEQ ID NO: 1935711 - RNA, 16 nt, Shigella flexneri 2a str. 2457T
cagcaucgucaucagc

SEQ ID NO: 1935712 - RNA, 16 nt, Shigella flexneri 2a str. 2457T
cagcaucccggcagcc

SEQ ID NO: 1935713 - RNA, 19 nt, Shigella flexneri 2a str. 2457T
cagccauaccgggaucagg

SEQ ID NO: 1935714 - RNA, 11 nt, Shigella flexneri 2a str. 2457T
cagccaucuga

SEQ ID NO: 1935715 - RNA, 12 nt, Shigella flexneri 2a str. 2457T
cagccaucaucc

SEQ ID NO: 1935716 - RNA, 20 nt, Shigella flexneri 2a str. 2457T
cagccauugcuaccgcuucg

SEQ ID NO: 1935717 - RNA, 12 nt, Shigella flexneri 2a str. 2457T
cagcccaaagca

SEQ ID NO: 1935718 - RNA, 13 nt, Shigella flexneri 2a str. 2457T
cagcccaaccacg

SEQ ID NO: 1935719 - RNA, 14 nt, Shigella flexneri 2a str. 2457T
cagcccaaucaucg

SEQ ID NO: 1935720 - RNA, 20 nt, Shigella flexneri 2a str. 2457T
cagcccaaagcagaguugcu

SEQ ID NO: 1935721 - RNA, 22 nt, Shigella flexneri 2a str. 2457T
cagcccaaucaucgcggcacac

SEQ ID NO: 1935722 - RNA, 12 nt, Shigella flexneri 2a str. 2457T
cagcccagcccu

SEQ ID NO: 1935723 - RNA, 14 nt, Shigella flexneri 2a str. 2457T
cagcccagacaaau

SEQ ID NO: 1935724 - RNA, 12 nt, Shigella flexneri 2a str. 2457T
cagcccaugaau

SEQ ID NO: 1935725 - RNA, 13 nt, Shigella flexneri 2a str. 2457T
cagccccacagca

SEQ ID NO: 1935726 - RNA, 14 nt, Shigella flexneri 2a str. 2457T
cagccccacagcag

SEQ ID NO: 1935727 - RNA, 17 nt, Shigella flexneri 2a str. 2457T
cagccccagagccugaa

SEQ ID NO: 1935728 - RNA, 12 nt, Shigella flexneri 2a str. 2457T
cagccccagcac

SEQ ID NO: 1935729 - RNA, 20 nt, Shigella flexneri 2a str. 2457T
cagccccgccgggaucugga

SEQ ID NO: 1935730 - RNA, 15 nt, Shigella flexneri 2a str. 2457T
cagccccgcgcggcg

SEQ ID NO: 1935731 - RNA, 19 nt, Shigella flexneri 2a str. 2457T
cagccaguucgagaaaaau

SEQ ID NO: 1935732 - RNA, 20 nt, Shigella flexneri 2a str. 2457T
cagccauaaagaaaucaccu

SEQ ID NO: 1935733 - RNA, 19 nt, Shigella flexneri 2a str. 2457T
cagccagcgucgcacccgg

SEQ ID NO: 1935734 - RNA, 14 nt, Shigella flexneri 2a str. 2457T
cagccagcgcgccu

SEQ ID NO: 1935735 - RNA, 12 nt, Shigella flexneri 2a str. 2457T
cagccacugcgg

SEQ ID NO: 1935736 - RNA, 15 nt, Shigella flexneri 2a str. 2457T
cagccagacgccagc

SEQ ID NO: 1935737 - RNA, 16 nt, Shigella flexneri 2a str. 2457T
cagccagagccaccaa

SEQ ID NO: 1935738 - RNA, 20 nt, Shigella flexneri 2a str. 2457T
cagccagagccaccaacucu

SEQ ID NO: 1935739 - RNA, 15 nt, Shigella flexneri 2a str. 2457T
cagccagcagcgaau

SEQ ID NO: 1935740 - RNA, 15 nt, Shigella flexneri 2a str. 2457T
cagccagcaccaggc

SEQ ID NO: 1935741 - RNA, 12 nt, Shigella flexneri 2a str. 2457T
cagccagcacug

SEQ ID NO: 1935742 - RNA, 15 nt, Shigella flexneri 2a str. 2457T
cagccagcacugccg

SEQ ID NO: 1935743 - RNA, 13 nt, Shigella flexneri 2a str. 2457T
cagcaguucacgc

SEQ ID NO: 1935744 - RNA, 16 nt, Shigella flexneri 2a str. 2457T
cagcaguucacgcagc

SEQ ID NO: 1935745 - RNA, 23 nt, Shigella flexneri 2a str. 2457T
cagcaguccagcgcgaacgugac

SEQ ID NO: 1935746 - RNA, 14 nt, Shigella flexneri 2a str. 2457T
cagcaguucugcca

SEQ ID NO: 1935747 - RNA, 13 nt, Shigella flexneri 2a str. 2457T
cagcaggugucca

SEQ ID NO: 1935748 - RNA, 16 nt, Shigella flexneri 2a str. 2457T
cagcaguaaaccaccc

SEQ ID NO: 1935749 - RNA, 23 nt, Shigella flexneri 2a str. 2457T
cagcaggcgaugaaaaaccguau

SEQ ID NO: 1935750 - RNA, 12 nt, Shigella flexneri 2a str. 2457T
cagcagggccug

SEQ ID NO: 1935751 - RNA, 14 nt, Shigella flexneri 2a str. 2457T
cagcagggccugaa

SEQ ID NO: 1935752 - RNA, 16 nt, Shigella flexneri 2a str. 2457T
cagcagggccugaagg

SEQ ID NO: 1935753 - RNA, 19 nt, Shigella flexneri 2a str. 2457T
cagcagcucaucaagcugu

SEQ ID NO: 1935754 - RNA, 16 nt, Shigella flexneri 2a str. 2457T
cagcagcggagaaaug

SEQ ID NO: 1935755 - RNA, 18 nt, Shigella flexneri 2a str. 2457T
cagcagcggcucggucag

SEQ ID NO: 1935756 - RNA, 16 nt, Shigella flexneri 2a str. 2457T
cagcagcagacagccu

SEQ ID NO: 1935757 - RNA, 11 nt, Shigella flexneri 2a str. 2457T
cagcagcagcg

SEQ ID NO: 1935758 - RNA, 13 nt, Shigella flexneri 2a str. 2457T
cagcagcgccgcg

SEQ ID NO: 1935759 - RNA, 19 nt, Shigella flexneri 2a str. 2457T
cagcagcgaaucagcccag

SEQ ID NO: 1935760 - RNA, 23 nt, Shigella flexneri 2a str. 2457T
cagcagccugcgcuucuuuuuac

SEQ ID NO: 1935761 - RNA, 19 nt, Shigella flexneri 2a str. 2457T
cagcagccgcgcuuucuuc

SEQ ID NO: 1935762 - RNA, 22 nt, Shigella flexneri 2a str. 2457T
cagcagccgcgcuuucuucuuc

SEQ ID NO: 1935763 - RNA, 16 nt, Shigella flexneri 2a str. 2457T
cagcacuacaccccag

SEQ ID NO: 1935764 - RNA, 17 nt, Shigella flexneri 2a str. 2457T
cagcacuccugccacca

SEQ ID NO: 1935765 - RNA, 20 nt, Shigella flexneri 2a str. 2457T
cagcacgucuuccauugccg

SEQ ID NO: 1935766 - RNA, 23 nt, Shigella flexneri 2a str. 2457T
cagcacgucgccuuuuacggcuu

SEQ ID NO: 1935767 - RNA, 13 nt, Shigella flexneri 2a str. 2457T
cagcacggagaga

SEQ ID NO: 1935768 - RNA, 14 nt, Shigella flexneri 2a str. 2457T
cagcacggagagac

SEQ ID NO: 1935769 - RNA, 18 nt, Shigella flexneri 2a str. 2457T
cagcagauugcgaauaug

SEQ ID NO: 1935770 - RNA, 15 nt, Shigella flexneri 2a str. 2457T
cagcagagcaaaaau

SEQ ID NO: 1935771 - RNA, 16 nt, Shigella flexneri 2a str. 2457T
cagcagagcaugguua

SEQ ID NO: 1935772 - RNA, 15 nt, Shigella flexneri 2a str. 2457T
cagcagaccagcaaa

SEQ ID NO: 1935773 - RNA, 16 nt, Shigella flexneri 2a str. 2457T
cagcagaccagcaaaa

SEQ ID NO: 1935774 - RNA, 20 nt, Shigella flexneri 2a str. 2457T
cagcacuucacccaucgcca

SEQ ID NO: 1935775 - RNA, 17 nt, Shigella flexneri 2a str. 2457T
cagcacuuccagcuccg

SEQ ID NO: 1935776 - RNA, 20 nt, Shigella flexneri 2a str. 2457T
cagcacuucgccaucugcca

SEQ ID NO: 1935777 - RNA, 22 nt, Shigella flexneri 2a str. 2457T
cagcacuuaucucuuccgcauu

SEQ ID NO: 1935778 - RNA, 15 nt, Shigella flexneri 2a str. 2457T
cagcacugcuuaaau

SEQ ID NO: 1935779 - RNA, 14 nt, Shigella flexneri 2a str. 2457T
cagcaccgcagaga

SEQ ID NO: 1935780 - RNA, 14 nt, Shigella flexneri 2a str. 2457T
cagcacccugaguu

SEQ ID NO: 1935781 - RNA, 17 nt, Shigella flexneri 2a str. 2457T
cagcaccgcgacaauca

SEQ ID NO: 1935782 - RNA, 14 nt, Shigella flexneri 2a str. 2457T
cagcaccgucaaac

SEQ ID NO: 1935783 - RNA, 15 nt, Shigella flexneri 2a str. 2457T
cagcaccugcuugaa

SEQ ID NO: 1935784 - RNA, 19 nt, Shigella flexneri 2a str. 2457T
cagcaccugcuugaacgca

SEQ ID NO: 1935785 - RNA, 17 nt, Shigella flexneri 2a str. 2457T
cagcacgacuauuauga

SEQ ID NO: 1935786 - RNA, 14 nt, Shigella flexneri 2a str. 2457T
cagcaccuuuugcu

SEQ ID NO: 1935787 - RNA, 15 nt, Shigella flexneri 2a str. 2457T
cagcacgccccggcg

SEQ ID NO: 1935788 - RNA, 23 nt, Shigella flexneri 2a str. 2457T
cagcacgaaugucguuuccaugg

SEQ ID NO: 1935789 - RNA, 15 nt, Shigella flexneri 2a str. 2457T
cagcacgcauucgaa

SEQ ID NO: 1935790 - RNA, 18 nt, Shigella flexneri 2a str. 2457T
cagcccggcauguuucaa

SEQ ID NO: 1935791 - RNA, 13 nt, Shigella flexneri 2a str. 2457T
cagcccugccagg

SEQ ID NO: 1935792 - RNA, 21 nt, Shigella flexneri 2a str. 2457T
cagcccugccaggucaucauu

SEQ ID NO: 1935793 - RNA, 20 nt, Shigella flexneri 2a str. 2457T
cagcccgucucagcgccgcu

SEQ ID NO: 1935794 - RNA, 16 nt, Shigella flexneri 2a str. 2457T
cagccgaacagcgcca

SEQ ID NO: 1935795 - RNA, 15 nt, Shigella flexneri 2a str. 2457T
cagccgcacaccugc

SEQ ID NO: 1935796 - RNA, 19 nt, Shigella flexneri 2a str. 2457T
cagccgcacaccugcauuc

SEQ ID NO: 1935797 - RNA, 20 nt, Shigella flexneri 2a str. 2457T
cagccgcaaaccuggcaaca

SEQ ID NO: 1935798 - RNA, 13 nt, Shigella flexneri 2a str. 2457T
cagccgccagaaa

SEQ ID NO: 1935799 - RNA, 22 nt, Shigella flexneri 2a str. 2457T
cagccgccagggcaagcgccua

SEQ ID NO: 1935800 - RNA, 13 nt, Shigella flexneri 2a str. 2457T
cagccgcgcgcuu

SEQ ID NO: 1935801 - RNA, 17 nt, Shigella flexneri 2a str. 2457T
cagccgguauccagcgc

SEQ ID NO: 1935802 - RNA, 22 nt, Shigella flexneri 2a str. 2457T
cagccggguaagaaaagcugca

SEQ ID NO: 1935803 - RNA, 15 nt, Shigella flexneri 2a str. 2457T
cagccgcuaccagcg

SEQ ID NO: 1935804 - RNA, 13 nt, Shigella flexneri 2a str. 2457T
cagccgcgucuga

SEQ ID NO: 1935805 - RNA, 18 nt, Shigella flexneri 2a str. 2457T
cagccgcuuuugcgcgua

SEQ ID NO: 1935806 - RNA, 21 nt, Shigella flexneri 2a str. 2457T
cagccggacccacacccccgc

SEQ ID NO: 1935807 - RNA, 13 nt, Shigella flexneri 2a str. 2457T
cagccggcaaagu

SEQ ID NO: 1935808 - RNA, 20 nt, Shigella flexneri 2a str. 2457T
cagccgcuaccagcgcggca

SEQ ID NO: 1935809 - RNA, 20 nt, Shigella flexneri 2a str. 2457T
cagccggagguguucauaau

SEQ ID NO: 1935810 - RNA, 17 nt, Shigella flexneri 2a str. 2457T
cagcgacugcgggcgca

SEQ ID NO: 1935811 - RNA, 20 nt, Shigella flexneri 2a str. 2457T
cagcgagaagucggcuuuua

SEQ ID NO: 1935812 - RNA, 15 nt, Shigella flexneri 2a str. 2457T
cagcgaacaccagca

SEQ ID NO: 1935813 - RNA, 22 nt, Shigella flexneri 2a str. 2457T
cagcgaagccagcucccacagu

SEQ ID NO: 1935814 - RNA, 20 nt, Shigella flexneri 2a str. 2457T
cagcgaaaucaccgccacca

SEQ ID NO: 1935815 - RNA, 18 nt, Shigella flexneri 2a str. 2457T
cagcgaaauacagguccc

SEQ ID NO: 1935816 - RNA, 22 nt, Shigella flexneri 2a str. 2457T
cagcgaaauacagguccccgcu

SEQ ID NO: 1935817 - RNA, 20 nt, Shigella flexneri 2a str. 2457T
cagcgaaaaagucccuuccc

SEQ ID NO: 1935818 - RNA, 22 nt, Shigella flexneri 2a str. 2457T
cagcgaaaaagucccuucccag

SEQ ID NO: 1935819 - RNA, 14 nt, Shigella flexneri 2a str. 2457T
cagcgacaccagcc

SEQ ID NO: 1935820 - RNA, 17 nt, Shigella flexneri 2a str. 2457T
cagcgacaccagccauc

SEQ ID NO: 1935821 - RNA, 18 nt, Shigella flexneri 2a str. 2457T
cagcgaagcccacgccgc

SEQ ID NO: 1935822 - RNA, 22 nt, Shigella flexneri 2a str. 2457T
cagcgaagcccacgccgcccag

SEQ ID NO: 1935823 - RNA, 21 nt, Shigella flexneri 2a str. 2457T
cagcgaaucagcccagcccug

SEQ ID NO: 1935824 - RNA, 15 nt, Shigella flexneri 2a str. 2457T
cagcgaauuccaguu

SEQ ID NO: 1935825 - RNA, 14 nt, Shigella flexneri 2a str. 2457T
cagcgaauccagca

SEQ ID NO: 1935826 - RNA, 12 nt, Shigella flexneri 2a str. 2457T
cagccuuuuucu

SEQ ID NO: 1935827 - RNA, 18 nt, Shigella flexneri 2a str. 2457T
cagccuuucucagagacu

SEQ ID NO: 1935828 - RNA, 16 nt, Shigella flexneri 2a str. 2457T
cagccuuuccggcaau

SEQ ID NO: 1935829 - RNA, 19 nt, Shigella flexneri 2a str. 2457T
cagccuucuucauccagcg

SEQ ID NO: 1935830 - RNA, 19 nt, Shigella flexneri 2a str. 2457T
cagccuucauucaggcauu

SEQ ID NO: 1935831 - RNA, 12 nt, Shigella flexneri 2a str. 2457T
cagccuucuuca

SEQ ID NO: 1935832 - RNA, 15 nt, Shigella flexneri 2a str. 2457T
cagccuuaaacucaa

SEQ ID NO: 1935833 - RNA, 17 nt, Shigella flexneri 2a str. 2457T
cagccugugccugagcc

SEQ ID NO: 1935834 - RNA, 14 nt, Shigella flexneri 2a str. 2457T
cagccuuaaacuca

SEQ ID NO: 1935835 - RNA, 19 nt, Shigella flexneri 2a str. 2457T
cagccuguuccagacgcug

SEQ ID NO: 1935836 - RNA, 20 nt, Shigella flexneri 2a str. 2457T
cagccugauacaggaaggcc

SEQ ID NO: 1935837 - RNA, 19 nt, Shigella flexneri 2a str. 2457T
cagccugacagcacgcccc

SEQ ID NO: 1935838 - RNA, 16 nt, Shigella flexneri 2a str. 2457T
cagccugaccgcacac

SEQ ID NO: 1935839 - RNA, 21 nt, Shigella flexneri 2a str. 2457T
cagccugaccgcacaccccgg

SEQ ID NO: 1935840 - RNA, 22 nt, Shigella flexneri 2a str. 2457T
cagccugaccgcacaccccggc

SEQ ID NO: 1935841 - RNA, 15 nt, Shigella flexneri 2a str. 2457T
cagccucccauuucc

SEQ ID NO: 1935842 - RNA, 19 nt, Shigella flexneri 2a str. 2457T
cagccuauaacgaaacccg

SEQ ID NO: 1935843 - RNA, 22 nt, Shigella flexneri 2a str. 2457T
cagccuaagccauuuaacucac

SEQ ID NO: 1935844 - RNA, 17 nt, Shigella flexneri 2a str. 2457T
cagccuacaaaaacuca

SEQ ID NO: 1935845 - RNA, 21 nt, Shigella flexneri 2a str. 2457T
cagccuacaaaaacucauaaa

SEQ ID NO: 1935846 - RNA, 18 nt, Shigella flexneri 2a str. 2457T
cagcgccgcgccacuacu

SEQ ID NO: 1935847 - RNA, 23 nt, Shigella flexneri 2a str. 2457T
cagcgccgcuuuccaggcugugu

SEQ ID NO: 1935848 - RNA, 15 nt, Shigella flexneri 2a str. 2457T
cagcgccagaaggga

SEQ ID NO: 1935849 - RNA, 13 nt, Shigella flexneri 2a str. 2457T
cagcgccaucccu

SEQ ID NO: 1935850 - RNA, 21 nt, Shigella flexneri 2a str. 2457T
cagcgccauuguguuaucccg

SEQ ID NO: 1935851 - RNA, 14 nt, Shigella flexneri 2a str. 2457T
cagcgcccaacacu

SEQ ID NO: 1935852 - RNA, 13 nt, Shigella flexneri 2a str. 2457T
cagcgcaggaaag

SEQ ID NO: 1935853 - RNA, 12 nt, Shigella flexneri 2a str. 2457T
cagcgcaggaaa

SEQ ID NO: 1935854 - RNA, 13 nt, Shigella flexneri 2a str. 2457T
cagcgcagcaccc

SEQ ID NO: 1935855 - RNA, 14 nt, Shigella flexneri 2a str. 2457T
cagcgcauccuggc

SEQ ID NO: 1935856 - RNA, 20 nt, Shigella flexneri 2a str. 2457T
cagcgcauccauuacaucac

SEQ ID NO: 1935857 - RNA, 19 nt, Shigella flexneri 2a str. 2457T
cagcgcauagcuaaucccc

SEQ ID NO: 1935858 - RNA, 18 nt, Shigella flexneri 2a str. 2457T
cagcgccaccaccagcac

SEQ ID NO: 1935859 - RNA, 18 nt, Shigella flexneri 2a str. 2457T
cagcgccaccagcgccgc

SEQ ID NO: 1935860 - RNA, 22 nt, Shigella flexneri 2a str. 2457T
cagcgccaacggugaaaaacca

SEQ ID NO: 1935861 - RNA, 13 nt, Shigella flexneri 2a str. 2457T
cagcgccaaucgc

SEQ ID NO: 1935862 - RNA, 16 nt, Shigella flexneri 2a str. 2457T
cagcgccaccacaaaa

SEQ ID NO: 1935863 - RNA, 12 nt, Shigella flexneri 2a str. 2457T
cagcgcauugcu

SEQ ID NO: 1935864 - RNA, 20 nt, Shigella flexneri 2a str. 2457T
cagcgcauugcuaaugcugg

SEQ ID NO: 1935865 - RNA, 15 nt, Shigella flexneri 2a str. 2457T
cagcgcauucguaau

SEQ ID NO: 1935866 - RNA, 15 nt, Shigella flexneri 2a str. 2457T
cagcgcaucugccgg

SEQ ID NO: 1935867 - RNA, 16 nt, Shigella flexneri 2a str. 2457T
cagcgcaccagaaaca

SEQ ID NO: 1935868 - RNA, 23 nt, Shigella flexneri 2a str. 2457T
cagcgcaccugugguagcggcuc

SEQ ID NO: 1935869 - RNA, 23 nt, Shigella flexneri 2a str. 2457T
cagcgauuuuggguuccacuucu

SEQ ID NO: 1935870 - RNA, 14 nt, Shigella flexneri 2a str. 2457T
cagcgcaaaacgca

SEQ ID NO: 1935871 - RNA, 18 nt, Shigella flexneri 2a str. 2457T
cagcgauugucagcuggu

SEQ ID NO: 1935872 - RNA, 22 nt, Shigella flexneri 2a str. 2457T
cagcgcaauaccgauaucgcca

SEQ ID NO: 1935873 - RNA, 13 nt, Shigella flexneri 2a str. 2457T
cagcgaucgcuuu

SEQ ID NO: 1935874 - RNA, 16 nt, Shigella flexneri 2a str. 2457T
cagcgaucuguuucuu

SEQ ID NO: 1935875 - RNA, 22 nt, Shigella flexneri 2a str. 2457T
cagcgaugcuuugcgcuuuucu

SEQ ID NO: 1935876 - RNA, 12 nt, Shigella flexneri 2a str. 2457T
cagcgaguugau

SEQ ID NO: 1935877 - RNA, 15 nt, Shigella flexneri 2a str. 2457T
cagcgaguuugaucu

SEQ ID NO: 1935878 - RNA, 20 nt, Shigella flexneri 2a str. 2457T
cagcgcggaagggaugaaau

SEQ ID NO: 1935879 - RNA, 14 nt, Shigella flexneri 2a str. 2457T
cagcgcgcucgcca

SEQ ID NO: 1935880 - RNA, 22 nt, Shigella flexneri 2a str. 2457T
cagcgcggaagggaugaaauag

SEQ ID NO: 1935881 - RNA, 18 nt, Shigella flexneri 2a str. 2457T
cagcgccuggcugcaugg

SEQ ID NO: 1935882 - RNA, 16 nt, Shigella flexneri 2a str. 2457T
cagcgccugcgcggca

SEQ ID NO: 1935883 - RNA, 19 nt, Shigella flexneri 2a str. 2457T
cagcgccugauacagccaa

SEQ ID NO: 1935884 - RNA, 13 nt, Shigella flexneri 2a str. 2457T
cagcgccugauac

SEQ ID NO: 1935885 - RNA, 18 nt, Shigella flexneri 2a str. 2457T
cagcgcgccagccaccac

SEQ ID NO: 1935886 - RNA, 17 nt, Shigella flexneri 2a str. 2457T
cagcgcgcauucagcag

SEQ ID NO: 1935887 - RNA, 13 nt, Shigella flexneri 2a str. 2457T
cagcgcgcagaac

SEQ ID NO: 1935888 - RNA, 12 nt, Shigella flexneri 2a str. 2457T
cagcgcgauacg

SEQ ID NO: 1935889 - RNA, 18 nt, Shigella flexneri 2a str. 2457T
cagcggcauuacgcgccc

SEQ ID NO: 1935890 - RNA, 21 nt, Shigella flexneri 2a str. 2457T
cagcggcauuacgcgccccuu

SEQ ID NO: 1935891 - RNA, 22 nt, Shigella flexneri 2a str. 2457T
cagcggcauuacgcgccccuuc

SEQ ID NO: 1935892 - RNA, 23 nt, Shigella flexneri 2a str. 2457T
cagcggcccggagacgccgaggg

SEQ ID NO: 1935893 - RNA, 18 nt, Shigella flexneri 2a str. 2457T
cagcggcaaccagcccau

SEQ ID NO: 1935894 - RNA, 20 nt, Shigella flexneri 2a str. 2457T
cagcggauaaagcagagcag

SEQ ID NO: 1935895 - RNA, 15 nt, Shigella flexneri 2a str. 2457T
cagcggaugacccag

SEQ ID NO: 1935896 - RNA, 19 nt, Shigella flexneri 2a str. 2457T
cagcggcaaacgacgcaga

SEQ ID NO: 1935897 - RNA, 14 nt, Shigella flexneri 2a str. 2457T
cagcggaugaccca

SEQ ID NO: 1935898 - RNA, 16 nt, Shigella flexneri 2a str. 2457T
cagcggauacaggaag

SEQ ID NO: 1935899 - RNA, 17 nt, Shigella flexneri 2a str. 2457T
cagcggauacaggaagc

SEQ ID NO: 1935900 - RNA, 14 nt, Shigella flexneri 2a str. 2457T
cagcggacgcugcu

SEQ ID NO: 1935901 - RNA, 19 nt, Shigella flexneri 2a str. 2457T
cagcggacaaugccuaccg

SEQ ID NO: 1935902 - RNA, 21 nt, Shigella flexneri 2a str. 2457T
cagcgcuuuuggcgcguuccc

SEQ ID NO: 1935903 - RNA, 15 nt, Shigella flexneri 2a str. 2457T
cagcgcuaccgccga

SEQ ID NO: 1935904 - RNA, 17 nt, Shigella flexneri 2a str. 2457T
cagcgcuaaccgccuga

SEQ ID NO: 1935905 - RNA, 13 nt, Shigella flexneri 2a str. 2457T
cagcgcuaaccgc

SEQ ID NO: 1935906 - RNA, 21 nt, Shigella flexneri 2a str. 2457T
cagcgcugcggcgcgcaucuu

SEQ ID NO: 1935907 - RNA, 20 nt, Shigella flexneri 2a str. 2457T
cagcgcugcgaaaguaccau

SEQ ID NO: 1935908 - RNA, 19 nt, Shigella flexneri 2a str. 2457T
caaccaguugugcaccacc

SEQ ID NO: 1935909 - RNA, 16 nt, Shigella flexneri 2a str. 2457T
caaccauccccaaaaa

SEQ ID NO: 1935910 - RNA, 17 nt, Shigella flexneri 2a str. 2457T
caaccauccuaaaaaag

SEQ ID NO: 1935911 - RNA, 21 nt, Shigella flexneri 2a str. 2457T
caaccaugguuucgaacgcca

SEQ ID NO: 1935912 - RNA, 14 nt, Shigella flexneri 2a str. 2457T
caacccagaagaaa

SEQ ID NO: 1935913 - RNA, 15 nt, Shigella flexneri 2a str. 2457T
caacccugcccuuca

SEQ ID NO: 1935914 - RNA, 20 nt, Shigella flexneri 2a str. 2457T
caacccggcgaaagagcugg

SEQ ID NO: 1935915 - RNA, 22 nt, Shigella flexneri 2a str. 2457T
caaccccgcacggugcaccgca

SEQ ID NO: 1935916 - RNA, 12 nt, Shigella flexneri 2a str. 2457T
caaccccagcca

SEQ ID NO: 1935917 - RNA, 19 nt, Shigella flexneri 2a str. 2457T
caaccguaaacgaucaucg

SEQ ID NO: 1935918 - RNA, 23 nt, Shigella flexneri 2a str. 2457T
caaccgguggcaguagcgccucu

SEQ ID NO: 1935919 - RNA, 17 nt, Shigella flexneri 2a str. 2457T
caaccgcgguacgccau

SEQ ID NO: 1935920 - RNA, 17 nt, Shigella flexneri 2a str. 2457T
caaccggcgggaaaaau

SEQ ID NO: 1935921 - RNA, 17 nt, Shigella flexneri 2a str. 2457T
caaccgauaucuuuccg

SEQ ID NO: 1935922 - RNA, 19 nt, Shigella flexneri 2a str. 2457T
caaccgaacccagcagguc

SEQ ID NO: 1935923 - RNA, 14 nt, Shigella flexneri 2a str. 2457T
caaccgcgacuggg

SEQ ID NO: 1935924 - RNA, 21 nt, Shigella flexneri 2a str. 2457T
caaccgcgacugggaggacag

SEQ ID NO: 1935925 - RNA, 19 nt, Shigella flexneri 2a str. 2457T
caaccaccucaguacccgc

SEQ ID NO: 1935926 - RNA, 20 nt, Shigella flexneri 2a str. 2457T
caaccacuacgugaucgucu

SEQ ID NO: 1935927 - RNA, 12 nt, Shigella flexneri 2a str. 2457T
caaccacauuca

SEQ ID NO: 1935928 - RNA, 14 nt, Shigella flexneri 2a str. 2457T
caaccacacccaca

SEQ ID NO: 1935929 - RNA, 16 nt, Shigella flexneri 2a str. 2457T
caaccaaucgcggcga

SEQ ID NO: 1935930 - RNA, 14 nt, Shigella flexneri 2a str. 2457T
caaccaacggccuu

SEQ ID NO: 1935931 - RNA, 16 nt, Shigella flexneri 2a str. 2457T
caaccagcccaugaau

SEQ ID NO: 1935932 - RNA, 18 nt, Shigella flexneri 2a str. 2457T
caaccagcuuaugccugu

SEQ ID NO: 1935933 - RNA, 19 nt, Shigella flexneri 2a str. 2457T
caaccagcacuucgccauc

SEQ ID NO: 1935934 - RNA, 15 nt, Shigella flexneri 2a str. 2457T
caaccagaagagaac

SEQ ID NO: 1935935 - RNA, 18 nt, Shigella flexneri 2a str. 2457T
caaccacuuuaucgagaa

SEQ ID NO: 1935936 - RNA, 22 nt, Shigella flexneri 2a str. 2457T
caaccacuuuaucgagaauacu

SEQ ID NO: 1935937 - RNA, 16 nt, Shigella flexneri 2a str. 2457T
caaccagaaagaugca

SEQ ID NO: 1935938 - RNA, 18 nt, Shigella flexneri 2a str. 2457T
caaccagaaagaugcauc

SEQ ID NO: 1935939 - RNA, 15 nt, Shigella flexneri 2a str. 2457T
caacaugaaaauaac

SEQ ID NO: 1935940 - RNA, 17 nt, Shigella flexneri 2a str. 2457T
caacaggguugaaucug

SEQ ID NO: 1935941 - RNA, 21 nt, Shigella flexneri 2a str. 2457T
caacaggcccaacuguugauc

SEQ ID NO: 1935942 - RNA, 15 nt, Shigella flexneri 2a str. 2457T
caacaggcgguaacc

SEQ ID NO: 1935943 - RNA, 20 nt, Shigella flexneri 2a str. 2457T
caacaugcggugauuuugcc

SEQ ID NO: 1935944 - RNA, 16 nt, Shigella flexneri 2a str. 2457T
caacaugagaacaguu

SEQ ID NO: 1935945 - RNA, 14 nt, Shigella flexneri 2a str. 2457T
caacaugaaacaga

SEQ ID NO: 1935946 - RNA, 16 nt, Shigella flexneri 2a str. 2457T
caacaugaaacagaaa

SEQ ID NO: 1935947 - RNA, 19 nt, Shigella flexneri 2a str. 2457T
caacaugucagcaaucacc

SEQ ID NO: 1935948 - RNA, 21 nt, Shigella flexneri 2a str. 2457T
caacauuucccccuuccugcu

SEQ ID NO: 1935949 - RNA, 20 nt, Shigella flexneri 2a str. 2457T
caacauuuugaauuagcacg

SEQ ID NO: 1935950 - RNA, 13 nt, Shigella flexneri 2a str. 2457T
caacguagccugc

SEQ ID NO: 1935951 - RNA, 17 nt, Shigella flexneri 2a str. 2457T
caacguagccugccauu

SEQ ID NO: 1935952 - RNA, 22 nt, Shigella flexneri 2a str. 2457T
caacggcugcuucggucagcac

SEQ ID NO: 1935953 - RNA, 23 nt, Shigella flexneri 2a str. 2457T
caacggcgaaagcuggcacuggg

SEQ ID NO: 1935954 - RNA, 22 nt, Shigella flexneri 2a str. 2457T
caacggcggaucaccgcgucuu

SEQ ID NO: 1935955 - RNA, 17 nt, Shigella flexneri 2a str. 2457T
caacguacucugccacu

SEQ ID NO: 1935956 - RNA, 13 nt, Shigella flexneri 2a str. 2457T
caacguauauaac

SEQ ID NO: 1935957 - RNA, 19 nt, Shigella flexneri 2a str. 2457T
caacguaucaucgcugaac

SEQ ID NO: 1935958 - RNA, 20 nt, Shigella flexneri 2a str. 2457T
caacggaacgaaaaaaauca

SEQ ID NO: 1935959 - RNA, 15 nt, Shigella flexneri 2a str. 2457T
caacggcaaacacgc

SEQ ID NO: 1935960 - RNA, 19 nt, Shigella flexneri 2a str. 2457T
caacggaggauuuuucgcg

SEQ ID NO: 1935961 - RNA, 17 nt, Shigella flexneri 2a str. 2457T
caacgcugaauggcgau

SEQ ID NO: 1935962 - RNA, 20 nt, Shigella flexneri 2a str. 2457T
caacgcuucauugcugaagu

SEQ ID NO: 1935963 - RNA, 11 nt, Shigella flexneri 2a str. 2457T
caacgcugucc

SEQ ID NO: 1935964 - RNA, 15 nt, Shigella flexneri 2a str. 2457T
caaccuagccuuccu

SEQ ID NO: 1935965 - RNA, 17 nt, Shigella flexneri 2a str. 2457T
caaccuacaaacguugc

SEQ ID NO: 1935966 - RNA, 23 nt, Shigella flexneri 2a str. 2457T
caaccguccuccguauccuguca

SEQ ID NO: 1935967 - RNA, 21 nt, Shigella flexneri 2a str. 2457T
caaccguugccgaacguaggc

SEQ ID NO: 1935968 - RNA, 14 nt, Shigella flexneri 2a str. 2457T
caaccucuucuuuu

SEQ ID NO: 1935969 - RNA, 15 nt, Shigella flexneri 2a str. 2457T
caacgccagcagcag

SEQ ID NO: 1935970 - RNA, 16 nt, Shigella flexneri 2a str. 2457T
caacgccagcagcagc

SEQ ID NO: 1935971 - RNA, 19 nt, Shigella flexneri 2a str. 2457T
caacgccgcauagcgacag

SEQ ID NO: 1935972 - RNA, 22 nt, Shigella flexneri 2a str. 2457T
caacuguacgccgacgcccugc

SEQ ID NO: 1935973 - RNA, 19 nt, Shigella flexneri 2a str. 2457T
caacuguugauccaggagc

SEQ ID NO: 1935974 - RNA, 22 nt, Shigella flexneri 2a str. 2457T
caacuuaacuugcuuaaaaaau

SEQ ID NO: 1935975 - RNA, 17 nt, Shigella flexneri 2a str. 2457T
caacuuaagucuccauu

SEQ ID NO: 1935976 - RNA, 15 nt, Shigella flexneri 2a str. 2457T
caacugccugaugcg

SEQ ID NO: 1935977 - RNA, 18 nt, Shigella flexneri 2a str. 2457T
caacugcuuuuugcucuc

SEQ ID NO: 1935978 - RNA, 20 nt, Shigella flexneri 2a str. 2457T
caacuggcaaccagaagaga

SEQ ID NO: 1935979 - RNA, 21 nt, Shigella flexneri 2a str. 2457T
caacuggagcaggaacuuggc

SEQ ID NO: 1935980 - RNA, 19 nt, Shigella flexneri 2a str. 2457T
caacugggacaugauucau

SEQ ID NO: 1935981 - RNA, 14 nt, Shigella flexneri 2a str. 2457T
caacugcauuauua

SEQ ID NO: 1935982 - RNA, 17 nt, Shigella flexneri 2a str. 2457T
caacugauaaaccuuca

SEQ ID NO: 1935983 - RNA, 16 nt, Shigella flexneri 2a str. 2457T
caacucuuuuuccugc

SEQ ID NO: 1935984 - RNA, 17 nt, Shigella flexneri 2a str. 2457T
caacucugggcugaaga

SEQ ID NO: 1935985 - RNA, 15 nt, Shigella flexneri 2a str. 2457T
caacucugguggaca

SEQ ID NO: 1935986 - RNA, 13 nt, Shigella flexneri 2a str. 2457T
caacaauagugcc

SEQ ID NO: 1935987 - RNA, 20 nt, Shigella flexneri 2a str. 2457T
caacaaucugcaaaucgauc

SEQ ID NO: 1935988 - RNA, 14 nt, Shigella flexneri 2a str. 2457T
caacaauggcauuu

SEQ ID NO: 1935989 - RNA, 21 nt, Shigella flexneri 2a str. 2457T
caacaauucccgcagcuccag

SEQ ID NO: 1935990 - RNA, 16 nt, Shigella flexneri 2a str. 2457T
caacaauucguuguuu

SEQ ID NO: 1935991 - RNA, 22 nt, Shigella flexneri 2a str. 2457T
caacaauugaagaauaucuucu

SEQ ID NO: 1935992 - RNA, 19 nt, Shigella flexneri 2a str. 2457T
caacacacugaauaaaaau

SEQ ID NO: 1935993 - RNA, 22 nt, Shigella flexneri 2a str. 2457T
caacacacugaauaaaaaugug

SEQ ID NO: 1935994 - RNA, 18 nt, Shigella flexneri 2a str. 2457T
caaauugcaccauccauu

SEQ ID NO: 1935995 - RNA, 16 nt, Shigella flexneri 2a str. 2457T
caaauuuaaacgacaa

SEQ ID NO: 1935996 - RNA, 23 nt, Shigella flexneri 2a str. 2457T
caacacgccagcguuaucccauc

SEQ ID NO: 1935997 - RNA, 20 nt, Shigella flexneri 2a str. 2457T
caacacgccgaucgaagaga

SEQ ID NO: 1935998 - RNA, 13 nt, Shigella flexneri 2a str. 2457T
caacaccacugcc

SEQ ID NO: 1935999 - RNA, 13 nt, Shigella flexneri 2a str. 2457T
caacacauaaccg

SEQ ID NO: 1936000 - RNA, 22 nt, Shigella flexneri 2a str. 2457T
caacacagauugauaaaaauag

SEQ ID NO: 1936001 - RNA, 20 nt, Shigella flexneri 2a str. 2457T
caacagaauuacuggcagau

SEQ ID NO: 1936002 - RNA, 19 nt, Shigella flexneri 2a str. 2457T
caacagcguuucuucgaca

SEQ ID NO: 1936003 - RNA, 17 nt, Shigella flexneri 2a str. 2457T
caaaugccagauaagac

SEQ ID NO: 1936004 - RNA, 18 nt, Shigella flexneri 2a str. 2457T
caaaugccagauaagaca

SEQ ID NO: 1936005 - RNA, 21 nt, Shigella flexneri 2a str. 2457T
caaaugcaucagugacaaauu

SEQ ID NO: 1936006 - RNA, 20 nt, Shigella flexneri 2a str. 2457T
caaauuacgauccaccaccg

SEQ ID NO: 1936007 - RNA, 14 nt, Shigella flexneri 2a str. 2457T
caaaugcgccgcca

SEQ ID NO: 1936008 - RNA, 19 nt, Shigella flexneri 2a str. 2457T
caaauucucuauuucaccc

SEQ ID NO: 1936009 - RNA, 16 nt, Shigella flexneri 2a str. 2457T
caaaucagaggcuguu

SEQ ID NO: 1936010 - RNA, 13 nt, Shigella flexneri 2a str. 2457T
caaaucacccugu

SEQ ID NO: 1936011 - RNA, 17 nt, Shigella flexneri 2a str. 2457T
caaaucaaugguguuau

SEQ ID NO: 1936012 - RNA, 13 nt, Shigella flexneri 2a str. 2457T
caaaucgcugaau

SEQ ID NO: 1936013 - RNA, 16 nt, Shigella flexneri 2a str. 2457T
caaagauuuuaccaau

SEQ ID NO: 1936014 - RNA, 21 nt, Shigella flexneri 2a str. 2457T
caaagauuguuggcaaaaaaa

SEQ ID NO: 1936015 - RNA, 23 nt, Shigella flexneri 2a str. 2457T
caaagauuguuggcaaaaaaauu

SEQ ID NO: 1936016 - RNA, 15 nt, Shigella flexneri 2a str. 2457T
caaagcaccacuccu

SEQ ID NO: 1936017 - RNA, 23 nt, Shigella flexneri 2a str. 2457T
caaagacaaauuuugaacagaac

SEQ ID NO: 1936018 - RNA, 12 nt, Shigella flexneri 2a str. 2457T
caaagacaaauu

SEQ ID NO: 1936019 - RNA, 23 nt, Shigella flexneri 2a str. 2457T
caaagcccacgccaucauaccca

SEQ ID NO: 1936020 - RNA, 15 nt, Shigella flexneri 2a str. 2457T
caaagccaacagcag

SEQ ID NO: 1936021 - RNA, 18 nt, Shigella flexneri 2a str. 2457T
caaagcauuuuuucacau

SEQ ID NO: 1936022 - RNA, 18 nt, Shigella flexneri 2a str. 2457T
caaaaggcgaaaccuccg

SEQ ID NO: 1936023 - RNA, 20 nt, Shigella flexneri 2a str. 2457T
caaaagccccggaauucuca

SEQ ID NO: 1936024 - RNA, 22 nt, Shigella flexneri 2a str. 2457T
caaaagccccggaauucucaaa

SEQ ID NO: 1936025 - RNA, 17 nt, Shigella flexneri 2a str. 2457T
caaagaaauccacaaau

SEQ ID NO: 1936026 - RNA, 20 nt, Shigella flexneri 2a str. 2457T
caaauagugccuggcugcgu

SEQ ID NO: 1936027 - RNA, 17 nt, Shigella flexneri 2a str. 2457T
caaauagccaauuccca

SEQ ID NO: 1936028 - RNA, 21 nt, Shigella flexneri 2a str. 2457T
caaauacauugauauacagcc

SEQ ID NO: 1936029 - RNA, 14 nt, Shigella flexneri 2a str. 2457T
caaauaauuccugc

SEQ ID NO: 1936030 - RNA, 18 nt, Shigella flexneri 2a str. 2457T
caaauaaaaaaugagaau

SEQ ID NO: 1936031 - RNA, 20 nt, Shigella flexneri 2a str. 2457T
caaaguuugugaucuuuuuc

SEQ ID NO: 1936032 - RNA, 20 nt, Shigella flexneri 2a str. 2457T
caaagugccuguguuuaugc

SEQ ID NO: 1936033 - RNA, 23 nt, Shigella flexneri 2a str. 2457T
caaaguugcauuagcacaaaccc

SEQ ID NO: 1936034 - RNA, 19 nt, Shigella flexneri 2a str. 2457T
caaagugaauacagaacag

SEQ ID NO: 1936035 - RNA, 14 nt, Shigella flexneri 2a str. 2457T
caaagccuuucacu

SEQ ID NO: 1936036 - RNA, 17 nt, Shigella flexneri 2a str. 2457T
caaagguaauggucagu

SEQ ID NO: 1936037 - RNA, 22 nt, Shigella flexneri 2a str. 2457T
caaagguaauggucaguacgcc

SEQ ID NO: 1936038 - RNA, 21 nt, Shigella flexneri 2a str. 2457T
caaaguaccaucguccagcag

SEQ ID NO: 1936039 - RNA, 21 nt, Shigella flexneri 2a str. 2457T
caaggcgcggguuucaacauu

SEQ ID NO: 1936040 - RNA, 19 nt, Shigella flexneri 2a str. 2457T
caagggcggcgagaaacuu

SEQ ID NO: 1936041 - RNA, 22 nt, Shigella flexneri 2a str. 2457T
caaggcgaggggaccgccccug

SEQ ID NO: 1936042 - RNA, 21 nt, Shigella flexneri 2a str. 2457T
caaggcgaggggaccgccccu

SEQ ID NO: 1936043 - RNA, 20 nt, Shigella flexneri 2a str. 2457T
caaggcgaggggaccgcccc

SEQ ID NO: 1936044 - RNA, 22 nt, Shigella flexneri 2a str. 2457T
caaggccguauggcgagcagga

SEQ ID NO: 1936045 - RNA, 20 nt, Shigella flexneri 2a str. 2457T
caaggugauugccuuuuucg

SEQ ID NO: 1936046 - RNA, 20 nt, Shigella flexneri 2a str. 2457T
caagguaucgguugcuggau

SEQ ID NO: 1936047 - RNA, 20 nt, Shigella flexneri 2a str. 2457T
caagggugucggcacacaca

SEQ ID NO: 1936048 - RNA, 23 nt, Shigella flexneri 2a str. 2457T
caagcggcauccagguuucuucc

SEQ ID NO: 1936049 - RNA, 15 nt, Shigella flexneri 2a str. 2457T
caagcggugcgaugc

SEQ ID NO: 1936050 - RNA, 19 nt, Shigella flexneri 2a str. 2457T
caagcuaacgaacgcagug

SEQ ID NO: 1936051 - RNA, 14 nt, Shigella flexneri 2a str. 2457T
caagcguugcuuca

SEQ ID NO: 1936052 - RNA, 17 nt, Shigella flexneri 2a str. 2457T
caagcguuucaucuuca

SEQ ID NO: 1936053 - RNA, 19 nt, Shigella flexneri 2a str. 2457T
caagcgucgcaucaggcau

SEQ ID NO: 1936054 - RNA, 21 nt, Shigella flexneri 2a str. 2457T
caagcgucgcaucaggcaugg

SEQ ID NO: 1936055 - RNA, 16 nt, Shigella flexneri 2a str. 2457T
caaggaaggcguaaag

SEQ ID NO: 1936056 - RNA, 12 nt, Shigella flexneri 2a str. 2457T
caaggaaauaau

SEQ ID NO: 1936057 - RNA, 14 nt, Shigella flexneri 2a str. 2457T
caagcccagccccc

SEQ ID NO: 1936058 - RNA, 23 nt, Shigella flexneri 2a str. 2457T
caagccgaauaacggcucaaacu

SEQ ID NO: 1936059 - RNA, 18 nt, Shigella flexneri 2a str. 2457T
caagccaggcuuuaaauu

SEQ ID NO: 1936060 - RNA, 19 nt, Shigella flexneri 2a str. 2457T
caagccaggacgcagucca

SEQ ID NO: 1936061 - RNA, 22 nt, Shigella flexneri 2a str. 2457T
caagccacaauaaacgcgcagg

SEQ ID NO: 1936062 - RNA, 19 nt, Shigella flexneri 2a str. 2457T
caagcaugaucgaggcaaa

SEQ ID NO: 1936063 - RNA, 19 nt, Shigella flexneri 2a str. 2457T
caagcagcgcgcagaacau

SEQ ID NO: 1936064 - RNA, 23 nt, Shigella flexneri 2a str. 2457T
caagcaguugguuaaucuuuucu

SEQ ID NO: 1936065 - RNA, 20 nt, Shigella flexneri 2a str. 2457T
caagcaguugguuaaucuuu

SEQ ID NO: 1936066 - RNA, 21 nt, Shigella flexneri 2a str. 2457T
caagcaguugguuaaucuuuu

SEQ ID NO: 1936067 - RNA, 12 nt, Shigella flexneri 2a str. 2457T
caacuuccccuc

SEQ ID NO: 1936068 - RNA, 23 nt, Shigella flexneri 2a str. 2457T
caacuucgaguacauccacugca

SEQ ID NO: 1936069 - RNA, 16 nt, Shigella flexneri 2a str. 2457T
caacuucgcuaaaucu

SEQ ID NO: 1936070 - RNA, 19 nt, Shigella flexneri 2a str. 2457T
caacuucucuuucggcagu

SEQ ID NO: 1936071 - RNA, 16 nt, Shigella flexneri 2a str. 2457T
caacuucagcagcagc

SEQ ID NO: 1936072 - RNA, 18 nt, Shigella flexneri 2a str. 2457T
caacuucaaggucaacau

SEQ ID NO: 1936073 - RNA, 19 nt, Shigella flexneri 2a str. 2457T
caacuucaaggucaacauu

SEQ ID NO: 1936074 - RNA, 16 nt, Shigella flexneri 2a str. 2457T
caauacgcauaugcau

SEQ ID NO: 1936075 - RNA, 16 nt, Shigella flexneri 2a str. 2457T
caauacgcccacguuu

SEQ ID NO: 1936076 - RNA, 21 nt, Shigella flexneri 2a str. 2457T
caauacuuucacaaaaauaau

SEQ ID NO: 1936077 - RNA, 14 nt, Shigella flexneri 2a str. 2457T
caauaauaucuuuu

SEQ ID NO: 1936078 - RNA, 13 nt, Shigella flexneri 2a str. 2457T
caauaaucaccgu

SEQ ID NO: 1936079 - RNA, 17 nt, Shigella flexneri 2a str. 2457T
caauaauuucaacaggu

SEQ ID NO: 1936080 - RNA, 15 nt, Shigella flexneri 2a str. 2457T
caauaguaaccagac

SEQ ID NO: 1936081 - RNA, 13 nt, Shigella flexneri 2a str. 2457T
caauauccugacc

SEQ ID NO: 1936082 - RNA, 16 nt, Shigella flexneri 2a str. 2457T
caauagucguguuauc

SEQ ID NO: 1936083 - RNA, 17 nt, Shigella flexneri 2a str. 2457T
caauaucauuacgccag

SEQ ID NO: 1936084 - RNA, 23 nt, Shigella flexneri 2a str. 2457T
caauauccaccgggguaaaucca

SEQ ID NO: 1936085 - RNA, 19 nt, Shigella flexneri 2a str. 2457T
caauauccgguucacuuca

SEQ ID NO: 1936086 - RNA, 15 nt, Shigella flexneri 2a str. 2457T
caauaauacccagca

SEQ ID NO: 1936087 - RNA, 20 nt, Shigella flexneri 2a str. 2457T
caauaacaggauuuucuaau

SEQ ID NO: 1936088 - RNA, 18 nt, Shigella flexneri 2a str. 2457T
caauaaacuucaauauau

SEQ ID NO: 1936089 - RNA, 16 nt, Shigella flexneri 2a str. 2457T
caaguuuugucaguuc

SEQ ID NO: 1936090 - RNA, 19 nt, Shigella flexneri 2a str. 2457T
caaguauucacucugcugu

SEQ ID NO: 1936091 - RNA, 12 nt, Shigella flexneri 2a str. 2457T
caaguaucuauu

SEQ ID NO: 1936092 - RNA, 21 nt, Shigella flexneri 2a str. 2457T
caagguggugaggccagagca

SEQ ID NO: 1936093 - RNA, 12 nt, Shigella flexneri 2a str. 2457T
caaguacggcaa

SEQ ID NO: 1936094 - RNA, 16 nt, Shigella flexneri 2a str. 2457T
caauguaggccugaua

SEQ ID NO: 1936095 - RNA, 21 nt, Shigella flexneri 2a str. 2457T
caaugucaucagcauucucau

SEQ ID NO: 1936096 - RNA, 19 nt, Shigella flexneri 2a str. 2457T
caaugguggcaaucugaau

SEQ ID NO: 1936097 - RNA, 17 nt, Shigella flexneri 2a str. 2457T
caauggguaacggcaga

SEQ ID NO: 1936098 - RNA, 16 nt, Shigella flexneri 2a str. 2457T
caauggucagccacag

SEQ ID NO: 1936099 - RNA, 23 nt, Shigella flexneri 2a str. 2457T
caauggucagcgccaggcuuucc

SEQ ID NO: 1936100 - RNA, 14 nt, Shigella flexneri 2a str. 2457T
caauggcuggccug

SEQ ID NO: 1936101 - RNA, 22 nt, Shigella flexneri 2a str. 2457T
caauggcuggccccgucagcaa

SEQ ID NO: 1936102 - RNA, 22 nt, Shigella flexneri 2a str. 2457T
caauggcugcaaagcauuuuuu

SEQ ID NO: 1936103 - RNA, 17 nt, Shigella flexneri 2a str. 2457T
caauggccugcgcgacc

SEQ ID NO: 1936104 - RNA, 12 nt, Shigella flexneri 2a str. 2457T
caauggcacugu

SEQ ID NO: 1936105 - RNA, 20 nt, Shigella flexneri 2a str. 2457T
caaugcccagaaaccaguuu

SEQ ID NO: 1936106 - RNA, 16 nt, Shigella flexneri 2a str. 2457T
caaugcccaucacuau

SEQ ID NO: 1936107 - RNA, 15 nt, Shigella flexneri 2a str. 2457T
caaugccauccagcu

SEQ ID NO: 1936108 - RNA, 19 nt, Shigella flexneri 2a str. 2457T
caaugccgucaccagcauc

SEQ ID NO: 1936109 - RNA, 17 nt, Shigella flexneri 2a str. 2457T
caaugccuucuggaaau

SEQ ID NO: 1936110 - RNA, 19 nt, Shigella flexneri 2a str. 2457T
caaugcgacaaacaggaag

SEQ ID NO: 1936111 - RNA, 23 nt, Shigella flexneri 2a str. 2457T
caaugccugaugcgcuucgcuua

SEQ ID NO: 1936112 - RNA, 11 nt, Shigella flexneri 2a str. 2457T
caaugcgcauc

SEQ ID NO: 1936113 - RNA, 22 nt, Shigella flexneri 2a str. 2457T
caaugcguagcugagcaacaaa

SEQ ID NO: 1936114 - RNA, 18 nt, Shigella flexneri 2a str. 2457T
caaugcucucuucgccaa

SEQ ID NO: 1936115 - RNA, 19 nt, Shigella flexneri 2a str. 2457T
caauggagcacauugccug

SEQ ID NO: 1936116 - RNA, 19 nt, Shigella flexneri 2a str. 2457T
caaugcuuuuugcauuucc

SEQ ID NO: 1936117 - RNA, 19 nt, Shigella flexneri 2a str. 2457T
caaugaagaaccgcaccag

SEQ ID NO: 1936118 - RNA, 15 nt, Shigella flexneri 2a str. 2457T
caaugaagcccgcug

SEQ ID NO: 1936119 - RNA, 17 nt, Shigella flexneri 2a str. 2457T
caaugacguuaauaaaa

SEQ ID NO: 1936120 - RNA, 17 nt, Shigella flexneri 2a str. 2457T
caaugacgggcuuaacu

SEQ ID NO: 1936121 - RNA, 20 nt, Shigella flexneri 2a str. 2457T
caaugaaagccccaccagca

SEQ ID NO: 1936122 - RNA, 19 nt, Shigella flexneri 2a str. 2457T
caaugaaagccccaccagc

SEQ ID NO: 1936123 - RNA, 23 nt, Shigella flexneri 2a str. 2457T
caaucuuguucucagcacauuga

SEQ ID NO: 1936124 - RNA, 18 nt, Shigella flexneri 2a str. 2457T
caaucuuuacacacaagc

SEQ ID NO: 1936125 - RNA, 17 nt, Shigella flexneri 2a str. 2457T
caaugcauuaucagaga

SEQ ID NO: 1936126 - RNA, 15 nt, Shigella flexneri 2a str. 2457T
caaugccacaaacgc

SEQ ID NO: 1936127 - RNA, 19 nt, Shigella flexneri 2a str. 2457T
caaugauuuugauggaaga

SEQ ID NO: 1936128 - RNA, 21 nt, Shigella flexneri 2a str. 2457T
caaugagagggcgauaaaucu

SEQ ID NO: 1936129 - RNA, 13 nt, Shigella flexneri 2a str. 2457T
caaugauaagccu

SEQ ID NO: 1936130 - RNA, 22 nt, Shigella flexneri 2a str. 2457T
caaugaguggugaaaaaaaggc

SEQ ID NO: 1936131 - RNA, 19 nt, Shigella flexneri 2a str. 2457T
caaugaguggugaaaaaaa

SEQ ID NO: 1936132 - RNA, 15 nt, Shigella flexneri 2a str. 2457T
caaugauuucugcca

SEQ ID NO: 1936133 - RNA, 14 nt, Shigella flexneri 2a str. 2457T
caaugauucaggca

SEQ ID NO: 1936134 - RNA, 19 nt, Shigella flexneri 2a str. 2457T
caaucccuuucucuucaaa

SEQ ID NO: 1936135 - RNA, 20 nt, Shigella flexneri 2a str. 2457T
caaucccuuucucuucaaac

SEQ ID NO: 1936136 - RNA, 18 nt, Shigella flexneri 2a str. 2457T
caaucccaaaauaauaaa

SEQ ID NO: 1936137 - RNA, 14 nt, Shigella flexneri 2a str. 2457T
caauccccgccagc

SEQ ID NO: 1936138 - RNA, 13 nt, Shigella flexneri 2a str. 2457T
caauccagcccug

SEQ ID NO: 1936139 - RNA, 15 nt, Shigella flexneri 2a str. 2457T
caauccagcccugcc

SEQ ID NO: 1936140 - RNA, 23 nt, Shigella flexneri 2a str. 2457T
caauccaguacaugaagcacugc

SEQ ID NO: 1936141 - RNA, 13 nt, Shigella flexneri 2a str. 2457T
caauccaguccac

SEQ ID NO: 1936142 - RNA, 19 nt, Shigella flexneri 2a str. 2457T
caaucaucucucgcaucag

SEQ ID NO: 1936143 - RNA, 15 nt, Shigella flexneri 2a str. 2457T
caauauuaucgauuu

SEQ ID NO: 1936144 - RNA, 21 nt, Shigella flexneri 2a str. 2457T
caauauucuuuugcagcagcg

SEQ ID NO: 1936145 - RNA, 16 nt, Shigella flexneri 2a str. 2457T
caaucaaauauucugc

SEQ ID NO: 1936146 - RNA, 19 nt, Shigella flexneri 2a str. 2457T
caaucaaauauucugccca

SEQ ID NO: 1936147 - RNA, 22 nt, Shigella flexneri 2a str. 2457T
caaucaaauauucugcccaagc

SEQ ID NO: 1936148 - RNA, 16 nt, Shigella flexneri 2a str. 2457T
caaucaaauagccugc

SEQ ID NO: 1936149 - RNA, 16 nt, Shigella flexneri 2a str. 2457T
caaucaaacucaauua

SEQ ID NO: 1936150 - RNA, 18 nt, Shigella flexneri 2a str. 2457T
caaucaucgccuuaugcu

SEQ ID NO: 1936151 - RNA, 21 nt, Shigella flexneri 2a str. 2457T
caaucaucgcggcacacagca

SEQ ID NO: 1936152 - RNA, 13 nt, Shigella flexneri 2a str. 2457T
caaucauccauau

SEQ ID NO: 1936153 - RNA, 16 nt, Shigella flexneri 2a str. 2457T
caaucguagcccagcu

SEQ ID NO: 1936154 - RNA, 14 nt, Shigella flexneri 2a str. 2457T
caaucggugcaaau

SEQ ID NO: 1936155 - RNA, 15 nt, Shigella flexneri 2a str. 2457T
caaucggcuuuuuau

SEQ ID NO: 1936156 - RNA, 19 nt, Shigella flexneri 2a str. 2457T
caaucggcaauucaguacg

SEQ ID NO: 1936157 - RNA, 19 nt, Shigella flexneri 2a str. 2457T
caaucgccuccagcgcugg

SEQ ID NO: 1936158 - RNA, 19 nt, Shigella flexneri 2a str. 2457T
caaucgcugcggcaauaau

SEQ ID NO: 1936159 - RNA, 19 nt, Shigella flexneri 2a str. 2457T
caaucgaccaggccaucag

SEQ ID NO: 1936160 - RNA, 21 nt, Shigella flexneri 2a str. 2457T
caaucgaaaaagaaucgauua

SEQ ID NO: 1936161 - RNA, 21 nt, Shigella flexneri 2a str. 2457T
caaucgcccccgucaccggca

SEQ ID NO: 1936162 - RNA, 15 nt, Shigella flexneri 2a str. 2457T
caaucgacuuuucau

SEQ ID NO: 1936163 - RNA, 18 nt, Shigella flexneri 2a str. 2457T
caaucgagauacgacuga

SEQ ID NO: 1936164 - RNA, 14 nt, Shigella flexneri 2a str. 2457T
caaucuacaaaaga

SEQ ID NO: 1936165 - RNA, 17 nt, Shigella flexneri 2a str. 2457T
caaucguuucaugccau

SEQ ID NO: 1936166 - RNA, 18 nt, Shigella flexneri 2a str. 2457T
caaucuacaaaagauuau

SEQ ID NO: 1936167 - RNA, 13 nt, Shigella flexneri 2a str. 2457T
caaucucacuccg

SEQ ID NO: 1936168 - RNA, 20 nt, Shigella flexneri 2a str. 2457T
caaucucauaccagguaccg

SEQ ID NO: 1936169 - RNA, 16 nt, Shigella flexneri 2a str. 2457T
caaucugcuccauuag

SEQ ID NO: 1936170 - RNA, 13 nt, Shigella flexneri 2a str. 2457T
caaucugcugccu

SEQ ID NO: 1936171 - RNA, 14 nt, Shigella flexneri 2a str. 2457T
caaucugcugccug

SEQ ID NO: 1936172 - RNA, 17 nt, Shigella flexneri 2a str. 2457T
caaucugcuggcaaacg

SEQ ID NO: 1936173 - RNA, 14 nt, Shigella flexneri 2a str. 2457T
caaucugcaaaaua

SEQ ID NO: 1936174 - RNA, 18 nt, Shigella flexneri 2a str. 2457T
caaucugauagugaucca

SEQ ID NO: 1936175 - RNA, 16 nt, Shigella flexneri 2a str. 2457T
caaucucuuuuuccac

SEQ ID NO: 1936176 - RNA, 18 nt, Shigella flexneri 2a str. 2457T
caaucucuuuuuccaccg

SEQ ID NO: 1936177 - RNA, 15 nt, Shigella flexneri 2a str. 2457T
caaucucuuccagaa

SEQ ID NO: 1936178 - RNA, 16 nt, Shigella flexneri 2a str. 2457T
caaucucgcgcccguc

SEQ ID NO: 1936179 - RNA, 16 nt, Shigella flexneri 2a str. 2457T
auuuuugugaagaaua

SEQ ID NO: 1936180 - RNA, 14 nt, Shigella flexneri 2a str. 2457T
auuuuugugaagaa

SEQ ID NO: 1936181 - RNA, 13 nt, Shigella flexneri 2a str. 2457T
auuuuuuauagua

SEQ ID NO: 1936182 - RNA, 22 nt, Shigella flexneri 2a str. 2457T
auuuuugcagaaacauaauaua

SEQ ID NO: 1936183 - RNA, 15 nt, Shigella flexneri 2a str. 2457T
auuuuugcagcaaac

SEQ ID NO: 1936184 - RNA, 20 nt, Shigella flexneri 2a str. 2457T
auuuuucacuuaaugaauca

SEQ ID NO: 1936185 - RNA, 13 nt, Shigella flexneri 2a str. 2457T
auuuuucauaauc

SEQ ID NO: 1936186 - RNA, 17 nt, Shigella flexneri 2a str. 2457T
auuuuuccagcauuucu

SEQ ID NO: 1936187 - RNA, 16 nt, Shigella flexneri 2a str. 2457T
auuuuuccagcauuuc

SEQ ID NO: 1936188 - RNA, 16 nt, Shigella flexneri 2a str. 2457T
auuuuucgcuaaaaaa

SEQ ID NO: 1936189 - RNA, 17 nt, Shigella flexneri 2a str. 2457T
auuuuucugcacuacgc

SEQ ID NO: 1936190 - RNA, 19 nt, Shigella flexneri 2a str. 2457T
auuuuucgugagagugaag

SEQ ID NO: 1936191 - RNA, 18 nt, Shigella flexneri 2a str. 2457T
auuuuuuuauugauaaac

SEQ ID NO: 1936192 - RNA, 22 nt, Shigella flexneri 2a str. 2457T
auuuuuuuaucauuucuggaag

SEQ ID NO: 1936193 - RNA, 20 nt, Shigella flexneri 2a str. 2457T
auuuuuugcucauaaaauca

SEQ ID NO: 1936194 - RNA, 12 nt, Shigella flexneri 2a str. 2457T
auuuuuucccau

SEQ ID NO: 1936195 - RNA, 21 nt, Shigella flexneri 2a str. 2457T
auuuuuuauuguccgguuuaa

SEQ ID NO: 1936196 - RNA, 20 nt, Shigella flexneri 2a str. 2457T
auuuuuuccgcaaaaacgac

SEQ ID NO: 1936197 - RNA, 19 nt, Shigella flexneri 2a str. 2457T
caaaaaaaccgccucaggc

SEQ ID NO: 1936198 - RNA, 20 nt, Shigella flexneri 2a str. 2457T
auuuuuuuucaggaaauaaa

SEQ ID NO: 1936199 - RNA, 21 nt, Shigella flexneri 2a str. 2457T
auuuuuuuucaggaaauaaau

SEQ ID NO: 1936200 - RNA, 12 nt, Shigella flexneri 2a str. 2457T
auuuuuuuuccg

SEQ ID NO: 1936201 - RNA, 20 nt, Shigella flexneri 2a str. 2457T
caaaaaaaugcacauauucu

SEQ ID NO: 1936202 - RNA, 19 nt, Shigella flexneri 2a str. 2457T
caaaaaaacuugauacuga

SEQ ID NO: 1936203 - RNA, 15 nt, Shigella flexneri 2a str. 2457T
caaaaaaagaacaac

SEQ ID NO: 1936204 - RNA, 19 nt, Shigella flexneri 2a str. 2457T
caaaaaaagaauucagacc

SEQ ID NO: 1936205 - RNA, 18 nt, Shigella flexneri 2a str. 2457T
caaaaaacuggaaaaaua

SEQ ID NO: 1936206 - RNA, 19 nt, Shigella flexneri 2a str. 2457T
caaaaaacuggaaaaauaa

SEQ ID NO: 1936207 - RNA, 20 nt, Shigella flexneri 2a str. 2457T
caaaaaacuucuucacacca

SEQ ID NO: 1936208 - RNA, 23 nt, Shigella flexneri 2a str. 2457T
caaaaaagccaaucacaaaaagu

SEQ ID NO: 1936209 - RNA, 21 nt, Shigella flexneri 2a str. 2457T
caaaaauaccaccaaugucga

SEQ ID NO: 1936210 - RNA, 14 nt, Shigella flexneri 2a str. 2457T
caaaaauaaucauc

SEQ ID NO: 1936211 - RNA, 17 nt, Shigella flexneri 2a str. 2457T
caaaaaguccaaaaggu

SEQ ID NO: 1936212 - RNA, 12 nt, Shigella flexneri 2a str. 2457T
caaaaaucgaca

SEQ ID NO: 1936213 - RNA, 17 nt, Shigella flexneri 2a str. 2457T
caaaaaucgacagcagg

SEQ ID NO: 1936214 - RNA, 21 nt, Shigella flexneri 2a str. 2457T
caaaaaucggcaacauuaaau

SEQ ID NO: 1936215 - RNA, 16 nt, Shigella flexneri 2a str. 2457T
caaaaaucggcaacau

SEQ ID NO: 1936216 - RNA, 23 nt, Shigella flexneri 2a str. 2457T
caaaaauugcgcgacuuuuuccu

SEQ ID NO: 1936217 - RNA, 15 nt, Shigella flexneri 2a str. 2457T
caaaaacccugccgu

SEQ ID NO: 1936218 - RNA, 21 nt, Shigella flexneri 2a str. 2457T
caaaaacuaauucaccuugcu

SEQ ID NO: 1936219 - RNA, 18 nt, Shigella flexneri 2a str. 2457T
caaaaagcucaaucgaga

SEQ ID NO: 1936220 - RNA, 16 nt, Shigella flexneri 2a str. 2457T
caaaaagauuaaaaaa

SEQ ID NO: 1936221 - RNA, 14 nt, Shigella flexneri 2a str. 2457T
caaaaaaugaaacu

SEQ ID NO: 1936222 - RNA, 18 nt, Shigella flexneri 2a str. 2457T
caaaaaaugaaacuguua

SEQ ID NO: 1936223 - RNA, 20 nt, Shigella flexneri 2a str. 2457T
caaaaaaggcugacaaauca

SEQ ID NO: 1936224 - RNA, 13 nt, Shigella flexneri 2a str. 2457T
caaaaaauagcaa

SEQ ID NO: 1936225 - RNA, 13 nt, Shigella flexneri 2a str. 2457T
caaaaacaaagaa

SEQ ID NO: 1936226 - RNA, 18 nt, Shigella flexneri 2a str. 2457T
caaaagcaauaauuucaa

SEQ ID NO: 1936227 - RNA, 20 nt, Shigella flexneri 2a str. 2457T
caaaagaugcgcugaguauc

SEQ ID NO: 1936228 - RNA, 20 nt, Shigella flexneri 2a str. 2457T
caaaacguggccuccaaaaa

SEQ ID NO: 1936229 - RNA, 21 nt, Shigella flexneri 2a str. 2457T
caaaacguggccuccaaaaaa

SEQ ID NO: 1936230 - RNA, 20 nt, Shigella flexneri 2a str. 2457T
caaaaccguucgaacuggau

SEQ ID NO: 1936231 - RNA, 12 nt, Shigella flexneri 2a str. 2457T
caaaaccugcuu

SEQ ID NO: 1936232 - RNA, 21 nt, Shigella flexneri 2a str. 2457T
caaaaccucuuccagcagaua

SEQ ID NO: 1936233 - RNA, 22 nt, Shigella flexneri 2a str. 2457T
caaaaccugguugguacugugg

SEQ ID NO: 1936234 - RNA, 19 nt, Shigella flexneri 2a str. 2457T
caaaacagcgacaccagcc

SEQ ID NO: 1936235 - RNA, 22 nt, Shigella flexneri 2a str. 2457T
auuugcggaaguaguucaucaa

SEQ ID NO: 1936236 - RNA, 13 nt, Shigella flexneri 2a str. 2457T
auuugcuccagaa

SEQ ID NO: 1936237 - RNA, 23 nt, Shigella flexneri 2a str. 2457T
auuuggguguaucuucagcugca

SEQ ID NO: 1936238 - RNA, 16 nt, Shigella flexneri 2a str. 2457T
auuuguucagcaaaug

SEQ ID NO: 1936239 - RNA, 12 nt, Shigella flexneri 2a str. 2457T
auuugugucaga

SEQ ID NO: 1936240 - RNA, 17 nt, Shigella flexneri 2a str. 2457T
auuuguugagcuggaag

SEQ ID NO: 1936241 - RNA, 23 nt, Shigella flexneri 2a str. 2457T
auuuuaaacgucaacccuuuauc

SEQ ID NO: 1936242 - RNA, 22 nt, Shigella flexneri 2a str. 2457T
auuugucgccaacuucaugacc

SEQ ID NO: 1936243 - RNA, 17 nt, Shigella flexneri 2a str. 2457T
auuuguggugaagccac

SEQ ID NO: 1936244 - RNA, 18 nt, Shigella flexneri 2a str. 2457T
auuuguggugaagccacc

SEQ ID NO: 1936245 - RNA, 15 nt, Shigella flexneri 2a str. 2457T
auuugugcaaauuca

SEQ ID NO: 1936246 - RNA, 15 nt, Shigella flexneri 2a str. 2457T
auuugaguucacugc

SEQ ID NO: 1936247 - RNA, 16 nt, Shigella flexneri 2a str. 2457T
auuugaguucacugcc

SEQ ID NO: 1936248 - RNA, 15 nt, Shigella flexneri 2a str. 2457T
auuugaaaccgucuu

SEQ ID NO: 1936249 - RNA, 21 nt, Shigella flexneri 2a str. 2457T
auuucuucauacuaccuggac

SEQ ID NO: 1936250 - RNA, 22 nt, Shigella flexneri 2a str. 2457T
auuucuuccagcguuucaagug

SEQ ID NO: 1936251 - RNA, 17 nt, Shigella flexneri 2a str. 2457T
auuucuucauacuaccu

SEQ ID NO: 1936252 - RNA, 15 nt, Shigella flexneri 2a str. 2457T
auuucucgugccacc

SEQ ID NO: 1936253 - RNA, 18 nt, Shigella flexneri 2a str. 2457T
auuucucguuggucauca

SEQ ID NO: 1936254 - RNA, 20 nt, Shigella flexneri 2a str. 2457T
auuucucguuggucaucacu

SEQ ID NO: 1936255 - RNA, 19 nt, Shigella flexneri 2a str. 2457T
auuucaucugccuuauuga

SEQ ID NO: 1936256 - RNA, 20 nt, Shigella flexneri 2a str. 2457T
auuucaucgcuacaccaauc

SEQ ID NO: 1936257 - RNA, 23 nt, Shigella flexneri 2a str. 2457T
auuucauggcggaaaucagagau

SEQ ID NO: 1936258 - RNA, 17 nt, Shigella flexneri 2a str. 2457T
auuucaugaagcugaca

SEQ ID NO: 1936259 - RNA, 21 nt, Shigella flexneri 2a str. 2457T
auuuucucgugccgccagcac

SEQ ID NO: 1936260 - RNA, 15 nt, Shigella flexneri 2a str. 2457T
auuuucugcccauuu

SEQ ID NO: 1936261 - RNA, 19 nt, Shigella flexneri 2a str. 2457T
auuuucuucagcaguucag

SEQ ID NO: 1936262 - RNA, 14 nt, Shigella flexneri 2a str. 2457T
auuuugcaaggcuu

SEQ ID NO: 1936263 - RNA, 16 nt, Shigella flexneri 2a str. 2457T
auuuugauggaagaaa

SEQ ID NO: 1936264 - RNA, 16 nt, Shigella flexneri 2a str. 2457T
auuuugugcagcaugc

SEQ ID NO: 1936265 - RNA, 17 nt, Shigella flexneri 2a str. 2457T
auuuuaauaaugagcgu

SEQ ID NO: 1936266 - RNA, 13 nt, Shigella flexneri 2a str. 2457T
auuuuagaaaaac

SEQ ID NO: 1936267 - RNA, 18 nt, Shigella flexneri 2a str. 2457T
auuuuaaauuuccucuug

SEQ ID NO: 1936268 - RNA, 21 nt, Shigella flexneri 2a str. 2457T
auuuucagcgugcccacguuc

SEQ ID NO: 1936269 - RNA, 17 nt, Shigella flexneri 2a str. 2457T
auuuucaauaaccugca

SEQ ID NO: 1936270 - RNA, 20 nt, Shigella flexneri 2a str. 2457T
auuuucaauaaccugcaaaa

SEQ ID NO: 1936271 - RNA, 18 nt, Shigella flexneri 2a str. 2457T
auuuaacccuucaagaau

SEQ ID NO: 1936272 - RNA, 14 nt, Shigella flexneri 2a str. 2457T
auuuaacggcagca

SEQ ID NO: 1936273 - RNA, 13 nt, Shigella flexneri 2a str. 2457T
auuuaacccugcg

SEQ ID NO: 1936274 - RNA, 13 nt, Shigella flexneri 2a str. 2457T
auuuaacagcaaa

SEQ ID NO: 1936275 - RNA, 15 nt, Shigella flexneri 2a str. 2457T
auuuaacagcaaaac

SEQ ID NO: 1936276 - RNA, 12 nt, Shigella flexneri 2a str. 2457T
auuuaacaccau

SEQ ID NO: 1936277 - RNA, 19 nt, Shigella flexneri 2a str. 2457T
auuuaaauugcgguuuuua

SEQ ID NO: 1936278 - RNA, 22 nt, Shigella flexneri 2a str. 2457T
auuuaaauugcgguuuuuaagg

SEQ ID NO: 1936279 - RNA, 17 nt, Shigella flexneri 2a str. 2457T
auuguuuccauauguac

SEQ ID NO: 1936280 - RNA, 16 nt, Shigella flexneri 2a str. 2457T
auuuaaagugcaaaaa

SEQ ID NO: 1936281 - RNA, 18 nt, Shigella flexneri 2a str. 2457T
auugugugauacuucuuc

SEQ ID NO: 1936282 - RNA, 17 nt, Shigella flexneri 2a str. 2457T
auuguuauaccagucca

SEQ ID NO: 1936283 - RNA, 20 nt, Shigella flexneri 2a str. 2457T
auuguuggcaaaaaaauuca

SEQ ID NO: 1936284 - RNA, 20 nt, Shigella flexneri 2a str. 2457T
auuguucgggccgguuuuaa

SEQ ID NO: 1936285 - RNA, 14 nt, Shigella flexneri 2a str. 2457T
auuguucugcgcug

SEQ ID NO: 1936286 - RNA, 16 nt, Shigella flexneri 2a str. 2457T
auuguugauaaggaaa

SEQ ID NO: 1936287 - RNA, 17 nt, Shigella flexneri 2a str. 2457T
auuguugauaaggaaau

SEQ ID NO: 1936288 - RNA, 14 nt, Shigella flexneri 2a str. 2457T
auuguaaucuauug

SEQ ID NO: 1936289 - RNA, 22 nt, Shigella flexneri 2a str. 2457T
auuguauuuaaagugcaaaaau

SEQ ID NO: 1936290 - RNA, 16 nt, Shigella flexneri 2a str. 2457T
auuguagaaaaucuca

SEQ ID NO: 1936291 - RNA, 17 nt, Shigella flexneri 2a str. 2457T
auugguaaacucaaagu

SEQ ID NO: 1936292 - RNA, 16 nt, Shigella flexneri 2a str. 2457T
auugguuuuuugguaa

SEQ ID NO: 1936293 - RNA, 19 nt, Shigella flexneri 2a str. 2457T
auugucucccacaugcugg

SEQ ID NO: 1936294 - RNA, 14 nt, Shigella flexneri 2a str. 2457T
auugucgccacaaa

SEQ ID NO: 1936295 - RNA, 20 nt, Shigella flexneri 2a str. 2457T
auugucuaaagguccauucu

SEQ ID NO: 1936296 - RNA, 22 nt, Shigella flexneri 2a str. 2457T
auugucuucaagaucagcggca

SEQ ID NO: 1936297 - RNA, 15 nt, Shigella flexneri 2a str. 2457T
auuguggugaucacc

SEQ ID NO: 1936298 - RNA, 23 nt, Shigella flexneri 2a str. 2457T
auuguggugaucacccagacgca

SEQ ID NO: 1936299 - RNA, 14 nt, Shigella flexneri 2a str. 2457T
auuguguaaauuca

SEQ ID NO: 1936300 - RNA, 15 nt, Shigella flexneri 2a str. 2457T
auugugcgccauuuu

SEQ ID NO: 1936301 - RNA, 14 nt, Shigella flexneri 2a str. 2457T
auuuaaucaguucu

SEQ ID NO: 1936302 - RNA, 20 nt, Shigella flexneri 2a str. 2457T
auuuauaaucuuuaaaaaaa

SEQ ID NO: 1936303 - RNA, 14 nt, Shigella flexneri 2a str. 2457T
auuuauaaaagaaa

SEQ ID NO: 1936304 - RNA, 15 nt, Shigella flexneri 2a str. 2457T
auuuagugaccaauc

SEQ ID NO: 1936305 - RNA, 15 nt, Shigella flexneri 2a str. 2457T
auuuaucgacugcca

SEQ ID NO: 1936306 - RNA, 19 nt, Shigella flexneri 2a str. 2457T
auuuauaggguaaauuacc

SEQ ID NO: 1936307 - RNA, 15 nt, Shigella flexneri 2a str. 2457T
auuuauagauuuacu

SEQ ID NO: 1936308 - RNA, 19 nt, Shigella flexneri 2a str. 2457T
auuuauuuuuccuccauug

SEQ ID NO: 1936309 - RNA, 15 nt, Shigella flexneri 2a str. 2457T
auuuauucaaaccaa

SEQ ID NO: 1936310 - RNA, 22 nt, Shigella flexneri 2a str. 2457T
auuuauucuugacgccauuuuu

SEQ ID NO: 1936311 - RNA, 18 nt, Shigella flexneri 2a str. 2457T
auuucaauaacuccaucu

SEQ ID NO: 1936312 - RNA, 19 nt, Shigella flexneri 2a str. 2457T
auuucaauaugauaaaccu

SEQ ID NO: 1936313 - RNA, 22 nt, Shigella flexneri 2a str. 2457T
auuucaauaucgccuuuugccc

SEQ ID NO: 1936314 - RNA, 16 nt, Shigella flexneri 2a str. 2457T
auuucaauaugauaaa

SEQ ID NO: 1936315 - RNA, 20 nt, Shigella flexneri 2a str. 2457T
auuucaacagauuacauuaa

SEQ ID NO: 1936316 - RNA, 22 nt, Shigella flexneri 2a str. 2457T
auuucaacagguuuuguugccc

SEQ ID NO: 1936317 - RNA, 13 nt, Shigella flexneri 2a str. 2457T
auuucaaugcauu

SEQ ID NO: 1936318 - RNA, 19 nt, Shigella flexneri 2a str. 2457T
auuucagaauagacaaaaa

SEQ ID NO: 1936319 - RNA, 21 nt, Shigella flexneri 2a str. 2457T
auuucaucgccagcgaauucc

SEQ ID NO: 1936320 - RNA, 21 nt, Shigella flexneri 2a str. 2457T
auuucagcgcagacaaucaca

SEQ ID NO: 1936321 - RNA, 14 nt, Shigella flexneri 2a str. 2457T
auuucagccccagc

SEQ ID NO: 1936322 - RNA, 12 nt, Shigella flexneri 2a str. 2457T
auugcucaaagu

SEQ ID NO: 1936323 - RNA, 15 nt, Shigella flexneri 2a str. 2457T
auugcgcaaauguuu

SEQ ID NO: 1936324 - RNA, 17 nt, Shigella flexneri 2a str. 2457T
auugcuauuuccaccuc

SEQ ID NO: 1936325 - RNA, 19 nt, Shigella flexneri 2a str. 2457T
auugcugugccggaagggg

SEQ ID NO: 1936326 - RNA, 14 nt, Shigella flexneri 2a str. 2457T
auugcuguuuuaca

SEQ ID NO: 1936327 - RNA, 15 nt, Shigella flexneri 2a str. 2457T
auugcgugucccacu

SEQ ID NO: 1936328 - RNA, 16 nt, Shigella flexneri 2a str. 2457T
auugcgcaccagcuug

SEQ ID NO: 1936329 - RNA, 22 nt, Shigella flexneri 2a str. 2457T
auugccuuccaccagauggcuu

SEQ ID NO: 1936330 - RNA, 14 nt, Shigella flexneri 2a str. 2457T
auugcgaauuccuu

SEQ ID NO: 1936331 - RNA, 17 nt, Shigella flexneri 2a str. 2457T
auugcgaauuccuucac

SEQ ID NO: 1936332 - RNA, 15 nt, Shigella flexneri 2a str. 2457T
auugcuucaguugcc

SEQ ID NO: 1936333 - RNA, 16 nt, Shigella flexneri 2a str. 2457T
auuggaguaucaccau

SEQ ID NO: 1936334 - RNA, 22 nt, Shigella flexneri 2a str. 2457T
auuggagaguugcaccagcaac

SEQ ID NO: 1936335 - RNA, 20 nt, Shigella flexneri 2a str. 2457T
auuggagacugaugacaaac

SEQ ID NO: 1936336 - RNA, 17 nt, Shigella flexneri 2a str. 2457T
auuggagacugaugaca

SEQ ID NO: 1936337 - RNA, 19 nt, Shigella flexneri 2a str. 2457T
auugggaugccgaaaaaag

SEQ ID NO: 1936338 - RNA, 19 nt, Shigella flexneri 2a str. 2457T
auuggcagagcgaucaacc

SEQ ID NO: 1936339 - RNA, 20 nt, Shigella flexneri 2a str. 2457T
auugcaccauccauuuuuca

SEQ ID NO: 1936340 - RNA, 18 nt, Shigella flexneri 2a str. 2457T
auugcacaguauagcauc

SEQ ID NO: 1936341 - RNA, 15 nt, Shigella flexneri 2a str. 2457T
auugcaaaccucagg

SEQ ID NO: 1936342 - RNA, 21 nt, Shigella flexneri 2a str. 2457T
auugcaaagagaacugagcga

SEQ ID NO: 1936343 - RNA, 21 nt, Shigella flexneri 2a str. 2457T
auugagcgauuuaugauauuu

SEQ ID NO: 1936344 - RNA, 13 nt, Shigella flexneri 2a str. 2457T
auugauuuucuug

SEQ ID NO: 1936345 - RNA, 18 nt, Shigella flexneri 2a str. 2457T
auugcacuugcuuaaaau

SEQ ID NO: 1936346 - RNA, 16 nt, Shigella flexneri 2a str. 2457T
auugcaccgacuggcu

SEQ ID NO: 1936347 - RNA, 19 nt, Shigella flexneri 2a str. 2457T
auugcacguccgguggcau

SEQ ID NO: 1936348 - RNA, 16 nt, Shigella flexneri 2a str. 2457T
auugcccgaagccaau

SEQ ID NO: 1936349 - RNA, 20 nt, Shigella flexneri 2a str. 2457T
auugcccgaugcgcaaacuu

SEQ ID NO: 1936350 - RNA, 16 nt, Shigella flexneri 2a str. 2457T
auugccguugauaaag

SEQ ID NO: 1936351 - RNA, 17 nt, Shigella flexneri 2a str. 2457T
auugccguugauaaaga

SEQ ID NO: 1936352 - RNA, 18 nt, Shigella flexneri 2a str. 2457T
auugccgggcgcaucaga

SEQ ID NO: 1936353 - RNA, 22 nt, Shigella flexneri 2a str. 2457T
auugccguggauuuaaugccaa

SEQ ID NO: 1936354 - RNA, 21 nt, Shigella flexneri 2a str. 2457T
auugccugaugcgacgcugcg

SEQ ID NO: 1936355 - RNA, 13 nt, Shigella flexneri 2a str. 2457T
auugccgaagccu

SEQ ID NO: 1936356 - RNA, 16 nt, Shigella flexneri 2a str. 2457T
auugccgaagaccaga

SEQ ID NO: 1936357 - RNA, 23 nt, Shigella flexneri 2a str. 2457T
auucuuaaagucuuuguauuuau

SEQ ID NO: 1936358 - RNA, 20 nt, Shigella flexneri 2a str. 2457T
auucuuacguaauuuauaau

SEQ ID NO: 1936359 - RNA, 12 nt, Shigella flexneri 2a str. 2457T
auucuucaacaa

SEQ ID NO: 1936360 - RNA, 12 nt, Shigella flexneri 2a str. 2457T
auucuucaagug

SEQ ID NO: 1936361 - RNA, 20 nt, Shigella flexneri 2a str. 2457T
auucuucagcgacagggcca

SEQ ID NO: 1936362 - RNA, 17 nt, Shigella flexneri 2a str. 2457T
auugaagcaauccauac

SEQ ID NO: 1936363 - RNA, 20 nt, Shigella flexneri 2a str. 2457T
auugaaauagccaauacgau

SEQ ID NO: 1936364 - RNA, 20 nt, Shigella flexneri 2a str. 2457T
auugaagauguugccacacg

SEQ ID NO: 1936365 - RNA, 21 nt, Shigella flexneri 2a str. 2457T
auugaagauuuugcugugcuu

SEQ ID NO: 1936366 - RNA, 15 nt, Shigella flexneri 2a str. 2457T
auugagcauuggcau

SEQ ID NO: 1936367 - RNA, 23 nt, Shigella flexneri 2a str. 2457T
auugagaaccacaaugaagaaag

SEQ ID NO: 1936368 - RNA, 19 nt, Shigella flexneri 2a str. 2457T
auugacgccaaaauaacuu

SEQ ID NO: 1936369 - RNA, 15 nt, Shigella flexneri 2a str. 2457T
auugacguuccuuuc

SEQ ID NO: 1936370 - RNA, 17 nt, Shigella flexneri 2a str. 2457T
auugacguuccuuucuu

SEQ ID NO: 1936371 - RNA, 22 nt, Shigella flexneri 2a str. 2457T
auucuguucaguacgaaauaac

SEQ ID NO: 1936372 - RNA, 21 nt, Shigella flexneri 2a str. 2457T
auucuguguaaaugccuuucu

SEQ ID NO: 1936373 - RNA, 18 nt, Shigella flexneri 2a str. 2457T
auucuguuuuaucagacc

SEQ ID NO: 1936374 - RNA, 16 nt, Shigella flexneri 2a str. 2457T
auucuggccacuucug

SEQ ID NO: 1936375 - RNA, 15 nt, Shigella flexneri 2a str. 2457T
auucucgccgcccug

SEQ ID NO: 1936376 - RNA, 17 nt, Shigella flexneri 2a str. 2457T
auucuccggcaggaaau

SEQ ID NO: 1936377 - RNA, 16 nt, Shigella flexneri 2a str. 2457T
auucuccggcaggaaa

SEQ ID NO: 1936378 - RNA, 15 nt, Shigella flexneri 2a str. 2457T
auucugcugauuaac

SEQ ID NO: 1936379 - RNA, 18 nt, Shigella flexneri 2a str. 2457T
auucuggagcauggcugg

SEQ ID NO: 1936380 - RNA, 19 nt, Shigella flexneri 2a str. 2457T
auucuggauaaucaaugac

SEQ ID NO: 1936381 - RNA, 19 nt, Shigella flexneri 2a str. 2457T
auucuaucgcccccucuuc

SEQ ID NO: 1936382 - RNA, 20 nt, Shigella flexneri 2a str. 2457T
auucucccucaucauuugaa

SEQ ID NO: 1936383 - RNA, 17 nt, Shigella flexneri 2a str. 2457T
auucagcccggcaacgu

SEQ ID NO: 1936384 - RNA, 14 nt, Shigella flexneri 2a str. 2457T
auucagcccggcaa

SEQ ID NO: 1936385 - RNA, 17 nt, Shigella flexneri 2a str. 2457T
auucagcguaucaauua

SEQ ID NO: 1936386 - RNA, 20 nt, Shigella flexneri 2a str. 2457T
auucagcgucgcgguugcug

SEQ ID NO: 1936387 - RNA, 20 nt, Shigella flexneri 2a str. 2457T
auucagcgucgucagcaguu

SEQ ID NO: 1936388 - RNA, 18 nt, Shigella flexneri 2a str. 2457T
auucagcagcagacagcc

SEQ ID NO: 1936389 - RNA, 21 nt, Shigella flexneri 2a str. 2457T
auucagcagcagcaagauauu

SEQ ID NO: 1936390 - RNA, 16 nt, Shigella flexneri 2a str. 2457T
auucagguaauuaaca

SEQ ID NO: 1936391 - RNA, 20 nt, Shigella flexneri 2a str. 2457T
auucagguaauuaacauuca

SEQ ID NO: 1936392 - RNA, 15 nt, Shigella flexneri 2a str. 2457T
auucagcgucucacu

SEQ ID NO: 1936393 - RNA, 22 nt, Shigella flexneri 2a str. 2457T
augccggguuugccgugugccg

SEQ ID NO: 1936394 - RNA, 17 nt, Shigella flexneri 2a str. 2457T
augccgguagaagccag

SEQ ID NO: 1936395 - RNA, 18 nt, Shigella flexneri 2a str. 2457T
augccgguagaagccagu

SEQ ID NO: 1936396 - RNA, 20 nt, Shigella flexneri 2a str. 2457T
augccgguagaagccaguca

SEQ ID NO: 1936397 - RNA, 11 nt, Shigella flexneri 2a str. 2457T
augccggugau

SEQ ID NO: 1936398 - RNA, 17 nt, Shigella flexneri 2a str. 2457T
augccgucgaggaacau

SEQ ID NO: 1936399 - RNA, 20 nt, Shigella flexneri 2a str. 2457T
augccggccagcgccaccac

SEQ ID NO: 1936400 - RNA, 15 nt, Shigella flexneri 2a str. 2457T
augccggaugcggag

SEQ ID NO: 1936401 - RNA, 24 nt, Shigella flexneri 2a str. 2457T
augccguuguucuacgugagagau

SEQ ID NO: 1936402 - RNA, 16 nt, Shigella flexneri 2a str. 2457T
augccguuugcugcau

SEQ ID NO: 1936403 - RNA, 23 nt, Shigella flexneri 2a str. 2457T
augccugaugguguugcaccauc

SEQ ID NO: 1936404 - RNA, 20 nt, Shigella flexneri 2a str. 2457T
augccugaugcgacgcuugc

SEQ ID NO: 1936405 - RNA, 21 nt, Shigella flexneri 2a str. 2457T
augccugcacuuugugucagc

SEQ ID NO: 1936406 - RNA, 21 nt, Shigella flexneri 2a str. 2457T
augccuugugggccugaaagc

SEQ ID NO: 1936407 - RNA, 17 nt, Shigella flexneri 2a str. 2457T
augccuuucucagaagu

SEQ ID NO: 1936408 - RNA, 14 nt, Shigella flexneri 2a str. 2457T
augccuuguuugau

SEQ ID NO: 1936409 - RNA, 17 nt, Shigella flexneri 2a str. 2457T
augccuuguuugaucau

SEQ ID NO: 1936410 - RNA, 20 nt, Shigella flexneri 2a str. 2457T
augcccucaauaucuuuccc

SEQ ID NO: 1936411 - RNA, 14 nt, Shigella flexneri 2a str. 2457T
augccgcagcaccc

SEQ ID NO: 1936412 - RNA, 21 nt, Shigella flexneri 2a str. 2457T
augccgcagcggcgauuucuu

SEQ ID NO: 1936413 - RNA, 19 nt, Shigella flexneri 2a str. 2457T
augccgauuguauacgcug

SEQ ID NO: 1936414 - RNA, 22 nt, Shigella flexneri 2a str. 2457T
augccgaucaauuucacaguaa

SEQ ID NO: 1936415 - RNA, 23 nt, Shigella flexneri 2a str. 2457T
augccgaucgucugggcauugaa

SEQ ID NO: 1936416 - RNA, 14 nt, Shigella flexneri 2a str. 2457T
augccgaguggcau

SEQ ID NO: 1936417 - RNA, 22 nt, Shigella flexneri 2a str. 2457T
augccaucgcauagcgcaauaa

SEQ ID NO: 1936418 - RNA, 13 nt, Shigella flexneri 2a str. 2457T
augccauccgcau

SEQ ID NO: 1936419 - RNA, 18 nt, Shigella flexneri 2a str. 2457T
augccaucugccagcaag

SEQ ID NO: 1936420 - RNA, 22 nt, Shigella flexneri 2a str. 2457T
augccagucccgcgacaaucgc

SEQ ID NO: 1936421 - RNA, 16 nt, Shigella flexneri 2a str. 2457T
augccaguaacucauu

SEQ ID NO: 1936422 - RNA, 12 nt, Shigella flexneri 2a str. 2457T
augccauuugcc

SEQ ID NO: 1936423 - RNA, 13 nt, Shigella flexneri 2a str. 2457T
augcagccuucau

SEQ ID NO: 1936424 - RNA, 13 nt, Shigella flexneri 2a str. 2457T
augcagcugcucg

SEQ ID NO: 1936425 - RNA, 15 nt, Shigella flexneri 2a str. 2457T
augcaggcagcacug

SEQ ID NO: 1936426 - RNA, 22 nt, Shigella flexneri 2a str. 2457T
augcaggcaucggugaugcucu

SEQ ID NO: 1936427 - RNA, 22 nt, Shigella flexneri 2a str. 2457T
augcagcauugccugaugcgcu

SEQ ID NO: 1936428 - RNA, 19 nt, Shigella flexneri 2a str. 2457T
augcaauuaccgccaccag

SEQ ID NO: 1936429 - RNA, 22 nt, Shigella flexneri 2a str. 2457T
augcaauagcgccugcugcugu

SEQ ID NO: 1936430 - RNA, 14 nt, Shigella flexneri 2a str. 2457T
augccagcgaagaa

SEQ ID NO: 1936431 - RNA, 16 nt, Shigella flexneri 2a str. 2457T
augccagauaagacac

SEQ ID NO: 1936432 - RNA, 20 nt, Shigella flexneri 2a str. 2457T
augccacauuagauaaaaau

SEQ ID NO: 1936433 - RNA, 17 nt, Shigella flexneri 2a str. 2457T
augccacgccacagccg

SEQ ID NO: 1936434 - RNA, 19 nt, Shigella flexneri 2a str. 2457T
augccacgugagcuuuucu

SEQ ID NO: 1936435 - RNA, 15 nt, Shigella flexneri 2a str. 2457T
augccaaucuucaca

SEQ ID NO: 1936436 - RNA, 18 nt, Shigella flexneri 2a str. 2457T
augcaguuuuuaauuuuc

SEQ ID NO: 1936437 - RNA, 13 nt, Shigella flexneri 2a str. 2457T
augcauaaaaaaa

SEQ ID NO: 1936438 - RNA, 22 nt, Shigella flexneri 2a str. 2457T
augaguuuggugccacgcgcau

SEQ ID NO: 1936439 - RNA, 15 nt, Shigella flexneri 2a str. 2457T
augaguuaagaagau

SEQ ID NO: 1936440 - RNA, 15 nt, Shigella flexneri 2a str. 2457T
augagugggaacggc

SEQ ID NO: 1936441 - RNA, 19 nt, Shigella flexneri 2a str. 2457T
augaguuauacagaguguu

SEQ ID NO: 1936442 - RNA, 15 nt, Shigella flexneri 2a str. 2457T
augaguugaaaaccu

SEQ ID NO: 1936443 - RNA, 17 nt, Shigella flexneri 2a str. 2457T
augaugaaacugauaau

SEQ ID NO: 1936444 - RNA, 20 nt, Shigella flexneri 2a str. 2457T
augaugacuugccuccagcg

SEQ ID NO: 1936445 - RNA, 14 nt, Shigella flexneri 2a str. 2457T
augauguaaaaaua

SEQ ID NO: 1936446 - RNA, 19 nt, Shigella flexneri 2a str. 2457T
augcaacgauccuucaaac

SEQ ID NO: 1936447 - RNA, 20 nt, Shigella flexneri 2a str. 2457T
augcaacuguuuuaccaaau

SEQ ID NO: 1936448 - RNA, 20 nt, Shigella flexneri 2a str. 2457T
augcaagaggguuauuuguu

SEQ ID NO: 1936449 - RNA, 18 nt, Shigella flexneri 2a str. 2457T
augcaagaggguuauuug

SEQ ID NO: 1936450 - RNA, 19 nt, Shigella flexneri 2a str. 2457T
augauuucgucauccggug

SEQ ID NO: 1936451 - RNA, 15 nt, Shigella flexneri 2a str. 2457T
augauuucugccagc

SEQ ID NO: 1936452 - RNA, 14 nt, Shigella flexneri 2a str. 2457T
augaaugauaaaau

SEQ ID NO: 1936453 - RNA, 16 nt, Shigella flexneri 2a str. 2457T
augaauguuuuccugc

SEQ ID NO: 1936454 - RNA, 14 nt, Shigella flexneri 2a str. 2457T
augaauuucucgcu

SEQ ID NO: 1936455 - RNA, 20 nt, Shigella flexneri 2a str. 2457T
augaauuuaucuuuaagcac

SEQ ID NO: 1936456 - RNA, 20 nt, Shigella flexneri 2a str. 2457T
augaccagugaggaugcggg

SEQ ID NO: 1936457 - RNA, 16 nt, Shigella flexneri 2a str. 2457T
augaccauaaaaggca

SEQ ID NO: 1936458 - RNA, 12 nt, Shigella flexneri 2a str. 2457T
augacauuaucu

SEQ ID NO: 1936459 - RNA, 22 nt, Shigella flexneri 2a str. 2457T
augacauucacgcugucggcac

SEQ ID NO: 1936460 - RNA, 13 nt, Shigella flexneri 2a str. 2457T
augaauagcgcaa

SEQ ID NO: 1936461 - RNA, 17 nt, Shigella flexneri 2a str. 2457T
augaauagcgcaaaauu

SEQ ID NO: 1936462 - RNA, 21 nt, Shigella flexneri 2a str. 2457T
augaauaucaagaucaucaaa

SEQ ID NO: 1936463 - RNA, 23 nt, Shigella flexneri 2a str. 2457T
augaauaccaagucucaagagug

SEQ ID NO: 1936464 - RNA, 20 nt, Shigella flexneri 2a str. 2457T
augaaguacuuuggaaguau

SEQ ID NO: 1936465 - RNA, 14 nt, Shigella flexneri 2a str. 2457T
augagauauuuaaa

SEQ ID NO: 1936466 - RNA, 19 nt, Shigella flexneri 2a str. 2457T
augagauauuuaaaugauu

SEQ ID NO: 1936467 - RNA, 15 nt, Shigella flexneri 2a str. 2457T
augagacaacaacau

SEQ ID NO: 1936468 - RNA, 15 nt, Shigella flexneri 2a str. 2457T
augagaauaaccagu

SEQ ID NO: 1936469 - RNA, 22 nt, Shigella flexneri 2a str. 2457T
augagaauaaucaccuuuaacc

SEQ ID NO: 1936470 - RNA, 16 nt, Shigella flexneri 2a str. 2457T
augagagaaaaucaca

SEQ ID NO: 1936471 - RNA, 23 nt, Shigella flexneri 2a str. 2457T
augagguuugguagcaaaacaau

SEQ ID NO: 1936472 - RNA, 17 nt, Shigella flexneri 2a str. 2457T
augagucggaccaucau

SEQ ID NO: 1936473 - RNA, 18 nt, Shigella flexneri 2a str. 2457T
augagucggaccaucauu

SEQ ID NO: 1936474 - RNA, 16 nt, Shigella flexneri 2a str. 2457T
augagauauuuaaugg

SEQ ID NO: 1936475 - RNA, 15 nt, Shigella flexneri 2a str. 2457T
augagguagccugag

SEQ ID NO: 1936476 - RNA, 18 nt, Shigella flexneri 2a str. 2457T
augacgaucgcagaaaaa

SEQ ID NO: 1936477 - RNA, 13 nt, Shigella flexneri 2a str. 2457T
augacgcccugug

SEQ ID NO: 1936478 - RNA, 15 nt, Shigella flexneri 2a str. 2457T
augacgacaaggcag

SEQ ID NO: 1936479 - RNA, 15 nt, Shigella flexneri 2a str. 2457T
augagaacaguucag

SEQ ID NO: 1936480 - RNA, 18 nt, Shigella flexneri 2a str. 2457T
augacuuaauaaaauagc

SEQ ID NO: 1936481 - RNA, 20 nt, Shigella flexneri 2a str. 2457T
augacuuucuggcacgaccu

SEQ ID NO: 1936482 - RNA, 20 nt, Shigella flexneri 2a str. 2457T
augaaauaguugcauuccag

SEQ ID NO: 1936483 - RNA, 23 nt, Shigella flexneri 2a str. 2457T
augaacuggcuuucacaaggccg

SEQ ID NO: 1936484 - RNA, 13 nt, Shigella flexneri 2a str. 2457T
augaagaacugga

SEQ ID NO: 1936485 - RNA, 13 nt, Shigella flexneri 2a str. 2457T
augaagcacugca

SEQ ID NO: 1936486 - RNA, 13 nt, Shigella flexneri 2a str. 2457T
aucuuuucugagu

SEQ ID NO: 1936487 - RNA, 16 nt, Shigella flexneri 2a str. 2457T
augaaacgcaaauacu

SEQ ID NO: 1936488 - RNA, 20 nt, Shigella flexneri 2a str. 2457T
augaaagccccaccagcaaa

SEQ ID NO: 1936489 - RNA, 14 nt, Shigella flexneri 2a str. 2457T
aucuucuucuaugc

SEQ ID NO: 1936490 - RNA, 16 nt, Shigella flexneri 2a str. 2457T
aucuucuguugcaggg

SEQ ID NO: 1936491 - RNA, 20 nt, Shigella flexneri 2a str. 2457T
aucuucuugcagcuuaauca

SEQ ID NO: 1936492 - RNA, 20 nt, Shigella flexneri 2a str. 2457T
aucuucuugucauauuugag

SEQ ID NO: 1936493 - RNA, 20 nt, Shigella flexneri 2a str. 2457T
aucuggcugugauccauucc

SEQ ID NO: 1936494 - RNA, 23 nt, Shigella flexneri 2a str. 2457T
aucugguaggacgaaaaaucaau

SEQ ID NO: 1936495 - RNA, 20 nt, Shigella flexneri 2a str. 2457T
aucugggcugccugagcugu

SEQ ID NO: 1936496 - RNA, 15 nt, Shigella flexneri 2a str. 2457T
aucuggccuacagau

SEQ ID NO: 1936497 - RNA, 16 nt, Shigella flexneri 2a str. 2457T
aucuggcauuugcacu

SEQ ID NO: 1936498 - RNA, 21 nt, Shigella flexneri 2a str. 2457T
aucuugauaccaaaauggcgc

SEQ ID NO: 1936499 - RNA, 18 nt, Shigella flexneri 2a str. 2457T
aucuuuaaaaaaagcauu

SEQ ID NO: 1936500 - RNA, 17 nt, Shigella flexneri 2a str. 2457T
aucuugagaaaaaccuc

SEQ ID NO: 1936501 - RNA, 13 nt, Shigella flexneri 2a str. 2457T
aucuuuccagccc

SEQ ID NO: 1936502 - RNA, 16 nt, Shigella flexneri 2a str. 2457T
aucuuucagaaucagg

SEQ ID NO: 1936503 - RNA, 14 nt, Shigella flexneri 2a str. 2457T
aucuuucacgccca

SEQ ID NO: 1936504 - RNA, 13 nt, Shigella flexneri 2a str. 2457T
aucuuucacgccc

SEQ ID NO: 1936505 - RNA, 23 nt, Shigella flexneri 2a str. 2457T
aucuuucacaaagacgccaucaa

SEQ ID NO: 1936506 - RNA, 17 nt, Shigella flexneri 2a str. 2457T
aucgccgguaaugacuc

SEQ ID NO: 1936507 - RNA, 18 nt, Shigella flexneri 2a str. 2457T
aucgcccugcuccagcaa

SEQ ID NO: 1936508 - RNA, 16 nt, Shigella flexneri 2a str. 2457T
aucgcccugcuccagc

SEQ ID NO: 1936509 - RNA, 14 nt, Shigella flexneri 2a str. 2457T
aucgccccuccccc

SEQ ID NO: 1936510 - RNA, 21 nt, Shigella flexneri 2a str. 2457T
aucgcccggauauccacccgc

SEQ ID NO: 1936511 - RNA, 16 nt, Shigella flexneri 2a str. 2457T
aucgcauacaaaaaca

SEQ ID NO: 1936512 - RNA, 23 nt, Shigella flexneri 2a str. 2457T
aucgcaucgaugguugcccugcu

SEQ ID NO: 1936513 - RNA, 17 nt, Shigella flexneri 2a str. 2457T
aucgcauugacgccaaa

SEQ ID NO: 1936514 - RNA, 21 nt, Shigella flexneri 2a str. 2457T
aucgcacguugucagcaacug

SEQ ID NO: 1936515 - RNA, 15 nt, Shigella flexneri 2a str. 2457T
aucgcagcaaacgaa

SEQ ID NO: 1936516 - RNA, 23 nt, Shigella flexneri 2a str. 2457T
aucgcggcuuauugcuucaagau

SEQ ID NO: 1936517 - RNA, 14 nt, Shigella flexneri 2a str. 2457T
aucgcggcacacag

SEQ ID NO: 1936518 - RNA, 20 nt, Shigella flexneri 2a str. 2457T
aucgcggaucagcuuaucca

SEQ ID NO: 1936519 - RNA, 21 nt, Shigella flexneri 2a str. 2457T
aucgcgcuuaucgccagcgcc

SEQ ID NO: 1936520 - RNA, 22 nt, Shigella flexneri 2a str. 2457T
aucgcgcccaaaccacccagca

SEQ ID NO: 1936521 - RNA, 14 nt, Shigella flexneri 2a str. 2457T
aucgcgccagccag

SEQ ID NO: 1936522 - RNA, 15 nt, Shigella flexneri 2a str. 2457T
aucgccuccagcgcu

SEQ ID NO: 1936523 - RNA, 15 nt, Shigella flexneri 2a str. 2457T
aucgcgaccaaucac

SEQ ID NO: 1936524 - RNA, 23 nt, Shigella flexneri 2a str. 2457T
aucgccucgcauaaucugaagaa

SEQ ID NO: 1936525 - RNA, 18 nt, Shigella flexneri 2a str. 2457T
aucgaggccauauuucac

SEQ ID NO: 1936526 - RNA, 16 nt, Shigella flexneri 2a str. 2457T
aucgagccgauuaaaa

SEQ ID NO: 1936527 - RNA, 14 nt, Shigella flexneri 2a str. 2457T
aucgauaaaccagc

SEQ ID NO: 1936528 - RNA, 21 nt, Shigella flexneri 2a str. 2457T
aucgcaaauugacuacaccau

SEQ ID NO: 1936529 - RNA, 16 nt, Shigella flexneri 2a str. 2457T
aucagcguaacggguc

SEQ ID NO: 1936530 - RNA, 19 nt, Shigella flexneri 2a str. 2457T
aucagcguccagcccuccg

SEQ ID NO: 1936531 - RNA, 16 nt, Shigella flexneri 2a str. 2457T
aucagcuauucuuaua

SEQ ID NO: 1936532 - RNA, 19 nt, Shigella flexneri 2a str. 2457T
aucagcugguuauuuucug

SEQ ID NO: 1936533 - RNA, 19 nt, Shigella flexneri 2a str. 2457T
aucagcuuuggugaaaaaa

SEQ ID NO: 1936534 - RNA, 23 nt, Shigella flexneri 2a str. 2457T
aucagcuuuuccauaucaagcau

SEQ ID NO: 1936535 - RNA, 15 nt, Shigella flexneri 2a str. 2457T
aucguuaaauucuaa

SEQ ID NO: 1936536 - RNA, 20 nt, Shigella flexneri 2a str. 2457T
aucguuaaauucuaauguua

SEQ ID NO: 1936537 - RNA, 20 nt, Shigella flexneri 2a str. 2457T
aucgugccaggaccauucac

SEQ ID NO: 1936538 - RNA, 13 nt, Shigella flexneri 2a str. 2457T
aucguccauuucu

SEQ ID NO: 1936539 - RNA, 16 nt, Shigella flexneri 2a str. 2457T
aucguccagcagcaau

SEQ ID NO: 1936540 - RNA, 17 nt, Shigella flexneri 2a str. 2457T
aucggugcggcaaugcc

SEQ ID NO: 1936541 - RNA, 17 nt, Shigella flexneri 2a str. 2457T
aucguccacgucaucaa

SEQ ID NO: 1936542 - RNA, 18 nt, Shigella flexneri 2a str. 2457T
aucguccacgucaucaaa

SEQ ID NO: 1936543 - RNA, 16 nt, Shigella flexneri 2a str. 2457T
aucguccacuugaaaa

SEQ ID NO: 1936544 - RNA, 19 nt, Shigella flexneri 2a str. 2457T
aucguccacuugaaaauua

SEQ ID NO: 1936545 - RNA, 17 nt, Shigella flexneri 2a str. 2457T
aucgugauuucaacgau

SEQ ID NO: 1936546 - RNA, 18 nt, Shigella flexneri 2a str. 2457T
aucgugcaaauucaauau

SEQ ID NO: 1936547 - RNA, 16 nt, Shigella flexneri 2a str. 2457T
aucuaaaugccacuga

SEQ ID NO: 1936548 - RNA, 21 nt, Shigella flexneri 2a str. 2457T
aucuacacgcuaccaaaaaau

SEQ ID NO: 1936549 - RNA, 15 nt, Shigella flexneri 2a str. 2457T
aucuaccacugccug

SEQ ID NO: 1936550 - RNA, 17 nt, Shigella flexneri 2a str. 2457T
aucguuacucuuaucaa

SEQ ID NO: 1936551 - RNA, 13 nt, Shigella flexneri 2a str. 2457T
aucgcgugcggca

SEQ ID NO: 1936552 - RNA, 14 nt, Shigella flexneri 2a str. 2457T
aucgcguugucaua

SEQ ID NO: 1936553 - RNA, 15 nt, Shigella flexneri 2a str. 2457T
aucgcguuguuuagc

SEQ ID NO: 1936554 - RNA, 18 nt, Shigella flexneri 2a str. 2457T
aucgcguacucaccgcuc

SEQ ID NO: 1936555 - RNA, 22 nt, Shigella flexneri 2a str. 2457T
aucgcguaaggcuucaaucaau

SEQ ID NO: 1936556 - RNA, 14 nt, Shigella flexneri 2a str. 2457T
aucgcguaaugcuu

SEQ ID NO: 1936557 - RNA, 13 nt, Shigella flexneri 2a str. 2457T
aucgcguaaggcu

SEQ ID NO: 1936558 - RNA, 20 nt, Shigella flexneri 2a str. 2457T
aucgcgguaaucacgcaugg

SEQ ID NO: 1936559 - RNA, 15 nt, Shigella flexneri 2a str. 2457T
aucggauugcuccug

SEQ ID NO: 1936560 - RNA, 18 nt, Shigella flexneri 2a str. 2457T
aucgguaccgccagcagg

SEQ ID NO: 1936561 - RNA, 20 nt, Shigella flexneri 2a str. 2457T
aucggugaaaguaacaaagc

SEQ ID NO: 1936562 - RNA, 18 nt, Shigella flexneri 2a str. 2457T
aucggugaggaucaccag

SEQ ID NO: 1936563 - RNA, 15 nt, Shigella flexneri 2a str. 2457T
aucgggucaccugcc

SEQ ID NO: 1936564 - RNA, 13 nt, Shigella flexneri 2a str. 2457T
aucgggugaaguu

SEQ ID NO: 1936565 - RNA, 14 nt, Shigella flexneri 2a str. 2457T
aucgggggaagcug

SEQ ID NO: 1936566 - RNA, 20 nt, Shigella flexneri 2a str. 2457T
aucgggggaagcugaaaguu

SEQ ID NO: 1936567 - RNA, 22 nt, Shigella flexneri 2a str. 2457T
aucgggcagcaucgccaggaug

SEQ ID NO: 1936568 - RNA, 15 nt, Shigella flexneri 2a str. 2457T
aucgggaaauaacau

SEQ ID NO: 1936569 - RNA, 22 nt, Shigella flexneri 2a str. 2457T
aucgggacuucgcaauacaggu

SEQ ID NO: 1936570 - RNA, 17 nt, Shigella flexneri 2a str. 2457T
aucgggagagauaagau

SEQ ID NO: 1936571 - RNA, 22 nt, Shigella flexneri 2a str. 2457T
aucggccaucucaacuuucuug

SEQ ID NO: 1936572 - RNA, 13 nt, Shigella flexneri 2a str. 2457T
aucugccagccau

SEQ ID NO: 1936573 - RNA, 16 nt, Shigella flexneri 2a str. 2457T
aucugccagcguaaau

SEQ ID NO: 1936574 - RNA, 23 nt, Shigella flexneri 2a str. 2457T
aucugccccauugcugaugcacc

SEQ ID NO: 1936575 - RNA, 17 nt, Shigella flexneri 2a str. 2457T
aucugcauucaacugga

SEQ ID NO: 1936576 - RNA, 14 nt, Shigella flexneri 2a str. 2457T
aucugccccauugc

SEQ ID NO: 1936577 - RNA, 22 nt, Shigella flexneri 2a str. 2457T
aucugcgccuacggcauucugc

SEQ ID NO: 1936578 - RNA, 15 nt, Shigella flexneri 2a str. 2457T
aucugcgcuggaaca

SEQ ID NO: 1936579 - RNA, 19 nt, Shigella flexneri 2a str. 2457T
aucugcgcuggaacaacgc

SEQ ID NO: 1936580 - RNA, 19 nt, Shigella flexneri 2a str. 2457T
aucugcguaucgcccugcc

SEQ ID NO: 1936581 - RNA, 19 nt, Shigella flexneri 2a str. 2457T
aucugccuuauugaagcuc

SEQ ID NO: 1936582 - RNA, 15 nt, Shigella flexneri 2a str. 2457T
aucugauuaauauug

SEQ ID NO: 1936583 - RNA, 22 nt, Shigella flexneri 2a str. 2457T
aucugaugauauuuuucccuga

SEQ ID NO: 1936584 - RNA, 18 nt, Shigella flexneri 2a str. 2457T
aucugaugauauuuuucc

SEQ ID NO: 1936585 - RNA, 14 nt, Shigella flexneri 2a str. 2457T
aucugaucaauaua

SEQ ID NO: 1936586 - RNA, 18 nt, Shigella flexneri 2a str. 2457T
aucugaccgaaugcaguc

SEQ ID NO: 1936587 - RNA, 11 nt, Shigella flexneri 2a str. 2457T
aucugaauauu

SEQ ID NO: 1936588 - RNA, 15 nt, Shigella flexneri 2a str. 2457T
aucugacagcaaaua

SEQ ID NO: 1936589 - RNA, 17 nt, Shigella flexneri 2a str. 2457T
aucugaaucauucaggu

SEQ ID NO: 1936590 - RNA, 24 nt, Shigella flexneri 2a str. 2457T
aucugaauggcugcauuccuuguu

SEQ ID NO: 1936591 - RNA, 17 nt, Shigella flexneri 2a str. 2457T
aucucuuccagcgauaa

SEQ ID NO: 1936592 - RNA, 21 nt, Shigella flexneri 2a str. 2457T
aucucuuaucauccaggugaa

SEQ ID NO: 1936593 - RNA, 13 nt, Shigella flexneri 2a str. 2457T
aucucuuccagaa

SEQ ID NO: 1936594 - RNA, 14 nt, Shigella flexneri 2a str. 2457T
aucucuucgccugc

SEQ ID NO: 1936595 - RNA, 18 nt, Shigella flexneri 2a str. 2457T
aucucuucgccugccugc

SEQ ID NO: 1936596 - RNA, 21 nt, Shigella flexneri 2a str. 2457T
aucucuucuucaagccaggcu

SEQ ID NO: 1936597 - RNA, 23 nt, Shigella flexneri 2a str. 2457T
aucucuucgccugccugcagcug

SEQ ID NO: 1936598 - RNA, 18 nt, Shigella flexneri 2a str. 2457T
aucucuucguuuucaacg

SEQ ID NO: 1936599 - RNA, 17 nt, Shigella flexneri 2a str. 2457T
aucucuuuccacaaugu

SEQ ID NO: 1936600 - RNA, 14 nt, Shigella flexneri 2a str. 2457T
aucucuucuucgcu

SEQ ID NO: 1936601 - RNA, 20 nt, Shigella flexneri 2a str. 2457T
aucucuguuuugcauggggu

SEQ ID NO: 1936602 - RNA, 21 nt, Shigella flexneri 2a str. 2457T
aucucucuugcuaucacccac

SEQ ID NO: 1936603 - RNA, 23 nt, Shigella flexneri 2a str. 2457T
aucucugacgcgcauacucuccu

SEQ ID NO: 1936604 - RNA, 16 nt, Shigella flexneri 2a str. 2457T
aucucugcgcuaucca

SEQ ID NO: 1936605 - RNA, 20 nt, Shigella flexneri 2a str. 2457T
aucucgccguggaugggacu

SEQ ID NO: 1936606 - RNA, 23 nt, Shigella flexneri 2a str. 2457T
aucucggggcuuauuaacuuccc

SEQ ID NO: 1936607 - RNA, 22 nt, Shigella flexneri 2a str. 2457T
aucucgguggaaaauagcauaa

SEQ ID NO: 1936608 - RNA, 14 nt, Shigella flexneri 2a str. 2457T
aucucguugaucac

SEQ ID NO: 1936609 - RNA, 23 nt, Shigella flexneri 2a str. 2457T
aucucuacagcgcccgccagcac

SEQ ID NO: 1936610 - RNA, 18 nt, Shigella flexneri 2a str. 2457T
aucucucaugucugccgc

SEQ ID NO: 1936611 - RNA, 18 nt, Shigella flexneri 2a str. 2457T
aucuaccguuacggcugg

SEQ ID NO: 1936612 - RNA, 21 nt, Shigella flexneri 2a str. 2457T
aucuaccguuacggcuggaag

SEQ ID NO: 1936613 - RNA, 19 nt, Shigella flexneri 2a str. 2457T
aucuacgcucucuucaaac

SEQ ID NO: 1936614 - RNA, 15 nt, Shigella flexneri 2a str. 2457T
aucuauagcacccgc

SEQ ID NO: 1936615 - RNA, 14 nt, Shigella flexneri 2a str. 2457T
aucuauccggcaua

SEQ ID NO: 1936616 - RNA, 23 nt, Shigella flexneri 2a str. 2457T
aucuaucaggacgaaaaaucaca

SEQ ID NO: 1936617 - RNA, 23 nt, Shigella flexneri 2a str. 2457T
aucuaugguuuuuucuacacaga

SEQ ID NO: 1936618 - RNA, 17 nt, Shigella flexneri 2a str. 2457T
aucuauuauuauuuuug

SEQ ID NO: 1936619 - RNA, 13 nt, Shigella flexneri 2a str. 2457T
aucucaauauuag

SEQ ID NO: 1936620 - RNA, 13 nt, Shigella flexneri 2a str. 2457T
aucuccuugcugg

SEQ ID NO: 1936621 - RNA, 21 nt, Shigella flexneri 2a str. 2457T
aucucccuguaucccaguucg

SEQ ID NO: 1936622 - RNA, 18 nt, Shigella flexneri 2a str. 2457T
aucuccggcgguaaaugc

SEQ ID NO: 1936623 - RNA, 22 nt, Shigella flexneri 2a str. 2457T
aucuccggcgguaaaugcucau

SEQ ID NO: 1936624 - RNA, 16 nt, Shigella flexneri 2a str. 2457T
aucuccagcuauaacg

SEQ ID NO: 1936625 - RNA, 18 nt, Shigella flexneri 2a str. 2457T
aucuccaguggugauacc

SEQ ID NO: 1936626 - RNA, 16 nt, Shigella flexneri 2a str. 2457T
aucuccacagucaggc

SEQ ID NO: 1936627 - RNA, 13 nt, Shigella flexneri 2a str. 2457T
aucucaucagcgu

SEQ ID NO: 1936628 - RNA, 23 nt, Shigella flexneri 2a str. 2457T
aucucacccauagauaccuucuu

SEQ ID NO: 1936629 - RNA, 22 nt, Shigella flexneri 2a str. 2457T
aucucagauaaaugcaaacgca

SEQ ID NO: 1936630 - RNA, 16 nt, Shigella flexneri 2a str. 2457T
aucucagauaaaugca

SEQ ID NO: 1936631 - RNA, 20 nt, Shigella flexneri 2a str. 2457T
aucucagcucauuaaaaaua

SEQ ID NO: 1936632 - RNA, 12 nt, Shigella flexneri 2a str. 2457T
auguggaaacag

SEQ ID NO: 1936633 - RNA, 14 nt, Shigella flexneri 2a str. 2457T
augugcaguuccug

SEQ ID NO: 1936634 - RNA, 15 nt, Shigella flexneri 2a str. 2457T
augugcaguuccugc

SEQ ID NO: 1936635 - RNA, 22 nt, Shigella flexneri 2a str. 2457T
auguggcccagccuuuccggca

SEQ ID NO: 1936636 - RNA, 16 nt, Shigella flexneri 2a str. 2457T
augugggcugccccag

SEQ ID NO: 1936637 - RNA, 14 nt, Shigella flexneri 2a str. 2457T
auguuaaccgccug

SEQ ID NO: 1936638 - RNA, 19 nt, Shigella flexneri 2a str. 2457T
auguguuggcaccaucccu

SEQ ID NO: 1936639 - RNA, 15 nt, Shigella flexneri 2a str. 2457T
augugauuuugugaa

SEQ ID NO: 1936640 - RNA, 22 nt, Shigella flexneri 2a str. 2457T
augugauggccgcgcagggcau

SEQ ID NO: 1936641 - RNA, 17 nt, Shigella flexneri 2a str. 2457T
augugaauggccagaca

SEQ ID NO: 1936642 - RNA, 21 nt, Shigella flexneri 2a str. 2457T
augucgagugaauaauugagg

SEQ ID NO: 1936643 - RNA, 16 nt, Shigella flexneri 2a str. 2457T
auguccugcggacagu

SEQ ID NO: 1936644 - RNA, 20 nt, Shigella flexneri 2a str. 2457T
augguuagccuguaauguca

SEQ ID NO: 1936645 - RNA, 17 nt, Shigella flexneri 2a str. 2457T
augguuacuuuuuaugu

SEQ ID NO: 1936646 - RNA, 11 nt, Shigella flexneri 2a str. 2457T
augguuuucaa

SEQ ID NO: 1936647 - RNA, 18 nt, Shigella flexneri 2a str. 2457T
augguuuggucuccugca

SEQ ID NO: 1936648 - RNA, 21 nt, Shigella flexneri 2a str. 2457T
auguaaaaggcgcuaaaaaua

SEQ ID NO: 1936649 - RNA, 14 nt, Shigella flexneri 2a str. 2457T
auguaaaaauacug

SEQ ID NO: 1936650 - RNA, 21 nt, Shigella flexneri 2a str. 2457T
auguaauuaagcgcaaaggcc

SEQ ID NO: 1936651 - RNA, 21 nt, Shigella flexneri 2a str. 2457T
auguaggguacagcacgauga

SEQ ID NO: 1936652 - RNA, 21 nt, Shigella flexneri 2a str. 2457T
auguaaucuguugaaauaaug

SEQ ID NO: 1936653 - RNA, 14 nt, Shigella flexneri 2a str. 2457T
auguccauuauuuc

SEQ ID NO: 1936654 - RNA, 12 nt, Shigella flexneri 2a str. 2457T
auguauccggca

SEQ ID NO: 1936655 - RNA, 20 nt, Shigella flexneri 2a str. 2457T
auguauggcgauagcccaga

SEQ ID NO: 1936656 - RNA, 18 nt, Shigella flexneri 2a str. 2457T
augcgcaaccguaaacga

SEQ ID NO: 1936657 - RNA, 23 nt, Shigella flexneri 2a str. 2457T
augcgcaucaaagccaggcagaa

SEQ ID NO: 1936658 - RNA, 14 nt, Shigella flexneri 2a str. 2457T
augcgaaaaaaaag

SEQ ID NO: 1936659 - RNA, 21 nt, Shigella flexneri 2a str. 2457T
auggcauuggccguugccauu

SEQ ID NO: 1936660 - RNA, 20 nt, Shigella flexneri 2a str. 2457T
auggcauucucacuccagcc

SEQ ID NO: 1936661 - RNA, 15 nt, Shigella flexneri 2a str. 2457T
auggcauuaauaugc

SEQ ID NO: 1936662 - RNA, 23 nt, Shigella flexneri 2a str. 2457T
auggcauccuguuuucuggaugc

SEQ ID NO: 1936663 - RNA, 20 nt, Shigella flexneri 2a str. 2457T
auggcauaccauccggcaua

SEQ ID NO: 1936664 - RNA, 21 nt, Shigella flexneri 2a str. 2457T
auggcaggaguggcagcaugc

SEQ ID NO: 1936665 - RNA, 13 nt, Shigella flexneri 2a str. 2457T
auggcagaagcau

SEQ ID NO: 1936666 - RNA, 20 nt, Shigella flexneri 2a str. 2457T
auggcagaguugccacccgg

SEQ ID NO: 1936667 - RNA, 18 nt, Shigella flexneri 2a str. 2457T
auggcagauaaaauacuu

SEQ ID NO: 1936668 - RNA, 14 nt, Shigella flexneri 2a str. 2457T
auggcgcgccaccu

SEQ ID NO: 1936669 - RNA, 18 nt, Shigella flexneri 2a str. 2457T
auggcgcgcggcaggaag

SEQ ID NO: 1936670 - RNA, 16 nt, Shigella flexneri 2a str. 2457T
auggcgggauguguaa

SEQ ID NO: 1936671 - RNA, 16 nt, Shigella flexneri 2a str. 2457T
auggcuacguagcuca

SEQ ID NO: 1936672 - RNA, 19 nt, Shigella flexneri 2a str. 2457T
auggcggaucacgcuguuu

SEQ ID NO: 1936673 - RNA, 14 nt, Shigella flexneri 2a str. 2457T
auggcucagauuga

SEQ ID NO: 1936674 - RNA, 14 nt, Shigella flexneri 2a str. 2457T
auggcuaucaagau

SEQ ID NO: 1936675 - RNA, 16 nt, Shigella flexneri 2a str. 2457T
auggcucagauugaac

SEQ ID NO: 1936676 - RNA, 13 nt, Shigella flexneri 2a str. 2457T
auggcuccgggug

SEQ ID NO: 1936677 - RNA, 22 nt, Shigella flexneri 2a str. 2457T
auggcuccgggugugacaacaa

SEQ ID NO: 1936678 - RNA, 16 nt, Shigella flexneri 2a str. 2457T
auggcucuucaccugc

SEQ ID NO: 1936679 - RNA, 22 nt, Shigella flexneri 2a str. 2457T
auggcugaaagcgccgggaaug

SEQ ID NO: 1936680 - RNA, 11 nt, Shigella flexneri 2a str. 2457T
augggagcaga

SEQ ID NO: 1936681 - RNA, 20 nt, Shigella flexneri 2a str. 2457T
augggaccgcuaccacggaa

SEQ ID NO: 1936682 - RNA, 16 nt, Shigella flexneri 2a str. 2457T
augggcguuucacugg

SEQ ID NO: 1936683 - RNA, 17 nt, Shigella flexneri 2a str. 2457T
augguaucgggcaguuu

SEQ ID NO: 1936684 - RNA, 20 nt, Shigella flexneri 2a str. 2457T
auggucucgccgauagucag

SEQ ID NO: 1936685 - RNA, 22 nt, Shigella flexneri 2a str. 2457T
auggucgcaucauuuaaaaaga

SEQ ID NO: 1936686 - RNA, 20 nt, Shigella flexneri 2a str. 2457T
auggucgcaucauuuaaaaa

SEQ ID NO: 1936687 - RNA, 22 nt, Shigella flexneri 2a str. 2457T
augguguuggcaaucagcggca

SEQ ID NO: 1936688 - RNA, 14 nt, Shigella flexneri 2a str. 2457T
augguguuuuccac

SEQ ID NO: 1936689 - RNA, 13 nt, Shigella flexneri 2a str. 2457T
augguuacgcaua

SEQ ID NO: 1936690 - RNA, 21 nt, Shigella flexneri 2a str. 2457T
augguuacgcagauauucguu

SEQ ID NO: 1936691 - RNA, 18 nt, Shigella flexneri 2a str. 2457T
augguguuggcaaucagc

SEQ ID NO: 1936692 - RNA, 17 nt, Shigella flexneri 2a str. 2457T
augguguucagauggcc

SEQ ID NO: 1936693 - RNA, 14 nt, Shigella flexneri 2a str. 2457T
auggugaaaguaaa

SEQ ID NO: 1936694 - RNA, 16 nt, Shigella flexneri 2a str. 2457T
auggucuguaccacca

SEQ ID NO: 1936695 - RNA, 17 nt, Shigella flexneri 2a str. 2457T
augguguaaaugccggu

SEQ ID NO: 1936696 - RNA, 23 nt, Shigella flexneri 2a str. 2457T
auuaacggcguuuccuucguuau

SEQ ID NO: 1936697 - RNA, 19 nt, Shigella flexneri 2a str. 2457T
auuaacgcuuguaaaugaa

SEQ ID NO: 1936698 - RNA, 20 nt, Shigella flexneri 2a str. 2457T
auuaacgauacuucugguga

SEQ ID NO: 1936699 - RNA, 20 nt, Shigella flexneri 2a str. 2457T
auuaacgacacucucuucaa

SEQ ID NO: 1936700 - RNA, 22 nt, Shigella flexneri 2a str. 2457T
auuaacgacgcauacucuuuga

SEQ ID NO: 1936701 - RNA, 16 nt, Shigella flexneri 2a str. 2457T
auuaacgauacuucug

SEQ ID NO: 1936702 - RNA, 18 nt, Shigella flexneri 2a str. 2457T
auuaaccucaaccacuca

SEQ ID NO: 1936703 - RNA, 22 nt, Shigella flexneri 2a str. 2457T
auuaaccgggcguuauuuccag

SEQ ID NO: 1936704 - RNA, 17 nt, Shigella flexneri 2a str. 2457T
auuaacgugaucaaauc

SEQ ID NO: 1936705 - RNA, 20 nt, Shigella flexneri 2a str. 2457T
auuaacgugaucaaaucaug

SEQ ID NO: 1936706 - RNA, 20 nt, Shigella flexneri 2a str. 2457T
auuaacugcgcgauuaucau

SEQ ID NO: 1936707 - RNA, 13 nt, Shigella flexneri 2a str. 2457T
auuaacuguucug

SEQ ID NO: 1936708 - RNA, 20 nt, Shigella flexneri 2a str. 2457T
auuaacuuaauaaacaucag

SEQ ID NO: 1936709 - RNA, 21 nt, Shigella flexneri 2a str. 2457T
auuaagccaugaaugauguaa

SEQ ID NO: 1936710 - RNA, 17 nt, Shigella flexneri 2a str. 2457T
auuaagcccggucauca

SEQ ID NO: 1936711 - RNA, 21 nt, Shigella flexneri 2a str. 2457T
auuaagaagucgcaaugagua

SEQ ID NO: 1936712 - RNA, 22 nt, Shigella flexneri 2a str. 2457T
auuaacagucagucucaaggga

SEQ ID NO: 1936713 - RNA, 12 nt, Shigella flexneri 2a str. 2457T
auuaacagguau

SEQ ID NO: 1936714 - RNA, 17 nt, Shigella flexneri 2a str. 2457T
auuaacaggugucacau

SEQ ID NO: 1936715 - RNA, 21 nt, Shigella flexneri 2a str. 2457T
auuaaccagccacugcgccau

SEQ ID NO: 1936716 - RNA, 14 nt, Shigella flexneri 2a str. 2457T
auuaacaacgggcu

SEQ ID NO: 1936717 - RNA, 15 nt, Shigella flexneri 2a str. 2457T
auuaacaacgggcua

SEQ ID NO: 1936718 - RNA, 16 nt, Shigella flexneri 2a str. 2457T
auuaacaacguuuuuc

SEQ ID NO: 1936719 - RNA, 17 nt, Shigella flexneri 2a str. 2457T
auuaacaacguuuuucu

SEQ ID NO: 1936720 - RNA, 22 nt, Shigella flexneri 2a str. 2457T
auuaaauucgaacggugaauuc

SEQ ID NO: 1936721 - RNA, 22 nt, Shigella flexneri 2a str. 2457T
auuaaauucaaugaauuaaaaa

SEQ ID NO: 1936722 - RNA, 12 nt, Shigella flexneri 2a str. 2457T
auuaaauugucu

SEQ ID NO: 1936723 - RNA, 20 nt, Shigella flexneri 2a str. 2457T
auuaaugccucgugcucaga

SEQ ID NO: 1936724 - RNA, 11 nt, Shigella flexneri 2a str. 2457T
auuaaugacau

SEQ ID NO: 1936725 - RNA, 20 nt, Shigella flexneri 2a str. 2457T
auuaaucgauaaaccagcaa

SEQ ID NO: 1936726 - RNA, 18 nt, Shigella flexneri 2a str. 2457T
auuaaucgugaaaagcug

SEQ ID NO: 1936727 - RNA, 21 nt, Shigella flexneri 2a str. 2457T
auuaaucccugcuucggucag

SEQ ID NO: 1936728 - RNA, 13 nt, Shigella flexneri 2a str. 2457T
auuaauaacacau

SEQ ID NO: 1936729 - RNA, 11 nt, Shigella flexneri 2a str. 2457T
auuaauacaac

SEQ ID NO: 1936730 - RNA, 22 nt, Shigella flexneri 2a str. 2457T
auuaagcgcaaaggccagcaau

SEQ ID NO: 1936731 - RNA, 15 nt, Shigella flexneri 2a str. 2457T
auuaaggcaagaaaa

SEQ ID NO: 1936732 - RNA, 17 nt, Shigella flexneri 2a str. 2457T
auuaagcgucgguacaa

SEQ ID NO: 1936733 - RNA, 20 nt, Shigella flexneri 2a str. 2457T
auuaagcgcaaaggccagca

SEQ ID NO: 1936734 - RNA, 24 nt, Shigella flexneri 2a str. 2457T
auuaaguaaugcggcaagggcgaa

SEQ ID NO: 1936735 - RNA, 14 nt, Shigella flexneri 2a str. 2457T
auuaaaaaaacacc

SEQ ID NO: 1936736 - RNA, 16 nt, Shigella flexneri 2a str. 2457T
auuaaaaagccugcca

SEQ ID NO: 1936737 - RNA, 17 nt, Shigella flexneri 2a str. 2457T
auuaaaggcaccaauau

SEQ ID NO: 1936738 - RNA, 22 nt, Shigella flexneri 2a str. 2457T
auuaaaguaggccagauaagac

SEQ ID NO: 1936739 - RNA, 15 nt, Shigella flexneri 2a str. 2457T
auuaaaggcaccaau

SEQ ID NO: 1936740 - RNA, 16 nt, Shigella flexneri 2a str. 2457T
auuaaaggaaggucau

SEQ ID NO: 1936741 - RNA, 14 nt, Shigella flexneri 2a str. 2457T
auuaaagaaaauaa

SEQ ID NO: 1936742 - RNA, 17 nt, Shigella flexneri 2a str. 2457T
auuaaacacgggguuaa

SEQ ID NO: 1936743 - RNA, 17 nt, Shigella flexneri 2a str. 2457T
auuaaaccuaaaaagaa

SEQ ID NO: 1936744 - RNA, 19 nt, Shigella flexneri 2a str. 2457T
auuaaaccuaaaaagaaaa

SEQ ID NO: 1936745 - RNA, 19 nt, Shigella flexneri 2a str. 2457T
auuaaacgcaguaagcgcc

SEQ ID NO: 1936746 - RNA, 14 nt, Shigella flexneri 2a str. 2457T
auguuuaucuacag

SEQ ID NO: 1936747 - RNA, 15 nt, Shigella flexneri 2a str. 2457T
auguuuaugccuggu

SEQ ID NO: 1936748 - RNA, 16 nt, Shigella flexneri 2a str. 2457T
auguuuaugccugguu

SEQ ID NO: 1936749 - RNA, 17 nt, Shigella flexneri 2a str. 2457T
auguuucuucaacaccc

SEQ ID NO: 1936750 - RNA, 19 nt, Shigella flexneri 2a str. 2457T
auguuucaacggaccaaua

SEQ ID NO: 1936751 - RNA, 23 nt, Shigella flexneri 2a str. 2457T
auguuugucacugacuauuuccg

SEQ ID NO: 1936752 - RNA, 21 nt, Shigella flexneri 2a str. 2457T
auguuuuaacacacaauuacc

SEQ ID NO: 1936753 - RNA, 11 nt, Shigella flexneri 2a str. 2457T
auguuugccau

SEQ ID NO: 1936754 - RNA, 12 nt, Shigella flexneri 2a str. 2457T
auguuugcaaua

SEQ ID NO: 1936755 - RNA, 23 nt, Shigella flexneri 2a str. 2457T
auguuugaaucaacauauuaaaa

SEQ ID NO: 1936756 - RNA, 17 nt, Shigella flexneri 2a str. 2457T
auguuggagauaacaac

SEQ ID NO: 1936757 - RNA, 15 nt, Shigella flexneri 2a str. 2457T
auguugucgccagua

SEQ ID NO: 1936758 - RNA, 14 nt, Shigella flexneri 2a str. 2457T
auguuguuccuuuu

SEQ ID NO: 1936759 - RNA, 21 nt, Shigella flexneri 2a str. 2457T
auguuguuccuuuuauuuaac

SEQ ID NO: 1936760 - RNA, 20 nt, Shigella flexneri 2a str. 2457T
auguuccagggccuccugca

SEQ ID NO: 1936761 - RNA, 13 nt, Shigella flexneri 2a str. 2457T
auguucagauaau

SEQ ID NO: 1936762 - RNA, 19 nt, Shigella flexneri 2a str. 2457T
auguucagauaaugcccga

SEQ ID NO: 1936763 - RNA, 21 nt, Shigella flexneri 2a str. 2457T
auguucacugccguacagaca

SEQ ID NO: 1936764 - RNA, 17 nt, Shigella flexneri 2a str. 2457T
auguucagauuguugau

SEQ ID NO: 1936765 - RNA, 19 nt, Shigella flexneri 2a str. 2457T
auguucagauuguugauua

SEQ ID NO: 1936766 - RNA, 16 nt, Shigella flexneri 2a str. 2457T
auuagucuuuaucugc

SEQ ID NO: 1936767 - RNA, 17 nt, Shigella flexneri 2a str. 2457T
auuagugcugcuggaag

SEQ ID NO: 1936768 - RNA, 20 nt, Shigella flexneri 2a str. 2457T
auuagggaucaucuuaacuu

SEQ ID NO: 1936769 - RNA, 19 nt, Shigella flexneri 2a str. 2457T
auuagggcggacaaccagc

SEQ ID NO: 1936770 - RNA, 17 nt, Shigella flexneri 2a str. 2457T
auuaggaauaaugucuu

SEQ ID NO: 1936771 - RNA, 18 nt, Shigella flexneri 2a str. 2457T
auuaggaauaaugucuuu

SEQ ID NO: 1936772 - RNA, 23 nt, Shigella flexneri 2a str. 2457T
auuaggaauaaugucuuuaaugg

SEQ ID NO: 1936773 - RNA, 22 nt, Shigella flexneri 2a str. 2457T
auuauaauaagcgcaaggguaa

SEQ ID NO: 1936774 - RNA, 15 nt, Shigella flexneri 2a str. 2457T
auuauagacaucuuu

SEQ ID NO: 1936775 - RNA, 24 nt, Shigella flexneri 2a str. 2457T
auuauagacaucuuuauaugcaac

SEQ ID NO: 1936776 - RNA, 17 nt, Shigella flexneri 2a str. 2457T
auuauaucgcucucuuu

SEQ ID NO: 1936777 - RNA, 15 nt, Shigella flexneri 2a str. 2457T
auuacuggcgauugu

SEQ ID NO: 1936778 - RNA, 22 nt, Shigella flexneri 2a str. 2457T
auuacugagcaauugcucauag

SEQ ID NO: 1936779 - RNA, 16 nt, Shigella flexneri 2a str. 2457T
auuacugacaauuugc

SEQ ID NO: 1936780 - RNA, 21 nt, Shigella flexneri 2a str. 2457T
auuacuucuugaugcggauaa

SEQ ID NO: 1936781 - RNA, 15 nt, Shigella flexneri 2a str. 2457T
auuacuuaacgucaa

SEQ ID NO: 1936782 - RNA, 13 nt, Shigella flexneri 2a str. 2457T
auuagaaacagaa

SEQ ID NO: 1936783 - RNA, 15 nt, Shigella flexneri 2a str. 2457T
auuacuuuauuuaua

SEQ ID NO: 1936784 - RNA, 14 nt, Shigella flexneri 2a str. 2457T
auuacuuuauuuau

SEQ ID NO: 1936785 - RNA, 18 nt, Shigella flexneri 2a str. 2457T
auuacuuuccaucuuucc

SEQ ID NO: 1936786 - RNA, 20 nt, Shigella flexneri 2a str. 2457T
auuagacgaacguuuaauaa

SEQ ID NO: 1936787 - RNA, 16 nt, Shigella flexneri 2a str. 2457T
auuagauaaaaaugaa

SEQ ID NO: 1936788 - RNA, 15 nt, Shigella flexneri 2a str. 2457T
auuagcacuuuucgu

SEQ ID NO: 1936789 - RNA, 21 nt, Shigella flexneri 2a str. 2457T
auuagcaaugcgcuguaauuu

SEQ ID NO: 1936790 - RNA, 22 nt, Shigella flexneri 2a str. 2457T
auuagcgcuaucaaagggcacc

SEQ ID NO: 1936791 - RNA, 22 nt, Shigella flexneri 2a str. 2457T
auuagcguccggcugccagcca

SEQ ID NO: 1936792 - RNA, 19 nt, Shigella flexneri 2a str. 2457T
auuaccaauaucaaauaaa

SEQ ID NO: 1936793 - RNA, 17 nt, Shigella flexneri 2a str. 2457T
auuaccaacucaucgcc

SEQ ID NO: 1936794 - RNA, 22 nt, Shigella flexneri 2a str. 2457T
auuacccgccucgcaaauucca

SEQ ID NO: 1936795 - RNA, 22 nt, Shigella flexneri 2a str. 2457T
auuaccgaugugaacccugauu

SEQ ID NO: 1936796 - RNA, 21 nt, Shigella flexneri 2a str. 2457T
auuaccgcaccaccagcagcu

SEQ ID NO: 1936797 - RNA, 12 nt, Shigella flexneri 2a str. 2457T
auuaccauuuca

SEQ ID NO: 1936798 - RNA, 18 nt, Shigella flexneri 2a str. 2457T
auuacgaauauaaauauu

SEQ ID NO: 1936799 - RNA, 13 nt, Shigella flexneri 2a str. 2457T
auuaccuuaucaa

SEQ ID NO: 1936800 - RNA, 16 nt, Shigella flexneri 2a str. 2457T
auuacccauauccaga

SEQ ID NO: 1936801 - RNA, 18 nt, Shigella flexneri 2a str. 2457T
auuaccguuaaaaccauc

SEQ ID NO: 1936802 - RNA, 16 nt, Shigella flexneri 2a str. 2457T
auuacuaaaugugcaa

SEQ ID NO: 1936803 - RNA, 12 nt, Shigella flexneri 2a str. 2457T
auuacucagcgc

SEQ ID NO: 1936804 - RNA, 13 nt, Shigella flexneri 2a str. 2457T
auuacuacgguaa

SEQ ID NO: 1936805 - RNA, 14 nt, Shigella flexneri 2a str. 2457T
auuacuacgguaau

SEQ ID NO: 1936806 - RNA, 13 nt, Shigella flexneri 2a str. 2457T
auuacgcuguuca

SEQ ID NO: 1936807 - RNA, 18 nt, Shigella flexneri 2a str. 2457T
auuacgcuguucaucccg

SEQ ID NO: 1936808 - RNA, 20 nt, Shigella flexneri 2a str. 2457T
auuacgagucacaaacauca

SEQ ID NO: 1936809 - RNA, 21 nt, Shigella flexneri 2a str. 2457T
auuacgcaaugcguacuucuu

SEQ ID NO: 1936810 - RNA, 14 nt, Shigella flexneri 2a str. 2457T
auuacgcucacugc

SEQ ID NO: 1936811 - RNA, 14 nt, Shigella flexneri 2a str. 2457T
auuaauuucauuuu

SEQ ID NO: 1936812 - RNA, 22 nt, Shigella flexneri 2a str. 2457T
auuaauugccguuaaaacuaaa

SEQ ID NO: 1936813 - RNA, 18 nt, Shigella flexneri 2a str. 2457T
auuacagagguuuuauga

SEQ ID NO: 1936814 - RNA, 14 nt, Shigella flexneri 2a str. 2457T
auuacagcaccuua

SEQ ID NO: 1936815 - RNA, 17 nt, Shigella flexneri 2a str. 2457T
auuacagagguuuuaug

SEQ ID NO: 1936816 - RNA, 14 nt, Shigella flexneri 2a str. 2457T
auuacagagguuuu

SEQ ID NO: 1936817 - RNA, 20 nt, Shigella flexneri 2a str. 2457T
auuacaucgcgaagaaagcg

SEQ ID NO: 1936818 - RNA, 20 nt, Shigella flexneri 2a str. 2457T
auuacaagaaucaugccaaa

SEQ ID NO: 1936819 - RNA, 22 nt, Shigella flexneri 2a str. 2457T
auuacaacguauuauauauaau

SEQ ID NO: 1936820 - RNA, 12 nt, Shigella flexneri 2a str. 2457T
auuacacagcca

SEQ ID NO: 1936821 - RNA, 13 nt, Shigella flexneri 2a str. 2457T
auuacacagccac

SEQ ID NO: 1936822 - RNA, 14 nt, Shigella flexneri 2a str. 2457T
auuacacagccaca

SEQ ID NO: 1936823 - RNA, 18 nt, Shigella flexneri 2a str. 2457T
auucacguucgugaacau

SEQ ID NO: 1936824 - RNA, 23 nt, Shigella flexneri 2a str. 2457T
auucacgccgcauccggcaucaa

SEQ ID NO: 1936825 - RNA, 18 nt, Shigella flexneri 2a str. 2457T
auucacgcuaucuuucaa

SEQ ID NO: 1936826 - RNA, 16 nt, Shigella flexneri 2a str. 2457T
auucacguugauggua

SEQ ID NO: 1936827 - RNA, 20 nt, Shigella flexneri 2a str. 2457T
auucacgagguuuuuucgga

SEQ ID NO: 1936828 - RNA, 19 nt, Shigella flexneri 2a str. 2457T
auucacgaauauuucccgg

SEQ ID NO: 1936829 - RNA, 17 nt, Shigella flexneri 2a str. 2457T
auucacgaaucuauuca

SEQ ID NO: 1936830 - RNA, 22 nt, Shigella flexneri 2a str. 2457T
auucacgaaucuauucauuuau

SEQ ID NO: 1936831 - RNA, 20 nt, Shigella flexneri 2a str. 2457T
auucacgccacugucauauu

SEQ ID NO: 1936832 - RNA, 13 nt, Shigella flexneri 2a str. 2457T
auucagaaaguaa

SEQ ID NO: 1936833 - RNA, 17 nt, Shigella flexneri 2a str. 2457T
auucagaaaaauacaau

SEQ ID NO: 1936834 - RNA, 17 nt, Shigella flexneri 2a str. 2457T
auucacuugaaguacga

SEQ ID NO: 1936835 - RNA, 17 nt, Shigella flexneri 2a str. 2457T
auucacugccugcugau

SEQ ID NO: 1936836 - RNA, 23 nt, Shigella flexneri 2a str. 2457T
auucagauugcagacaaagugag

SEQ ID NO: 1936837 - RNA, 13 nt, Shigella flexneri 2a str. 2457T
auucagauuaugu

SEQ ID NO: 1936838 - RNA, 21 nt, Shigella flexneri 2a str. 2457T
auucagagggcaaauucuuca

SEQ ID NO: 1936839 - RNA, 17 nt, Shigella flexneri 2a str. 2457T
auucagaucgguuuuuu

SEQ ID NO: 1936840 - RNA, 16 nt, Shigella flexneri 2a str. 2457T
auucacaauucaucau

SEQ ID NO: 1936841 - RNA, 16 nt, Shigella flexneri 2a str. 2457T
auucaauuauaguauc

SEQ ID NO: 1936842 - RNA, 19 nt, Shigella flexneri 2a str. 2457T
auucaauuauaguaucguu

SEQ ID NO: 1936843 - RNA, 16 nt, Shigella flexneri 2a str. 2457T
auucaauuaauaacac

SEQ ID NO: 1936844 - RNA, 22 nt, Shigella flexneri 2a str. 2457T
auucacaucauccggcaccuuu

SEQ ID NO: 1936845 - RNA, 18 nt, Shigella flexneri 2a str. 2457T
auucacaguuaaguuaau

SEQ ID NO: 1936846 - RNA, 19 nt, Shigella flexneri 2a str. 2457T
auucaccgcaucaauauua

SEQ ID NO: 1936847 - RNA, 11 nt, Shigella flexneri 2a str. 2457T
auucaccucug

SEQ ID NO: 1936848 - RNA, 17 nt, Shigella flexneri 2a str. 2457T
auucaccagcaaaucca

SEQ ID NO: 1936849 - RNA, 17 nt, Shigella flexneri 2a str. 2457T
auucaccagaccugaaa

SEQ ID NO: 1936850 - RNA, 18 nt, Shigella flexneri 2a str. 2457T
auucaccagaccugaaac

SEQ ID NO: 1936851 - RNA, 17 nt, Shigella flexneri 2a str. 2457T
auucaacgucacugggu

SEQ ID NO: 1936852 - RNA, 12 nt, Shigella flexneri 2a str. 2457T
auucaacaguag

SEQ ID NO: 1936853 - RNA, 18 nt, Shigella flexneri 2a str. 2457T
auucaacaccgaugcaau

SEQ ID NO: 1936854 - RNA, 13 nt, Shigella flexneri 2a str. 2457T
auucaaauuaugu

SEQ ID NO: 1936855 - RNA, 15 nt, Shigella flexneri 2a str. 2457T
auucaaucucuucac

SEQ ID NO: 1936856 - RNA, 21 nt, Shigella flexneri 2a str. 2457T
auucaauauauugcugaaaua

SEQ ID NO: 1936857 - RNA, 13 nt, Shigella flexneri 2a str. 2457T
auucaagaucaug

SEQ ID NO: 1936858 - RNA, 14 nt, Shigella flexneri 2a str. 2457T
auuauuuuuaaaca

SEQ ID NO: 1936859 - RNA, 19 nt, Shigella flexneri 2a str. 2457T
auuauuuuuaaacaucaaa

SEQ ID NO: 1936860 - RNA, 12 nt, Shigella flexneri 2a str. 2457T
auuauuuuaaau

SEQ ID NO: 1936861 - RNA, 20 nt, Shigella flexneri 2a str. 2457T
auuauuucaaugcauuauca

SEQ ID NO: 1936862 - RNA, 23 nt, Shigella flexneri 2a str. 2457T
auuauuucaaugcauuaucagag

SEQ ID NO: 1936863 - RNA, 19 nt, Shigella flexneri 2a str. 2457T
auuauuugcgucagcucac

SEQ ID NO: 1936864 - RNA, 19 nt, Shigella flexneri 2a str. 2457T
auuauuuuugugaagaaua

SEQ ID NO: 1936865 - RNA, 22 nt, Shigella flexneri 2a str. 2457T
auuauuuuugugaagaauaaau

SEQ ID NO: 1936866 - RNA, 18 nt, Shigella flexneri 2a str. 2457T
auuauuuuuuuaucauuu

SEQ ID NO: 1936867 - RNA, 15 nt, Shigella flexneri 2a str. 2457T
auucaaaauccgcca

SEQ ID NO: 1936868 - RNA, 16 nt, Shigella flexneri 2a str. 2457T
auuauggaucaccauc

SEQ ID NO: 1936869 - RNA, 19 nt, Shigella flexneri 2a str. 2457T
auuaugcagccuuuuuuau

SEQ ID NO: 1936870 - RNA, 16 nt, Shigella flexneri 2a str. 2457T
auuauuaauauucagc

SEQ ID NO: 1936871 - RNA, 12 nt, Shigella flexneri 2a str. 2457T
auuauuauaaua

SEQ ID NO: 1936872 - RNA, 20 nt, Shigella flexneri 2a str. 2457T
auuaugucgcucaaugcgcu

SEQ ID NO: 1936873 - RNA, 15 nt, Shigella flexneri 2a str. 2457T
auuauuaaauuuaau

SEQ ID NO: 1936874 - RNA, 12 nt, Shigella flexneri 2a str. 2457T
auuauugccgca

SEQ ID NO: 1936875 - RNA, 20 nt, Shigella flexneri 2a str. 2457T
auuauugagcgcaaauugcu

SEQ ID NO: 1936876 - RNA, 17 nt, Shigella flexneri 2a str. 2457T
auuauucauaaugccca

SEQ ID NO: 1936877 - RNA, 16 nt, Shigella flexneri 2a str. 2457T
auuauuccguuucguu

SEQ ID NO: 1936878 - RNA, 17 nt, Shigella flexneri 2a str. 2457T
auuauuccauccugcuc

SEQ ID NO: 1936879 - RNA, 16 nt, Shigella flexneri 2a str. 2457T
auuaugcagccuucau

SEQ ID NO: 1936880 - RNA, 19 nt, Shigella flexneri 2a str. 2457T
auuaucuuuauuaucaaca

SEQ ID NO: 1936881 - RNA, 12 nt, Shigella flexneri 2a str. 2457T
auuaucuuuacu

SEQ ID NO: 1936882 - RNA, 20 nt, Shigella flexneri 2a str. 2457T
auuaucuggcaagccugaaa

SEQ ID NO: 1936883 - RNA, 11 nt, Shigella flexneri 2a str. 2457T
auuaucuggau

SEQ ID NO: 1936884 - RNA, 14 nt, Shigella flexneri 2a str. 2457T
auuaucugggcugc

SEQ ID NO: 1936885 - RNA, 12 nt, Shigella flexneri 2a str. 2457T
auuaucuucacc

SEQ ID NO: 1936886 - RNA, 20 nt, Shigella flexneri 2a str. 2457T
auuaucuucaccguucguga

SEQ ID NO: 1936887 - RNA, 19 nt, Shigella flexneri 2a str. 2457T
auuaucucuugccaggcuu

SEQ ID NO: 1936888 - RNA, 14 nt, Shigella flexneri 2a str. 2457T
auuaucucaacaca

SEQ ID NO: 1936889 - RNA, 19 nt, Shigella flexneri 2a str. 2457T
auuaucaggcuaaagguau

SEQ ID NO: 1936890 - RNA, 18 nt, Shigella flexneri 2a str. 2457T
auuaucagacaccgauug

SEQ ID NO: 1936891 - RNA, 17 nt, Shigella flexneri 2a str. 2457T
auuaucagagauucuuu

SEQ ID NO: 1936892 - RNA, 13 nt, Shigella flexneri 2a str. 2457T
auuaucauuuuac

SEQ ID NO: 1936893 - RNA, 18 nt, Shigella flexneri 2a str. 2457T
auuaucccgugcacaaau

SEQ ID NO: 1936894 - RNA, 22 nt, Shigella flexneri 2a str. 2457T
auuauccaucaaagguuuuuca

SEQ ID NO: 1936895 - RNA, 18 nt, Shigella flexneri 2a str. 2457T
auuaucgacugcgcccug

SEQ ID NO: 1936896 - RNA, 17 nt, Shigella flexneri 2a str. 2457T
auuaucgcgucuaaauu

SEQ ID NO: 1936897 - RNA, 19 nt, Shigella flexneri 2a str. 2457T
auuaucgcgucuaaauuuu

SEQ ID NO: 1936898 - RNA, 17 nt, Shigella flexneri 2a str. 2457T
auuaucgucauggcugu

SEQ ID NO: 1936899 - RNA, 21 nt, Shigella flexneri 2a str. 2457T
auauaaauucccgcagauaaa

SEQ ID NO: 1936900 - RNA, 12 nt, Shigella flexneri 2a str. 2457T
auauaaauuuca

SEQ ID NO: 1936901 - RNA, 17 nt, Shigella flexneri 2a str. 2457T
auauaacagucauacaa

SEQ ID NO: 1936902 - RNA, 16 nt, Shigella flexneri 2a str. 2457T
auauaauugaccagau

SEQ ID NO: 1936903 - RNA, 22 nt, Shigella flexneri 2a str. 2457T
auauaauugaccagaucuucau

SEQ ID NO: 1936904 - RNA, 13 nt, Shigella flexneri 2a str. 2457T
auauaauuaaaaa

SEQ ID NO: 1936905 - RNA, 22 nt, Shigella flexneri 2a str. 2457T
auaguguuuuauguucagauaa

SEQ ID NO: 1936906 - RNA, 20 nt, Shigella flexneri 2a str. 2457T
auaguugcauuccaguccac

SEQ ID NO: 1936907 - RNA, 14 nt, Shigella flexneri 2a str. 2457T
auaguggcucaggc

SEQ ID NO: 1936908 - RNA, 21 nt, Shigella flexneri 2a str. 2457T
auaguagccagccagaaucau

SEQ ID NO: 1936909 - RNA, 14 nt, Shigella flexneri 2a str. 2457T
auaggaauuaaaac

SEQ ID NO: 1936910 - RNA, 17 nt, Shigella flexneri 2a str. 2457T
auaggaauuaaaacccc

SEQ ID NO: 1936911 - RNA, 19 nt, Shigella flexneri 2a str. 2457T
auaggcaaaaaaaaugccc

SEQ ID NO: 1936912 - RNA, 21 nt, Shigella flexneri 2a str. 2457T
auaggcaaaaaaaaugcccgc

SEQ ID NO: 1936913 - RNA, 23 nt, Shigella flexneri 2a str. 2457T
auaggauuucugauuauggcggc

SEQ ID NO: 1936914 - RNA, 19 nt, Shigella flexneri 2a str. 2457T
auaggcuuccaccguuucu

SEQ ID NO: 1936915 - RNA, 18 nt, Shigella flexneri 2a str. 2457T
auaggcggcaaacaguuu

SEQ ID NO: 1936916 - RNA, 13 nt, Shigella flexneri 2a str. 2457T
auagggacacauu

SEQ ID NO: 1936917 - RNA, 18 nt, Shigella flexneri 2a str. 2457T
auagguugaaauaaaccg

SEQ ID NO: 1936918 - RNA, 16 nt, Shigella flexneri 2a str. 2457T
auagguucuuuuaaau

SEQ ID NO: 1936919 - RNA, 13 nt, Shigella flexneri 2a str. 2457T
auaguaaccagac

SEQ ID NO: 1936920 - RNA, 15 nt, Shigella flexneri 2a str. 2457T
auauagacaaaguaa

SEQ ID NO: 1936921 - RNA, 21 nt, Shigella flexneri 2a str. 2457T
auauauucguuacuggcaugu

SEQ ID NO: 1936922 - RNA, 23 nt, Shigella flexneri 2a str. 2457T
auauauugaauuagcaauauuuu

SEQ ID NO: 1936923 - RNA, 17 nt, Shigella flexneri 2a str. 2457T
auauauuucaucaacug

SEQ ID NO: 1936924 - RNA, 19 nt, Shigella flexneri 2a str. 2457T
auauauugcaaucaucuug

SEQ ID NO: 1936925 - RNA, 18 nt, Shigella flexneri 2a str. 2457T
auauauuuuuaaauauaa

SEQ ID NO: 1936926 - RNA, 13 nt, Shigella flexneri 2a str. 2457T
auaucaaauaaaa

SEQ ID NO: 1936927 - RNA, 17 nt, Shigella flexneri 2a str. 2457T
auaucaaccaguugugc

SEQ ID NO: 1936928 - RNA, 19 nt, Shigella flexneri 2a str. 2457T
auaucaacguaauggaugc

SEQ ID NO: 1936929 - RNA, 14 nt, Shigella flexneri 2a str. 2457T
auaucaagcaugau

SEQ ID NO: 1936930 - RNA, 17 nt, Shigella flexneri 2a str. 2457T
auaucgccauuaaacaa

SEQ ID NO: 1936931 - RNA, 18 nt, Shigella flexneri 2a str. 2457T
auauccacccgcagccau

SEQ ID NO: 1936932 - RNA, 21 nt, Shigella flexneri 2a str. 2457T
auauccaccgggguaaaucca

SEQ ID NO: 1936933 - RNA, 17 nt, Shigella flexneri 2a str. 2457T
auaucgacgaaccauuu

SEQ ID NO: 1936934 - RNA, 19 nt, Shigella flexneri 2a str. 2457T
auaucgacgaaccauuucg

SEQ ID NO: 1936935 - RNA, 21 nt, Shigella flexneri 2a str. 2457T
auaucgacgaaccauuucgau

SEQ ID NO: 1936936 - RNA, 16 nt, Shigella flexneri 2a str. 2457T
auaucgaagaacugcu

SEQ ID NO: 1936937 - RNA, 22 nt, Shigella flexneri 2a str. 2457T
auauccagcgcggcgaaggugc

SEQ ID NO: 1936938 - RNA, 19 nt, Shigella flexneri 2a str. 2457T
auauccagauccagcaccu

SEQ ID NO: 1936939 - RNA, 16 nt, Shigella flexneri 2a str. 2457T
auauccagauggcuau

SEQ ID NO: 1936940 - RNA, 16 nt, Shigella flexneri 2a str. 2457T
auauccagcgccgagg

SEQ ID NO: 1936941 - RNA, 19 nt, Shigella flexneri 2a str. 2457T
auauccagcgccgagguug

SEQ ID NO: 1936942 - RNA, 20 nt, Shigella flexneri 2a str. 2457T
auaucuuuucuuaacaaaaa

SEQ ID NO: 1936943 - RNA, 23 nt, Shigella flexneri 2a str. 2457T
auaucuuucccuuucgauaagac

SEQ ID NO: 1936944 - RNA, 22 nt, Shigella flexneri 2a str. 2457T
auaucuuauagacuaaauuuca

SEQ ID NO: 1936945 - RNA, 19 nt, Shigella flexneri 2a str. 2457T
auaucugccggaagacaca

SEQ ID NO: 1936946 - RNA, 23 nt, Shigella flexneri 2a str. 2457T
auaucuaugguuuuuucuacaca

SEQ ID NO: 1936947 - RNA, 19 nt, Shigella flexneri 2a str. 2457T
auagcugcgacaucauuuu

SEQ ID NO: 1936948 - RNA, 19 nt, Shigella flexneri 2a str. 2457T
auagcuaaucaucuguugu

SEQ ID NO: 1936949 - RNA, 14 nt, Shigella flexneri 2a str. 2457T
auagcuaaucaucu

SEQ ID NO: 1936950 - RNA, 17 nt, Shigella flexneri 2a str. 2457T
auagcuuauucuuauua

SEQ ID NO: 1936951 - RNA, 21 nt, Shigella flexneri 2a str. 2457T
auagcgguaagcaugaauauc

SEQ ID NO: 1936952 - RNA, 12 nt, Shigella flexneri 2a str. 2457T
auagcgucaaga

SEQ ID NO: 1936953 - RNA, 15 nt, Shigella flexneri 2a str. 2457T
auagcggcugacggu

SEQ ID NO: 1936954 - RNA, 21 nt, Shigella flexneri 2a str. 2457T
auagcaguaauugcagcagcu

SEQ ID NO: 1936955 - RNA, 19 nt, Shigella flexneri 2a str. 2457T
auagccaccuggcugcguu

SEQ ID NO: 1936956 - RNA, 19 nt, Shigella flexneri 2a str. 2457T
auacuuucacaaaaauaau

SEQ ID NO: 1936957 - RNA, 23 nt, Shigella flexneri 2a str. 2457T
auacuuucaucaaacgaccaauc

SEQ ID NO: 1936958 - RNA, 13 nt, Shigella flexneri 2a str. 2457T
auagacuucccuc

SEQ ID NO: 1936959 - RNA, 15 nt, Shigella flexneri 2a str. 2457T
auagagauuuuuccc

SEQ ID NO: 1936960 - RNA, 18 nt, Shigella flexneri 2a str. 2457T
auagaguguuccucugcc

SEQ ID NO: 1936961 - RNA, 18 nt, Shigella flexneri 2a str. 2457T
auagagaaaguaaaccac

SEQ ID NO: 1936962 - RNA, 14 nt, Shigella flexneri 2a str. 2457T
auagagcgccugca

SEQ ID NO: 1936963 - RNA, 17 nt, Shigella flexneri 2a str. 2457T
auagcacccgccagcgc

SEQ ID NO: 1936964 - RNA, 14 nt, Shigella flexneri 2a str. 2457T
auaccggacacacu

SEQ ID NO: 1936965 - RNA, 22 nt, Shigella flexneri 2a str. 2457T
auaccggagacgguuauauuua

SEQ ID NO: 1936966 - RNA, 19 nt, Shigella flexneri 2a str. 2457T
auaccggacacacuucauu

SEQ ID NO: 1936967 - RNA, 16 nt, Shigella flexneri 2a str. 2457T
auaauuacuuacaucu

SEQ ID NO: 1936968 - RNA, 23 nt, Shigella flexneri 2a str. 2457T
auaccugaguggcaauagaauaa

SEQ ID NO: 1936969 - RNA, 21 nt, Shigella flexneri 2a str. 2457T
auaccugaugagaugcuggag

SEQ ID NO: 1936970 - RNA, 22 nt, Shigella flexneri 2a str. 2457T
auaccugaugagaugcuggaga

SEQ ID NO: 1936971 - RNA, 13 nt, Shigella flexneri 2a str. 2457T
auaccugccuggu

SEQ ID NO: 1936972 - RNA, 17 nt, Shigella flexneri 2a str. 2457T
auaccuggcgcagcugc

SEQ ID NO: 1936973 - RNA, 15 nt, Shigella flexneri 2a str. 2457T
auaccugguccuuca

SEQ ID NO: 1936974 - RNA, 21 nt, Shigella flexneri 2a str. 2457T
auaccggcgucccaucggcaa

SEQ ID NO: 1936975 - RNA, 17 nt, Shigella flexneri 2a str. 2457T
auacggguuuuccccuu

SEQ ID NO: 1936976 - RNA, 20 nt, Shigella flexneri 2a str. 2457T
auacgggcuuuuuaauuccu

SEQ ID NO: 1936977 - RNA, 15 nt, Shigella flexneri 2a str. 2457T
auacgucaucccaac

SEQ ID NO: 1936978 - RNA, 16 nt, Shigella flexneri 2a str. 2457T
auacgccaucgccagc

SEQ ID NO: 1936979 - RNA, 13 nt, Shigella flexneri 2a str. 2457T
auacgcaccgcuc

SEQ ID NO: 1936980 - RNA, 16 nt, Shigella flexneri 2a str. 2457T
auacgcaccuuuacca

SEQ ID NO: 1936981 - RNA, 22 nt, Shigella flexneri 2a str. 2457T
auacguugcauaaaugccgcaa

SEQ ID NO: 1936982 - RNA, 19 nt, Shigella flexneri 2a str. 2457T
auacuguuuaucuucccag

SEQ ID NO: 1936983 - RNA, 23 nt, Shigella flexneri 2a str. 2457T
auacuggauagauauucuccagc

SEQ ID NO: 1936984 - RNA, 17 nt, Shigella flexneri 2a str. 2457T
auacuggauuucauucg

SEQ ID NO: 1936985 - RNA, 23 nt, Shigella flexneri 2a str. 2457T
auacugauaauaaauaacagugc

SEQ ID NO: 1936986 - RNA, 13 nt, Shigella flexneri 2a str. 2457T
auacugacauuaa

SEQ ID NO: 1936987 - RNA, 14 nt, Shigella flexneri 2a str. 2457T
auacugacaucagc

SEQ ID NO: 1936988 - RNA, 14 nt, Shigella flexneri 2a str. 2457T
auacugcaucagcg

SEQ ID NO: 1936989 - RNA, 14 nt, Shigella flexneri 2a str. 2457T
auacugaucaucau

SEQ ID NO: 1936990 - RNA, 13 nt, Shigella flexneri 2a str. 2457T
auacugcucagac

SEQ ID NO: 1936991 - RNA, 22 nt, Shigella flexneri 2a str. 2457T
auacugcuccccgaacgauugu

SEQ ID NO: 1936992 - RNA, 15 nt, Shigella flexneri 2a str. 2457T
auauuuuaaucagcg

SEQ ID NO: 1936993 - RNA, 19 nt, Shigella flexneri 2a str. 2457T
auauugccgaagaccagau

SEQ ID NO: 1936994 - RNA, 12 nt, Shigella flexneri 2a str. 2457T
auauuguuuuaa

SEQ ID NO: 1936995 - RNA, 17 nt, Shigella flexneri 2a str. 2457T
auauuuucugaaaauca

SEQ ID NO: 1936996 - RNA, 14 nt, Shigella flexneri 2a str. 2457T
auauuuuucccuga

SEQ ID NO: 1936997 - RNA, 15 nt, Shigella flexneri 2a str. 2457T
auauuuuuaaauaua

SEQ ID NO: 1936998 - RNA, 13 nt, Shigella flexneri 2a str. 2457T
auauuuuuuuagu

SEQ ID NO: 1936999 - RNA, 19 nt, Shigella flexneri 2a str. 2457T
aucaaaaaaggcugacaaa

SEQ ID NO: 1937000 - RNA, 21 nt, Shigella flexneri 2a str. 2457T
aucaaaaaaggcugacaaauc

SEQ ID NO: 1937001 - RNA, 11 nt, Shigella flexneri 2a str. 2457T
auauuuuuccg

SEQ ID NO: 1937002 - RNA, 20 nt, Shigella flexneri 2a str. 2457T
auauuuuuuuccuaaacccu

SEQ ID NO: 1937003 - RNA, 14 nt, Shigella flexneri 2a str. 2457T
auauucgcuuucag

SEQ ID NO: 1937004 - RNA, 20 nt, Shigella flexneri 2a str. 2457T
auauucgacaccaucuuccu

SEQ ID NO: 1937005 - RNA, 13 nt, Shigella flexneri 2a str. 2457T
auauucagcagca

SEQ ID NO: 1937006 - RNA, 19 nt, Shigella flexneri 2a str. 2457T
auauugcacaguauagcau

SEQ ID NO: 1937007 - RNA, 24 nt, Shigella flexneri 2a str. 2457T
auauuauuggcaucguauuucaga

SEQ ID NO: 1937008 - RNA, 15 nt, Shigella flexneri 2a str. 2457T
auauuauugaaauca

SEQ ID NO: 1937009 - RNA, 20 nt, Shigella flexneri 2a str. 2457T
auaugagcgauuuuuuauag

SEQ ID NO: 1937010 - RNA, 22 nt, Shigella flexneri 2a str. 2457T
auaugagguuagcaaugccuuc

SEQ ID NO: 1937011 - RNA, 17 nt, Shigella flexneri 2a str. 2457T
auaugauaauuauuaua

SEQ ID NO: 1937012 - RNA, 12 nt, Shigella flexneri 2a str. 2457T
auauucaccacg

SEQ ID NO: 1937013 - RNA, 15 nt, Shigella flexneri 2a str. 2457T
auauucaacaccgau

SEQ ID NO: 1937014 - RNA, 21 nt, Shigella flexneri 2a str. 2457T
aucaauuuucccuucugagau

SEQ ID NO: 1937015 - RNA, 20 nt, Shigella flexneri 2a str. 2457T
aucaauuugcuucuggcugg

SEQ ID NO: 1937016 - RNA, 20 nt, Shigella flexneri 2a str. 2457T
aucaauugcguuaaaaucag

SEQ ID NO: 1937017 - RNA, 15 nt, Shigella flexneri 2a str. 2457T
aucaauugcuaccga

SEQ ID NO: 1937018 - RNA, 23 nt, Shigella flexneri 2a str. 2457T
aucaauuuccggcuuaccaaaua

SEQ ID NO: 1937019 - RNA, 17 nt, Shigella flexneri 2a str. 2457T
aucacaauagaaauauu

SEQ ID NO: 1937020 - RNA, 19 nt, Shigella flexneri 2a str. 2457T
aucacaccgcgaucuucca

SEQ ID NO: 1937021 - RNA, 14 nt, Shigella flexneri 2a str. 2457T
aucaauaaaaauac

SEQ ID NO: 1937022 - RNA, 18 nt, Shigella flexneri 2a str. 2457T
aucaauagcaguaauuuu

SEQ ID NO: 1937023 - RNA, 20 nt, Shigella flexneri 2a str. 2457T
aucaauagcaguaauuuuac

SEQ ID NO: 1937024 - RNA, 18 nt, Shigella flexneri 2a str. 2457T
aucaauagugaacugacu

SEQ ID NO: 1937025 - RNA, 14 nt, Shigella flexneri 2a str. 2457T
aucaaguugauuuu

SEQ ID NO: 1937026 - RNA, 15 nt, Shigella flexneri 2a str. 2457T
aucaaucugcugccu

SEQ ID NO: 1937027 - RNA, 15 nt, Shigella flexneri 2a str. 2457T
aucaauauuuucaau

SEQ ID NO: 1937028 - RNA, 17 nt, Shigella flexneri 2a str. 2457T
aucaauauuuucaaucu

SEQ ID NO: 1937029 - RNA, 13 nt, Shigella flexneri 2a str. 2457T
aucaauauauugc

SEQ ID NO: 1937030 - RNA, 21 nt, Shigella flexneri 2a str. 2457T
aucaaugccgcaacuuuagcc

SEQ ID NO: 1937031 - RNA, 13 nt, Shigella flexneri 2a str. 2457T
aucaaugccagca

SEQ ID NO: 1937032 - RNA, 15 nt, Shigella flexneri 2a str. 2457T
aucaaugccagcaua

SEQ ID NO: 1937033 - RNA, 18 nt, Shigella flexneri 2a str. 2457T
aucaaucuuuacacacaa

SEQ ID NO: 1937034 - RNA, 16 nt, Shigella flexneri 2a str. 2457T
aucaaugaugaacgcc

SEQ ID NO: 1937035 - RNA, 18 nt, Shigella flexneri 2a str. 2457T
aucaauggcugcaaagca

SEQ ID NO: 1937036 - RNA, 23 nt, Shigella flexneri 2a str. 2457T
aucaaccagaucgcucaucugcu

SEQ ID NO: 1937037 - RNA, 15 nt, Shigella flexneri 2a str. 2457T
aucaacccagcuggu

SEQ ID NO: 1937038 - RNA, 14 nt, Shigella flexneri 2a str. 2457T
aucaacauucagau

SEQ ID NO: 1937039 - RNA, 21 nt, Shigella flexneri 2a str. 2457T
aucaaccgcacucuacuucuu

SEQ ID NO: 1937040 - RNA, 20 nt, Shigella flexneri 2a str. 2457T
aucaacccugcccuucaggg

SEQ ID NO: 1937041 - RNA, 21 nt, Shigella flexneri 2a str. 2457T
aucaaacuuuuaaauugaaga

SEQ ID NO: 1937042 - RNA, 19 nt, Shigella flexneri 2a str. 2457T
aucaaacuuuuaaauugaa

SEQ ID NO: 1937043 - RNA, 21 nt, Shigella flexneri 2a str. 2457T
aucaacaugauggcuggcuuc

SEQ ID NO: 1937044 - RNA, 22 nt, Shigella flexneri 2a str. 2457T
aucaaacgccugaccguugauu

SEQ ID NO: 1937045 - RNA, 19 nt, Shigella flexneri 2a str. 2457T
aucaaacgugacauucuga

SEQ ID NO: 1937046 - RNA, 20 nt, Shigella flexneri 2a str. 2457T
aucaaacgugacauucugac

SEQ ID NO: 1937047 - RNA, 15 nt, Shigella flexneri 2a str. 2457T
aucaaaccacuuaau

SEQ ID NO: 1937048 - RNA, 14 nt, Shigella flexneri 2a str. 2457T
aucaacgcuggcau

SEQ ID NO: 1937049 - RNA, 15 nt, Shigella flexneri 2a str. 2457T
aucaagauuaaaagu

SEQ ID NO: 1937050 - RNA, 13 nt, Shigella flexneri 2a str. 2457T
aucaagcacaauc

SEQ ID NO: 1937051 - RNA, 15 nt, Shigella flexneri 2a str. 2457T
aucaaguauuuuuaa

SEQ ID NO: 1937052 - RNA, 17 nt, Shigella flexneri 2a str. 2457T
aucagaaacacacuuuc

SEQ ID NO: 1937053 - RNA, 18 nt, Shigella flexneri 2a str. 2457T
aucagaaacacacuuucc

SEQ ID NO: 1937054 - RNA, 19 nt, Shigella flexneri 2a str. 2457T
aucagaaacacacuuucca

SEQ ID NO: 1937055 - RNA, 13 nt, Shigella flexneri 2a str. 2457T
aucacuuucagac

SEQ ID NO: 1937056 - RNA, 17 nt, Shigella flexneri 2a str. 2457T
aucacuuuugaaaucaa

SEQ ID NO: 1937057 - RNA, 12 nt, Shigella flexneri 2a str. 2457T
aucacuuucaaa

SEQ ID NO: 1937058 - RNA, 17 nt, Shigella flexneri 2a str. 2457T
aucacuuucaaaagccc

SEQ ID NO: 1937059 - RNA, 14 nt, Shigella flexneri 2a str. 2457T
aucacuuccagcag

SEQ ID NO: 1937060 - RNA, 21 nt, Shigella flexneri 2a str. 2457T
aucacuguuugacaacucauc

SEQ ID NO: 1937061 - RNA, 21 nt, Shigella flexneri 2a str. 2457T
aucagaccuacaaaaccugca

SEQ ID NO: 1937062 - RNA, 16 nt, Shigella flexneri 2a str. 2457T
aucagacgacccacga

SEQ ID NO: 1937063 - RNA, 21 nt, Shigella flexneri 2a str. 2457T
aucagacaccgauugccccug

SEQ ID NO: 1937064 - RNA, 21 nt, Shigella flexneri 2a str. 2457T
aucagacaaaugucacugcuu

SEQ ID NO: 1937065 - RNA, 22 nt, Shigella flexneri 2a str. 2457T
aucagacacaauaauuuuauug

SEQ ID NO: 1937066 - RNA, 16 nt, Shigella flexneri 2a str. 2457T
aucagacaccagccag

SEQ ID NO: 1937067 - RNA, 17 nt, Shigella flexneri 2a str. 2457T
aucagaauugcgagccu

SEQ ID NO: 1937068 - RNA, 14 nt, Shigella flexneri 2a str. 2457T
aucagaauuuuucg

SEQ ID NO: 1937069 - RNA, 22 nt, Shigella flexneri 2a str. 2457T
aucagaauuuuucgcuaaaaaa

SEQ ID NO: 1937070 - RNA, 19 nt, Shigella flexneri 2a str. 2457T
aucagaaugcgcucuuccg

SEQ ID NO: 1937071 - RNA, 19 nt, Shigella flexneri 2a str. 2457T
aucagauggcggcuggcgc

SEQ ID NO: 1937072 - RNA, 17 nt, Shigella flexneri 2a str. 2457T
aucagauugccacagga

SEQ ID NO: 1937073 - RNA, 20 nt, Shigella flexneri 2a str. 2457T
aucagauucgauagagaacg

SEQ ID NO: 1937074 - RNA, 22 nt, Shigella flexneri 2a str. 2457T
aucagauucacgguauuauuca

SEQ ID NO: 1937075 - RNA, 23 nt, Shigella flexneri 2a str. 2457T
aucagauaauauuuaucuuccca

SEQ ID NO: 1937076 - RNA, 13 nt, Shigella flexneri 2a str. 2457T
aucagauaaaaua

SEQ ID NO: 1937077 - RNA, 15 nt, Shigella flexneri 2a str. 2457T
aucagauaaaauaca

SEQ ID NO: 1937078 - RNA, 16 nt, Shigella flexneri 2a str. 2457T
aucagaguugaaaaac

SEQ ID NO: 1937079 - RNA, 18 nt, Shigella flexneri 2a str. 2457T
aucagaguugaaaaacau

SEQ ID NO: 1937080 - RNA, 16 nt, Shigella flexneri 2a str. 2457T
aucagcggacgcugcu

SEQ ID NO: 1937081 - RNA, 14 nt, Shigella flexneri 2a str. 2457T
aucagcggacugca

SEQ ID NO: 1937082 - RNA, 23 nt, Shigella flexneri 2a str. 2457T
aucagcguaggacacagaauguu

SEQ ID NO: 1937083 - RNA, 14 nt, Shigella flexneri 2a str. 2457T
aucagcgccagcgc

SEQ ID NO: 1937084 - RNA, 15 nt, Shigella flexneri 2a str. 2457T
aucagcgccagcgcg

SEQ ID NO: 1937085 - RNA, 22 nt, Shigella flexneri 2a str. 2457T
aucagccauuuugcacauucca

SEQ ID NO: 1937086 - RNA, 13 nt, Shigella flexneri 2a str. 2457T
aucagcccagccc

SEQ ID NO: 1937087 - RNA, 15 nt, Shigella flexneri 2a str. 2457T
aucagcgccaccaca

SEQ ID NO: 1937088 - RNA, 19 nt, Shigella flexneri 2a str. 2457T
aucagcauucucaucacca

SEQ ID NO: 1937089 - RNA, 20 nt, Shigella flexneri 2a str. 2457T
aucagcauucucaucaccau

SEQ ID NO: 1937090 - RNA, 14 nt, Shigella flexneri 2a str. 2457T
aucagccacuuccu

SEQ ID NO: 1937091 - RNA, 19 nt, Shigella flexneri 2a str. 2457T
aucagccacuuccugcucg

SEQ ID NO: 1937092 - RNA, 19 nt, Shigella flexneri 2a str. 2457T
aucagcaucucauccauca

SEQ ID NO: 1937093 - RNA, 17 nt, Shigella flexneri 2a str. 2457T
aucagcaugacaaaaaa

SEQ ID NO: 1937094 - RNA, 19 nt, Shigella flexneri 2a str. 2457T
aucagcaugacaaaaaagc

SEQ ID NO: 1937095 - RNA, 22 nt, Shigella flexneri 2a str. 2457T
aucagcaugacaaaaaagccaa

SEQ ID NO: 1937096 - RNA, 15 nt, Shigella flexneri 2a str. 2457T
aucagcauucucauc

SEQ ID NO: 1937097 - RNA, 17 nt, Shigella flexneri 2a str. 2457T
aucagcauaaucaccag

SEQ ID NO: 1937098 - RNA, 13 nt, Shigella flexneri 2a str. 2457T
aucagcaguucac

SEQ ID NO: 1937099 - RNA, 18 nt, Shigella flexneri 2a str. 2457T
aucagcaucccaccugaa

SEQ ID NO: 1937100 - RNA, 17 nt, Shigella flexneri 2a str. 2457T
aucagcaucucauccau

SEQ ID NO: 1937101 - RNA, 21 nt, Shigella flexneri 2a str. 2457T
aucagcagaaucgcaaccagc

SEQ ID NO: 1937102 - RNA, 16 nt, Shigella flexneri 2a str. 2457T
aucagcagcggagaaa

SEQ ID NO: 1937103 - RNA, 13 nt, Shigella flexneri 2a str. 2457T
aucagcaacuggc

SEQ ID NO: 1937104 - RNA, 15 nt, Shigella flexneri 2a str. 2457T
aucagcaacuggcaa

SEQ ID NO: 1937105 - RNA, 18 nt, Shigella flexneri 2a str. 2457T
aucagcaacucuggugga

SEQ ID NO: 1937106 - RNA, 16 nt, Shigella flexneri 2a str. 2457T
aucagcaauuuuuccu

SEQ ID NO: 1937107 - RNA, 16 nt, Shigella flexneri 2a str. 2457T
aucacaucccagcaga

SEQ ID NO: 1937108 - RNA, 20 nt, Shigella flexneri 2a str. 2457T
aucacauccggcaauauuca

SEQ ID NO: 1937109 - RNA, 12 nt, Shigella flexneri 2a str. 2457T
aucacauccagc

SEQ ID NO: 1937110 - RNA, 21 nt, Shigella flexneri 2a str. 2457T
aucacaucaucaucgccaggc

SEQ ID NO: 1937111 - RNA, 13 nt, Shigella flexneri 2a str. 2457T
aucaccaaucaca

SEQ ID NO: 1937112 - RNA, 15 nt, Shigella flexneri 2a str. 2457T
aucaccagauugaac

SEQ ID NO: 1937113 - RNA, 15 nt, Shigella flexneri 2a str. 2457T
aucaccguaacgaac

SEQ ID NO: 1937114 - RNA, 22 nt, Shigella flexneri 2a str. 2457T
aucaccgccacuaccaucaggu

SEQ ID NO: 1937115 - RNA, 20 nt, Shigella flexneri 2a str. 2457T
aucaccgccacuaccaucag

SEQ ID NO: 1937116 - RNA, 17 nt, Shigella flexneri 2a str. 2457T
aucaccccgcccgauaa

SEQ ID NO: 1937117 - RNA, 16 nt, Shigella flexneri 2a str. 2457T
aucaccaucagcagca

SEQ ID NO: 1937118 - RNA, 14 nt, Shigella flexneri 2a str. 2457T
aucaccaucuugag

SEQ ID NO: 1937119 - RNA, 16 nt, Shigella flexneri 2a str. 2457T
aucaccauaaaucaga

SEQ ID NO: 1937120 - RNA, 21 nt, Shigella flexneri 2a str. 2457T
aucacguugcuguugguucag

SEQ ID NO: 1937121 - RNA, 19 nt, Shigella flexneri 2a str. 2457T
aucacgucggcguuuucug

SEQ ID NO: 1937122 - RNA, 17 nt, Shigella flexneri 2a str. 2457T
aucacuaccuucuuccc

SEQ ID NO: 1937123 - RNA, 19 nt, Shigella flexneri 2a str. 2457T
aucacucggggcuuuucuc

SEQ ID NO: 1937124 - RNA, 13 nt, Shigella flexneri 2a str. 2457T
aucacucacccgc

SEQ ID NO: 1937125 - RNA, 17 nt, Shigella flexneri 2a str. 2457T
aucacuccauccagcaa

SEQ ID NO: 1937126 - RNA, 13 nt, Shigella flexneri 2a str. 2457T
aucacugacugcg

SEQ ID NO: 1937127 - RNA, 14 nt, Shigella flexneri 2a str. 2457T
aucacucggggcuu

SEQ ID NO: 1937128 - RNA, 23 nt, Shigella flexneri 2a str. 2457T
aucaccuuacggcacuccucuuc

SEQ ID NO: 1937129 - RNA, 14 nt, Shigella flexneri 2a str. 2457T
aucaccugcuggac

SEQ ID NO: 1937130 - RNA, 14 nt, Shigella flexneri 2a str. 2457T
aucaccugcacaug

SEQ ID NO: 1937131 - RNA, 19 nt, Shigella flexneri 2a str. 2457T
aucaccugcauacaaauaa

SEQ ID NO: 1937132 - RNA, 15 nt, Shigella flexneri 2a str. 2457T
aucaccugcuggacg

SEQ ID NO: 1937133 - RNA, 18 nt, Shigella flexneri 2a str. 2457T
aucacgcaaccacaacgc

SEQ ID NO: 1937134 - RNA, 14 nt, Shigella flexneri 2a str. 2457T
aucacgauugcugc

SEQ ID NO: 1937135 - RNA, 12 nt, Shigella flexneri 2a str. 2457T
aucacgcagcug

SEQ ID NO: 1937136 - RNA, 17 nt, Shigella flexneri 2a str. 2457T
aucacgcagcaagccgu

SEQ ID NO: 1937137 - RNA, 14 nt, Shigella flexneri 2a str. 2457T
aucacgaugcuaaa

SEQ ID NO: 1937138 - RNA, 17 nt, Shigella flexneri 2a str. 2457T
aucacgcugcugauuaa

SEQ ID NO: 1937139 - RNA, 14 nt, Shigella flexneri 2a str. 2457T
aucacgcugcugau

SEQ ID NO: 1937140 - RNA, 14 nt, Shigella flexneri 2a str. 2457T
aucacgcccgccag

SEQ ID NO: 1937141 - RNA, 18 nt, Shigella flexneri 2a str. 2457T
aucacgcuauacaaccac

SEQ ID NO: 1937142 - RNA, 15 nt, Shigella flexneri 2a str. 2457T
aucacgcgccugcca

SEQ ID NO: 1937143 - RNA, 17 nt, Shigella flexneri 2a str. 2457T
aucacgcaucgcgaaau

SEQ ID NO: 1937144 - RNA, 14 nt, Shigella flexneri 2a str. 2457T
aucacgcauggaca

SEQ ID NO: 1937145 - RNA, 20 nt, Shigella flexneri 2a str. 2457T
aucacgccaauaccgcccag

SEQ ID NO: 1937146 - RNA, 13 nt, Shigella flexneri 2a str. 2457T
aucacgcaucacu

SEQ ID NO: 1937147 - RNA, 14 nt, Shigella flexneri 2a str. 2457T
aguuucuuaccuac

SEQ ID NO: 1937148 - RNA, 21 nt, Shigella flexneri 2a str. 2457T
aguuugauuauucacaauuca

SEQ ID NO: 1937149 - RNA, 13 nt, Shigella flexneri 2a str. 2457T
aguuucugcagcu

SEQ ID NO: 1937150 - RNA, 18 nt, Shigella flexneri 2a str. 2457T
aguuuccgcuucugcuuu

SEQ ID NO: 1937151 - RNA, 18 nt, Shigella flexneri 2a str. 2457T
aguuuaauugccauuucu

SEQ ID NO: 1937152 - RNA, 12 nt, Shigella flexneri 2a str. 2457T
aguuuucuuugc

SEQ ID NO: 1937153 - RNA, 15 nt, Shigella flexneri 2a str. 2457T
aguuuguucagcugc

SEQ ID NO: 1937154 - RNA, 24 nt, Shigella flexneri 2a str. 2457T
auaaaaaaaacgccagcaacacau

SEQ ID NO: 1937155 - RNA, 18 nt, Shigella flexneri 2a str. 2457T
auaaaaaaagaaacuauc

SEQ ID NO: 1937156 - RNA, 16 nt, Shigella flexneri 2a str. 2457T
aguuuuggggagaugu

SEQ ID NO: 1937157 - RNA, 17 nt, Shigella flexneri 2a str. 2457T
aguuuuuucuucccaag

SEQ ID NO: 1937158 - RNA, 20 nt, Shigella flexneri 2a str. 2457T
aguugaccagcuccagcaga

SEQ ID NO: 1937159 - RNA, 16 nt, Shigella flexneri 2a str. 2457T
aguugaaaaccucucu

SEQ ID NO: 1937160 - RNA, 14 nt, Shigella flexneri 2a str. 2457T
aguugaaaaccucu

SEQ ID NO: 1937161 - RNA, 17 nt, Shigella flexneri 2a str. 2457T
aguugcacacuuuccau

SEQ ID NO: 1937162 - RNA, 23 nt, Shigella flexneri 2a str. 2457T
aguugauuaugaucgccacgcgg

SEQ ID NO: 1937163 - RNA, 19 nt, Shigella flexneri 2a str. 2457T
aguugauuaauuucauuuu

SEQ ID NO: 1937164 - RNA, 20 nt, Shigella flexneri 2a str. 2457T
aguugauucggccaguaacc

SEQ ID NO: 1937165 - RNA, 17 nt, Shigella flexneri 2a str. 2457T
aguugcagcgucaucaa

SEQ ID NO: 1937166 - RNA, 21 nt, Shigella flexneri 2a str. 2457T
aguugcagcaacucuuuuucc

SEQ ID NO: 1937167 - RNA, 14 nt, Shigella flexneri 2a str. 2457T
aguugcuccacugc

SEQ ID NO: 1937168 - RNA, 14 nt, Shigella flexneri 2a str. 2457T
aguugcuccagcaa

SEQ ID NO: 1937169 - RNA, 19 nt, Shigella flexneri 2a str. 2457T
aguugcuucaucucaguga

SEQ ID NO: 1937170 - RNA, 15 nt, Shigella flexneri 2a str. 2457T
aguuggcagaauuug

SEQ ID NO: 1937171 - RNA, 15 nt, Shigella flexneri 2a str. 2457T
aguuuaauucuuuga

SEQ ID NO: 1937172 - RNA, 23 nt, Shigella flexneri 2a str. 2457T
aguuguugauaauuagugcugcu

SEQ ID NO: 1937173 - RNA, 20 nt, Shigella flexneri 2a str. 2457T
aguuaaaauucaagacauca

SEQ ID NO: 1937174 - RNA, 17 nt, Shigella flexneri 2a str. 2457T
aguguuuuauguucaga

SEQ ID NO: 1937175 - RNA, 20 nt, Shigella flexneri 2a str. 2457T
aguguuuuauguucagauaa

SEQ ID NO: 1937176 - RNA, 21 nt, Shigella flexneri 2a str. 2457T
aguguuuuauguucagauaau

SEQ ID NO: 1937177 - RNA, 20 nt, Shigella flexneri 2a str. 2457T
aguuagcaaggauguggcua

SEQ ID NO: 1937178 - RNA, 18 nt, Shigella flexneri 2a str. 2457T
aguuacugccaucuuccg

SEQ ID NO: 1937179 - RNA, 16 nt, Shigella flexneri 2a str. 2457T
aguuacgugcugcgca

SEQ ID NO: 1937180 - RNA, 21 nt, Shigella flexneri 2a str. 2457T
aguguuggcgucagaccggca

SEQ ID NO: 1937181 - RNA, 15 nt, Shigella flexneri 2a str. 2457T
aguguuggcgucaga

SEQ ID NO: 1937182 - RNA, 16 nt, Shigella flexneri 2a str. 2457T
aguguuggaucugauc

SEQ ID NO: 1937183 - RNA, 21 nt, Shigella flexneri 2a str. 2457T
aguguguauggcauugucuga

SEQ ID NO: 1937184 - RNA, 21 nt, Shigella flexneri 2a str. 2457T
aguguggggaaugauauuuuc

SEQ ID NO: 1937185 - RNA, 16 nt, Shigella flexneri 2a str. 2457T
agugugggaaaaauug

SEQ ID NO: 1937186 - RNA, 16 nt, Shigella flexneri 2a str. 2457T
aguuauaaauaaaaag

SEQ ID NO: 1937187 - RNA, 18 nt, Shigella flexneri 2a str. 2457T
aguuauaaauaaaaagag

SEQ ID NO: 1937188 - RNA, 15 nt, Shigella flexneri 2a str. 2457T
aguuagucugggcga

SEQ ID NO: 1937189 - RNA, 12 nt, Shigella flexneri 2a str. 2457T
aguucaagugcu

SEQ ID NO: 1937190 - RNA, 22 nt, Shigella flexneri 2a str. 2457T
aguucaacgcccgcuuucacca

SEQ ID NO: 1937191 - RNA, 10 nt, Shigella flexneri 2a str. 2457T
aguucaacgg

SEQ ID NO: 1937192 - RNA, 16 nt, Shigella flexneri 2a str. 2457T
aguucaagaugucugc

SEQ ID NO: 1937193 - RNA, 20 nt, Shigella flexneri 2a str. 2457T
aguuccacauaaaguagcca

SEQ ID NO: 1937194 - RNA, 13 nt, Shigella flexneri 2a str. 2457T
aguuccaguucau

SEQ ID NO: 1937195 - RNA, 16 nt, Shigella flexneri 2a str. 2457T
aguuccuacugcuccu

SEQ ID NO: 1937196 - RNA, 16 nt, Shigella flexneri 2a str. 2457T
aguuccugccagauuu

SEQ ID NO: 1937197 - RNA, 13 nt, Shigella flexneri 2a str. 2457T
aguuccuggauga

SEQ ID NO: 1937198 - RNA, 16 nt, Shigella flexneri 2a str. 2457T
aguucugccaggcugg

SEQ ID NO: 1937199 - RNA, 20 nt, Shigella flexneri 2a str. 2457T
aguucugcagcccgaacggu

SEQ ID NO: 1937200 - RNA, 18 nt, Shigella flexneri 2a str. 2457T
aguucgucgcguuugccc

SEQ ID NO: 1937201 - RNA, 13 nt, Shigella flexneri 2a str. 2457T
aguucugcgcauc

SEQ ID NO: 1937202 - RNA, 18 nt, Shigella flexneri 2a str. 2457T
aguggggcggagaugcgg

SEQ ID NO: 1937203 - RNA, 15 nt, Shigella flexneri 2a str. 2457T
aguggcaaauucuug

SEQ ID NO: 1937204 - RNA, 19 nt, Shigella flexneri 2a str. 2457T
aguggcugcguuucaugua

SEQ ID NO: 1937205 - RNA, 14 nt, Shigella flexneri 2a str. 2457T
aguggugaaaaaaa

SEQ ID NO: 1937206 - RNA, 14 nt, Shigella flexneri 2a str. 2457T
aguguccagcggca

SEQ ID NO: 1937207 - RNA, 17 nt, Shigella flexneri 2a str. 2457T
agugugaauauucagaa

SEQ ID NO: 1937208 - RNA, 19 nt, Shigella flexneri 2a str. 2457T
agugugaauauucagaaua

SEQ ID NO: 1937209 - RNA, 12 nt, Shigella flexneri 2a str. 2457T
aguguaaaacag

SEQ ID NO: 1937210 - RNA, 13 nt, Shigella flexneri 2a str. 2457T
aguguaaaauucu

SEQ ID NO: 1937211 - RNA, 21 nt, Shigella flexneri 2a str. 2457T
agugguuagccggauaaacaa

SEQ ID NO: 1937212 - RNA, 22 nt, Shigella flexneri 2a str. 2457T
aguguaccggaacgggaaacga

SEQ ID NO: 1937213 - RNA, 22 nt, Shigella flexneri 2a str. 2457T
aguguacagcggcagggaaaac

SEQ ID NO: 1937214 - RNA, 19 nt, Shigella flexneri 2a str. 2457T
aguguagcgcaucaggcuu

SEQ ID NO: 1937215 - RNA, 14 nt, Shigella flexneri 2a str. 2457T
agugacucacgaau

SEQ ID NO: 1937216 - RNA, 15 nt, Shigella flexneri 2a str. 2457T
agugagaauuuuuca

SEQ ID NO: 1937217 - RNA, 13 nt, Shigella flexneri 2a str. 2457T
agugacugggugc

SEQ ID NO: 1937218 - RNA, 14 nt, Shigella flexneri 2a str. 2457T
agugagcacugaau

SEQ ID NO: 1937219 - RNA, 12 nt, Shigella flexneri 2a str. 2457T
agugcagcgaag

SEQ ID NO: 1937220 - RNA, 15 nt, Shigella flexneri 2a str. 2457T
agugcagcaugcacc

SEQ ID NO: 1937221 - RNA, 22 nt, Shigella flexneri 2a str. 2457T
agugcaggcaccagccccugga

SEQ ID NO: 1937222 - RNA, 14 nt, Shigella flexneri 2a str. 2457T
agugcauugagucc

SEQ ID NO: 1937223 - RNA, 17 nt, Shigella flexneri 2a str. 2457T
agugcauugagucccau

SEQ ID NO: 1937224 - RNA, 19 nt, Shigella flexneri 2a str. 2457T
agugcauugagucccaucu

SEQ ID NO: 1937225 - RNA, 17 nt, Shigella flexneri 2a str. 2457T
agugccugugcaggcgu

SEQ ID NO: 1937226 - RNA, 16 nt, Shigella flexneri 2a str. 2457T
agugccguuccagcca

SEQ ID NO: 1937227 - RNA, 18 nt, Shigella flexneri 2a str. 2457T
agugccucgcuaaucucu

SEQ ID NO: 1937228 - RNA, 17 nt, Shigella flexneri 2a str. 2457T
agugccgguggaagggc

SEQ ID NO: 1937229 - RNA, 18 nt, Shigella flexneri 2a str. 2457T
agugccgguggaagggcu

SEQ ID NO: 1937230 - RNA, 21 nt, Shigella flexneri 2a str. 2457T
agugccggauguuugcauccg

SEQ ID NO: 1937231 - RNA, 15 nt, Shigella flexneri 2a str. 2457T
agugcguaucaauag

SEQ ID NO: 1937232 - RNA, 23 nt, Shigella flexneri 2a str. 2457T
agugcguaucaauagcaguaauu

SEQ ID NO: 1937233 - RNA, 11 nt, Shigella flexneri 2a str. 2457T
agugcguucac

SEQ ID NO: 1937234 - RNA, 23 nt, Shigella flexneri 2a str. 2457T
agugcguucaccccuuucucgcc

SEQ ID NO: 1937235 - RNA, 19 nt, Shigella flexneri 2a str. 2457T
aguggaugcgccauaccau

SEQ ID NO: 1937236 - RNA, 19 nt, Shigella flexneri 2a str. 2457T
aguggaguccagcgccuga

SEQ ID NO: 1937237 - RNA, 13 nt, Shigella flexneri 2a str. 2457T
agugcugaagguu

SEQ ID NO: 1937238 - RNA, 20 nt, Shigella flexneri 2a str. 2457T
agucguguuaucgcgcugaa

SEQ ID NO: 1937239 - RNA, 17 nt, Shigella flexneri 2a str. 2457T
agucguucaaccacuuc

SEQ ID NO: 1937240 - RNA, 18 nt, Shigella flexneri 2a str. 2457T
agucgcccauuuugccac

SEQ ID NO: 1937241 - RNA, 17 nt, Shigella flexneri 2a str. 2457T
agucgccggcggauuca

SEQ ID NO: 1937242 - RNA, 21 nt, Shigella flexneri 2a str. 2457T
agucgcgcucaucagcggcga

SEQ ID NO: 1937243 - RNA, 12 nt, Shigella flexneri 2a str. 2457T
agucgccugcuu

SEQ ID NO: 1937244 - RNA, 15 nt, Shigella flexneri 2a str. 2457T
agucgccugcuuuau

SEQ ID NO: 1937245 - RNA, 17 nt, Shigella flexneri 2a str. 2457T
aguccggcuuuucgaca

SEQ ID NO: 1937246 - RNA, 19 nt, Shigella flexneri 2a str. 2457T
aguccgcgcuugccgccgg

SEQ ID NO: 1937247 - RNA, 19 nt, Shigella flexneri 2a str. 2457T
aguaccgaacggagucggg

SEQ ID NO: 1937248 - RNA, 23 nt, Shigella flexneri 2a str. 2457T
aguaccgccgccauaaacagcag

SEQ ID NO: 1937249 - RNA, 18 nt, Shigella flexneri 2a str. 2457T
aguccgcgcuugccgccg

SEQ ID NO: 1937250 - RNA, 24 nt, Shigella flexneri 2a str. 2457T
agucuugcuggaugccagcgaaga

SEQ ID NO: 1937251 - RNA, 17 nt, Shigella flexneri 2a str. 2457T
agucuuuuuucaacuuu

SEQ ID NO: 1937252 - RNA, 18 nt, Shigella flexneri 2a str. 2457T
agugaauuguuuuauaaa

SEQ ID NO: 1937253 - RNA, 22 nt, Shigella flexneri 2a str. 2457T
agugaauuguuuuauaaagaac

SEQ ID NO: 1937254 - RNA, 13 nt, Shigella flexneri 2a str. 2457T
agugaauuucacu

SEQ ID NO: 1937255 - RNA, 15 nt, Shigella flexneri 2a str. 2457T
agugaccuuaaucag

SEQ ID NO: 1937256 - RNA, 22 nt, Shigella flexneri 2a str. 2457T
agugaccgaaccuguuuucacc

SEQ ID NO: 1937257 - RNA, 20 nt, Shigella flexneri 2a str. 2457T
agugacccgcagccagcacu

SEQ ID NO: 1937258 - RNA, 14 nt, Shigella flexneri 2a str. 2457T
agucuucaucaucc

SEQ ID NO: 1937259 - RNA, 18 nt, Shigella flexneri 2a str. 2457T
agucugcugaccaccugu

SEQ ID NO: 1937260 - RNA, 17 nt, Shigella flexneri 2a str. 2457T
agucuggaagccaguca

SEQ ID NO: 1937261 - RNA, 18 nt, Shigella flexneri 2a str. 2457T
agucuggacaaagagcuu

SEQ ID NO: 1937262 - RNA, 17 nt, Shigella flexneri 2a str. 2457T
agucugccguugccacg

SEQ ID NO: 1937263 - RNA, 12 nt, Shigella flexneri 2a str. 2457T
agucugcauuuu

SEQ ID NO: 1937264 - RNA, 14 nt, Shigella flexneri 2a str. 2457T
agucugcauuuucu

SEQ ID NO: 1937265 - RNA, 23 nt, Shigella flexneri 2a str. 2457T
auaaccgcugcaaaaaauugcgu

SEQ ID NO: 1937266 - RNA, 19 nt, Shigella flexneri 2a str. 2457T
auaaccgucagcgcaugau

SEQ ID NO: 1937267 - RNA, 21 nt, Shigella flexneri 2a str. 2457T
auaaccggcaagcaaauacuu

SEQ ID NO: 1937268 - RNA, 22 nt, Shigella flexneri 2a str. 2457T
auaaccguacgcaucaccagac

SEQ ID NO: 1937269 - RNA, 16 nt, Shigella flexneri 2a str. 2457T
auaaccuauaaaagau

SEQ ID NO: 1937270 - RNA, 19 nt, Shigella flexneri 2a str. 2457T
auaacgugacggcuuuuuu

SEQ ID NO: 1937271 - RNA, 14 nt, Shigella flexneri 2a str. 2457T
auaacucaccauca

SEQ ID NO: 1937272 - RNA, 19 nt, Shigella flexneri 2a str. 2457T
auaacguugaugcaggcag

SEQ ID NO: 1937273 - RNA, 15 nt, Shigella flexneri 2a str. 2457T
auaacguuauauccc

SEQ ID NO: 1937274 - RNA, 16 nt, Shigella flexneri 2a str. 2457T
auaacugaauaauaca

SEQ ID NO: 1937275 - RNA, 19 nt, Shigella flexneri 2a str. 2457T
auaacucgcacguucaguu

SEQ ID NO: 1937276 - RNA, 21 nt, Shigella flexneri 2a str. 2457T
auaacuccccgagaaauacug

SEQ ID NO: 1937277 - RNA, 16 nt, Shigella flexneri 2a str. 2457T
auaacuggucaucaaa

SEQ ID NO: 1937278 - RNA, 16 nt, Shigella flexneri 2a str. 2457T
auaaccgcaaaaccaa

SEQ ID NO: 1937279 - RNA, 23 nt, Shigella flexneri 2a str. 2457T
auaaccaacggcgagccagcgca

SEQ ID NO: 1937280 - RNA, 21 nt, Shigella flexneri 2a str. 2457T
auaacccgcuguaaaugcugc

SEQ ID NO: 1937281 - RNA, 14 nt, Shigella flexneri 2a str. 2457T
auaacccccuccuu

SEQ ID NO: 1937282 - RNA, 15 nt, Shigella flexneri 2a str. 2457T
auaacccaguacaac

SEQ ID NO: 1937283 - RNA, 10 nt, Shigella flexneri 2a str. 2457T
auaaccaaau

SEQ ID NO: 1937284 - RNA, 19 nt, Shigella flexneri 2a str. 2457T
auaacaccagccagaauua

SEQ ID NO: 1937285 - RNA, 21 nt, Shigella flexneri 2a str. 2457T
auaacacgcccguuguuuuau

SEQ ID NO: 1937286 - RNA, 16 nt, Shigella flexneri 2a str. 2457T
auaacaccgauuuugu

SEQ ID NO: 1937287 - RNA, 24 nt, Shigella flexneri 2a str. 2457T
auaaauuaacugcgcgauuaucau

SEQ ID NO: 1937288 - RNA, 23 nt, Shigella flexneri 2a str. 2457T
auaaauuucugccauuuugcuuu

SEQ ID NO: 1937289 - RNA, 19 nt, Shigella flexneri 2a str. 2457T
auaaaccagugccaaacca

SEQ ID NO: 1937290 - RNA, 22 nt, Shigella flexneri 2a str. 2457T
auaaaccagugccaaaccagau

SEQ ID NO: 1937291 - RNA, 16 nt, Shigella flexneri 2a str. 2457T
auaaaccagcaaccaa

SEQ ID NO: 1937292 - RNA, 19 nt, Shigella flexneri 2a str. 2457T
auaaacaagcguacaaaau

SEQ ID NO: 1937293 - RNA, 10 nt, Shigella flexneri 2a str. 2457T
auaaacaaag

SEQ ID NO: 1937294 - RNA, 16 nt, Shigella flexneri 2a str. 2457T
auaaaaaaaguauuuu

SEQ ID NO: 1937295 - RNA, 16 nt, Shigella flexneri 2a str. 2457T
auaaacugagccaaac

SEQ ID NO: 1937296 - RNA, 23 nt, Shigella flexneri 2a str. 2457T
auaaaccgaugcaccacuuaacu

SEQ ID NO: 1937297 - RNA, 16 nt, Shigella flexneri 2a str. 2457T
auaaacuccugcacgc

SEQ ID NO: 1937298 - RNA, 13 nt, Shigella flexneri 2a str. 2457T
auaaacuauccug

SEQ ID NO: 1937299 - RNA, 14 nt, Shigella flexneri 2a str. 2457T
auaaacuauccugu

SEQ ID NO: 1937300 - RNA, 14 nt, Shigella flexneri 2a str. 2457T
auaaaucuccauuu

SEQ ID NO: 1937301 - RNA, 18 nt, Shigella flexneri 2a str. 2457T
auaaauacagcguuaaaa

SEQ ID NO: 1937302 - RNA, 19 nt, Shigella flexneri 2a str. 2457T
auaaauauggugaaaguaa

SEQ ID NO: 1937303 - RNA, 20 nt, Shigella flexneri 2a str. 2457T
auaaauauggugaaaguaaa

SEQ ID NO: 1937304 - RNA, 15 nt, Shigella flexneri 2a str. 2457T
auaaagcgguuuuca

SEQ ID NO: 1937305 - RNA, 21 nt, Shigella flexneri 2a str. 2457T
auaaagcccccuguuugucua

SEQ ID NO: 1937306 - RNA, 23 nt, Shigella flexneri 2a str. 2457T
auaaagccugcuucaaacgcuga

SEQ ID NO: 1937307 - RNA, 18 nt, Shigella flexneri 2a str. 2457T
auaaaggucgacagcagc

SEQ ID NO: 1937308 - RNA, 19 nt, Shigella flexneri 2a str. 2457T
auaaaggucgacagcagcc

SEQ ID NO: 1937309 - RNA, 15 nt, Shigella flexneri 2a str. 2457T
auaauauuuuugcgu

SEQ ID NO: 1937310 - RNA, 23 nt, Shigella flexneri 2a str. 2457T
auaauauuuuugcguccuggcaa

SEQ ID NO: 1937311 - RNA, 16 nt, Shigella flexneri 2a str. 2457T
auaaucaauaaaaaua

SEQ ID NO: 1937312 - RNA, 17 nt, Shigella flexneri 2a str. 2457T
auaaucaacaaaccaaa

SEQ ID NO: 1937313 - RNA, 15 nt, Shigella flexneri 2a str. 2457T
auaauaucuuuucuu

SEQ ID NO: 1937314 - RNA, 13 nt, Shigella flexneri 2a str. 2457T
auaauaucuccag

SEQ ID NO: 1937315 - RNA, 21 nt, Shigella flexneri 2a str. 2457T
auaauauccugccguuuuuua

SEQ ID NO: 1937316 - RNA, 13 nt, Shigella flexneri 2a str. 2457T
auaauaguauuaa

SEQ ID NO: 1937317 - RNA, 13 nt, Shigella flexneri 2a str. 2457T
auaauaaucauca

SEQ ID NO: 1937318 - RNA, 14 nt, Shigella flexneri 2a str. 2457T
auaauaaucaucac

SEQ ID NO: 1937319 - RNA, 15 nt, Shigella flexneri 2a str. 2457T
auaauguguucaacu

SEQ ID NO: 1937320 - RNA, 13 nt, Shigella flexneri 2a str. 2457T
auaauuaaaaaua

SEQ ID NO: 1937321 - RNA, 22 nt, Shigella flexneri 2a str. 2457T
auaauguuauuuaauuacugag

SEQ ID NO: 1937322 - RNA, 19 nt, Shigella flexneri 2a str. 2457T
auaaugcgacaacagaaau

SEQ ID NO: 1937323 - RNA, 22 nt, Shigella flexneri 2a str. 2457T
auaaugcccgaugaccuuguca

SEQ ID NO: 1937324 - RNA, 22 nt, Shigella flexneri 2a str. 2457T
auaaugccguuuggcaaauaca

SEQ ID NO: 1937325 - RNA, 15 nt, Shigella flexneri 2a str. 2457T
auaaucacaaugguc

SEQ ID NO: 1937326 - RNA, 14 nt, Shigella flexneri 2a str. 2457T
auaaucacauaauc

SEQ ID NO: 1937327 - RNA, 15 nt, Shigella flexneri 2a str. 2457T
auaaucagacgacga

SEQ ID NO: 1937328 - RNA, 19 nt, Shigella flexneri 2a str. 2457T
auaaucagacgacgauuaa

SEQ ID NO: 1937329 - RNA, 19 nt, Shigella flexneri 2a str. 2457T
auaaucacucuuccccgcu

SEQ ID NO: 1937330 - RNA, 17 nt, Shigella flexneri 2a str. 2457T
auaaucaggaauauggu

SEQ ID NO: 1937331 - RNA, 17 nt, Shigella flexneri 2a str. 2457T
auaaucgauugcacauu

SEQ ID NO: 1937332 - RNA, 21 nt, Shigella flexneri 2a str. 2457T
auaaucgaucgcguaauaaaa

SEQ ID NO: 1937333 - RNA, 19 nt, Shigella flexneri 2a str. 2457T
auaaucgauugcacauucc

SEQ ID NO: 1937334 - RNA, 16 nt, Shigella flexneri 2a str. 2457T
auaaucuuuaaaaaaa

SEQ ID NO: 1937335 - RNA, 14 nt, Shigella flexneri 2a str. 2457T
auaaugaaggauga

SEQ ID NO: 1937336 - RNA, 19 nt, Shigella flexneri 2a str. 2457T
auaaucgcgcuaauuccag

SEQ ID NO: 1937337 - RNA, 19 nt, Shigella flexneri 2a str. 2457T
auaaucgcgaauagcuuca

SEQ ID NO: 1937338 - RNA, 17 nt, Shigella flexneri 2a str. 2457T
auaaucguaaucagcau

SEQ ID NO: 1937339 - RNA, 22 nt, Shigella flexneri 2a str. 2457T
auaagugauggcgauuauauga

SEQ ID NO: 1937340 - RNA, 14 nt, Shigella flexneri 2a str. 2457T
auaaguguaaaauu

SEQ ID NO: 1937341 - RNA, 22 nt, Shigella flexneri 2a str. 2457T
auaaguuaaccccaguaauuca

SEQ ID NO: 1937342 - RNA, 13 nt, Shigella flexneri 2a str. 2457T
auaaguucaguau

SEQ ID NO: 1937343 - RNA, 20 nt, Shigella flexneri 2a str. 2457T
auaagguaucgcgaaaaaaa

SEQ ID NO: 1937344 - RNA, 14 nt, Shigella flexneri 2a str. 2457T
auaaguaaugaacu

SEQ ID NO: 1937345 - RNA, 15 nt, Shigella flexneri 2a str. 2457T
auaaggcgcaauaau

SEQ ID NO: 1937346 - RNA, 17 nt, Shigella flexneri 2a str. 2457T
auaagaugcuacaacau

SEQ ID NO: 1937347 - RNA, 19 nt, Shigella flexneri 2a str. 2457T
auaagauaacccugcauau

SEQ ID NO: 1937348 - RNA, 19 nt, Shigella flexneri 2a str. 2457T
auaagagcgggacaacaaa

SEQ ID NO: 1937349 - RNA, 19 nt, Shigella flexneri 2a str. 2457T
auaagacuggcaaaugaca

SEQ ID NO: 1937350 - RNA, 20 nt, Shigella flexneri 2a str. 2457T
auaagacuggcaaaugacau

SEQ ID NO: 1937351 - RNA, 22 nt, Shigella flexneri 2a str. 2457T
auaagacuggcaaaugacauaa

SEQ ID NO: 1937352 - RNA, 19 nt, Shigella flexneri 2a str. 2457T
auaagacagcgucacauca

SEQ ID NO: 1937353 - RNA, 17 nt, Shigella flexneri 2a str. 2457T
auaagcaucuauuauug

SEQ ID NO: 1937354 - RNA, 16 nt, Shigella flexneri 2a str. 2457T
auaagccaaauccagc

SEQ ID NO: 1937355 - RNA, 15 nt, Shigella flexneri 2a str. 2457T
auaagccaccucaac

SEQ ID NO: 1937356 - RNA, 20 nt, Shigella flexneri 2a str. 2457T
auaagcccagaacaaauaaa

SEQ ID NO: 1937357 - RNA, 22 nt, Shigella flexneri 2a str. 2457T
auaagcccagaacaaauaaaua

SEQ ID NO: 1937358 - RNA, 19 nt, Shigella flexneri 2a str. 2457T
aggcaaagaguugccccuc

SEQ ID NO: 1937359 - RNA, 19 nt, Shigella flexneri 2a str. 2457T
aggcaacgaccagaaaugc

SEQ ID NO: 1937360 - RNA, 15 nt, Shigella flexneri 2a str. 2457T
aggcacaaaaccugc

SEQ ID NO: 1937361 - RNA, 20 nt, Shigella flexneri 2a str. 2457T
aggcaagccgcuaacagcag

SEQ ID NO: 1937362 - RNA, 22 nt, Shigella flexneri 2a str. 2457T
aggcaagccgcuaacagcagca

SEQ ID NO: 1937363 - RNA, 18 nt, Shigella flexneri 2a str. 2457T
aggcacagcaggccaaga

SEQ ID NO: 1937364 - RNA, 17 nt, Shigella flexneri 2a str. 2457T
aggcaccagccccugga

SEQ ID NO: 1937365 - RNA, 16 nt, Shigella flexneri 2a str. 2457T
aggcagauccaguuac

SEQ ID NO: 1937366 - RNA, 15 nt, Shigella flexneri 2a str. 2457T
aggcagaaacaaacg

SEQ ID NO: 1937367 - RNA, 17 nt, Shigella flexneri 2a str. 2457T
aggauugaucaauucua

SEQ ID NO: 1937368 - RNA, 18 nt, Shigella flexneri 2a str. 2457T
aggauucgcuaacguuuu

SEQ ID NO: 1937369 - RNA, 17 nt, Shigella flexneri 2a str. 2457T
aggcaaaaugccagccc

SEQ ID NO: 1937370 - RNA, 23 nt, Shigella flexneri 2a str. 2457T
aggcaaacugucuaauggugaac

SEQ ID NO: 1937371 - RNA, 21 nt, Shigella flexneri 2a str. 2457T
aggcaaaauacguucucaccu

SEQ ID NO: 1937372 - RNA, 21 nt, Shigella flexneri 2a str. 2457T
aggaugcgggucaggccagga

SEQ ID NO: 1937373 - RNA, 23 nt, Shigella flexneri 2a str. 2457T
aggaugcugcaauaaaauaucuu

SEQ ID NO: 1937374 - RNA, 18 nt, Shigella flexneri 2a str. 2457T
aggauguuccggcaaagu

SEQ ID NO: 1937375 - RNA, 20 nt, Shigella flexneri 2a str. 2457T
aggaugggcaacgcgcaugg

SEQ ID NO: 1937376 - RNA, 14 nt, Shigella flexneri 2a str. 2457T
aggauggccgggca

SEQ ID NO: 1937377 - RNA, 16 nt, Shigella flexneri 2a str. 2457T
aggaucguuacgcccc

SEQ ID NO: 1937378 - RNA, 22 nt, Shigella flexneri 2a str. 2457T
aggaucuggcuugccagcaggg

SEQ ID NO: 1937379 - RNA, 21 nt, Shigella flexneri 2a str. 2457T
aggaugcacucgcauccucuu

SEQ ID NO: 1937380 - RNA, 22 nt, Shigella flexneri 2a str. 2457T
aggaugcacucgcauccucuuu

SEQ ID NO: 1937381 - RNA, 23 nt, Shigella flexneri 2a str. 2457T
aggcauuuacgccgcauccggca

SEQ ID NO: 1937382 - RNA, 15 nt, Shigella flexneri 2a str. 2457T
aggcauuuuuaucac

SEQ ID NO: 1937383 - RNA, 17 nt, Shigella flexneri 2a str. 2457T
aggccaaucagcaauaa

SEQ ID NO: 1937384 - RNA, 13 nt, Shigella flexneri 2a str. 2457T
aggcaugaucagc

SEQ ID NO: 1937385 - RNA, 16 nt, Shigella flexneri 2a str. 2457T
aggcaucugcgcauaa

SEQ ID NO: 1937386 - RNA, 19 nt, Shigella flexneri 2a str. 2457T
aggcauucuuuuucauuau

SEQ ID NO: 1937387 - RNA, 20 nt, Shigella flexneri 2a str. 2457T
aggcauuaucucuugccagg

SEQ ID NO: 1937388 - RNA, 18 nt, Shigella flexneri 2a str. 2457T
aggcaggucuuucaccug

SEQ ID NO: 1937389 - RNA, 22 nt, Shigella flexneri 2a str. 2457T
aggcaguaaaccgucagcacca

SEQ ID NO: 1937390 - RNA, 17 nt, Shigella flexneri 2a str. 2457T
aggcagggccaccagcg

SEQ ID NO: 1937391 - RNA, 15 nt, Shigella flexneri 2a str. 2457T
aggcaggcaucaaug

SEQ ID NO: 1937392 - RNA, 19 nt, Shigella flexneri 2a str. 2457T
aggcaggcaucaaugaaag

SEQ ID NO: 1937393 - RNA, 16 nt, Shigella flexneri 2a str. 2457T
aggcaggcaucaucag

SEQ ID NO: 1937394 - RNA, 15 nt, Shigella flexneri 2a str. 2457T
aggcagccuuucuca

SEQ ID NO: 1937395 - RNA, 15 nt, Shigella flexneri 2a str. 2457T
aggcaucgugcacca

SEQ ID NO: 1937396 - RNA, 22 nt, Shigella flexneri 2a str. 2457T
aggcaucggugcacuccgccac

SEQ ID NO: 1937397 - RNA, 20 nt, Shigella flexneri 2a str. 2457T
aggcaucagcaauuguaaau

SEQ ID NO: 1937398 - RNA, 13 nt, Shigella flexneri 2a str. 2457T
aggcaucagcaau

SEQ ID NO: 1937399 - RNA, 16 nt, Shigella flexneri 2a str. 2457T
aggcccgcccccgggc

SEQ ID NO: 1937400 - RNA, 16 nt, Shigella flexneri 2a str. 2457T
aggccgacagcaggcu

SEQ ID NO: 1937401 - RNA, 16 nt, Shigella flexneri 2a str. 2457T
aggccgaggcacagca

SEQ ID NO: 1937402 - RNA, 17 nt, Shigella flexneri 2a str. 2457T
aggccgaggcacagcag

SEQ ID NO: 1937403 - RNA, 15 nt, Shigella flexneri 2a str. 2457T
aggccagauaagacg

SEQ ID NO: 1937404 - RNA, 17 nt, Shigella flexneri 2a str. 2457T
aggccacccuguacgaa

SEQ ID NO: 1937405 - RNA, 22 nt, Shigella flexneri 2a str. 2457T
aggccacccuguacgaaaacgg

SEQ ID NO: 1937406 - RNA, 16 nt, Shigella flexneri 2a str. 2457T
aggccagcguaccuug

SEQ ID NO: 1937407 - RNA, 21 nt, Shigella flexneri 2a str. 2457T
aggccagguaaucugucuuuu

SEQ ID NO: 1937408 - RNA, 21 nt, Shigella flexneri 2a str. 2457T
aggaagggauugugcaggcgc

SEQ ID NO: 1937409 - RNA, 19 nt, Shigella flexneri 2a str. 2457T
aggaaguuaagaucagaag

SEQ ID NO: 1937410 - RNA, 21 nt, Shigella flexneri 2a str. 2457T
aggaagcuuucgcaguagauc

SEQ ID NO: 1937411 - RNA, 21 nt, Shigella flexneri 2a str. 2457T
aggaagcgacccgguucaauu

SEQ ID NO: 1937412 - RNA, 22 nt, Shigella flexneri 2a str. 2457T
aggaagccggaauuuuccuucg

SEQ ID NO: 1937413 - RNA, 12 nt, Shigella flexneri 2a str. 2457T
aggaagacgcag

SEQ ID NO: 1937414 - RNA, 16 nt, Shigella flexneri 2a str. 2457T
aggaauguggcaauga

SEQ ID NO: 1937415 - RNA, 13 nt, Shigella flexneri 2a str. 2457T
aggacacagaaug

SEQ ID NO: 1937416 - RNA, 14 nt, Shigella flexneri 2a str. 2457T
aggacaaaaauuca

SEQ ID NO: 1937417 - RNA, 19 nt, Shigella flexneri 2a str. 2457T
aggaauuuuacagcccugg

SEQ ID NO: 1937418 - RNA, 19 nt, Shigella flexneri 2a str. 2457T
aggaaugacgacuaaaucu

SEQ ID NO: 1937419 - RNA, 14 nt, Shigella flexneri 2a str. 2457T
aggaaucaggcagg

SEQ ID NO: 1937420 - RNA, 17 nt, Shigella flexneri 2a str. 2457T
aggaauaugguuagaga

SEQ ID NO: 1937421 - RNA, 11 nt, Shigella flexneri 2a str. 2457T
aggaaauaaau

SEQ ID NO: 1937422 - RNA, 14 nt, Shigella flexneri 2a str. 2457T
aggaaauaaauaau

SEQ ID NO: 1937423 - RNA, 15 nt, Shigella flexneri 2a str. 2457T
aggaaauaauauagu

SEQ ID NO: 1937424 - RNA, 15 nt, Shigella flexneri 2a str. 2457T
agcuuuuuauagcaa

SEQ ID NO: 1937425 - RNA, 14 nt, Shigella flexneri 2a str. 2457T
aggaaaauaagcau

SEQ ID NO: 1937426 - RNA, 13 nt, Shigella flexneri 2a str. 2457T
aggaaaauacagc

SEQ ID NO: 1937427 - RNA, 11 nt, Shigella flexneri 2a str. 2457T
aggaaaaaccg

SEQ ID NO: 1937428 - RNA, 22 nt, Shigella flexneri 2a str. 2457T
aggaaaaaaauuaacgcagaau

SEQ ID NO: 1937429 - RNA, 21 nt, Shigella flexneri 2a str. 2457T
aggaacgggauugccagcaua

SEQ ID NO: 1937430 - RNA, 20 nt, Shigella flexneri 2a str. 2457T
aggaacgaucccagcgugga

SEQ ID NO: 1937431 - RNA, 18 nt, Shigella flexneri 2a str. 2457T
aggaaauuaccgcaaagc

SEQ ID NO: 1937432 - RNA, 17 nt, Shigella flexneri 2a str. 2457T
aggaaauugcgaauucc

SEQ ID NO: 1937433 - RNA, 21 nt, Shigella flexneri 2a str. 2457T
aggaacaucccuugugcacug

SEQ ID NO: 1937434 - RNA, 16 nt, Shigella flexneri 2a str. 2457T
aggaacagaagaaagc

SEQ ID NO: 1937435 - RNA, 18 nt, Shigella flexneri 2a str. 2457T
aggaacagaagaaagcaa

SEQ ID NO: 1937436 - RNA, 23 nt, Shigella flexneri 2a str. 2457T
aggagucauccucccuuacccuu

SEQ ID NO: 1937437 - RNA, 19 nt, Shigella flexneri 2a str. 2457T
aggauaaacuccugcacgc

SEQ ID NO: 1937438 - RNA, 15 nt, Shigella flexneri 2a str. 2457T
aggauaaauuuucug

SEQ ID NO: 1937439 - RNA, 20 nt, Shigella flexneri 2a str. 2457T
aggaguuugaacauaucagc

SEQ ID NO: 1937440 - RNA, 21 nt, Shigella flexneri 2a str. 2457T
aggauaaaaaagggugcugca

SEQ ID NO: 1937441 - RNA, 20 nt, Shigella flexneri 2a str. 2457T
aggaggcguaauuuccacgc

SEQ ID NO: 1937442 - RNA, 19 nt, Shigella flexneri 2a str. 2457T
aggagcuccagguccuccu

SEQ ID NO: 1937443 - RNA, 13 nt, Shigella flexneri 2a str. 2457T
aggagcuggagga

SEQ ID NO: 1937444 - RNA, 22 nt, Shigella flexneri 2a str. 2457T
aggauaggcuucuauaccaaug

SEQ ID NO: 1937445 - RNA, 17 nt, Shigella flexneri 2a str. 2457T
aggagcacgccuggaaa

SEQ ID NO: 1937446 - RNA, 20 nt, Shigella flexneri 2a str. 2457T
aggagccaacacuuucacua

SEQ ID NO: 1937447 - RNA, 13 nt, Shigella flexneri 2a str. 2457T
aggagacgcgcaa

SEQ ID NO: 1937448 - RNA, 18 nt, Shigella flexneri 2a str. 2457T
aggacuuauucauuucgu

SEQ ID NO: 1937449 - RNA, 22 nt, Shigella flexneri 2a str. 2457T
aggacuucaucacgaugcaaau

SEQ ID NO: 1937450 - RNA, 18 nt, Shigella flexneri 2a str. 2457T
aggagacacgcugccccu

SEQ ID NO: 1937451 - RNA, 19 nt, Shigella flexneri 2a str. 2457T
aggacaucccggcagagaa

SEQ ID NO: 1937452 - RNA, 18 nt, Shigella flexneri 2a str. 2457T
aggaccgguuucaaaacu

SEQ ID NO: 1937453 - RNA, 19 nt, Shigella flexneri 2a str. 2457T
aggacagugggauuaaaaa

SEQ ID NO: 1937454 - RNA, 20 nt, Shigella flexneri 2a str. 2457T
aggacgaaaaaucaauaaac

SEQ ID NO: 1937455 - RNA, 16 nt, Shigella flexneri 2a str. 2457T
aggacgaaaaaucaca

SEQ ID NO: 1937456 - RNA, 16 nt, Shigella flexneri 2a str. 2457T
agcuugcgucgccagu

SEQ ID NO: 1937457 - RNA, 20 nt, Shigella flexneri 2a str. 2457T
agcuugcguguuuuauauaa

SEQ ID NO: 1937458 - RNA, 14 nt, Shigella flexneri 2a str. 2457T
agcuugcgauccug

SEQ ID NO: 1937459 - RNA, 16 nt, Shigella flexneri 2a str. 2457T
agcuugcgauccugca

SEQ ID NO: 1937460 - RNA, 18 nt, Shigella flexneri 2a str. 2457T
agcuugcuuuccagcuuc

SEQ ID NO: 1937461 - RNA, 20 nt, Shigella flexneri 2a str. 2457T
agcuuuuccauaucaagcau

SEQ ID NO: 1937462 - RNA, 15 nt, Shigella flexneri 2a str. 2457T
agcuuuggugaaaaa

SEQ ID NO: 1937463 - RNA, 20 nt, Shigella flexneri 2a str. 2457T
agcuuuauccugcccacucc

SEQ ID NO: 1937464 - RNA, 16 nt, Shigella flexneri 2a str. 2457T
agcuucuguuauucca

SEQ ID NO: 1937465 - RNA, 18 nt, Shigella flexneri 2a str. 2457T
agcuucuuauccagcugc

SEQ ID NO: 1937466 - RNA, 11 nt, Shigella flexneri 2a str. 2457T
agcuucuuccu

SEQ ID NO: 1937467 - RNA, 14 nt, Shigella flexneri 2a str. 2457T
agcuucccaaagau

SEQ ID NO: 1937468 - RNA, 18 nt, Shigella flexneri 2a str. 2457T
agcuucaucaucgcagau

SEQ ID NO: 1937469 - RNA, 21 nt, Shigella flexneri 2a str. 2457T
agcuucacgcgccagcuuagu

SEQ ID NO: 1937470 - RNA, 21 nt, Shigella flexneri 2a str. 2457T
agcuucacaaaggcuugcugc

SEQ ID NO: 1937471 - RNA, 15 nt, Shigella flexneri 2a str. 2457T
agcuuauuucuguga

SEQ ID NO: 1937472 - RNA, 21 nt, Shigella flexneri 2a str. 2457T
agcuucaaauagugccuggcu

SEQ ID NO: 1937473 - RNA, 14 nt, Shigella flexneri 2a str. 2457T
agcuuaucuuuuuc

SEQ ID NO: 1937474 - RNA, 23 nt, Shigella flexneri 2a str. 2457T
agcuuauccauaauuuugguugc

SEQ ID NO: 1937475 - RNA, 14 nt, Shigella flexneri 2a str. 2457T
agcuuauccagcaa

SEQ ID NO: 1937476 - RNA, 18 nt, Shigella flexneri 2a str. 2457T
agcuuaaucaccagcgca

SEQ ID NO: 1937477 - RNA, 13 nt, Shigella flexneri 2a str. 2457T
agcuuagcauccc

SEQ ID NO: 1937478 - RNA, 22 nt, Shigella flexneri 2a str. 2457T
agcuuaccguccucuucccaga

SEQ ID NO: 1937479 - RNA, 24 nt, Shigella flexneri 2a str. 2457T
agcuuacgcugauauucgacacca

SEQ ID NO: 1937480 - RNA, 23 nt, Shigella flexneri 2a str. 2457T
agcuggaggaccuuauggaucug

SEQ ID NO: 1937481 - RNA, 17 nt, Shigella flexneri 2a str. 2457T
agcugcgacaucauuuu

SEQ ID NO: 1937482 - RNA, 23 nt, Shigella flexneri 2a str. 2457T
agcuggaaaaucuacguuaaaaa

SEQ ID NO: 1937483 - RNA, 23 nt, Shigella flexneri 2a str. 2457T
agcuguuuauuuauacagugagu

SEQ ID NO: 1937484 - RNA, 18 nt, Shigella flexneri 2a str. 2457T
agcugguguaacugcgcc

SEQ ID NO: 1937485 - RNA, 15 nt, Shigella flexneri 2a str. 2457T
agcugucgaaaagau

SEQ ID NO: 1937486 - RNA, 15 nt, Shigella flexneri 2a str. 2457T
agcuguaucccagcc

SEQ ID NO: 1937487 - RNA, 22 nt, Shigella flexneri 2a str. 2457T
agcugcauccgggguucgaauc

SEQ ID NO: 1937488 - RNA, 23 nt, Shigella flexneri 2a str. 2457T
agcugcauuucauauucaaaauc

SEQ ID NO: 1937489 - RNA, 15 nt, Shigella flexneri 2a str. 2457T
agcugcacgaugacu

SEQ ID NO: 1937490 - RNA, 17 nt, Shigella flexneri 2a str. 2457T
agcugccguccccauca

SEQ ID NO: 1937491 - RNA, 12 nt, Shigella flexneri 2a str. 2457T
agcugcccggcu

SEQ ID NO: 1937492 - RNA, 18 nt, Shigella flexneri 2a str. 2457T
agcugccgacgccaguuc

SEQ ID NO: 1937493 - RNA, 15 nt, Shigella flexneri 2a str. 2457T
agcugaaaguuuucu

SEQ ID NO: 1937494 - RNA, 17 nt, Shigella flexneri 2a str. 2457T
agcugaagcucguuguu

SEQ ID NO: 1937495 - RNA, 16 nt, Shigella flexneri 2a str. 2457T
agcugaaaaucagauc

SEQ ID NO: 1937496 - RNA, 17 nt, Shigella flexneri 2a str. 2457T
agcugaacaagaauaca

SEQ ID NO: 1937497 - RNA, 22 nt, Shigella flexneri 2a str. 2457T
agcugaauaucacgggcgcgga

SEQ ID NO: 1937498 - RNA, 18 nt, Shigella flexneri 2a str. 2457T
agcugaagcucguuguuu

SEQ ID NO: 1937499 - RNA, 15 nt, Shigella flexneri 2a str. 2457T
agcucuuuuccagcc

SEQ ID NO: 1937500 - RNA, 11 nt, Shigella flexneri 2a str. 2457T
agcucugccac

SEQ ID NO: 1937501 - RNA, 16 nt, Shigella flexneri 2a str. 2457T
agcucuuuuccagcca

SEQ ID NO: 1937502 - RNA, 17 nt, Shigella flexneri 2a str. 2457T
agcucucuuccaguucg

SEQ ID NO: 1937503 - RNA, 11 nt, Shigella flexneri 2a str. 2457T
agcucaucguu

SEQ ID NO: 1937504 - RNA, 19 nt, Shigella flexneri 2a str. 2457T
agcucguuuacaaccugau

SEQ ID NO: 1937505 - RNA, 19 nt, Shigella flexneri 2a str. 2457T
agcucaguuaacggcauaa

SEQ ID NO: 1937506 - RNA, 19 nt, Shigella flexneri 2a str. 2457T
agcucacggccggucauuu

SEQ ID NO: 1937507 - RNA, 19 nt, Shigella flexneri 2a str. 2457T
agcgcgcaguuugucuuca

SEQ ID NO: 1937508 - RNA, 14 nt, Shigella flexneri 2a str. 2457T
agcgcugcaaacca

SEQ ID NO: 1937509 - RNA, 15 nt, Shigella flexneri 2a str. 2457T
agcgcugagacgcgc

SEQ ID NO: 1937510 - RNA, 18 nt, Shigella flexneri 2a str. 2457T
agcgcugaagaaaauggc

SEQ ID NO: 1937511 - RNA, 18 nt, Shigella flexneri 2a str. 2457T
agcgcugacgugauuuag

SEQ ID NO: 1937512 - RNA, 16 nt, Shigella flexneri 2a str. 2457T
agcgcggugacgcaca

SEQ ID NO: 1937513 - RNA, 16 nt, Shigella flexneri 2a str. 2457T
agcgcggggaucacug

SEQ ID NO: 1937514 - RNA, 19 nt, Shigella flexneri 2a str. 2457T
agcgcggggaucacuggca

SEQ ID NO: 1937515 - RNA, 22 nt, Shigella flexneri 2a str. 2457T
agcgcuggugacaucgccagag

SEQ ID NO: 1937516 - RNA, 19 nt, Shigella flexneri 2a str. 2457T
agcgcugcgcgcuucgccc

SEQ ID NO: 1937517 - RNA, 19 nt, Shigella flexneri 2a str. 2457T
agcgcggauuuuauucagc

SEQ ID NO: 1937518 - RNA, 17 nt, Shigella flexneri 2a str. 2457T
agcggccaaagggagca

SEQ ID NO: 1937519 - RNA, 19 nt, Shigella flexneri 2a str. 2457T
agcggccaaagggagcaga

SEQ ID NO: 1937520 - RNA, 14 nt, Shigella flexneri 2a str. 2457T
agcgcuuuuuuccu

SEQ ID NO: 1937521 - RNA, 12 nt, Shigella flexneri 2a str. 2457T
agcggaaaucac

SEQ ID NO: 1937522 - RNA, 12 nt, Shigella flexneri 2a str. 2457T
agcggaaaucuc

SEQ ID NO: 1937523 - RNA, 17 nt, Shigella flexneri 2a str. 2457T
agcggaaaucuccagau

SEQ ID NO: 1937524 - RNA, 13 nt, Shigella flexneri 2a str. 2457T
agcggaacugaag

SEQ ID NO: 1937525 - RNA, 17 nt, Shigella flexneri 2a str. 2457T
agcggaacugaagcuga

SEQ ID NO: 1937526 - RNA, 20 nt, Shigella flexneri 2a str. 2457T
agcggaaauuaccgcaccac

SEQ ID NO: 1937527 - RNA, 15 nt, Shigella flexneri 2a str. 2457T
agcggcugaauaucc

SEQ ID NO: 1937528 - RNA, 23 nt, Shigella flexneri 2a str. 2457T
agcggcggugucuaacgaugcca

SEQ ID NO: 1937529 - RNA, 16 nt, Shigella flexneri 2a str. 2457T
agcggcguaucuucca

SEQ ID NO: 1937530 - RNA, 23 nt, Shigella flexneri 2a str. 2457T
agcguaccaugauccugcaauac

SEQ ID NO: 1937531 - RNA, 20 nt, Shigella flexneri 2a str. 2457T
agcggucggagguucgaauc

SEQ ID NO: 1937532 - RNA, 13 nt, Shigella flexneri 2a str. 2457T
agcggggaacacc

SEQ ID NO: 1937533 - RNA, 18 nt, Shigella flexneri 2a str. 2457T
agcggggaacaucaggca

SEQ ID NO: 1937534 - RNA, 16 nt, Shigella flexneri 2a str. 2457T
agcguagcgcaucagg

SEQ ID NO: 1937535 - RNA, 22 nt, Shigella flexneri 2a str. 2457T
agcguauccguggcgcuaugcu

SEQ ID NO: 1937536 - RNA, 23 nt, Shigella flexneri 2a str. 2457T
agcgucugcuccuccuucucacc

SEQ ID NO: 1937537 - RNA, 23 nt, Shigella flexneri 2a str. 2457T
agcguggaacuugacgaucugcu

SEQ ID NO: 1937538 - RNA, 11 nt, Shigella flexneri 2a str. 2457T
agcgugcuggu

SEQ ID NO: 1937539 - RNA, 14 nt, Shigella flexneri 2a str. 2457T
agcguggucauggc

SEQ ID NO: 1937540 - RNA, 20 nt, Shigella flexneri 2a str. 2457T
agcuaauccccuccagcgag

SEQ ID NO: 1937541 - RNA, 18 nt, Shigella flexneri 2a str. 2457T
agcuaacucuaaucccuu

SEQ ID NO: 1937542 - RNA, 13 nt, Shigella flexneri 2a str. 2457T
agcuaaaucacac

SEQ ID NO: 1937543 - RNA, 14 nt, Shigella flexneri 2a str. 2457T
agcguuaaaacuuu

SEQ ID NO: 1937544 - RNA, 15 nt, Shigella flexneri 2a str. 2457T
agcguuaaucaucaa

SEQ ID NO: 1937545 - RNA, 21 nt, Shigella flexneri 2a str. 2457T
agcguuaaugauaucccugcu

SEQ ID NO: 1937546 - RNA, 20 nt, Shigella flexneri 2a str. 2457T
agcguguuaaugcccaucag

SEQ ID NO: 1937547 - RNA, 20 nt, Shigella flexneri 2a str. 2457T
agcguuacgccccaacacaa

SEQ ID NO: 1937548 - RNA, 20 nt, Shigella flexneri 2a str. 2457T
agcguggugauaccagacca

SEQ ID NO: 1937549 - RNA, 19 nt, Shigella flexneri 2a str. 2457T
agcucaaacgaaugcaggc

SEQ ID NO: 1937550 - RNA, 17 nt, Shigella flexneri 2a str. 2457T
agcuauucuuauaaaga

SEQ ID NO: 1937551 - RNA, 16 nt, Shigella flexneri 2a str. 2457T
agcucaauacaaccca

SEQ ID NO: 1937552 - RNA, 17 nt, Shigella flexneri 2a str. 2457T
agcucaaucaacuccau

SEQ ID NO: 1937553 - RNA, 12 nt, Shigella flexneri 2a str. 2457T
agcuaauuuuug

SEQ ID NO: 1937554 - RNA, 21 nt, Shigella flexneri 2a str. 2457T
agcuauguuugaaccagauau

SEQ ID NO: 1937555 - RNA, 19 nt, Shigella flexneri 2a str. 2457T
agggaaauaaucgggaaua

SEQ ID NO: 1937556 - RNA, 21 nt, Shigella flexneri 2a str. 2457T
agggaaagagcgauccguuca

SEQ ID NO: 1937557 - RNA, 16 nt, Shigella flexneri 2a str. 2457T
agggaaacaacaccgu

SEQ ID NO: 1937558 - RNA, 23 nt, Shigella flexneri 2a str. 2457T
aggcuuuuuuaccucuuuuuuca

SEQ ID NO: 1937559 - RNA, 18 nt, Shigella flexneri 2a str. 2457T
aggcuuuuuugguaauga

SEQ ID NO: 1937560 - RNA, 22 nt, Shigella flexneri 2a str. 2457T
agggagcaggcuaguaaaaagc

SEQ ID NO: 1937561 - RNA, 22 nt, Shigella flexneri 2a str. 2457T
agggagagggccgggguggggg

SEQ ID NO: 1937562 - RNA, 13 nt, Shigella flexneri 2a str. 2457T
agggaauggcaga

SEQ ID NO: 1937563 - RNA, 12 nt, Shigella flexneri 2a str. 2457T
agggaauuaaac

SEQ ID NO: 1937564 - RNA, 13 nt, Shigella flexneri 2a str. 2457T
agggaauccagca

SEQ ID NO: 1937565 - RNA, 15 nt, Shigella flexneri 2a str. 2457T
agggaagcgaguuac

SEQ ID NO: 1937566 - RNA, 18 nt, Shigella flexneri 2a str. 2457T
agggaugaaauagacauu

SEQ ID NO: 1937567 - RNA, 15 nt, Shigella flexneri 2a str. 2457T
agggauugugcaggc

SEQ ID NO: 1937568 - RNA, 14 nt, Shigella flexneri 2a str. 2457T
agggcaaacaccgc

SEQ ID NO: 1937569 - RNA, 19 nt, Shigella flexneri 2a str. 2457T
agggaggggugcaugaaaa

SEQ ID NO: 1937570 - RNA, 13 nt, Shigella flexneri 2a str. 2457T
agggaucacgcgg

SEQ ID NO: 1937571 - RNA, 14 nt, Shigella flexneri 2a str. 2457T
agggauauuucacc

SEQ ID NO: 1937572 - RNA, 19 nt, Shigella flexneri 2a str. 2457T
aggcuuuccugauaaucca

SEQ ID NO: 1937573 - RNA, 13 nt, Shigella flexneri 2a str. 2457T
aggcuugcugcau

SEQ ID NO: 1937574 - RNA, 15 nt, Shigella flexneri 2a str. 2457T
aggcuucaaucaaua

SEQ ID NO: 1937575 - RNA, 21 nt, Shigella flexneri 2a str. 2457T
aggcuguuuuuuauacuugca

SEQ ID NO: 1937576 - RNA, 16 nt, Shigella flexneri 2a str. 2457T
aggcuguucccacgca

SEQ ID NO: 1937577 - RNA, 16 nt, Shigella flexneri 2a str. 2457T
aggcuuauccggcaug

SEQ ID NO: 1937578 - RNA, 20 nt, Shigella flexneri 2a str. 2457T
aggcugccagaucaucguuu

SEQ ID NO: 1937579 - RNA, 15 nt, Shigella flexneri 2a str. 2457T
aggcugcauaaugcg

SEQ ID NO: 1937580 - RNA, 16 nt, Shigella flexneri 2a str. 2457T
aggcugcgaguccugu

SEQ ID NO: 1937581 - RNA, 15 nt, Shigella flexneri 2a str. 2457T
aggcuggaucagacg

SEQ ID NO: 1937582 - RNA, 21 nt, Shigella flexneri 2a str. 2457T
aggcuggcuuuaucacugagu

SEQ ID NO: 1937583 - RNA, 14 nt, Shigella flexneri 2a str. 2457T
aggggaacagacca

SEQ ID NO: 1937584 - RNA, 17 nt, Shigella flexneri 2a str. 2457T
agggcuaacgugcaggu

SEQ ID NO: 1937585 - RNA, 18 nt, Shigella flexneri 2a str. 2457T
agggcuacaaguccggga

SEQ ID NO: 1937586 - RNA, 21 nt, Shigella flexneri 2a str. 2457T
aggggccgaaaaaugcuggau

SEQ ID NO: 1937587 - RNA, 13 nt, Shigella flexneri 2a str. 2457T
aggguaaaaggau

SEQ ID NO: 1937588 - RNA, 15 nt, Shigella flexneri 2a str. 2457T
aggggugaaaaaaac

SEQ ID NO: 1937589 - RNA, 17 nt, Shigella flexneri 2a str. 2457T
aggguaaacaacaugcu

SEQ ID NO: 1937590 - RNA, 13 nt, Shigella flexneri 2a str. 2457T
agggcaucaagaa

SEQ ID NO: 1937591 - RNA, 17 nt, Shigella flexneri 2a str. 2457T
agggcaucaagaaugcu

SEQ ID NO: 1937592 - RNA, 21 nt, Shigella flexneri 2a str. 2457T
agggcaagcgccuaaauccac

SEQ ID NO: 1937593 - RNA, 14 nt, Shigella flexneri 2a str. 2457T
agggcaauuaaaaa

SEQ ID NO: 1937594 - RNA, 15 nt, Shigella flexneri 2a str. 2457T
agggccaacuggcaa

SEQ ID NO: 1937595 - RNA, 23 nt, Shigella flexneri 2a str. 2457T
aggccgccaguguuggcgucaga

SEQ ID NO: 1937596 - RNA, 14 nt, Shigella flexneri 2a str. 2457T
aggccggagcaugc

SEQ ID NO: 1937597 - RNA, 14 nt, Shigella flexneri 2a str. 2457T
aggccgcuuucuga

SEQ ID NO: 1937598 - RNA, 14 nt, Shigella flexneri 2a str. 2457T
aggccuacaacucc

SEQ ID NO: 1937599 - RNA, 19 nt, Shigella flexneri 2a str. 2457T
aggccuacaaaaucuauug

SEQ ID NO: 1937600 - RNA, 14 nt, Shigella flexneri 2a str. 2457T
aggcgauguucugg

SEQ ID NO: 1937601 - RNA, 14 nt, Shigella flexneri 2a str. 2457T
aggcgaucuucccg

SEQ ID NO: 1937602 - RNA, 16 nt, Shigella flexneri 2a str. 2457T
aggcgaugaaauucac

SEQ ID NO: 1937603 - RNA, 17 nt, Shigella flexneri 2a str. 2457T
aggcgauuuacuggcag

SEQ ID NO: 1937604 - RNA, 13 nt, Shigella flexneri 2a str. 2457T
aggcgcaauggcg

SEQ ID NO: 1937605 - RNA, 13 nt, Shigella flexneri 2a str. 2457T
aggcgcagaacuu

SEQ ID NO: 1937606 - RNA, 15 nt, Shigella flexneri 2a str. 2457T
aggcgcacgccgaca

SEQ ID NO: 1937607 - RNA, 20 nt, Shigella flexneri 2a str. 2457T
aggcgcacgccgacaaagau

SEQ ID NO: 1937608 - RNA, 17 nt, Shigella flexneri 2a str. 2457T
aggcgccauuuucauau

SEQ ID NO: 1937609 - RNA, 22 nt, Shigella flexneri 2a str. 2457T
aggcgcauugcuggcugcggga

SEQ ID NO: 1937610 - RNA, 14 nt, Shigella flexneri 2a str. 2457T
aggccugauaagug

SEQ ID NO: 1937611 - RNA, 17 nt, Shigella flexneri 2a str. 2457T
aggccugcccacgggca

SEQ ID NO: 1937612 - RNA, 15 nt, Shigella flexneri 2a str. 2457T
aggccuggacucuua

SEQ ID NO: 1937613 - RNA, 22 nt, Shigella flexneri 2a str. 2457T
aggccuuaguagaagaggaacc

SEQ ID NO: 1937614 - RNA, 22 nt, Shigella flexneri 2a str. 2457T
aggccuugaacucugaaucgcu

SEQ ID NO: 1937615 - RNA, 19 nt, Shigella flexneri 2a str. 2457T
aggcgaggcggacugaaua

SEQ ID NO: 1937616 - RNA, 13 nt, Shigella flexneri 2a str. 2457T
aggcgagaaucaa

SEQ ID NO: 1937617 - RNA, 16 nt, Shigella flexneri 2a str. 2457T
aggcgacgaauagcau

SEQ ID NO: 1937618 - RNA, 13 nt, Shigella flexneri 2a str. 2457T
aggcggcagaaca

SEQ ID NO: 1937619 - RNA, 17 nt, Shigella flexneri 2a str. 2457T
aggcgcuggucagugaa

SEQ ID NO: 1937620 - RNA, 21 nt, Shigella flexneri 2a str. 2457T
aggcgcugguaaucaccaccc

SEQ ID NO: 1937621 - RNA, 19 nt, Shigella flexneri 2a str. 2457T
aggcguaauuuccacgcca

SEQ ID NO: 1937622 - RNA, 15 nt, Shigella flexneri 2a str. 2457T
aggcgguaaccgcca

SEQ ID NO: 1937623 - RNA, 18 nt, Shigella flexneri 2a str. 2457T
aggcgucgggaagaccug

SEQ ID NO: 1937624 - RNA, 15 nt, Shigella flexneri 2a str. 2457T
aggcguccugcugaa

SEQ ID NO: 1937625 - RNA, 17 nt, Shigella flexneri 2a str. 2457T
aggcguuaacagcgcau

SEQ ID NO: 1937626 - RNA, 19 nt, Shigella flexneri 2a str. 2457T
aggcuaaauaaccagcaua

SEQ ID NO: 1937627 - RNA, 23 nt, Shigella flexneri 2a str. 2457T
aggcguuuugcagauucagccac

SEQ ID NO: 1937628 - RNA, 23 nt, Shigella flexneri 2a str. 2457T
aggcuaauaccgucgaugccaau

SEQ ID NO: 1937629 - RNA, 19 nt, Shigella flexneri 2a str. 2457T
aggcuaucgaacaugcggg

SEQ ID NO: 1937630 - RNA, 20 nt, Shigella flexneri 2a str. 2457T
aggcucugauugccuuccac

SEQ ID NO: 1937631 - RNA, 16 nt, Shigella flexneri 2a str. 2457T
aggcucucauuuuuca

SEQ ID NO: 1937632 - RNA, 13 nt, Shigella flexneri 2a str. 2457T
aggcugaugacaa

SEQ ID NO: 1937633 - RNA, 17 nt, Shigella flexneri 2a str. 2457T
aguaaauggugauauca

SEQ ID NO: 1937634 - RNA, 18 nt, Shigella flexneri 2a str. 2457T
aguaaaugacagcgaaug

SEQ ID NO: 1937635 - RNA, 13 nt, Shigella flexneri 2a str. 2457T
aguaaauccauaa

SEQ ID NO: 1937636 - RNA, 20 nt, Shigella flexneri 2a str. 2457T
aguaaaucguccguuugcgu

SEQ ID NO: 1937637 - RNA, 11 nt, Shigella flexneri 2a str. 2457T
aguaacaauau

SEQ ID NO: 1937638 - RNA, 21 nt, Shigella flexneri 2a str. 2457T
aguaacagauuguggugccga

SEQ ID NO: 1937639 - RNA, 22 nt, Shigella flexneri 2a str. 2457T
aguaaccuucgcggcacuggua

SEQ ID NO: 1937640 - RNA, 19 nt, Shigella flexneri 2a str. 2457T
aguaaccgcuuuuucaauu

SEQ ID NO: 1937641 - RNA, 15 nt, Shigella flexneri 2a str. 2457T
aguaacccggcacca

SEQ ID NO: 1937642 - RNA, 17 nt, Shigella flexneri 2a str. 2457T
aguaacguuugauuaac

SEQ ID NO: 1937643 - RNA, 15 nt, Shigella flexneri 2a str. 2457T
aguaacucauugcca

SEQ ID NO: 1937644 - RNA, 22 nt, Shigella flexneri 2a str. 2457T
aguaacguuugauuaacgccag

SEQ ID NO: 1937645 - RNA, 17 nt, Shigella flexneri 2a str. 2457T
aguaagcacucugacgg

SEQ ID NO: 1937646 - RNA, 21 nt, Shigella flexneri 2a str. 2457T
aguaagucuuccggugcauca

SEQ ID NO: 1937647 - RNA, 18 nt, Shigella flexneri 2a str. 2457T
aguaauauccccagccua

SEQ ID NO: 1937648 - RNA, 22 nt, Shigella flexneri 2a str. 2457T
aguaauaaugaucaguggaaga

SEQ ID NO: 1937649 - RNA, 11 nt, Shigella flexneri 2a str. 2457T
aguaauaacuu

SEQ ID NO: 1937650 - RNA, 14 nt, Shigella flexneri 2a str. 2457T
aguaauaacuuccu

SEQ ID NO: 1937651 - RNA, 18 nt, Shigella flexneri 2a str. 2457T
aguaauaacuuccugagu

SEQ ID NO: 1937652 - RNA, 14 nt, Shigella flexneri 2a str. 2457T
aguaccauuugcau

SEQ ID NO: 1937653 - RNA, 19 nt, Shigella flexneri 2a str. 2457T
aguaccauuugcauagcga

SEQ ID NO: 1937654 - RNA, 18 nt, Shigella flexneri 2a str. 2457T
aguaccaucguccagcag

SEQ ID NO: 1937655 - RNA, 20 nt, Shigella flexneri 2a str. 2457T
aguaccaucguccagcagca

SEQ ID NO: 1937656 - RNA, 23 nt, Shigella flexneri 2a str. 2457T
aguaccaucguccagcagcaaug

SEQ ID NO: 1937657 - RNA, 17 nt, Shigella flexneri 2a str. 2457T
aguacaugaagcacugc

SEQ ID NO: 1937658 - RNA, 16 nt, Shigella flexneri 2a str. 2457T
aguacauuguuuucca

SEQ ID NO: 1937659 - RNA, 19 nt, Shigella flexneri 2a str. 2457T
aguaccacgguacgccaga

SEQ ID NO: 1937660 - RNA, 21 nt, Shigella flexneri 2a str. 2457T
aguaccacgguacgccagagu

SEQ ID NO: 1937661 - RNA, 13 nt, Shigella flexneri 2a str. 2457T
aguacauuaaaau

SEQ ID NO: 1937662 - RNA, 19 nt, Shigella flexneri 2a str. 2457T
aguacauuaaaauuggcuu

SEQ ID NO: 1937663 - RNA, 17 nt, Shigella flexneri 2a str. 2457T
aguacagccgccagaca

SEQ ID NO: 1937664 - RNA, 21 nt, Shigella flexneri 2a str. 2457T
aguacaucguagugaugccau

SEQ ID NO: 1937665 - RNA, 16 nt, Shigella flexneri 2a str. 2457T
aguaauugcagcagcu

SEQ ID NO: 1937666 - RNA, 16 nt, Shigella flexneri 2a str. 2457T
aguaaugcggcaaggg

SEQ ID NO: 1937667 - RNA, 15 nt, Shigella flexneri 2a str. 2457T
aguaaugcgcccaug

SEQ ID NO: 1937668 - RNA, 21 nt, Shigella flexneri 2a str. 2457T
aguaaugccggaggcaaguuu

SEQ ID NO: 1937669 - RNA, 23 nt, Shigella flexneri 2a str. 2457T
aguaauuaucuuuacugauaauu

SEQ ID NO: 1937670 - RNA, 16 nt, Shigella flexneri 2a str. 2457T
aguaauguuauugcau

SEQ ID NO: 1937671 - RNA, 18 nt, Shigella flexneri 2a str. 2457T
aguaaugauuuaaaacca

SEQ ID NO: 1937672 - RNA, 14 nt, Shigella flexneri 2a str. 2457T
aguaaugagcacag

SEQ ID NO: 1937673 - RNA, 16 nt, Shigella flexneri 2a str. 2457T
aguaaugagcacagaa

SEQ ID NO: 1937674 - RNA, 22 nt, Shigella flexneri 2a str. 2457T
aguaauauucaacgucacuggg

SEQ ID NO: 1937675 - RNA, 14 nt, Shigella flexneri 2a str. 2457T
aguaauccuuucuc

SEQ ID NO: 1937676 - RNA, 14 nt, Shigella flexneri 2a str. 2457T
aguaaucaggcuau

SEQ ID NO: 1937677 - RNA, 15 nt, Shigella flexneri 2a str. 2457T
agguugaacccuuuc

SEQ ID NO: 1937678 - RNA, 17 nt, Shigella flexneri 2a str. 2457T
agguugcugcgccccac

SEQ ID NO: 1937679 - RNA, 17 nt, Shigella flexneri 2a str. 2457T
agguuccaauauugguc

SEQ ID NO: 1937680 - RNA, 21 nt, Shigella flexneri 2a str. 2457T
agguuccacggaauauuucac

SEQ ID NO: 1937681 - RNA, 22 nt, Shigella flexneri 2a str. 2457T
agguucggaguggcagccccag

SEQ ID NO: 1937682 - RNA, 20 nt, Shigella flexneri 2a str. 2457T
agguucucucagucuuuccc

SEQ ID NO: 1937683 - RNA, 12 nt, Shigella flexneri 2a str. 2457T
agguucuuugcu

SEQ ID NO: 1937684 - RNA, 15 nt, Shigella flexneri 2a str. 2457T
agguucuuuuaaaug

SEQ ID NO: 1937685 - RNA, 18 nt, Shigella flexneri 2a str. 2457T
agguuaauaaauauuaau

SEQ ID NO: 1937686 - RNA, 23 nt, Shigella flexneri 2a str. 2457T
agguuaauaaauauuaauacaac

SEQ ID NO: 1937687 - RNA, 17 nt, Shigella flexneri 2a str. 2457T
agguuaaaguacucuuu

SEQ ID NO: 1937688 - RNA, 15 nt, Shigella flexneri 2a str. 2457T
aggugucacaugcag

SEQ ID NO: 1937689 - RNA, 16 nt, Shigella flexneri 2a str. 2457T
agguguauuguucugg

SEQ ID NO: 1937690 - RNA, 14 nt, Shigella flexneri 2a str. 2457T
aggugucacaugca

SEQ ID NO: 1937691 - RNA, 21 nt, Shigella flexneri 2a str. 2457T
aggugugaaaccuuuaugcag

SEQ ID NO: 1937692 - RNA, 15 nt, Shigella flexneri 2a str. 2457T
aguaaacgcuuuuuu

SEQ ID NO: 1937693 - RNA, 12 nt, Shigella flexneri 2a str. 2457T
aguaaaguuacc

SEQ ID NO: 1937694 - RNA, 22 nt, Shigella flexneri 2a str. 2457T
aguaaaacggauaugauuuaaa

SEQ ID NO: 1937695 - RNA, 17 nt, Shigella flexneri 2a str. 2457T
aguaaaaaaacaucaua

SEQ ID NO: 1937696 - RNA, 16 nt, Shigella flexneri 2a str. 2457T
aguaaaaaaacaucau

SEQ ID NO: 1937697 - RNA, 14 nt, Shigella flexneri 2a str. 2457T
aguaaaaaagaagg

SEQ ID NO: 1937698 - RNA, 14 nt, Shigella flexneri 2a str. 2457T
agguuuuccuucag

SEQ ID NO: 1937699 - RNA, 20 nt, Shigella flexneri 2a str. 2457T
agguuuucuuucaccucuuc

SEQ ID NO: 1937700 - RNA, 19 nt, Shigella flexneri 2a str. 2457T
agguuuucuuucaccucuu

SEQ ID NO: 1937701 - RNA, 22 nt, Shigella flexneri 2a str. 2457T
agguuucauagcgucccaguaa

SEQ ID NO: 1937702 - RNA, 13 nt, Shigella flexneri 2a str. 2457T
agguuuuccuuca

SEQ ID NO: 1937703 - RNA, 16 nt, Shigella flexneri 2a str. 2457T
agguuuuaguuucgcc

SEQ ID NO: 1937704 - RNA, 19 nt, Shigella flexneri 2a str. 2457T
agguuguggcauuagauau

SEQ ID NO: 1937705 - RNA, 16 nt, Shigella flexneri 2a str. 2457T
agguuuaaacagagau

SEQ ID NO: 1937706 - RNA, 16 nt, Shigella flexneri 2a str. 2457T
agguuuaccagcagcc

SEQ ID NO: 1937707 - RNA, 15 nt, Shigella flexneri 2a str. 2457T
agguuuaccagcagc

SEQ ID NO: 1937708 - RNA, 19 nt, Shigella flexneri 2a str. 2457T
agguuuaccagcagcccug

SEQ ID NO: 1937709 - RNA, 16 nt, Shigella flexneri 2a str. 2457T
agguuucccgccguaa

SEQ ID NO: 1937710 - RNA, 17 nt, Shigella flexneri 2a str. 2457T
agguaacaauaaacacc

SEQ ID NO: 1937711 - RNA, 14 nt, Shigella flexneri 2a str. 2457T
agguaaacagaaau

SEQ ID NO: 1937712 - RNA, 13 nt, Shigella flexneri 2a str. 2457T
agguaagcaaagg

SEQ ID NO: 1937713 - RNA, 22 nt, Shigella flexneri 2a str. 2457T
agguaacgucgguuucaucaca

SEQ ID NO: 1937714 - RNA, 23 nt, Shigella flexneri 2a str. 2457T
agguaacgucgguuucaucacau

SEQ ID NO: 1937715 - RNA, 15 nt, Shigella flexneri 2a str. 2457T
agguaagagugaauu

SEQ ID NO: 1937716 - RNA, 22 nt, Shigella flexneri 2a str. 2457T
aggguuauuuguucagcaaaug

SEQ ID NO: 1937717 - RNA, 22 nt, Shigella flexneri 2a str. 2457T
aggguuucggcuuuuuccugcc

SEQ ID NO: 1937718 - RNA, 13 nt, Shigella flexneri 2a str. 2457T
agguaaaaccuga

SEQ ID NO: 1937719 - RNA, 15 nt, Shigella flexneri 2a str. 2457T
aggguauuuuucuau

SEQ ID NO: 1937720 - RNA, 23 nt, Shigella flexneri 2a str. 2457T
agggucuuccagcaaauccauca

SEQ ID NO: 1937721 - RNA, 12 nt, Shigella flexneri 2a str. 2457T
agggugccggga

SEQ ID NO: 1937722 - RNA, 20 nt, Shigella flexneri 2a str. 2457T
agguaucgcgaaaaaaagau

SEQ ID NO: 1937723 - RNA, 20 nt, Shigella flexneri 2a str. 2457T
aggucagcaggagcagcccc

SEQ ID NO: 1937724 - RNA, 22 nt, Shigella flexneri 2a str. 2457T
aggucagcaggagcagccccug

SEQ ID NO: 1937725 - RNA, 17 nt, Shigella flexneri 2a str. 2457T
aggucagagagccagcc

SEQ ID NO: 1937726 - RNA, 20 nt, Shigella flexneri 2a str. 2457T
aggucagagagccagcccca

SEQ ID NO: 1937727 - RNA, 15 nt, Shigella flexneri 2a str. 2457T
aggucaaagaaucaa

SEQ ID NO: 1937728 - RNA, 15 nt, Shigella flexneri 2a str. 2457T
agguauuuugucagc

SEQ ID NO: 1937729 - RNA, 15 nt, Shigella flexneri 2a str. 2457T
agguacgcuccagca

SEQ ID NO: 1937730 - RNA, 14 nt, Shigella flexneri 2a str. 2457T
agguacaaagccaa

SEQ ID NO: 1937731 - RNA, 19 nt, Shigella flexneri 2a str. 2457T
agguacaaagccaacagca

SEQ ID NO: 1937732 - RNA, 23 nt, Shigella flexneri 2a str. 2457T
agguaggcagucauaaaaucaau

SEQ ID NO: 1937733 - RNA, 17 nt, Shigella flexneri 2a str. 2457T
aggucaucacaucccag

SEQ ID NO: 1937734 - RNA, 20 nt, Shigella flexneri 2a str. 2457T
aggucaucauugcagucaua

SEQ ID NO: 1937735 - RNA, 14 nt, Shigella flexneri 2a str. 2457T
aggucaggcggcga

SEQ ID NO: 1937736 - RNA, 18 nt, Shigella flexneri 2a str. 2457T
aggucagguuugacauaa

SEQ ID NO: 1937737 - RNA, 13 nt, Shigella flexneri 2a str. 2457T
aggucaguaauga

SEQ ID NO: 1937738 - RNA, 19 nt, Shigella flexneri 2a str. 2457T
aggucaguaaugagcacag

SEQ ID NO: 1937739 - RNA, 16 nt, Shigella flexneri 2a str. 2457T
agguccccgagcacau

SEQ ID NO: 1937740 - RNA, 16 nt, Shigella flexneri 2a str. 2457T
aggucgaugcgcucgc

SEQ ID NO: 1937741 - RNA, 19 nt, Shigella flexneri 2a str. 2457T
aggucgaucagcugacaac

SEQ ID NO: 1937742 - RNA, 18 nt, Shigella flexneri 2a str. 2457T
agguccuguaaugagaau

SEQ ID NO: 1937743 - RNA, 13 nt, Shigella flexneri 2a str. 2457T
agguccuccagcu

SEQ ID NO: 1937744 - RNA, 14 nt, Shigella flexneri 2a str. 2457T
aggucgacagcagc

SEQ ID NO: 1937745 - RNA, 15 nt, Shigella flexneri 2a str. 2457T
aggucgacagcagcc

SEQ ID NO: 1937746 - RNA, 14 nt, Shigella flexneri 2a str. 2457T
aggucggcuuugaa

SEQ ID NO: 1937747 - RNA, 17 nt, Shigella flexneri 2a str. 2457T
aggucguugggaggagg

SEQ ID NO: 1937748 - RNA, 13 nt, Shigella flexneri 2a str. 2457T
aggucgugccaga

SEQ ID NO: 1937749 - RNA, 17 nt, Shigella flexneri 2a str. 2457T
aggucgucaaaaaacuu

SEQ ID NO: 1937750 - RNA, 18 nt, Shigella flexneri 2a str. 2457T
aggugaacaucgcaggga

SEQ ID NO: 1937751 - RNA, 14 nt, Shigella flexneri 2a str. 2457T
aggugcaaaaaaac

SEQ ID NO: 1937752 - RNA, 15 nt, Shigella flexneri 2a str. 2457T
aggugcaaaaaaacu

SEQ ID NO: 1937753 - RNA, 18 nt, Shigella flexneri 2a str. 2457T
aggugcaucggggaauug

SEQ ID NO: 1937754 - RNA, 21 nt, Shigella flexneri 2a str. 2457T
aggugcagcccguaagcaaaa

SEQ ID NO: 1937755 - RNA, 15 nt, Shigella flexneri 2a str. 2457T
aggugaaaaauaaaa

SEQ ID NO: 1937756 - RNA, 17 nt, Shigella flexneri 2a str. 2457T
aggugacacuucauuaa

SEQ ID NO: 1937757 - RNA, 18 nt, Shigella flexneri 2a str. 2457T
aggugacgcgggcagcag

SEQ ID NO: 1937758 - RNA, 18 nt, Shigella flexneri 2a str. 2457T
aggugagucgcaaaacuc

SEQ ID NO: 1937759 - RNA, 14 nt, Shigella flexneri 2a str. 2457T
aggugauacaucaa

SEQ ID NO: 1937760 - RNA, 16 nt, Shigella flexneri 2a str. 2457T
aggugccuuaccacuc

SEQ ID NO: 1937761 - RNA, 21 nt, Shigella flexneri 2a str. 2457T
aggugcugaaagggcaaauaa

SEQ ID NO: 1937762 - RNA, 17 nt, Shigella flexneri 2a str. 2457T
aggugcucaaugagcac

SEQ ID NO: 1937763 - RNA, 15 nt, Shigella flexneri 2a str. 2457T
aggugguagcugccc

SEQ ID NO: 1937764 - RNA, 17 nt, Shigella flexneri 2a str. 2457T
agguggccgagaggcug

SEQ ID NO: 1937765 - RNA, 22 nt, Shigella flexneri 2a str. 2457T
acggucccucaacaacagucuc

SEQ ID NO: 1937766 - RNA, 21 nt, Shigella flexneri 2a str. 2457T
acggucgaggcaaccagcacg

SEQ ID NO: 1937767 - RNA, 14 nt, Shigella flexneri 2a str. 2457T
acggucuaucauca

SEQ ID NO: 1937768 - RNA, 17 nt, Shigella flexneri 2a str. 2457T
acggugauaaucauccc

SEQ ID NO: 1937769 - RNA, 22 nt, Shigella flexneri 2a str. 2457T
acggugaagaagcggaaaucac

SEQ ID NO: 1937770 - RNA, 15 nt, Shigella flexneri 2a str. 2457T
acggugaacucacac

SEQ ID NO: 1937771 - RNA, 20 nt, Shigella flexneri 2a str. 2457T
acggugccauugaccagcug

SEQ ID NO: 1937772 - RNA, 22 nt, Shigella flexneri 2a str. 2457T
acggugccauugaccagcugcc

SEQ ID NO: 1937773 - RNA, 15 nt, Shigella flexneri 2a str. 2457T
acggugaugcuccac

SEQ ID NO: 1937774 - RNA, 15 nt, Shigella flexneri 2a str. 2457T
acggugguaaagccg

SEQ ID NO: 1937775 - RNA, 14 nt, Shigella flexneri 2a str. 2457T
acguaacagagcau

SEQ ID NO: 1937776 - RNA, 16 nt, Shigella flexneri 2a str. 2457T
acguaacaaaacucag

SEQ ID NO: 1937777 - RNA, 17 nt, Shigella flexneri 2a str. 2457T
acguaaccguugaccag

SEQ ID NO: 1937778 - RNA, 14 nt, Shigella flexneri 2a str. 2457T
acguaaagaagaug

SEQ ID NO: 1937779 - RNA, 13 nt, Shigella flexneri 2a str. 2457T
acguaaaaacccg

SEQ ID NO: 1937780 - RNA, 18 nt, Shigella flexneri 2a str. 2457T
acgguuaaaaacagccag

SEQ ID NO: 1937781 - RNA, 21 nt, Shigella flexneri 2a str. 2457T
acgguuaaaaacagccagcag

SEQ ID NO: 1937782 - RNA, 15 nt, Shigella flexneri 2a str. 2457T
acgguuaaaaacagc

SEQ ID NO: 1937783 - RNA, 20 nt, Shigella flexneri 2a str. 2457T
acgguuuaucucaucuucca

SEQ ID NO: 1937784 - RNA, 22 nt, Shigella flexneri 2a str. 2457T
acgguucauuggguucaucuga

SEQ ID NO: 1937785 - RNA, 15 nt, Shigella flexneri 2a str. 2457T
acgguucuugaaaau

SEQ ID NO: 1937786 - RNA, 18 nt, Shigella flexneri 2a str. 2457T
acgggugauuaaagaaaa

SEQ ID NO: 1937787 - RNA, 16 nt, Shigella flexneri 2a str. 2457T
acggguauuuacaucu

SEQ ID NO: 1937788 - RNA, 15 nt, Shigella flexneri 2a str. 2457T
acggguuuuccccuu

SEQ ID NO: 1937789 - RNA, 23 nt, Shigella flexneri 2a str. 2457T
acgguaaccccucuucagccccg

SEQ ID NO: 1937790 - RNA, 12 nt, Shigella flexneri 2a str. 2457T
acgguaauacaa

SEQ ID NO: 1937791 - RNA, 16 nt, Shigella flexneri 2a str. 2457T
acgguacucaucacgu

SEQ ID NO: 1937792 - RNA, 21 nt, Shigella flexneri 2a str. 2457T
acgguacucaucacgucgccu

SEQ ID NO: 1937793 - RNA, 16 nt, Shigella flexneri 2a str. 2457T
acgguaggucacuuuu

SEQ ID NO: 1937794 - RNA, 16 nt, Shigella flexneri 2a str. 2457T
acgguaguugaacucg

SEQ ID NO: 1937795 - RNA, 18 nt, Shigella flexneri 2a str. 2457T
acggggacuccacaccgg

SEQ ID NO: 1937796 - RNA, 19 nt, Shigella flexneri 2a str. 2457T
acgggguugugauuacagg

SEQ ID NO: 1937797 - RNA, 19 nt, Shigella flexneri 2a str. 2457T
acggguaaaacgugccauu

SEQ ID NO: 1937798 - RNA, 20 nt, Shigella flexneri 2a str. 2457T
acggguaaaacgugccauua

SEQ ID NO: 1937799 - RNA, 17 nt, Shigella flexneri 2a str. 2457T
acggggugcgguaaaac

SEQ ID NO: 1937800 - RNA, 15 nt, Shigella flexneri 2a str. 2457T
acgcaauauccgcca

SEQ ID NO: 1937801 - RNA, 13 nt, Shigella flexneri 2a str. 2457T
acgcaauaccugg

SEQ ID NO: 1937802 - RNA, 14 nt, Shigella flexneri 2a str. 2457T
acgcugcucaaugg

SEQ ID NO: 1937803 - RNA, 20 nt, Shigella flexneri 2a str. 2457T
acgcugcggucgaacauaca

SEQ ID NO: 1937804 - RNA, 18 nt, Shigella flexneri 2a str. 2457T
acgcuggcgcgccgccuc

SEQ ID NO: 1937805 - RNA, 13 nt, Shigella flexneri 2a str. 2457T
acgcugucggcaa

SEQ ID NO: 1937806 - RNA, 21 nt, Shigella flexneri 2a str. 2457T
acgcuguuccggcggcagggu

SEQ ID NO: 1937807 - RNA, 15 nt, Shigella flexneri 2a str. 2457T
acggaacgaaaaaaa

SEQ ID NO: 1937808 - RNA, 14 nt, Shigella flexneri 2a str. 2457T
acggaacguugccu

SEQ ID NO: 1937809 - RNA, 23 nt, Shigella flexneri 2a str. 2457T
acggaacguugccugauuuuauu

SEQ ID NO: 1937810 - RNA, 15 nt, Shigella flexneri 2a str. 2457T
acggacaugccauug

SEQ ID NO: 1937811 - RNA, 22 nt, Shigella flexneri 2a str. 2457T
acgcuuuuucccugguaaaaaa

SEQ ID NO: 1937812 - RNA, 15 nt, Shigella flexneri 2a str. 2457T
acgcuuaacaacccg

SEQ ID NO: 1937813 - RNA, 19 nt, Shigella flexneri 2a str. 2457T
acggaaaucauccagcacg

SEQ ID NO: 1937814 - RNA, 13 nt, Shigella flexneri 2a str. 2457T
acggcaauaccug

SEQ ID NO: 1937815 - RNA, 17 nt, Shigella flexneri 2a str. 2457T
acggcaauucccagaau

SEQ ID NO: 1937816 - RNA, 16 nt, Shigella flexneri 2a str. 2457T
acggcauuuugcugau

SEQ ID NO: 1937817 - RNA, 15 nt, Shigella flexneri 2a str. 2457T
acggccaaaaucucu

SEQ ID NO: 1937818 - RNA, 16 nt, Shigella flexneri 2a str. 2457T
acggaugacacgcagg

SEQ ID NO: 1937819 - RNA, 15 nt, Shigella flexneri 2a str. 2457T
acggauucagugagc

SEQ ID NO: 1937820 - RNA, 17 nt, Shigella flexneri 2a str. 2457T
acucaaaccccgcagca

SEQ ID NO: 1937821 - RNA, 21 nt, Shigella flexneri 2a str. 2457T
acucaaacagggcaauuaaaa

SEQ ID NO: 1937822 - RNA, 13 nt, Shigella flexneri 2a str. 2457T
acucaaaucacgc

SEQ ID NO: 1937823 - RNA, 13 nt, Shigella flexneri 2a str. 2457T
acucaaagucgag

SEQ ID NO: 1937824 - RNA, 13 nt, Shigella flexneri 2a str. 2457T
acuauuucuuugu

SEQ ID NO: 1937825 - RNA, 23 nt, Shigella flexneri 2a str. 2457T
acuauuaaacaggaugacacuga

SEQ ID NO: 1937826 - RNA, 23 nt, Shigella flexneri 2a str. 2457T
acuauuaguuuguugaaguuuau

SEQ ID NO: 1937827 - RNA, 19 nt, Shigella flexneri 2a str. 2457T
acuaucgaaaguuuaccag

SEQ ID NO: 1937828 - RNA, 17 nt, Shigella flexneri 2a str. 2457T
acuauccuggacuuuaa

SEQ ID NO: 1937829 - RNA, 17 nt, Shigella flexneri 2a str. 2457T
acuaucauacucauuua

SEQ ID NO: 1937830 - RNA, 18 nt, Shigella flexneri 2a str. 2457T
acuaaagccuuuugccag

SEQ ID NO: 1937831 - RNA, 13 nt, Shigella flexneri 2a str. 2457T
acuaccauaaaaa

SEQ ID NO: 1937832 - RNA, 19 nt, Shigella flexneri 2a str. 2457T
acuaccauuuguucuuuuu

SEQ ID NO: 1937833 - RNA, 15 nt, Shigella flexneri 2a str. 2457T
acuacccauauuuaa

SEQ ID NO: 1937834 - RNA, 16 nt, Shigella flexneri 2a str. 2457T
acuaccggggacaggc

SEQ ID NO: 1937835 - RNA, 19 nt, Shigella flexneri 2a str. 2457T
acuaccggaacccaccgca

SEQ ID NO: 1937836 - RNA, 22 nt, Shigella flexneri 2a str. 2457T
acuacggcuucugacauaacca

SEQ ID NO: 1937837 - RNA, 23 nt, Shigella flexneri 2a str. 2457T
acuacggcuucugacauaaccac

SEQ ID NO: 1937838 - RNA, 18 nt, Shigella flexneri 2a str. 2457T
acuacgccaacagaagug

SEQ ID NO: 1937839 - RNA, 17 nt, Shigella flexneri 2a str. 2457T
acuagacgaugaaaaag

SEQ ID NO: 1937840 - RNA, 14 nt, Shigella flexneri 2a str. 2457T
acuagugauaacca

SEQ ID NO: 1937841 - RNA, 17 nt, Shigella flexneri 2a str. 2457T
acguuggcggugccauc

SEQ ID NO: 1937842 - RNA, 20 nt, Shigella flexneri 2a str. 2457T
acguuaguguggccaguucc

SEQ ID NO: 1937843 - RNA, 16 nt, Shigella flexneri 2a str. 2457T
acguuagaaacaaaaa

SEQ ID NO: 1937844 - RNA, 20 nt, Shigella flexneri 2a str. 2457T
acguuaucgcgccaucaaau

SEQ ID NO: 1937845 - RNA, 18 nt, Shigella flexneri 2a str. 2457T
acguuucaaacaggcugc

SEQ ID NO: 1937846 - RNA, 16 nt, Shigella flexneri 2a str. 2457T
acguugucaguucuuu

SEQ ID NO: 1937847 - RNA, 14 nt, Shigella flexneri 2a str. 2457T
acguuuuucgaaaa

SEQ ID NO: 1937848 - RNA, 15 nt, Shigella flexneri 2a str. 2457T
acguuuugcugaugc

SEQ ID NO: 1937849 - RNA, 20 nt, Shigella flexneri 2a str. 2457T
acguuuugcaauuucccuga

SEQ ID NO: 1937850 - RNA, 15 nt, Shigella flexneri 2a str. 2457T
acguuucuggugugc

SEQ ID NO: 1937851 - RNA, 17 nt, Shigella flexneri 2a str. 2457T
acguuuggucagaucag

SEQ ID NO: 1937852 - RNA, 19 nt, Shigella flexneri 2a str. 2457T
acgugcucugcgccgccuu

SEQ ID NO: 1937853 - RNA, 18 nt, Shigella flexneri 2a str. 2457T
acguuacguacuuccuua

SEQ ID NO: 1937854 - RNA, 18 nt, Shigella flexneri 2a str. 2457T
acgugccagauguuugaa

SEQ ID NO: 1937855 - RNA, 16 nt, Shigella flexneri 2a str. 2457T
acgugccgcagcuucu

SEQ ID NO: 1937856 - RNA, 18 nt, Shigella flexneri 2a str. 2457T
acgugccugugcagcgac

SEQ ID NO: 1937857 - RNA, 20 nt, Shigella flexneri 2a str. 2457T
acgugcggccguuccauuca

SEQ ID NO: 1937858 - RNA, 15 nt, Shigella flexneri 2a str. 2457T
acgucgucaggcaac

SEQ ID NO: 1937859 - RNA, 14 nt, Shigella flexneri 2a str. 2457T
acgucgucgucuuc

SEQ ID NO: 1937860 - RNA, 17 nt, Shigella flexneri 2a str. 2457T
acgucucaaucaccacc

SEQ ID NO: 1937861 - RNA, 13 nt, Shigella flexneri 2a str. 2457T
acgucucaucagg

SEQ ID NO: 1937862 - RNA, 17 nt, Shigella flexneri 2a str. 2457T
acgucuccggugcuuua

SEQ ID NO: 1937863 - RNA, 17 nt, Shigella flexneri 2a str. 2457T
acgucuccaucaauaca

SEQ ID NO: 1937864 - RNA, 13 nt, Shigella flexneri 2a str. 2457T
acgucgcccaccg

SEQ ID NO: 1937865 - RNA, 22 nt, Shigella flexneri 2a str. 2457T
acgucgauauaauugaccagau

SEQ ID NO: 1937866 - RNA, 18 nt, Shigella flexneri 2a str. 2457T
acgucgauuuuuaaugaa

SEQ ID NO: 1937867 - RNA, 20 nt, Shigella flexneri 2a str. 2457T
acgucgauuuuuaaugaacg

SEQ ID NO: 1937868 - RNA, 17 nt, Shigella flexneri 2a str. 2457T
acguccuguacuguuuc

SEQ ID NO: 1937869 - RNA, 23 nt, Shigella flexneri 2a str. 2457T
acguccagcgauuugcggaagua

SEQ ID NO: 1937870 - RNA, 16 nt, Shigella flexneri 2a str. 2457T
acguaaugauguaaaa

SEQ ID NO: 1937871 - RNA, 13 nt, Shigella flexneri 2a str. 2457T
acguaauuucaau

SEQ ID NO: 1937872 - RNA, 15 nt, Shigella flexneri 2a str. 2457T
acuucacggcugcua

SEQ ID NO: 1937873 - RNA, 12 nt, Shigella flexneri 2a str. 2457T
acuucagcagca

SEQ ID NO: 1937874 - RNA, 21 nt, Shigella flexneri 2a str. 2457T
acuucagcaagcgauaauuua

SEQ ID NO: 1937875 - RNA, 22 nt, Shigella flexneri 2a str. 2457T
acuucagauaaaucacgcuuca

SEQ ID NO: 1937876 - RNA, 13 nt, Shigella flexneri 2a str. 2457T
acuucacuucccc

SEQ ID NO: 1937877 - RNA, 14 nt, Shigella flexneri 2a str. 2457T
acuucacuucuucu

SEQ ID NO: 1937878 - RNA, 18 nt, Shigella flexneri 2a str. 2457T
acuuccgcgucaaucugc

SEQ ID NO: 1937879 - RNA, 20 nt, Shigella flexneri 2a str. 2457T
acuuccgcgucaaucugccc

SEQ ID NO: 1937880 - RNA, 16 nt, Shigella flexneri 2a str. 2457T
acuuccguaccagccu

SEQ ID NO: 1937881 - RNA, 20 nt, Shigella flexneri 2a str. 2457T
acuuccugagugaauauuua

SEQ ID NO: 1937882 - RNA, 21 nt, Shigella flexneri 2a str. 2457T
acuucccucccguuucccugu

SEQ ID NO: 1937883 - RNA, 18 nt, Shigella flexneri 2a str. 2457T
acuuccgaacaguacugg

SEQ ID NO: 1937884 - RNA, 15 nt, Shigella flexneri 2a str. 2457T
acuucacaucaccau

SEQ ID NO: 1937885 - RNA, 17 nt, Shigella flexneri 2a str. 2457T
acuucaaucgccaccac

SEQ ID NO: 1937886 - RNA, 13 nt, Shigella flexneri 2a str. 2457T
acuuaucggaaca

SEQ ID NO: 1937887 - RNA, 19 nt, Shigella flexneri 2a str. 2457T
acuuaucuuuuacaagcaa

SEQ ID NO: 1937888 - RNA, 11 nt, Shigella flexneri 2a str. 2457T
acuuaucauca

SEQ ID NO: 1937889 - RNA, 17 nt, Shigella flexneri 2a str. 2457T
acuuaucgugccuacac

SEQ ID NO: 1937890 - RNA, 14 nt, Shigella flexneri 2a str. 2457T
acugucuucaccau

SEQ ID NO: 1937891 - RNA, 22 nt, Shigella flexneri 2a str. 2457T
acugucugcuucugccugggcc

SEQ ID NO: 1937892 - RNA, 19 nt, Shigella flexneri 2a str. 2457T
acuguuaacggccgaagaa

SEQ ID NO: 1937893 - RNA, 16 nt, Shigella flexneri 2a str. 2457T
acuguuacugucggca

SEQ ID NO: 1937894 - RNA, 17 nt, Shigella flexneri 2a str. 2457T
acuguucuaguaccgau

SEQ ID NO: 1937895 - RNA, 18 nt, Shigella flexneri 2a str. 2457T
acuguucugauaguuaaa

SEQ ID NO: 1937896 - RNA, 13 nt, Shigella flexneri 2a str. 2457T
acuguuccagcac

SEQ ID NO: 1937897 - RNA, 21 nt, Shigella flexneri 2a str. 2457T
acugucguuaaauccagaucc

SEQ ID NO: 1937898 - RNA, 15 nt, Shigella flexneri 2a str. 2457T
acugguuuuccugag

SEQ ID NO: 1937899 - RNA, 20 nt, Shigella flexneri 2a str. 2457T
acugguucccaacaacagcg

SEQ ID NO: 1937900 - RNA, 16 nt, Shigella flexneri 2a str. 2457T
acuguugauccaggag

SEQ ID NO: 1937901 - RNA, 21 nt, Shigella flexneri 2a str. 2457T
acuuaaauccguuaugucucc

SEQ ID NO: 1937902 - RNA, 21 nt, Shigella flexneri 2a str. 2457T
acuuaauccugaguuaagcaa

SEQ ID NO: 1937903 - RNA, 16 nt, Shigella flexneri 2a str. 2457T
acuuaaggucacagaa

SEQ ID NO: 1937904 - RNA, 15 nt, Shigella flexneri 2a str. 2457T
acuuaacccauuaca

SEQ ID NO: 1937905 - RNA, 21 nt, Shigella flexneri 2a str. 2457T
acuggaaaaauaauuuuaaau

SEQ ID NO: 1937906 - RNA, 17 nt, Shigella flexneri 2a str. 2457T
acugcuuuuuaaucucc

SEQ ID NO: 1937907 - RNA, 13 nt, Shigella flexneri 2a str. 2457T
acuggaaaucaaa

SEQ ID NO: 1937908 - RNA, 16 nt, Shigella flexneri 2a str. 2457T
acugcuggaagcuggc

SEQ ID NO: 1937909 - RNA, 18 nt, Shigella flexneri 2a str. 2457T
acugcuggcuuaaaaaac

SEQ ID NO: 1937910 - RNA, 14 nt, Shigella flexneri 2a str. 2457T
acugcuuaauauua

SEQ ID NO: 1937911 - RNA, 21 nt, Shigella flexneri 2a str. 2457T
acugcuuaauauuaacuuaau

SEQ ID NO: 1937912 - RNA, 14 nt, Shigella flexneri 2a str. 2457T
acugcuuacaggcu

SEQ ID NO: 1937913 - RNA, 18 nt, Shigella flexneri 2a str. 2457T
acugcuccggcuuuuuag

SEQ ID NO: 1937914 - RNA, 14 nt, Shigella flexneri 2a str. 2457T
acugcucagcuccu

SEQ ID NO: 1937915 - RNA, 15 nt, Shigella flexneri 2a str. 2457T
acugcugaaugaggc

SEQ ID NO: 1937916 - RNA, 18 nt, Shigella flexneri 2a str. 2457T
acugcugauguuguuucu

SEQ ID NO: 1937917 - RNA, 20 nt, Shigella flexneri 2a str. 2457T
acugcugauuuggaaagugu

SEQ ID NO: 1937918 - RNA, 12 nt, Shigella flexneri 2a str. 2457T
acugcgugcuga

SEQ ID NO: 1937919 - RNA, 23 nt, Shigella flexneri 2a str. 2457T
acugcguauuuccugccagaccu

SEQ ID NO: 1937920 - RNA, 20 nt, Shigella flexneri 2a str. 2457T
acugcgucauuucgaagaaa

SEQ ID NO: 1937921 - RNA, 23 nt, Shigella flexneri 2a str. 2457T
acugcgggcgaaaguguaaagca

SEQ ID NO: 1937922 - RNA, 20 nt, Shigella flexneri 2a str. 2457T
acugcggucuaaaucuuccg

SEQ ID NO: 1937923 - RNA, 20 nt, Shigella flexneri 2a str. 2457T
acugcguuucuggcuuaaac

SEQ ID NO: 1937924 - RNA, 14 nt, Shigella flexneri 2a str. 2457T
acugcguucugucg

SEQ ID NO: 1937925 - RNA, 19 nt, Shigella flexneri 2a str. 2457T
acugguagcuguagguaaa

SEQ ID NO: 1937926 - RNA, 13 nt, Shigella flexneri 2a str. 2457T
acugguacucaac

SEQ ID NO: 1937927 - RNA, 22 nt, Shigella flexneri 2a str. 2457T
acuggguuggguucacuuuccc

SEQ ID NO: 1937928 - RNA, 20 nt, Shigella flexneri 2a str. 2457T
acugguggcaggaaaacaau

SEQ ID NO: 1937929 - RNA, 19 nt, Shigella flexneri 2a str. 2457T
acugguucccaacaacagc

SEQ ID NO: 1937930 - RNA, 14 nt, Shigella flexneri 2a str. 2457T
acuggugagcggug

SEQ ID NO: 1937931 - RNA, 21 nt, Shigella flexneri 2a str. 2457T
acuggucaucaaauuacgaua

SEQ ID NO: 1937932 - RNA, 15 nt, Shigella flexneri 2a str. 2457T
acugguccagccccu

SEQ ID NO: 1937933 - RNA, 23 nt, Shigella flexneri 2a str. 2457T
acuggugacuuuugcccggcaug

SEQ ID NO: 1937934 - RNA, 16 nt, Shigella flexneri 2a str. 2457T
acugggucaguaugga

SEQ ID NO: 1937935 - RNA, 16 nt, Shigella flexneri 2a str. 2457T
acuggggcuggcggca

SEQ ID NO: 1937936 - RNA, 13 nt, Shigella flexneri 2a str. 2457T
acugggcgauuaa

SEQ ID NO: 1937937 - RNA, 17 nt, Shigella flexneri 2a str. 2457T
acugggcgauuaauaaa

SEQ ID NO: 1937938 - RNA, 18 nt, Shigella flexneri 2a str. 2457T
acuggcuggcuaaauauu

SEQ ID NO: 1937939 - RNA, 20 nt, Shigella flexneri 2a str. 2457T
acugggaagaauggaaaaaa

SEQ ID NO: 1937940 - RNA, 14 nt, Shigella flexneri 2a str. 2457T
acuggcucuuuuuc

SEQ ID NO: 1937941 - RNA, 17 nt, Shigella flexneri 2a str. 2457T
acuggcggucaugacga

SEQ ID NO: 1937942 - RNA, 14 nt, Shigella flexneri 2a str. 2457T
acuggcggcaaaaa

SEQ ID NO: 1937943 - RNA, 16 nt, Shigella flexneri 2a str. 2457T
acuggcaaaugacaua

SEQ ID NO: 1937944 - RNA, 17 nt, Shigella flexneri 2a str. 2457T
acuggcaacaauggcau

SEQ ID NO: 1937945 - RNA, 14 nt, Shigella flexneri 2a str. 2457T
acuggcaaccagaa

SEQ ID NO: 1937946 - RNA, 17 nt, Shigella flexneri 2a str. 2457T
acuggcaaccagaagag

SEQ ID NO: 1937947 - RNA, 14 nt, Shigella flexneri 2a str. 2457T
acuggaugaaaaaa

SEQ ID NO: 1937948 - RNA, 16 nt, Shigella flexneri 2a str. 2457T
acugcacaccgcggaa

SEQ ID NO: 1937949 - RNA, 23 nt, Shigella flexneri 2a str. 2457T
acugcauaaugccgguggugacc

SEQ ID NO: 1937950 - RNA, 16 nt, Shigella flexneri 2a str. 2457T
acugccacaagggcau

SEQ ID NO: 1937951 - RNA, 14 nt, Shigella flexneri 2a str. 2457T
acugcccgagaaca

SEQ ID NO: 1937952 - RNA, 12 nt, Shigella flexneri 2a str. 2457T
acugcccgagaa

SEQ ID NO: 1937953 - RNA, 13 nt, Shigella flexneri 2a str. 2457T
acugccaccaucc

SEQ ID NO: 1937954 - RNA, 16 nt, Shigella flexneri 2a str. 2457T
acugcaucuuccgugg

SEQ ID NO: 1937955 - RNA, 15 nt, Shigella flexneri 2a str. 2457T
acugcgccaucaaug

SEQ ID NO: 1937956 - RNA, 18 nt, Shigella flexneri 2a str. 2457T
acugcgccacgguguugu

SEQ ID NO: 1937957 - RNA, 17 nt, Shigella flexneri 2a str. 2457T
acugcgaugggagcagc

SEQ ID NO: 1937958 - RNA, 16 nt, Shigella flexneri 2a str. 2457T
acugcgaccgaucacc

SEQ ID NO: 1937959 - RNA, 20 nt, Shigella flexneri 2a str. 2457T
acugcgcguuaaagagcauu

SEQ ID NO: 1937960 - RNA, 18 nt, Shigella flexneri 2a str. 2457T
acugcgcgccgcgcugcu

SEQ ID NO: 1937961 - RNA, 15 nt, Shigella flexneri 2a str. 2457T
acugcgcuaccagga

SEQ ID NO: 1937962 - RNA, 19 nt, Shigella flexneri 2a str. 2457T
acugcgccucaacauacaa

SEQ ID NO: 1937963 - RNA, 19 nt, Shigella flexneri 2a str. 2457T
acugcgcgauuaucauuuu

SEQ ID NO: 1937964 - RNA, 16 nt, Shigella flexneri 2a str. 2457T
acugcgccgcucagua

SEQ ID NO: 1937965 - RNA, 13 nt, Shigella flexneri 2a str. 2457T
acugccggaagag

SEQ ID NO: 1937966 - RNA, 16 nt, Shigella flexneri 2a str. 2457T
acugccggacguucgc

SEQ ID NO: 1937967 - RNA, 15 nt, Shigella flexneri 2a str. 2457T
acugccguacaggca

SEQ ID NO: 1937968 - RNA, 22 nt, Shigella flexneri 2a str. 2457T
acugccuuugcccgcaagcugc

SEQ ID NO: 1937969 - RNA, 16 nt, Shigella flexneri 2a str. 2457T
acugauaguguuuuau

SEQ ID NO: 1937970 - RNA, 23 nt, Shigella flexneri 2a str. 2457T
acugauaauuuucgguaaugacu

SEQ ID NO: 1937971 - RNA, 18 nt, Shigella flexneri 2a str. 2457T
acugauaacgcauuucau

SEQ ID NO: 1937972 - RNA, 15 nt, Shigella flexneri 2a str. 2457T
acugauaaaccuuca

SEQ ID NO: 1937973 - RNA, 21 nt, Shigella flexneri 2a str. 2457T
acugagucagcccaacaaagc

SEQ ID NO: 1937974 - RNA, 16 nt, Shigella flexneri 2a str. 2457T
acugaguucucauggu

SEQ ID NO: 1937975 - RNA, 13 nt, Shigella flexneri 2a str. 2457T
acugacuauccug

SEQ ID NO: 1937976 - RNA, 15 nt, Shigella flexneri 2a str. 2457T
acugacugacuucaa

SEQ ID NO: 1937977 - RNA, 14 nt, Shigella flexneri 2a str. 2457T
acugacuuucguuu

SEQ ID NO: 1937978 - RNA, 16 nt, Shigella flexneri 2a str. 2457T
acugcaaaucaccaca

SEQ ID NO: 1937979 - RNA, 19 nt, Shigella flexneri 2a str. 2457T
acugcaacagcuguugaaa

SEQ ID NO: 1937980 - RNA, 18 nt, Shigella flexneri 2a str. 2457T
acugcaacugcgcggcaa

SEQ ID NO: 1937981 - RNA, 14 nt, Shigella flexneri 2a str. 2457T
acugcaaugaccau

SEQ ID NO: 1937982 - RNA, 13 nt, Shigella flexneri 2a str. 2457T
acugcaaaccaug

SEQ ID NO: 1937983 - RNA, 17 nt, Shigella flexneri 2a str. 2457T
acugcaaaccaugacgc

SEQ ID NO: 1937984 - RNA, 14 nt, Shigella flexneri 2a str. 2457T
acugauccugacaa

SEQ ID NO: 1937985 - RNA, 12 nt, Shigella flexneri 2a str. 2457T
acugaucaucau

SEQ ID NO: 1937986 - RNA, 13 nt, Shigella flexneri 2a str. 2457T
acugaucaucauu

SEQ ID NO: 1937987 - RNA, 16 nt, Shigella flexneri 2a str. 2457T
acucgauuaauucaua

SEQ ID NO: 1937988 - RNA, 23 nt, Shigella flexneri 2a str. 2457T
acucgauaccagauuaauuauug

SEQ ID NO: 1937989 - RNA, 16 nt, Shigella flexneri 2a str. 2457T
acucgaggagcuggag

SEQ ID NO: 1937990 - RNA, 18 nt, Shigella flexneri 2a str. 2457T
acucuacaaccagcuuau

SEQ ID NO: 1937991 - RNA, 13 nt, Shigella flexneri 2a str. 2457T
acucuacuucuuc

SEQ ID NO: 1937992 - RNA, 13 nt, Shigella flexneri 2a str. 2457T
acucucugaagua

SEQ ID NO: 1937993 - RNA, 21 nt, Shigella flexneri 2a str. 2457T
acucucgggaaggcccuuucc

SEQ ID NO: 1937994 - RNA, 15 nt, Shigella flexneri 2a str. 2457T
acucugaaaacgcug

SEQ ID NO: 1937995 - RNA, 12 nt, Shigella flexneri 2a str. 2457T
acucuuuuuccu

SEQ ID NO: 1937996 - RNA, 23 nt, Shigella flexneri 2a str. 2457T
acucuuuggcaaccguggugagu

SEQ ID NO: 1937997 - RNA, 19 nt, Shigella flexneri 2a str. 2457T
acucugggcugaagaguaa

SEQ ID NO: 1937998 - RNA, 21 nt, Shigella flexneri 2a str. 2457T
acucuuaagguucacuuaauc

SEQ ID NO: 1937999 - RNA, 21 nt, Shigella flexneri 2a str. 2457T
acuccgguuauuauuuacuug

SEQ ID NO: 1938000 - RNA, 21 nt, Shigella flexneri 2a str. 2457T
acuccggcuugaaccagccaa

SEQ ID NO: 1938001 - RNA, 18 nt, Shigella flexneri 2a str. 2457T
acuccgccgcaucuuccc

SEQ ID NO: 1938002 - RNA, 19 nt, Shigella flexneri 2a str. 2457T
acuccgccgcaucuuccca

SEQ ID NO: 1938003 - RNA, 19 nt, Shigella flexneri 2a str. 2457T
acuccgcgaccacacucaa

SEQ ID NO: 1938004 - RNA, 23 nt, Shigella flexneri 2a str. 2457T
acuccggaaaaacagaggcccgc

SEQ ID NO: 1938005 - RNA, 13 nt, Shigella flexneri 2a str. 2457T
acucaaugacuuc

SEQ ID NO: 1938006 - RNA, 12 nt, Shigella flexneri 2a str. 2457T
acucaauaccug

SEQ ID NO: 1938007 - RNA, 16 nt, Shigella flexneri 2a str. 2457T
acucaauaccugauga

SEQ ID NO: 1938008 - RNA, 22 nt, Shigella flexneri 2a str. 2457T
acucaacgguucgccaucaaga

SEQ ID NO: 1938009 - RNA, 13 nt, Shigella flexneri 2a str. 2457T
acucaaccgccac

SEQ ID NO: 1938010 - RNA, 14 nt, Shigella flexneri 2a str. 2457T
acuccugccaccac

SEQ ID NO: 1938011 - RNA, 13 nt, Shigella flexneri 2a str. 2457T
acuccugccacca

SEQ ID NO: 1938012 - RNA, 20 nt, Shigella flexneri 2a str. 2457T
acuccuucuaaagccugagc

SEQ ID NO: 1938013 - RNA, 19 nt, Shigella flexneri 2a str. 2457T
acuccuguaucgucacugg

SEQ ID NO: 1938014 - RNA, 18 nt, Shigella flexneri 2a str. 2457T
acuccuuccugaaauaga

SEQ ID NO: 1938015 - RNA, 23 nt, Shigella flexneri 2a str. 2457T
acuccugguaucuuuacagcgcu

SEQ ID NO: 1938016 - RNA, 14 nt, Shigella flexneri 2a str. 2457T
agauucaauuauag

SEQ ID NO: 1938017 - RNA, 18 nt, Shigella flexneri 2a str. 2457T
agauucagcgucgucagc

SEQ ID NO: 1938018 - RNA, 16 nt, Shigella flexneri 2a str. 2457T
agauucaggcgcagca

SEQ ID NO: 1938019 - RNA, 22 nt, Shigella flexneri 2a str. 2457T
agauuccccgcaguuacagcag

SEQ ID NO: 1938020 - RNA, 23 nt, Shigella flexneri 2a str. 2457T
agauucaugguacgggacagcag

SEQ ID NO: 1938021 - RNA, 23 nt, Shigella flexneri 2a str. 2457T
agauuagccgguaaaucaccagc

SEQ ID NO: 1938022 - RNA, 13 nt, Shigella flexneri 2a str. 2457T
agauuauugacaa

SEQ ID NO: 1938023 - RNA, 18 nt, Shigella flexneri 2a str. 2457T
agauugcgaauauguacu

SEQ ID NO: 1938024 - RNA, 22 nt, Shigella flexneri 2a str. 2457T
agauugccugaugcgcugggca

SEQ ID NO: 1938025 - RNA, 21 nt, Shigella flexneri 2a str. 2457T
agauuggcuucauugauuaac

SEQ ID NO: 1938026 - RNA, 20 nt, Shigella flexneri 2a str. 2457T
agauucguuuuccagugcca

SEQ ID NO: 1938027 - RNA, 15 nt, Shigella flexneri 2a str. 2457T
agauucgguaaccau

SEQ ID NO: 1938028 - RNA, 13 nt, Shigella flexneri 2a str. 2457T
agauucgccagau

SEQ ID NO: 1938029 - RNA, 16 nt, Shigella flexneri 2a str. 2457T
agauugaauuagcaag

SEQ ID NO: 1938030 - RNA, 20 nt, Shigella flexneri 2a str. 2457T
agauugaacgcuggcggcag

SEQ ID NO: 1938031 - RNA, 14 nt, Shigella flexneri 2a str. 2457T
agauugaagugaac

SEQ ID NO: 1938032 - RNA, 12 nt, Shigella flexneri 2a str. 2457T
agauucuuaaag

SEQ ID NO: 1938033 - RNA, 16 nt, Shigella flexneri 2a str. 2457T
agauguugucucagau

SEQ ID NO: 1938034 - RNA, 17 nt, Shigella flexneri 2a str. 2457T
agauguugucucagauu

SEQ ID NO: 1938035 - RNA, 16 nt, Shigella flexneri 2a str. 2457T
agaugugcgguggcuu

SEQ ID NO: 1938036 - RNA, 19 nt, Shigella flexneri 2a str. 2457T
agauguucuaucuuucaga

SEQ ID NO: 1938037 - RNA, 17 nt, Shigella flexneri 2a str. 2457T
agauuaacgugaccgcc

SEQ ID NO: 1938038 - RNA, 22 nt, Shigella flexneri 2a str. 2457T
agauggucuguaccaccagaau

SEQ ID NO: 1938039 - RNA, 20 nt, Shigella flexneri 2a str. 2457T
agaugugggcaaucucacuc

SEQ ID NO: 1938040 - RNA, 21 nt, Shigella flexneri 2a str. 2457T
agaugugcaguuccugcaacu

SEQ ID NO: 1938041 - RNA, 23 nt, Shigella flexneri 2a str. 2457T
agauggcuauaaucacucaaaau

SEQ ID NO: 1938042 - RNA, 17 nt, Shigella flexneri 2a str. 2457T
agauggcuuugcccuuu

SEQ ID NO: 1938043 - RNA, 19 nt, Shigella flexneri 2a str. 2457T
agauggcuuugcccuuucu

SEQ ID NO: 1938044 - RNA, 20 nt, Shigella flexneri 2a str. 2457T
agauggcuuugcccuuucug

SEQ ID NO: 1938045 - RNA, 16 nt, Shigella flexneri 2a str. 2457T
agauggcgcgcagaaa

SEQ ID NO: 1938046 - RNA, 20 nt, Shigella flexneri 2a str. 2457T
agauggauugcugaaauaca

SEQ ID NO: 1938047 - RNA, 16 nt, Shigella flexneri 2a str. 2457T
agauggauugcugaaa

SEQ ID NO: 1938048 - RNA, 18 nt, Shigella flexneri 2a str. 2457T
agauggauugcugaaaua

SEQ ID NO: 1938049 - RNA, 22 nt, Shigella flexneri 2a str. 2457T
agaugcuugcgauauucuucag

SEQ ID NO: 1938050 - RNA, 15 nt, Shigella flexneri 2a str. 2457T
agaugcuuucagcac

SEQ ID NO: 1938051 - RNA, 12 nt, Shigella flexneri 2a str. 2457T
agaugcuggaga

SEQ ID NO: 1938052 - RNA, 12 nt, Shigella flexneri 2a str. 2457T
agauccgccagu

SEQ ID NO: 1938053 - RNA, 16 nt, Shigella flexneri 2a str. 2457T
agauccgccaguuugu

SEQ ID NO: 1938054 - RNA, 19 nt, Shigella flexneri 2a str. 2457T
agauccgccauuucuccuc

SEQ ID NO: 1938055 - RNA, 17 nt, Shigella flexneri 2a str. 2457T
agauccgggcauauuuc

SEQ ID NO: 1938056 - RNA, 18 nt, Shigella flexneri 2a str. 2457T
agauccgggcauauuucc

SEQ ID NO: 1938057 - RNA, 23 nt, Shigella flexneri 2a str. 2457T
agauccugauccugcaacagcac

SEQ ID NO: 1938058 - RNA, 16 nt, Shigella flexneri 2a str. 2457T
agauccauaagguccu

SEQ ID NO: 1938059 - RNA, 17 nt, Shigella flexneri 2a str. 2457T
agauccauaagguccuc

SEQ ID NO: 1938060 - RNA, 17 nt, Shigella flexneri 2a str. 2457T
agaucccauaaccaaca

SEQ ID NO: 1938061 - RNA, 15 nt, Shigella flexneri 2a str. 2457T
agauccaggaacaga

SEQ ID NO: 1938062 - RNA, 13 nt, Shigella flexneri 2a str. 2457T
agauccagguuac

SEQ ID NO: 1938063 - RNA, 23 nt, Shigella flexneri 2a str. 2457T
agauccagugcguaucaauagca

SEQ ID NO: 1938064 - RNA, 20 nt, Shigella flexneri 2a str. 2457T
agauccagugcucauccuuc

SEQ ID NO: 1938065 - RNA, 22 nt, Shigella flexneri 2a str. 2457T
agauccaaaccgacugccugca

SEQ ID NO: 1938066 - RNA, 18 nt, Shigella flexneri 2a str. 2457T
agaucguucgcaccaaau

SEQ ID NO: 1938067 - RNA, 18 nt, Shigella flexneri 2a str. 2457T
agaucgugaaacucagcc

SEQ ID NO: 1938068 - RNA, 16 nt, Shigella flexneri 2a str. 2457T
agaucgguugccauaa

SEQ ID NO: 1938069 - RNA, 14 nt, Shigella flexneri 2a str. 2457T
agaucggaugacgc

SEQ ID NO: 1938070 - RNA, 20 nt, Shigella flexneri 2a str. 2457T
agaucgcgaugggucgccgc

SEQ ID NO: 1938071 - RNA, 19 nt, Shigella flexneri 2a str. 2457T
agaucgcggcaauuuuuac

SEQ ID NO: 1938072 - RNA, 16 nt, Shigella flexneri 2a str. 2457T
agaucgaacacgguga

SEQ ID NO: 1938073 - RNA, 16 nt, Shigella flexneri 2a str. 2457T
agaugaauaauguuua

SEQ ID NO: 1938074 - RNA, 15 nt, Shigella flexneri 2a str. 2457T
agaugaagcuggcaa

SEQ ID NO: 1938075 - RNA, 16 nt, Shigella flexneri 2a str. 2457T
agaucuuucacgccca

SEQ ID NO: 1938076 - RNA, 18 nt, Shigella flexneri 2a str. 2457T
agaucuggcgauuauuuu

SEQ ID NO: 1938077 - RNA, 22 nt, Shigella flexneri 2a str. 2457T
agaucugcuucaggaauauguu

SEQ ID NO: 1938078 - RNA, 14 nt, Shigella flexneri 2a str. 2457T
agaucuugauuuac

SEQ ID NO: 1938079 - RNA, 22 nt, Shigella flexneri 2a str. 2457T
agaucuugcgcgaccacgauau

SEQ ID NO: 1938080 - RNA, 14 nt, Shigella flexneri 2a str. 2457T
agaugaugauacug

SEQ ID NO: 1938081 - RNA, 15 nt, Shigella flexneri 2a str. 2457T
agaugaugauacuga

SEQ ID NO: 1938082 - RNA, 16 nt, Shigella flexneri 2a str. 2457T
agaugaugauacugac

SEQ ID NO: 1938083 - RNA, 13 nt, Shigella flexneri 2a str. 2457T
agaugauaacccc

SEQ ID NO: 1938084 - RNA, 19 nt, Shigella flexneri 2a str. 2457T
agaugcgacggcaccacau

SEQ ID NO: 1938085 - RNA, 11 nt, Shigella flexneri 2a str. 2457T
agaugauuuuu

SEQ ID NO: 1938086 - RNA, 18 nt, Shigella flexneri 2a str. 2457T
agaugauggcauucucac

SEQ ID NO: 1938087 - RNA, 23 nt, Shigella flexneri 2a str. 2457T
agaugaucgccgcacuuucuccu

SEQ ID NO: 1938088 - RNA, 12 nt, Shigella flexneri 2a str. 2457T
agaucagaccaa

SEQ ID NO: 1938089 - RNA, 13 nt, Shigella flexneri 2a str. 2457T
agaucagauaaua

SEQ ID NO: 1938090 - RNA, 15 nt, Shigella flexneri 2a str. 2457T
agaucaccugcugga

SEQ ID NO: 1938091 - RNA, 16 nt, Shigella flexneri 2a str. 2457T
agaucaccugcuggac

SEQ ID NO: 1938092 - RNA, 14 nt, Shigella flexneri 2a str. 2457T
agaucaaacucuuu

SEQ ID NO: 1938093 - RNA, 21 nt, Shigella flexneri 2a str. 2457T
agauauuuuuaugcaugaccu

SEQ ID NO: 1938094 - RNA, 23 nt, Shigella flexneri 2a str. 2457T
agauauuuuuaugcaugaccuac

SEQ ID NO: 1938095 - RNA, 23 nt, Shigella flexneri 2a str. 2457T
agauauuggggguaauucccugc

SEQ ID NO: 1938096 - RNA, 22 nt, Shigella flexneri 2a str. 2457T
agauaguaagauuauauaauau

SEQ ID NO: 1938097 - RNA, 20 nt, Shigella flexneri 2a str. 2457T
agauaguugauuaauuucau

SEQ ID NO: 1938098 - RNA, 23 nt, Shigella flexneri 2a str. 2457T
agauaucccgccagcaccagcaa

SEQ ID NO: 1938099 - RNA, 14 nt, Shigella flexneri 2a str. 2457T
agauauuucaccag

SEQ ID NO: 1938100 - RNA, 16 nt, Shigella flexneri 2a str. 2457T
agaguuuuaaacgcag

SEQ ID NO: 1938101 - RNA, 18 nt, Shigella flexneri 2a str. 2457T
agagugacgucauagcag

SEQ ID NO: 1938102 - RNA, 15 nt, Shigella flexneri 2a str. 2457T
agaguugcaccagca

SEQ ID NO: 1938103 - RNA, 15 nt, Shigella flexneri 2a str. 2457T
agauaccccagcgca

SEQ ID NO: 1938104 - RNA, 13 nt, Shigella flexneri 2a str. 2457T
agauaccuucuug

SEQ ID NO: 1938105 - RNA, 21 nt, Shigella flexneri 2a str. 2457T
agauacccggauacaacucgc

SEQ ID NO: 1938106 - RNA, 22 nt, Shigella flexneri 2a str. 2457T
agauagccagguuuaccagcag

SEQ ID NO: 1938107 - RNA, 19 nt, Shigella flexneri 2a str. 2457T
agauagccagguuuaccag

SEQ ID NO: 1938108 - RNA, 20 nt, Shigella flexneri 2a str. 2457T
agauagaggucauuaggcca

SEQ ID NO: 1938109 - RNA, 20 nt, Shigella flexneri 2a str. 2457T
agauagcacgacguuucuuu

SEQ ID NO: 1938110 - RNA, 17 nt, Shigella flexneri 2a str. 2457T
agauagcaacagcagcc

SEQ ID NO: 1938111 - RNA, 21 nt, Shigella flexneri 2a str. 2457T
agauagcguucuuuaacugcc

SEQ ID NO: 1938112 - RNA, 15 nt, Shigella flexneri 2a str. 2457T
agauagcugucccag

SEQ ID NO: 1938113 - RNA, 14 nt, Shigella flexneri 2a str. 2457T
agauagaacugcau

SEQ ID NO: 1938114 - RNA, 16 nt, Shigella flexneri 2a str. 2457T
agauacugaugaacgc

SEQ ID NO: 1938115 - RNA, 19 nt, Shigella flexneri 2a str. 2457T
agauaccgccgccaugcuu

SEQ ID NO: 1938116 - RNA, 22 nt, Shigella flexneri 2a str. 2457T
agauacgaccguuccauucaaa

SEQ ID NO: 1938117 - RNA, 19 nt, Shigella flexneri 2a str. 2457T
agauacgacugauaucugc

SEQ ID NO: 1938118 - RNA, 18 nt, Shigella flexneri 2a str. 2457T
agauacguuugccagugc

SEQ ID NO: 1938119 - RNA, 16 nt, Shigella flexneri 2a str. 2457T
agagaucauacagaug

SEQ ID NO: 1938120 - RNA, 13 nt, Shigella flexneri 2a str. 2457T
agagaucagauaa

SEQ ID NO: 1938121 - RNA, 18 nt, Shigella flexneri 2a str. 2457T
agagauaaacgaccacuc

SEQ ID NO: 1938122 - RNA, 14 nt, Shigella flexneri 2a str. 2457T
agagauaauaaaac

SEQ ID NO: 1938123 - RNA, 22 nt, Shigella flexneri 2a str. 2457T
agagaucgauguuuucugccuc

SEQ ID NO: 1938124 - RNA, 20 nt, Shigella flexneri 2a str. 2457T
agagaucuugagaaauuaac

SEQ ID NO: 1938125 - RNA, 15 nt, Shigella flexneri 2a str. 2457T
agagauguugaagaa

SEQ ID NO: 1938126 - RNA, 18 nt, Shigella flexneri 2a str. 2457T
agagauuacuuuauuuau

SEQ ID NO: 1938127 - RNA, 17 nt, Shigella flexneri 2a str. 2457T
agagauuugcuccagcg

SEQ ID NO: 1938128 - RNA, 19 nt, Shigella flexneri 2a str. 2457T
agagcaaauaaaacaucac

SEQ ID NO: 1938129 - RNA, 15 nt, Shigella flexneri 2a str. 2457T
agagcaaauaaaaca

SEQ ID NO: 1938130 - RNA, 20 nt, Shigella flexneri 2a str. 2457T
agagcaaauaaaacaucacc

SEQ ID NO: 1938131 - RNA, 13 nt, Shigella flexneri 2a str. 2457T
agagcaaccaccu

SEQ ID NO: 1938132 - RNA, 12 nt, Shigella flexneri 2a str. 2457T
agagcaaauaaa

SEQ ID NO: 1938133 - RNA, 13 nt, Shigella flexneri 2a str. 2457T
agagcaaauaaaa

SEQ ID NO: 1938134 - RNA, 19 nt, Shigella flexneri 2a str. 2457T
agagauuuuuccccaccuc

SEQ ID NO: 1938135 - RNA, 16 nt, Shigella flexneri 2a str. 2457T
agagagcgccagaagu

SEQ ID NO: 1938136 - RNA, 14 nt, Shigella flexneri 2a str. 2457T
agacucaaaccaau

SEQ ID NO: 1938137 - RNA, 12 nt, Shigella flexneri 2a str. 2457T
agacucaagcag

SEQ ID NO: 1938138 - RNA, 17 nt, Shigella flexneri 2a str. 2457T
agacuaaauuucacugc

SEQ ID NO: 1938139 - RNA, 15 nt, Shigella flexneri 2a str. 2457T
agagucgacacagau

SEQ ID NO: 1938140 - RNA, 20 nt, Shigella flexneri 2a str. 2457T
agagucaugcguuugagugg

SEQ ID NO: 1938141 - RNA, 20 nt, Shigella flexneri 2a str. 2457T
agagucggcgcugaaauucu

SEQ ID NO: 1938142 - RNA, 14 nt, Shigella flexneri 2a str. 2457T
agaggucuuuucuc

SEQ ID NO: 1938143 - RNA, 14 nt, Shigella flexneri 2a str. 2457T
agaguaguaauugc

SEQ ID NO: 1938144 - RNA, 17 nt, Shigella flexneri 2a str. 2457T
agaguauccaugcgcau

SEQ ID NO: 1938145 - RNA, 20 nt, Shigella flexneri 2a str. 2457T
agagcuggcgaacgugcagg

SEQ ID NO: 1938146 - RNA, 20 nt, Shigella flexneri 2a str. 2457T
agagcuggaaguuacucaaa

SEQ ID NO: 1938147 - RNA, 14 nt, Shigella flexneri 2a str. 2457T
agagcugauuuccg

SEQ ID NO: 1938148 - RNA, 14 nt, Shigella flexneri 2a str. 2457T
agaggggaaguuuu

SEQ ID NO: 1938149 - RNA, 17 nt, Shigella flexneri 2a str. 2457T
agagcuuucauuucaau

SEQ ID NO: 1938150 - RNA, 14 nt, Shigella flexneri 2a str. 2457T
agagcgagggagaa

SEQ ID NO: 1938151 - RNA, 14 nt, Shigella flexneri 2a str. 2457T
agagcaacccccuc

SEQ ID NO: 1938152 - RNA, 14 nt, Shigella flexneri 2a str. 2457T
agagcaaucaccag

SEQ ID NO: 1938153 - RNA, 18 nt, Shigella flexneri 2a str. 2457T
agagccugaauaaacgcc

SEQ ID NO: 1938154 - RNA, 10 nt, Shigella flexneri 2a str. 2457T
agagccugaa

SEQ ID NO: 1938155 - RNA, 22 nt, Shigella flexneri 2a str. 2457T
agagccugccaauggcaggcuc

SEQ ID NO: 1938156 - RNA, 22 nt, Shigella flexneri 2a str. 2457T
agaaaccgaugacgcauacgug

SEQ ID NO: 1938157 - RNA, 20 nt, Shigella flexneri 2a str. 2457T
agaaaccugauuacgcaccg

SEQ ID NO: 1938158 - RNA, 19 nt, Shigella flexneri 2a str. 2457T
agaaaauuuuagggaagua

SEQ ID NO: 1938159 - RNA, 17 nt, Shigella flexneri 2a str. 2457T
agaaacgccagcagcag

SEQ ID NO: 1938160 - RNA, 16 nt, Shigella flexneri 2a str. 2457T
agaaacgccaucugaa

SEQ ID NO: 1938161 - RNA, 18 nt, Shigella flexneri 2a str. 2457T
agaaacggaccugggaga

SEQ ID NO: 1938162 - RNA, 16 nt, Shigella flexneri 2a str. 2457T
agaaaaucgugccaga

SEQ ID NO: 1938163 - RNA, 17 nt, Shigella flexneri 2a str. 2457T
agaaaauuauuuuaaau

SEQ ID NO: 1938164 - RNA, 22 nt, Shigella flexneri 2a str. 2457T
agaaaaugcccauggcaagaau

SEQ ID NO: 1938165 - RNA, 18 nt, Shigella flexneri 2a str. 2457T
agaaaaucucaauguauu

SEQ ID NO: 1938166 - RNA, 17 nt, Shigella flexneri 2a str. 2457T
agaaaggcguuguccuu

SEQ ID NO: 1938167 - RNA, 11 nt, Shigella flexneri 2a str. 2457T
agaaaggggga

SEQ ID NO: 1938168 - RNA, 18 nt, Shigella flexneri 2a str. 2457T
agaaagccggaugaucau

SEQ ID NO: 1938169 - RNA, 17 nt, Shigella flexneri 2a str. 2457T
agaaagcgccagcaaga

SEQ ID NO: 1938170 - RNA, 12 nt, Shigella flexneri 2a str. 2457T
agaaagcccugg

SEQ ID NO: 1938171 - RNA, 15 nt, Shigella flexneri 2a str. 2457T
agaaagcccuggcgc

SEQ ID NO: 1938172 - RNA, 16 nt, Shigella flexneri 2a str. 2457T
agaaagcaaugaaauu

SEQ ID NO: 1938173 - RNA, 22 nt, Shigella flexneri 2a str. 2457T
acuuuuuccuuaaacaccuggc

SEQ ID NO: 1938174 - RNA, 14 nt, Shigella flexneri 2a str. 2457T
acuuuuguauuuua

SEQ ID NO: 1938175 - RNA, 15 nt, Shigella flexneri 2a str. 2457T
acuuuuuaacuuuaa

SEQ ID NO: 1938176 - RNA, 13 nt, Shigella flexneri 2a str. 2457T
acuuuugcccggc

SEQ ID NO: 1938177 - RNA, 17 nt, Shigella flexneri 2a str. 2457T
acuucgaguacauccac

SEQ ID NO: 1938178 - RNA, 18 nt, Shigella flexneri 2a str. 2457T
acuucgauguccgcucca

SEQ ID NO: 1938179 - RNA, 18 nt, Shigella flexneri 2a str. 2457T
acuucgauuucgccaccc

SEQ ID NO: 1938180 - RNA, 15 nt, Shigella flexneri 2a str. 2457T
acuucgccaacgccc

SEQ ID NO: 1938181 - RNA, 17 nt, Shigella flexneri 2a str. 2457T
acuucgccaucugccag

SEQ ID NO: 1938182 - RNA, 18 nt, Shigella flexneri 2a str. 2457T
acuuccuuuuuuauuuac

SEQ ID NO: 1938183 - RNA, 19 nt, Shigella flexneri 2a str. 2457T
agaacuaaaagauggcggc

SEQ ID NO: 1938184 - RNA, 16 nt, Shigella flexneri 2a str. 2457T
agaacguaaacgcagc

SEQ ID NO: 1938185 - RNA, 14 nt, Shigella flexneri 2a str. 2457T
agaacgugccggga

SEQ ID NO: 1938186 - RNA, 21 nt, Shigella flexneri 2a str. 2457T
agaacgugccgggaaaguggc

SEQ ID NO: 1938187 - RNA, 22 nt, Shigella flexneri 2a str. 2457T
agaacucguucagcgcauucca

SEQ ID NO: 1938188 - RNA, 14 nt, Shigella flexneri 2a str. 2457T
agaacucggaagca

SEQ ID NO: 1938189 - RNA, 18 nt, Shigella flexneri 2a str. 2457T
agaacuccugaaagcgaa

SEQ ID NO: 1938190 - RNA, 15 nt, Shigella flexneri 2a str. 2457T
agaacugcgccagac

SEQ ID NO: 1938191 - RNA, 17 nt, Shigella flexneri 2a str. 2457T
agaacuguagacaaaau

SEQ ID NO: 1938192 - RNA, 19 nt, Shigella flexneri 2a str. 2457T
agaacuguagacaaaaugu

SEQ ID NO: 1938193 - RNA, 20 nt, Shigella flexneri 2a str. 2457T
agaacugcaacucaccuuua

SEQ ID NO: 1938194 - RNA, 15 nt, Shigella flexneri 2a str. 2457T
agaacugcuggaagc

SEQ ID NO: 1938195 - RNA, 13 nt, Shigella flexneri 2a str. 2457T
agaaccuuccaug

SEQ ID NO: 1938196 - RNA, 18 nt, Shigella flexneri 2a str. 2457T
agaacgaccaucagcugc

SEQ ID NO: 1938197 - RNA, 22 nt, Shigella flexneri 2a str. 2457T
agaacggcgcaccagaauaccu

SEQ ID NO: 1938198 - RNA, 17 nt, Shigella flexneri 2a str. 2457T
agaacggauucagugag

SEQ ID NO: 1938199 - RNA, 21 nt, Shigella flexneri 2a str. 2457T
agaaaguauauaaaaaacaau

SEQ ID NO: 1938200 - RNA, 23 nt, Shigella flexneri 2a str. 2457T
agaaaguauauaaaaaacaauau

SEQ ID NO: 1938201 - RNA, 21 nt, Shigella flexneri 2a str. 2457T
agaaauugucuccaccaauga

SEQ ID NO: 1938202 - RNA, 17 nt, Shigella flexneri 2a str. 2457T
agaaauuuggcuccucu

SEQ ID NO: 1938203 - RNA, 17 nt, Shigella flexneri 2a str. 2457T
agaacaaauaaauagau

SEQ ID NO: 1938204 - RNA, 20 nt, Shigella flexneri 2a str. 2457T
agaacaacccggcgaaagag

SEQ ID NO: 1938205 - RNA, 17 nt, Shigella flexneri 2a str. 2457T
agaacaccaccugccag

SEQ ID NO: 1938206 - RNA, 12 nt, Shigella flexneri 2a str. 2457T
agaacaccaccu

SEQ ID NO: 1938207 - RNA, 17 nt, Shigella flexneri 2a str. 2457T
agaacaaggcuuuaaua

SEQ ID NO: 1938208 - RNA, 11 nt, Shigella flexneri 2a str. 2457T
agaaccaugca

SEQ ID NO: 1938209 - RNA, 21 nt, Shigella flexneri 2a str. 2457T
agaaccaugcaauuaccgcca

SEQ ID NO: 1938210 - RNA, 23 nt, Shigella flexneri 2a str. 2457T
agaaccacggaauaaccagcgaa

SEQ ID NO: 1938211 - RNA, 13 nt, Shigella flexneri 2a str. 2457T
agaacagaacauc

SEQ ID NO: 1938212 - RNA, 19 nt, Shigella flexneri 2a str. 2457T
agaacacuguuaccgcugc

SEQ ID NO: 1938213 - RNA, 15 nt, Shigella flexneri 2a str. 2457T
agaacacgguaauga

SEQ ID NO: 1938214 - RNA, 19 nt, Shigella flexneri 2a str. 2457T
agaacaguucagcagcacu

SEQ ID NO: 1938215 - RNA, 16 nt, Shigella flexneri 2a str. 2457T
agaacaguucagcagc

SEQ ID NO: 1938216 - RNA, 17 nt, Shigella flexneri 2a str. 2457T
agaacagcggugcaaga

SEQ ID NO: 1938217 - RNA, 13 nt, Shigella flexneri 2a str. 2457T
agacagaaucagg

SEQ ID NO: 1938218 - RNA, 17 nt, Shigella flexneri 2a str. 2457T
agacagacagccucaag

SEQ ID NO: 1938219 - RNA, 14 nt, Shigella flexneri 2a str. 2457T
agacaguucuuccu

SEQ ID NO: 1938220 - RNA, 15 nt, Shigella flexneri 2a str. 2457T
agacagaccuggcgc

SEQ ID NO: 1938221 - RNA, 21 nt, Shigella flexneri 2a str. 2457T
agacauaaggaaacuccagcc

SEQ ID NO: 1938222 - RNA, 16 nt, Shigella flexneri 2a str. 2457T
agacaucaauaaacaa

SEQ ID NO: 1938223 - RNA, 17 nt, Shigella flexneri 2a str. 2457T
agaccacucauuuuuuc

SEQ ID NO: 1938224 - RNA, 22 nt, Shigella flexneri 2a str. 2457T
agaccagacugcuccuguauga

SEQ ID NO: 1938225 - RNA, 16 nt, Shigella flexneri 2a str. 2457T
agaccacuuuccucau

SEQ ID NO: 1938226 - RNA, 18 nt, Shigella flexneri 2a str. 2457T
agaccagaaacgccacca

SEQ ID NO: 1938227 - RNA, 19 nt, Shigella flexneri 2a str. 2457T
agaccagauuaaucagcag

SEQ ID NO: 1938228 - RNA, 17 nt, Shigella flexneri 2a str. 2457T
agaauugauaaaaaaaa

SEQ ID NO: 1938229 - RNA, 23 nt, Shigella flexneri 2a str. 2457T
agaauuuccuucgcuuccuguau

SEQ ID NO: 1938230 - RNA, 15 nt, Shigella flexneri 2a str. 2457T
agacaauauaacugc

SEQ ID NO: 1938231 - RNA, 17 nt, Shigella flexneri 2a str. 2457T
agacaauauaacugcgg

SEQ ID NO: 1938232 - RNA, 12 nt, Shigella flexneri 2a str. 2457T
agacaacuuccc

SEQ ID NO: 1938233 - RNA, 18 nt, Shigella flexneri 2a str. 2457T
agacguuaacuacaauca

SEQ ID NO: 1938234 - RNA, 16 nt, Shigella flexneri 2a str. 2457T
agacguugauucacuu

SEQ ID NO: 1938235 - RNA, 12 nt, Shigella flexneri 2a str. 2457T
agacgguuuuuc

SEQ ID NO: 1938236 - RNA, 22 nt, Shigella flexneri 2a str. 2457T
agacgguuuaucucaucuucca

SEQ ID NO: 1938237 - RNA, 23 nt, Shigella flexneri 2a str. 2457T
agacgguuuaucucaucuuccac

SEQ ID NO: 1938238 - RNA, 16 nt, Shigella flexneri 2a str. 2457T
agacgguuaaaaacag

SEQ ID NO: 1938239 - RNA, 20 nt, Shigella flexneri 2a str. 2457T
agacgguuaaaaacagccag

SEQ ID NO: 1938240 - RNA, 22 nt, Shigella flexneri 2a str. 2457T
agacgguuaaaaacagccagca

SEQ ID NO: 1938241 - RNA, 17 nt, Shigella flexneri 2a str. 2457T
agacggcggaaagggcc

SEQ ID NO: 1938242 - RNA, 15 nt, Shigella flexneri 2a str. 2457T
agacgguacccgcug

SEQ ID NO: 1938243 - RNA, 15 nt, Shigella flexneri 2a str. 2457T
agacgaugaaaaaga

SEQ ID NO: 1938244 - RNA, 22 nt, Shigella flexneri 2a str. 2457T
agacgauaguaauuucaucugc

SEQ ID NO: 1938245 - RNA, 17 nt, Shigella flexneri 2a str. 2457T
agacgcacccucaaaau

SEQ ID NO: 1938246 - RNA, 22 nt, Shigella flexneri 2a str. 2457T
agacgcagcguuuauugucguu

SEQ ID NO: 1938247 - RNA, 14 nt, Shigella flexneri 2a str. 2457T
agacgcaacagaaa

SEQ ID NO: 1938248 - RNA, 17 nt, Shigella flexneri 2a str. 2457T
agacgaugcgucuugcc

SEQ ID NO: 1938249 - RNA, 22 nt, Shigella flexneri 2a str. 2457T
agacgauuacucgccuuucaca

SEQ ID NO: 1938250 - RNA, 23 nt, Shigella flexneri 2a str. 2457T
agacgauuacucgccuuucacac

SEQ ID NO: 1938251 - RNA, 17 nt, Shigella flexneri 2a str. 2457T
agaccuggcgcuucacu

SEQ ID NO: 1938252 - RNA, 21 nt, Shigella flexneri 2a str. 2457T
agacgacggaagaucguugcc

SEQ ID NO: 1938253 - RNA, 13 nt, Shigella flexneri 2a str. 2457T
agacgagagugac

SEQ ID NO: 1938254 - RNA, 16 nt, Shigella flexneri 2a str. 2457T
agacgagggaaaauaa

SEQ ID NO: 1938255 - RNA, 18 nt, Shigella flexneri 2a str. 2457T
agaccguugcucagaauc

SEQ ID NO: 1938256 - RNA, 23 nt, Shigella flexneri 2a str. 2457T
agacccaguuucggcaucagcag

SEQ ID NO: 1938257 - RNA, 14 nt, Shigella flexneri 2a str. 2457T
agaccuaccaucuc

SEQ ID NO: 1938258 - RNA, 19 nt, Shigella flexneri 2a str. 2457T
agaccaguaaagugcgcuu

SEQ ID NO: 1938259 - RNA, 20 nt, Shigella flexneri 2a str. 2457T
agaccaguaaagugcgcuuu

SEQ ID NO: 1938260 - RNA, 22 nt, Shigella flexneri 2a str. 2457T
agaccaucaauuggaucugaug

SEQ ID NO: 1938261 - RNA, 21 nt, Shigella flexneri 2a str. 2457T
agacccaguuucggcaucagc

SEQ ID NO: 1938262 - RNA, 16 nt, Shigella flexneri 2a str. 2457T
agaccguugcucagaa

SEQ ID NO: 1938263 - RNA, 21 nt, Shigella flexneri 2a str. 2457T
agaccauuugaucgcuggcag

SEQ ID NO: 1938264 - RNA, 16 nt, Shigella flexneri 2a str. 2457T
agaaucaaucccauca

SEQ ID NO: 1938265 - RNA, 19 nt, Shigella flexneri 2a str. 2457T
agaaucaaucccaucaggc

SEQ ID NO: 1938266 - RNA, 15 nt, Shigella flexneri 2a str. 2457T
agaaucaaucucagc

SEQ ID NO: 1938267 - RNA, 19 nt, Shigella flexneri 2a str. 2457T
agaaucaaucucagcgaug

SEQ ID NO: 1938268 - RNA, 17 nt, Shigella flexneri 2a str. 2457T
agaaucguaaagaucug

SEQ ID NO: 1938269 - RNA, 17 nt, Shigella flexneri 2a str. 2457T
agaaucgggaaauaaca

SEQ ID NO: 1938270 - RNA, 15 nt, Shigella flexneri 2a str. 2457T
agaauauguauuacc

SEQ ID NO: 1938271 - RNA, 14 nt, Shigella flexneri 2a str. 2457T
agaaucaagucuau

SEQ ID NO: 1938272 - RNA, 13 nt, Shigella flexneri 2a str. 2457T
agaauauuugauu

SEQ ID NO: 1938273 - RNA, 15 nt, Shigella flexneri 2a str. 2457T
agaauauugugcuca

SEQ ID NO: 1938274 - RNA, 19 nt, Shigella flexneri 2a str. 2457T
agaauggcaucagaaggag

SEQ ID NO: 1938275 - RNA, 17 nt, Shigella flexneri 2a str. 2457T
agaauggcaucagaagg

SEQ ID NO: 1938276 - RNA, 18 nt, Shigella flexneri 2a str. 2457T
agaauggcaucagaagga

SEQ ID NO: 1938277 - RNA, 15 nt, Shigella flexneri 2a str. 2457T
agaauggcuguaggg

SEQ ID NO: 1938278 - RNA, 16 nt, Shigella flexneri 2a str. 2457T
agaauucacgcacuuc

SEQ ID NO: 1938279 - RNA, 19 nt, Shigella flexneri 2a str. 2457T
agaaugguaacaccagagu

SEQ ID NO: 1938280 - RNA, 21 nt, Shigella flexneri 2a str. 2457T
agaaugcgggcgaaaacaucg

SEQ ID NO: 1938281 - RNA, 21 nt, Shigella flexneri 2a str. 2457T
agaauggacaccagcucagug

SEQ ID NO: 1938282 - RNA, 17 nt, Shigella flexneri 2a str. 2457T
agaaugcucgcuggcag

SEQ ID NO: 1938283 - RNA, 14 nt, Shigella flexneri 2a str. 2457T
agaaucucugacag

SEQ ID NO: 1938284 - RNA, 12 nt, Shigella flexneri 2a str. 2457T
agaagcuggcga

SEQ ID NO: 1938285 - RNA, 14 nt, Shigella flexneri 2a str. 2457T
agaaggaaaauaca

SEQ ID NO: 1938286 - RNA, 16 nt, Shigella flexneri 2a str. 2457T
agaagcguaaauccca

SEQ ID NO: 1938287 - RNA, 20 nt, Shigella flexneri 2a str. 2457T
agaagcguaauauccaggcc

SEQ ID NO: 1938288 - RNA, 19 nt, Shigella flexneri 2a str. 2457T
agaagcugcaggaccauac

SEQ ID NO: 1938289 - RNA, 23 nt, Shigella flexneri 2a str. 2457T
agaagcugcugccgcuguugcgu

SEQ ID NO: 1938290 - RNA, 19 nt, Shigella flexneri 2a str. 2457T
agaaguauucuuuuaaugg

SEQ ID NO: 1938291 - RNA, 23 nt, Shigella flexneri 2a str. 2457T
agaauaccugccugucacgcagg

SEQ ID NO: 1938292 - RNA, 23 nt, Shigella flexneri 2a str. 2457T
agaagucgcaaugaguauuacuu

SEQ ID NO: 1938293 - RNA, 14 nt, Shigella flexneri 2a str. 2457T
agaacuucugcaac

SEQ ID NO: 1938294 - RNA, 22 nt, Shigella flexneri 2a str. 2457T
agaacuugacucgccugaaagu

SEQ ID NO: 1938295 - RNA, 20 nt, Shigella flexneri 2a str. 2457T
agaagauuuuuugccagcac

SEQ ID NO: 1938296 - RNA, 19 nt, Shigella flexneri 2a str. 2457T
agaagcacguucaucccac

SEQ ID NO: 1938297 - RNA, 13 nt, Shigella flexneri 2a str. 2457T
agaagcagcaaca

SEQ ID NO: 1938298 - RNA, 22 nt, Shigella flexneri 2a str. 2457T
agaagcagcaacacaaucagac

SEQ ID NO: 1938299 - RNA, 22 nt, Shigella flexneri 2a str. 2457T
agaagcaccguugcccggagca

SEQ ID NO: 1938300 - RNA, 15 nt, Shigella flexneri 2a str. 2457T
acagguaaggcgcga

SEQ ID NO: 1938301 - RNA, 17 nt, Shigella flexneri 2a str. 2457T
acagggcucuuaagcac

SEQ ID NO: 1938302 - RNA, 19 nt, Shigella flexneri 2a str. 2457T
acaggggaugcuaugaaca

SEQ ID NO: 1938303 - RNA, 18 nt, Shigella flexneri 2a str. 2457T
acaggcugguuucucuuc

SEQ ID NO: 1938304 - RNA, 13 nt, Shigella flexneri 2a str. 2457T
acagggaaagaag

SEQ ID NO: 1938305 - RNA, 21 nt, Shigella flexneri 2a str. 2457T
acaggcuuuccugauaaucca

SEQ ID NO: 1938306 - RNA, 21 nt, Shigella flexneri 2a str. 2457T
acaggcggguaaucuuuccag

SEQ ID NO: 1938307 - RNA, 21 nt, Shigella flexneri 2a str. 2457T
acaguaucaucauuauuaaua

SEQ ID NO: 1938308 - RNA, 23 nt, Shigella flexneri 2a str. 2457T
acaguauuaucugggcugccuga

SEQ ID NO: 1938309 - RNA, 21 nt, Shigella flexneri 2a str. 2457T
acaguauagcaucauaagacu

SEQ ID NO: 1938310 - RNA, 15 nt, Shigella flexneri 2a str. 2457T
acaguacugggauuc

SEQ ID NO: 1938311 - RNA, 16 nt, Shigella flexneri 2a str. 2457T
acaguacaauaugaau

SEQ ID NO: 1938312 - RNA, 16 nt, Shigella flexneri 2a str. 2457T
acagguuuaaacagag

SEQ ID NO: 1938313 - RNA, 20 nt, Shigella flexneri 2a str. 2457T
acagguuuaaacagagauua

SEQ ID NO: 1938314 - RNA, 12 nt, Shigella flexneri 2a str. 2457T
acaguaaaguuu

SEQ ID NO: 1938315 - RNA, 23 nt, Shigella flexneri 2a str. 2457T
acagguugccgaugauucccagu

SEQ ID NO: 1938316 - RNA, 19 nt, Shigella flexneri 2a str. 2457T
acagguggcguuugccacc

SEQ ID NO: 1938317 - RNA, 16 nt, Shigella flexneri 2a str. 2457T
acaggugcuccagggu

SEQ ID NO: 1938318 - RNA, 15 nt, Shigella flexneri 2a str. 2457T
acaggugccggauuu

SEQ ID NO: 1938319 - RNA, 14 nt, Shigella flexneri 2a str. 2457T
acagugaaucucuu

SEQ ID NO: 1938320 - RNA, 15 nt, Shigella flexneri 2a str. 2457T
acagugacccgcagc

SEQ ID NO: 1938321 - RNA, 14 nt, Shigella flexneri 2a str. 2457T
acagugcaccggac

SEQ ID NO: 1938322 - RNA, 17 nt, Shigella flexneri 2a str. 2457T
acagugggauuaaaaag

SEQ ID NO: 1938323 - RNA, 16 nt, Shigella flexneri 2a str. 2457T
acaguucuucaaaaau

SEQ ID NO: 1938324 - RNA, 12 nt, Shigella flexneri 2a str. 2457T
acaguucuuccu

SEQ ID NO: 1938325 - RNA, 13 nt, Shigella flexneri 2a str. 2457T
acauaaccacuca

SEQ ID NO: 1938326 - RNA, 18 nt, Shigella flexneri 2a str. 2457T
acauaaccacucaccgcc

SEQ ID NO: 1938327 - RNA, 18 nt, Shigella flexneri 2a str. 2457T
acaucuaaccauuauuaa

SEQ ID NO: 1938328 - RNA, 17 nt, Shigella flexneri 2a str. 2457T
acaucgcuaccgcgcag

SEQ ID NO: 1938329 - RNA, 23 nt, Shigella flexneri 2a str. 2457T
acaucgcugauuucaccaucuuc

SEQ ID NO: 1938330 - RNA, 21 nt, Shigella flexneri 2a str. 2457T
acaucguugacauuugcuuuu

SEQ ID NO: 1938331 - RNA, 14 nt, Shigella flexneri 2a str. 2457T
acaucgccagaaau

SEQ ID NO: 1938332 - RNA, 19 nt, Shigella flexneri 2a str. 2457T
acaucugucugauaaaaaa

SEQ ID NO: 1938333 - RNA, 20 nt, Shigella flexneri 2a str. 2457T
acaucugucugauaaaaaac

SEQ ID NO: 1938334 - RNA, 16 nt, Shigella flexneri 2a str. 2457T
acaucuucaauccacg

SEQ ID NO: 1938335 - RNA, 14 nt, Shigella flexneri 2a str. 2457T
acaucuucaucauc

SEQ ID NO: 1938336 - RNA, 14 nt, Shigella flexneri 2a str. 2457T
acaugaagcacugc

SEQ ID NO: 1938337 - RNA, 15 nt, Shigella flexneri 2a str. 2457T
acaugagaacaguuc

SEQ ID NO: 1938338 - RNA, 19 nt, Shigella flexneri 2a str. 2457T
acaugagaacaguucagca

SEQ ID NO: 1938339 - RNA, 14 nt, Shigella flexneri 2a str. 2457T
acaugagagaaaau

SEQ ID NO: 1938340 - RNA, 17 nt, Shigella flexneri 2a str. 2457T
acaugagcgaauaaaaa

SEQ ID NO: 1938341 - RNA, 18 nt, Shigella flexneri 2a str. 2457T
acaugagcgaauaaaaaa

SEQ ID NO: 1938342 - RNA, 14 nt, Shigella flexneri 2a str. 2457T
acaugauaugccug

SEQ ID NO: 1938343 - RNA, 17 nt, Shigella flexneri 2a str. 2457T
acaugaugauggcuauc

SEQ ID NO: 1938344 - RNA, 14 nt, Shigella flexneri 2a str. 2457T
acaugcagggcaaa

SEQ ID NO: 1938345 - RNA, 22 nt, Shigella flexneri 2a str. 2457T
acaugauguggugcaaggaaau

SEQ ID NO: 1938346 - RNA, 14 nt, Shigella flexneri 2a str. 2457T
acaugccacuggcc

SEQ ID NO: 1938347 - RNA, 17 nt, Shigella flexneri 2a str. 2457T
acaugccacuggcccca

SEQ ID NO: 1938348 - RNA, 23 nt, Shigella flexneri 2a str. 2457T
acaugcuggucacugacaccaua

SEQ ID NO: 1938349 - RNA, 22 nt, Shigella flexneri 2a str. 2457T
acaugcuucaggacuucuuugc

SEQ ID NO: 1938350 - RNA, 18 nt, Shigella flexneri 2a str. 2457T
acaucauuaguaccuucc

SEQ ID NO: 1938351 - RNA, 13 nt, Shigella flexneri 2a str. 2457T
acaucauuucaau

SEQ ID NO: 1938352 - RNA, 23 nt, Shigella flexneri 2a str. 2457T
acaucauuuuuucccauuaccau

SEQ ID NO: 1938353 - RNA, 16 nt, Shigella flexneri 2a str. 2457T
acaucauuuugguuac

SEQ ID NO: 1938354 - RNA, 18 nt, Shigella flexneri 2a str. 2457T
acauccacgccuuuuuuc

SEQ ID NO: 1938355 - RNA, 14 nt, Shigella flexneri 2a str. 2457T
acaucgcagcaaac

SEQ ID NO: 1938356 - RNA, 19 nt, Shigella flexneri 2a str. 2457T
acaucgacucaagcguugc

SEQ ID NO: 1938357 - RNA, 13 nt, Shigella flexneri 2a str. 2457T
acaucgauaaggu

SEQ ID NO: 1938358 - RNA, 22 nt, Shigella flexneri 2a str. 2457T
acaucagauaaucgccauccug

SEQ ID NO: 1938359 - RNA, 19 nt, Shigella flexneri 2a str. 2457T
acaucagccagaugcaccg

SEQ ID NO: 1938360 - RNA, 15 nt, Shigella flexneri 2a str. 2457T
acaucacugcaaaua

SEQ ID NO: 1938361 - RNA, 15 nt, Shigella flexneri 2a str. 2457T
acaucacuguuugac

SEQ ID NO: 1938362 - RNA, 19 nt, Shigella flexneri 2a str. 2457T
acaucacuccauccagcaa

SEQ ID NO: 1938363 - RNA, 20 nt, Shigella flexneri 2a str. 2457T
acaucacuccauccagcaac

SEQ ID NO: 1938364 - RNA, 22 nt, Shigella flexneri 2a str. 2457T
acauauuuuuguugaaauaaua

SEQ ID NO: 1938365 - RNA, 17 nt, Shigella flexneri 2a str. 2457T
acauacagaucgugcau

SEQ ID NO: 1938366 - RNA, 13 nt, Shigella flexneri 2a str. 2457T
acauaaucgaaaa

SEQ ID NO: 1938367 - RNA, 21 nt, Shigella flexneri 2a str. 2457T
acacuuuccaguuccggcauu

SEQ ID NO: 1938368 - RNA, 15 nt, Shigella flexneri 2a str. 2457T
acacuucuucugucg

SEQ ID NO: 1938369 - RNA, 22 nt, Shigella flexneri 2a str. 2457T
acacuuuaaugccacauuagau

SEQ ID NO: 1938370 - RNA, 19 nt, Shigella flexneri 2a str. 2457T
acacuucaauauuaaugcu

SEQ ID NO: 1938371 - RNA, 20 nt, Shigella flexneri 2a str. 2457T
acacuucacacacuuuuauu

SEQ ID NO: 1938372 - RNA, 18 nt, Shigella flexneri 2a str. 2457T
acacuucuucagccaguu

SEQ ID NO: 1938373 - RNA, 17 nt, Shigella flexneri 2a str. 2457T
acagaccaguaaagugc

SEQ ID NO: 1938374 - RNA, 12 nt, Shigella flexneri 2a str. 2457T
acagacaaacag

SEQ ID NO: 1938375 - RNA, 18 nt, Shigella flexneri 2a str. 2457T
acagacauaaagccugcu

SEQ ID NO: 1938376 - RNA, 15 nt, Shigella flexneri 2a str. 2457T
acagaauggcaucug

SEQ ID NO: 1938377 - RNA, 14 nt, Shigella flexneri 2a str. 2457T
acagaauguugcuu

SEQ ID NO: 1938378 - RNA, 19 nt, Shigella flexneri 2a str. 2457T
acagaaugcgggcgaaaac

SEQ ID NO: 1938379 - RNA, 13 nt, Shigella flexneri 2a str. 2457T
acacugcuuacag

SEQ ID NO: 1938380 - RNA, 18 nt, Shigella flexneri 2a str. 2457T
acacugcuuacaggcugg

SEQ ID NO: 1938381 - RNA, 18 nt, Shigella flexneri 2a str. 2457T
acacuguuaccgcugcug

SEQ ID NO: 1938382 - RNA, 19 nt, Shigella flexneri 2a str. 2457T
acacugggaugaaagugau

SEQ ID NO: 1938383 - RNA, 20 nt, Shigella flexneri 2a str. 2457T
acacugacgcgucuuaucug

SEQ ID NO: 1938384 - RNA, 17 nt, Shigella flexneri 2a str. 2457T
acacugauugauucaau

SEQ ID NO: 1938385 - RNA, 20 nt, Shigella flexneri 2a str. 2457T
acacugaauaaaaaugugca

SEQ ID NO: 1938386 - RNA, 20 nt, Shigella flexneri 2a str. 2457T
acacucuuccagucgccugc

SEQ ID NO: 1938387 - RNA, 18 nt, Shigella flexneri 2a str. 2457T
acacugacgcgucuuauc

SEQ ID NO: 1938388 - RNA, 18 nt, Shigella flexneri 2a str. 2457T
aauuucagcgccugauac

SEQ ID NO: 1938389 - RNA, 17 nt, Shigella flexneri 2a str. 2457T
aauuucagcggcacugu

SEQ ID NO: 1938390 - RNA, 17 nt, Shigella flexneri 2a str. 2457T
acacugaaccgaaaugg

SEQ ID NO: 1938391 - RNA, 18 nt, Shigella flexneri 2a str. 2457T
acagcacgccccggcugc

SEQ ID NO: 1938392 - RNA, 17 nt, Shigella flexneri 2a str. 2457T
acagcacggcagcaacg

SEQ ID NO: 1938393 - RNA, 20 nt, Shigella flexneri 2a str. 2457T
acagcacgaugaaucuguua

SEQ ID NO: 1938394 - RNA, 18 nt, Shigella flexneri 2a str. 2457T
acagccauccgucaucca

SEQ ID NO: 1938395 - RNA, 12 nt, Shigella flexneri 2a str. 2457T
acagccagccaa

SEQ ID NO: 1938396 - RNA, 16 nt, Shigella flexneri 2a str. 2457T
acagccagaagcccgg

SEQ ID NO: 1938397 - RNA, 18 nt, Shigella flexneri 2a str. 2457T
acagccagccagcaccag

SEQ ID NO: 1938398 - RNA, 22 nt, Shigella flexneri 2a str. 2457T
acagccagccagcaccaggcuu

SEQ ID NO: 1938399 - RNA, 19 nt, Shigella flexneri 2a str. 2457T
acagcagccacaccaauca

SEQ ID NO: 1938400 - RNA, 13 nt, Shigella flexneri 2a str. 2457T
acagcagcccuug

SEQ ID NO: 1938401 - RNA, 23 nt, Shigella flexneri 2a str. 2457T
acagccacagggugaucaccagu

SEQ ID NO: 1938402 - RNA, 18 nt, Shigella flexneri 2a str. 2457T
acagccagauuaaaagug

SEQ ID NO: 1938403 - RNA, 23 nt, Shigella flexneri 2a str. 2457T
acagccagauuaaaagugcuggg

SEQ ID NO: 1938404 - RNA, 22 nt, Shigella flexneri 2a str. 2457T
acagaugcgacggcaccacauu

SEQ ID NO: 1938405 - RNA, 22 nt, Shigella flexneri 2a str. 2457T
acagaucugccuguccggcaua

SEQ ID NO: 1938406 - RNA, 17 nt, Shigella flexneri 2a str. 2457T
acagagguuuuaugaua

SEQ ID NO: 1938407 - RNA, 16 nt, Shigella flexneri 2a str. 2457T
acagaggucuuuucuc

SEQ ID NO: 1938408 - RNA, 16 nt, Shigella flexneri 2a str. 2457T
acagagcgagggagaa

SEQ ID NO: 1938409 - RNA, 16 nt, Shigella flexneri 2a str. 2457T
acagagacgcacugcu

SEQ ID NO: 1938410 - RNA, 21 nt, Shigella flexneri 2a str. 2457T
acagagauuacuuuauuuaua

SEQ ID NO: 1938411 - RNA, 23 nt, Shigella flexneri 2a str. 2457T
acagagcacuguuacugucggca

SEQ ID NO: 1938412 - RNA, 18 nt, Shigella flexneri 2a str. 2457T
acagcacauuucagaaag

SEQ ID NO: 1938413 - RNA, 12 nt, Shigella flexneri 2a str. 2457T
acagauucaggc

SEQ ID NO: 1938414 - RNA, 13 nt, Shigella flexneri 2a str. 2457T
acaggcgaugcca

SEQ ID NO: 1938415 - RNA, 16 nt, Shigella flexneri 2a str. 2457T
acaggcgaucuucccg

SEQ ID NO: 1938416 - RNA, 13 nt, Shigella flexneri 2a str. 2457T
acaggcagcugcc

SEQ ID NO: 1938417 - RNA, 16 nt, Shigella flexneri 2a str. 2457T
acaggcagcuuagaaa

SEQ ID NO: 1938418 - RNA, 14 nt, Shigella flexneri 2a str. 2457T
acaggcagcaauca

SEQ ID NO: 1938419 - RNA, 22 nt, Shigella flexneri 2a str. 2457T
acaggauggcguucgcaacacc

SEQ ID NO: 1938420 - RNA, 21 nt, Shigella flexneri 2a str. 2457T
acaggauaauuagaggucagu

SEQ ID NO: 1938421 - RNA, 19 nt, Shigella flexneri 2a str. 2457T
acaggacgguaaagcaaca

SEQ ID NO: 1938422 - RNA, 19 nt, Shigella flexneri 2a str. 2457T
acaggacaucuugaauaug

SEQ ID NO: 1938423 - RNA, 14 nt, Shigella flexneri 2a str. 2457T
acagcuuuuuccug

SEQ ID NO: 1938424 - RNA, 20 nt, Shigella flexneri 2a str. 2457T
acagcuuuuacagccaaugc

SEQ ID NO: 1938425 - RNA, 22 nt, Shigella flexneri 2a str. 2457T
acagcucgguauggccuuucug

SEQ ID NO: 1938426 - RNA, 19 nt, Shigella flexneri 2a str. 2457T
acagcuaaucaucaucagu

SEQ ID NO: 1938427 - RNA, 19 nt, Shigella flexneri 2a str. 2457T
acagcuuagcgccuucuac

SEQ ID NO: 1938428 - RNA, 11 nt, Shigella flexneri 2a str. 2457T
acagcugggcg

SEQ ID NO: 1938429 - RNA, 14 nt, Shigella flexneri 2a str. 2457T
acagcggaguaauc

SEQ ID NO: 1938430 - RNA, 14 nt, Shigella flexneri 2a str. 2457T
acagcgcgcugaca

SEQ ID NO: 1938431 - RNA, 19 nt, Shigella flexneri 2a str. 2457T
acagcgcugcgaaaguacc

SEQ ID NO: 1938432 - RNA, 16 nt, Shigella flexneri 2a str. 2457T
acagcgccuuuucuuu

SEQ ID NO: 1938433 - RNA, 15 nt, Shigella flexneri 2a str. 2457T
acagcgcgccagcca

SEQ ID NO: 1938434 - RNA, 22 nt, Shigella flexneri 2a str. 2457T
acagcgcaaaacgcaggaucca

SEQ ID NO: 1938435 - RNA, 14 nt, Shigella flexneri 2a str. 2457T
acagcgccagaagg

SEQ ID NO: 1938436 - RNA, 15 nt, Shigella flexneri 2a str. 2457T
acagcgccagaaggg

SEQ ID NO: 1938437 - RNA, 17 nt, Shigella flexneri 2a str. 2457T
acagcgcaccagaaaca

SEQ ID NO: 1938438 - RNA, 23 nt, Shigella flexneri 2a str. 2457T
acagcgccagacaaaccacgccu

SEQ ID NO: 1938439 - RNA, 22 nt, Shigella flexneri 2a str. 2457T
acagcgcaccagaaacaauaag

SEQ ID NO: 1938440 - RNA, 14 nt, Shigella flexneri 2a str. 2457T
acagcgcccaacac

SEQ ID NO: 1938441 - RNA, 22 nt, Shigella flexneri 2a str. 2457T
acagcgggugcauuuucacuuc

SEQ ID NO: 1938442 - RNA, 17 nt, Shigella flexneri 2a str. 2457T
acagcggccagccaucc

SEQ ID NO: 1938443 - RNA, 20 nt, Shigella flexneri 2a str. 2457T
acagcggcgaauguuccauc

SEQ ID NO: 1938444 - RNA, 15 nt, Shigella flexneri 2a str. 2457T
acagcguguuaaugc

SEQ ID NO: 1938445 - RNA, 16 nt, Shigella flexneri 2a str. 2457T
acagcgacguaaaaaa

SEQ ID NO: 1938446 - RNA, 14 nt, Shigella flexneri 2a str. 2457T
acagcgaccgcaga

SEQ ID NO: 1938447 - RNA, 23 nt, Shigella flexneri 2a str. 2457T
acagccuucggacguuugccaug

SEQ ID NO: 1938448 - RNA, 17 nt, Shigella flexneri 2a str. 2457T
acagcgacaccagccau

SEQ ID NO: 1938449 - RNA, 20 nt, Shigella flexneri 2a str. 2457T
acagccugauacaggaaggc

SEQ ID NO: 1938450 - RNA, 18 nt, Shigella flexneri 2a str. 2457T
acagccuuauugucuuua

SEQ ID NO: 1938451 - RNA, 21 nt, Shigella flexneri 2a str. 2457T
acagccgccagacaauugccg

SEQ ID NO: 1938452 - RNA, 13 nt, Shigella flexneri 2a str. 2457T
accauccaggaga

SEQ ID NO: 1938453 - RNA, 12 nt, Shigella flexneri 2a str. 2457T
accaucacuuuc

SEQ ID NO: 1938454 - RNA, 14 nt, Shigella flexneri 2a str. 2457T
accaucacuuucaa

SEQ ID NO: 1938455 - RNA, 20 nt, Shigella flexneri 2a str. 2457T
accaucacuuucaaaagccc

SEQ ID NO: 1938456 - RNA, 16 nt, Shigella flexneri 2a str. 2457T
accaucauaccgauca

SEQ ID NO: 1938457 - RNA, 14 nt, Shigella flexneri 2a str. 2457T
accaucauauuuuc

SEQ ID NO: 1938458 - RNA, 14 nt, Shigella flexneri 2a str. 2457T
accauuaucaaaca

SEQ ID NO: 1938459 - RNA, 14 nt, Shigella flexneri 2a str. 2457T
accauucaggcugg

SEQ ID NO: 1938460 - RNA, 16 nt, Shigella flexneri 2a str. 2457T
accauccauucagugc

SEQ ID NO: 1938461 - RNA, 11 nt, Shigella flexneri 2a str. 2457T
accauccauac

SEQ ID NO: 1938462 - RNA, 21 nt, Shigella flexneri 2a str. 2457T
accauuaaucgauaaaccagc

SEQ ID NO: 1938463 - RNA, 21 nt, Shigella flexneri 2a str. 2457T
accauuacuguauacgggcuu

SEQ ID NO: 1938464 - RNA, 20 nt, Shigella flexneri 2a str. 2457T
accauugcugccgccaguuc

SEQ ID NO: 1938465 - RNA, 21 nt, Shigella flexneri 2a str. 2457T
accauugcugccgccaguucu

SEQ ID NO: 1938466 - RNA, 17 nt, Shigella flexneri 2a str. 2457T
accauugcugccgccag

SEQ ID NO: 1938467 - RNA, 15 nt, Shigella flexneri 2a str. 2457T
accauugauaaucca

SEQ ID NO: 1938468 - RNA, 22 nt, Shigella flexneri 2a str. 2457T
accauugaggauugcgccuuua

SEQ ID NO: 1938469 - RNA, 12 nt, Shigella flexneri 2a str. 2457T
acccacaccccc

SEQ ID NO: 1938470 - RNA, 14 nt, Shigella flexneri 2a str. 2457T
acccacacuucaau

SEQ ID NO: 1938471 - RNA, 16 nt, Shigella flexneri 2a str. 2457T
acccacauguugcgcu

SEQ ID NO: 1938472 - RNA, 13 nt, Shigella flexneri 2a str. 2457T
acccacuuccccu

SEQ ID NO: 1938473 - RNA, 12 nt, Shigella flexneri 2a str. 2457T
acccagaacuau

SEQ ID NO: 1938474 - RNA, 11 nt, Shigella flexneri 2a str. 2457T
acccaauccag

SEQ ID NO: 1938475 - RNA, 14 nt, Shigella flexneri 2a str. 2457T
acccagcaccagua

SEQ ID NO: 1938476 - RNA, 16 nt, Shigella flexneri 2a str. 2457T
acccagccagacgcca

SEQ ID NO: 1938477 - RNA, 21 nt, Shigella flexneri 2a str. 2457T
acccagcagguccccgagcac

SEQ ID NO: 1938478 - RNA, 23 nt, Shigella flexneri 2a str. 2457T
acccagcagguccccgagcacau

SEQ ID NO: 1938479 - RNA, 13 nt, Shigella flexneri 2a str. 2457T
acccagcagcagc

SEQ ID NO: 1938480 - RNA, 20 nt, Shigella flexneri 2a str. 2457T
acccagcguguugaggaagc

SEQ ID NO: 1938481 - RNA, 20 nt, Shigella flexneri 2a str. 2457T
accccacgauguauccggca

SEQ ID NO: 1938482 - RNA, 20 nt, Shigella flexneri 2a str. 2457T
accccaauguagccgcacgc

SEQ ID NO: 1938483 - RNA, 16 nt, Shigella flexneri 2a str. 2457T
accccaggcugugcgc

SEQ ID NO: 1938484 - RNA, 23 nt, Shigella flexneri 2a str. 2457T
accccagguuuucaacgugucuu

SEQ ID NO: 1938485 - RNA, 22 nt, Shigella flexneri 2a str. 2457T
accccagcgcaagggccgcagc

SEQ ID NO: 1938486 - RNA, 15 nt, Shigella flexneri 2a str. 2457T
accccauugaagaau

SEQ ID NO: 1938487 - RNA, 14 nt, Shigella flexneri 2a str. 2457T
acccccuccuuuua

SEQ ID NO: 1938488 - RNA, 13 nt, Shigella flexneri 2a str. 2457T
acccccgaacugg

SEQ ID NO: 1938489 - RNA, 22 nt, Shigella flexneri 2a str. 2457T
accagguugccuugucaucguc

SEQ ID NO: 1938490 - RNA, 14 nt, Shigella flexneri 2a str. 2457T
accaguaaaccaau

SEQ ID NO: 1938491 - RNA, 22 nt, Shigella flexneri 2a str. 2457T
accagggaaauaaucgggaaua

SEQ ID NO: 1938492 - RNA, 15 nt, Shigella flexneri 2a str. 2457T
accaggcguggauac

SEQ ID NO: 1938493 - RNA, 22 nt, Shigella flexneri 2a str. 2457T
accagcgaaaucaccgccacca

SEQ ID NO: 1938494 - RNA, 15 nt, Shigella flexneri 2a str. 2457T
accagccuucuucau

SEQ ID NO: 1938495 - RNA, 21 nt, Shigella flexneri 2a str. 2457T
accagcgaauggguaaaaccg

SEQ ID NO: 1938496 - RNA, 17 nt, Shigella flexneri 2a str. 2457T
accagcgcaauauguuu

SEQ ID NO: 1938497 - RNA, 19 nt, Shigella flexneri 2a str. 2457T
accagcgacaucaccgccg

SEQ ID NO: 1938498 - RNA, 19 nt, Shigella flexneri 2a str. 2457T
accaggcgaccguuuucac

SEQ ID NO: 1938499 - RNA, 15 nt, Shigella flexneri 2a str. 2457T
accaggccaucagca

SEQ ID NO: 1938500 - RNA, 16 nt, Shigella flexneri 2a str. 2457T
accauacagcagcaac

SEQ ID NO: 1938501 - RNA, 19 nt, Shigella flexneri 2a str. 2457T
accauaaccaauaacagga

SEQ ID NO: 1938502 - RNA, 14 nt, Shigella flexneri 2a str. 2457T
accauaaaucagau

SEQ ID NO: 1938503 - RNA, 18 nt, Shigella flexneri 2a str. 2457T
accauaaauauggugaaa

SEQ ID NO: 1938504 - RNA, 16 nt, Shigella flexneri 2a str. 2457T
accauauagcgcacau

SEQ ID NO: 1938505 - RNA, 19 nt, Shigella flexneri 2a str. 2457T
accauauagcgcacaugca

SEQ ID NO: 1938506 - RNA, 19 nt, Shigella flexneri 2a str. 2457T
accauaaucucaucagcgu

SEQ ID NO: 1938507 - RNA, 15 nt, Shigella flexneri 2a str. 2457T
accauagcaucccaa

SEQ ID NO: 1938508 - RNA, 18 nt, Shigella flexneri 2a str. 2457T
accauauguguuugugcc

SEQ ID NO: 1938509 - RNA, 20 nt, Shigella flexneri 2a str. 2457T
accauauaugauaauuauua

SEQ ID NO: 1938510 - RNA, 21 nt, Shigella flexneri 2a str. 2457T
accauauaugauaauuauuau

SEQ ID NO: 1938511 - RNA, 18 nt, Shigella flexneri 2a str. 2457T
accagugaauuucacuuc

SEQ ID NO: 1938512 - RNA, 20 nt, Shigella flexneri 2a str. 2457T
accagugaauuucacuucgc

SEQ ID NO: 1938513 - RNA, 20 nt, Shigella flexneri 2a str. 2457T
accagugcaggcaccagccc

SEQ ID NO: 1938514 - RNA, 20 nt, Shigella flexneri 2a str. 2457T
accaguccuacacacgccag

SEQ ID NO: 1938515 - RNA, 15 nt, Shigella flexneri 2a str. 2457T
accaguaaggcaucu

SEQ ID NO: 1938516 - RNA, 13 nt, Shigella flexneri 2a str. 2457T
accaguaccgccg

SEQ ID NO: 1938517 - RNA, 22 nt, Shigella flexneri 2a str. 2457T
accaguaccgccgccauaaaca

SEQ ID NO: 1938518 - RNA, 14 nt, Shigella flexneri 2a str. 2457T
accaguagcgucau

SEQ ID NO: 1938519 - RNA, 22 nt, Shigella flexneri 2a str. 2457T
accaguugguagguccagccgc

SEQ ID NO: 1938520 - RNA, 16 nt, Shigella flexneri 2a str. 2457T
accaguugcuccagca

SEQ ID NO: 1938521 - RNA, 17 nt, Shigella flexneri 2a str. 2457T
accacccauuuuaaugu

SEQ ID NO: 1938522 - RNA, 23 nt, Shigella flexneri 2a str. 2457T
accacccgcagcgaucugcaccu

SEQ ID NO: 1938523 - RNA, 13 nt, Shigella flexneri 2a str. 2457T
accaccaccgcag

SEQ ID NO: 1938524 - RNA, 16 nt, Shigella flexneri 2a str. 2457T
accaccaaugucgaaa

SEQ ID NO: 1938525 - RNA, 20 nt, Shigella flexneri 2a str. 2457T
accaccagacgcaacagaaa

SEQ ID NO: 1938526 - RNA, 13 nt, Shigella flexneri 2a str. 2457T
accaccggcacca

SEQ ID NO: 1938527 - RNA, 20 nt, Shigella flexneri 2a str. 2457T
accaccggauaaaggcggcc

SEQ ID NO: 1938528 - RNA, 17 nt, Shigella flexneri 2a str. 2457T
accaccggacgcacacg

SEQ ID NO: 1938529 - RNA, 21 nt, Shigella flexneri 2a str. 2457T
accaccgacgugguuaacgac

SEQ ID NO: 1938530 - RNA, 21 nt, Shigella flexneri 2a str. 2457T
accaccgaugaucaacagcau

SEQ ID NO: 1938531 - RNA, 21 nt, Shigella flexneri 2a str. 2457T
accaccgaugcacagcacgcu

SEQ ID NO: 1938532 - RNA, 18 nt, Shigella flexneri 2a str. 2457T
accaccgcaaucgccagu

SEQ ID NO: 1938533 - RNA, 20 nt, Shigella flexneri 2a str. 2457T
accacggaguugaccagcuc

SEQ ID NO: 1938534 - RNA, 16 nt, Shigella flexneri 2a str. 2457T
accacggcagcaacuu

SEQ ID NO: 1938535 - RNA, 17 nt, Shigella flexneri 2a str. 2457T
accacggccacagccag

SEQ ID NO: 1938536 - RNA, 14 nt, Shigella flexneri 2a str. 2457T
accacggaguugac

SEQ ID NO: 1938537 - RNA, 18 nt, Shigella flexneri 2a str. 2457T
accacgauauguucagga

SEQ ID NO: 1938538 - RNA, 15 nt, Shigella flexneri 2a str. 2457T
accacgaacgagguu

SEQ ID NO: 1938539 - RNA, 15 nt, Shigella flexneri 2a str. 2457T
accacgaagcaaugg

SEQ ID NO: 1938540 - RNA, 17 nt, Shigella flexneri 2a str. 2457T
accacgaagcaauggcg

SEQ ID NO: 1938541 - RNA, 14 nt, Shigella flexneri 2a str. 2457T
accagaaucaaucc

SEQ ID NO: 1938542 - RNA, 18 nt, Shigella flexneri 2a str. 2457T
accagaaucgccagcauc

SEQ ID NO: 1938543 - RNA, 16 nt, Shigella flexneri 2a str. 2457T
accagacggcguaauc

SEQ ID NO: 1938544 - RNA, 14 nt, Shigella flexneri 2a str. 2457T
accagacgcgggca

SEQ ID NO: 1938545 - RNA, 21 nt, Shigella flexneri 2a str. 2457T
accagacgcgcguccccugcc

SEQ ID NO: 1938546 - RNA, 21 nt, Shigella flexneri 2a str. 2457T
accagaccggcaaucgcgcca

SEQ ID NO: 1938547 - RNA, 23 nt, Shigella flexneri 2a str. 2457T
accagaccggcaaucgcgccaga

SEQ ID NO: 1938548 - RNA, 18 nt, Shigella flexneri 2a str. 2457T
accagacugugaaucaug

SEQ ID NO: 1938549 - RNA, 22 nt, Shigella flexneri 2a str. 2457T
accacugacacaggcagcaauc

SEQ ID NO: 1938550 - RNA, 14 nt, Shigella flexneri 2a str. 2457T
accacugcaaugac

SEQ ID NO: 1938551 - RNA, 19 nt, Shigella flexneri 2a str. 2457T
accacugccagauucucca

SEQ ID NO: 1938552 - RNA, 14 nt, Shigella flexneri 2a str. 2457T
accacugcgcauaa

SEQ ID NO: 1938553 - RNA, 20 nt, Shigella flexneri 2a str. 2457T
accacugcgcauaauccacu

SEQ ID NO: 1938554 - RNA, 16 nt, Shigella flexneri 2a str. 2457T
accagaaacaauaagu

SEQ ID NO: 1938555 - RNA, 19 nt, Shigella flexneri 2a str. 2457T
accagaaagggaagaacau

SEQ ID NO: 1938556 - RNA, 20 nt, Shigella flexneri 2a str. 2457T
accagagcugauacgggagg

SEQ ID NO: 1938557 - RNA, 18 nt, Shigella flexneri 2a str. 2457T
accagauaaucaccugcc

SEQ ID NO: 1938558 - RNA, 21 nt, Shigella flexneri 2a str. 2457T
accagaucuggcgauuauuuu

SEQ ID NO: 1938559 - RNA, 23 nt, Shigella flexneri 2a str. 2457T
accagaugcucuuuucugaagua

SEQ ID NO: 1938560 - RNA, 16 nt, Shigella flexneri 2a str. 2457T
accagauuauaagcca

SEQ ID NO: 1938561 - RNA, 16 nt, Shigella flexneri 2a str. 2457T
accagauuccucucau

SEQ ID NO: 1938562 - RNA, 22 nt, Shigella flexneri 2a str. 2457T
accagcgaaaguaacaccaucc

SEQ ID NO: 1938563 - RNA, 20 nt, Shigella flexneri 2a str. 2457T
accagcgaaaucaccgccac

SEQ ID NO: 1938564 - RNA, 15 nt, Shigella flexneri 2a str. 2457T
accagcaucaacaac

SEQ ID NO: 1938565 - RNA, 13 nt, Shigella flexneri 2a str. 2457T
accaacgaggaga

SEQ ID NO: 1938566 - RNA, 13 nt, Shigella flexneri 2a str. 2457T
accaacgcacaca

SEQ ID NO: 1938567 - RNA, 18 nt, Shigella flexneri 2a str. 2457T
accaacugauccugacaa

SEQ ID NO: 1938568 - RNA, 23 nt, Shigella flexneri 2a str. 2457T
accaacgcaccggcuuguugccc

SEQ ID NO: 1938569 - RNA, 22 nt, Shigella flexneri 2a str. 2457T
accacaaacucuuuuccggaac

SEQ ID NO: 1938570 - RNA, 17 nt, Shigella flexneri 2a str. 2457T
accaauuuugcauucac

SEQ ID NO: 1938571 - RNA, 21 nt, Shigella flexneri 2a str. 2457T
accaaucaccgccagcaaggc

SEQ ID NO: 1938572 - RNA, 14 nt, Shigella flexneri 2a str. 2457T
accaauccagccgg

SEQ ID NO: 1938573 - RNA, 23 nt, Shigella flexneri 2a str. 2457T
accaauagcccaugcaucggcca

SEQ ID NO: 1938574 - RNA, 20 nt, Shigella flexneri 2a str. 2457T
accaauauaauuccauucac

SEQ ID NO: 1938575 - RNA, 16 nt, Shigella flexneri 2a str. 2457T
accaauaucaaauaaa

SEQ ID NO: 1938576 - RNA, 20 nt, Shigella flexneri 2a str. 2457T
accaauaucaaauaaaaagg

SEQ ID NO: 1938577 - RNA, 14 nt, Shigella flexneri 2a str. 2457T
accaauauccugaa

SEQ ID NO: 1938578 - RNA, 15 nt, Shigella flexneri 2a str. 2457T
accaaucaccgccac

SEQ ID NO: 1938579 - RNA, 15 nt, Shigella flexneri 2a str. 2457T
accaaucaccgccag

SEQ ID NO: 1938580 - RNA, 22 nt, Shigella flexneri 2a str. 2457T
acauggugggcggguggaguau

SEQ ID NO: 1938581 - RNA, 20 nt, Shigella flexneri 2a str. 2457T
acauggacgcaacuuccccu

SEQ ID NO: 1938582 - RNA, 20 nt, Shigella flexneri 2a str. 2457T
acauuucagaaaguauauaa

SEQ ID NO: 1938583 - RNA, 12 nt, Shigella flexneri 2a str. 2457T
acauuuccagga

SEQ ID NO: 1938584 - RNA, 16 nt, Shigella flexneri 2a str. 2457T
accaaaaaaucaaugc

SEQ ID NO: 1938585 - RNA, 14 nt, Shigella flexneri 2a str. 2457T
accaaacugauuua

SEQ ID NO: 1938586 - RNA, 21 nt, Shigella flexneri 2a str. 2457T
accaaaggcgaguucaaucaa

SEQ ID NO: 1938587 - RNA, 19 nt, Shigella flexneri 2a str. 2457T
accaaauaaacgaaucugc

SEQ ID NO: 1938588 - RNA, 16 nt, Shigella flexneri 2a str. 2457T
accaaagccuuucacu

SEQ ID NO: 1938589 - RNA, 17 nt, Shigella flexneri 2a str. 2457T
accaaagccuuucacuu

SEQ ID NO: 1938590 - RNA, 15 nt, Shigella flexneri 2a str. 2457T
accaaagaaugacac

SEQ ID NO: 1938591 - RNA, 13 nt, Shigella flexneri 2a str. 2457T
accaaauacacgc

SEQ ID NO: 1938592 - RNA, 15 nt, Shigella flexneri 2a str. 2457T
acgauacagaagcac

SEQ ID NO: 1938593 - RNA, 13 nt, Shigella flexneri 2a str. 2457T
acgauaagcaccg

SEQ ID NO: 1938594 - RNA, 14 nt, Shigella flexneri 2a str. 2457T
acgauauuuuuccg

SEQ ID NO: 1938595 - RNA, 22 nt, Shigella flexneri 2a str. 2457T
acgaucaagauugauccccgcu

SEQ ID NO: 1938596 - RNA, 18 nt, Shigella flexneri 2a str. 2457T
acgaucgccugguaccag

SEQ ID NO: 1938597 - RNA, 16 nt, Shigella flexneri 2a str. 2457T
acgagcgcaaugaaaa

SEQ ID NO: 1938598 - RNA, 15 nt, Shigella flexneri 2a str. 2457T
acgaggggagaccuc

SEQ ID NO: 1938599 - RNA, 18 nt, Shigella flexneri 2a str. 2457T
acgaguggcggacgggug

SEQ ID NO: 1938600 - RNA, 18 nt, Shigella flexneri 2a str. 2457T
acgagucacaaacaucau

SEQ ID NO: 1938601 - RNA, 18 nt, Shigella flexneri 2a str. 2457T
acgauggcaauuuucacu

SEQ ID NO: 1938602 - RNA, 17 nt, Shigella flexneri 2a str. 2457T
acgauggcaauuuucac

SEQ ID NO: 1938603 - RNA, 19 nt, Shigella flexneri 2a str. 2457T
acgauggaaccguacagca

SEQ ID NO: 1938604 - RNA, 15 nt, Shigella flexneri 2a str. 2457T
acgauguucugagcg

SEQ ID NO: 1938605 - RNA, 15 nt, Shigella flexneri 2a str. 2457T
acgaugucaaucagg

SEQ ID NO: 1938606 - RNA, 19 nt, Shigella flexneri 2a str. 2457T
acgaucuucggcgucagaa

SEQ ID NO: 1938607 - RNA, 20 nt, Shigella flexneri 2a str. 2457T
acgaugaaagaaaaaacgau

SEQ ID NO: 1938608 - RNA, 15 nt, Shigella flexneri 2a str. 2457T
acgaucgcuuucaac

SEQ ID NO: 1938609 - RNA, 18 nt, Shigella flexneri 2a str. 2457T
acgauuuuuuuaauaaua

SEQ ID NO: 1938610 - RNA, 22 nt, Shigella flexneri 2a str. 2457T
acgcaaaaccucuuccagcaga

SEQ ID NO: 1938611 - RNA, 14 nt, Shigella flexneri 2a str. 2457T
acgcaaaauugccu

SEQ ID NO: 1938612 - RNA, 18 nt, Shigella flexneri 2a str. 2457T
acgcaaacaccagcgaau

SEQ ID NO: 1938613 - RNA, 18 nt, Shigella flexneri 2a str. 2457T
acgcaaccgcaaaugauu

SEQ ID NO: 1938614 - RNA, 13 nt, Shigella flexneri 2a str. 2457T
acgcaaccacaaa

SEQ ID NO: 1938615 - RNA, 22 nt, Shigella flexneri 2a str. 2457T
acgcaacaugucagcaaucacc

SEQ ID NO: 1938616 - RNA, 12 nt, Shigella flexneri 2a str. 2457T
acgcaaccacaa

SEQ ID NO: 1938617 - RNA, 22 nt, Shigella flexneri 2a str. 2457T
acgauuugcggcguauccggcu

SEQ ID NO: 1938618 - RNA, 22 nt, Shigella flexneri 2a str. 2457T
acgauuuggccgaagaggaacu

SEQ ID NO: 1938619 - RNA, 16 nt, Shigella flexneri 2a str. 2457T
acgauuaauuacacag

SEQ ID NO: 1938620 - RNA, 18 nt, Shigella flexneri 2a str. 2457T
acgauucggcaaucacca

SEQ ID NO: 1938621 - RNA, 16 nt, Shigella flexneri 2a str. 2457T
acgauucggcaaucac

SEQ ID NO: 1938622 - RNA, 23 nt, Shigella flexneri 2a str. 2457T
acgauucgcccgcagccaucacu

SEQ ID NO: 1938623 - RNA, 17 nt, Shigella flexneri 2a str. 2457T
acgaaucaaucgccccu

SEQ ID NO: 1938624 - RNA, 14 nt, Shigella flexneri 2a str. 2457T
acgaauaguuucag

SEQ ID NO: 1938625 - RNA, 14 nt, Shigella flexneri 2a str. 2457T
acgaauaaaacaga

SEQ ID NO: 1938626 - RNA, 20 nt, Shigella flexneri 2a str. 2457T
acgaauaaaacagaaaccga

SEQ ID NO: 1938627 - RNA, 16 nt, Shigella flexneri 2a str. 2457T
acgaauuccaagcaga

SEQ ID NO: 1938628 - RNA, 20 nt, Shigella flexneri 2a str. 2457T
acgacaacgcggcacagcaa

SEQ ID NO: 1938629 - RNA, 11 nt, Shigella flexneri 2a str. 2457T
acgacaaucuc

SEQ ID NO: 1938630 - RNA, 12 nt, Shigella flexneri 2a str. 2457T
acgacaccaucu

SEQ ID NO: 1938631 - RNA, 18 nt, Shigella flexneri 2a str. 2457T
acgacacucucuucaaca

SEQ ID NO: 1938632 - RNA, 22 nt, Shigella flexneri 2a str. 2457T
acgacaaggcaggcaucaauga

SEQ ID NO: 1938633 - RNA, 13 nt, Shigella flexneri 2a str. 2457T
acgaagauuuuac

SEQ ID NO: 1938634 - RNA, 14 nt, Shigella flexneri 2a str. 2457T
acgaaccgagcggu

SEQ ID NO: 1938635 - RNA, 18 nt, Shigella flexneri 2a str. 2457T
acgaaccauaaaaucaca

SEQ ID NO: 1938636 - RNA, 20 nt, Shigella flexneri 2a str. 2457T
acgacuggccgaaaaaggau

SEQ ID NO: 1938637 - RNA, 18 nt, Shigella flexneri 2a str. 2457T
acgacugccgcucaccug

SEQ ID NO: 1938638 - RNA, 17 nt, Shigella flexneri 2a str. 2457T
acgacugcgagcaaaau

SEQ ID NO: 1938639 - RNA, 13 nt, Shigella flexneri 2a str. 2457T
acgagaaaagcca

SEQ ID NO: 1938640 - RNA, 22 nt, Shigella flexneri 2a str. 2457T
acgagagccggaagaauuucau

SEQ ID NO: 1938641 - RNA, 20 nt, Shigella flexneri 2a str. 2457T
acgagauagcgaaguagaca

SEQ ID NO: 1938642 - RNA, 15 nt, Shigella flexneri 2a str. 2457T
acgacgguuuccacc

SEQ ID NO: 1938643 - RNA, 14 nt, Shigella flexneri 2a str. 2457T
acgaccaccuucaa

SEQ ID NO: 1938644 - RNA, 18 nt, Shigella flexneri 2a str. 2457T
acgaccaucagcugccag

SEQ ID NO: 1938645 - RNA, 14 nt, Shigella flexneri 2a str. 2457T
acgacgacaggcaa

SEQ ID NO: 1938646 - RNA, 16 nt, Shigella flexneri 2a str. 2457T
acgaaauugaggaugc

SEQ ID NO: 1938647 - RNA, 12 nt, Shigella flexneri 2a str. 2457T
acgaaaacgggc

SEQ ID NO: 1938648 - RNA, 13 nt, Shigella flexneri 2a str. 2457T
acgaaaacugcgc

SEQ ID NO: 1938649 - RNA, 19 nt, Shigella flexneri 2a str. 2457T
acgaaaccgggcaauuuaa

SEQ ID NO: 1938650 - RNA, 13 nt, Shigella flexneri 2a str. 2457T
accuuuaaacaga

SEQ ID NO: 1938651 - RNA, 21 nt, Shigella flexneri 2a str. 2457T
accuuugaacaaccagaaaga

SEQ ID NO: 1938652 - RNA, 21 nt, Shigella flexneri 2a str. 2457T
accuugcgccucaacccauuu

SEQ ID NO: 1938653 - RNA, 20 nt, Shigella flexneri 2a str. 2457T
accuugcuuauccucuguaa

SEQ ID NO: 1938654 - RNA, 15 nt, Shigella flexneri 2a str. 2457T
accuugcuuugcaac

SEQ ID NO: 1938655 - RNA, 13 nt, Shigella flexneri 2a str. 2457T
accuucuuccugc

SEQ ID NO: 1938656 - RNA, 18 nt, Shigella flexneri 2a str. 2457T
accuucuuccugcgccag

SEQ ID NO: 1938657 - RNA, 14 nt, Shigella flexneri 2a str. 2457T
accuucuucuuuca

SEQ ID NO: 1938658 - RNA, 20 nt, Shigella flexneri 2a str. 2457T
accuucacgcgcuccaggag

SEQ ID NO: 1938659 - RNA, 19 nt, Shigella flexneri 2a str. 2457T
accuucacagaaggccagg

SEQ ID NO: 1938660 - RNA, 15 nt, Shigella flexneri 2a str. 2457T
accuucauccagcau

SEQ ID NO: 1938661 - RNA, 21 nt, Shigella flexneri 2a str. 2457T
accuucgggugccuuuuuuau

SEQ ID NO: 1938662 - RNA, 16 nt, Shigella flexneri 2a str. 2457T
accuucgcggcacugg

SEQ ID NO: 1938663 - RNA, 13 nt, Shigella flexneri 2a str. 2457T
accuucgcggcac

SEQ ID NO: 1938664 - RNA, 22 nt, Shigella flexneri 2a str. 2457T
accuuccggcguaccuuugccu

SEQ ID NO: 1938665 - RNA, 14 nt, Shigella flexneri 2a str. 2457T
accuuccuuauuuc

SEQ ID NO: 1938666 - RNA, 19 nt, Shigella flexneri 2a str. 2457T
accuucgaaugccgcagca

SEQ ID NO: 1938667 - RNA, 16 nt, Shigella flexneri 2a str. 2457T
accuucuucagcaaua

SEQ ID NO: 1938668 - RNA, 19 nt, Shigella flexneri 2a str. 2457T
accuucugcgcccgcccgc

SEQ ID NO: 1938669 - RNA, 14 nt, Shigella flexneri 2a str. 2457T
accugccuuacaua

SEQ ID NO: 1938670 - RNA, 20 nt, Shigella flexneri 2a str. 2457T
accugcgccugcaccauugc

SEQ ID NO: 1938671 - RNA, 16 nt, Shigella flexneri 2a str. 2457T
accugcggugcagccg

SEQ ID NO: 1938672 - RNA, 17 nt, Shigella flexneri 2a str. 2457T
accugcgggaugguugg

SEQ ID NO: 1938673 - RNA, 21 nt, Shigella flexneri 2a str. 2457T
accugccagcgccgacagcag

SEQ ID NO: 1938674 - RNA, 13 nt, Shigella flexneri 2a str. 2457T
accugccagggag

SEQ ID NO: 1938675 - RNA, 22 nt, Shigella flexneri 2a str. 2457T
accugccagggagcgaaaaagc

SEQ ID NO: 1938676 - RNA, 19 nt, Shigella flexneri 2a str. 2457T
accugcccgguauccauca

SEQ ID NO: 1938677 - RNA, 22 nt, Shigella flexneri 2a str. 2457T
accugcacguuagcccuuugua

SEQ ID NO: 1938678 - RNA, 22 nt, Shigella flexneri 2a str. 2457T
accugcacaaauagccagcaga

SEQ ID NO: 1938679 - RNA, 14 nt, Shigella flexneri 2a str. 2457T
accuggcuugccgg

SEQ ID NO: 1938680 - RNA, 21 nt, Shigella flexneri 2a str. 2457T
accugggaaauccaacagacc

SEQ ID NO: 1938681 - RNA, 22 nt, Shigella flexneri 2a str. 2457T
accugggcaauggugaacugcc

SEQ ID NO: 1938682 - RNA, 17 nt, Shigella flexneri 2a str. 2457T
accuggcgcaguggaua

SEQ ID NO: 1938683 - RNA, 16 nt, Shigella flexneri 2a str. 2457T
accuggcgcuguucgg

SEQ ID NO: 1938684 - RNA, 16 nt, Shigella flexneri 2a str. 2457T
accuggcgcagcugcg

SEQ ID NO: 1938685 - RNA, 14 nt, Shigella flexneri 2a str. 2457T
accuggauugccug

SEQ ID NO: 1938686 - RNA, 23 nt, Shigella flexneri 2a str. 2457T
accuggaaggacucgaggagcug

SEQ ID NO: 1938687 - RNA, 22 nt, Shigella flexneri 2a str. 2457T
accugcuuaauaucccuuccuc

SEQ ID NO: 1938688 - RNA, 18 nt, Shigella flexneri 2a str. 2457T
accuggaaauuuugcuga

SEQ ID NO: 1938689 - RNA, 18 nt, Shigella flexneri 2a str. 2457T
accuggaaccaggcgcga

SEQ ID NO: 1938690 - RNA, 16 nt, Shigella flexneri 2a str. 2457T
accugcuuuguucagc

SEQ ID NO: 1938691 - RNA, 22 nt, Shigella flexneri 2a str. 2457T
accugcuggacgcgccaacaaa

SEQ ID NO: 1938692 - RNA, 18 nt, Shigella flexneri 2a str. 2457T
accugcuggaaaggccgc

SEQ ID NO: 1938693 - RNA, 21 nt, Shigella flexneri 2a str. 2457T
accugcugauuauccgcauca

SEQ ID NO: 1938694 - RNA, 23 nt, Shigella flexneri 2a str. 2457T
accugcguucagcaguucugcca

SEQ ID NO: 1938695 - RNA, 14 nt, Shigella flexneri 2a str. 2457T
accuguugaaauua

SEQ ID NO: 1938696 - RNA, 15 nt, Shigella flexneri 2a str. 2457T
accuguaccagcccg

SEQ ID NO: 1938697 - RNA, 19 nt, Shigella flexneri 2a str. 2457T
accuguccuguaggccuga

SEQ ID NO: 1938698 - RNA, 15 nt, Shigella flexneri 2a str. 2457T
accugugccagccau

SEQ ID NO: 1938699 - RNA, 16 nt, Shigella flexneri 2a str. 2457T
accugugacagcagcg

SEQ ID NO: 1938700 - RNA, 22 nt, Shigella flexneri 2a str. 2457T
accuguaguguguugcaauaca

SEQ ID NO: 1938701 - RNA, 14 nt, Shigella flexneri 2a str. 2457T
accuguaccagccc

SEQ ID NO: 1938702 - RNA, 16 nt, Shigella flexneri 2a str. 2457T
accugguccuucaucu

SEQ ID NO: 1938703 - RNA, 21 nt, Shigella flexneri 2a str. 2457T
accuuacggcacuccucuuca

SEQ ID NO: 1938704 - RNA, 15 nt, Shigella flexneri 2a str. 2457T
accuuacggucagua

SEQ ID NO: 1938705 - RNA, 14 nt, Shigella flexneri 2a str. 2457T
accuuaucaaucuc

SEQ ID NO: 1938706 - RNA, 21 nt, Shigella flexneri 2a str. 2457T
accuuaucaaucucagcaaga

SEQ ID NO: 1938707 - RNA, 14 nt, Shigella flexneri 2a str. 2457T
accuuaucgaagag

SEQ ID NO: 1938708 - RNA, 23 nt, Shigella flexneri 2a str. 2457T
accuucaacacuggcaaaaucaa

SEQ ID NO: 1938709 - RNA, 23 nt, Shigella flexneri 2a str. 2457T
accucuucggcagucacuuuuuu

SEQ ID NO: 1938710 - RNA, 20 nt, Shigella flexneri 2a str. 2457T
accucuuaaugcaggcagca

SEQ ID NO: 1938711 - RNA, 23 nt, Shigella flexneri 2a str. 2457T
accucuggcgaauagaaagcaag

SEQ ID NO: 1938712 - RNA, 17 nt, Shigella flexneri 2a str. 2457T
accucugcugcugcguu

SEQ ID NO: 1938713 - RNA, 23 nt, Shigella flexneri 2a str. 2457T
accucguccuguugaaaaaccag

SEQ ID NO: 1938714 - RNA, 13 nt, Shigella flexneri 2a str. 2457T
accugaauauuag

SEQ ID NO: 1938715 - RNA, 12 nt, Shigella flexneri 2a str. 2457T
accugaauauua

SEQ ID NO: 1938716 - RNA, 14 nt, Shigella flexneri 2a str. 2457T
accugaccagugaa

SEQ ID NO: 1938717 - RNA, 15 nt, Shigella flexneri 2a str. 2457T
accugaauuaauuua

SEQ ID NO: 1938718 - RNA, 13 nt, Shigella flexneri 2a str. 2457T
accugacaacaaa

SEQ ID NO: 1938719 - RNA, 22 nt, Shigella flexneri 2a str. 2457T
accucuuucgcacgaaccguaa

SEQ ID NO: 1938720 - RNA, 13 nt, Shigella flexneri 2a str. 2457T
accugauccaucg

SEQ ID NO: 1938721 - RNA, 15 nt, Shigella flexneri 2a str. 2457T
accugaucagcaauc

SEQ ID NO: 1938722 - RNA, 16 nt, Shigella flexneri 2a str. 2457T
accugauccagcucuu

SEQ ID NO: 1938723 - RNA, 15 nt, Shigella flexneri 2a str. 2457T
accugagucaucaac

SEQ ID NO: 1938724 - RNA, 18 nt, Shigella flexneri 2a str. 2457T
accugacuguuccagcac

SEQ ID NO: 1938725 - RNA, 19 nt, Shigella flexneri 2a str. 2457T
accugacuguuccagcacg

SEQ ID NO: 1938726 - RNA, 13 nt, Shigella flexneri 2a str. 2457T
accugagagugau

SEQ ID NO: 1938727 - RNA, 13 nt, Shigella flexneri 2a str. 2457T
accugacugugac

SEQ ID NO: 1938728 - RNA, 14 nt, Shigella flexneri 2a str. 2457T
accuccuucacagu

SEQ ID NO: 1938729 - RNA, 15 nt, Shigella flexneri 2a str. 2457T
accuccguuuuucug

SEQ ID NO: 1938730 - RNA, 22 nt, Shigella flexneri 2a str. 2457T
accuccagcgaaggaucacccc

SEQ ID NO: 1938731 - RNA, 20 nt, Shigella flexneri 2a str. 2457T
accuccagccugaugaugag

SEQ ID NO: 1938732 - RNA, 18 nt, Shigella flexneri 2a str. 2457T
accuccacgcccagcgca

SEQ ID NO: 1938733 - RNA, 17 nt, Shigella flexneri 2a str. 2457T
accucacuuucuggcag

SEQ ID NO: 1938734 - RNA, 12 nt, Shigella flexneri 2a str. 2457T
accucagcgaac

SEQ ID NO: 1938735 - RNA, 20 nt, Shigella flexneri 2a str. 2457T
accucagcgaacaggaccuu

SEQ ID NO: 1938736 - RNA, 13 nt, Shigella flexneri 2a str. 2457T
accucacugaaaa

SEQ ID NO: 1938737 - RNA, 22 nt, Shigella flexneri 2a str. 2457T
accucaucaccacagacaaaca

SEQ ID NO: 1938738 - RNA, 20 nt, Shigella flexneri 2a str. 2457T
accucauuaagaugcauuua

SEQ ID NO: 1938739 - RNA, 22 nt, Shigella flexneri 2a str. 2457T
accuaugcgugggccgcgucgg

SEQ ID NO: 1938740 - RNA, 19 nt, Shigella flexneri 2a str. 2457T
accuaaaaaguuauaaaua

SEQ ID NO: 1938741 - RNA, 19 nt, Shigella flexneri 2a str. 2457T
accguuucuuugccgagga

SEQ ID NO: 1938742 - RNA, 22 nt, Shigella flexneri 2a str. 2457T
accguuucuuugccgaggaaga

SEQ ID NO: 1938743 - RNA, 22 nt, Shigella flexneri 2a str. 2457T
accguucgccaggucagagagc

SEQ ID NO: 1938744 - RNA, 12 nt, Shigella flexneri 2a str. 2457T
accuaauuuuuu

SEQ ID NO: 1938745 - RNA, 22 nt, Shigella flexneri 2a str. 2457T
accuacuuuuuaauucaggaaa

SEQ ID NO: 1938746 - RNA, 19 nt, Shigella flexneri 2a str. 2457T
accuacgugcgcaauaacc

SEQ ID NO: 1938747 - RNA, 21 nt, Shigella flexneri 2a str. 2457T
accuacgcuuucgaugugaac

SEQ ID NO: 1938748 - RNA, 20 nt, Shigella flexneri 2a str. 2457T
accuagcacuguaaaccucu

SEQ ID NO: 1938749 - RNA, 20 nt, Shigella flexneri 2a str. 2457T
accgucaccccauugaagaa

SEQ ID NO: 1938750 - RNA, 13 nt, Shigella flexneri 2a str. 2457T
accguccucacug

SEQ ID NO: 1938751 - RNA, 14 nt, Shigella flexneri 2a str. 2457T
accguccucacugu

SEQ ID NO: 1938752 - RNA, 18 nt, Shigella flexneri 2a str. 2457T
accguauuuugguaauga

SEQ ID NO: 1938753 - RNA, 15 nt, Shigella flexneri 2a str. 2457T
accgucaaacacagc

SEQ ID NO: 1938754 - RNA, 23 nt, Shigella flexneri 2a str. 2457T
accguaguccauacccagcauca

SEQ ID NO: 1938755 - RNA, 15 nt, Shigella flexneri 2a str. 2457T
accguagacuuuagc

SEQ ID NO: 1938756 - RNA, 14 nt, Shigella flexneri 2a str. 2457T
accguaccggcacc

SEQ ID NO: 1938757 - RNA, 17 nt, Shigella flexneri 2a str. 2457T
accgugcauuucucacu

SEQ ID NO: 1938758 - RNA, 20 nt, Shigella flexneri 2a str. 2457T
accgugcgggcaucaucuuc

SEQ ID NO: 1938759 - RNA, 16 nt, Shigella flexneri 2a str. 2457T
accguggcguaaauca

SEQ ID NO: 1938760 - RNA, 16 nt, Shigella flexneri 2a str. 2457T
accgucugcgccgagg

SEQ ID NO: 1938761 - RNA, 14 nt, Shigella flexneri 2a str. 2457T
accgucgccuucau

SEQ ID NO: 1938762 - RNA, 16 nt, Shigella flexneri 2a str. 2457T
accgucuucccgcagc

SEQ ID NO: 1938763 - RNA, 23 nt, Shigella flexneri 2a str. 2457T
accgucugugugccugucgggac

SEQ ID NO: 1938764 - RNA, 13 nt, Shigella flexneri 2a str. 2457T
accguaccggcac

SEQ ID NO: 1938765 - RNA, 17 nt, Shigella flexneri 2a str. 2457T
accguacaaccaaaucu

SEQ ID NO: 1938766 - RNA, 23 nt, Shigella flexneri 2a str. 2457T
accgguucggggcuguuuuccag

SEQ ID NO: 1938767 - RNA, 22 nt, Shigella flexneri 2a str. 2457T
accgguucggggcuguuuucca

SEQ ID NO: 1938768 - RNA, 16 nt, Shigella flexneri 2a str. 2457T
accggggacaggcggc

SEQ ID NO: 1938769 - RNA, 14 nt, Shigella flexneri 2a str. 2457T
accgggcuguucac

SEQ ID NO: 1938770 - RNA, 17 nt, Shigella flexneri 2a str. 2457T
accgguacaaacaucau

SEQ ID NO: 1938771 - RNA, 21 nt, Shigella flexneri 2a str. 2457T
accgggcgcaaggugugggca

SEQ ID NO: 1938772 - RNA, 16 nt, Shigella flexneri 2a str. 2457T
accgggaagauccagg

SEQ ID NO: 1938773 - RNA, 20 nt, Shigella flexneri 2a str. 2457T
accggccguaagaaagucau

SEQ ID NO: 1938774 - RNA, 13 nt, Shigella flexneri 2a str. 2457T
accggcacccaau

SEQ ID NO: 1938775 - RNA, 17 nt, Shigella flexneri 2a str. 2457T
accggauuuuuuuuccg

SEQ ID NO: 1938776 - RNA, 14 nt, Shigella flexneri 2a str. 2457T
accggcaaucugcu

SEQ ID NO: 1938777 - RNA, 18 nt, Shigella flexneri 2a str. 2457T
accggauuuucaccaucg

SEQ ID NO: 1938778 - RNA, 20 nt, Shigella flexneri 2a str. 2457T
accggauuuccgaaaaaagc

SEQ ID NO: 1938779 - RNA, 17 nt, Shigella flexneri 2a str. 2457T
accgcuucauaggucag

SEQ ID NO: 1938780 - RNA, 13 nt, Shigella flexneri 2a str. 2457T
accgcaccaccag

SEQ ID NO: 1938781 - RNA, 12 nt, Shigella flexneri 2a str. 2457T
accgauucccag

SEQ ID NO: 1938782 - RNA, 15 nt, Shigella flexneri 2a str. 2457T
accgcacgcagaauc

SEQ ID NO: 1938783 - RNA, 14 nt, Shigella flexneri 2a str. 2457T
accgcaccaccagc

SEQ ID NO: 1938784 - RNA, 16 nt, Shigella flexneri 2a str. 2457T
accgcaccaccagcag

SEQ ID NO: 1938785 - RNA, 16 nt, Shigella flexneri 2a str. 2457T
accgccaaagauaaaa

SEQ ID NO: 1938786 - RNA, 18 nt, Shigella flexneri 2a str. 2457T
accgccaccaccgaugau

SEQ ID NO: 1938787 - RNA, 13 nt, Shigella flexneri 2a str. 2457T
accgccaccaccg

SEQ ID NO: 1938788 - RNA, 23 nt, Shigella flexneri 2a str. 2457T
accgaugaucgccaucagugcca

SEQ ID NO: 1938789 - RNA, 12 nt, Shigella flexneri 2a str. 2457T
accgauccggca

SEQ ID NO: 1938790 - RNA, 19 nt, Shigella flexneri 2a str. 2457T
accgauccggcaccaaugu

SEQ ID NO: 1938791 - RNA, 20 nt, Shigella flexneri 2a str. 2457T
accgauccugaaguggcguu

SEQ ID NO: 1938792 - RNA, 12 nt, Shigella flexneri 2a str. 2457T
accccugcggcc

SEQ ID NO: 1938793 - RNA, 16 nt, Shigella flexneri 2a str. 2457T
accccugcggccgguu

SEQ ID NO: 1938794 - RNA, 13 nt, Shigella flexneri 2a str. 2457T
accccugauuuug

SEQ ID NO: 1938795 - RNA, 17 nt, Shigella flexneri 2a str. 2457T
accccucuucagccccg

SEQ ID NO: 1938796 - RNA, 22 nt, Shigella flexneri 2a str. 2457T
accccgcacggugcaccgcauc

SEQ ID NO: 1938797 - RNA, 16 nt, Shigella flexneri 2a str. 2457T
accgccguugccuuua

SEQ ID NO: 1938798 - RNA, 14 nt, Shigella flexneri 2a str. 2457T
accgcccaccacca

SEQ ID NO: 1938799 - RNA, 14 nt, Shigella flexneri 2a str. 2457T
accgccugcgggga

SEQ ID NO: 1938800 - RNA, 13 nt, Shigella flexneri 2a str. 2457T
accgccuugcugu

SEQ ID NO: 1938801 - RNA, 14 nt, Shigella flexneri 2a str. 2457T
accgccuggcgcug

SEQ ID NO: 1938802 - RNA, 15 nt, Shigella flexneri 2a str. 2457T
accgcugacuuucaa

SEQ ID NO: 1938803 - RNA, 23 nt, Shigella flexneri 2a str. 2457T
accgcugacuuucaaacgccaca

SEQ ID NO: 1938804 - RNA, 22 nt, Shigella flexneri 2a str. 2457T
accgcugacggcagcgaagggu

SEQ ID NO: 1938805 - RNA, 21 nt, Shigella flexneri 2a str. 2457T
accgcugcuuaauuacugccu

SEQ ID NO: 1938806 - RNA, 17 nt, Shigella flexneri 2a str. 2457T
accgcuccgccaucuuc

SEQ ID NO: 1938807 - RNA, 14 nt, Shigella flexneri 2a str. 2457T
aacccaacguuacu

SEQ ID NO: 1938808 - RNA, 22 nt, Shigella flexneri 2a str. 2457T
aacccaacguucguacugcccu

SEQ ID NO: 1938809 - RNA, 17 nt, Shigella flexneri 2a str. 2457T
aacccaacggcaaacau

SEQ ID NO: 1938810 - RNA, 18 nt, Shigella flexneri 2a str. 2457T
aacccaucaagcgaaaau

SEQ ID NO: 1938811 - RNA, 22 nt, Shigella flexneri 2a str. 2457T
aacccagcggaugacccagcgc

SEQ ID NO: 1938812 - RNA, 15 nt, Shigella flexneri 2a str. 2457T
aaccaugucaucaau

SEQ ID NO: 1938813 - RNA, 23 nt, Shigella flexneri 2a str. 2457T
aaccaugacgcacuuucgcuuua

SEQ ID NO: 1938814 - RNA, 16 nt, Shigella flexneri 2a str. 2457T
aaccaucgcauacugc

SEQ ID NO: 1938815 - RNA, 15 nt, Shigella flexneri 2a str. 2457T
aaccauccuaaaaaa

SEQ ID NO: 1938816 - RNA, 19 nt, Shigella flexneri 2a str. 2457T
aaccauccuaaaaaagcau

SEQ ID NO: 1938817 - RNA, 17 nt, Shigella flexneri 2a str. 2457T
aaccaucgguacgcuuu

SEQ ID NO: 1938818 - RNA, 21 nt, Shigella flexneri 2a str. 2457T
aaccaucaggaugacaaacuu

SEQ ID NO: 1938819 - RNA, 13 nt, Shigella flexneri 2a str. 2457T
aaccauaaaauca

SEQ ID NO: 1938820 - RNA, 15 nt, Shigella flexneri 2a str. 2457T
aaccauaaaaucaca

SEQ ID NO: 1938821 - RNA, 15 nt, Shigella flexneri 2a str. 2457T
aaccaguaaugaucg

SEQ ID NO: 1938822 - RNA, 23 nt, Shigella flexneri 2a str. 2457T
aaccaguuacgugcugcgcagac

SEQ ID NO: 1938823 - RNA, 23 nt, Shigella flexneri 2a str. 2457T
aaccacggaguugaccagcucca

SEQ ID NO: 1938824 - RNA, 23 nt, Shigella flexneri 2a str. 2457T
aaccacggcagcaacuuaaucau

SEQ ID NO: 1938825 - RNA, 19 nt, Shigella flexneri 2a str. 2457T
aaccagaaagggaagaaca

SEQ ID NO: 1938826 - RNA, 20 nt, Shigella flexneri 2a str. 2457T
aaccagaaagggaagaacau

SEQ ID NO: 1938827 - RNA, 18 nt, Shigella flexneri 2a str. 2457T
aaccacguucauuucaua

SEQ ID NO: 1938828 - RNA, 12 nt, Shigella flexneri 2a str. 2457T
aaccacucacga

SEQ ID NO: 1938829 - RNA, 15 nt, Shigella flexneri 2a str. 2457T
aaccaccggcaccac

SEQ ID NO: 1938830 - RNA, 14 nt, Shigella flexneri 2a str. 2457T
aaccaccaguaaau

SEQ ID NO: 1938831 - RNA, 14 nt, Shigella flexneri 2a str. 2457T
aaccacccaccagc

SEQ ID NO: 1938832 - RNA, 14 nt, Shigella flexneri 2a str. 2457T
aaccaccaaacugc

SEQ ID NO: 1938833 - RNA, 15 nt, Shigella flexneri 2a str. 2457T
aaccacaaccacuuu

SEQ ID NO: 1938834 - RNA, 22 nt, Shigella flexneri 2a str. 2457T
aaccaauuaugaauaaccucuu

SEQ ID NO: 1938835 - RNA, 17 nt, Shigella flexneri 2a str. 2457T
aaccacaaaacacucuu

SEQ ID NO: 1938836 - RNA, 14 nt, Shigella flexneri 2a str. 2457T
aaccacaaugaaga

SEQ ID NO: 1938837 - RNA, 13 nt, Shigella flexneri 2a str. 2457T
aaccacaauguca

SEQ ID NO: 1938838 - RNA, 15 nt, Shigella flexneri 2a str. 2457T
aaccagagaauauua

SEQ ID NO: 1938839 - RNA, 17 nt, Shigella flexneri 2a str. 2457T
aaccagagacagaccaa

SEQ ID NO: 1938840 - RNA, 13 nt, Shigella flexneri 2a str. 2457T
aaccagagacaga

SEQ ID NO: 1938841 - RNA, 18 nt, Shigella flexneri 2a str. 2457T
aaccagcgcagacaccag

SEQ ID NO: 1938842 - RNA, 14 nt, Shigella flexneri 2a str. 2457T
aaccagcaggcugg

SEQ ID NO: 1938843 - RNA, 22 nt, Shigella flexneri 2a str. 2457T
aaccagcgcggcgauaaugccc

SEQ ID NO: 1938844 - RNA, 19 nt, Shigella flexneri 2a str. 2457T
aaccagggaaaaaagcccc

SEQ ID NO: 1938845 - RNA, 21 nt, Shigella flexneri 2a str. 2457T
aaccagcuuaugccuguccuc

SEQ ID NO: 1938846 - RNA, 23 nt, Shigella flexneri 2a str. 2457T
aaccguaguccauacccagcauc

SEQ ID NO: 1938847 - RNA, 16 nt, Shigella flexneri 2a str. 2457T
aaccguacgcaucacc

SEQ ID NO: 1938848 - RNA, 14 nt, Shigella flexneri 2a str. 2457T
aaccguacagcaug

SEQ ID NO: 1938849 - RNA, 14 nt, Shigella flexneri 2a str. 2457T
aaccgguaaagaag

SEQ ID NO: 1938850 - RNA, 14 nt, Shigella flexneri 2a str. 2457T
aaccgguaccggac

SEQ ID NO: 1938851 - RNA, 15 nt, Shigella flexneri 2a str. 2457T
aaccgguaaagaaga

SEQ ID NO: 1938852 - RNA, 16 nt, Shigella flexneri 2a str. 2457T
aaccgggugcagagcc

SEQ ID NO: 1938853 - RNA, 17 nt, Shigella flexneri 2a str. 2457T
aaccgggucgauaaaca

SEQ ID NO: 1938854 - RNA, 17 nt, Shigella flexneri 2a str. 2457T
aaccggacugaaaguac

SEQ ID NO: 1938855 - RNA, 13 nt, Shigella flexneri 2a str. 2457T
aaccggagucaga

SEQ ID NO: 1938856 - RNA, 13 nt, Shigella flexneri 2a str. 2457T
aaccgcuuuucca

SEQ ID NO: 1938857 - RNA, 14 nt, Shigella flexneri 2a str. 2457T
aaccgcuuuuucaa

SEQ ID NO: 1938858 - RNA, 19 nt, Shigella flexneri 2a str. 2457T
aaccggaaauccaggucag

SEQ ID NO: 1938859 - RNA, 18 nt, Shigella flexneri 2a str. 2457T
aaccggaucgccaaugaa

SEQ ID NO: 1938860 - RNA, 16 nt, Shigella flexneri 2a str. 2457T
aaccggcacuucaacu

SEQ ID NO: 1938861 - RNA, 20 nt, Shigella flexneri 2a str. 2457T
aaccgcccagaccugcguuc

SEQ ID NO: 1938862 - RNA, 22 nt, Shigella flexneri 2a str. 2457T
aaccgccaguaaucuggccaau

SEQ ID NO: 1938863 - RNA, 16 nt, Shigella flexneri 2a str. 2457T
aaccgccaucauggau

SEQ ID NO: 1938864 - RNA, 22 nt, Shigella flexneri 2a str. 2457T
aaccgcaguguaguucuggccu

SEQ ID NO: 1938865 - RNA, 17 nt, Shigella flexneri 2a str. 2457T
aaccgcauccagauucu

SEQ ID NO: 1938866 - RNA, 22 nt, Shigella flexneri 2a str. 2457T
aaccgcuguugucugaaugaua

SEQ ID NO: 1938867 - RNA, 17 nt, Shigella flexneri 2a str. 2457T
aaccgccucaggcaaca

SEQ ID NO: 1938868 - RNA, 21 nt, Shigella flexneri 2a str. 2457T
aaccgccugcgaguuuuaccu

SEQ ID NO: 1938869 - RNA, 14 nt, Shigella flexneri 2a str. 2457T
aaccgcgacuggga

SEQ ID NO: 1938870 - RNA, 15 nt, Shigella flexneri 2a str. 2457T
aaccgaaggcaccau

SEQ ID NO: 1938871 - RNA, 19 nt, Shigella flexneri 2a str. 2457T
aaccgaauucaaauccuuc

SEQ ID NO: 1938872 - RNA, 19 nt, Shigella flexneri 2a str. 2457T
aacccuuuuuuaaacauua

SEQ ID NO: 1938873 - RNA, 22 nt, Shigella flexneri 2a str. 2457T
aacccugauuucgugauuguug

SEQ ID NO: 1938874 - RNA, 14 nt, Shigella flexneri 2a str. 2457T
aaccgagcagauac

SEQ ID NO: 1938875 - RNA, 16 nt, Shigella flexneri 2a str. 2457T
aacccucuccccaagg

SEQ ID NO: 1938876 - RNA, 18 nt, Shigella flexneri 2a str. 2457T
aacccgcucauaauacag

SEQ ID NO: 1938877 - RNA, 15 nt, Shigella flexneri 2a str. 2457T
aacccuaccagcugc

SEQ ID NO: 1938878 - RNA, 18 nt, Shigella flexneri 2a str. 2457T
aacccuaccagcugccac

SEQ ID NO: 1938879 - RNA, 21 nt, Shigella flexneri 2a str. 2457T
aacccuugcguuucugacucu

SEQ ID NO: 1938880 - RNA, 19 nt, Shigella flexneri 2a str. 2457T
aacccugagcgguuaacac

SEQ ID NO: 1938881 - RNA, 11 nt, Shigella flexneri 2a str. 2457T
aacccugcaga

SEQ ID NO: 1938882 - RNA, 21 nt, Shigella flexneri 2a str. 2457T
aacccuucaagaauuaaaaua

SEQ ID NO: 1938883 - RNA, 21 nt, Shigella flexneri 2a str. 2457T
aaccccuuucuaugguuuuga

SEQ ID NO: 1938884 - RNA, 16 nt, Shigella flexneri 2a str. 2457T
aacccgaccacuucca

SEQ ID NO: 1938885 - RNA, 15 nt, Shigella flexneri 2a str. 2457T
aacccggucccuuca

SEQ ID NO: 1938886 - RNA, 23 nt, Shigella flexneri 2a str. 2457T
aacccggccugcucccgaaccuu

SEQ ID NO: 1938887 - RNA, 16 nt, Shigella flexneri 2a str. 2457T
aacccgcucaaacacc

SEQ ID NO: 1938888 - RNA, 17 nt, Shigella flexneri 2a str. 2457T
aacccgcagcuuaauga

SEQ ID NO: 1938889 - RNA, 19 nt, Shigella flexneri 2a str. 2457T
aacccgccagaccagcuac

SEQ ID NO: 1938890 - RNA, 23 nt, Shigella flexneri 2a str. 2457T
aacccgccaguuugucuggcaau

SEQ ID NO: 1938891 - RNA, 18 nt, Shigella flexneri 2a str. 2457T
aacccgcccagugccgag

SEQ ID NO: 1938892 - RNA, 14 nt, Shigella flexneri 2a str. 2457T
aacccgcugccauc

SEQ ID NO: 1938893 - RNA, 16 nt, Shigella flexneri 2a str. 2457T
aacaucuccacaguca

SEQ ID NO: 1938894 - RNA, 19 nt, Shigella flexneri 2a str. 2457T
aacaugagaacaguucagc

SEQ ID NO: 1938895 - RNA, 13 nt, Shigella flexneri 2a str. 2457T
aacaugaaaauaa

SEQ ID NO: 1938896 - RNA, 18 nt, Shigella flexneri 2a str. 2457T
aacaugaaacagaaaauu

SEQ ID NO: 1938897 - RNA, 21 nt, Shigella flexneri 2a str. 2457T
aacauccgcuuucgguuuuuc

SEQ ID NO: 1938898 - RNA, 13 nt, Shigella flexneri 2a str. 2457T
aacaucccuguaa

SEQ ID NO: 1938899 - RNA, 17 nt, Shigella flexneri 2a str. 2457T
aacaugcggugauuuug

SEQ ID NO: 1938900 - RNA, 19 nt, Shigella flexneri 2a str. 2457T
aacauggauucgaugauca

SEQ ID NO: 1938901 - RNA, 16 nt, Shigella flexneri 2a str. 2457T
aacaugagcgaauaaa

SEQ ID NO: 1938902 - RNA, 19 nt, Shigella flexneri 2a str. 2457T
aacaugagcgaauaaaaaa

SEQ ID NO: 1938903 - RNA, 16 nt, Shigella flexneri 2a str. 2457T
aaccaacaauaaaauu

SEQ ID NO: 1938904 - RNA, 13 nt, Shigella flexneri 2a str. 2457T
aaccaacaaugca

SEQ ID NO: 1938905 - RNA, 20 nt, Shigella flexneri 2a str. 2457T
aaccaaacguggucgccagc

SEQ ID NO: 1938906 - RNA, 21 nt, Shigella flexneri 2a str. 2457T
aacauugcccggucaggaugg

SEQ ID NO: 1938907 - RNA, 19 nt, Shigella flexneri 2a str. 2457T
aacauucccaucaguagca

SEQ ID NO: 1938908 - RNA, 15 nt, Shigella flexneri 2a str. 2457T
aacauaauauaaauu

SEQ ID NO: 1938909 - RNA, 22 nt, Shigella flexneri 2a str. 2457T
aacauaaugcaacgauccuuca

SEQ ID NO: 1938910 - RNA, 17 nt, Shigella flexneri 2a str. 2457T
aacauacccaguuucau

SEQ ID NO: 1938911 - RNA, 20 nt, Shigella flexneri 2a str. 2457T
aacauagcuuggcagagcaa

SEQ ID NO: 1938912 - RNA, 15 nt, Shigella flexneri 2a str. 2457T
aacauaucagcgcaa

SEQ ID NO: 1938913 - RNA, 13 nt, Shigella flexneri 2a str. 2457T
aacaucaaaccac

SEQ ID NO: 1938914 - RNA, 14 nt, Shigella flexneri 2a str. 2457T
aacaucaaauuaca

SEQ ID NO: 1938915 - RNA, 12 nt, Shigella flexneri 2a str. 2457T
aacaucacaugc

SEQ ID NO: 1938916 - RNA, 18 nt, Shigella flexneri 2a str. 2457T
aacaucacaccugcucag

SEQ ID NO: 1938917 - RNA, 12 nt, Shigella flexneri 2a str. 2457T
aacaucagauaa

SEQ ID NO: 1938918 - RNA, 16 nt, Shigella flexneri 2a str. 2457T
aacauccaucgccagc

SEQ ID NO: 1938919 - RNA, 22 nt, Shigella flexneri 2a str. 2457T
aacagucgcucggcgacacguu

SEQ ID NO: 1938920 - RNA, 19 nt, Shigella flexneri 2a str. 2457T
aacaguagccucgccgagc

SEQ ID NO: 1938921 - RNA, 18 nt, Shigella flexneri 2a str. 2457T
aacagugauuucuucauu

SEQ ID NO: 1938922 - RNA, 23 nt, Shigella flexneri 2a str. 2457T
aacagugccgcacauagcaccac

SEQ ID NO: 1938923 - RNA, 21 nt, Shigella flexneri 2a str. 2457T
aacagugcugauccccggaau

SEQ ID NO: 1938924 - RNA, 16 nt, Shigella flexneri 2a str. 2457T
aacaguucugcagcgu

SEQ ID NO: 1938925 - RNA, 23 nt, Shigella flexneri 2a str. 2457T
aacaguuccgcaaagcccaucac

SEQ ID NO: 1938926 - RNA, 22 nt, Shigella flexneri 2a str. 2457T
aacaguucaacgccgcuaucag

SEQ ID NO: 1938927 - RNA, 12 nt, Shigella flexneri 2a str. 2457T
aacaguuaccuu

SEQ ID NO: 1938928 - RNA, 22 nt, Shigella flexneri 2a str. 2457T
aacagguaaagaccauaaauau

SEQ ID NO: 1938929 - RNA, 21 nt, Shigella flexneri 2a str. 2457T
aacagggaggggugcaugaaa

SEQ ID NO: 1938930 - RNA, 19 nt, Shigella flexneri 2a str. 2457T
aacagggcaauuaaaaauu

SEQ ID NO: 1938931 - RNA, 20 nt, Shigella flexneri 2a str. 2457T
aacaguaagcacucugacgg

SEQ ID NO: 1938932 - RNA, 19 nt, Shigella flexneri 2a str. 2457T
aacaguaauaaugcccauc

SEQ ID NO: 1938933 - RNA, 22 nt, Shigella flexneri 2a str. 2457T
aacagguugcgcuggauuucaa

SEQ ID NO: 1938934 - RNA, 19 nt, Shigella flexneri 2a str. 2457T
aacaggcagggccaccagc

SEQ ID NO: 1938935 - RNA, 19 nt, Shigella flexneri 2a str. 2457T
aacaggcccaggcggccug

SEQ ID NO: 1938936 - RNA, 22 nt, Shigella flexneri 2a str. 2457T
aacaggaauaaaucuaaaagau

SEQ ID NO: 1938937 - RNA, 18 nt, Shigella flexneri 2a str. 2457T
aacaggaacaccagcauc

SEQ ID NO: 1938938 - RNA, 16 nt, Shigella flexneri 2a str. 2457T
aacaggaguagcucug

SEQ ID NO: 1938939 - RNA, 16 nt, Shigella flexneri 2a str. 2457T
aacaggcgcuggucag

SEQ ID NO: 1938940 - RNA, 23 nt, Shigella flexneri 2a str. 2457T
aacaggcgcagaacuucacucuc

SEQ ID NO: 1938941 - RNA, 17 nt, Shigella flexneri 2a str. 2457T
aacaggcgaucuucccg

SEQ ID NO: 1938942 - RNA, 16 nt, Shigella flexneri 2a str. 2457T
aacaggcccaacuguu

SEQ ID NO: 1938943 - RNA, 15 nt, Shigella flexneri 2a str. 2457T
aacagcuuuuuccug

SEQ ID NO: 1938944 - RNA, 16 nt, Shigella flexneri 2a str. 2457T
aacagcucgacaccaa

SEQ ID NO: 1938945 - RNA, 20 nt, Shigella flexneri 2a str. 2457T
aacagcgacaccagccaucu

SEQ ID NO: 1938946 - RNA, 14 nt, Shigella flexneri 2a str. 2457T
aacagcgacaccag

SEQ ID NO: 1938947 - RNA, 13 nt, Shigella flexneri 2a str. 2457T
aacagcgcaccag

SEQ ID NO: 1938948 - RNA, 19 nt, Shigella flexneri 2a str. 2457T
aacagcgcaccagaaacaa

SEQ ID NO: 1938949 - RNA, 22 nt, Shigella flexneri 2a str. 2457T
aacagcgaguucaggcgcugca

SEQ ID NO: 1938950 - RNA, 23 nt, Shigella flexneri 2a str. 2457T
aacagcgccuguuuaccgcucac

SEQ ID NO: 1938951 - RNA, 23 nt, Shigella flexneri 2a str. 2457T
aacagcaccagcaggugauacau

SEQ ID NO: 1938952 - RNA, 13 nt, Shigella flexneri 2a str. 2457T
aacagcaccaucc

SEQ ID NO: 1938953 - RNA, 11 nt, Shigella flexneri 2a str. 2457T
aacagcaccau

SEQ ID NO: 1938954 - RNA, 15 nt, Shigella flexneri 2a str. 2457T
aacagcaaucccaaa

SEQ ID NO: 1938955 - RNA, 19 nt, Shigella flexneri 2a str. 2457T
aacagcaauacguuucaua

SEQ ID NO: 1938956 - RNA, 15 nt, Shigella flexneri 2a str. 2457T
aacagccagaagccc

SEQ ID NO: 1938957 - RNA, 16 nt, Shigella flexneri 2a str. 2457T
aacagcccaaucaucg

SEQ ID NO: 1938958 - RNA, 13 nt, Shigella flexneri 2a str. 2457T
aacagccagaagc

SEQ ID NO: 1938959 - RNA, 18 nt, Shigella flexneri 2a str. 2457T
aacagcagggccugaagg

SEQ ID NO: 1938960 - RNA, 19 nt, Shigella flexneri 2a str. 2457T
aacacgguuggagggccau

SEQ ID NO: 1938961 - RNA, 21 nt, Shigella flexneri 2a str. 2457T
aacacggaucaggcggcucac

SEQ ID NO: 1938962 - RNA, 17 nt, Shigella flexneri 2a str. 2457T
aacacgcucccagcaga

SEQ ID NO: 1938963 - RNA, 14 nt, Shigella flexneri 2a str. 2457T
aacacgaucagcca

SEQ ID NO: 1938964 - RNA, 23 nt, Shigella flexneri 2a str. 2457T
aacacgcccguuguuuuauuuau

SEQ ID NO: 1938965 - RNA, 15 nt, Shigella flexneri 2a str. 2457T
aacacucuuccaguc

SEQ ID NO: 1938966 - RNA, 18 nt, Shigella flexneri 2a str. 2457T
aacacguugcacuagguu

SEQ ID NO: 1938967 - RNA, 21 nt, Shigella flexneri 2a str. 2457T
aacagauaggcaucagcaauu

SEQ ID NO: 1938968 - RNA, 16 nt, Shigella flexneri 2a str. 2457T
aacagaacaauaauaa

SEQ ID NO: 1938969 - RNA, 20 nt, Shigella flexneri 2a str. 2457T
aacacuuguuaugagauaau

SEQ ID NO: 1938970 - RNA, 15 nt, Shigella flexneri 2a str. 2457T
aacagaccaguaaag

SEQ ID NO: 1938971 - RNA, 12 nt, Shigella flexneri 2a str. 2457T
aacagaccaaug

SEQ ID NO: 1938972 - RNA, 11 nt, Shigella flexneri 2a str. 2457T
aacagaauuac

SEQ ID NO: 1938973 - RNA, 19 nt, Shigella flexneri 2a str. 2457T
aacagaagugcguuucugg

SEQ ID NO: 1938974 - RNA, 13 nt, Shigella flexneri 2a str. 2457T
aacaccagcgaau

SEQ ID NO: 1938975 - RNA, 13 nt, Shigella flexneri 2a str. 2457T
aacaccagccaga

SEQ ID NO: 1938976 - RNA, 12 nt, Shigella flexneri 2a str. 2457T
aacaccauaaug

SEQ ID NO: 1938977 - RNA, 15 nt, Shigella flexneri 2a str. 2457T
aacaccagcaauaau

SEQ ID NO: 1938978 - RNA, 12 nt, Shigella flexneri 2a str. 2457T
aacaccagcagu

SEQ ID NO: 1938979 - RNA, 15 nt, Shigella flexneri 2a str. 2457T
aacacauccaguggc

SEQ ID NO: 1938980 - RNA, 17 nt, Shigella flexneri 2a str. 2457T
aacacagguaacuuaaa

SEQ ID NO: 1938981 - RNA, 17 nt, Shigella flexneri 2a str. 2457T
aacacagcgauccggua

SEQ ID NO: 1938982 - RNA, 18 nt, Shigella flexneri 2a str. 2457T
aacaccugggcaauggug

SEQ ID NO: 1938983 - RNA, 19 nt, Shigella flexneri 2a str. 2457T
aacaccuucauccagcauc

SEQ ID NO: 1938984 - RNA, 18 nt, Shigella flexneri 2a str. 2457T
aacaccaucauauuuucc

SEQ ID NO: 1938985 - RNA, 20 nt, Shigella flexneri 2a str. 2457T
aacaccaucauauuuuccau

SEQ ID NO: 1938986 - RNA, 22 nt, Shigella flexneri 2a str. 2457T
aacaccauaucuaugguuuuuu

SEQ ID NO: 1938987 - RNA, 22 nt, Shigella flexneri 2a str. 2457T
aacacccauggggaugcugcag

SEQ ID NO: 1938988 - RNA, 12 nt, Shigella flexneri 2a str. 2457T
aacaccgggugc

SEQ ID NO: 1938989 - RNA, 17 nt, Shigella flexneri 2a str. 2457T
aacaccgaaccagagau

SEQ ID NO: 1938990 - RNA, 23 nt, Shigella flexneri 2a str. 2457T
aacaccgauuuuguaaaagaagg

SEQ ID NO: 1938991 - RNA, 18 nt, Shigella flexneri 2a str. 2457T
aacaccgcuucaacagcg

SEQ ID NO: 1938992 - RNA, 17 nt, Shigella flexneri 2a str. 2457T
aacaaucgggaaaaucu

SEQ ID NO: 1938993 - RNA, 22 nt, Shigella flexneri 2a str. 2457T
aacaaucugcaaaucgaucuca

SEQ ID NO: 1938994 - RNA, 18 nt, Shigella flexneri 2a str. 2457T
aacaaucucuuccagaau

SEQ ID NO: 1938995 - RNA, 17 nt, Shigella flexneri 2a str. 2457T
aacaaugccgauaaaua

SEQ ID NO: 1938996 - RNA, 23 nt, Shigella flexneri 2a str. 2457T
aacaaugagauauuuaaaugauu

SEQ ID NO: 1938997 - RNA, 14 nt, Shigella flexneri 2a str. 2457T
aacaauagguuaua

SEQ ID NO: 1938998 - RNA, 13 nt, Shigella flexneri 2a str. 2457T
aacaauacaucuu

SEQ ID NO: 1938999 - RNA, 17 nt, Shigella flexneri 2a str. 2457T
aacaauacaucuuuuca

SEQ ID NO: 1939000 - RNA, 17 nt, Shigella flexneri 2a str. 2457T
aacacaauccccgcgcc

SEQ ID NO: 1939001 - RNA, 18 nt, Shigella flexneri 2a str. 2457T
aacacaacgcuuucaaca

SEQ ID NO: 1939002 - RNA, 21 nt, Shigella flexneri 2a str. 2457T
aacacacaauuaccuuccaca

SEQ ID NO: 1939003 - RNA, 15 nt, Shigella flexneri 2a str. 2457T
aacacaaaacugccu

SEQ ID NO: 1939004 - RNA, 23 nt, Shigella flexneri 2a str. 2457T
aacaauugcgggccaaagaccag

SEQ ID NO: 1939005 - RNA, 16 nt, Shigella flexneri 2a str. 2457T
aacaauugaagaauau

SEQ ID NO: 1939006 - RNA, 19 nt, Shigella flexneri 2a str. 2457T
aacaaaugcgcuuuauuca

SEQ ID NO: 1939007 - RNA, 19 nt, Shigella flexneri 2a str. 2457T
aacaaacgauuuaucgauu

SEQ ID NO: 1939008 - RNA, 14 nt, Shigella flexneri 2a str. 2457T
aacaaacgcaaaau

SEQ ID NO: 1939009 - RNA, 15 nt, Shigella flexneri 2a str. 2457T
aacaaacgcaaacac

SEQ ID NO: 1939010 - RNA, 12 nt, Shigella flexneri 2a str. 2457T
aacaaagccacu

SEQ ID NO: 1939011 - RNA, 14 nt, Shigella flexneri 2a str. 2457T
aacaaauaaaagca

SEQ ID NO: 1939012 - RNA, 12 nt, Shigella flexneri 2a str. 2457T
aacaaacaguac

SEQ ID NO: 1939013 - RNA, 16 nt, Shigella flexneri 2a str. 2457T
aacaaaaucuucuaac

SEQ ID NO: 1939014 - RNA, 21 nt, Shigella flexneri 2a str. 2457T
aacaaaacucaacgguccaau

SEQ ID NO: 1939015 - RNA, 22 nt, Shigella flexneri 2a str. 2457T
aacaaaaccuguugaaauuauu

SEQ ID NO: 1939016 - RNA, 13 nt, Shigella flexneri 2a str. 2457T
aacaaaaaagagu

SEQ ID NO: 1939017 - RNA, 18 nt, Shigella flexneri 2a str. 2457T
aaauuuuuccguuuucca

SEQ ID NO: 1939018 - RNA, 18 nt, Shigella flexneri 2a str. 2457T
aacaauaaaaccaguaau

SEQ ID NO: 1939019 - RNA, 21 nt, Shigella flexneri 2a str. 2457T
aacaagguuugaaaaaaccug

SEQ ID NO: 1939020 - RNA, 16 nt, Shigella flexneri 2a str. 2457T
aacaagcguacaaaau

SEQ ID NO: 1939021 - RNA, 20 nt, Shigella flexneri 2a str. 2457T
aacaagccaguccagaaaug

SEQ ID NO: 1939022 - RNA, 22 nt, Shigella flexneri 2a str. 2457T
aacaacguuuuucuaagcuuug

SEQ ID NO: 1939023 - RNA, 15 nt, Shigella flexneri 2a str. 2457T
aacaacgugguuuuc

SEQ ID NO: 1939024 - RNA, 19 nt, Shigella flexneri 2a str. 2457T
aacaacgcgcggaacugau

SEQ ID NO: 1939025 - RNA, 16 nt, Shigella flexneri 2a str. 2457T
aacaacuuaacuugcu

SEQ ID NO: 1939026 - RNA, 17 nt, Shigella flexneri 2a str. 2457T
aacaacugaaaaaaaau

SEQ ID NO: 1939027 - RNA, 21 nt, Shigella flexneri 2a str. 2457T
aacaacagcgauuauggauca

SEQ ID NO: 1939028 - RNA, 21 nt, Shigella flexneri 2a str. 2457T
aacaacggcaaacacgcagcc

SEQ ID NO: 1939029 - RNA, 20 nt, Shigella flexneri 2a str. 2457T
aacaaccgaugaacuggcuu

SEQ ID NO: 1939030 - RNA, 20 nt, Shigella flexneri 2a str. 2457T
aacaacccggcgaaagagcu

SEQ ID NO: 1939031 - RNA, 21 nt, Shigella flexneri 2a str. 2457T
aaauuuugugggcaggagaaa

SEQ ID NO: 1939032 - RNA, 17 nt, Shigella flexneri 2a str. 2457T
aaauuucacugcuuaau

SEQ ID NO: 1939033 - RNA, 15 nt, Shigella flexneri 2a str. 2457T
aaauuucauuaauau

SEQ ID NO: 1939034 - RNA, 21 nt, Shigella flexneri 2a str. 2457T
aaauuuaugcgcuaaauguuu

SEQ ID NO: 1939035 - RNA, 14 nt, Shigella flexneri 2a str. 2457T
aaauuuccgcgaaa

SEQ ID NO: 1939036 - RNA, 12 nt, Shigella flexneri 2a str. 2457T
aaauuucuccuu

SEQ ID NO: 1939037 - RNA, 21 nt, Shigella flexneri 2a str. 2457T
aaauuucugccauuuugcuuu

SEQ ID NO: 1939038 - RNA, 20 nt, Shigella flexneri 2a str. 2457T
aaauuguuuuugauuuugca

SEQ ID NO: 1939039 - RNA, 17 nt, Shigella flexneri 2a str. 2457T
aaauugugauaaaaauc

SEQ ID NO: 1939040 - RNA, 15 nt, Shigella flexneri 2a str. 2457T
aaauugugauaaaaa

SEQ ID NO: 1939041 - RNA, 18 nt, Shigella flexneri 2a str. 2457T
aaauuuagcaaauuuuua

SEQ ID NO: 1939042 - RNA, 22 nt, Shigella flexneri 2a str. 2457T
aaauuuacaguauaaguaauga

SEQ ID NO: 1939043 - RNA, 23 nt, Shigella flexneri 2a str. 2457T
aaauugccccagacacaguucuu

SEQ ID NO: 1939044 - RNA, 22 nt, Shigella flexneri 2a str. 2457T
uuuauuuuuuuucaggaaauaa

SEQ ID NO: 1939045 - RNA, 12 nt, Shigella flexneri 2a str. 2457T
uuucaaaaacaa

SEQ ID NO: 1939046 - RNA, 15 nt, Shigella flexneri 2a str. 2457T
aaauugcaggaaaua

SEQ ID NO: 1939047 - RNA, 15 nt, Shigella flexneri 2a str. 2457T
aagaaauuauucaug

SEQ ID NO: 1939048 - RNA, 19 nt, Shigella flexneri 2a str. 2457T
aagaaaccgaaguuguagc

SEQ ID NO: 1939049 - RNA, 17 nt, Shigella flexneri 2a str. 2457T
aagaaacgccaucugaa

SEQ ID NO: 1939050 - RNA, 22 nt, Shigella flexneri 2a str. 2457T
aagaaacuaucaggcaaaaaaa

SEQ ID NO: 1939051 - RNA, 14 nt, Shigella flexneri 2a str. 2457T
aagaaaaauauaaa

SEQ ID NO: 1939052 - RNA, 21 nt, Shigella flexneri 2a str. 2457T
aagaaaaaaugaccggccagc

SEQ ID NO: 1939053 - RNA, 13 nt, Shigella flexneri 2a str. 2457T
aagaaacaccaga

SEQ ID NO: 1939054 - RNA, 22 nt, Shigella flexneri 2a str. 2457T
aagaaaauggccagccagcaga

SEQ ID NO: 1939055 - RNA, 16 nt, Shigella flexneri 2a str. 2457T
aagaaaacguuucaac

SEQ ID NO: 1939056 - RNA, 22 nt, Shigella flexneri 2a str. 2457T
aagaagaucguggagaacaaua

SEQ ID NO: 1939057 - RNA, 12 nt, Shigella flexneri 2a str. 2457T
aagaagaaguuu

SEQ ID NO: 1939058 - RNA, 23 nt, Shigella flexneri 2a str. 2457T
aagaacugacuuccacuuccugc

SEQ ID NO: 1939059 - RNA, 22 nt, Shigella flexneri 2a str. 2457T
aagaagccuuuaucugguuguu

SEQ ID NO: 1939060 - RNA, 13 nt, Shigella flexneri 2a str. 2457T
aagaaggaaaaua

SEQ ID NO: 1939061 - RNA, 14 nt, Shigella flexneri 2a str. 2457T
aagaaggaaaauac

SEQ ID NO: 1939062 - RNA, 15 nt, Shigella flexneri 2a str. 2457T
aagaaggcauaacuc

SEQ ID NO: 1939063 - RNA, 18 nt, Shigella flexneri 2a str. 2457T
aagaagcggugaaaaaau

SEQ ID NO: 1939064 - RNA, 18 nt, Shigella flexneri 2a str. 2457T
aagaacuauuaguuuguu

SEQ ID NO: 1939065 - RNA, 14 nt, Shigella flexneri 2a str. 2457T
aagaacuccugaaa

SEQ ID NO: 1939066 - RNA, 19 nt, Shigella flexneri 2a str. 2457T
aagaacucgaggauaaauu

SEQ ID NO: 1939067 - RNA, 22 nt, Shigella flexneri 2a str. 2457T
aagaacucgaggauaaauuuuc

SEQ ID NO: 1939068 - RNA, 16 nt, Shigella flexneri 2a str. 2457T
aagaacgccauaaaag

SEQ ID NO: 1939069 - RNA, 14 nt, Shigella flexneri 2a str. 2457T
aagaacgaguaaaa

SEQ ID NO: 1939070 - RNA, 15 nt, Shigella flexneri 2a str. 2457T
aagaaccugaacgcc

SEQ ID NO: 1939071 - RNA, 19 nt, Shigella flexneri 2a str. 2457T
aagaacagccuuaaacuca

SEQ ID NO: 1939072 - RNA, 13 nt, Shigella flexneri 2a str. 2457T
aagaacaucauuc

SEQ ID NO: 1939073 - RNA, 16 nt, Shigella flexneri 2a str. 2457T
aacuuuaagcugaaaa

SEQ ID NO: 1939074 - RNA, 17 nt, Shigella flexneri 2a str. 2457T
aacuugacucgccugaa

SEQ ID NO: 1939075 - RNA, 18 nt, Shigella flexneri 2a str. 2457T
aacuucuuuuucgacaaa

SEQ ID NO: 1939076 - RNA, 18 nt, Shigella flexneri 2a str. 2457T
aacuugauagaacaaaag

SEQ ID NO: 1939077 - RNA, 18 nt, Shigella flexneri 2a str. 2457T
aacuuuucaacaaauucu

SEQ ID NO: 1939078 - RNA, 21 nt, Shigella flexneri 2a str. 2457T
aacuuuguuagcgaauaaagu

SEQ ID NO: 1939079 - RNA, 20 nt, Shigella flexneri 2a str. 2457T
aacuuaucaucaggcgaagg

SEQ ID NO: 1939080 - RNA, 14 nt, Shigella flexneri 2a str. 2457T
aacuuaucuguaau

SEQ ID NO: 1939081 - RNA, 18 nt, Shigella flexneri 2a str. 2457T
aacuuaucuguaauuaaa

SEQ ID NO: 1939082 - RNA, 20 nt, Shigella flexneri 2a str. 2457T
aacuucaccagcacuucacu

SEQ ID NO: 1939083 - RNA, 17 nt, Shigella flexneri 2a str. 2457T
aacuucacaucaccaua

SEQ ID NO: 1939084 - RNA, 15 nt, Shigella flexneri 2a str. 2457T
aacuuaucaucaggc

SEQ ID NO: 1939085 - RNA, 14 nt, Shigella flexneri 2a str. 2457T
aacuuacugaugca

SEQ ID NO: 1939086 - RNA, 17 nt, Shigella flexneri 2a str. 2457T
aacuuaacuugcuuaaa

SEQ ID NO: 1939087 - RNA, 16 nt, Shigella flexneri 2a str. 2457T
aacuuccggcagaaau

SEQ ID NO: 1939088 - RNA, 15 nt, Shigella flexneri 2a str. 2457T
aacuuccugagugaa

SEQ ID NO: 1939089 - RNA, 16 nt, Shigella flexneri 2a str. 2457T
aacuucgguuaccaca

SEQ ID NO: 1939090 - RNA, 14 nt, Shigella flexneri 2a str. 2457T
aacuucgucacagc

SEQ ID NO: 1939091 - RNA, 16 nt, Shigella flexneri 2a str. 2457T
aacuucgcguuguaua

SEQ ID NO: 1939092 - RNA, 21 nt, Shigella flexneri 2a str. 2457T
aacuucguuagguucucucag

SEQ ID NO: 1939093 - RNA, 14 nt, Shigella flexneri 2a str. 2457T
aacuucuucaguuu

SEQ ID NO: 1939094 - RNA, 22 nt, Shigella flexneri 2a str. 2457T
aacuucuuuacuggcuuucauu

SEQ ID NO: 1939095 - RNA, 20 nt, Shigella flexneri 2a str. 2457T
aacuucucgcaagccgaaua

SEQ ID NO: 1939096 - RNA, 18 nt, Shigella flexneri 2a str. 2457T
aacuucucuucuuccgcu

SEQ ID NO: 1939097 - RNA, 13 nt, Shigella flexneri 2a str. 2457T
aacuucucuuucg

SEQ ID NO: 1939098 - RNA, 16 nt, Shigella flexneri 2a str. 2457T
aacugcuuaucaucac

SEQ ID NO: 1939099 - RNA, 17 nt, Shigella flexneri 2a str. 2457T
aacuggaagcugccucg

SEQ ID NO: 1939100 - RNA, 13 nt, Shigella flexneri 2a str. 2457T
aacuggaaaaaua

SEQ ID NO: 1939101 - RNA, 14 nt, Shigella flexneri 2a str. 2457T
aacuggcaaaaacc

SEQ ID NO: 1939102 - RNA, 18 nt, Shigella flexneri 2a str. 2457T
aacuggauuacaaauaaa

SEQ ID NO: 1939103 - RNA, 17 nt, Shigella flexneri 2a str. 2457T
aacuggcaaccagaaga

SEQ ID NO: 1939104 - RNA, 15 nt, Shigella flexneri 2a str. 2457T
aacuggcaggaaaca

SEQ ID NO: 1939105 - RNA, 17 nt, Shigella flexneri 2a str. 2457T
aacuggguuaucgccuu

SEQ ID NO: 1939106 - RNA, 15 nt, Shigella flexneri 2a str. 2457T
aacuggucaucaaau

SEQ ID NO: 1939107 - RNA, 20 nt, Shigella flexneri 2a str. 2457T
aacugguggauuauauggaa

SEQ ID NO: 1939108 - RNA, 22 nt, Shigella flexneri 2a str. 2457T
aacugguccagccccugaagcg

SEQ ID NO: 1939109 - RNA, 17 nt, Shigella flexneri 2a str. 2457T
aacuggcguguuucauu

SEQ ID NO: 1939110 - RNA, 21 nt, Shigella flexneri 2a str. 2457T
aacuggcguguuucauuagcc

SEQ ID NO: 1939111 - RNA, 18 nt, Shigella flexneri 2a str. 2457T
aacuggcuuucacaaggc

SEQ ID NO: 1939112 - RNA, 19 nt, Shigella flexneri 2a str. 2457T
aacuguggcgcgaagcccu

SEQ ID NO: 1939113 - RNA, 13 nt, Shigella flexneri 2a str. 2457T
aacugucuaaugg

SEQ ID NO: 1939114 - RNA, 17 nt, Shigella flexneri 2a str. 2457T
aacugucuucaccauag

SEQ ID NO: 1939115 - RNA, 19 nt, Shigella flexneri 2a str. 2457T
aacuguagugaucaaacac

SEQ ID NO: 1939116 - RNA, 20 nt, Shigella flexneri 2a str. 2457T
aacuguagugaucaaacaca

SEQ ID NO: 1939117 - RNA, 13 nt, Shigella flexneri 2a str. 2457T
aacuguacaggcu

SEQ ID NO: 1939118 - RNA, 23 nt, Shigella flexneri 2a str. 2457T
aacuguacaggcuccuguagcug

SEQ ID NO: 1939119 - RNA, 13 nt, Shigella flexneri 2a str. 2457T
aacuguuccaacu

SEQ ID NO: 1939120 - RNA, 12 nt, Shigella flexneri 2a str. 2457T
aacugacaauuc

SEQ ID NO: 1939121 - RNA, 17 nt, Shigella flexneri 2a str. 2457T
aacugacggcaugacca

SEQ ID NO: 1939122 - RNA, 18 nt, Shigella flexneri 2a str. 2457T
aacugacuuccacuuccu

SEQ ID NO: 1939123 - RNA, 17 nt, Shigella flexneri 2a str. 2457T
aacugacugaaugccac

SEQ ID NO: 1939124 - RNA, 15 nt, Shigella flexneri 2a str. 2457T
aacugacuggcucuu

SEQ ID NO: 1939125 - RNA, 13 nt, Shigella flexneri 2a str. 2457T
aacugaacaaaaa

SEQ ID NO: 1939126 - RNA, 14 nt, Shigella flexneri 2a str. 2457T
aacugaacaaaaaa

SEQ ID NO: 1939127 - RNA, 15 nt, Shigella flexneri 2a str. 2457T
aacugaacaaaaaag

SEQ ID NO: 1939128 - RNA, 20 nt, Shigella flexneri 2a str. 2457T
aacugaguggaguccagcgc

SEQ ID NO: 1939129 - RNA, 20 nt, Shigella flexneri 2a str. 2457T
aacugauggcaaaugcagca

SEQ ID NO: 1939130 - RNA, 15 nt, Shigella flexneri 2a str. 2457T
aacugauccugacaa

SEQ ID NO: 1939131 - RNA, 17 nt, Shigella flexneri 2a str. 2457T
aacugccaguucccccu

SEQ ID NO: 1939132 - RNA, 16 nt, Shigella flexneri 2a str. 2457T
aacugcccgaucaacg

SEQ ID NO: 1939133 - RNA, 15 nt, Shigella flexneri 2a str. 2457T
aacugccggaaggcg

SEQ ID NO: 1939134 - RNA, 22 nt, Shigella flexneri 2a str. 2457T
aacugccggaaggcgauuaaac

SEQ ID NO: 1939135 - RNA, 16 nt, Shigella flexneri 2a str. 2457T
aacugauuuucaucuu

SEQ ID NO: 1939136 - RNA, 20 nt, Shigella flexneri 2a str. 2457T
aacugauuuucaucuucuuc

SEQ ID NO: 1939137 - RNA, 21 nt, Shigella flexneri 2a str. 2457T
aacugcggucuaaaucuuccg

SEQ ID NO: 1939138 - RNA, 15 nt, Shigella flexneri 2a str. 2457T
aacugcguucugucg

SEQ ID NO: 1939139 - RNA, 16 nt, Shigella flexneri 2a str. 2457T
aacugcucaaaggcga

SEQ ID NO: 1939140 - RNA, 16 nt, Shigella flexneri 2a str. 2457T
aacucgcuuaagccau

SEQ ID NO: 1939141 - RNA, 14 nt, Shigella flexneri 2a str. 2457T
aacuccguugaaau

SEQ ID NO: 1939142 - RNA, 22 nt, Shigella flexneri 2a str. 2457T
aacucccgcgcggguaauugcu

SEQ ID NO: 1939143 - RNA, 15 nt, Shigella flexneri 2a str. 2457T
aacuccgugaagcuc

SEQ ID NO: 1939144 - RNA, 13 nt, Shigella flexneri 2a str. 2457T
aacuccagaauac

SEQ ID NO: 1939145 - RNA, 16 nt, Shigella flexneri 2a str. 2457T
aacuccccgagaaaua

SEQ ID NO: 1939146 - RNA, 15 nt, Shigella flexneri 2a str. 2457T
aacuccaucuuuaac

SEQ ID NO: 1939147 - RNA, 22 nt, Shigella flexneri 2a str. 2457T
aacucucaucuuugaaaucacg

SEQ ID NO: 1939148 - RNA, 19 nt, Shigella flexneri 2a str. 2457T
aacucucuuuugcuugaca

SEQ ID NO: 1939149 - RNA, 22 nt, Shigella flexneri 2a str. 2457T
aacucuaaucccuuagcuaauu

SEQ ID NO: 1939150 - RNA, 12 nt, Shigella flexneri 2a str. 2457T
aacucacacagc

SEQ ID NO: 1939151 - RNA, 16 nt, Shigella flexneri 2a str. 2457T
aacucaaucaggcuau

SEQ ID NO: 1939152 - RNA, 13 nt, Shigella flexneri 2a str. 2457T
aacucaaucgccu

SEQ ID NO: 1939153 - RNA, 14 nt, Shigella flexneri 2a str. 2457T
aacucaauaccuga

SEQ ID NO: 1939154 - RNA, 22 nt, Shigella flexneri 2a str. 2457T
aacuauuguuuugaugaaucag

SEQ ID NO: 1939155 - RNA, 16 nt, Shigella flexneri 2a str. 2457T
aacucaaaaauaauca

SEQ ID NO: 1939156 - RNA, 15 nt, Shigella flexneri 2a str. 2457T
aacuaucccagccua

SEQ ID NO: 1939157 - RNA, 19 nt, Shigella flexneri 2a str. 2457T
aacuauggucggucaggag

SEQ ID NO: 1939158 - RNA, 11 nt, Shigella flexneri 2a str. 2457T
aacucaucacu

SEQ ID NO: 1939159 - RNA, 19 nt, Shigella flexneri 2a str. 2457T
aacucaucaccaucaggca

SEQ ID NO: 1939160 - RNA, 18 nt, Shigella flexneri 2a str. 2457T
aacucauugccaguccua

SEQ ID NO: 1939161 - RNA, 20 nt, Shigella flexneri 2a str. 2457T
aacucauugccaguccuaaa

SEQ ID NO: 1939162 - RNA, 20 nt, Shigella flexneri 2a str. 2457T
aacucauuuuuuaauaugcu

SEQ ID NO: 1939163 - RNA, 14 nt, Shigella flexneri 2a str. 2457T
aacuccaccagcac

SEQ ID NO: 1939164 - RNA, 12 nt, Shigella flexneri 2a str. 2457T
aacucacgcagg

SEQ ID NO: 1939165 - RNA, 14 nt, Shigella flexneri 2a str. 2457T
aacucaccgaugau

SEQ ID NO: 1939166 - RNA, 18 nt, Shigella flexneri 2a str. 2457T
aacucaccggcauuuuuu

SEQ ID NO: 1939167 - RNA, 18 nt, Shigella flexneri 2a str. 2457T
aacucacgccccagauug

SEQ ID NO: 1939168 - RNA, 18 nt, Shigella flexneri 2a str. 2457T
aacucagcauuauuuuua

SEQ ID NO: 1939169 - RNA, 20 nt, Shigella flexneri 2a str. 2457T
aacucagcauuauuuuuaaa

SEQ ID NO: 1939170 - RNA, 14 nt, Shigella flexneri 2a str. 2457T
aacucaguaacguu

SEQ ID NO: 1939171 - RNA, 19 nt, Shigella flexneri 2a str. 2457T
aacucauacaccagcggca

SEQ ID NO: 1939172 - RNA, 19 nt, Shigella flexneri 2a str. 2457T
aacucacgauuguuaauca

SEQ ID NO: 1939173 - RNA, 12 nt, Shigella flexneri 2a str. 2457T
aacuaaacaacg

SEQ ID NO: 1939174 - RNA, 18 nt, Shigella flexneri 2a str. 2457T
aacuaagcgcacuuuguc

SEQ ID NO: 1939175 - RNA, 12 nt, Shigella flexneri 2a str. 2457T
aacuacaaauua

SEQ ID NO: 1939176 - RNA, 20 nt, Shigella flexneri 2a str. 2457T
aacgucaggugagcgucauu

SEQ ID NO: 1939177 - RNA, 17 nt, Shigella flexneri 2a str. 2457T
aacguaucuggugucag

SEQ ID NO: 1939178 - RNA, 16 nt, Shigella flexneri 2a str. 2457T
aacguaggcacauucg

SEQ ID NO: 1939179 - RNA, 15 nt, Shigella flexneri 2a str. 2457T
aacgucccccagauc

SEQ ID NO: 1939180 - RNA, 17 nt, Shigella flexneri 2a str. 2457T
aacguccgguuaaaucg

SEQ ID NO: 1939181 - RNA, 18 nt, Shigella flexneri 2a str. 2457T
aacgucgguuucaucaca

SEQ ID NO: 1939182 - RNA, 16 nt, Shigella flexneri 2a str. 2457T
aacgucgguuucauca

SEQ ID NO: 1939183 - RNA, 15 nt, Shigella flexneri 2a str. 2457T
aacgucgcaucugac

SEQ ID NO: 1939184 - RNA, 21 nt, Shigella flexneri 2a str. 2457T
aacgugcagguuuuguagguc

SEQ ID NO: 1939185 - RNA, 12 nt, Shigella flexneri 2a str. 2457T
aacgugcagcuu

SEQ ID NO: 1939186 - RNA, 16 nt, Shigella flexneri 2a str. 2457T
aacgugcaaaaucaaa

SEQ ID NO: 1939187 - RNA, 19 nt, Shigella flexneri 2a str. 2457T
aacguuacucuaaagaguu

SEQ ID NO: 1939188 - RNA, 21 nt, Shigella flexneri 2a str. 2457T
aacguggccuccaaaaaacaa

SEQ ID NO: 1939189 - RNA, 13 nt, Shigella flexneri 2a str. 2457T
aacguggccauga

SEQ ID NO: 1939190 - RNA, 21 nt, Shigella flexneri 2a str. 2457T
aacguguuuauauuugaacau

SEQ ID NO: 1939191 - RNA, 16 nt, Shigella flexneri 2a str. 2457T
aacguugggaucagua

SEQ ID NO: 1939192 - RNA, 21 nt, Shigella flexneri 2a str. 2457T
aacguugccugauuuuauuuc

SEQ ID NO: 1939193 - RNA, 18 nt, Shigella flexneri 2a str. 2457T
aacguugaauuucagguu

SEQ ID NO: 1939194 - RNA, 12 nt, Shigella flexneri 2a str. 2457T
aacguuccagca

SEQ ID NO: 1939195 - RNA, 22 nt, Shigella flexneri 2a str. 2457T
aacguuucuuucaucaggucaa

SEQ ID NO: 1939196 - RNA, 17 nt, Shigella flexneri 2a str. 2457T
aacguuuacagggaugg

SEQ ID NO: 1939197 - RNA, 19 nt, Shigella flexneri 2a str. 2457T
aacguuuacagggauggcu

SEQ ID NO: 1939198 - RNA, 15 nt, Shigella flexneri 2a str. 2457T
aacguuuaaaaacuu

SEQ ID NO: 1939199 - RNA, 22 nt, Shigella flexneri 2a str. 2457T
aacggugcggcucucuuucucc

SEQ ID NO: 1939200 - RNA, 23 nt, Shigella flexneri 2a str. 2457T
aacggugccauugaccagcugcc

SEQ ID NO: 1939201 - RNA, 21 nt, Shigella flexneri 2a str. 2457T
aacggucgugcgagauaacca

SEQ ID NO: 1939202 - RNA, 16 nt, Shigella flexneri 2a str. 2457T
aacggucccucaacaa

SEQ ID NO: 1939203 - RNA, 16 nt, Shigella flexneri 2a str. 2457T
aacguaacaguacaau

SEQ ID NO: 1939204 - RNA, 14 nt, Shigella flexneri 2a str. 2457T
aacguacugcugaa

SEQ ID NO: 1939205 - RNA, 18 nt, Shigella flexneri 2a str. 2457T
aacggcauuauucaucug

SEQ ID NO: 1939206 - RNA, 21 nt, Shigella flexneri 2a str. 2457T
aacggcgaugcuuugaccucc

SEQ ID NO: 1939207 - RNA, 12 nt, Shigella flexneri 2a str. 2457T
aacggcgaaaaa

SEQ ID NO: 1939208 - RNA, 16 nt, Shigella flexneri 2a str. 2457T
aacggcgagccagcgc

SEQ ID NO: 1939209 - RNA, 18 nt, Shigella flexneri 2a str. 2457T
aacggcgcaccagaauac

SEQ ID NO: 1939210 - RNA, 12 nt, Shigella flexneri 2a str. 2457T
aacggcggauga

SEQ ID NO: 1939211 - RNA, 14 nt, Shigella flexneri 2a str. 2457T
aacggcuaaagccg

SEQ ID NO: 1939212 - RNA, 21 nt, Shigella flexneri 2a str. 2457T
aacggcgguuucgcaaaccaa

SEQ ID NO: 1939213 - RNA, 20 nt, Shigella flexneri 2a str. 2457T
aacggcucacgcccaucagc

SEQ ID NO: 1939214 - RNA, 18 nt, Shigella flexneri 2a str. 2457T
aacggcugggaaaucacc

SEQ ID NO: 1939215 - RNA, 18 nt, Shigella flexneri 2a str. 2457T
aacggcugcuucggucag

SEQ ID NO: 1939216 - RNA, 18 nt, Shigella flexneri 2a str. 2457T
aacgggauuccugcgcuu

SEQ ID NO: 1939217 - RNA, 21 nt, Shigella flexneri 2a str. 2457T
aacgggcaggguggugacacc

SEQ ID NO: 1939218 - RNA, 21 nt, Shigella flexneri 2a str. 2457T
aacgggcauggugucaccacc

SEQ ID NO: 1939219 - RNA, 23 nt, Shigella flexneri 2a str. 2457T
aacgcgccaagauagaaccacgc

SEQ ID NO: 1939220 - RNA, 20 nt, Shigella flexneri 2a str. 2457T
aacgcgcccucagcccacau

SEQ ID NO: 1939221 - RNA, 19 nt, Shigella flexneri 2a str. 2457T
aacgcgucuuaucuggccu

SEQ ID NO: 1939222 - RNA, 16 nt, Shigella flexneri 2a str. 2457T
aacgcugacauauuuu

SEQ ID NO: 1939223 - RNA, 14 nt, Shigella flexneri 2a str. 2457T
aacgcuggcagcau

SEQ ID NO: 1939224 - RNA, 14 nt, Shigella flexneri 2a str. 2457T
aacgcguucacugc

SEQ ID NO: 1939225 - RNA, 16 nt, Shigella flexneri 2a str. 2457T
aacgcguucacugccg

SEQ ID NO: 1939226 - RNA, 21 nt, Shigella flexneri 2a str. 2457T
aacgcugugcguaaucgccga

SEQ ID NO: 1939227 - RNA, 20 nt, Shigella flexneri 2a str. 2457T
aacgcuuuacucaacucccc

SEQ ID NO: 1939228 - RNA, 18 nt, Shigella flexneri 2a str. 2457T
aacgcuucucccagccgc

SEQ ID NO: 1939229 - RNA, 15 nt, Shigella flexneri 2a str. 2457T
aacgcuucucccagc

SEQ ID NO: 1939230 - RNA, 13 nt, Shigella flexneri 2a str. 2457T
aacggaccaauaa

SEQ ID NO: 1939231 - RNA, 17 nt, Shigella flexneri 2a str. 2457T
aacggaacgaaaaaaau

SEQ ID NO: 1939232 - RNA, 19 nt, Shigella flexneri 2a str. 2457T
aacgcuuuuuugagcagca

SEQ ID NO: 1939233 - RNA, 20 nt, Shigella flexneri 2a str. 2457T
aacgcuuguaaaugaacuca

SEQ ID NO: 1939234 - RNA, 23 nt, Shigella flexneri 2a str. 2457T
aacgcuuucuuuggcaucaauca

SEQ ID NO: 1939235 - RNA, 17 nt, Shigella flexneri 2a str. 2457T
aacggcacggaaagcag

SEQ ID NO: 1939236 - RNA, 17 nt, Shigella flexneri 2a str. 2457T
aacggcagaagcugcag

SEQ ID NO: 1939237 - RNA, 22 nt, Shigella flexneri 2a str. 2457T
aacggcagaguuguucugcgac

SEQ ID NO: 1939238 - RNA, 22 nt, Shigella flexneri 2a str. 2457T
aacggaacguugccugauuuua

SEQ ID NO: 1939239 - RNA, 14 nt, Shigella flexneri 2a str. 2457T
aacggacccgcgau

SEQ ID NO: 1939240 - RNA, 17 nt, Shigella flexneri 2a str. 2457T
aacggaugcagcaucau

SEQ ID NO: 1939241 - RNA, 20 nt, Shigella flexneri 2a str. 2457T
aacggaguugagguuuuuga

SEQ ID NO: 1939242 - RNA, 15 nt, Shigella flexneri 2a str. 2457T
aacgccagcagcagc

SEQ ID NO: 1939243 - RNA, 20 nt, Shigella flexneri 2a str. 2457T
aacgccagccuguuccagac

SEQ ID NO: 1939244 - RNA, 14 nt, Shigella flexneri 2a str. 2457T
aacgccauccggca

SEQ ID NO: 1939245 - RNA, 15 nt, Shigella flexneri 2a str. 2457T
aacgccaucgccagg

SEQ ID NO: 1939246 - RNA, 22 nt, Shigella flexneri 2a str. 2457T
aacgccaauucauuccuugaaa

SEQ ID NO: 1939247 - RNA, 22 nt, Shigella flexneri 2a str. 2457T
aacgccgcuauacgccucacag

SEQ ID NO: 1939248 - RNA, 13 nt, Shigella flexneri 2a str. 2457T
aacgcccuuaccu

SEQ ID NO: 1939249 - RNA, 22 nt, Shigella flexneri 2a str. 2457T
aacgccguuauuaaaaagccug

SEQ ID NO: 1939250 - RNA, 14 nt, Shigella flexneri 2a str. 2457T
aacgccuaauaaau

SEQ ID NO: 1939251 - RNA, 15 nt, Shigella flexneri 2a str. 2457T
aacgccuaaugccag

SEQ ID NO: 1939252 - RNA, 20 nt, Shigella flexneri 2a str. 2457T
aacgccggagugaaaauucu

SEQ ID NO: 1939253 - RNA, 15 nt, Shigella flexneri 2a str. 2457T
aacgccggagagaaa

SEQ ID NO: 1939254 - RNA, 19 nt, Shigella flexneri 2a str. 2457T
aacgcgcaccgugacagua

SEQ ID NO: 1939255 - RNA, 19 nt, Shigella flexneri 2a str. 2457T
aacgcgaucgacgcgucca

SEQ ID NO: 1939256 - RNA, 15 nt, Shigella flexneri 2a str. 2457T
aacgcgaaggccaga

SEQ ID NO: 1939257 - RNA, 20 nt, Shigella flexneri 2a str. 2457T
aacgcgaaggccagaaccac

SEQ ID NO: 1939258 - RNA, 21 nt, Shigella flexneri 2a str. 2457T
aacgccuuccgucagcaaagu

SEQ ID NO: 1939259 - RNA, 12 nt, Shigella flexneri 2a str. 2457T
aacgccugggca

SEQ ID NO: 1939260 - RNA, 16 nt, Shigella flexneri 2a str. 2457T
aacgauaacggugcaa

SEQ ID NO: 1939261 - RNA, 22 nt, Shigella flexneri 2a str. 2457T
aacgaucgccugguaccagcac

SEQ ID NO: 1939262 - RNA, 16 nt, Shigella flexneri 2a str. 2457T
aacgagccaauaaaaa

SEQ ID NO: 1939263 - RNA, 15 nt, Shigella flexneri 2a str. 2457T
aacgacgcagaacug

SEQ ID NO: 1939264 - RNA, 12 nt, Shigella flexneri 2a str. 2457T
aacgaugacauc

SEQ ID NO: 1939265 - RNA, 20 nt, Shigella flexneri 2a str. 2457T
aacgcaaagagagaagccag

SEQ ID NO: 1939266 - RNA, 19 nt, Shigella flexneri 2a str. 2457T
aacgauuuggccgaagagg

SEQ ID NO: 1939267 - RNA, 21 nt, Shigella flexneri 2a str. 2457T
aacgauuuuagcaaacugauc

SEQ ID NO: 1939268 - RNA, 16 nt, Shigella flexneri 2a str. 2457T
aacgauuuuuuccgca

SEQ ID NO: 1939269 - RNA, 20 nt, Shigella flexneri 2a str. 2457T
aacgcaaacaccagcgaaug

SEQ ID NO: 1939270 - RNA, 16 nt, Shigella flexneri 2a str. 2457T
aacgcaccgccaccac

SEQ ID NO: 1939271 - RNA, 16 nt, Shigella flexneri 2a str. 2457T
aacgcacacauccaca

SEQ ID NO: 1939272 - RNA, 13 nt, Shigella flexneri 2a str. 2457T
aacgcaccaggcg

SEQ ID NO: 1939273 - RNA, 13 nt, Shigella flexneri 2a str. 2457T
aacgcaccugaaa

SEQ ID NO: 1939274 - RNA, 18 nt, Shigella flexneri 2a str. 2457T
aacgcauaccccaucagc

SEQ ID NO: 1939275 - RNA, 15 nt, Shigella flexneri 2a str. 2457T
aacgcagucuuccca

SEQ ID NO: 1939276 - RNA, 17 nt, Shigella flexneri 2a str. 2457T
aacgcagucuucccagc

SEQ ID NO: 1939277 - RNA, 17 nt, Shigella flexneri 2a str. 2457T
aacgcagcuccgggcuc

SEQ ID NO: 1939278 - RNA, 22 nt, Shigella flexneri 2a str. 2457T
aaccguaguggccacagauaau

SEQ ID NO: 1939279 - RNA, 13 nt, Shigella flexneri 2a str. 2457T
aaccgucgccggg

SEQ ID NO: 1939280 - RNA, 15 nt, Shigella flexneri 2a str. 2457T
aaccgucgagauaca

SEQ ID NO: 1939281 - RNA, 21 nt, Shigella flexneri 2a str. 2457T
aaccucacagaggucuuuucu

SEQ ID NO: 1939282 - RNA, 14 nt, Shigella flexneri 2a str. 2457T
aaccuacuuuuuaa

SEQ ID NO: 1939283 - RNA, 16 nt, Shigella flexneri 2a str. 2457T
aaccuaacgcugucgg

SEQ ID NO: 1939284 - RNA, 18 nt, Shigella flexneri 2a str. 2457T
aaccugcuccucaguuuc

SEQ ID NO: 1939285 - RNA, 18 nt, Shigella flexneri 2a str. 2457T
aaccuggauauugcggaa

SEQ ID NO: 1939286 - RNA, 18 nt, Shigella flexneri 2a str. 2457T
aaccugcggguuggcuuu

SEQ ID NO: 1939287 - RNA, 21 nt, Shigella flexneri 2a str. 2457T
aaccugccgcgucgggcauca

SEQ ID NO: 1939288 - RNA, 13 nt, Shigella flexneri 2a str. 2457T
aaccugcaaaaua

SEQ ID NO: 1939289 - RNA, 17 nt, Shigella flexneri 2a str. 2457T
aaccugauuacgcaccg

SEQ ID NO: 1939290 - RNA, 18 nt, Shigella flexneri 2a str. 2457T
aaccugaauauuaguacu

SEQ ID NO: 1939291 - RNA, 21 nt, Shigella flexneri 2a str. 2457T
aaccucagaguuaaccugaaa

SEQ ID NO: 1939292 - RNA, 15 nt, Shigella flexneri 2a str. 2457T
aacgaccagaaaugc

SEQ ID NO: 1939293 - RNA, 13 nt, Shigella flexneri 2a str. 2457T
aacgaccaucagc

SEQ ID NO: 1939294 - RNA, 18 nt, Shigella flexneri 2a str. 2457T
aacgacaaaaauaccacc

SEQ ID NO: 1939295 - RNA, 13 nt, Shigella flexneri 2a str. 2457T
aacgaaucugcaa

SEQ ID NO: 1939296 - RNA, 14 nt, Shigella flexneri 2a str. 2457T
aacgaaucugcaaa

SEQ ID NO: 1939297 - RNA, 18 nt, Shigella flexneri 2a str. 2457T
aacgaaucugcaaaucug

SEQ ID NO: 1939298 - RNA, 12 nt, Shigella flexneri 2a str. 2457T
aacgaagaaaac

SEQ ID NO: 1939299 - RNA, 16 nt, Shigella flexneri 2a str. 2457T
aacgaagcgccauuca

SEQ ID NO: 1939300 - RNA, 17 nt, Shigella flexneri 2a str. 2457T
aacgaaguaauaaucaa

SEQ ID NO: 1939301 - RNA, 15 nt, Shigella flexneri 2a str. 2457T
aacgaauaguuucag

SEQ ID NO: 1939302 - RNA, 20 nt, Shigella flexneri 2a str. 2457T
aacgaaaguuaauccacagc

SEQ ID NO: 1939303 - RNA, 19 nt, Shigella flexneri 2a str. 2457T
aaccuugccauuccacaaa

SEQ ID NO: 1939304 - RNA, 10 nt, Shigella flexneri 2a str. 2457T
aaccuuuaau

SEQ ID NO: 1939305 - RNA, 13 nt, Shigella flexneri 2a str. 2457T
aaccuuuaaucag

SEQ ID NO: 1939306 - RNA, 16 nt, Shigella flexneri 2a str. 2457T
aaccuugcuggcgauu

SEQ ID NO: 1939307 - RNA, 15 nt, Shigella flexneri 2a str. 2457T
aaccuugccauucca

SEQ ID NO: 1939308 - RNA, 18 nt, Shigella flexneri 2a str. 2457T
aaccuucuucauuaugaa

SEQ ID NO: 1939309 - RNA, 16 nt, Shigella flexneri 2a str. 2457T
aaccuuuaugcagcuc

SEQ ID NO: 1939310 - RNA, 16 nt, Shigella flexneri 2a str. 2457T
aaccuuuaaucaggcu

SEQ ID NO: 1939311 - RNA, 20 nt, Shigella flexneri 2a str. 2457T
aaccuuugcgguuaaaaaua

SEQ ID NO: 1939312 - RNA, 22 nt, Shigella flexneri 2a str. 2457T
aaccuucuucauuaugaauagc

SEQ ID NO: 1939313 - RNA, 17 nt, Shigella flexneri 2a str. 2457T
aaccugguggugcugga

SEQ ID NO: 1939314 - RNA, 17 nt, Shigella flexneri 2a str. 2457T
aaucauucgcaguugca

SEQ ID NO: 1939315 - RNA, 23 nt, Shigella flexneri 2a str. 2457T
aaucauucgccgguuccagcuuc

SEQ ID NO: 1939316 - RNA, 17 nt, Shigella flexneri 2a str. 2457T
aaucauuacaguuucgg

SEQ ID NO: 1939317 - RNA, 18 nt, Shigella flexneri 2a str. 2457T
aaucauuacaguuucgga

SEQ ID NO: 1939318 - RNA, 16 nt, Shigella flexneri 2a str. 2457T
aaucaucgcguacuca

SEQ ID NO: 1939319 - RNA, 20 nt, Shigella flexneri 2a str. 2457T
aaucaucgccuuaugcugcu

SEQ ID NO: 1939320 - RNA, 20 nt, Shigella flexneri 2a str. 2457T
aaucaucugauaucucacca

SEQ ID NO: 1939321 - RNA, 17 nt, Shigella flexneri 2a str. 2457T
aaucaugcaauaaauau

SEQ ID NO: 1939322 - RNA, 21 nt, Shigella flexneri 2a str. 2457T
aaucaggaacuggaagcugcc

SEQ ID NO: 1939323 - RNA, 22 nt, Shigella flexneri 2a str. 2457T
aaucagguaagcgauaaaaaua

SEQ ID NO: 1939324 - RNA, 21 nt, Shigella flexneri 2a str. 2457T
aauaugugaucgaauauauca

SEQ ID NO: 1939325 - RNA, 16 nt, Shigella flexneri 2a str. 2457T
aauaugucguuauaua

SEQ ID NO: 1939326 - RNA, 16 nt, Shigella flexneri 2a str. 2457T
aaucauuuuuugaagu

SEQ ID NO: 1939327 - RNA, 16 nt, Shigella flexneri 2a str. 2457T
aauccacgcgcgaaau

SEQ ID NO: 1939328 - RNA, 19 nt, Shigella flexneri 2a str. 2457T
aauccacgguuuaucggcg

SEQ ID NO: 1939329 - RNA, 14 nt, Shigella flexneri 2a str. 2457T
aauccacagcaaug

SEQ ID NO: 1939330 - RNA, 15 nt, Shigella flexneri 2a str. 2457T
aauccagaacaccau

SEQ ID NO: 1939331 - RNA, 22 nt, Shigella flexneri 2a str. 2457T
aauccagauuuauaaaagaaaa

SEQ ID NO: 1939332 - RNA, 22 nt, Shigella flexneri 2a str. 2457T
aauccaggcccgcauuaaaagu

SEQ ID NO: 1939333 - RNA, 11 nt, Shigella flexneri 2a str. 2457T
aauccagcaau

SEQ ID NO: 1939334 - RNA, 14 nt, Shigella flexneri 2a str. 2457T
aauccagcaauaau

SEQ ID NO: 1939335 - RNA, 15 nt, Shigella flexneri 2a str. 2457T
aaucccaaaauaaua

SEQ ID NO: 1939336 - RNA, 17 nt, Shigella flexneri 2a str. 2457T
aauccaguaagcugugc

SEQ ID NO: 1939337 - RNA, 20 nt, Shigella flexneri 2a str. 2457T
aauccaucccgcucuguaag

SEQ ID NO: 1939338 - RNA, 22 nt, Shigella flexneri 2a str. 2457T
aaucuacaaaagauuauugcuu

SEQ ID NO: 1939339 - RNA, 14 nt, Shigella flexneri 2a str. 2457T
aaucgucaguucac

SEQ ID NO: 1939340 - RNA, 21 nt, Shigella flexneri 2a str. 2457T
aaucgucgguguccacuuccg

SEQ ID NO: 1939341 - RNA, 22 nt, Shigella flexneri 2a str. 2457T
aaucuacgguggaacauuuacc

SEQ ID NO: 1939342 - RNA, 20 nt, Shigella flexneri 2a str. 2457T
aaucuaccgucaugcugacc

SEQ ID NO: 1939343 - RNA, 14 nt, Shigella flexneri 2a str. 2457T
aaucgcugaauauc

SEQ ID NO: 1939344 - RNA, 22 nt, Shigella flexneri 2a str. 2457T
aaucgcuucagccggaauaauc

SEQ ID NO: 1939345 - RNA, 18 nt, Shigella flexneri 2a str. 2457T
aaucggggauaagaauau

SEQ ID NO: 1939346 - RNA, 17 nt, Shigella flexneri 2a str. 2457T
aaucggugcaaaugcca

SEQ ID NO: 1939347 - RNA, 21 nt, Shigella flexneri 2a str. 2457T
aaucgccagcaaaaucaccau

SEQ ID NO: 1939348 - RNA, 19 nt, Shigella flexneri 2a str. 2457T
aaucgccacaacuucaacg

SEQ ID NO: 1939349 - RNA, 21 nt, Shigella flexneri 2a str. 2457T
aaucgcauugacgccaaaaua

SEQ ID NO: 1939350 - RNA, 22 nt, Shigella flexneri 2a str. 2457T
aaucgcauugacgccaaaauaa

SEQ ID NO: 1939351 - RNA, 17 nt, Shigella flexneri 2a str. 2457T
aauccuucacuuuugcc

SEQ ID NO: 1939352 - RNA, 22 nt, Shigella flexneri 2a str. 2457T
aauccuucacuuuugccagacg

SEQ ID NO: 1939353 - RNA, 17 nt, Shigella flexneri 2a str. 2457T
aaucgccguauaauauc

SEQ ID NO: 1939354 - RNA, 20 nt, Shigella flexneri 2a str. 2457T
aaucgccguauaauaucuuu

SEQ ID NO: 1939355 - RNA, 15 nt, Shigella flexneri 2a str. 2457T
aaucgccagcggcag

SEQ ID NO: 1939356 - RNA, 18 nt, Shigella flexneri 2a str. 2457T
aaucgccagcggcagcuc

SEQ ID NO: 1939357 - RNA, 14 nt, Shigella flexneri 2a str. 2457T
aaucgccagcggca

SEQ ID NO: 1939358 - RNA, 19 nt, Shigella flexneri 2a str. 2457T
aaucgcccagcgcguaaau

SEQ ID NO: 1939359 - RNA, 18 nt, Shigella flexneri 2a str. 2457T
aaucgcgaaauaacugcu

SEQ ID NO: 1939360 - RNA, 23 nt, Shigella flexneri 2a str. 2457T
aaucgccuuacccggaccgucuu

SEQ ID NO: 1939361 - RNA, 17 nt, Shigella flexneri 2a str. 2457T
aauccugaguuaagcaa

SEQ ID NO: 1939362 - RNA, 22 nt, Shigella flexneri 2a str. 2457T
aauccgucagcgaguugaucac

SEQ ID NO: 1939363 - RNA, 21 nt, Shigella flexneri 2a str. 2457T
aauccggugccauagacugga

SEQ ID NO: 1939364 - RNA, 13 nt, Shigella flexneri 2a str. 2457T
aauccggaagaau

SEQ ID NO: 1939365 - RNA, 17 nt, Shigella flexneri 2a str. 2457T
aauccgcccuaacaucg

SEQ ID NO: 1939366 - RNA, 18 nt, Shigella flexneri 2a str. 2457T
aauccgcuuguucaguau

SEQ ID NO: 1939367 - RNA, 20 nt, Shigella flexneri 2a str. 2457T
aaucccgccauaacggcugu

SEQ ID NO: 1939368 - RNA, 14 nt, Shigella flexneri 2a str. 2457T
aaucccacauccua

SEQ ID NO: 1939369 - RNA, 13 nt, Shigella flexneri 2a str. 2457T
aaucccagacuua

SEQ ID NO: 1939370 - RNA, 20 nt, Shigella flexneri 2a str. 2457T
aauccgcgacuggcaugccg

SEQ ID NO: 1939371 - RNA, 12 nt, Shigella flexneri 2a str. 2457T
aaucccuucgac

SEQ ID NO: 1939372 - RNA, 20 nt, Shigella flexneri 2a str. 2457T
aaucccuuagcuaauuuuug

SEQ ID NO: 1939373 - RNA, 16 nt, Shigella flexneri 2a str. 2457T
aaucccuggauuugcc

SEQ ID NO: 1939374 - RNA, 13 nt, Shigella flexneri 2a str. 2457T
aaucuguugaaau

SEQ ID NO: 1939375 - RNA, 12 nt, Shigella flexneri 2a str. 2457T
aaucuguaaauu

SEQ ID NO: 1939376 - RNA, 21 nt, Shigella flexneri 2a str. 2457T
aaucuguaacaaggugaauca

SEQ ID NO: 1939377 - RNA, 15 nt, Shigella flexneri 2a str. 2457T
aaucuauucauuuau

SEQ ID NO: 1939378 - RNA, 21 nt, Shigella flexneri 2a str. 2457T
aaucuauugcaacauguugaa

SEQ ID NO: 1939379 - RNA, 15 nt, Shigella flexneri 2a str. 2457T
aaucuauugcaacau

SEQ ID NO: 1939380 - RNA, 15 nt, Shigella flexneri 2a str. 2457T
aaucuuauaugauga

SEQ ID NO: 1939381 - RNA, 21 nt, Shigella flexneri 2a str. 2457T
aaucuuauaugaugaaacuga

SEQ ID NO: 1939382 - RNA, 11 nt, Shigella flexneri 2a str. 2457T
aaugaaaaacc

SEQ ID NO: 1939383 - RNA, 23 nt, Shigella flexneri 2a str. 2457T
aaugaaagccccaccagcaaaua

SEQ ID NO: 1939384 - RNA, 13 nt, Shigella flexneri 2a str. 2457T
aaugaacaccaaa

SEQ ID NO: 1939385 - RNA, 15 nt, Shigella flexneri 2a str. 2457T
aaugaacaccaaacc

SEQ ID NO: 1939386 - RNA, 13 nt, Shigella flexneri 2a str. 2457T
aaugaaagaggcc

SEQ ID NO: 1939387 - RNA, 14 nt, Shigella flexneri 2a str. 2457T
aaugaaaaaauaga

SEQ ID NO: 1939388 - RNA, 20 nt, Shigella flexneri 2a str. 2457T
aaugauuuugauggaagaaa

SEQ ID NO: 1939389 - RNA, 23 nt, Shigella flexneri 2a str. 2457T
aaugauuuugauggaagaaacca

SEQ ID NO: 1939390 - RNA, 16 nt, Shigella flexneri 2a str. 2457T
aaugcagcauugccug

SEQ ID NO: 1939391 - RNA, 17 nt, Shigella flexneri 2a str. 2457T
aaugauuuaaaaccacu

SEQ ID NO: 1939392 - RNA, 16 nt, Shigella flexneri 2a str. 2457T
aaugauuuacggaaau

SEQ ID NO: 1939393 - RNA, 22 nt, Shigella flexneri 2a str. 2457T
aaugauuuccugcgugacuaaa

SEQ ID NO: 1939394 - RNA, 19 nt, Shigella flexneri 2a str. 2457T
aaugagccggaccucuuuc

SEQ ID NO: 1939395 - RNA, 19 nt, Shigella flexneri 2a str. 2457T
aaugaucagcgguuuugcc

SEQ ID NO: 1939396 - RNA, 20 nt, Shigella flexneri 2a str. 2457T
aaugaucagcgguuuugcca

SEQ ID NO: 1939397 - RNA, 19 nt, Shigella flexneri 2a str. 2457T
aaugaugcccgguugcuuu

SEQ ID NO: 1939398 - RNA, 21 nt, Shigella flexneri 2a str. 2457T
aaugaugccgccagaaaugga

SEQ ID NO: 1939399 - RNA, 14 nt, Shigella flexneri 2a str. 2457T
aaugacgaugcacc

SEQ ID NO: 1939400 - RNA, 20 nt, Shigella flexneri 2a str. 2457T
aaugagauauuuaaaugauu

SEQ ID NO: 1939401 - RNA, 15 nt, Shigella flexneri 2a str. 2457T
aaugagauauuuaau

SEQ ID NO: 1939402 - RNA, 21 nt, Shigella flexneri 2a str. 2457T
aaugaaucaucguucauauau

SEQ ID NO: 1939403 - RNA, 13 nt, Shigella flexneri 2a str. 2457T
aaugaaugaugcg

SEQ ID NO: 1939404 - RNA, 12 nt, Shigella flexneri 2a str. 2457T
aaugaccgcgcc

SEQ ID NO: 1939405 - RNA, 21 nt, Shigella flexneri 2a str. 2457T
aaugccucgugcucagagcua

SEQ ID NO: 1939406 - RNA, 23 nt, Shigella flexneri 2a str. 2457T
aaugccucgugcucagagcuaca

SEQ ID NO: 1939407 - RNA, 18 nt, Shigella flexneri 2a str. 2457T
aaugccucucaaaccccg

SEQ ID NO: 1939408 - RNA, 16 nt, Shigella flexneri 2a str. 2457T
aaugccguucucuggc

SEQ ID NO: 1939409 - RNA, 16 nt, Shigella flexneri 2a str. 2457T
aaugccucagagcuaa

SEQ ID NO: 1939410 - RNA, 18 nt, Shigella flexneri 2a str. 2457T
aaugccucagagcuaacu

SEQ ID NO: 1939411 - RNA, 21 nt, Shigella flexneri 2a str. 2457T
aaugccugcacuuugugucag

SEQ ID NO: 1939412 - RNA, 18 nt, Shigella flexneri 2a str. 2457T
aaugccgucgaggaacau

SEQ ID NO: 1939413 - RNA, 18 nt, Shigella flexneri 2a str. 2457T
aaugccgguggugaccug

SEQ ID NO: 1939414 - RNA, 23 nt, Shigella flexneri 2a str. 2457T
aaugcgcccagcgucagcauaaa

SEQ ID NO: 1939415 - RNA, 14 nt, Shigella flexneri 2a str. 2457T
aaugcgcaguugca

SEQ ID NO: 1939416 - RNA, 20 nt, Shigella flexneri 2a str. 2457T
aaugcgauccugagccaguu

SEQ ID NO: 1939417 - RNA, 14 nt, Shigella flexneri 2a str. 2457T
aaugcgaaaauccu

SEQ ID NO: 1939418 - RNA, 11 nt, Shigella flexneri 2a str. 2457T
aaugcgaaaac

SEQ ID NO: 1939419 - RNA, 16 nt, Shigella flexneri 2a str. 2457T
aaugccgucaccagca

SEQ ID NO: 1939420 - RNA, 17 nt, Shigella flexneri 2a str. 2457T
aaugccuuauccgaugg

SEQ ID NO: 1939421 - RNA, 15 nt, Shigella flexneri 2a str. 2457T
aaugccuuugaaauc

SEQ ID NO: 1939422 - RNA, 21 nt, Shigella flexneri 2a str. 2457T
aaugccuuugaaaucgaacag

SEQ ID NO: 1939423 - RNA, 21 nt, Shigella flexneri 2a str. 2457T
aaugcaguuuuuaauuuucgu

SEQ ID NO: 1939424 - RNA, 22 nt, Shigella flexneri 2a str. 2457T
aaugcaucagugacaaauuccg

SEQ ID NO: 1939425 - RNA, 22 nt, Shigella flexneri 2a str. 2457T
aaugcaucgcgaccaaucacac

SEQ ID NO: 1939426 - RNA, 18 nt, Shigella flexneri 2a str. 2457T
aaugcagcguuuccagcc

SEQ ID NO: 1939427 - RNA, 19 nt, Shigella flexneri 2a str. 2457T
aaugcaggggcguccagau

SEQ ID NO: 1939428 - RNA, 15 nt, Shigella flexneri 2a str. 2457T
aaugcaguuccauau

SEQ ID NO: 1939429 - RNA, 23 nt, Shigella flexneri 2a str. 2457T
aaugcagucgcguagguaaucau

SEQ ID NO: 1939430 - RNA, 17 nt, Shigella flexneri 2a str. 2457T
aaugccacugaauaaag

SEQ ID NO: 1939431 - RNA, 13 nt, Shigella flexneri 2a str. 2457T
aaugccagauaag

SEQ ID NO: 1939432 - RNA, 14 nt, Shigella flexneri 2a str. 2457T
aaugccagauaaga

SEQ ID NO: 1939433 - RNA, 21 nt, Shigella flexneri 2a str. 2457T
aaugccaaauauuucuuuauc

SEQ ID NO: 1939434 - RNA, 21 nt, Shigella flexneri 2a str. 2457T
aaugccaaguaauagaacuau

SEQ ID NO: 1939435 - RNA, 16 nt, Shigella flexneri 2a str. 2457T
aaugccagauaagaca

SEQ ID NO: 1939436 - RNA, 22 nt, Shigella flexneri 2a str. 2457T
aauggugugcaugguguucaga

SEQ ID NO: 1939437 - RNA, 22 nt, Shigella flexneri 2a str. 2457T
aauggauuagcgaccgaacaga

SEQ ID NO: 1939438 - RNA, 17 nt, Shigella flexneri 2a str. 2457T
aauggcaggcucagacu

SEQ ID NO: 1939439 - RNA, 19 nt, Shigella flexneri 2a str. 2457T
aauggcaggcucagacuga

SEQ ID NO: 1939440 - RNA, 12 nt, Shigella flexneri 2a str. 2457T
aauggcaugcuc

SEQ ID NO: 1939441 - RNA, 17 nt, Shigella flexneri 2a str. 2457T
aauggcgcgaaaacaac

SEQ ID NO: 1939442 - RNA, 14 nt, Shigella flexneri 2a str. 2457T
aauggcgcgaaaac

SEQ ID NO: 1939443 - RNA, 19 nt, Shigella flexneri 2a str. 2457T
aauggccgucgccacaacc

SEQ ID NO: 1939444 - RNA, 19 nt, Shigella flexneri 2a str. 2457T
aaugcuuuuuccugcguca

SEQ ID NO: 1939445 - RNA, 16 nt, Shigella flexneri 2a str. 2457T
aauggaaacagcacca

SEQ ID NO: 1939446 - RNA, 13 nt, Shigella flexneri 2a str. 2457T
aaugcuuuaaaug

SEQ ID NO: 1939447 - RNA, 20 nt, Shigella flexneri 2a str. 2457T
aauggaaucgcucucagaga

SEQ ID NO: 1939448 - RNA, 17 nt, Shigella flexneri 2a str. 2457T
aauggacacuauuuccc

SEQ ID NO: 1939449 - RNA, 13 nt, Shigella flexneri 2a str. 2457T
aauggaaauuguu

SEQ ID NO: 1939450 - RNA, 17 nt, Shigella flexneri 2a str. 2457T
aauggaaagcccgcccc

SEQ ID NO: 1939451 - RNA, 17 nt, Shigella flexneri 2a str. 2457T
aauggaaacagcaccau

SEQ ID NO: 1939452 - RNA, 13 nt, Shigella flexneri 2a str. 2457T
aaugcuucuaccg

SEQ ID NO: 1939453 - RNA, 18 nt, Shigella flexneri 2a str. 2457T
aaugcgggcgaaaacauc

SEQ ID NO: 1939454 - RNA, 16 nt, Shigella flexneri 2a str. 2457T
aaugcgggugcaauca

SEQ ID NO: 1939455 - RNA, 14 nt, Shigella flexneri 2a str. 2457T
aaugcgcucagggu

SEQ ID NO: 1939456 - RNA, 19 nt, Shigella flexneri 2a str. 2457T
aaugcggagguuucuuuuu

SEQ ID NO: 1939457 - RNA, 21 nt, Shigella flexneri 2a str. 2457T
aaugcgcuguuuagcgcggca

SEQ ID NO: 1939458 - RNA, 17 nt, Shigella flexneri 2a str. 2457T
aaugcgcguaauuugcg

SEQ ID NO: 1939459 - RNA, 18 nt, Shigella flexneri 2a str. 2457T
aauucagaccauuccucu

SEQ ID NO: 1939460 - RNA, 14 nt, Shigella flexneri 2a str. 2457T
aauucacgccuucu

SEQ ID NO: 1939461 - RNA, 20 nt, Shigella flexneri 2a str. 2457T
aauucauuugaauaguuaau

SEQ ID NO: 1939462 - RNA, 21 nt, Shigella flexneri 2a str. 2457T
aauucauucaauuaauaacac

SEQ ID NO: 1939463 - RNA, 19 nt, Shigella flexneri 2a str. 2457T
aauuccacgcgccacgcac

SEQ ID NO: 1939464 - RNA, 14 nt, Shigella flexneri 2a str. 2457T
aauuccgaacaaaa

SEQ ID NO: 1939465 - RNA, 13 nt, Shigella flexneri 2a str. 2457T
aauuccgaacaaa

SEQ ID NO: 1939466 - RNA, 14 nt, Shigella flexneri 2a str. 2457T
aauucccugcgcca

SEQ ID NO: 1939467 - RNA, 23 nt, Shigella flexneri 2a str. 2457T
aauuccauuucccugacaaauca

SEQ ID NO: 1939468 - RNA, 18 nt, Shigella flexneri 2a str. 2457T
aauucccaguuacugcca

SEQ ID NO: 1939469 - RNA, 20 nt, Shigella flexneri 2a str. 2457T
aauucccgcagcuccagccc

SEQ ID NO: 1939470 - RNA, 18 nt, Shigella flexneri 2a str. 2457T
aauucccgcuucuucugc

SEQ ID NO: 1939471 - RNA, 20 nt, Shigella flexneri 2a str. 2457T
aauucucaaacgaaucugca

SEQ ID NO: 1939472 - RNA, 22 nt, Shigella flexneri 2a str. 2457T
aauucugagagcaugaaaugaa

SEQ ID NO: 1939473 - RNA, 14 nt, Shigella flexneri 2a str. 2457T
aauucuaaauguuc

SEQ ID NO: 1939474 - RNA, 16 nt, Shigella flexneri 2a str. 2457T
aauucuaaauguucaa

SEQ ID NO: 1939475 - RNA, 18 nt, Shigella flexneri 2a str. 2457T
aauucuacagaaaugaaa

SEQ ID NO: 1939476 - RNA, 22 nt, Shigella flexneri 2a str. 2457T
aauucuacagaaaugaaaaaau

SEQ ID NO: 1939477 - RNA, 15 nt, Shigella flexneri 2a str. 2457T
aauucuaauguuaaa

SEQ ID NO: 1939478 - RNA, 12 nt, Shigella flexneri 2a str. 2457T
aauucuacagaa

SEQ ID NO: 1939479 - RNA, 17 nt, Shigella flexneri 2a str. 2457T
aauucuacagaaaugaa

SEQ ID NO: 1939480 - RNA, 15 nt, Shigella flexneri 2a str. 2457T
aauucuaucaugcaa

SEQ ID NO: 1939481 - RNA, 13 nt, Shigella flexneri 2a str. 2457T
aauucgcccuucg

SEQ ID NO: 1939482 - RNA, 23 nt, Shigella flexneri 2a str. 2457T
aauucgcccuucggcaucacgaa

SEQ ID NO: 1939483 - RNA, 21 nt, Shigella flexneri 2a str. 2457T
aauuccuuucccuauuuuuuc

SEQ ID NO: 1939484 - RNA, 23 nt, Shigella flexneri 2a str. 2457T
aauucgcgucggcgucagcgcca

SEQ ID NO: 1939485 - RNA, 23 nt, Shigella flexneri 2a str. 2457T
aauucgcggauguugcugcacca

SEQ ID NO: 1939486 - RNA, 20 nt, Shigella flexneri 2a str. 2457T
aauucguaaguacauuaaaa

SEQ ID NO: 1939487 - RNA, 21 nt, Shigella flexneri 2a str. 2457T
aauuccuaugcaacaacugaa

SEQ ID NO: 1939488 - RNA, 19 nt, Shigella flexneri 2a str. 2457T
aauuccuaaccgaauucaa

SEQ ID NO: 1939489 - RNA, 21 nt, Shigella flexneri 2a str. 2457T
aauucgaaauagagaaaguaa

SEQ ID NO: 1939490 - RNA, 14 nt, Shigella flexneri 2a str. 2457T
aauucgaagcugua

SEQ ID NO: 1939491 - RNA, 16 nt, Shigella flexneri 2a str. 2457T
aauucgacuuucucug

SEQ ID NO: 1939492 - RNA, 23 nt, Shigella flexneri 2a str. 2457T
aauuacuuacaucugucugauaa

SEQ ID NO: 1939493 - RNA, 18 nt, Shigella flexneri 2a str. 2457T
aauuagcacgauuuugua

SEQ ID NO: 1939494 - RNA, 17 nt, Shigella flexneri 2a str. 2457T
aauuagcaauauuuuua

SEQ ID NO: 1939495 - RNA, 17 nt, Shigella flexneri 2a str. 2457T
aauuacacccuuaauca

SEQ ID NO: 1939496 - RNA, 22 nt, Shigella flexneri 2a str. 2457T
aauuacucccgugccagagcau

SEQ ID NO: 1939497 - RNA, 20 nt, Shigella flexneri 2a str. 2457T
aauuacugccgcuguugcaa

SEQ ID NO: 1939498 - RNA, 13 nt, Shigella flexneri 2a str. 2457T
aauuacugagcaa

SEQ ID NO: 1939499 - RNA, 15 nt, Shigella flexneri 2a str. 2457T
aauuacugcuuaaau

SEQ ID NO: 1939500 - RNA, 22 nt, Shigella flexneri 2a str. 2457T
aauuacugccuugaugaaaaaa

SEQ ID NO: 1939501 - RNA, 15 nt, Shigella flexneri 2a str. 2457T
aauuaaauuaucaac

SEQ ID NO: 1939502 - RNA, 16 nt, Shigella flexneri 2a str. 2457T
aauuaacgaaaucuca

SEQ ID NO: 1939503 - RNA, 13 nt, Shigella flexneri 2a str. 2457T
aauuaauugugaa

SEQ ID NO: 1939504 - RNA, 13 nt, Shigella flexneri 2a str. 2457T
aauuauuaccauc

SEQ ID NO: 1939505 - RNA, 12 nt, Shigella flexneri 2a str. 2457T
aauuaugaauaa

SEQ ID NO: 1939506 - RNA, 18 nt, Shigella flexneri 2a str. 2457T
aauuaugccgaucaucau

SEQ ID NO: 1939507 - RNA, 17 nt, Shigella flexneri 2a str. 2457T
aauuauagggaugcaga

SEQ ID NO: 1939508 - RNA, 18 nt, Shigella flexneri 2a str. 2457T
aauuauagggaugcagaa

SEQ ID NO: 1939509 - RNA, 19 nt, Shigella flexneri 2a str. 2457T
aauuaucucuguuuugcau

SEQ ID NO: 1939510 - RNA, 15 nt, Shigella flexneri 2a str. 2457T
aauuauuucuuuuac

SEQ ID NO: 1939511 - RNA, 11 nt, Shigella flexneri 2a str. 2457T
aauucaaugaa

SEQ ID NO: 1939512 - RNA, 18 nt, Shigella flexneri 2a str. 2457T
aauucaacgcguuuuuuc

SEQ ID NO: 1939513 - RNA, 23 nt, Shigella flexneri 2a str. 2457T
aauucaaacaguucuggaagaga

SEQ ID NO: 1939514 - RNA, 12 nt, Shigella flexneri 2a str. 2457T
aauucaaauccu

SEQ ID NO: 1939515 - RNA, 23 nt, Shigella flexneri 2a str. 2457T
aauugguauucugggaacuauau

SEQ ID NO: 1939516 - RNA, 12 nt, Shigella flexneri 2a str. 2457T
aauuguaaaucu

SEQ ID NO: 1939517 - RNA, 22 nt, Shigella flexneri 2a str. 2457T
aauuguuccgucagccgcccgc

SEQ ID NO: 1939518 - RNA, 22 nt, Shigella flexneri 2a str. 2457T
aauuguuugacuuauaagucuc

SEQ ID NO: 1939519 - RNA, 12 nt, Shigella flexneri 2a str. 2457T
aauuguuuuaua

SEQ ID NO: 1939520 - RNA, 17 nt, Shigella flexneri 2a str. 2457T
aauuguuuuugauuuug

SEQ ID NO: 1939521 - RNA, 13 nt, Shigella flexneri 2a str. 2457T
aauuuaacaccau

SEQ ID NO: 1939522 - RNA, 19 nt, Shigella flexneri 2a str. 2457T
aauuuaccgacgcugcuca

SEQ ID NO: 1939523 - RNA, 16 nt, Shigella flexneri 2a str. 2457T
aauuuacgcuuuucuu

SEQ ID NO: 1939524 - RNA, 19 nt, Shigella flexneri 2a str. 2457T
aauuuacguuuuaaaccua

SEQ ID NO: 1939525 - RNA, 17 nt, Shigella flexneri 2a str. 2457T
aauuuagugaccaauca

SEQ ID NO: 1939526 - RNA, 19 nt, Shigella flexneri 2a str. 2457T
aauuuagugaccaaucauu

SEQ ID NO: 1939527 - RNA, 23 nt, Shigella flexneri 2a str. 2457T
aauugagaaccacaaugaagaaa

SEQ ID NO: 1939528 - RNA, 22 nt, Shigella flexneri 2a str. 2457T
aauugaggcccggcguauauug

SEQ ID NO: 1939529 - RNA, 20 nt, Shigella flexneri 2a str. 2457T
aauugaaaaguccaggcugc

SEQ ID NO: 1939530 - RNA, 12 nt, Shigella flexneri 2a str. 2457T
aauucuucugaa

SEQ ID NO: 1939531 - RNA, 20 nt, Shigella flexneri 2a str. 2457T
aauucuggacgguggagcaa

SEQ ID NO: 1939532 - RNA, 18 nt, Shigella flexneri 2a str. 2457T
aauugcccgaagccaauu

SEQ ID NO: 1939533 - RNA, 13 nt, Shigella flexneri 2a str. 2457T
aauugccagcccu

SEQ ID NO: 1939534 - RNA, 18 nt, Shigella flexneri 2a str. 2457T
aauugccugauggccugc

SEQ ID NO: 1939535 - RNA, 12 nt, Shigella flexneri 2a str. 2457T
aauugccagaca

SEQ ID NO: 1939536 - RNA, 14 nt, Shigella flexneri 2a str. 2457T
aauugccagacaac

SEQ ID NO: 1939537 - RNA, 19 nt, Shigella flexneri 2a str. 2457T
aauugcauauuucaacgac

SEQ ID NO: 1939538 - RNA, 22 nt, Shigella flexneri 2a str. 2457T
aauugcacguccgguggcaucc

SEQ ID NO: 1939539 - RNA, 23 nt, Shigella flexneri 2a str. 2457T
aauugauccgcgauaagucuuug

SEQ ID NO: 1939540 - RNA, 17 nt, Shigella flexneri 2a str. 2457T
aauugcugguuuuguag

SEQ ID NO: 1939541 - RNA, 18 nt, Shigella flexneri 2a str. 2457T
aauugcucauagagcgca

SEQ ID NO: 1939542 - RNA, 22 nt, Shigella flexneri 2a str. 2457T
aauugcucaguacaggccgcac

SEQ ID NO: 1939543 - RNA, 14 nt, Shigella flexneri 2a str. 2457T
aauugcgguuuuua

SEQ ID NO: 1939544 - RNA, 19 nt, Shigella flexneri 2a str. 2457T
aauugcguaaagccugcug

SEQ ID NO: 1939545 - RNA, 22 nt, Shigella flexneri 2a str. 2457T
aauugcguaaagccugcuggca

SEQ ID NO: 1939546 - RNA, 15 nt, Shigella flexneri 2a str. 2457T
aauugcgaacugugc

SEQ ID NO: 1939547 - RNA, 16 nt, Shigella flexneri 2a str. 2457T
aauuggaauacauaua

SEQ ID NO: 1939548 - RNA, 18 nt, Shigella flexneri 2a str. 2457T
aauugcuuuuaccauacu

SEQ ID NO: 1939549 - RNA, 23 nt, Shigella flexneri 2a str. 2457T
aagggagagggauucucuuuguu

SEQ ID NO: 1939550 - RNA, 17 nt, Shigella flexneri 2a str. 2457T
aaggggacguaaagaag

SEQ ID NO: 1939551 - RNA, 15 nt, Shigella flexneri 2a str. 2457T
aagggcggcgagaaa

SEQ ID NO: 1939552 - RNA, 15 nt, Shigella flexneri 2a str. 2457T
aaggcggcagaacag

SEQ ID NO: 1939553 - RNA, 18 nt, Shigella flexneri 2a str. 2457T
aaggcggcagaacagaac

SEQ ID NO: 1939554 - RNA, 18 nt, Shigella flexneri 2a str. 2457T
aaggauugcagcacugau

SEQ ID NO: 1939555 - RNA, 16 nt, Shigella flexneri 2a str. 2457T
aaggaugagaagcuuc

SEQ ID NO: 1939556 - RNA, 14 nt, Shigella flexneri 2a str. 2457T
aaggagauaaaccg

SEQ ID NO: 1939557 - RNA, 20 nt, Shigella flexneri 2a str. 2457T
aaggcguucacgccacaucc

SEQ ID NO: 1939558 - RNA, 18 nt, Shigella flexneri 2a str. 2457T
aaggauugaucaauucua

SEQ ID NO: 1939559 - RNA, 22 nt, Shigella flexneri 2a str. 2457T
aaggucaucaaucauuuuuuga

SEQ ID NO: 1939560 - RNA, 18 nt, Shigella flexneri 2a str. 2457T
aaggucaucaaucauuuu

SEQ ID NO: 1939561 - RNA, 17 nt, Shigella flexneri 2a str. 2457T
aaggucggcuuugaaua

SEQ ID NO: 1939562 - RNA, 18 nt, Shigella flexneri 2a str. 2457T
aaggucggcuuugaauau

SEQ ID NO: 1939563 - RNA, 23 nt, Shigella flexneri 2a str. 2457T
aaggucggcuuugaauaucuccu

SEQ ID NO: 1939564 - RNA, 18 nt, Shigella flexneri 2a str. 2457T
aaggucauccaaaucgcc

SEQ ID NO: 1939565 - RNA, 13 nt, Shigella flexneri 2a str. 2457T
aaggucagacgaa

SEQ ID NO: 1939566 - RNA, 19 nt, Shigella flexneri 2a str. 2457T
aaguaccaucguccagcag

SEQ ID NO: 1939567 - RNA, 20 nt, Shigella flexneri 2a str. 2457T
aaguaccaucguccagcagc

SEQ ID NO: 1939568 - RNA, 14 nt, Shigella flexneri 2a str. 2457T
aaguaauucauuca

SEQ ID NO: 1939569 - RNA, 20 nt, Shigella flexneri 2a str. 2457T
aaguacacauaaacagguaa

SEQ ID NO: 1939570 - RNA, 22 nt, Shigella flexneri 2a str. 2457T
aaguacacauaaacagguaaag

SEQ ID NO: 1939571 - RNA, 21 nt, Shigella flexneri 2a str. 2457T
aaguagagugguuuuucaaca

SEQ ID NO: 1939572 - RNA, 19 nt, Shigella flexneri 2a str. 2457T
aaguacuucacaaucagcg

SEQ ID NO: 1939573 - RNA, 21 nt, Shigella flexneri 2a str. 2457T
aaguacucuuugaacagccag

SEQ ID NO: 1939574 - RNA, 20 nt, Shigella flexneri 2a str. 2457T
aaguauugcgcaaauguuug

SEQ ID NO: 1939575 - RNA, 19 nt, Shigella flexneri 2a str. 2457T
aaguauccacacagacaau

SEQ ID NO: 1939576 - RNA, 16 nt, Shigella flexneri 2a str. 2457T
aaguauauaaaaaaca

SEQ ID NO: 1939577 - RNA, 18 nt, Shigella flexneri 2a str. 2457T
aaguauauaaaaaacaau

SEQ ID NO: 1939578 - RNA, 19 nt, Shigella flexneri 2a str. 2457T
aaguagugauuuuaauaaa

SEQ ID NO: 1939579 - RNA, 16 nt, Shigella flexneri 2a str. 2457T
aaguagugauuuuaau

SEQ ID NO: 1939580 - RNA, 13 nt, Shigella flexneri 2a str. 2457T
aaguagccaguac

SEQ ID NO: 1939581 - RNA, 20 nt, Shigella flexneri 2a str. 2457T
aaguagccuucaucagauga

SEQ ID NO: 1939582 - RNA, 14 nt, Shigella flexneri 2a str. 2457T
aaguagccuucauc

SEQ ID NO: 1939583 - RNA, 20 nt, Shigella flexneri 2a str. 2457T
aaguccaaaagguccuucag

SEQ ID NO: 1939584 - RNA, 12 nt, Shigella flexneri 2a str. 2457T
aaguccaaaagg

SEQ ID NO: 1939585 - RNA, 16 nt, Shigella flexneri 2a str. 2457T
aagucauuaccagcga

SEQ ID NO: 1939586 - RNA, 13 nt, Shigella flexneri 2a str. 2457T
aagucaaacuggu

SEQ ID NO: 1939587 - RNA, 15 nt, Shigella flexneri 2a str. 2457T
aaguauuugacuguu

SEQ ID NO: 1939588 - RNA, 17 nt, Shigella flexneri 2a str. 2457T
aagucaggguauuaacc

SEQ ID NO: 1939589 - RNA, 19 nt, Shigella flexneri 2a str. 2457T
aaguuaucaaguauuuuua

SEQ ID NO: 1939590 - RNA, 20 nt, Shigella flexneri 2a str. 2457T
aaguuaucaaguauuuuuaa

SEQ ID NO: 1939591 - RNA, 23 nt, Shigella flexneri 2a str. 2457T
aaguuaucaaguauuuuuaauua

SEQ ID NO: 1939592 - RNA, 23 nt, Shigella flexneri 2a str. 2457T
aaguuagucgcuuucauucagaa

SEQ ID NO: 1939593 - RNA, 15 nt, Shigella flexneri 2a str. 2457T
aaguuauaaauaaaa

SEQ ID NO: 1939594 - RNA, 21 nt, Shigella flexneri 2a str. 2457T
aaguuauacagacucaaacca

SEQ ID NO: 1939595 - RNA, 17 nt, Shigella flexneri 2a str. 2457T
aagugugcaaacgauaa

SEQ ID NO: 1939596 - RNA, 15 nt, Shigella flexneri 2a str. 2457T
aagucugaaugaugu

SEQ ID NO: 1939597 - RNA, 18 nt, Shigella flexneri 2a str. 2457T
aagugagaauuuuucacu

SEQ ID NO: 1939598 - RNA, 19 nt, Shigella flexneri 2a str. 2457T
aagugcgcgcagcugcgca

SEQ ID NO: 1939599 - RNA, 23 nt, Shigella flexneri 2a str. 2457T
aagcugauucgcgacguaagaaa

SEQ ID NO: 1939600 - RNA, 13 nt, Shigella flexneri 2a str. 2457T
aagcuggaagggu

SEQ ID NO: 1939601 - RNA, 20 nt, Shigella flexneri 2a str. 2457T
aagcuggaaggguugaaaua

SEQ ID NO: 1939602 - RNA, 22 nt, Shigella flexneri 2a str. 2457T
aagcugagcacaaaacaggucg

SEQ ID NO: 1939603 - RNA, 16 nt, Shigella flexneri 2a str. 2457T
aagcuggcauugaugu

SEQ ID NO: 1939604 - RNA, 21 nt, Shigella flexneri 2a str. 2457T
aaggaaauccugccgcaguuu

SEQ ID NO: 1939605 - RNA, 13 nt, Shigella flexneri 2a str. 2457T
aaggaaaguaaau

SEQ ID NO: 1939606 - RNA, 20 nt, Shigella flexneri 2a str. 2457T
aaggacagugggauuaaaaa

SEQ ID NO: 1939607 - RNA, 18 nt, Shigella flexneri 2a str. 2457T
aaggaccaaagaaugaca

SEQ ID NO: 1939608 - RNA, 15 nt, Shigella flexneri 2a str. 2457T
aagcguuucaucuuc

SEQ ID NO: 1939609 - RNA, 17 nt, Shigella flexneri 2a str. 2457T
aagcgcauccggcacca

SEQ ID NO: 1939610 - RNA, 23 nt, Shigella flexneri 2a str. 2457T
aagcgccagauaugaucgaaaau

SEQ ID NO: 1939611 - RNA, 17 nt, Shigella flexneri 2a str. 2457T
aagcgcacaauggcggu

SEQ ID NO: 1939612 - RNA, 14 nt, Shigella flexneri 2a str. 2457T
aagcgccaucaaug

SEQ ID NO: 1939613 - RNA, 19 nt, Shigella flexneri 2a str. 2457T
aagcgccgccucagccaga

SEQ ID NO: 1939614 - RNA, 19 nt, Shigella flexneri 2a str. 2457T
aagcgccggacauugcguu

SEQ ID NO: 1939615 - RNA, 20 nt, Shigella flexneri 2a str. 2457T
aagcgccggacauugcguuu

SEQ ID NO: 1939616 - RNA, 18 nt, Shigella flexneri 2a str. 2457T
aagcgcggauuuuauuca

SEQ ID NO: 1939617 - RNA, 17 nt, Shigella flexneri 2a str. 2457T
aagcgcguguuacugga

SEQ ID NO: 1939618 - RNA, 21 nt, Shigella flexneri 2a str. 2457T
aagcggcguugcucuucuccg

SEQ ID NO: 1939619 - RNA, 14 nt, Shigella flexneri 2a str. 2457T
aagcggugaaaaaa

SEQ ID NO: 1939620 - RNA, 13 nt, Shigella flexneri 2a str. 2457T
aagccccagcagg

SEQ ID NO: 1939621 - RNA, 17 nt, Shigella flexneri 2a str. 2457T
aagccccagcaggaugu

SEQ ID NO: 1939622 - RNA, 14 nt, Shigella flexneri 2a str. 2457T
aagccccaccagca

SEQ ID NO: 1939623 - RNA, 21 nt, Shigella flexneri 2a str. 2457T
aagcccaucaguacaccaccu

SEQ ID NO: 1939624 - RNA, 15 nt, Shigella flexneri 2a str. 2457T
aagcccauaccacag

SEQ ID NO: 1939625 - RNA, 13 nt, Shigella flexneri 2a str. 2457T
aagcccucaaaca

SEQ ID NO: 1939626 - RNA, 13 nt, Shigella flexneri 2a str. 2457T
aagccgccaaacg

SEQ ID NO: 1939627 - RNA, 11 nt, Shigella flexneri 2a str. 2457T
aagcccagaac

SEQ ID NO: 1939628 - RNA, 14 nt, Shigella flexneri 2a str. 2457T
aagcccagcgacug

SEQ ID NO: 1939629 - RNA, 21 nt, Shigella flexneri 2a str. 2457T
aagccaugcccgugcugacag

SEQ ID NO: 1939630 - RNA, 14 nt, Shigella flexneri 2a str. 2457T
aagccagguuuuga

SEQ ID NO: 1939631 - RNA, 17 nt, Shigella flexneri 2a str. 2457T
aagccaguccagaaaug

SEQ ID NO: 1939632 - RNA, 14 nt, Shigella flexneri 2a str. 2457T
aagaagucucugaa

SEQ ID NO: 1939633 - RNA, 16 nt, Shigella flexneri 2a str. 2457T
aagaagucucugaaau

SEQ ID NO: 1939634 - RNA, 20 nt, Shigella flexneri 2a str. 2457T
aagaagggcuggccaauugg

SEQ ID NO: 1939635 - RNA, 14 nt, Shigella flexneri 2a str. 2457T
aagccagaauuaau

SEQ ID NO: 1939636 - RNA, 14 nt, Shigella flexneri 2a str. 2457T
aagcgauaacgcug

SEQ ID NO: 1939637 - RNA, 13 nt, Shigella flexneri 2a str. 2457T
aagcgcacaacgu

SEQ ID NO: 1939638 - RNA, 17 nt, Shigella flexneri 2a str. 2457T
aagcgauaaaaauaccg

SEQ ID NO: 1939639 - RNA, 21 nt, Shigella flexneri 2a str. 2457T
aagcgagguauuuucugaaac

SEQ ID NO: 1939640 - RNA, 18 nt, Shigella flexneri 2a str. 2457T
aagccuuccgcaaacagg

SEQ ID NO: 1939641 - RNA, 17 nt, Shigella flexneri 2a str. 2457T
aagccuucgccuuucag

SEQ ID NO: 1939642 - RNA, 21 nt, Shigella flexneri 2a str. 2457T
aagccggaugaucauccggcu

SEQ ID NO: 1939643 - RNA, 16 nt, Shigella flexneri 2a str. 2457T
aagccgcuaacagcag

SEQ ID NO: 1939644 - RNA, 17 nt, Shigella flexneri 2a str. 2457T
aagccgcuaacagcagc

SEQ ID NO: 1939645 - RNA, 17 nt, Shigella flexneri 2a str. 2457T
aagccggaugaucaucc

SEQ ID NO: 1939646 - RNA, 12 nt, Shigella flexneri 2a str. 2457T
aagccugacagg

SEQ ID NO: 1939647 - RNA, 14 nt, Shigella flexneri 2a str. 2457T
aagccgugaaucac

SEQ ID NO: 1939648 - RNA, 18 nt, Shigella flexneri 2a str. 2457T
aagccguuagucaucauc

SEQ ID NO: 1939649 - RNA, 22 nt, Shigella flexneri 2a str. 2457T
aagccguuagucaucaucagga

SEQ ID NO: 1939650 - RNA, 23 nt, Shigella flexneri 2a str. 2457T
aauauaccauggaagaaaaauau

SEQ ID NO: 1939651 - RNA, 12 nt, Shigella flexneri 2a str. 2457T
aauauacaggcg

SEQ ID NO: 1939652 - RNA, 22 nt, Shigella flexneri 2a str. 2457T
aauaguuaucaagugcuuucau

SEQ ID NO: 1939653 - RNA, 22 nt, Shigella flexneri 2a str. 2457T
aauagccgccauacggaaaauc

SEQ ID NO: 1939654 - RNA, 17 nt, Shigella flexneri 2a str. 2457T
aauagccgcagccauca

SEQ ID NO: 1939655 - RNA, 18 nt, Shigella flexneri 2a str. 2457T
aauagccugccagaggag

SEQ ID NO: 1939656 - RNA, 15 nt, Shigella flexneri 2a str. 2457T
aauagcgcaaaauua

SEQ ID NO: 1939657 - RNA, 16 nt, Shigella flexneri 2a str. 2457T
aauagcgcaaaauuau

SEQ ID NO: 1939658 - RNA, 20 nt, Shigella flexneri 2a str. 2457T
aauagcggaaaucuccagau

SEQ ID NO: 1939659 - RNA, 14 nt, Shigella flexneri 2a str. 2457T
aauagugccgcacu

SEQ ID NO: 1939660 - RNA, 21 nt, Shigella flexneri 2a str. 2457T
aauauccguagugaaaaagcu

SEQ ID NO: 1939661 - RNA, 20 nt, Shigella flexneri 2a str. 2457T
aauauccgucgaaaaugauc

SEQ ID NO: 1939662 - RNA, 17 nt, Shigella flexneri 2a str. 2457T
aauaucuguauaaccug

SEQ ID NO: 1939663 - RNA, 21 nt, Shigella flexneri 2a str. 2457T
aauaucugccggaagacacau

SEQ ID NO: 1939664 - RNA, 14 nt, Shigella flexneri 2a str. 2457T
aauaugcauuauau

SEQ ID NO: 1939665 - RNA, 14 nt, Shigella flexneri 2a str. 2457T
aauaugcauaaacc

SEQ ID NO: 1939666 - RNA, 19 nt, Shigella flexneri 2a str. 2457T
aauaugcugguuccugacu

SEQ ID NO: 1939667 - RNA, 22 nt, Shigella flexneri 2a str. 2457T
aauauggugaaaguaaaaaaga

SEQ ID NO: 1939668 - RNA, 16 nt, Shigella flexneri 2a str. 2457T
aauaugguuagagaac

SEQ ID NO: 1939669 - RNA, 23 nt, Shigella flexneri 2a str. 2457T
aauauggaacggaugcagcauca

SEQ ID NO: 1939670 - RNA, 15 nt, Shigella flexneri 2a str. 2457T
aauauccaacagguu

SEQ ID NO: 1939671 - RNA, 13 nt, Shigella flexneri 2a str. 2457T
aauaucaucauuu

SEQ ID NO: 1939672 - RNA, 20 nt, Shigella flexneri 2a str. 2457T
aauauauccgaaaaaggaua

SEQ ID NO: 1939673 - RNA, 11 nt, Shigella flexneri 2a str. 2457T
aauauauccua

SEQ ID NO: 1939674 - RNA, 19 nt, Shigella flexneri 2a str. 2457T
aauauauccgaaaaaggau

SEQ ID NO: 1939675 - RNA, 21 nt, Shigella flexneri 2a str. 2457T
aauauaucagccugaaugcuu

SEQ ID NO: 1939676 - RNA, 16 nt, Shigella flexneri 2a str. 2457T
aauaucaguuauuaca

SEQ ID NO: 1939677 - RNA, 17 nt, Shigella flexneri 2a str. 2457T
aauauauaaaaaaacaa

SEQ ID NO: 1939678 - RNA, 14 nt, Shigella flexneri 2a str. 2457T
aauauauaauuaaa

SEQ ID NO: 1939679 - RNA, 18 nt, Shigella flexneri 2a str. 2457T
aauauauaauuaaaaaua

SEQ ID NO: 1939680 - RNA, 12 nt, Shigella flexneri 2a str. 2457T
aauaccaauaau

SEQ ID NO: 1939681 - RNA, 19 nt, Shigella flexneri 2a str. 2457T
aauaccaauaaucaauuua

SEQ ID NO: 1939682 - RNA, 15 nt, Shigella flexneri 2a str. 2457T
aauaccgaagaguaa

SEQ ID NO: 1939683 - RNA, 21 nt, Shigella flexneri 2a str. 2457T
aauacccuguauaauaggaaa

SEQ ID NO: 1939684 - RNA, 15 nt, Shigella flexneri 2a str. 2457T
aauaauuuuaaauau

SEQ ID NO: 1939685 - RNA, 20 nt, Shigella flexneri 2a str. 2457T
aauacaaaauuuaacaccau

SEQ ID NO: 1939686 - RNA, 19 nt, Shigella flexneri 2a str. 2457T
aauaauuuuuucgccaacu

SEQ ID NO: 1939687 - RNA, 23 nt, Shigella flexneri 2a str. 2457T
aauacgcuggcugaacauuaaau

SEQ ID NO: 1939688 - RNA, 23 nt, Shigella flexneri 2a str. 2457T
aauacggauauucaucuccagca

SEQ ID NO: 1939689 - RNA, 20 nt, Shigella flexneri 2a str. 2457T
aauacgcucgaacagcuggu

SEQ ID NO: 1939690 - RNA, 14 nt, Shigella flexneri 2a str. 2457T
aauaccuucuuccu

SEQ ID NO: 1939691 - RNA, 18 nt, Shigella flexneri 2a str. 2457T
aauaccugaccguuaauu

SEQ ID NO: 1939692 - RNA, 22 nt, Shigella flexneri 2a str. 2457T
aauaccguucauuaacgcccca

SEQ ID NO: 1939693 - RNA, 18 nt, Shigella flexneri 2a str. 2457T
aauaccguaauauuuaaa

SEQ ID NO: 1939694 - RNA, 15 nt, Shigella flexneri 2a str. 2457T
aauaccgauaucgcc

SEQ ID NO: 1939695 - RNA, 15 nt, Shigella flexneri 2a str. 2457T
aauaccgacaucacg

SEQ ID NO: 1939696 - RNA, 14 nt, Shigella flexneri 2a str. 2457T
aauaccgcccacca

SEQ ID NO: 1939697 - RNA, 14 nt, Shigella flexneri 2a str. 2457T
aauaccgcccagac

SEQ ID NO: 1939698 - RNA, 18 nt, Shigella flexneri 2a str. 2457T
aauacuuucacaaaaaua

SEQ ID NO: 1939699 - RNA, 15 nt, Shigella flexneri 2a str. 2457T
aauacugaucaucau

SEQ ID NO: 1939700 - RNA, 22 nt, Shigella flexneri 2a str. 2457T
aauacugaagucgaacuucucu

SEQ ID NO: 1939701 - RNA, 17 nt, Shigella flexneri 2a str. 2457T
aauacugacaucagcau

SEQ ID NO: 1939702 - RNA, 22 nt, Shigella flexneri 2a str. 2457T
aauagcaacugauuuauagauu

SEQ ID NO: 1939703 - RNA, 16 nt, Shigella flexneri 2a str. 2457T
aauagcaacugauuua

SEQ ID NO: 1939704 - RNA, 21 nt, Shigella flexneri 2a str. 2457T
aauagagugguuagagcacag

SEQ ID NO: 1939705 - RNA, 20 nt, Shigella flexneri 2a str. 2457T
aauagccagcagagcaaaaa

SEQ ID NO: 1939706 - RNA, 21 nt, Shigella flexneri 2a str. 2457T
aauagccagcagagcaaaaau

SEQ ID NO: 1939707 - RNA, 17 nt, Shigella flexneri 2a str. 2457T
aauagccacauugcugc

SEQ ID NO: 1939708 - RNA, 24 nt, Shigella flexneri 2a str. 2457T
aauaaccagcguuuccagcaccag

SEQ ID NO: 1939709 - RNA, 14 nt, Shigella flexneri 2a str. 2457T
aauaaccaucagcu

SEQ ID NO: 1939710 - RNA, 19 nt, Shigella flexneri 2a str. 2457T
aauaaccauggcagaagca

SEQ ID NO: 1939711 - RNA, 15 nt, Shigella flexneri 2a str. 2457T
aauaaccaaauaaaa

SEQ ID NO: 1939712 - RNA, 20 nt, Shigella flexneri 2a str. 2457T
aauaaccaacggcgagccag

SEQ ID NO: 1939713 - RNA, 16 nt, Shigella flexneri 2a str. 2457T
aauaacaucgccagaa

SEQ ID NO: 1939714 - RNA, 22 nt, Shigella flexneri 2a str. 2457T
aauaacagggaaugugaugaaa

SEQ ID NO: 1939715 - RNA, 23 nt, Shigella flexneri 2a str. 2457T
aauaacagggaaugugaugaaaa

SEQ ID NO: 1939716 - RNA, 16 nt, Shigella flexneri 2a str. 2457T
aauaacccgcuguaaa

SEQ ID NO: 1939717 - RNA, 20 nt, Shigella flexneri 2a str. 2457T
aauaacccgcuguaaaugcu

SEQ ID NO: 1939718 - RNA, 22 nt, Shigella flexneri 2a str. 2457T
aauaacccgcuguaaaugcugc

SEQ ID NO: 1939719 - RNA, 17 nt, Shigella flexneri 2a str. 2457T
aauaaccgcugcaaaaa

SEQ ID NO: 1939720 - RNA, 18 nt, Shigella flexneri 2a str. 2457T
aauaaccgcugcaaaaaa

SEQ ID NO: 1939721 - RNA, 21 nt, Shigella flexneri 2a str. 2457T
aauaacgccggagagaaaaac

SEQ ID NO: 1939722 - RNA, 15 nt, Shigella flexneri 2a str. 2457T
aauaacugcuauuca

SEQ ID NO: 1939723 - RNA, 19 nt, Shigella flexneri 2a str. 2457T
aauaacggcucaaacugcu

SEQ ID NO: 1939724 - RNA, 13 nt, Shigella flexneri 2a str. 2457T
aauaaauuugguu

SEQ ID NO: 1939725 - RNA, 18 nt, Shigella flexneri 2a str. 2457T
aauaaauuugguucaauu

SEQ ID NO: 1939726 - RNA, 15 nt, Shigella flexneri 2a str. 2457T
aauaaaucuaaaaga

SEQ ID NO: 1939727 - RNA, 12 nt, Shigella flexneri 2a str. 2457T
aauaaaugccac

SEQ ID NO: 1939728 - RNA, 20 nt, Shigella flexneri 2a str. 2457T
aauaaauaugggugcaauga

SEQ ID NO: 1939729 - RNA, 15 nt, Shigella flexneri 2a str. 2457T
aauaaauauuaauac

SEQ ID NO: 1939730 - RNA, 18 nt, Shigella flexneri 2a str. 2457T
aauaaauauuaauacaac

SEQ ID NO: 1939731 - RNA, 22 nt, Shigella flexneri 2a str. 2457T
aauaaaucaaagucagaucaau

SEQ ID NO: 1939732 - RNA, 17 nt, Shigella flexneri 2a str. 2457T
aaguugcucaagcugaa

SEQ ID NO: 1939733 - RNA, 18 nt, Shigella flexneri 2a str. 2457T
aaguugccggauguguug

SEQ ID NO: 1939734 - RNA, 18 nt, Shigella flexneri 2a str. 2457T
aaguugcgaaagcgagca

SEQ ID NO: 1939735 - RNA, 17 nt, Shigella flexneri 2a str. 2457T
aaguuccuguaaagagu

SEQ ID NO: 1939736 - RNA, 22 nt, Shigella flexneri 2a str. 2457T
aauaaucaccacacaaccgagg

SEQ ID NO: 1939737 - RNA, 14 nt, Shigella flexneri 2a str. 2457T
aauaaucaccacac

SEQ ID NO: 1939738 - RNA, 19 nt, Shigella flexneri 2a str. 2457T
aauaagccaaauccagcgc

SEQ ID NO: 1939739 - RNA, 22 nt, Shigella flexneri 2a str. 2457T
aauaagccccuuucgaaaucau

SEQ ID NO: 1939740 - RNA, 15 nt, Shigella flexneri 2a str. 2457T
aauaagcuauaaaaa

SEQ ID NO: 1939741 - RNA, 16 nt, Shigella flexneri 2a str. 2457T
aauaaggccaugcugc

SEQ ID NO: 1939742 - RNA, 13 nt, Shigella flexneri 2a str. 2457T
aauaagguuaauu

SEQ ID NO: 1939743 - RNA, 19 nt, Shigella flexneri 2a str. 2457T
aauaaguccgaacuaaaga

SEQ ID NO: 1939744 - RNA, 23 nt, Shigella flexneri 2a str. 2457T
aauaaguuaucaaguauuuuuaa

SEQ ID NO: 1939745 - RNA, 12 nt, Shigella flexneri 2a str. 2457T
aauaaugcagau

SEQ ID NO: 1939746 - RNA, 15 nt, Shigella flexneri 2a str. 2457T
aauaauggccuuuuc

SEQ ID NO: 1939747 - RNA, 19 nt, Shigella flexneri 2a str. 2457T
aauaauggccuuuucgcca

SEQ ID NO: 1939748 - RNA, 20 nt, Shigella flexneri 2a str. 2457T
aauaaugcgacaacagaaau

SEQ ID NO: 1939749 - RNA, 21 nt, Shigella flexneri 2a str. 2457T
aauaaugcgacaacagaaaua

SEQ ID NO: 1939750 - RNA, 23 nt, Shigella flexneri 2a str. 2457T
aauaaugaucaguggaagacguu

SEQ ID NO: 1939751 - RNA, 14 nt, Shigella flexneri 2a str. 2457T
aauaaugagcagaa

SEQ ID NO: 1939752 - RNA, 19 nt, Shigella flexneri 2a str. 2457T
aauaaucccgcgcaacaaa

SEQ ID NO: 1939753 - RNA, 22 nt, Shigella flexneri 2a str. 2457T
aauaaucgcgcuaauuccaguc

SEQ ID NO: 1939754 - RNA, 16 nt, Shigella flexneri 2a str. 2457T
aauaaucucuacacca

SEQ ID NO: 1939755 - RNA, 18 nt, Shigella flexneri 2a str. 2457T
aauaaucguaaucagcau

SEQ ID NO: 1939756 - RNA, 15 nt, Shigella flexneri 2a str. 2457T
aauaaucucuacacc

SEQ ID NO: 1939757 - RNA, 18 nt, Shigella flexneri 2a str. 2457T
aauaaucgggaauacaga

SEQ ID NO: 1939758 - RNA, 22 nt, Shigella flexneri 2a str. 2457T
aauaaucgggaauacagaaaau

SEQ ID NO: 1939759 - RNA, 14 nt, Shigella flexneri 2a str. 2457T
aauaaucguaauca

SEQ ID NO: 1939760 - RNA, 15 nt, Shigella flexneri 2a str. 2457T
aauaaugucuuuaau

SEQ ID NO: 1939761 - RNA, 15 nt, Shigella flexneri 2a str. 2457T
aauaauuauccugug

SEQ ID NO: 1939762 - RNA, 16 nt, Shigella flexneri 2a str. 2457T
aauaauucaaaaaccu

SEQ ID NO: 1939763 - RNA, 21 nt, Shigella flexneri 2a str. 2457T
uuggugauaaaacgcagucuu

SEQ ID NO: 1939764 - RNA, 16 nt, Shigella flexneri 2a str. 2457T
uuggugaaaaaaugau

SEQ ID NO: 1939765 - RNA, 16 nt, Shigella flexneri 2a str. 2457T
uuggucucaagcaagu

SEQ ID NO: 1939766 - RNA, 17 nt, Shigella flexneri 2a str. 2457T
uugguucaucgugcugu

SEQ ID NO: 1939767 - RNA, 14 nt, Shigella flexneri 2a str. 2457T
uuggugcuuuugcu

SEQ ID NO: 1939768 - RNA, 13 nt, Shigella flexneri 2a str. 2457T
uugguaaugacuc

SEQ ID NO: 1939769 - RNA, 16 nt, Shigella flexneri 2a str. 2457T
uugguacauaacacaa

SEQ ID NO: 1939770 - RNA, 13 nt, Shigella flexneri 2a str. 2457T
uuggguauucauu

SEQ ID NO: 1939771 - RNA, 15 nt, Shigella flexneri 2a str. 2457T
uugggugacaaucac

SEQ ID NO: 1939772 - RNA, 21 nt, Shigella flexneri 2a str. 2457T
uuggcaucguauuucagaccu

SEQ ID NO: 1939773 - RNA, 16 nt, Shigella flexneri 2a str. 2457T
uuggccgaagaggaac

SEQ ID NO: 1939774 - RNA, 20 nt, Shigella flexneri 2a str. 2457T
uuggcccgacgcuugaagca

SEQ ID NO: 1939775 - RNA, 23 nt, Shigella flexneri 2a str. 2457T
uuggcgcgaaccaucaccucuuc

SEQ ID NO: 1939776 - RNA, 16 nt, Shigella flexneri 2a str. 2457T
uuggcgcaauagcacu

SEQ ID NO: 1939777 - RNA, 16 nt, Shigella flexneri 2a str. 2457T
uuggccugacagguga

SEQ ID NO: 1939778 - RNA, 18 nt, Shigella flexneri 2a str. 2457T
uuggcucuucgcuccagu

SEQ ID NO: 1939779 - RNA, 12 nt, Shigella flexneri 2a str. 2457T
uuggcuggcccu

SEQ ID NO: 1939780 - RNA, 14 nt, Shigella flexneri 2a str. 2457T
uugcugguuuugua

SEQ ID NO: 1939781 - RNA, 12 nt, Shigella flexneri 2a str. 2457T
uugcuguacaua

SEQ ID NO: 1939782 - RNA, 21 nt, Shigella flexneri 2a str. 2457T
uugcuauuuccaccucccccu

SEQ ID NO: 1939783 - RNA, 16 nt, Shigella flexneri 2a str. 2457T
uugcucaaauccauca

SEQ ID NO: 1939784 - RNA, 14 nt, Shigella flexneri 2a str. 2457T
uugcuauggggaaa

SEQ ID NO: 1939785 - RNA, 21 nt, Shigella flexneri 2a str. 2457T
uugcuggacgcauugcauuuc

SEQ ID NO: 1939786 - RNA, 20 nt, Shigella flexneri 2a str. 2457T
uugcguacaccaacaucacg

SEQ ID NO: 1939787 - RNA, 15 nt, Shigella flexneri 2a str. 2457T
uugcgguuucaacug

SEQ ID NO: 1939788 - RNA, 18 nt, Shigella flexneri 2a str. 2457T
uugcuaacuggaaaggaa

SEQ ID NO: 1939789 - RNA, 18 nt, Shigella flexneri 2a str. 2457T
uugcuucaagaugccauu

SEQ ID NO: 1939790 - RNA, 23 nt, Shigella flexneri 2a str. 2457T
uugcuucaauacgcuccaguacc

SEQ ID NO: 1939791 - RNA, 15 nt, Shigella flexneri 2a str. 2457T
uugcugugcuuuaca

SEQ ID NO: 1939792 - RNA, 14 nt, Shigella flexneri 2a str. 2457T
uugcuguugguuca

SEQ ID NO: 1939793 - RNA, 17 nt, Shigella flexneri 2a str. 2457T
uugcuuuugauguuuga

SEQ ID NO: 1939794 - RNA, 12 nt, Shigella flexneri 2a str. 2457T
uugcuuugcaac

SEQ ID NO: 1939795 - RNA, 13 nt, Shigella flexneri 2a str. 2457T
uugcuuuccagcu

SEQ ID NO: 1939796 - RNA, 18 nt, Shigella flexneri 2a str. 2457T
uugcuucuaugaguggaa

SEQ ID NO: 1939797 - RNA, 16 nt, Shigella flexneri 2a str. 2457T
uugcuucguuuacugu

SEQ ID NO: 1939798 - RNA, 12 nt, Shigella flexneri 2a str. 2457T
uugcuucugcuu

SEQ ID NO: 1939799 - RNA, 13 nt, Shigella flexneri 2a str. 2457T
uugcuucugcuuc

SEQ ID NO: 1939800 - RNA, 14 nt, Shigella flexneri 2a str. 2457T
uuggcaaauacaaa

SEQ ID NO: 1939801 - RNA, 14 nt, Shigella flexneri 2a str. 2457T
uuggcaccaucccu

SEQ ID NO: 1939802 - RNA, 19 nt, Shigella flexneri 2a str. 2457T
uuggcaucgauaucaacca

SEQ ID NO: 1939803 - RNA, 23 nt, Shigella flexneri 2a str. 2457T
uuggcagagcaacauacagugga

SEQ ID NO: 1939804 - RNA, 13 nt, Shigella flexneri 2a str. 2457T
uuggaauacauau

SEQ ID NO: 1939805 - RNA, 12 nt, Shigella flexneri 2a str. 2457T
uugccauaucuu

SEQ ID NO: 1939806 - RNA, 10 nt, Shigella flexneri 2a str. 2457T
uugccaggac

SEQ ID NO: 1939807 - RNA, 24 nt, Shigella flexneri 2a str. 2457T
uugccaugcaauauuguagcaacu

SEQ ID NO: 1939808 - RNA, 21 nt, Shigella flexneri 2a str. 2457T
uugccaugcauauccaggcua

SEQ ID NO: 1939809 - RNA, 20 nt, Shigella flexneri 2a str. 2457T
uugccaucaaucacuuugcg

SEQ ID NO: 1939810 - RNA, 20 nt, Shigella flexneri 2a str. 2457T
uugccgucgauaugcaaauc

SEQ ID NO: 1939811 - RNA, 18 nt, Shigella flexneri 2a str. 2457T
uugccgugccccauaugg

SEQ ID NO: 1939812 - RNA, 13 nt, Shigella flexneri 2a str. 2457T
uugccguaagcaa

SEQ ID NO: 1939813 - RNA, 16 nt, Shigella flexneri 2a str. 2457T
uugccguauacacacu

SEQ ID NO: 1939814 - RNA, 13 nt, Shigella flexneri 2a str. 2457T
uugccguugaucu

SEQ ID NO: 1939815 - RNA, 15 nt, Shigella flexneri 2a str. 2457T
uugccguucuucccg

SEQ ID NO: 1939816 - RNA, 21 nt, Shigella flexneri 2a str. 2457T
uugcgaacgcguucacugccg

SEQ ID NO: 1939817 - RNA, 15 nt, Shigella flexneri 2a str. 2457T
uugcgcgacuuuuuc

SEQ ID NO: 1939818 - RNA, 18 nt, Shigella flexneri 2a str. 2457T
uugcgauauucuucagua

SEQ ID NO: 1939819 - RNA, 13 nt, Shigella flexneri 2a str. 2457T
uugcggcacccau

SEQ ID NO: 1939820 - RNA, 17 nt, Shigella flexneri 2a str. 2457T
uugcgcuaaaaaguucc

SEQ ID NO: 1939821 - RNA, 20 nt, Shigella flexneri 2a str. 2457T
uugcggaaauuccagcggca

SEQ ID NO: 1939822 - RNA, 11 nt, Shigella flexneri 2a str. 2457T
uugcaguuccu

SEQ ID NO: 1939823 - RNA, 21 nt, Shigella flexneri 2a str. 2457T
uugcaguuccugccagauuug

SEQ ID NO: 1939824 - RNA, 16 nt, Shigella flexneri 2a str. 2457T
uugcaucccagaaaaa

SEQ ID NO: 1939825 - RNA, 17 nt, Shigella flexneri 2a str. 2457T
uugcaucccagaaaaaa

SEQ ID NO: 1939826 - RNA, 17 nt, Shigella flexneri 2a str. 2457T
uugcauccggcauggca

SEQ ID NO: 1939827 - RNA, 16 nt, Shigella flexneri 2a str. 2457T
uugcaucgcuugaaaa

SEQ ID NO: 1939828 - RNA, 22 nt, Shigella flexneri 2a str. 2457T
uugcaucgucuguuuuaucucc

SEQ ID NO: 1939829 - RNA, 23 nt, Shigella flexneri 2a str. 2457T
uugccaccgguacaaacaucauc

SEQ ID NO: 1939830 - RNA, 23 nt, Shigella flexneri 2a str. 2457T
uugcauuacuacgguaauacaac

SEQ ID NO: 1939831 - RNA, 21 nt, Shigella flexneri 2a str. 2457T
uugccaccgguacaaacauca

SEQ ID NO: 1939832 - RNA, 23 nt, Shigella flexneri 2a str. 2457T
uugcauuagcacaaacccagggc

SEQ ID NO: 1939833 - RNA, 21 nt, Shigella flexneri 2a str. 2457T
uugccagagcagcaacaagcc

SEQ ID NO: 1939834 - RNA, 14 nt, Shigella flexneri 2a str. 2457T
uugcaggaaaaacu

SEQ ID NO: 1939835 - RNA, 19 nt, Shigella flexneri 2a str. 2457T
uugcaggaaaaacugcccg

SEQ ID NO: 1939836 - RNA, 22 nt, Shigella flexneri 2a str. 2457T
uugcaggggagcgaauacuccc

SEQ ID NO: 1939837 - RNA, 22 nt, Shigella flexneri 2a str. 2457T
uugcagggaggcaagacaugcu

SEQ ID NO: 1939838 - RNA, 12 nt, Shigella flexneri 2a str. 2457T
uugcaggcuauu

SEQ ID NO: 1939839 - RNA, 23 nt, Shigella flexneri 2a str. 2457T
uugcaggcgauccuguucaaaca

SEQ ID NO: 1939840 - RNA, 21 nt, Shigella flexneri 2a str. 2457T
uugcaggucguccugcaaagc

SEQ ID NO: 1939841 - RNA, 14 nt, Shigella flexneri 2a str. 2457T
uugcagguucugcu

SEQ ID NO: 1939842 - RNA, 17 nt, Shigella flexneri 2a str. 2457T
uugcagcacacauuaua

SEQ ID NO: 1939843 - RNA, 16 nt, Shigella flexneri 2a str. 2457T
uugcagauaccacauc

SEQ ID NO: 1939844 - RNA, 19 nt, Shigella flexneri 2a str. 2457T
uugcagaggugcugaaagg

SEQ ID NO: 1939845 - RNA, 12 nt, Shigella flexneri 2a str. 2457T
uugcagaaacau

SEQ ID NO: 1939846 - RNA, 18 nt, Shigella flexneri 2a str. 2457T
uugaucgcaccuuaucga

SEQ ID NO: 1939847 - RNA, 16 nt, Shigella flexneri 2a str. 2457T
uugaucgccaaagaaa

SEQ ID NO: 1939848 - RNA, 13 nt, Shigella flexneri 2a str. 2457T
uugaucucaaacg

SEQ ID NO: 1939849 - RNA, 13 nt, Shigella flexneri 2a str. 2457T
uugauagcaauac

SEQ ID NO: 1939850 - RNA, 13 nt, Shigella flexneri 2a str. 2457T
uugauacugaaca

SEQ ID NO: 1939851 - RNA, 13 nt, Shigella flexneri 2a str. 2457T
uugauacgagagc

SEQ ID NO: 1939852 - RNA, 13 nt, Shigella flexneri 2a str. 2457T
uugauaauguuau

SEQ ID NO: 1939853 - RNA, 13 nt, Shigella flexneri 2a str. 2457T
uugauuuaucagg

SEQ ID NO: 1939854 - RNA, 23 nt, Shigella flexneri 2a str. 2457T
uugauuauuggacgguaaaaaga

SEQ ID NO: 1939855 - RNA, 13 nt, Shigella flexneri 2a str. 2457T
uugauuaaaggaa

SEQ ID NO: 1939856 - RNA, 22 nt, Shigella flexneri 2a str. 2457T
uugauuaccaauaucaaauaaa

SEQ ID NO: 1939857 - RNA, 17 nt, Shigella flexneri 2a str. 2457T
uugauuacagcuggagu

SEQ ID NO: 1939858 - RNA, 22 nt, Shigella flexneri 2a str. 2457T
uugaugugaaaacucuuagcaa

SEQ ID NO: 1939859 - RNA, 13 nt, Shigella flexneri 2a str. 2457T
uugaugguaaaau

SEQ ID NO: 1939860 - RNA, 17 nt, Shigella flexneri 2a str. 2457T
uugauguccaguuccca

SEQ ID NO: 1939861 - RNA, 15 nt, Shigella flexneri 2a str. 2457T
uugaggcacaucuua

SEQ ID NO: 1939862 - RNA, 20 nt, Shigella flexneri 2a str. 2457T
uugagccaaaaugccugaug

SEQ ID NO: 1939863 - RNA, 20 nt, Shigella flexneri 2a str. 2457T
uucuuggcacccagcgcuuu

SEQ ID NO: 1939864 - RNA, 22 nt, Shigella flexneri 2a str. 2457T
uuuauaucugguuugccacguu

SEQ ID NO: 1939865 - RNA, 18 nt, Shigella flexneri 2a str. 2457T
uuuauauuacgaauauaa

SEQ ID NO: 1939866 - RNA, 13 nt, Shigella flexneri 2a str. 2457T
uuuagcauaaaaa

SEQ ID NO: 1939867 - RNA, 12 nt, Shigella flexneri 2a str. 2457T
uuuaucaggcca

SEQ ID NO: 1939868 - RNA, 21 nt, Shigella flexneri 2a str. 2457T
uuuaucagaccgcuucugcgu

SEQ ID NO: 1939869 - RNA, 22 nt, Shigella flexneri 2a str. 2457T
uuuaucccaaccuaaaaaguua

SEQ ID NO: 1939870 - RNA, 15 nt, Shigella flexneri 2a str. 2457T
uuuaucccaauuauc

SEQ ID NO: 1939871 - RNA, 16 nt, Shigella flexneri 2a str. 2457T
uuuaucaucacccaac

SEQ ID NO: 1939872 - RNA, 15 nt, Shigella flexneri 2a str. 2457T
uuuaugggagauuuu

SEQ ID NO: 1939873 - RNA, 16 nt, Shigella flexneri 2a str. 2457T
uuuaugggagauuuua

SEQ ID NO: 1939874 - RNA, 21 nt, Shigella flexneri 2a str. 2457T
uuuaugggcacggugcggggu

SEQ ID NO: 1939875 - RNA, 19 nt, Shigella flexneri 2a str. 2457T
uuuaugccggaucaggcgu

SEQ ID NO: 1939876 - RNA, 13 nt, Shigella flexneri 2a str. 2457T
uuuaugauauuuu

SEQ ID NO: 1939877 - RNA, 15 nt, Shigella flexneri 2a str. 2457T
uuuaugauauuuuuu

SEQ ID NO: 1939878 - RNA, 13 nt, Shigella flexneri 2a str. 2457T
uuuaucuucccag

SEQ ID NO: 1939879 - RNA, 15 nt, Shigella flexneri 2a str. 2457T
uuuaucggucuuagc

SEQ ID NO: 1939880 - RNA, 20 nt, Shigella flexneri 2a str. 2457T
uuuaucgaucacauccagua

SEQ ID NO: 1939881 - RNA, 20 nt, Shigella flexneri 2a str. 2457T
uuuaucugugaacucaggcu

SEQ ID NO: 1939882 - RNA, 18 nt, Shigella flexneri 2a str. 2457T
uuuaucucuuacagaaau

SEQ ID NO: 1939883 - RNA, 17 nt, Shigella flexneri 2a str. 2457T
uuuauggucguuugccu

SEQ ID NO: 1939884 - RNA, 14 nt, Shigella flexneri 2a str. 2457T
uuuauguucagaua

SEQ ID NO: 1939885 - RNA, 15 nt, Shigella flexneri 2a str. 2457T
uuuauuaauucuaaa

SEQ ID NO: 1939886 - RNA, 14 nt, Shigella flexneri 2a str. 2457T
uuuauuaagaauuu

SEQ ID NO: 1939887 - RNA, 23 nt, Shigella flexneri 2a str. 2457T
uuuauuaauccagggaucaacau

SEQ ID NO: 1939888 - RNA, 22 nt, Shigella flexneri 2a str. 2457T
uuuauuaacucagcauuauuuu

SEQ ID NO: 1939889 - RNA, 22 nt, Shigella flexneri 2a str. 2457T
uuuauucuugacgccauuuuuu

SEQ ID NO: 1939890 - RNA, 16 nt, Shigella flexneri 2a str. 2457T
uuuauugacauguuga

SEQ ID NO: 1939891 - RNA, 18 nt, Shigella flexneri 2a str. 2457T
uuuauugccaucuaaaug

SEQ ID NO: 1939892 - RNA, 22 nt, Shigella flexneri 2a str. 2457T
uuuauuuugcgagcagcauucc

SEQ ID NO: 1939893 - RNA, 22 nt, Shigella flexneri 2a str. 2457T
uuuauuguuaaguuuaucccaa

SEQ ID NO: 1939894 - RNA, 18 nt, Shigella flexneri 2a str. 2457T
uuuaauggcgacauaaaa

SEQ ID NO: 1939895 - RNA, 22 nt, Shigella flexneri 2a str. 2457T
uuuacaugcgcgacaaaaauua

SEQ ID NO: 1939896 - RNA, 20 nt, Shigella flexneri 2a str. 2457T
uuuaccugcuuaaucauauu

SEQ ID NO: 1939897 - RNA, 16 nt, Shigella flexneri 2a str. 2457T
uuuaccucgaaaacca

SEQ ID NO: 1939898 - RNA, 18 nt, Shigella flexneri 2a str. 2457T
uuuaccugcgccggucac

SEQ ID NO: 1939899 - RNA, 15 nt, Shigella flexneri 2a str. 2457T
uuuaccucuuucuca

SEQ ID NO: 1939900 - RNA, 11 nt, Shigella flexneri 2a str. 2457T
uuuacccuucg

SEQ ID NO: 1939901 - RNA, 18 nt, Shigella flexneri 2a str. 2457T
uuuaccgcaacucauuua

SEQ ID NO: 1939902 - RNA, 21 nt, Shigella flexneri 2a str. 2457T
uuuaccguagcguucuuugag

SEQ ID NO: 1939903 - RNA, 17 nt, Shigella flexneri 2a str. 2457T
uuuaccggugccagcaa

SEQ ID NO: 1939904 - RNA, 23 nt, Shigella flexneri 2a str. 2457T
uuuaccggucaggauuuccagcu

SEQ ID NO: 1939905 - RNA, 11 nt, Shigella flexneri 2a str. 2457T
uuuacuuugcu

SEQ ID NO: 1939906 - RNA, 11 nt, Shigella flexneri 2a str. 2457T
uuuagaaaaac

SEQ ID NO: 1939907 - RNA, 16 nt, Shigella flexneri 2a str. 2457T
uuuagaaaaacuuaau

SEQ ID NO: 1939908 - RNA, 16 nt, Shigella flexneri 2a str. 2457T
uuuacuuacuucagca

SEQ ID NO: 1939909 - RNA, 13 nt, Shigella flexneri 2a str. 2457T
uuuacuucucagc

SEQ ID NO: 1939910 - RNA, 17 nt, Shigella flexneri 2a str. 2457T
uuuacggcugcauuaug

SEQ ID NO: 1939911 - RNA, 12 nt, Shigella flexneri 2a str. 2457T
uuuaaucaccug

SEQ ID NO: 1939912 - RNA, 13 nt, Shigella flexneri 2a str. 2457T
uuuaaucacacca

SEQ ID NO: 1939913 - RNA, 23 nt, Shigella flexneri 2a str. 2457T
uuuaauaaucucgccuuaucaga

SEQ ID NO: 1939914 - RNA, 19 nt, Shigella flexneri 2a str. 2457T
uuuaagcuggguaaaugca

SEQ ID NO: 1939915 - RNA, 18 nt, Shigella flexneri 2a str. 2457T
uuuaaggguauuuuucua

SEQ ID NO: 1939916 - RNA, 14 nt, Shigella flexneri 2a str. 2457T
uugucgauuuccau

SEQ ID NO: 1939917 - RNA, 18 nt, Shigella flexneri 2a str. 2457T
uugucgaaguuaccaccc

SEQ ID NO: 1939918 - RNA, 15 nt, Shigella flexneri 2a str. 2457T
uuguauccuguuuuu

SEQ ID NO: 1939919 - RNA, 18 nt, Shigella flexneri 2a str. 2457T
uuguaugcguuucacaau

SEQ ID NO: 1939920 - RNA, 15 nt, Shigella flexneri 2a str. 2457T
uugucaagauugaua

SEQ ID NO: 1939921 - RNA, 12 nt, Shigella flexneri 2a str. 2457T
uugucaauaauc

SEQ ID NO: 1939922 - RNA, 21 nt, Shigella flexneri 2a str. 2457T
uugucagcaaucugauugaca

SEQ ID NO: 1939923 - RNA, 16 nt, Shigella flexneri 2a str. 2457T
uugucauaaccaaugu

SEQ ID NO: 1939924 - RNA, 15 nt, Shigella flexneri 2a str. 2457T
uuguacuuuccagcc

SEQ ID NO: 1939925 - RNA, 14 nt, Shigella flexneri 2a str. 2457T
uuguagauuuugca

SEQ ID NO: 1939926 - RNA, 21 nt, Shigella flexneri 2a str. 2457T
uuguaagcugucgaaaagaua

SEQ ID NO: 1939927 - RNA, 16 nt, Shigella flexneri 2a str. 2457T
uuguaagucagaaagc

SEQ ID NO: 1939928 - RNA, 14 nt, Shigella flexneri 2a str. 2457T
uuguaaagcgccaa

SEQ ID NO: 1939929 - RNA, 16 nt, Shigella flexneri 2a str. 2457T
uuguucaugccggaug

SEQ ID NO: 1939930 - RNA, 17 nt, Shigella flexneri 2a str. 2457T
uuguguaaguuuaaccu

SEQ ID NO: 1939931 - RNA, 14 nt, Shigella flexneri 2a str. 2457T
uugucgggcaggcu

SEQ ID NO: 1939932 - RNA, 20 nt, Shigella flexneri 2a str. 2457T
uugucucccacaugcugguc

SEQ ID NO: 1939933 - RNA, 20 nt, Shigella flexneri 2a str. 2457T
uugugacauuaaccaaccac

SEQ ID NO: 1939934 - RNA, 21 nt, Shigella flexneri 2a str. 2457T
uugucuucaagaucagcggca

SEQ ID NO: 1939935 - RNA, 14 nt, Shigella flexneri 2a str. 2457T
uugucuguuugccu

SEQ ID NO: 1939936 - RNA, 17 nt, Shigella flexneri 2a str. 2457T
uugucuuuuuaaugacu

SEQ ID NO: 1939937 - RNA, 16 nt, Shigella flexneri 2a str. 2457T
uugucuuuccagacuc

SEQ ID NO: 1939938 - RNA, 18 nt, Shigella flexneri 2a str. 2457T
uugucuuuuuaaugacuu

SEQ ID NO: 1939939 - RNA, 16 nt, Shigella flexneri 2a str. 2457T
uugugcugugacagau

SEQ ID NO: 1939940 - RNA, 13 nt, Shigella flexneri 2a str. 2457T
uugugcugaacga

SEQ ID NO: 1939941 - RNA, 14 nt, Shigella flexneri 2a str. 2457T
uugugaucuuuuuc

SEQ ID NO: 1939942 - RNA, 17 nt, Shigella flexneri 2a str. 2457T
uugugcaccagcuggcu

SEQ ID NO: 1939943 - RNA, 20 nt, Shigella flexneri 2a str. 2457T
uugugcacgauugccggaug

SEQ ID NO: 1939944 - RNA, 18 nt, Shigella flexneri 2a str. 2457T
uugugcacgugccagaug

SEQ ID NO: 1939945 - RNA, 16 nt, Shigella flexneri 2a str. 2457T
uugugcaaauucaaua

SEQ ID NO: 1939946 - RNA, 14 nt, Shigella flexneri 2a str. 2457T
uugugcaccaccaa

SEQ ID NO: 1939947 - RNA, 13 nt, Shigella flexneri 2a str. 2457T
uugugccaguuca

SEQ ID NO: 1939948 - RNA, 21 nt, Shigella flexneri 2a str. 2457T
uugugccagaccaaacagcau

SEQ ID NO: 1939949 - RNA, 18 nt, Shigella flexneri 2a str. 2457T
uucuacgugcgcuaugug

SEQ ID NO: 1939950 - RNA, 23 nt, Shigella flexneri 2a str. 2457T
uucuacgugcgcuauguguuaaa

SEQ ID NO: 1939951 - RNA, 14 nt, Shigella flexneri 2a str. 2457T
uucguuuucagcuu

SEQ ID NO: 1939952 - RNA, 21 nt, Shigella flexneri 2a str. 2457T
uucuccagcgaauccguucuu

SEQ ID NO: 1939953 - RNA, 16 nt, Shigella flexneri 2a str. 2457T
uucucaaucugcuugc

SEQ ID NO: 1939954 - RNA, 18 nt, Shigella flexneri 2a str. 2457T
uucuaugaagaacuggaa

SEQ ID NO: 1939955 - RNA, 16 nt, Shigella flexneri 2a str. 2457T
uucuggagcauggcug

SEQ ID NO: 1939956 - RNA, 13 nt, Shigella flexneri 2a str. 2457T
uucuggauaauca

SEQ ID NO: 1939957 - RNA, 12 nt, Shigella flexneri 2a str. 2457T
uucuggcaucac

SEQ ID NO: 1939958 - RNA, 22 nt, Shigella flexneri 2a str. 2457T
uucuggcaccggacgcuuguca

SEQ ID NO: 1939959 - RNA, 21 nt, Shigella flexneri 2a str. 2457T
uucuggcaccuguaccagccc

SEQ ID NO: 1939960 - RNA, 18 nt, Shigella flexneri 2a str. 2457T
uucugcuuuggcugccgc

SEQ ID NO: 1939961 - RNA, 21 nt, Shigella flexneri 2a str. 2457T
uucugagagcaugaaaugaaa

SEQ ID NO: 1939962 - RNA, 14 nt, Shigella flexneri 2a str. 2457T
uucugagcaucaca

SEQ ID NO: 1939963 - RNA, 20 nt, Shigella flexneri 2a str. 2457T
uucugcguucugauuuaauc

SEQ ID NO: 1939964 - RNA, 17 nt, Shigella flexneri 2a str. 2457T
uucuccuucacucuaua

SEQ ID NO: 1939965 - RNA, 16 nt, Shigella flexneri 2a str. 2457T
uucucuuuccagcaac

SEQ ID NO: 1939966 - RNA, 15 nt, Shigella flexneri 2a str. 2457T
uucucuuucggcagu

SEQ ID NO: 1939967 - RNA, 22 nt, Shigella flexneri 2a str. 2457T
uucugaaaacggacaugccauu

SEQ ID NO: 1939968 - RNA, 19 nt, Shigella flexneri 2a str. 2457T
uucucuuuuguuacuuauu

SEQ ID NO: 1939969 - RNA, 20 nt, Shigella flexneri 2a str. 2457T
uucucuuuguuaaacagugc

SEQ ID NO: 1939970 - RNA, 20 nt, Shigella flexneri 2a str. 2457T
uucugaaggaauauucaggc

SEQ ID NO: 1939971 - RNA, 22 nt, Shigella flexneri 2a str. 2457T
uucugaaggauuagccggauau

SEQ ID NO: 1939972 - RNA, 17 nt, Shigella flexneri 2a str. 2457T
uucuccgcguucaauac

SEQ ID NO: 1939973 - RNA, 21 nt, Shigella flexneri 2a str. 2457T
uucucccugguucaagagaga

SEQ ID NO: 1939974 - RNA, 21 nt, Shigella flexneri 2a str. 2457T
uucuucauucccggaaauugc

SEQ ID NO: 1939975 - RNA, 23 nt, Shigella flexneri 2a str. 2457T
uucuucauucccggaaauugcca

SEQ ID NO: 1939976 - RNA, 16 nt, Shigella flexneri 2a str. 2457T
uucuucaugccaaaag

SEQ ID NO: 1939977 - RNA, 22 nt, Shigella flexneri 2a str. 2457T
uucuucagcgacagggccagga

SEQ ID NO: 1939978 - RNA, 15 nt, Shigella flexneri 2a str. 2457T
uucuucagcagccca

SEQ ID NO: 1939979 - RNA, 23 nt, Shigella flexneri 2a str. 2457T
uucuucaaguguggccgccagug

SEQ ID NO: 1939980 - RNA, 17 nt, Shigella flexneri 2a str. 2457T
uucuucacggaaaauau

SEQ ID NO: 1939981 - RNA, 12 nt, Shigella flexneri 2a str. 2457T
uucuucacugac

SEQ ID NO: 1939982 - RNA, 16 nt, Shigella flexneri 2a str. 2457T
uucuuauuaaauuguc

SEQ ID NO: 1939983 - RNA, 13 nt, Shigella flexneri 2a str. 2457T
uucuucaaaaaua

SEQ ID NO: 1939984 - RNA, 15 nt, Shigella flexneri 2a str. 2457T
uucuucaacaauuga

SEQ ID NO: 1939985 - RNA, 15 nt, Shigella flexneri 2a str. 2457T
uucuucccaaaucuu

SEQ ID NO: 1939986 - RNA, 15 nt, Shigella flexneri 2a str. 2457T
uucuuccagcggcag

SEQ ID NO: 1939987 - RNA, 17 nt, Shigella flexneri 2a str. 2457T
uucuucggucagagaau

SEQ ID NO: 1939988 - RNA, 20 nt, Shigella flexneri 2a str. 2457T
uucuucggucagagaaucga

SEQ ID NO: 1939989 - RNA, 20 nt, Shigella flexneri 2a str. 2457T
uucuucgcugacaguaccca

SEQ ID NO: 1939990 - RNA, 23 nt, Shigella flexneri 2a str. 2457T
uucuucgguucguaagcaagaac

SEQ ID NO: 1939991 - RNA, 22 nt, Shigella flexneri 2a str. 2457T
uucuucgucgucuucgucccag

SEQ ID NO: 1939992 - RNA, 21 nt, Shigella flexneri 2a str. 2457T
uucuucguuaaacagcuugga

SEQ ID NO: 1939993 - RNA, 16 nt, Shigella flexneri 2a str. 2457T
uucuucuucugacuca

SEQ ID NO: 1939994 - RNA, 20 nt, Shigella flexneri 2a str. 2457T
uucuuagucccaaacagcag

SEQ ID NO: 1939995 - RNA, 21 nt, Shigella flexneri 2a str. 2457T
uucuuauaaagaaaaucugaa

SEQ ID NO: 1939996 - RNA, 17 nt, Shigella flexneri 2a str. 2457T
uucuuacgccgacuaau

SEQ ID NO: 1939997 - RNA, 19 nt, Shigella flexneri 2a str. 2457T
uucuggcgcgaacagcaca

SEQ ID NO: 1939998 - RNA, 12 nt, Shigella flexneri 2a str. 2457T
uucuggcugcca

SEQ ID NO: 1939999 - RNA, 14 nt, Shigella flexneri 2a str. 2457T
uucuggucauugcc

SEQ ID NO: 1940000 - RNA, 20 nt, Shigella flexneri 2a str. 2457T
uucuggguaaugacuccaac

SEQ ID NO: 1940001 - RNA, 23 nt, Shigella flexneri 2a str. 2457T
uucuguaugccggauaagguguu

SEQ ID NO: 1940002 - RNA, 22 nt, Shigella flexneri 2a str. 2457T
uucuguagauaaaacacucuuu

SEQ ID NO: 1940003 - RNA, 12 nt, Shigella flexneri 2a str. 2457T
uucugugcgcca

SEQ ID NO: 1940004 - RNA, 19 nt, Shigella flexneri 2a str. 2457T
uucugugcagccaaaaaug

SEQ ID NO: 1940005 - RNA, 20 nt, Shigella flexneri 2a str. 2457T
uucugucgauaaacucaugg

SEQ ID NO: 1940006 - RNA, 21 nt, Shigella flexneri 2a str. 2457T
uucuguugcugaaauuccauc

SEQ ID NO: 1940007 - RNA, 22 nt, Shigella flexneri 2a str. 2457T
uucuguguaaaugccuuucuca

SEQ ID NO: 1940008 - RNA, 15 nt, Shigella flexneri 2a str. 2457T
uucgcguacugcuga

SEQ ID NO: 1940009 - RNA, 22 nt, Shigella flexneri 2a str. 2457T
uucgcuaaagacuuugcugccu

SEQ ID NO: 1940010 - RNA, 16 nt, Shigella flexneri 2a str. 2457T
uucggcaggcuuugcu

SEQ ID NO: 1940011 - RNA, 13 nt, Shigella flexneri 2a str. 2457T
uucggcaaucacc

SEQ ID NO: 1940012 - RNA, 21 nt, Shigella flexneri 2a str. 2457T
uucggcgucuuguugaacagg

SEQ ID NO: 1940013 - RNA, 18 nt, Shigella flexneri 2a str. 2457T
uucggcagucacuuuuuu

SEQ ID NO: 1940014 - RNA, 15 nt, Shigella flexneri 2a str. 2457T
uucggcagugccagu

SEQ ID NO: 1940015 - RNA, 15 nt, Shigella flexneri 2a str. 2457T
uucguugaagucagg

SEQ ID NO: 1940016 - RNA, 19 nt, Shigella flexneri 2a str. 2457T
uucgucuggcgauuuugaa

SEQ ID NO: 1940017 - RNA, 21 nt, Shigella flexneri 2a str. 2457T
uucggguuauugguuaacaag

SEQ ID NO: 1940018 - RNA, 15 nt, Shigella flexneri 2a str. 2457T
uucggguuauugguu

SEQ ID NO: 1940019 - RNA, 20 nt, Shigella flexneri 2a str. 2457T
uucgguaaugacuccaacuu

SEQ ID NO: 1940020 - RNA, 18 nt, Shigella flexneri 2a str. 2457T
uucgggcacagauuucca

SEQ ID NO: 1940021 - RNA, 18 nt, Shigella flexneri 2a str. 2457T
uucggggcuaaugccagu

SEQ ID NO: 1940022 - RNA, 16 nt, Shigella flexneri 2a str. 2457T
uucgauagcaaauugc

SEQ ID NO: 1940023 - RNA, 20 nt, Shigella flexneri 2a str. 2457T
uucgauagacucccagccuc

SEQ ID NO: 1940024 - RNA, 23 nt, Shigella flexneri 2a str. 2457T
uucgaugaugccggaaucaacca

SEQ ID NO: 1940025 - RNA, 14 nt, Shigella flexneri 2a str. 2457T
uucgaugagagcgg

SEQ ID NO: 1940026 - RNA, 23 nt, Shigella flexneri 2a str. 2457T
uucgauaaacucaaucaggcuau

SEQ ID NO: 1940027 - RNA, 23 nt, Shigella flexneri 2a str. 2457T
uucgaguacauccacugcauacu

SEQ ID NO: 1940028 - RNA, 16 nt, Shigella flexneri 2a str. 2457T
uucgagcaauuuuccu

SEQ ID NO: 1940029 - RNA, 18 nt, Shigella flexneri 2a str. 2457T
uucgagcuggaagccaca

SEQ ID NO: 1940030 - RNA, 14 nt, Shigella flexneri 2a str. 2457T
uucgauugcacaaa

SEQ ID NO: 1940031 - RNA, 19 nt, Shigella flexneri 2a str. 2457T
uucgccaggucagagagcc

SEQ ID NO: 1940032 - RNA, 21 nt, Shigella flexneri 2a str. 2457T
uucgcaauaaucaucucuccu

SEQ ID NO: 1940033 - RNA, 12 nt, Shigella flexneri 2a str. 2457T
uucgcccugcag

SEQ ID NO: 1940034 - RNA, 17 nt, Shigella flexneri 2a str. 2457T
uucgcccuggacaacau

SEQ ID NO: 1940035 - RNA, 15 nt, Shigella flexneri 2a str. 2457T
uucgccgaacacaca

SEQ ID NO: 1940036 - RNA, 21 nt, Shigella flexneri 2a str. 2457T
uucgcgauucugauugccgcu

SEQ ID NO: 1940037 - RNA, 22 nt, Shigella flexneri 2a str. 2457T
uucgcgaucaaacgccagauca

SEQ ID NO: 1940038 - RNA, 12 nt, Shigella flexneri 2a str. 2457T
uucccccacagc

SEQ ID NO: 1940039 - RNA, 23 nt, Shigella flexneri 2a str. 2457T
uuccccuguaacgagaaguuuuu

SEQ ID NO: 1940040 - RNA, 19 nt, Shigella flexneri 2a str. 2457T
uuccccgcuucagcccgcg

SEQ ID NO: 1940041 - RNA, 17 nt, Shigella flexneri 2a str. 2457T
uuccccggaugaguaca

SEQ ID NO: 1940042 - RNA, 20 nt, Shigella flexneri 2a str. 2457T
uucccucccguuucccuguc

SEQ ID NO: 1940043 - RNA, 20 nt, Shigella flexneri 2a str. 2457T
uucccguccacugcgagaaa

SEQ ID NO: 1940044 - RNA, 18 nt, Shigella flexneri 2a str. 2457T
uuccccuguugcaaacug

SEQ ID NO: 1940045 - RNA, 19 nt, Shigella flexneri 2a str. 2457T
uucccggguaguacuuaac

SEQ ID NO: 1940046 - RNA, 21 nt, Shigella flexneri 2a str. 2457T
uucccgggucgcgacugccag

SEQ ID NO: 1940047 - RNA, 22 nt, Shigella flexneri 2a str. 2457T
uucccggucaguagaauaaucu

SEQ ID NO: 1940048 - RNA, 20 nt, Shigella flexneri 2a str. 2457T
uuccgccagcgacugcgccg

SEQ ID NO: 1940049 - RNA, 22 nt, Shigella flexneri 2a str. 2457T
uuccgcgcaaucgcccagcgcg

SEQ ID NO: 1940050 - RNA, 18 nt, Shigella flexneri 2a str. 2457T
uuccggcagcauguguaa

SEQ ID NO: 1940051 - RNA, 21 nt, Shigella flexneri 2a str. 2457T
uuccggguuugccacaucacu

SEQ ID NO: 1940052 - RNA, 20 nt, Shigella flexneri 2a str. 2457T
uuccgggaucugauucugau

SEQ ID NO: 1940053 - RNA, 21 nt, Shigella flexneri 2a str. 2457T
uucccugcugaauccccuucu

SEQ ID NO: 1940054 - RNA, 17 nt, Shigella flexneri 2a str. 2457T
uucccuguucagccuga

SEQ ID NO: 1940055 - RNA, 14 nt, Shigella flexneri 2a str. 2457T
uuccgcaccugcca

SEQ ID NO: 1940056 - RNA, 23 nt, Shigella flexneri 2a str. 2457T
uuccgcacguuagaaacaaaaaa

SEQ ID NO: 1940057 - RNA, 11 nt, Shigella flexneri 2a str. 2457T
uucgaacugga

SEQ ID NO: 1940058 - RNA, 17 nt, Shigella flexneri 2a str. 2457T
uucgaagaguuccaacg

SEQ ID NO: 1940059 - RNA, 19 nt, Shigella flexneri 2a str. 2457T
uuccuugaaaaagagguug

SEQ ID NO: 1940060 - RNA, 12 nt, Shigella flexneri 2a str. 2457T
uuccuugaaaaa

SEQ ID NO: 1940061 - RNA, 13 nt, Shigella flexneri 2a str. 2457T
uuccuucaacccg

SEQ ID NO: 1940062 - RNA, 15 nt, Shigella flexneri 2a str. 2457T
uuccuucagcagcag

SEQ ID NO: 1940063 - RNA, 15 nt, Shigella flexneri 2a str. 2457T
uucgaauccuucccc

SEQ ID NO: 1940064 - RNA, 18 nt, Shigella flexneri 2a str. 2457T
uucgaccagccaggccgc

SEQ ID NO: 1940065 - RNA, 19 nt, Shigella flexneri 2a str. 2457T
uuccgguuggccugccgga

SEQ ID NO: 1940066 - RNA, 15 nt, Shigella flexneri 2a str. 2457T
uuccgucagcggcaa

SEQ ID NO: 1940067 - RNA, 19 nt, Shigella flexneri 2a str. 2457T
uuccuaaccgaauucaaau

SEQ ID NO: 1940068 - RNA, 17 nt, Shigella flexneri 2a str. 2457T
uuccuaacauaaugcaa

SEQ ID NO: 1940069 - RNA, 16 nt, Shigella flexneri 2a str. 2457T
uuccugaguaauaacu

SEQ ID NO: 1940070 - RNA, 22 nt, Shigella flexneri 2a str. 2457T
uuccugaguaauaacuuccuga

SEQ ID NO: 1940071 - RNA, 17 nt, Shigella flexneri 2a str. 2457T
uuccugagcaauaaucu

SEQ ID NO: 1940072 - RNA, 18 nt, Shigella flexneri 2a str. 2457T
uuccugagcacuggggcu

SEQ ID NO: 1940073 - RNA, 22 nt, Shigella flexneri 2a str. 2457T
uuccugacccagcaccaguacc

SEQ ID NO: 1940074 - RNA, 13 nt, Shigella flexneri 2a str. 2457T
uucauuugccagc

SEQ ID NO: 1940075 - RNA, 21 nt, Shigella flexneri 2a str. 2457T
uucauuugccagcuucagcgc

SEQ ID NO: 1940076 - RNA, 18 nt, Shigella flexneri 2a str. 2457T
uucauuucaauaaauucc

SEQ ID NO: 1940077 - RNA, 15 nt, Shigella flexneri 2a str. 2457T
uucauuguucuccca

SEQ ID NO: 1940078 - RNA, 13 nt, Shigella flexneri 2a str. 2457T
uucauuguugacu

SEQ ID NO: 1940079 - RNA, 16 nt, Shigella flexneri 2a str. 2457T
uucauuaccaaccuga

SEQ ID NO: 1940080 - RNA, 12 nt, Shigella flexneri 2a str. 2457T
uucauuccuuga

SEQ ID NO: 1940081 - RNA, 17 nt, Shigella flexneri 2a str. 2457T
uucauugaaugcggcag

SEQ ID NO: 1940082 - RNA, 22 nt, Shigella flexneri 2a str. 2457T
uucauugaacgggugauuuccc

SEQ ID NO: 1940083 - RNA, 23 nt, Shigella flexneri 2a str. 2457T
uucauugaacgggugauuucccc

SEQ ID NO: 1940084 - RNA, 21 nt, Shigella flexneri 2a str. 2457T
uuccaacuguaccagcaacug

SEQ ID NO: 1940085 - RNA, 20 nt, Shigella flexneri 2a str. 2457T
uuccaagauuaaaggcacca

SEQ ID NO: 1940086 - RNA, 15 nt, Shigella flexneri 2a str. 2457T
uucauuuuucucaac

SEQ ID NO: 1940087 - RNA, 20 nt, Shigella flexneri 2a str. 2457T
uucaugcuuaaucaucgacu

SEQ ID NO: 1940088 - RNA, 16 nt, Shigella flexneri 2a str. 2457T
uucaugcgaauacacc

SEQ ID NO: 1940089 - RNA, 14 nt, Shigella flexneri 2a str. 2457T
uucaugcuauuccu

SEQ ID NO: 1940090 - RNA, 17 nt, Shigella flexneri 2a str. 2457T
uucauggaugguugaac

SEQ ID NO: 1940091 - RNA, 14 nt, Shigella flexneri 2a str. 2457T
uucauggugcaaga

SEQ ID NO: 1940092 - RNA, 21 nt, Shigella flexneri 2a str. 2457T
uucaugguacgggacagcagg

SEQ ID NO: 1940093 - RNA, 16 nt, Shigella flexneri 2a str. 2457T
uucaugccauccgcau

SEQ ID NO: 1940094 - RNA, 15 nt, Shigella flexneri 2a str. 2457T
uucauuaaagccgcc

SEQ ID NO: 1940095 - RNA, 21 nt, Shigella flexneri 2a str. 2457T
uucauggugcaagaaaugaca

SEQ ID NO: 1940096 - RNA, 13 nt, Shigella flexneri 2a str. 2457T
uucaucuucaguc

SEQ ID NO: 1940097 - RNA, 20 nt, Shigella flexneri 2a str. 2457T
uucaucuuuccaaaccucag

SEQ ID NO: 1940098 - RNA, 13 nt, Shigella flexneri 2a str. 2457T
uucaucucaaaca

SEQ ID NO: 1940099 - RNA, 13 nt, Shigella flexneri 2a str. 2457T
uucaucucaguga

SEQ ID NO: 1940100 - RNA, 18 nt, Shigella flexneri 2a str. 2457T
uucaucucuucacgcuuu

SEQ ID NO: 1940101 - RNA, 16 nt, Shigella flexneri 2a str. 2457T
uucaucugauagcuuu

SEQ ID NO: 1940102 - RNA, 11 nt, Shigella flexneri 2a str. 2457T
uucaucugccu

SEQ ID NO: 1940103 - RNA, 17 nt, Shigella flexneri 2a str. 2457T
uucaucggcguuuucug

SEQ ID NO: 1940104 - RNA, 14 nt, Shigella flexneri 2a str. 2457T
uucaucgugcucgc

SEQ ID NO: 1940105 - RNA, 19 nt, Shigella flexneri 2a str. 2457T
uucaguuugccgcucaguu

SEQ ID NO: 1940106 - RNA, 14 nt, Shigella flexneri 2a str. 2457T
uucaguuuuacucu

SEQ ID NO: 1940107 - RNA, 18 nt, Shigella flexneri 2a str. 2457T
uucaguggguuaugaaac

SEQ ID NO: 1940108 - RNA, 17 nt, Shigella flexneri 2a str. 2457T
uucaguuaccugaaugc

SEQ ID NO: 1940109 - RNA, 10 nt, Shigella flexneri 2a str. 2457T
uucaguuccg

SEQ ID NO: 1940110 - RNA, 14 nt, Shigella flexneri 2a str. 2457T
uucaguugcucugc

SEQ ID NO: 1940111 - RNA, 23 nt, Shigella flexneri 2a str. 2457T
uucauaaacacgguuuuucauug

SEQ ID NO: 1940112 - RNA, 16 nt, Shigella flexneri 2a str. 2457T
uucagguuguuuucug

SEQ ID NO: 1940113 - RNA, 15 nt, Shigella flexneri 2a str. 2457T
uucaguaugguauua

SEQ ID NO: 1940114 - RNA, 22 nt, Shigella flexneri 2a str. 2457T
uucaguauagcggggaacauca

SEQ ID NO: 1940115 - RNA, 13 nt, Shigella flexneri 2a str. 2457T
uucagugccaggu

SEQ ID NO: 1940116 - RNA, 16 nt, Shigella flexneri 2a str. 2457T
uucagugcaaaugcca

SEQ ID NO: 1940117 - RNA, 20 nt, Shigella flexneri 2a str. 2457T
uucagugauggugauaauca

SEQ ID NO: 1940118 - RNA, 14 nt, Shigella flexneri 2a str. 2457T
uucagugcaaaugc

SEQ ID NO: 1940119 - RNA, 16 nt, Shigella flexneri 2a str. 2457T
uucagcguuccccaga

SEQ ID NO: 1940120 - RNA, 21 nt, Shigella flexneri 2a str. 2457T
uucagcgaucgcuuucgcuuu

SEQ ID NO: 1940121 - RNA, 19 nt, Shigella flexneri 2a str. 2457T
uucagcgccugauacagcc

SEQ ID NO: 1940122 - RNA, 21 nt, Shigella flexneri 2a str. 2457T
uucauacugccgaccaucugu

SEQ ID NO: 1940123 - RNA, 12 nt, Shigella flexneri 2a str. 2457T
uucauacugccg

SEQ ID NO: 1940124 - RNA, 13 nt, Shigella flexneri 2a str. 2457T
uucauacagcgga

SEQ ID NO: 1940125 - RNA, 22 nt, Shigella flexneri 2a str. 2457T
uucaucaagaaaacgaauacug

SEQ ID NO: 1940126 - RNA, 22 nt, Shigella flexneri 2a str. 2457T
uucaucaagcugugccugaaua

SEQ ID NO: 1940127 - RNA, 13 nt, Shigella flexneri 2a str. 2457T
uucaucaaaaaau

SEQ ID NO: 1940128 - RNA, 20 nt, Shigella flexneri 2a str. 2457T
uucauaugcgccagcugcau

SEQ ID NO: 1940129 - RNA, 16 nt, Shigella flexneri 2a str. 2457T
uucauauccgucauau

SEQ ID NO: 1940130 - RNA, 13 nt, Shigella flexneri 2a str. 2457T
uucauaucugcca

SEQ ID NO: 1940131 - RNA, 12 nt, Shigella flexneri 2a str. 2457T
uucauccagcau

SEQ ID NO: 1940132 - RNA, 12 nt, Shigella flexneri 2a str. 2457T
uucauccagcag

SEQ ID NO: 1940133 - RNA, 20 nt, Shigella flexneri 2a str. 2457T
uucaucccgguuauuaaaac

SEQ ID NO: 1940134 - RNA, 17 nt, Shigella flexneri 2a str. 2457T
uucaucccucucaucca

SEQ ID NO: 1940135 - RNA, 16 nt, Shigella flexneri 2a str. 2457T
uucauccgauccucac

SEQ ID NO: 1940136 - RNA, 14 nt, Shigella flexneri 2a str. 2457T
uucauccguuuccc

SEQ ID NO: 1940137 - RNA, 16 nt, Shigella flexneri 2a str. 2457T
uucauccguuucucug

SEQ ID NO: 1940138 - RNA, 22 nt, Shigella flexneri 2a str. 2457T
uucauccuguacgacaaaagaa

SEQ ID NO: 1940139 - RNA, 19 nt, Shigella flexneri 2a str. 2457T
uucauccuggcacagcagu

SEQ ID NO: 1940140 - RNA, 15 nt, Shigella flexneri 2a str. 2457T
uucaucgcccuuuuu

SEQ ID NO: 1940141 - RNA, 16 nt, Shigella flexneri 2a str. 2457T
uucaucgcacgagaaa

SEQ ID NO: 1940142 - RNA, 19 nt, Shigella flexneri 2a str. 2457T
uucaucgcacgagaaaaaa

SEQ ID NO: 1940143 - RNA, 20 nt, Shigella flexneri 2a str. 2457T
uucaucgcacgagaaaaaau

SEQ ID NO: 1940144 - RNA, 22 nt, Shigella flexneri 2a str. 2457T
uucaucauccgugaauaaugca

SEQ ID NO: 1940145 - RNA, 17 nt, Shigella flexneri 2a str. 2457T
uucaucauccucuucag

SEQ ID NO: 1940146 - RNA, 24 nt, Shigella flexneri 2a str. 2457T
uucaucauccuuugggcauuugca

SEQ ID NO: 1940147 - RNA, 20 nt, Shigella flexneri 2a str. 2457T
uucaucacuaccuucuuccc

SEQ ID NO: 1940148 - RNA, 20 nt, Shigella flexneri 2a str. 2457T
uucaucacuugauccauauc

SEQ ID NO: 1940149 - RNA, 22 nt, Shigella flexneri 2a str. 2457T
uucaccauucugcgcugacucu

SEQ ID NO: 1940150 - RNA, 18 nt, Shigella flexneri 2a str. 2457T
uucacgccaaccagcuga

SEQ ID NO: 1940151 - RNA, 15 nt, Shigella flexneri 2a str. 2457T
uucacgcagugcugc

SEQ ID NO: 1940152 - RNA, 19 nt, Shigella flexneri 2a str. 2457T
uucaccaucgcgaucauca

SEQ ID NO: 1940153 - RNA, 16 nt, Shigella flexneri 2a str. 2457T
uucacgcccagaucca

SEQ ID NO: 1940154 - RNA, 21 nt, Shigella flexneri 2a str. 2457T
uucacgcccgccccaguaaau

SEQ ID NO: 1940155 - RNA, 19 nt, Shigella flexneri 2a str. 2457T
uucacgccgcauccggcaa

SEQ ID NO: 1940156 - RNA, 23 nt, Shigella flexneri 2a str. 2457T
uucacgccgcauccggcaaguug

SEQ ID NO: 1940157 - RNA, 23 nt, Shigella flexneri 2a str. 2457T
uucacgccgcauccggcaauaag

SEQ ID NO: 1940158 - RNA, 23 nt, Shigella flexneri 2a str. 2457T
uucacgccgcauccggcaguaau

SEQ ID NO: 1940159 - RNA, 18 nt, Shigella flexneri 2a str. 2457T
uucacgccgcaucuggca

SEQ ID NO: 1940160 - RNA, 16 nt, Shigella flexneri 2a str. 2457T
uucaccagaccugaaa

SEQ ID NO: 1940161 - RNA, 17 nt, Shigella flexneri 2a str. 2457T
uucaccaaucggcagaa

SEQ ID NO: 1940162 - RNA, 17 nt, Shigella flexneri 2a str. 2457T
uucacggcaccagccau

SEQ ID NO: 1940163 - RNA, 20 nt, Shigella flexneri 2a str. 2457T
uucacggcuuugucauuaaa

SEQ ID NO: 1940164 - RNA, 22 nt, Shigella flexneri 2a str. 2457T
uucacgccgggaaauuuuuccg

SEQ ID NO: 1940165 - RNA, 18 nt, Shigella flexneri 2a str. 2457T
uucacgcgcuccaggagu

SEQ ID NO: 1940166 - RNA, 19 nt, Shigella flexneri 2a str. 2457T
uucacgcgcuccaggaguu

SEQ ID NO: 1940167 - RNA, 17 nt, Shigella flexneri 2a str. 2457T
uucacucugcugccaca

SEQ ID NO: 1940168 - RNA, 12 nt, Shigella flexneri 2a str. 2457T
uucacugccugc

SEQ ID NO: 1940169 - RNA, 19 nt, Shigella flexneri 2a str. 2457T
uucacugccguacaggcag

SEQ ID NO: 1940170 - RNA, 22 nt, Shigella flexneri 2a str. 2457T
uucacugacuuuucgucuuacu

SEQ ID NO: 1940171 - RNA, 14 nt, Shigella flexneri 2a str. 2457T
uucacuuucugaag

SEQ ID NO: 1940172 - RNA, 19 nt, Shigella flexneri 2a str. 2457T
uucagaaauuuggcuccuc

SEQ ID NO: 1940173 - RNA, 20 nt, Shigella flexneri 2a str. 2457T
uucacuuuugccagacgaau

SEQ ID NO: 1940174 - RNA, 17 nt, Shigella flexneri 2a str. 2457T
uucacuucaaccacauu

SEQ ID NO: 1940175 - RNA, 20 nt, Shigella flexneri 2a str. 2457T
uucagccugaccgcacaccc

SEQ ID NO: 1940176 - RNA, 15 nt, Shigella flexneri 2a str. 2457T
uucagauugcagaca

SEQ ID NO: 1940177 - RNA, 23 nt, Shigella flexneri 2a str. 2457T
uucagauaaugcccgaugaccuu

SEQ ID NO: 1940178 - RNA, 16 nt, Shigella flexneri 2a str. 2457T
uucagauaauagguaa

SEQ ID NO: 1940179 - RNA, 23 nt, Shigella flexneri 2a str. 2457T
uucagauaauagguaaacauccg

SEQ ID NO: 1940180 - RNA, 18 nt, Shigella flexneri 2a str. 2457T
uucagaacacaaaaccga

SEQ ID NO: 1940181 - RNA, 21 nt, Shigella flexneri 2a str. 2457T
uucacacacaucgacccagaa

SEQ ID NO: 1940182 - RNA, 17 nt, Shigella flexneri 2a str. 2457T
uucacacacuuuuauua

SEQ ID NO: 1940183 - RNA, 20 nt, Shigella flexneri 2a str. 2457T
uucaauuagcgccucggggc

SEQ ID NO: 1940184 - RNA, 22 nt, Shigella flexneri 2a str. 2457T
uucaauuauaguaucguuaaau

SEQ ID NO: 1940185 - RNA, 16 nt, Shigella flexneri 2a str. 2457T
uucaauuaauugugaa

SEQ ID NO: 1940186 - RNA, 18 nt, Shigella flexneri 2a str. 2457T
uucaauuuaaggaauacc

SEQ ID NO: 1940187 - RNA, 17 nt, Shigella flexneri 2a str. 2457T
uucaaugcgaucuaccc

SEQ ID NO: 1940188 - RNA, 15 nt, Shigella flexneri 2a str. 2457T
uucaaugccgccgau

SEQ ID NO: 1940189 - RNA, 22 nt, Shigella flexneri 2a str. 2457T
uucaaugauaaaggucaucaca

SEQ ID NO: 1940190 - RNA, 20 nt, Shigella flexneri 2a str. 2457T
uucaaugauaaaggucauca

SEQ ID NO: 1940191 - RNA, 13 nt, Shigella flexneri 2a str. 2457T
uucaaucugguga

SEQ ID NO: 1940192 - RNA, 14 nt, Shigella flexneri 2a str. 2457T
uuauucggucaggu

SEQ ID NO: 1940193 - RNA, 20 nt, Shigella flexneri 2a str. 2457T
uuauugauuccagcauaaug

SEQ ID NO: 1940194 - RNA, 14 nt, Shigella flexneri 2a str. 2457T
uuauuuccugcauu

SEQ ID NO: 1940195 - RNA, 16 nt, Shigella flexneri 2a str. 2457T
uuauuggugagaacua

SEQ ID NO: 1940196 - RNA, 20 nt, Shigella flexneri 2a str. 2457T
uuauugguaguguguuugau

SEQ ID NO: 1940197 - RNA, 16 nt, Shigella flexneri 2a str. 2457T
uuauuccauccugcuc

SEQ ID NO: 1940198 - RNA, 21 nt, Shigella flexneri 2a str. 2457T
uuauucagcuggcagugcuau

SEQ ID NO: 1940199 - RNA, 15 nt, Shigella flexneri 2a str. 2457T
uuaggcauuaucucu

SEQ ID NO: 1940200 - RNA, 18 nt, Shigella flexneri 2a str. 2457T
uuaggaugcugcaauaaa

SEQ ID NO: 1940201 - RNA, 17 nt, Shigella flexneri 2a str. 2457T
uuaggaccgguuucaaa

SEQ ID NO: 1940202 - RNA, 22 nt, Shigella flexneri 2a str. 2457T
uuauuaucuggcaagccugaaa

SEQ ID NO: 1940203 - RNA, 19 nt, Shigella flexneri 2a str. 2457T
uucaacaauugaagaauau

SEQ ID NO: 1940204 - RNA, 16 nt, Shigella flexneri 2a str. 2457T
uucaaauuaugucuca

SEQ ID NO: 1940205 - RNA, 22 nt, Shigella flexneri 2a str. 2457T
uucaaauuacgauccaccaccg

SEQ ID NO: 1940206 - RNA, 23 nt, Shigella flexneri 2a str. 2457T
uucaacggacgauuugccgucuc

SEQ ID NO: 1940207 - RNA, 17 nt, Shigella flexneri 2a str. 2457T
uucaacagcgugaacug

SEQ ID NO: 1940208 - RNA, 21 nt, Shigella flexneri 2a str. 2457T
uucaacagguuaacucccccu

SEQ ID NO: 1940209 - RNA, 22 nt, Shigella flexneri 2a str. 2457T
uucaacgguaaguugacgagau

SEQ ID NO: 1940210 - RNA, 13 nt, Shigella flexneri 2a str. 2457T
uucaacuucagca

SEQ ID NO: 1940211 - RNA, 11 nt, Shigella flexneri 2a str. 2457T
uuauuuuauuu

SEQ ID NO: 1940212 - RNA, 11 nt, Shigella flexneri 2a str. 2457T
uuauuuuaaau

SEQ ID NO: 1940213 - RNA, 22 nt, Shigella flexneri 2a str. 2457T
uucaaacugaagauugaacagc

SEQ ID NO: 1940214 - RNA, 19 nt, Shigella flexneri 2a str. 2457T
uucaaacgugaacagcuuc

SEQ ID NO: 1940215 - RNA, 18 nt, Shigella flexneri 2a str. 2457T
uucaaacguuuugcaauu

SEQ ID NO: 1940216 - RNA, 17 nt, Shigella flexneri 2a str. 2457T
uuauuuugcccugcuau

SEQ ID NO: 1940217 - RNA, 12 nt, Shigella flexneri 2a str. 2457T
uucaaagcgauu

SEQ ID NO: 1940218 - RNA, 17 nt, Shigella flexneri 2a str. 2457T
uucaaagguaaugguca

SEQ ID NO: 1940219 - RNA, 20 nt, Shigella flexneri 2a str. 2457T
uucaaaguaauauucaacgu

SEQ ID NO: 1940220 - RNA, 23 nt, Shigella flexneri 2a str. 2457T
uucaaagugauauccaccgcguu

SEQ ID NO: 1940221 - RNA, 18 nt, Shigella flexneri 2a str. 2457T
uucaaaucauuacaguuu

SEQ ID NO: 1940222 - RNA, 16 nt, Shigella flexneri 2a str. 2457T
uucaaaucgaaaucaa

SEQ ID NO: 1940223 - RNA, 17 nt, Shigella flexneri 2a str. 2457T
uucaaauccuucagacu

SEQ ID NO: 1940224 - RNA, 16 nt, Shigella flexneri 2a str. 2457T
uggcaaucaguggcuu

SEQ ID NO: 1940225 - RNA, 20 nt, Shigella flexneri 2a str. 2457T
uggcaaugagcaguuugguu

SEQ ID NO: 1940226 - RNA, 20 nt, Shigella flexneri 2a str. 2457T
uggcaaugcccgguguuccc

SEQ ID NO: 1940227 - RNA, 16 nt, Shigella flexneri 2a str. 2457T
uggcaaugcgcuguuu

SEQ ID NO: 1940228 - RNA, 16 nt, Shigella flexneri 2a str. 2457T
uggcaaccagcggcug

SEQ ID NO: 1940229 - RNA, 19 nt, Shigella flexneri 2a str. 2457T
uggcaaucagcggcaguuc

SEQ ID NO: 1940230 - RNA, 19 nt, Shigella flexneri 2a str. 2457T
uggcaauagcgggacacua

SEQ ID NO: 1940231 - RNA, 21 nt, Shigella flexneri 2a str. 2457T
uggcaauagcuucuuccacau

SEQ ID NO: 1940232 - RNA, 16 nt, Shigella flexneri 2a str. 2457T
uggcaccguucuuuau

SEQ ID NO: 1940233 - RNA, 13 nt, Shigella flexneri 2a str. 2457T
uggcaccgcagau

SEQ ID NO: 1940234 - RNA, 17 nt, Shigella flexneri 2a str. 2457T
uggcaccaguaaaccaa

SEQ ID NO: 1940235 - RNA, 12 nt, Shigella flexneri 2a str. 2457T
uggcacaacucg

SEQ ID NO: 1940236 - RNA, 20 nt, Shigella flexneri 2a str. 2457T
uggcacaugcauaaagcggu

SEQ ID NO: 1940237 - RNA, 18 nt, Shigella flexneri 2a str. 2457T
uggcacauucugacuggg

SEQ ID NO: 1940238 - RNA, 19 nt, Shigella flexneri 2a str. 2457T
ugcguuacccacaguuuca

SEQ ID NO: 1940239 - RNA, 18 nt, Shigella flexneri 2a str. 2457T
ugcguuccggcaugauuc

SEQ ID NO: 1940240 - RNA, 18 nt, Shigella flexneri 2a str. 2457T
ugcguuccuggggaaaau

SEQ ID NO: 1940241 - RNA, 19 nt, Shigella flexneri 2a str. 2457T
ugcguuccuggggaaaaug

SEQ ID NO: 1940242 - RNA, 19 nt, Shigella flexneri 2a str. 2457T
ugcguugauagcauuugua

SEQ ID NO: 1940243 - RNA, 14 nt, Shigella flexneri 2a str. 2457T
uggcaaaaucaaaa

SEQ ID NO: 1940244 - RNA, 21 nt, Shigella flexneri 2a str. 2457T
uggauuuaccguuaagcugga

SEQ ID NO: 1940245 - RNA, 16 nt, Shigella flexneri 2a str. 2457T
uggauugcugaaauac

SEQ ID NO: 1940246 - RNA, 19 nt, Shigella flexneri 2a str. 2457T
uggauugcugaaauacaga

SEQ ID NO: 1940247 - RNA, 17 nt, Shigella flexneri 2a str. 2457T
uggcaaacugaguggag

SEQ ID NO: 1940248 - RNA, 21 nt, Shigella flexneri 2a str. 2457T
uggcaaagcugucaccaauca

SEQ ID NO: 1940249 - RNA, 19 nt, Shigella flexneri 2a str. 2457T
uggcaaaugcaucagugac

SEQ ID NO: 1940250 - RNA, 14 nt, Shigella flexneri 2a str. 2457T
uggccgccacgcgu

SEQ ID NO: 1940251 - RNA, 16 nt, Shigella flexneri 2a str. 2457T
uggccgauaccaucac

SEQ ID NO: 1940252 - RNA, 17 nt, Shigella flexneri 2a str. 2457T
uggcauuuugcaguaac

SEQ ID NO: 1940253 - RNA, 19 nt, Shigella flexneri 2a str. 2457T
uggcaggaguggcagcaug

SEQ ID NO: 1940254 - RNA, 13 nt, Shigella flexneri 2a str. 2457T
uggcagccaggcg

SEQ ID NO: 1940255 - RNA, 23 nt, Shigella flexneri 2a str. 2457T
uggcagccauaaucacucuuccc

SEQ ID NO: 1940256 - RNA, 16 nt, Shigella flexneri 2a str. 2457T
uggcagauuaugcacu

SEQ ID NO: 1940257 - RNA, 20 nt, Shigella flexneri 2a str. 2457T
uggcagcgcgaagcuggcgg

SEQ ID NO: 1940258 - RNA, 23 nt, Shigella flexneri 2a str. 2457T
uggccuacgguucgggcacagau

SEQ ID NO: 1940259 - RNA, 15 nt, Shigella flexneri 2a str. 2457T
uggccguuauccuga

SEQ ID NO: 1940260 - RNA, 21 nt, Shigella flexneri 2a str. 2457T
uggccugagacugaugacaaa

SEQ ID NO: 1940261 - RNA, 21 nt, Shigella flexneri 2a str. 2457T
uggccucucuggccgcuucca

SEQ ID NO: 1940262 - RNA, 12 nt, Shigella flexneri 2a str. 2457T
uggcgaauagaa

SEQ ID NO: 1940263 - RNA, 19 nt, Shigella flexneri 2a str. 2457T
uggcgaacccaaccgugag

SEQ ID NO: 1940264 - RNA, 23 nt, Shigella flexneri 2a str. 2457T
uggcgaaauguguuggcaccauc

SEQ ID NO: 1940265 - RNA, 14 nt, Shigella flexneri 2a str. 2457T
uggccgcuuccagc

SEQ ID NO: 1940266 - RNA, 20 nt, Shigella flexneri 2a str. 2457T
uggcgauaaucagcgccagc

SEQ ID NO: 1940267 - RNA, 13 nt, Shigella flexneri 2a str. 2457T
uggcgaggaacga

SEQ ID NO: 1940268 - RNA, 12 nt, Shigella flexneri 2a str. 2457T
uggcgauagccc

SEQ ID NO: 1940269 - RNA, 22 nt, Shigella flexneri 2a str. 2457T
uggcgaucgucgcuccaugaga

SEQ ID NO: 1940270 - RNA, 12 nt, Shigella flexneri 2a str. 2457T
uggcgcugcuca

SEQ ID NO: 1940271 - RNA, 17 nt, Shigella flexneri 2a str. 2457T
uggcggaaaucuuucau

SEQ ID NO: 1940272 - RNA, 14 nt, Shigella flexneri 2a str. 2457T
uggcggaaacgggu

SEQ ID NO: 1940273 - RNA, 22 nt, Shigella flexneri 2a str. 2457T
uggcggggagggaauccagcaa

SEQ ID NO: 1940274 - RNA, 16 nt, Shigella flexneri 2a str. 2457T
uggcggggaucacucc

SEQ ID NO: 1940275 - RNA, 15 nt, Shigella flexneri 2a str. 2457T
uggcgggauguguaa

SEQ ID NO: 1940276 - RNA, 20 nt, Shigella flexneri 2a str. 2457T
ugguacuucaaucgccacca

SEQ ID NO: 1940277 - RNA, 15 nt, Shigella flexneri 2a str. 2457T
ugguagcugcccccg

SEQ ID NO: 1940278 - RNA, 21 nt, Shigella flexneri 2a str. 2457T
ugguaccguguaaaaugacuc

SEQ ID NO: 1940279 - RNA, 15 nt, Shigella flexneri 2a str. 2457T
ugguacuggugcaaa

SEQ ID NO: 1940280 - RNA, 14 nt, Shigella flexneri 2a str. 2457T
ugguacuuucacag

SEQ ID NO: 1940281 - RNA, 17 nt, Shigella flexneri 2a str. 2457T
ugguauuaaauuugcuu

SEQ ID NO: 1940282 - RNA, 16 nt, Shigella flexneri 2a str. 2457T
uggguuucuaauuuuu

SEQ ID NO: 1940283 - RNA, 21 nt, Shigella flexneri 2a str. 2457T
uggguucacuuuccccggcau

SEQ ID NO: 1940284 - RNA, 15 nt, Shigella flexneri 2a str. 2457T
uggguuucauccugc

SEQ ID NO: 1940285 - RNA, 17 nt, Shigella flexneri 2a str. 2457T
ugguaaucaccacccau

SEQ ID NO: 1940286 - RNA, 15 nt, Shigella flexneri 2a str. 2457T
ugguacauaacacaa

SEQ ID NO: 1940287 - RNA, 23 nt, Shigella flexneri 2a str. 2457T
ugguaaagccgauuaaucuucca

SEQ ID NO: 1940288 - RNA, 14 nt, Shigella flexneri 2a str. 2457T
uggucgauuccucg

SEQ ID NO: 1940289 - RNA, 22 nt, Shigella flexneri 2a str. 2457T
uggucgcguuggucucaagcaa

SEQ ID NO: 1940290 - RNA, 19 nt, Shigella flexneri 2a str. 2457T
ugguccuggcugauugaua

SEQ ID NO: 1940291 - RNA, 17 nt, Shigella flexneri 2a str. 2457T
uggucccgacaaccuga

SEQ ID NO: 1940292 - RNA, 19 nt, Shigella flexneri 2a str. 2457T
ugguccgcuuguaggccug

SEQ ID NO: 1940293 - RNA, 14 nt, Shigella flexneri 2a str. 2457T
uggucauuuuauug

SEQ ID NO: 1940294 - RNA, 21 nt, Shigella flexneri 2a str. 2457T
uggucauucggcgcagguuua

SEQ ID NO: 1940295 - RNA, 16 nt, Shigella flexneri 2a str. 2457T
uggucccgacaaccug

SEQ ID NO: 1940296 - RNA, 19 nt, Shigella flexneri 2a str. 2457T
uggucagaaaaguaaacca

SEQ ID NO: 1940297 - RNA, 13 nt, Shigella flexneri 2a str. 2457T
uggucagagcauu

SEQ ID NO: 1940298 - RNA, 22 nt, Shigella flexneri 2a str. 2457T
uggucauaucaauaguaaccag

SEQ ID NO: 1940299 - RNA, 19 nt, Shigella flexneri 2a str. 2457T
uggucaaugauuucugcca

SEQ ID NO: 1940300 - RNA, 15 nt, Shigella flexneri 2a str. 2457T
uggcuuugcccuggc

SEQ ID NO: 1940301 - RNA, 17 nt, Shigella flexneri 2a str. 2457T
uggcuuugcccuuucug

SEQ ID NO: 1940302 - RNA, 14 nt, Shigella flexneri 2a str. 2457T
uggcuuuccgggag

SEQ ID NO: 1940303 - RNA, 20 nt, Shigella flexneri 2a str. 2457T
ugggauugcuucaguugccu

SEQ ID NO: 1940304 - RNA, 16 nt, Shigella flexneri 2a str. 2457T
ugggcaauuucuuuug

SEQ ID NO: 1940305 - RNA, 14 nt, Shigella flexneri 2a str. 2457T
ugggauugcuucag

SEQ ID NO: 1940306 - RNA, 21 nt, Shigella flexneri 2a str. 2457T
ugggaugguuuugcuuuauua

SEQ ID NO: 1940307 - RNA, 13 nt, Shigella flexneri 2a str. 2457T
ugggauuaaaaag

SEQ ID NO: 1940308 - RNA, 17 nt, Shigella flexneri 2a str. 2457T
uggcuuuccaccaucac

SEQ ID NO: 1940309 - RNA, 14 nt, Shigella flexneri 2a str. 2457T
uggcuugccagcca

SEQ ID NO: 1940310 - RNA, 13 nt, Shigella flexneri 2a str. 2457T
uggcuucauccac

SEQ ID NO: 1940311 - RNA, 18 nt, Shigella flexneri 2a str. 2457T
uggcuuaucuuccuguuc

SEQ ID NO: 1940312 - RNA, 16 nt, Shigella flexneri 2a str. 2457T
uggcuuaucuuccugu

SEQ ID NO: 1940313 - RNA, 14 nt, Shigella flexneri 2a str. 2457T
uggcuuaaucugcc

SEQ ID NO: 1940314 - RNA, 22 nt, Shigella flexneri 2a str. 2457T
uggcguugggugcuugaggcug

SEQ ID NO: 1940315 - RNA, 17 nt, Shigella flexneri 2a str. 2457T
uggcguggcgcuccacu

SEQ ID NO: 1940316 - RNA, 17 nt, Shigella flexneri 2a str. 2457T
ugggcgcaccugaaucg

SEQ ID NO: 1940317 - RNA, 12 nt, Shigella flexneri 2a str. 2457T
ugggcucaucaa

SEQ ID NO: 1940318 - RNA, 22 nt, Shigella flexneri 2a str. 2457T
ugggcggcgugauuggcaucau

SEQ ID NO: 1940319 - RNA, 14 nt, Shigella flexneri 2a str. 2457T
ugggcguagcuggg

SEQ ID NO: 1940320 - RNA, 19 nt, Shigella flexneri 2a str. 2457T
uggggcuugccagagcagc

SEQ ID NO: 1940321 - RNA, 17 nt, Shigella flexneri 2a str. 2457T
uggggcguguuuuguca

SEQ ID NO: 1940322 - RNA, 20 nt, Shigella flexneri 2a str. 2457T
ugggggcugaaaauucgcgg

SEQ ID NO: 1940323 - RNA, 20 nt, Shigella flexneri 2a str. 2457T
ugggugcuuuaaaaaagaau

SEQ ID NO: 1940324 - RNA, 19 nt, Shigella flexneri 2a str. 2457T
uggggcaggggcuucuucc

SEQ ID NO: 1940325 - RNA, 19 nt, Shigella flexneri 2a str. 2457T
uggggauagcgcugcugca

SEQ ID NO: 1940326 - RNA, 22 nt, Shigella flexneri 2a str. 2457T
uggggauagaaacagucuggag

SEQ ID NO: 1940327 - RNA, 16 nt, Shigella flexneri 2a str. 2457T
ugugggucgaggaaau

SEQ ID NO: 1940328 - RNA, 15 nt, Shigella flexneri 2a str. 2457T
uguguaaacccagcc

SEQ ID NO: 1940329 - RNA, 21 nt, Shigella flexneri 2a str. 2457T
uguguacauccuaaaggcaaa

SEQ ID NO: 1940330 - RNA, 18 nt, Shigella flexneri 2a str. 2457T
uguggcggcgcgaggcga

SEQ ID NO: 1940331 - RNA, 18 nt, Shigella flexneri 2a str. 2457T
ugugcugguacuggugca

SEQ ID NO: 1940332 - RNA, 19 nt, Shigella flexneri 2a str. 2457T
uguggauuaaauugcgcca

SEQ ID NO: 1940333 - RNA, 21 nt, Shigella flexneri 2a str. 2457T
ugugcugaacgaaaagcgcac

SEQ ID NO: 1940334 - RNA, 21 nt, Shigella flexneri 2a str. 2457T
ugugcguuacccacaguuuca

SEQ ID NO: 1940335 - RNA, 12 nt, Shigella flexneri 2a str. 2457T
ugugugaaaguc

SEQ ID NO: 1940336 - RNA, 17 nt, Shigella flexneri 2a str. 2457T
uguguuaaauauuuaaa

SEQ ID NO: 1940337 - RNA, 15 nt, Shigella flexneri 2a str. 2457T
uguguuugaucacuu

SEQ ID NO: 1940338 - RNA, 11 nt, Shigella flexneri 2a str. 2457T
uguguuuauaa

SEQ ID NO: 1940339 - RNA, 19 nt, Shigella flexneri 2a str. 2457T
uguuaaaacgcacgcuguc

SEQ ID NO: 1940340 - RNA, 21 nt, Shigella flexneri 2a str. 2457T
uguuaacggccgaagaagaag

SEQ ID NO: 1940341 - RNA, 21 nt, Shigella flexneri 2a str. 2457T
uguuaaccaccaguaaauugu

SEQ ID NO: 1940342 - RNA, 12 nt, Shigella flexneri 2a str. 2457T
uguuaaccaacg

SEQ ID NO: 1940343 - RNA, 15 nt, Shigella flexneri 2a str. 2457T
uguuaaggaaauccu

SEQ ID NO: 1940344 - RNA, 21 nt, Shigella flexneri 2a str. 2457T
uguuacugagcggaugcuuaa

SEQ ID NO: 1940345 - RNA, 17 nt, Shigella flexneri 2a str. 2457T
uguuacggugcgcagcc

SEQ ID NO: 1940346 - RNA, 21 nt, Shigella flexneri 2a str. 2457T
uguuacgauagaauauuucua

SEQ ID NO: 1940347 - RNA, 21 nt, Shigella flexneri 2a str. 2457T
uguuacgcaaaaccucuucca

SEQ ID NO: 1940348 - RNA, 13 nt, Shigella flexneri 2a str. 2457T
ugugacagcagcg

SEQ ID NO: 1940349 - RNA, 16 nt, Shigella flexneri 2a str. 2457T
ugugacgacaccaucu

SEQ ID NO: 1940350 - RNA, 21 nt, Shigella flexneri 2a str. 2457T
ugugacgcuaccgggcucuuu

SEQ ID NO: 1940351 - RNA, 15 nt, Shigella flexneri 2a str. 2457T
ugucugcuucugccu

SEQ ID NO: 1940352 - RNA, 15 nt, Shigella flexneri 2a str. 2457T
ugugacaacaacauc

SEQ ID NO: 1940353 - RNA, 17 nt, Shigella flexneri 2a str. 2457T
ugugacaacaacaucac

SEQ ID NO: 1940354 - RNA, 17 nt, Shigella flexneri 2a str. 2457T
ugucuguacggcaguga

SEQ ID NO: 1940355 - RNA, 14 nt, Shigella flexneri 2a str. 2457T
ugugccacauccag

SEQ ID NO: 1940356 - RNA, 21 nt, Shigella flexneri 2a str. 2457T
ugugcgccauuuuuuugucug

SEQ ID NO: 1940357 - RNA, 23 nt, Shigella flexneri 2a str. 2457T
ugugcgccaccgcggacagacuu

SEQ ID NO: 1940358 - RNA, 15 nt, Shigella flexneri 2a str. 2457T
ugugcagcaugcacc

SEQ ID NO: 1940359 - RNA, 13 nt, Shigella flexneri 2a str. 2457T
ugucgccauccag

SEQ ID NO: 1940360 - RNA, 22 nt, Shigella flexneri 2a str. 2457T
uguccauagcgauguauuucau

SEQ ID NO: 1940361 - RNA, 15 nt, Shigella flexneri 2a str. 2457T
uguccagcggcauaa

SEQ ID NO: 1940362 - RNA, 20 nt, Shigella flexneri 2a str. 2457T
uguccagcuugaucaauaac

SEQ ID NO: 1940363 - RNA, 15 nt, Shigella flexneri 2a str. 2457T
uguccagcacgccgc

SEQ ID NO: 1940364 - RNA, 13 nt, Shigella flexneri 2a str. 2457T
uguccacaggaaa

SEQ ID NO: 1940365 - RNA, 23 nt, Shigella flexneri 2a str. 2457T
uguccacaggaaaacuacacacu

SEQ ID NO: 1940366 - RNA, 22 nt, Shigella flexneri 2a str. 2457T
ugucauucgccugacgcaauaa

SEQ ID NO: 1940367 - RNA, 20 nt, Shigella flexneri 2a str. 2457T
ugucgcucaaugcgcugagu

SEQ ID NO: 1940368 - RNA, 20 nt, Shigella flexneri 2a str. 2457T
ugucgcucaaugugcugagu

SEQ ID NO: 1940369 - RNA, 21 nt, Shigella flexneri 2a str. 2457T
ugucgggugcuuuuuucaauu

SEQ ID NO: 1940370 - RNA, 20 nt, Shigella flexneri 2a str. 2457T
ugucgguggcgggcaagcgg

SEQ ID NO: 1940371 - RNA, 13 nt, Shigella flexneri 2a str. 2457T
ugucuauuuccac

SEQ ID NO: 1940372 - RNA, 15 nt, Shigella flexneri 2a str. 2457T
ugucuauuuccaccc

SEQ ID NO: 1940373 - RNA, 22 nt, Shigella flexneri 2a str. 2457T
ugucauggcagucuuaaucgcu

SEQ ID NO: 1940374 - RNA, 22 nt, Shigella flexneri 2a str. 2457T
ugucauguauauuauccaucaa

SEQ ID NO: 1940375 - RNA, 16 nt, Shigella flexneri 2a str. 2457T
ugucaugacuacacua

SEQ ID NO: 1940376 - RNA, 14 nt, Shigella flexneri 2a str. 2457T
ugucaugcagcucc

SEQ ID NO: 1940377 - RNA, 15 nt, Shigella flexneri 2a str. 2457T
ugucauauuaucuau

SEQ ID NO: 1940378 - RNA, 23 nt, Shigella flexneri 2a str. 2457T
ugucaucagcauucucaucacca

SEQ ID NO: 1940379 - RNA, 22 nt, Shigella flexneri 2a str. 2457T
ugucauaacacagguaacuuaa

SEQ ID NO: 1940380 - RNA, 17 nt, Shigella flexneri 2a str. 2457T
ugucauacgcguaaaac

SEQ ID NO: 1940381 - RNA, 19 nt, Shigella flexneri 2a str. 2457T
ugucauacgcguaaaacag

SEQ ID NO: 1940382 - RNA, 11 nt, Shigella flexneri 2a str. 2457T
ugucacuuuga

SEQ ID NO: 1940383 - RNA, 14 nt, Shigella flexneri 2a str. 2457T
ugucagaaguugca

SEQ ID NO: 1940384 - RNA, 20 nt, Shigella flexneri 2a str. 2457T
ugucaguauaacuacugaug

SEQ ID NO: 1940385 - RNA, 22 nt, Shigella flexneri 2a str. 2457T
ugucaguauaacuacugauggc

SEQ ID NO: 1940386 - RNA, 16 nt, Shigella flexneri 2a str. 2457T
uguaugccucuuucag

SEQ ID NO: 1940387 - RNA, 20 nt, Shigella flexneri 2a str. 2457T
uguaugaccuuuggcgagcc

SEQ ID NO: 1940388 - RNA, 22 nt, Shigella flexneri 2a str. 2457T
uguauuaacauuaggcauuauc

SEQ ID NO: 1940389 - RNA, 18 nt, Shigella flexneri 2a str. 2457T
ugucaaaaucaaaauaau

SEQ ID NO: 1940390 - RNA, 20 nt, Shigella flexneri 2a str. 2457T
ugucaacugcgccacucgau

SEQ ID NO: 1940391 - RNA, 17 nt, Shigella flexneri 2a str. 2457T
ugucacugacuauuucc

SEQ ID NO: 1940392 - RNA, 14 nt, Shigella flexneri 2a str. 2457T
ugucacguuuugug

SEQ ID NO: 1940393 - RNA, 20 nt, Shigella flexneri 2a str. 2457T
uguauacgcgccacaucaga

SEQ ID NO: 1940394 - RNA, 14 nt, Shigella flexneri 2a str. 2457T
uguauaucaaacca

SEQ ID NO: 1940395 - RNA, 18 nt, Shigella flexneri 2a str. 2457T
uguauauuauccaucaaa

SEQ ID NO: 1940396 - RNA, 17 nt, Shigella flexneri 2a str. 2457T
uguagguuuuggcgcaa

SEQ ID NO: 1940397 - RNA, 18 nt, Shigella flexneri 2a str. 2457T
uguaguccuaacagagca

SEQ ID NO: 1940398 - RNA, 16 nt, Shigella flexneri 2a str. 2457T
uguagcuacgcaucaa

SEQ ID NO: 1940399 - RNA, 17 nt, Shigella flexneri 2a str. 2457T
uguagcgcugcaaacca

SEQ ID NO: 1940400 - RNA, 19 nt, Shigella flexneri 2a str. 2457T
uguaaaacagcacuccugc

SEQ ID NO: 1940401 - RNA, 15 nt, Shigella flexneri 2a str. 2457T
uguaacauaccuaaa

SEQ ID NO: 1940402 - RNA, 13 nt, Shigella flexneri 2a str. 2457T
uguaacaacuggc

SEQ ID NO: 1940403 - RNA, 19 nt, Shigella flexneri 2a str. 2457T
uguaaauucucaauaucau

SEQ ID NO: 1940404 - RNA, 17 nt, Shigella flexneri 2a str. 2457T
uggugaagccaccagca

SEQ ID NO: 1940405 - RNA, 15 nt, Shigella flexneri 2a str. 2457T
uggugacgcauuuua

SEQ ID NO: 1940406 - RNA, 21 nt, Shigella flexneri 2a str. 2457T
uggucuuguagguuuuggcgc

SEQ ID NO: 1940407 - RNA, 17 nt, Shigella flexneri 2a str. 2457T
uggugaaaaaaaggcga

SEQ ID NO: 1940408 - RNA, 14 nt, Shigella flexneri 2a str. 2457T
ugguuucaaagauu

SEQ ID NO: 1940409 - RNA, 14 nt, Shigella flexneri 2a str. 2457T
ugguuucaaugcuc

SEQ ID NO: 1940410 - RNA, 21 nt, Shigella flexneri 2a str. 2457T
ugguuuaucuccguuaaaggc

SEQ ID NO: 1940411 - RNA, 15 nt, Shigella flexneri 2a str. 2457T
ugguuuauuucccag

SEQ ID NO: 1940412 - RNA, 16 nt, Shigella flexneri 2a str. 2457T
ugguuucgccagcacc

SEQ ID NO: 1940413 - RNA, 20 nt, Shigella flexneri 2a str. 2457T
ugguuuuucgauuuaaauga

SEQ ID NO: 1940414 - RNA, 15 nt, Shigella flexneri 2a str. 2457T
ugguuuuguaggcug

SEQ ID NO: 1940415 - RNA, 15 nt, Shigella flexneri 2a str. 2457T
uguacaaacccagcc

SEQ ID NO: 1940416 - RNA, 15 nt, Shigella flexneri 2a str. 2457T
uguacaaaaaaugug

SEQ ID NO: 1940417 - RNA, 16 nt, Shigella flexneri 2a str. 2457T
uguaaugacaacauuu

SEQ ID NO: 1940418 - RNA, 16 nt, Shigella flexneri 2a str. 2457T
uguaacccaccaugcc

SEQ ID NO: 1940419 - RNA, 17 nt, Shigella flexneri 2a str. 2457T
uguaaccuucacccuca

SEQ ID NO: 1940420 - RNA, 18 nt, Shigella flexneri 2a str. 2457T
uguaacgccuuuuccagc

SEQ ID NO: 1940421 - RNA, 19 nt, Shigella flexneri 2a str. 2457T
uguaacgccuuuuccagcg

SEQ ID NO: 1940422 - RNA, 23 nt, Shigella flexneri 2a str. 2457T
uguaacugcgccagacccagacg

SEQ ID NO: 1940423 - RNA, 21 nt, Shigella flexneri 2a str. 2457T
uguaacugcguuucuggcuua

SEQ ID NO: 1940424 - RNA, 13 nt, Shigella flexneri 2a str. 2457T
uguacauuuugac

SEQ ID NO: 1940425 - RNA, 13 nt, Shigella flexneri 2a str. 2457T
uguagaaaaucuc

SEQ ID NO: 1940426 - RNA, 18 nt, Shigella flexneri 2a str. 2457T
uguagauaaaacacucuu

SEQ ID NO: 1940427 - RNA, 18 nt, Shigella flexneri 2a str. 2457T
uguagaccggauaaggaa

SEQ ID NO: 1940428 - RNA, 13 nt, Shigella flexneri 2a str. 2457T
uguacuuuccagc

SEQ ID NO: 1940429 - RNA, 22 nt, Shigella flexneri 2a str. 2457T
uguacuuccggacguucagcca

SEQ ID NO: 1940430 - RNA, 14 nt, Shigella flexneri 2a str. 2457T
uguacgacaaaaga

SEQ ID NO: 1940431 - RNA, 16 nt, Shigella flexneri 2a str. 2457T
uguaccuucagcggca

SEQ ID NO: 1940432 - RNA, 16 nt, Shigella flexneri 2a str. 2457T
uguuuagccacaccga

SEQ ID NO: 1940433 - RNA, 21 nt, Shigella flexneri 2a str. 2457T
uguuuaacuccuucuaaagca

SEQ ID NO: 1940434 - RNA, 12 nt, Shigella flexneri 2a str. 2457T
uguuuaaauauc

SEQ ID NO: 1940435 - RNA, 21 nt, Shigella flexneri 2a str. 2457T
uguugguaaccaaaucuccag

SEQ ID NO: 1940436 - RNA, 15 nt, Shigella flexneri 2a str. 2457T
uguuggcaaaaaaau

SEQ ID NO: 1940437 - RNA, 20 nt, Shigella flexneri 2a str. 2457T
uguuggcaaaaaaauucaga

SEQ ID NO: 1940438 - RNA, 16 nt, Shigella flexneri 2a str. 2457T
uguuggaacccgcagc

SEQ ID NO: 1940439 - RNA, 22 nt, Shigella flexneri 2a str. 2457T
uguuggauccccugcccggcaa

SEQ ID NO: 1940440 - RNA, 20 nt, Shigella flexneri 2a str. 2457T
uguuguagaccggaaaaggu

SEQ ID NO: 1940441 - RNA, 13 nt, Shigella flexneri 2a str. 2457T
uguuguacaguac

SEQ ID NO: 1940442 - RNA, 16 nt, Shigella flexneri 2a str. 2457T
uguuguaagcuugaca

SEQ ID NO: 1940443 - RNA, 15 nt, Shigella flexneri 2a str. 2457T
uguugucugaaugau

SEQ ID NO: 1940444 - RNA, 14 nt, Shigella flexneri 2a str. 2457T
uguugauaaggaaa

SEQ ID NO: 1940445 - RNA, 13 nt, Shigella flexneri 2a str. 2457T
uguugcaaacuga

SEQ ID NO: 1940446 - RNA, 21 nt, Shigella flexneri 2a str. 2457T
uguugauuucccgcacguugg

SEQ ID NO: 1940447 - RNA, 14 nt, Shigella flexneri 2a str. 2457T
uguugauccaggag

SEQ ID NO: 1940448 - RNA, 23 nt, Shigella flexneri 2a str. 2457T
uguugcaggaaaagguaggccug

SEQ ID NO: 1940449 - RNA, 19 nt, Shigella flexneri 2a str. 2457T
uguugcaccaucaggcaua

SEQ ID NO: 1940450 - RNA, 18 nt, Shigella flexneri 2a str. 2457T
uguugccacacgcccaac

SEQ ID NO: 1940451 - RNA, 21 nt, Shigella flexneri 2a str. 2457T
uguugccauuucugcugccac

SEQ ID NO: 1940452 - RNA, 13 nt, Shigella flexneri 2a str. 2457T
uguugcuaauuua

SEQ ID NO: 1940453 - RNA, 17 nt, Shigella flexneri 2a str. 2457T
uguugcuauggggaaaa

SEQ ID NO: 1940454 - RNA, 22 nt, Shigella flexneri 2a str. 2457T
uguugcccagcgcaucaggcaa

SEQ ID NO: 1940455 - RNA, 20 nt, Shigella flexneri 2a str. 2457T
uguugcgccaguaaauuuau

SEQ ID NO: 1940456 - RNA, 17 nt, Shigella flexneri 2a str. 2457T
uguugcgcugaaacuuu

SEQ ID NO: 1940457 - RNA, 21 nt, Shigella flexneri 2a str. 2457T
uguugagaugguuacuuuuua

SEQ ID NO: 1940458 - RNA, 19 nt, Shigella flexneri 2a str. 2457T
uguucugcgcuugguuuug

SEQ ID NO: 1940459 - RNA, 17 nt, Shigella flexneri 2a str. 2457T
uguucguccauuucagc

SEQ ID NO: 1940460 - RNA, 16 nt, Shigella flexneri 2a str. 2457T
uguucguaccugaauu

SEQ ID NO: 1940461 - RNA, 22 nt, Shigella flexneri 2a str. 2457T
uguucguaccugaauuaauuua

SEQ ID NO: 1940462 - RNA, 21 nt, Shigella flexneri 2a str. 2457T
uguucgcccacgcgcauuccc

SEQ ID NO: 1940463 - RNA, 21 nt, Shigella flexneri 2a str. 2457T
uguucgcaaccuaaccaaaca

SEQ ID NO: 1940464 - RNA, 15 nt, Shigella flexneri 2a str. 2457T
uguucgagcaucaca

SEQ ID NO: 1940465 - RNA, 13 nt, Shigella flexneri 2a str. 2457T
uguucucccauag

SEQ ID NO: 1940466 - RNA, 15 nt, Shigella flexneri 2a str. 2457T
uguucucuucauuac

SEQ ID NO: 1940467 - RNA, 16 nt, Shigella flexneri 2a str. 2457T
uguucuacgugcgcua

SEQ ID NO: 1940468 - RNA, 14 nt, Shigella flexneri 2a str. 2457T
uguucguuauuggg

SEQ ID NO: 1940469 - RNA, 20 nt, Shigella flexneri 2a str. 2457T
uguuccugaacgcccgcaua

SEQ ID NO: 1940470 - RNA, 14 nt, Shigella flexneri 2a str. 2457T
uguuccucugcucc

SEQ ID NO: 1940471 - RNA, 15 nt, Shigella flexneri 2a str. 2457T
uguuccgccagcgac

SEQ ID NO: 1940472 - RNA, 18 nt, Shigella flexneri 2a str. 2457T
uguucccgcgccucaggc

SEQ ID NO: 1940473 - RNA, 16 nt, Shigella flexneri 2a str. 2457T
uguuccagcaaauccc

SEQ ID NO: 1940474 - RNA, 13 nt, Shigella flexneri 2a str. 2457T
uguucaucugcau

SEQ ID NO: 1940475 - RNA, 21 nt, Shigella flexneri 2a str. 2457T
uguuccacucuuucagcacca

SEQ ID NO: 1940476 - RNA, 12 nt, Shigella flexneri 2a str. 2457T
uguucaacaauu

SEQ ID NO: 1940477 - RNA, 15 nt, Shigella flexneri 2a str. 2457T
uguucaacaauucgu

SEQ ID NO: 1940478 - RNA, 16 nt, Shigella flexneri 2a str. 2457T
uguucacccaacucuc

SEQ ID NO: 1940479 - RNA, 13 nt, Shigella flexneri 2a str. 2457T
uguucacugugcu

SEQ ID NO: 1940480 - RNA, 12 nt, Shigella flexneri 2a str. 2457T
uguucacugccg

SEQ ID NO: 1940481 - RNA, 13 nt, Shigella flexneri 2a str. 2457T
uguucacugccgu

SEQ ID NO: 1940482 - RNA, 18 nt, Shigella flexneri 2a str. 2457T
uguucagccugacagcac

SEQ ID NO: 1940483 - RNA, 15 nt, Shigella flexneri 2a str. 2457T
uguucagcugcgugc

SEQ ID NO: 1940484 - RNA, 18 nt, Shigella flexneri 2a str. 2457T
uguucagcgggcagggca

SEQ ID NO: 1940485 - RNA, 12 nt, Shigella flexneri 2a str. 2457T
uguucaggagaa

SEQ ID NO: 1940486 - RNA, 20 nt, Shigella flexneri 2a str. 2457T
uguuagcgaauaaaguagaa

SEQ ID NO: 1940487 - RNA, 22 nt, Shigella flexneri 2a str. 2457T
uguuagcaugcuggcugcgcuc

SEQ ID NO: 1940488 - RNA, 20 nt, Shigella flexneri 2a str. 2457T
uguuagaugugggcaaucuc

SEQ ID NO: 1940489 - RNA, 18 nt, Shigella flexneri 2a str. 2457T
uguuagcggcgacaauaa

SEQ ID NO: 1940490 - RNA, 19 nt, Shigella flexneri 2a str. 2457T
uguuaucguuugcauuauc

SEQ ID NO: 1940491 - RNA, 13 nt, Shigella flexneri 2a str. 2457T
uguuauucagaau

SEQ ID NO: 1940492 - RNA, 16 nt, Shigella flexneri 2a str. 2457T
uuaaaaccgaggggcu

SEQ ID NO: 1940493 - RNA, 12 nt, Shigella flexneri 2a str. 2457T
uuaaaaaaagca

SEQ ID NO: 1940494 - RNA, 21 nt, Shigella flexneri 2a str. 2457T
uuaaaaaaggugcucaaugag

SEQ ID NO: 1940495 - RNA, 14 nt, Shigella flexneri 2a str. 2457T
uuaaaaaagaauac

SEQ ID NO: 1940496 - RNA, 11 nt, Shigella flexneri 2a str. 2457T
uuaaaaaagaa

SEQ ID NO: 1940497 - RNA, 18 nt, Shigella flexneri 2a str. 2457T
uuaaaaacccugcagaaa

SEQ ID NO: 1940498 - RNA, 20 nt, Shigella flexneri 2a str. 2457T
uuaaaaagaaaaaacuaaca

SEQ ID NO: 1940499 - RNA, 18 nt, Shigella flexneri 2a str. 2457T
uuaaacaugagcgaauaa

SEQ ID NO: 1940500 - RNA, 21 nt, Shigella flexneri 2a str. 2457T
uuaaacaugagcgaauaaaaa

SEQ ID NO: 1940501 - RNA, 22 nt, Shigella flexneri 2a str. 2457T
uuaaacaugagcgaauaaaaaa

SEQ ID NO: 1940502 - RNA, 17 nt, Shigella flexneri 2a str. 2457T
uuaaacagcuuggauuc

SEQ ID NO: 1940503 - RNA, 16 nt, Shigella flexneri 2a str. 2457T
uuaaaccuaaaaagaa

SEQ ID NO: 1940504 - RNA, 15 nt, Shigella flexneri 2a str. 2457T
uuaaacucugccgca

SEQ ID NO: 1940505 - RNA, 15 nt, Shigella flexneri 2a str. 2457T
uuaaacuuucauaaa

SEQ ID NO: 1940506 - RNA, 22 nt, Shigella flexneri 2a str. 2457T
uuaaacgcaguaagcgccaggg

SEQ ID NO: 1940507 - RNA, 19 nt, Shigella flexneri 2a str. 2457T
uuaaacgcagagacaucac

SEQ ID NO: 1940508 - RNA, 17 nt, Shigella flexneri 2a str. 2457T
uuaaacgggucaucaaa

SEQ ID NO: 1940509 - RNA, 17 nt, Shigella flexneri 2a str. 2457T
uuaaagcaaaaaaagaa

SEQ ID NO: 1940510 - RNA, 22 nt, Shigella flexneri 2a str. 2457T
uuaaagagcauuacacgcggcu

SEQ ID NO: 1940511 - RNA, 16 nt, Shigella flexneri 2a str. 2457T
uguuuuagagaauuaa

SEQ ID NO: 1940512 - RNA, 13 nt, Shigella flexneri 2a str. 2457T
uguuuuauguuca

SEQ ID NO: 1940513 - RNA, 16 nt, Shigella flexneri 2a str. 2457T
uguuuuauguucagau

SEQ ID NO: 1940514 - RNA, 18 nt, Shigella flexneri 2a str. 2457T
uguuugugcugugacaga

SEQ ID NO: 1940515 - RNA, 22 nt, Shigella flexneri 2a str. 2457T
uguuuuaacacacaauuaccuu

SEQ ID NO: 1940516 - RNA, 11 nt, Shigella flexneri 2a str. 2457T
uguuuucucuc

SEQ ID NO: 1940517 - RNA, 14 nt, Shigella flexneri 2a str. 2457T
uguuuugaacuuca

SEQ ID NO: 1940518 - RNA, 13 nt, Shigella flexneri 2a str. 2457T
uguuuauguugug

SEQ ID NO: 1940519 - RNA, 15 nt, Shigella flexneri 2a str. 2457T
uguuuaucuucccag

SEQ ID NO: 1940520 - RNA, 14 nt, Shigella flexneri 2a str. 2457T
uguuuaucaggcca

SEQ ID NO: 1940521 - RNA, 16 nt, Shigella flexneri 2a str. 2457T
uguuucauaucaccgu

SEQ ID NO: 1940522 - RNA, 17 nt, Shigella flexneri 2a str. 2457T
uguuuccagauuuugcu

SEQ ID NO: 1940523 - RNA, 16 nt, Shigella flexneri 2a str. 2457T
uguuuccauauguacg

SEQ ID NO: 1940524 - RNA, 16 nt, Shigella flexneri 2a str. 2457T
uguuuccauccggcaa

SEQ ID NO: 1940525 - RNA, 15 nt, Shigella flexneri 2a str. 2457T
uguuucgaucagcaa

SEQ ID NO: 1940526 - RNA, 14 nt, Shigella flexneri 2a str. 2457T
uguuucugguggaa

SEQ ID NO: 1940527 - RNA, 13 nt, Shigella flexneri 2a str. 2457T
uguuucucuuucu

SEQ ID NO: 1940528 - RNA, 19 nt, Shigella flexneri 2a str. 2457T
uguuugcaggugaccagca

SEQ ID NO: 1940529 - RNA, 14 nt, Shigella flexneri 2a str. 2457T
uguuugaaucaaca

SEQ ID NO: 1940530 - RNA, 16 nt, Shigella flexneri 2a str. 2457T
uguuugaaucaacaua

SEQ ID NO: 1940531 - RNA, 16 nt, Shigella flexneri 2a str. 2457T
uuacaacguauugaaa

SEQ ID NO: 1940532 - RNA, 18 nt, Shigella flexneri 2a str. 2457T
uuaauccacagcaaugca

SEQ ID NO: 1940533 - RNA, 20 nt, Shigella flexneri 2a str. 2457T
uuaaugaacucgagaacacg

SEQ ID NO: 1940534 - RNA, 13 nt, Shigella flexneri 2a str. 2457T
uuaaucugguauc

SEQ ID NO: 1940535 - RNA, 17 nt, Shigella flexneri 2a str. 2457T
uuaaucuuccagaucac

SEQ ID NO: 1940536 - RNA, 20 nt, Shigella flexneri 2a str. 2457T
uuaauuuugugcagcaugca

SEQ ID NO: 1940537 - RNA, 16 nt, Shigella flexneri 2a str. 2457T
uuaauuuucgcccguu

SEQ ID NO: 1940538 - RNA, 19 nt, Shigella flexneri 2a str. 2457T
uuacauaugcgcuggcagu

SEQ ID NO: 1940539 - RNA, 20 nt, Shigella flexneri 2a str. 2457T
uuacaucagcguaggacaca

SEQ ID NO: 1940540 - RNA, 22 nt, Shigella flexneri 2a str. 2457T
uuaccagcccuaauaaaccagu

SEQ ID NO: 1940541 - RNA, 20 nt, Shigella flexneri 2a str. 2457T
uuacaucccuauagauuauu

SEQ ID NO: 1940542 - RNA, 22 nt, Shigella flexneri 2a str. 2457T
uuaccagcaaauugaggaucug

SEQ ID NO: 1940543 - RNA, 22 nt, Shigella flexneri 2a str. 2457T
uuaccguaccaaccgcaauugc

SEQ ID NO: 1940544 - RNA, 20 nt, Shigella flexneri 2a str. 2457T
uuaccguaaccauaaccaau

SEQ ID NO: 1940545 - RNA, 19 nt, Shigella flexneri 2a str. 2457T
uuaccgcuauuugcgccug

SEQ ID NO: 1940546 - RNA, 19 nt, Shigella flexneri 2a str. 2457T
uuacgagugcgcucuucaa

SEQ ID NO: 1940547 - RNA, 19 nt, Shigella flexneri 2a str. 2457T
uuacgauccaccaccgcaa

SEQ ID NO: 1940548 - RNA, 18 nt, Shigella flexneri 2a str. 2457T
uuacgaauauaaauauuu

SEQ ID NO: 1940549 - RNA, 19 nt, Shigella flexneri 2a str. 2457T
uuacgaauauaaauauuuu

SEQ ID NO: 1940550 - RNA, 16 nt, Shigella flexneri 2a str. 2457T
uuacgagucacaaaca

SEQ ID NO: 1940551 - RNA, 19 nt, Shigella flexneri 2a str. 2457T
uuacgacgcaaucaaaaaa

SEQ ID NO: 1940552 - RNA, 14 nt, Shigella flexneri 2a str. 2457T
uuaccucaccgggc

SEQ ID NO: 1940553 - RNA, 14 nt, Shigella flexneri 2a str. 2457T
uuaccucaggcacc

SEQ ID NO: 1940554 - RNA, 13 nt, Shigella flexneri 2a str. 2457T
uuaccuucauuug

SEQ ID NO: 1940555 - RNA, 15 nt, Shigella flexneri 2a str. 2457T
uuaccuucgcuuugu

SEQ ID NO: 1940556 - RNA, 17 nt, Shigella flexneri 2a str. 2457T
uuaccuuuaugacgauc

SEQ ID NO: 1940557 - RNA, 21 nt, Shigella flexneri 2a str. 2457T
uuagaugugggcaaucucacu

SEQ ID NO: 1940558 - RNA, 13 nt, Shigella flexneri 2a str. 2457T
uuagaugcuuuca

SEQ ID NO: 1940559 - RNA, 18 nt, Shigella flexneri 2a str. 2457T
uuagcgcaugaccaguga

SEQ ID NO: 1940560 - RNA, 20 nt, Shigella flexneri 2a str. 2457T
uuagcaacaggccaguucga

SEQ ID NO: 1940561 - RNA, 15 nt, Shigella flexneri 2a str. 2457T
uuagauaaaaaugaa

SEQ ID NO: 1940562 - RNA, 16 nt, Shigella flexneri 2a str. 2457T
uuagaaacaaaaaaac

SEQ ID NO: 1940563 - RNA, 13 nt, Shigella flexneri 2a str. 2457T
uuacucuuaucaa

SEQ ID NO: 1940564 - RNA, 21 nt, Shigella flexneri 2a str. 2457T
uuacuccuuagcaacaggcca

SEQ ID NO: 1940565 - RNA, 13 nt, Shigella flexneri 2a str. 2457T
uuacugacaucaa

SEQ ID NO: 1940566 - RNA, 16 nt, Shigella flexneri 2a str. 2457T
uuacuucaccuucuuu

SEQ ID NO: 1940567 - RNA, 14 nt, Shigella flexneri 2a str. 2457T
uuacgcccgugaug

SEQ ID NO: 1940568 - RNA, 23 nt, Shigella flexneri 2a str. 2457T
uuacgcauuaccccuuccugaac

SEQ ID NO: 1940569 - RNA, 14 nt, Shigella flexneri 2a str. 2457T
uuacgccgcaucag

SEQ ID NO: 1940570 - RNA, 21 nt, Shigella flexneri 2a str. 2457T
uuacgcucccacggaauagaa

SEQ ID NO: 1940571 - RNA, 23 nt, Shigella flexneri 2a str. 2457T
uuacgggcgaaguucgccaucaa

SEQ ID NO: 1940572 - RNA, 17 nt, Shigella flexneri 2a str. 2457T
uuacgggcgauauaccu

SEQ ID NO: 1940573 - RNA, 23 nt, Shigella flexneri 2a str. 2457T
uuacggguucaagucccguccuc

SEQ ID NO: 1940574 - RNA, 18 nt, Shigella flexneri 2a str. 2457T
uuaacuuaauaaacauca

SEQ ID NO: 1940575 - RNA, 22 nt, Shigella flexneri 2a str. 2457T
uuaacugggcgucaaagugaaa

SEQ ID NO: 1940576 - RNA, 21 nt, Shigella flexneri 2a str. 2457T
uuaacugcccgaucaacggau

SEQ ID NO: 1940577 - RNA, 18 nt, Shigella flexneri 2a str. 2457T
uuaacugcgcgauuauca

SEQ ID NO: 1940578 - RNA, 19 nt, Shigella flexneri 2a str. 2457T
uuaacugcgcgauuaucau

SEQ ID NO: 1940579 - RNA, 20 nt, Shigella flexneri 2a str. 2457T
uuaacugcgcgauuaucauu

SEQ ID NO: 1940580 - RNA, 21 nt, Shigella flexneri 2a str. 2457T
uuaagcaagugcaaucuacaa

SEQ ID NO: 1940581 - RNA, 17 nt, Shigella flexneri 2a str. 2457T
uuaagcaaaaaaacaua

SEQ ID NO: 1940582 - RNA, 11 nt, Shigella flexneri 2a str. 2457T
uuaagaaaacg

SEQ ID NO: 1940583 - RNA, 20 nt, Shigella flexneri 2a str. 2457T
uuaagaaaacggaagcucag

SEQ ID NO: 1940584 - RNA, 20 nt, Shigella flexneri 2a str. 2457T
uuaacgcagaaucuucuucu

SEQ ID NO: 1940585 - RNA, 22 nt, Shigella flexneri 2a str. 2457T
uuaaccuuugcgguuaaaaaua

SEQ ID NO: 1940586 - RNA, 13 nt, Shigella flexneri 2a str. 2457T
uuaacgacgcaua

SEQ ID NO: 1940587 - RNA, 18 nt, Shigella flexneri 2a str. 2457T
uuaacgcuucucccagcc

SEQ ID NO: 1940588 - RNA, 18 nt, Shigella flexneri 2a str. 2457T
uuaacggccgaagaagaa

SEQ ID NO: 1940589 - RNA, 17 nt, Shigella flexneri 2a str. 2457T
uuaacggcggcaaauau

SEQ ID NO: 1940590 - RNA, 22 nt, Shigella flexneri 2a str. 2457T
uuaacggcggcaaauauuaugg

SEQ ID NO: 1940591 - RNA, 19 nt, Shigella flexneri 2a str. 2457T
uuaacggaggagagugcaa

SEQ ID NO: 1940592 - RNA, 23 nt, Shigella flexneri 2a str. 2457T
uuaacugacuuucguuugaaaac

SEQ ID NO: 1940593 - RNA, 16 nt, Shigella flexneri 2a str. 2457T
uuaacugauauuuaaa

SEQ ID NO: 1940594 - RNA, 23 nt, Shigella flexneri 2a str. 2457T
uuaacauguguugucgcuguaau

SEQ ID NO: 1940595 - RNA, 14 nt, Shigella flexneri 2a str. 2457T
uuaaccuuauauug

SEQ ID NO: 1940596 - RNA, 19 nt, Shigella flexneri 2a str. 2457T
uuaaucaucaaugccagca

SEQ ID NO: 1940597 - RNA, 13 nt, Shigella flexneri 2a str. 2457T
uuaaucagugcaa

SEQ ID NO: 1940598 - RNA, 16 nt, Shigella flexneri 2a str. 2457T
uuaaucaucaacuggc

SEQ ID NO: 1940599 - RNA, 18 nt, Shigella flexneri 2a str. 2457T
uuaauaccgagcguucaa

SEQ ID NO: 1940600 - RNA, 13 nt, Shigella flexneri 2a str. 2457T
uuaaggguaaaaa

SEQ ID NO: 1940601 - RNA, 14 nt, Shigella flexneri 2a str. 2457T
uuaaggguauuuuu

SEQ ID NO: 1940602 - RNA, 13 nt, Shigella flexneri 2a str. 2457T
uuaagggugauca

SEQ ID NO: 1940603 - RNA, 15 nt, Shigella flexneri 2a str. 2457T
uuaaggcaagaaaau

SEQ ID NO: 1940604 - RNA, 18 nt, Shigella flexneri 2a str. 2457T
uuaaggcagaaacaaacg

SEQ ID NO: 1940605 - RNA, 22 nt, Shigella flexneri 2a str. 2457T
uuaagcaacugacuggcucuuu

SEQ ID NO: 1940606 - RNA, 18 nt, Shigella flexneri 2a str. 2457T
uuaagccaucaucaauau

SEQ ID NO: 1940607 - RNA, 15 nt, Shigella flexneri 2a str. 2457T
uuaagccaucaucaa

SEQ ID NO: 1940608 - RNA, 15 nt, Shigella flexneri 2a str. 2457T
uuaauaaauauuaau

SEQ ID NO: 1940609 - RNA, 19 nt, Shigella flexneri 2a str. 2457T
uuaauaaaaauuuuaguuu

SEQ ID NO: 1940610 - RNA, 16 nt, Shigella flexneri 2a str. 2457T
uuaauaaaauuaucca

SEQ ID NO: 1940611 - RNA, 20 nt, Shigella flexneri 2a str. 2457T
uuaauaaaauuauccagcuu

SEQ ID NO: 1940612 - RNA, 21 nt, Shigella flexneri 2a str. 2457T
uuaauaaaauuauccagcuuu

SEQ ID NO: 1940613 - RNA, 22 nt, Shigella flexneri 2a str. 2457T
uuaaauacauauaagcguuaau

SEQ ID NO: 1940614 - RNA, 18 nt, Shigella flexneri 2a str. 2457T
uuaaauacagcuuaauca

SEQ ID NO: 1940615 - RNA, 19 nt, Shigella flexneri 2a str. 2457T
uuaaauauaaaacaacgga

SEQ ID NO: 1940616 - RNA, 20 nt, Shigella flexneri 2a str. 2457T
uuaaaucgguauuuccauuu

SEQ ID NO: 1940617 - RNA, 16 nt, Shigella flexneri 2a str. 2457T
uuaaauaucaucaaaa

SEQ ID NO: 1940618 - RNA, 18 nt, Shigella flexneri 2a str. 2457T
uuaaaggaaggucaucca

SEQ ID NO: 1940619 - RNA, 17 nt, Shigella flexneri 2a str. 2457T
uuaaaggcaccaauauu

SEQ ID NO: 1940620 - RNA, 16 nt, Shigella flexneri 2a str. 2457T
uuaaaggggugaaaaa

SEQ ID NO: 1940621 - RNA, 21 nt, Shigella flexneri 2a str. 2457T
uuaaaguugagcgaaaacgaa

SEQ ID NO: 1940622 - RNA, 14 nt, Shigella flexneri 2a str. 2457T
uuaaaguuaucgcc

SEQ ID NO: 1940623 - RNA, 17 nt, Shigella flexneri 2a str. 2457T
uuaaauggacgcaaaaa

SEQ ID NO: 1940624 - RNA, 17 nt, Shigella flexneri 2a str. 2457T
uuaaaugauaccgggcu

SEQ ID NO: 1940625 - RNA, 14 nt, Shigella flexneri 2a str. 2457T
uuaaauuaauaauc

SEQ ID NO: 1940626 - RNA, 14 nt, Shigella flexneri 2a str. 2457T
uuaacaaucacaau

SEQ ID NO: 1940627 - RNA, 19 nt, Shigella flexneri 2a str. 2457T
uuaacacacaauuaccuuc

SEQ ID NO: 1940628 - RNA, 13 nt, Shigella flexneri 2a str. 2457T
uuaaauuuaauaa

SEQ ID NO: 1940629 - RNA, 17 nt, Shigella flexneri 2a str. 2457T
uuaaauuucuuguauua

SEQ ID NO: 1940630 - RNA, 18 nt, Shigella flexneri 2a str. 2457T
ucuauacuuaucuuuuug

SEQ ID NO: 1940631 - RNA, 23 nt, Shigella flexneri 2a str. 2457T
ucuauauuacgagucacaaacau

SEQ ID NO: 1940632 - RNA, 20 nt, Shigella flexneri 2a str. 2457T
ucuaugagaaaauuucauua

SEQ ID NO: 1940633 - RNA, 16 nt, Shigella flexneri 2a str. 2457T
ucuaugagaaaauuuc

SEQ ID NO: 1940634 - RNA, 16 nt, Shigella flexneri 2a str. 2457T
ucuaucuuucagaccu

SEQ ID NO: 1940635 - RNA, 10 nt, Shigella flexneri 2a str. 2457T
ucuaucugcc

SEQ ID NO: 1940636 - RNA, 18 nt, Shigella flexneri 2a str. 2457T
ucuaucaggacgaaaaau

SEQ ID NO: 1940637 - RNA, 17 nt, Shigella flexneri 2a str. 2457T
ucuauccagcucaucca

SEQ ID NO: 1940638 - RNA, 15 nt, Shigella flexneri 2a str. 2457T
ucuaucaucagcaug

SEQ ID NO: 1940639 - RNA, 16 nt, Shigella flexneri 2a str. 2457T
ucuaucaacaguuugu

SEQ ID NO: 1940640 - RNA, 18 nt, Shigella flexneri 2a str. 2457T
ucuaucaacaguuuguug

SEQ ID NO: 1940641 - RNA, 20 nt, Shigella flexneri 2a str. 2457T
aaaugaucgccgaagugaag

SEQ ID NO: 1940642 - RNA, 14 nt, Shigella flexneri 2a str. 2457T
aaaugaucgccgga

SEQ ID NO: 1940643 - RNA, 12 nt, Shigella flexneri 2a str. 2457T
aaaugauuuccu

SEQ ID NO: 1940644 - RNA, 14 nt, Shigella flexneri 2a str. 2457T
aaaugcaguuuuua

SEQ ID NO: 1940645 - RNA, 13 nt, Shigella flexneri 2a str. 2457T
ucucauccaucaa

SEQ ID NO: 1940646 - RNA, 22 nt, Shigella flexneri 2a str. 2457T
ucucaucgccaucaauaaccag

SEQ ID NO: 1940647 - RNA, 21 nt, Shigella flexneri 2a str. 2457T
ucucaucgcugcgcucuaaaa

SEQ ID NO: 1940648 - RNA, 23 nt, Shigella flexneri 2a str. 2457T
ucucagguagcgcauaagccacc

SEQ ID NO: 1940649 - RNA, 19 nt, Shigella flexneri 2a str. 2457T
ucucaguggcuauuuacca

SEQ ID NO: 1940650 - RNA, 22 nt, Shigella flexneri 2a str. 2457T
ucucaguggcuauuuaccaaua

SEQ ID NO: 1940651 - RNA, 23 nt, Shigella flexneri 2a str. 2457T
ucucaggccuacaaaaucuugca

SEQ ID NO: 1940652 - RNA, 18 nt, Shigella flexneri 2a str. 2457T
ucucagcucauuaaaaau

SEQ ID NO: 1940653 - RNA, 23 nt, Shigella flexneri 2a str. 2457T
ucucagcgccgcuuuccaggcug

SEQ ID NO: 1940654 - RNA, 18 nt, Shigella flexneri 2a str. 2457T
ucucagccagcuggcaga

SEQ ID NO: 1940655 - RNA, 21 nt, Shigella flexneri 2a str. 2457T
ucucagcgccgcuuuccaggc

SEQ ID NO: 1940656 - RNA, 11 nt, Shigella flexneri 2a str. 2457T
ucucagcagac

SEQ ID NO: 1940657 - RNA, 21 nt, Shigella flexneri 2a str. 2457T
ucucagagaacuguagacaaa

SEQ ID NO: 1940658 - RNA, 18 nt, Shigella flexneri 2a str. 2457T
ucucacuuggguaacagc

SEQ ID NO: 1940659 - RNA, 20 nt, Shigella flexneri 2a str. 2457T
ucucacuuggguaacagccc

SEQ ID NO: 1940660 - RNA, 13 nt, Shigella flexneri 2a str. 2457T
aaaugccgcacau

SEQ ID NO: 1940661 - RNA, 19 nt, Shigella flexneri 2a str. 2457T
aaaugccagauaagacacu

SEQ ID NO: 1940662 - RNA, 11 nt, Shigella flexneri 2a str. 2457T
aaaugccagau

SEQ ID NO: 1940663 - RNA, 18 nt, Shigella flexneri 2a str. 2457T
aaaugcgcuuuauucaga

SEQ ID NO: 1940664 - RNA, 22 nt, Shigella flexneri 2a str. 2457T
ucucacccggaggaaagcaccu

SEQ ID NO: 1940665 - RNA, 18 nt, Shigella flexneri 2a str. 2457T
ucucacuguucacuuuug

SEQ ID NO: 1940666 - RNA, 13 nt, Shigella flexneri 2a str. 2457T
ucucacucaccgc

SEQ ID NO: 1940667 - RNA, 16 nt, Shigella flexneri 2a str. 2457T
ucucacuccagccaga

SEQ ID NO: 1940668 - RNA, 19 nt, Shigella flexneri 2a str. 2457T
ucucacuccggccagagca

SEQ ID NO: 1940669 - RNA, 19 nt, Shigella flexneri 2a str. 2457T
aaaugccuuucucagaagu

SEQ ID NO: 1940670 - RNA, 13 nt, Shigella flexneri 2a str. 2457T
ucucaccccauuu

SEQ ID NO: 1940671 - RNA, 22 nt, Shigella flexneri 2a str. 2457T
ucucacccgcaaacaggaacac

SEQ ID NO: 1940672 - RNA, 18 nt, Shigella flexneri 2a str. 2457T
ucucacccgcuucauaac

SEQ ID NO: 1940673 - RNA, 13 nt, Shigella flexneri 2a str. 2457T
ucuauuaauuaug

SEQ ID NO: 1940674 - RNA, 15 nt, Shigella flexneri 2a str. 2457T
ucuauucaccgcauc

SEQ ID NO: 1940675 - RNA, 21 nt, Shigella flexneri 2a str. 2457T
ucuauucaccgcaucaauauu

SEQ ID NO: 1940676 - RNA, 13 nt, Shigella flexneri 2a str. 2457T
ucuauuaaaaagc

SEQ ID NO: 1940677 - RNA, 18 nt, Shigella flexneri 2a str. 2457T
ucuauugcaacauguuga

SEQ ID NO: 1940678 - RNA, 20 nt, Shigella flexneri 2a str. 2457T
ucuauuccgcgugaaaugcc

SEQ ID NO: 1940679 - RNA, 14 nt, Shigella flexneri 2a str. 2457T
ucucaagagugaac

SEQ ID NO: 1940680 - RNA, 13 nt, Shigella flexneri 2a str. 2457T
ucucaagcaaguu

SEQ ID NO: 1940681 - RNA, 19 nt, Shigella flexneri 2a str. 2457T
ucucaaucucuuuuuccac

SEQ ID NO: 1940682 - RNA, 18 nt, Shigella flexneri 2a str. 2457T
ucucaauguauucccgua

SEQ ID NO: 1940683 - RNA, 17 nt, Shigella flexneri 2a str. 2457T
ucucaauuacugucguu

SEQ ID NO: 1940684 - RNA, 14 nt, Shigella flexneri 2a str. 2457T
ucucaauuuucacu

SEQ ID NO: 1940685 - RNA, 15 nt, Shigella flexneri 2a str. 2457T
ucucaauaucaucau

SEQ ID NO: 1940686 - RNA, 18 nt, Shigella flexneri 2a str. 2457T
ucucaaucccuuucucuu

SEQ ID NO: 1940687 - RNA, 13 nt, Shigella flexneri 2a str. 2457T
ucucaaucaccac

SEQ ID NO: 1940688 - RNA, 12 nt, Shigella flexneri 2a str. 2457T
ucucaaucccuu

SEQ ID NO: 1940689 - RNA, 22 nt, Shigella flexneri 2a str. 2457T
ucuaauggugaacugacagcca

SEQ ID NO: 1940690 - RNA, 20 nt, Shigella flexneri 2a str. 2457T
ucuaaugcguagaccggaaa

SEQ ID NO: 1940691 - RNA, 21 nt, Shigella flexneri 2a str. 2457T
ucuaaucgcacaaaaucauga

SEQ ID NO: 1940692 - RNA, 21 nt, Shigella flexneri 2a str. 2457T
ucuacaaccagcuuaugccug

SEQ ID NO: 1940693 - RNA, 21 nt, Shigella flexneri 2a str. 2457T
ucuacacagacgguuuuucaa

SEQ ID NO: 1940694 - RNA, 14 nt, Shigella flexneri 2a str. 2457T
ucuacagaaaugaa

SEQ ID NO: 1940695 - RNA, 12 nt, Shigella flexneri 2a str. 2457T
ucuacaccaacg

SEQ ID NO: 1940696 - RNA, 22 nt, Shigella flexneri 2a str. 2457T
ucuaauuuuuugcgccacuuuu

SEQ ID NO: 1940697 - RNA, 14 nt, Shigella flexneri 2a str. 2457T
ucuacauucauaga

SEQ ID NO: 1940698 - RNA, 11 nt, Shigella flexneri 2a str. 2457T
ucuacaguacg

SEQ ID NO: 1940699 - RNA, 17 nt, Shigella flexneri 2a str. 2457T
ucuacagcauuuccuua

SEQ ID NO: 1940700 - RNA, 13 nt, Shigella flexneri 2a str. 2457T
aaaugaggaauua

SEQ ID NO: 1940701 - RNA, 22 nt, Shigella flexneri 2a str. 2457T
ucuacucguuuauuaugccaca

SEQ ID NO: 1940702 - RNA, 18 nt, Shigella flexneri 2a str. 2457T
ucuacgacuugaaaaagu

SEQ ID NO: 1940703 - RNA, 17 nt, Shigella flexneri 2a str. 2457T
ucuacucguuuauuaug

SEQ ID NO: 1940704 - RNA, 23 nt, Shigella flexneri 2a str. 2457T
ucuaccccagugguuucgccagc

SEQ ID NO: 1940705 - RNA, 14 nt, Shigella flexneri 2a str. 2457T
ucuaccgcaccuuc

SEQ ID NO: 1940706 - RNA, 19 nt, Shigella flexneri 2a str. 2457T
ucuaccgucuguaaccaga

SEQ ID NO: 1940707 - RNA, 23 nt, Shigella flexneri 2a str. 2457T
ucuaccagaugcucuuuucugaa

SEQ ID NO: 1940708 - RNA, 15 nt, Shigella flexneri 2a str. 2457T
ucuaccaucaauggc

SEQ ID NO: 1940709 - RNA, 16 nt, Shigella flexneri 2a str. 2457T
ucuaccagcaccugcu

SEQ ID NO: 1940710 - RNA, 19 nt, Shigella flexneri 2a str. 2457T
aaaugaccauaaaaggcac

SEQ ID NO: 1940711 - RNA, 16 nt, Shigella flexneri 2a str. 2457T
aaaugaccauaaaagg

SEQ ID NO: 1940712 - RNA, 20 nt, Shigella flexneri 2a str. 2457T
ucuaagcugccuguacggca

SEQ ID NO: 1940713 - RNA, 14 nt, Shigella flexneri 2a str. 2457T
aaaugaacugggca

SEQ ID NO: 1940714 - RNA, 12 nt, Shigella flexneri 2a str. 2457T
aaaugaaaaaau

SEQ ID NO: 1940715 - RNA, 14 nt, Shigella flexneri 2a str. 2457T
aaaucuuucauuuc

SEQ ID NO: 1940716 - RNA, 11 nt, Shigella flexneri 2a str. 2457T
aaaucuuuaua

SEQ ID NO: 1940717 - RNA, 16 nt, Shigella flexneri 2a str. 2457T
aaaucuuuauaauuaa

SEQ ID NO: 1940718 - RNA, 17 nt, Shigella flexneri 2a str. 2457T
ucuaaaguauguaauaa

SEQ ID NO: 1940719 - RNA, 21 nt, Shigella flexneri 2a str. 2457T
ucuaacaaccuugccauucca

SEQ ID NO: 1940720 - RNA, 16 nt, Shigella flexneri 2a str. 2457T
ucuaaccauuauuaaa

SEQ ID NO: 1940721 - RNA, 14 nt, Shigella flexneri 2a str. 2457T
ucguuuuuuauucc

SEQ ID NO: 1940722 - RNA, 17 nt, Shigella flexneri 2a str. 2457T
ucguuugcaggccugau

SEQ ID NO: 1940723 - RNA, 14 nt, Shigella flexneri 2a str. 2457T
ucguuugcugccuu

SEQ ID NO: 1940724 - RNA, 19 nt, Shigella flexneri 2a str. 2457T
ucuggugggugcuuuaaaa

SEQ ID NO: 1940725 - RNA, 20 nt, Shigella flexneri 2a str. 2457T
ucuggugaccugggaaaucc

SEQ ID NO: 1940726 - RNA, 17 nt, Shigella flexneri 2a str. 2457T
ucuggucaguuggcugg

SEQ ID NO: 1940727 - RNA, 23 nt, Shigella flexneri 2a str. 2457T
ucuggcugacauaaacaccagca

SEQ ID NO: 1940728 - RNA, 16 nt, Shigella flexneri 2a str. 2457T
ucuggcuguuucgcuu

SEQ ID NO: 1940729 - RNA, 20 nt, Shigella flexneri 2a str. 2457T
ucugggcaaaaucaucacuc

SEQ ID NO: 1940730 - RNA, 15 nt, Shigella flexneri 2a str. 2457T
ucuggcaccuguacc

SEQ ID NO: 1940731 - RNA, 22 nt, Shigella flexneri 2a str. 2457T
ucuggcuacugaugguuuuaau

SEQ ID NO: 1940732 - RNA, 19 nt, Shigella flexneri 2a str. 2457T
ucuggcguugcuggaccuu

SEQ ID NO: 1940733 - RNA, 13 nt, Shigella flexneri 2a str. 2457T
ucuggcagcgcgc

SEQ ID NO: 1940734 - RNA, 18 nt, Shigella flexneri 2a str. 2457T
ucuggcgucaaagcugcu

SEQ ID NO: 1940735 - RNA, 20 nt, Shigella flexneri 2a str. 2457T
ucuggcauaaacaaagcgca

SEQ ID NO: 1940736 - RNA, 17 nt, Shigella flexneri 2a str. 2457T
ucuggcguacagagggc

SEQ ID NO: 1940737 - RNA, 23 nt, Shigella flexneri 2a str. 2457T
ucuggcguacagagggcaggcaa

SEQ ID NO: 1940738 - RNA, 19 nt, Shigella flexneri 2a str. 2457T
ucugccagccauaaaaaag

SEQ ID NO: 1940739 - RNA, 22 nt, Shigella flexneri 2a str. 2457T
ucugccagacgguaaccccucu

SEQ ID NO: 1940740 - RNA, 17 nt, Shigella flexneri 2a str. 2457T
ucugcuuucucagcaaa

SEQ ID NO: 1940741 - RNA, 17 nt, Shigella flexneri 2a str. 2457T
ucugcuuuucccuccac

SEQ ID NO: 1940742 - RNA, 18 nt, Shigella flexneri 2a str. 2457T
ucugcuuuucccuccacu

SEQ ID NO: 1940743 - RNA, 16 nt, Shigella flexneri 2a str. 2457T
ucugcuuuucguucag

SEQ ID NO: 1940744 - RNA, 21 nt, Shigella flexneri 2a str. 2457T
ucugcauggucgauucuuaua

SEQ ID NO: 1940745 - RNA, 13 nt, Shigella flexneri 2a str. 2457T
ucugcauuuucuc

SEQ ID NO: 1940746 - RNA, 14 nt, Shigella flexneri 2a str. 2457T
ucugcauuuucucg

SEQ ID NO: 1940747 - RNA, 13 nt, Shigella flexneri 2a str. 2457T
ucugccacgccac

SEQ ID NO: 1940748 - RNA, 18 nt, Shigella flexneri 2a str. 2457T
ucugccacgccacgcugc

SEQ ID NO: 1940749 - RNA, 23 nt, Shigella flexneri 2a str. 2457T
ucuguguaaaugccuuucucaga

SEQ ID NO: 1940750 - RNA, 14 nt, Shigella flexneri 2a str. 2457T
ucuguaugacaaca

SEQ ID NO: 1940751 - RNA, 18 nt, Shigella flexneri 2a str. 2457T
ucugucaguuggcugugg

SEQ ID NO: 1940752 - RNA, 16 nt, Shigella flexneri 2a str. 2457T
ucugucaguuggcugu

SEQ ID NO: 1940753 - RNA, 16 nt, Shigella flexneri 2a str. 2457T
ucugucagguaacaag

SEQ ID NO: 1940754 - RNA, 22 nt, Shigella flexneri 2a str. 2457T
ucugucaguggacgauaagcac

SEQ ID NO: 1940755 - RNA, 15 nt, Shigella flexneri 2a str. 2457T
ucuguaccaccagaa

SEQ ID NO: 1940756 - RNA, 21 nt, Shigella flexneri 2a str. 2457T
ucugguuucaguaauccuuuc

SEQ ID NO: 1940757 - RNA, 13 nt, Shigella flexneri 2a str. 2457T
ucugguugagcag

SEQ ID NO: 1940758 - RNA, 22 nt, Shigella flexneri 2a str. 2457T
ucugguuucaguaauccuuucu

SEQ ID NO: 1940759 - RNA, 23 nt, Shigella flexneri 2a str. 2457T
ucugguucgccaaaugucaccag

SEQ ID NO: 1940760 - RNA, 13 nt, Shigella flexneri 2a str. 2457T
ucuguaacaaggu

SEQ ID NO: 1940761 - RNA, 23 nt, Shigella flexneri 2a str. 2457T
ucuuccagcgcaaggaaauaacg

SEQ ID NO: 1940762 - RNA, 20 nt, Shigella flexneri 2a str. 2457T
ucuuccagaauaaacaacug

SEQ ID NO: 1940763 - RNA, 21 nt, Shigella flexneri 2a str. 2457T
ucuuccagcagcggcagauca

SEQ ID NO: 1940764 - RNA, 21 nt, Shigella flexneri 2a str. 2457T
ucuuccagaucaccgcagaag

SEQ ID NO: 1940765 - RNA, 16 nt, Shigella flexneri 2a str. 2457T
ucuuccagcaaaucca

SEQ ID NO: 1940766 - RNA, 14 nt, Shigella flexneri 2a str. 2457T
ucuuccacgccugc

SEQ ID NO: 1940767 - RNA, 15 nt, Shigella flexneri 2a str. 2457T
ucuucacuucuucaa

SEQ ID NO: 1940768 - RNA, 16 nt, Shigella flexneri 2a str. 2457T
ucuucacggaaaauau

SEQ ID NO: 1940769 - RNA, 22 nt, Shigella flexneri 2a str. 2457T
ucuucacaccaucaaagaagcu

SEQ ID NO: 1940770 - RNA, 14 nt, Shigella flexneri 2a str. 2457T
ucuucacaucauca

SEQ ID NO: 1940771 - RNA, 13 nt, Shigella flexneri 2a str. 2457T
ucuucaaugguca

SEQ ID NO: 1940772 - RNA, 16 nt, Shigella flexneri 2a str. 2457T
ucuuccuucagcuccc

SEQ ID NO: 1940773 - RNA, 13 nt, Shigella flexneri 2a str. 2457T
ucuucgccugccu

SEQ ID NO: 1940774 - RNA, 21 nt, Shigella flexneri 2a str. 2457T
ucuucccagguuucaaugccg

SEQ ID NO: 1940775 - RNA, 14 nt, Shigella flexneri 2a str. 2457T
ucuucccagccccc

SEQ ID NO: 1940776 - RNA, 17 nt, Shigella flexneri 2a str. 2457T
ucuucccagcccccgca

SEQ ID NO: 1940777 - RNA, 19 nt, Shigella flexneri 2a str. 2457T
ucuuccggcaccauuccac

SEQ ID NO: 1940778 - RNA, 17 nt, Shigella flexneri 2a str. 2457T
ucuuccggcgauucuuu

SEQ ID NO: 1940779 - RNA, 21 nt, Shigella flexneri 2a str. 2457T
ucuuccggcgauucuuugcug

SEQ ID NO: 1940780 - RNA, 22 nt, Shigella flexneri 2a str. 2457T
ucuuccgggcuauauacccuuc

SEQ ID NO: 1940781 - RNA, 19 nt, Shigella flexneri 2a str. 2457T
ucuuccauaaucgacuccc

SEQ ID NO: 1940782 - RNA, 14 nt, Shigella flexneri 2a str. 2457T
ucuuccagucgccu

SEQ ID NO: 1940783 - RNA, 13 nt, Shigella flexneri 2a str. 2457T
ucuuccaguuccg

SEQ ID NO: 1940784 - RNA, 21 nt, Shigella flexneri 2a str. 2457T
ucuguuaucacuuaacccauu

SEQ ID NO: 1940785 - RNA, 15 nt, Shigella flexneri 2a str. 2457T
ucuguucaucuauac

SEQ ID NO: 1940786 - RNA, 14 nt, Shigella flexneri 2a str. 2457T
ucugugccgcugac

SEQ ID NO: 1940787 - RNA, 23 nt, Shigella flexneri 2a str. 2457T
ucuguugugccacauccaguggc

SEQ ID NO: 1940788 - RNA, 18 nt, Shigella flexneri 2a str. 2457T
ucuguuguaauaguguau

SEQ ID NO: 1940789 - RNA, 14 nt, Shigella flexneri 2a str. 2457T
ucuuaccccugauu

SEQ ID NO: 1940790 - RNA, 21 nt, Shigella flexneri 2a str. 2457T
ucuuacccuuccuuagcaaaa

SEQ ID NO: 1940791 - RNA, 13 nt, Shigella flexneri 2a str. 2457T
ucuuacauuccgu

SEQ ID NO: 1940792 - RNA, 16 nt, Shigella flexneri 2a str. 2457T
ucuguuuccagauuuu

SEQ ID NO: 1940793 - RNA, 17 nt, Shigella flexneri 2a str. 2457T
ucuuacgcgaauaguuu

SEQ ID NO: 1940794 - RNA, 19 nt, Shigella flexneri 2a str. 2457T
ucuuacuaaguacauuaag

SEQ ID NO: 1940795 - RNA, 20 nt, Shigella flexneri 2a str. 2457T
ucuuauccugcguuuguccg

SEQ ID NO: 1940796 - RNA, 14 nt, Shigella flexneri 2a str. 2457T
ucuucaacugccau

SEQ ID NO: 1940797 - RNA, 19 nt, Shigella flexneri 2a str. 2457T
ucuucaacugccaugaccg

SEQ ID NO: 1940798 - RNA, 13 nt, Shigella flexneri 2a str. 2457T
ucuucaacuucag

SEQ ID NO: 1940799 - RNA, 17 nt, Shigella flexneri 2a str. 2457T
ucuucaacuucagcagc

SEQ ID NO: 1940800 - RNA, 18 nt, Shigella flexneri 2a str. 2457T
ucuucaacuucagcagca

SEQ ID NO: 1940801 - RNA, 16 nt, Shigella flexneri 2a str. 2457T
ucuucaagaauacugu

SEQ ID NO: 1940802 - RNA, 17 nt, Shigella flexneri 2a str. 2457T
ucuuauaugaugaaacu

SEQ ID NO: 1940803 - RNA, 15 nt, Shigella flexneri 2a str. 2457T
ucuuauaaagaaaau

SEQ ID NO: 1940804 - RNA, 23 nt, Shigella flexneri 2a str. 2457T
ucuuaucacgaugcuaaaaacau

SEQ ID NO: 1940805 - RNA, 17 nt, Shigella flexneri 2a str. 2457T
ucuuaucaggccuacaa

SEQ ID NO: 1940806 - RNA, 13 nt, Shigella flexneri 2a str. 2457T
ucuuaucaggccu

SEQ ID NO: 1940807 - RNA, 22 nt, Shigella flexneri 2a str. 2457T
ucuuaucaggccuaccuuaacc

SEQ ID NO: 1940808 - RNA, 16 nt, Shigella flexneri 2a str. 2457T
ucuuaucaggccugug

SEQ ID NO: 1940809 - RNA, 20 nt, Shigella flexneri 2a str. 2457T
ucuuaucaugccuacauauu

SEQ ID NO: 1940810 - RNA, 19 nt, Shigella flexneri 2a str. 2457T
ucuuaucaguauacgccac

SEQ ID NO: 1940811 - RNA, 17 nt, Shigella flexneri 2a str. 2457T
ucuuauccagcaaccag

SEQ ID NO: 1940812 - RNA, 17 nt, Shigella flexneri 2a str. 2457T
ucugagcggccuuuucc

SEQ ID NO: 1940813 - RNA, 18 nt, Shigella flexneri 2a str. 2457T
ucugcacaucuaaccauu

SEQ ID NO: 1940814 - RNA, 17 nt, Shigella flexneri 2a str. 2457T
ucugcaauuuaccuuuc

SEQ ID NO: 1940815 - RNA, 22 nt, Shigella flexneri 2a str. 2457T
ucucuuuccuuaauaaaaauuu

SEQ ID NO: 1940816 - RNA, 18 nt, Shigella flexneri 2a str. 2457T
ucucuuucggcagugcca

SEQ ID NO: 1940817 - RNA, 18 nt, Shigella flexneri 2a str. 2457T
ucucuuuaaaaaguaaaa

SEQ ID NO: 1940818 - RNA, 13 nt, Shigella flexneri 2a str. 2457T
ucugaaaaucaua

SEQ ID NO: 1940819 - RNA, 22 nt, Shigella flexneri 2a str. 2457T
ucugacaccaucacccaacaau

SEQ ID NO: 1940820 - RNA, 20 nt, Shigella flexneri 2a str. 2457T
ucugaccacggccacagcca

SEQ ID NO: 1940821 - RNA, 15 nt, Shigella flexneri 2a str. 2457T
ucugaccggccagca

SEQ ID NO: 1940822 - RNA, 16 nt, Shigella flexneri 2a str. 2457T
ucugaccgucuuucau

SEQ ID NO: 1940823 - RNA, 19 nt, Shigella flexneri 2a str. 2457T
ucugacauuuuuacuccuu

SEQ ID NO: 1940824 - RNA, 23 nt, Shigella flexneri 2a str. 2457T
ucugacauuuuuacuccuuagca

SEQ ID NO: 1940825 - RNA, 14 nt, Shigella flexneri 2a str. 2457T
ucugacgaaaucaa

SEQ ID NO: 1940826 - RNA, 18 nt, Shigella flexneri 2a str. 2457T
ucugacgcugaauacgca

SEQ ID NO: 1940827 - RNA, 18 nt, Shigella flexneri 2a str. 2457T
ucucuuggggcuucaucu

SEQ ID NO: 1940828 - RNA, 14 nt, Shigella flexneri 2a str. 2457T
ucucuugccaggcu

SEQ ID NO: 1940829 - RNA, 13 nt, Shigella flexneri 2a str. 2457T
ucucuucuccuug

SEQ ID NO: 1940830 - RNA, 23 nt, Shigella flexneri 2a str. 2457T
ucucuucggcuucugccuuaucc

SEQ ID NO: 1940831 - RNA, 15 nt, Shigella flexneri 2a str. 2457T
ucucuucguuuucaa

SEQ ID NO: 1940832 - RNA, 17 nt, Shigella flexneri 2a str. 2457T
ucucugacgcucucuac

SEQ ID NO: 1940833 - RNA, 22 nt, Shigella flexneri 2a str. 2457T
ucucugaaguagccaguaccac

SEQ ID NO: 1940834 - RNA, 18 nt, Shigella flexneri 2a str. 2457T
ucucuggcuguuucgcuu

SEQ ID NO: 1940835 - RNA, 18 nt, Shigella flexneri 2a str. 2457T
ucucugcgcuauccagcg

SEQ ID NO: 1940836 - RNA, 15 nt, Shigella flexneri 2a str. 2457T
ucucugcuccugaug

SEQ ID NO: 1940837 - RNA, 21 nt, Shigella flexneri 2a str. 2457T
ucucuggcuguuucgcuucuu

SEQ ID NO: 1940838 - RNA, 13 nt, Shigella flexneri 2a str. 2457T
ucucgugccacca

SEQ ID NO: 1940839 - RNA, 15 nt, Shigella flexneri 2a str. 2457T
ucucggcgcggcccu

SEQ ID NO: 1940840 - RNA, 20 nt, Shigella flexneri 2a str. 2457T
ucucucugauuacccuucgc

SEQ ID NO: 1940841 - RNA, 14 nt, Shigella flexneri 2a str. 2457T
ucucuccuuucggc

SEQ ID NO: 1940842 - RNA, 17 nt, Shigella flexneri 2a str. 2457T
ucuccuguucucacuaa

SEQ ID NO: 1940843 - RNA, 18 nt, Shigella flexneri 2a str. 2457T
ucuccuguugugaugcaa

SEQ ID NO: 1940844 - RNA, 17 nt, Shigella flexneri 2a str. 2457T
ucuccuguugugaugca

SEQ ID NO: 1940845 - RNA, 14 nt, Shigella flexneri 2a str. 2457T
ucuccuuacugccc

SEQ ID NO: 1940846 - RNA, 12 nt, Shigella flexneri 2a str. 2457T
ucuccugcgcac

SEQ ID NO: 1940847 - RNA, 21 nt, Shigella flexneri 2a str. 2457T
ucuccugccaauacaaaauuu

SEQ ID NO: 1940848 - RNA, 20 nt, Shigella flexneri 2a str. 2457T
ucuccugcggcgacaaaugu

SEQ ID NO: 1940849 - RNA, 14 nt, Shigella flexneri 2a str. 2457T
ucuccuccgaugac

SEQ ID NO: 1940850 - RNA, 22 nt, Shigella flexneri 2a str. 2457T
ucuccgcugagacgcgcuugca

SEQ ID NO: 1940851 - RNA, 15 nt, Shigella flexneri 2a str. 2457T
ucucgaucacuucgc

SEQ ID NO: 1940852 - RNA, 18 nt, Shigella flexneri 2a str. 2457T
ucucgauaaaccauccug

SEQ ID NO: 1940853 - RNA, 24 nt, Shigella flexneri 2a str. 2457T
ucuccuuuauagugugcaaucacu

SEQ ID NO: 1940854 - RNA, 15 nt, Shigella flexneri 2a str. 2457T
ucuccuuugccaaaa

SEQ ID NO: 1940855 - RNA, 17 nt, Shigella flexneri 2a str. 2457T
ucuccuuuaccacucuc

SEQ ID NO: 1940856 - RNA, 22 nt, Shigella flexneri 2a str. 2457T
ucucgaucgauaggaauuaaaa

SEQ ID NO: 1940857 - RNA, 23 nt, Shigella flexneri 2a str. 2457T
ucucgcgcagcgguuucacagga

SEQ ID NO: 1940858 - RNA, 20 nt, Shigella flexneri 2a str. 2457T
ucucccucaucauuugaaau

SEQ ID NO: 1940859 - RNA, 21 nt, Shigella flexneri 2a str. 2457T
ucuccccgaaggggcgaggga

SEQ ID NO: 1940860 - RNA, 13 nt, Shigella flexneri 2a str. 2457T
ucucccaguaagc

SEQ ID NO: 1940861 - RNA, 23 nt, Shigella flexneri 2a str. 2457T
ucucccgaaugaccgccccugcg

SEQ ID NO: 1940862 - RNA, 20 nt, Shigella flexneri 2a str. 2457T
ucucccgaaaaaccugacgu

SEQ ID NO: 1940863 - RNA, 18 nt, Shigella flexneri 2a str. 2457T
ucucaucuuugaaaucac

SEQ ID NO: 1940864 - RNA, 19 nt, Shigella flexneri 2a str. 2457T
ucuccagcuucaaaucauu

SEQ ID NO: 1940865 - RNA, 12 nt, Shigella flexneri 2a str. 2457T
ucuccagcuccc

SEQ ID NO: 1940866 - RNA, 15 nt, Shigella flexneri 2a str. 2457T
ucuccagcuccccac

SEQ ID NO: 1940867 - RNA, 16 nt, Shigella flexneri 2a str. 2457T
ucuccagauaauuaug

SEQ ID NO: 1940868 - RNA, 18 nt, Shigella flexneri 2a str. 2457T
ucuccagcaguucuacug

SEQ ID NO: 1940869 - RNA, 21 nt, Shigella flexneri 2a str. 2457T
ucuccaacaucgaaaacgcca

SEQ ID NO: 1940870 - RNA, 22 nt, Shigella flexneri 2a str. 2457T
ucuccaacaucgaaaacgccac

SEQ ID NO: 1940871 - RNA, 14 nt, Shigella flexneri 2a str. 2457T
ucuccacagucagg

SEQ ID NO: 1940872 - RNA, 15 nt, Shigella flexneri 2a str. 2457T
ucguuguaacugucu

SEQ ID NO: 1940873 - RNA, 14 nt, Shigella flexneri 2a str. 2457T
ucguuggauauuuu

SEQ ID NO: 1940874 - RNA, 21 nt, Shigella flexneri 2a str. 2457T
ucguugugggccgaaaugaga

SEQ ID NO: 1940875 - RNA, 23 nt, Shigella flexneri 2a str. 2457T
ucguugccugcgaagcucuuucg

SEQ ID NO: 1940876 - RNA, 22 nt, Shigella flexneri 2a str. 2457T
ucguugcgccgggaugauggcu

SEQ ID NO: 1940877 - RNA, 17 nt, Shigella flexneri 2a str. 2457T
ucguugccgaagcggcg

SEQ ID NO: 1940878 - RNA, 19 nt, Shigella flexneri 2a str. 2457T
ucguugauaauaaagcuac

SEQ ID NO: 1940879 - RNA, 14 nt, Shigella flexneri 2a str. 2457T
ucguugaagucagg

SEQ ID NO: 1940880 - RNA, 13 nt, Shigella flexneri 2a str. 2457T
ucguucauauauu

SEQ ID NO: 1940881 - RNA, 18 nt, Shigella flexneri 2a str. 2457T
ucguucgcaccaaaucca

SEQ ID NO: 1940882 - RNA, 15 nt, Shigella flexneri 2a str. 2457T
ucguuaaauucuaau

SEQ ID NO: 1940883 - RNA, 22 nt, Shigella flexneri 2a str. 2457T
ucguguggaguaauaauuucug

SEQ ID NO: 1940884 - RNA, 21 nt, Shigella flexneri 2a str. 2457T
ucguguugaugcuccuggcga

SEQ ID NO: 1940885 - RNA, 23 nt, Shigella flexneri 2a str. 2457T
ucguguugcaccgaguucuucac

SEQ ID NO: 1940886 - RNA, 16 nt, Shigella flexneri 2a str. 2457T
ucgugguaagaaggcc

SEQ ID NO: 1940887 - RNA, 14 nt, Shigella flexneri 2a str. 2457T
ucguggagaacaau

SEQ ID NO: 1940888 - RNA, 13 nt, Shigella flexneri 2a str. 2457T
ucgugcaccaauu

SEQ ID NO: 1940889 - RNA, 20 nt, Shigella flexneri 2a str. 2457T
ucgugcggguaaccagccaa

SEQ ID NO: 1940890 - RNA, 12 nt, Shigella flexneri 2a str. 2457T
ucgugcucgcuu

SEQ ID NO: 1940891 - RNA, 17 nt, Shigella flexneri 2a str. 2457T
ucgugcuaacguuuagu

SEQ ID NO: 1940892 - RNA, 15 nt, Shigella flexneri 2a str. 2457T
ucgugcguuuguagg

SEQ ID NO: 1940893 - RNA, 22 nt, Shigella flexneri 2a str. 2457T
ucgugaacauguccuuucaggg

SEQ ID NO: 1940894 - RNA, 22 nt, Shigella flexneri 2a str. 2457T
ucgugaauuuuaggaugcugca

SEQ ID NO: 1940895 - RNA, 17 nt, Shigella flexneri 2a str. 2457T
ucgucuggcgauuuuga

SEQ ID NO: 1940896 - RNA, 14 nt, Shigella flexneri 2a str. 2457T
ucgucuguuuuauc

SEQ ID NO: 1940897 - RNA, 17 nt, Shigella flexneri 2a str. 2457T
ucgucucccgucaggag

SEQ ID NO: 1940898 - RNA, 16 nt, Shigella flexneri 2a str. 2457T
ucgucguuuauauaga

SEQ ID NO: 1940899 - RNA, 15 nt, Shigella flexneri 2a str. 2457T
ucguaguaguucauc

SEQ ID NO: 1940900 - RNA, 17 nt, Shigella flexneri 2a str. 2457T
ucguagcguuuuuucau

SEQ ID NO: 1940901 - RNA, 14 nt, Shigella flexneri 2a str. 2457T
ucguauagaucacu

SEQ ID NO: 1940902 - RNA, 19 nt, Shigella flexneri 2a str. 2457T
ucgucaaaaaacuucuuca

SEQ ID NO: 1940903 - RNA, 20 nt, Shigella flexneri 2a str. 2457T
ucgucaaaaaacuucuucac

SEQ ID NO: 1940904 - RNA, 13 nt, Shigella flexneri 2a str. 2457T
ucgucaaccugua

SEQ ID NO: 1940905 - RNA, 14 nt, Shigella flexneri 2a str. 2457T
ucguaauuuuucgg

SEQ ID NO: 1940906 - RNA, 15 nt, Shigella flexneri 2a str. 2457T
ucguaaugaauguuu

SEQ ID NO: 1940907 - RNA, 18 nt, Shigella flexneri 2a str. 2457T
ucguaagccgugaaaaca

SEQ ID NO: 1940908 - RNA, 22 nt, Shigella flexneri 2a str. 2457T
ucguaaaaacggauuucauaag

SEQ ID NO: 1940909 - RNA, 14 nt, Shigella flexneri 2a str. 2457T
ucguacgaaagugc

SEQ ID NO: 1940910 - RNA, 21 nt, Shigella flexneri 2a str. 2457T
ucgucgccgauaauuuucagc

SEQ ID NO: 1940911 - RNA, 14 nt, Shigella flexneri 2a str. 2457T
ucguccuucacauu

SEQ ID NO: 1940912 - RNA, 15 nt, Shigella flexneri 2a str. 2457T
ucguccuuuuauuac

SEQ ID NO: 1940913 - RNA, 22 nt, Shigella flexneri 2a str. 2457T
ucgucaguuccauaauguacau

SEQ ID NO: 1940914 - RNA, 23 nt, Shigella flexneri 2a str. 2457T
ucgucaggaucagccauuuugca

SEQ ID NO: 1940915 - RNA, 16 nt, Shigella flexneri 2a str. 2457T
ucgucaucccagucuu

SEQ ID NO: 1940916 - RNA, 13 nt, Shigella flexneri 2a str. 2457T
ucgucagauuuua

SEQ ID NO: 1940917 - RNA, 16 nt, Shigella flexneri 2a str. 2457T
ucguccacuugaaaau

SEQ ID NO: 1940918 - RNA, 16 nt, Shigella flexneri 2a str. 2457T
ucgucccaaaagcucg

SEQ ID NO: 1940919 - RNA, 12 nt, Shigella flexneri 2a str. 2457T
ucgucccagucg

SEQ ID NO: 1940920 - RNA, 20 nt, Shigella flexneri 2a str. 2457T
ucggcgcucucguuuuauuc

SEQ ID NO: 1940921 - RNA, 12 nt, Shigella flexneri 2a str. 2457T
ucggcggcggca

SEQ ID NO: 1940922 - RNA, 18 nt, Shigella flexneri 2a str. 2457T
ucgggaacgcuuuugcau

SEQ ID NO: 1940923 - RNA, 22 nt, Shigella flexneri 2a str. 2457T
ucgggaaggcccuuccccuucu

SEQ ID NO: 1940924 - RNA, 22 nt, Shigella flexneri 2a str. 2457T
ucggcuuugaauaucuccucug

SEQ ID NO: 1940925 - RNA, 13 nt, Shigella flexneri 2a str. 2457T
ucgggaaauaaca

SEQ ID NO: 1940926 - RNA, 22 nt, Shigella flexneri 2a str. 2457T
ucggcuucugccuuauccagca

SEQ ID NO: 1940927 - RNA, 15 nt, Shigella flexneri 2a str. 2457T
ucggcugccagccau

SEQ ID NO: 1940928 - RNA, 20 nt, Shigella flexneri 2a str. 2457T
ucggcugacgauaccaggug

SEQ ID NO: 1940929 - RNA, 18 nt, Shigella flexneri 2a str. 2457T
ucggccaguaaccuuuca

SEQ ID NO: 1940930 - RNA, 12 nt, Shigella flexneri 2a str. 2457T
ucggccaugggc

SEQ ID NO: 1940931 - RNA, 22 nt, Shigella flexneri 2a str. 2457T
ucggcccggcgacuaacggaau

SEQ ID NO: 1940932 - RNA, 19 nt, Shigella flexneri 2a str. 2457T
ucggcgagucgcuccugcc

SEQ ID NO: 1940933 - RNA, 17 nt, Shigella flexneri 2a str. 2457T
ucggcgcagucacacca

SEQ ID NO: 1940934 - RNA, 15 nt, Shigella flexneri 2a str. 2457T
ucggugacagaaacu

SEQ ID NO: 1940935 - RNA, 14 nt, Shigella flexneri 2a str. 2457T
ucggugaugaaccc

SEQ ID NO: 1940936 - RNA, 14 nt, Shigella flexneri 2a str. 2457T
ucggugcaaaugcc

SEQ ID NO: 1940937 - RNA, 20 nt, Shigella flexneri 2a str. 2457T
ucggugcgacaucaucagcg

SEQ ID NO: 1940938 - RNA, 20 nt, Shigella flexneri 2a str. 2457T
ucggugcacgaugccugaug

SEQ ID NO: 1940939 - RNA, 19 nt, Shigella flexneri 2a str. 2457T
ucggucacugacaccagca

SEQ ID NO: 1940940 - RNA, 14 nt, Shigella flexneri 2a str. 2457T
ucgguauuuccauu

SEQ ID NO: 1940941 - RNA, 11 nt, Shigella flexneri 2a str. 2457T
ucggucacagu

SEQ ID NO: 1940942 - RNA, 19 nt, Shigella flexneri 2a str. 2457T
ucggucuuagcaaaggcuu

SEQ ID NO: 1940943 - RNA, 22 nt, Shigella flexneri 2a str. 2457T
ucgguccaccacguaccacggc

SEQ ID NO: 1940944 - RNA, 20 nt, Shigella flexneri 2a str. 2457T
ucgguuuucgcgccagccag

SEQ ID NO: 1940945 - RNA, 19 nt, Shigella flexneri 2a str. 2457T
ucgguuuaaccggccuuuu

SEQ ID NO: 1940946 - RNA, 14 nt, Shigella flexneri 2a str. 2457T
ucgguuguuuucag

SEQ ID NO: 1940947 - RNA, 19 nt, Shigella flexneri 2a str. 2457T
ucggugucguuacgccgca

SEQ ID NO: 1940948 - RNA, 14 nt, Shigella flexneri 2a str. 2457T
ucgguguccacuuc

SEQ ID NO: 1940949 - RNA, 24 nt, Shigella flexneri 2a str. 2457T
ucgguguuaaaacgcacgcuguca

SEQ ID NO: 1940950 - RNA, 20 nt, Shigella flexneri 2a str. 2457T
ucgguucaagauucaguuca

SEQ ID NO: 1940951 - RNA, 23 nt, Shigella flexneri 2a str. 2457T
ucggguuuacgugcacaggcaac

SEQ ID NO: 1940952 - RNA, 18 nt, Shigella flexneri 2a str. 2457T
ucggggcuaaugccaguc

SEQ ID NO: 1940953 - RNA, 19 nt, Shigella flexneri 2a str. 2457T
ucggggcuguuuuccagca

SEQ ID NO: 1940954 - RNA, 18 nt, Shigella flexneri 2a str. 2457T
ucgggugcgacaggagcc

SEQ ID NO: 1940955 - RNA, 14 nt, Shigella flexneri 2a str. 2457T
ucgggcaucagaag

SEQ ID NO: 1940956 - RNA, 13 nt, Shigella flexneri 2a str. 2457T
ucgggcagcaucg

SEQ ID NO: 1940957 - RNA, 13 nt, Shigella flexneri 2a str. 2457T
ucgggaugccuuc

SEQ ID NO: 1940958 - RNA, 20 nt, Shigella flexneri 2a str. 2457T
ucgggcaacguugaccaguc

SEQ ID NO: 1940959 - RNA, 23 nt, Shigella flexneri 2a str. 2457T
ucggggcgaucgcgccaaucagc

SEQ ID NO: 1940960 - RNA, 21 nt, Shigella flexneri 2a str. 2457T
ucgggcuuugcuacagccugg

SEQ ID NO: 1940961 - RNA, 22 nt, Shigella flexneri 2a str. 2457T
ucgggcuagacugaugacaaag

SEQ ID NO: 1940962 - RNA, 21 nt, Shigella flexneri 2a str. 2457T
ucgggccguauugauuuucuu

SEQ ID NO: 1940963 - RNA, 22 nt, Shigella flexneri 2a str. 2457T
ucgggcgauuuugcuuuuguca

SEQ ID NO: 1940964 - RNA, 15 nt, Shigella flexneri 2a str. 2457T
ucggcaaacugcuga

SEQ ID NO: 1940965 - RNA, 16 nt, Shigella flexneri 2a str. 2457T
ucggcacacacaucac

SEQ ID NO: 1940966 - RNA, 17 nt, Shigella flexneri 2a str. 2457T
ucggcaauuucgcugcc

SEQ ID NO: 1940967 - RNA, 14 nt, Shigella flexneri 2a str. 2457T
ucggcaaaauacau

SEQ ID NO: 1940968 - RNA, 21 nt, Shigella flexneri 2a str. 2457T
ucggauaagacgcgccagcgu

SEQ ID NO: 1940969 - RNA, 17 nt, Shigella flexneri 2a str. 2457T
ucggaucggcaaugaga

SEQ ID NO: 1940970 - RNA, 17 nt, Shigella flexneri 2a str. 2457T
ucggaucgcgugcggca

SEQ ID NO: 1940971 - RNA, 22 nt, Shigella flexneri 2a str. 2457T
ucggauaaggcgcucgcgccgc

SEQ ID NO: 1940972 - RNA, 17 nt, Shigella flexneri 2a str. 2457T
ucggcagcgccaaucgc

SEQ ID NO: 1940973 - RNA, 17 nt, Shigella flexneri 2a str. 2457T
ucggcaguaccugacca

SEQ ID NO: 1940974 - RNA, 16 nt, Shigella flexneri 2a str. 2457T
ucggcauaaagcugcg

SEQ ID NO: 1940975 - RNA, 13 nt, Shigella flexneri 2a str. 2457T
ucggcauaaucau

SEQ ID NO: 1940976 - RNA, 14 nt, Shigella flexneri 2a str. 2457T
ucggcagucugcug

SEQ ID NO: 1940977 - RNA, 20 nt, Shigella flexneri 2a str. 2457T
ucggcaccauuuaaaucaau

SEQ ID NO: 1940978 - RNA, 22 nt, Shigella flexneri 2a str. 2457T
ucggcacugaccaccaccaccu

SEQ ID NO: 1940979 - RNA, 20 nt, Shigella flexneri 2a str. 2457T
ucggcagaguugagcagucc

SEQ ID NO: 1940980 - RNA, 15 nt, Shigella flexneri 2a str. 2457T
ucggcaucagcagaa

SEQ ID NO: 1940981 - RNA, 19 nt, Shigella flexneri 2a str. 2457T
ucggcaucgccaccguuau

SEQ ID NO: 1940982 - RNA, 16 nt, Shigella flexneri 2a str. 2457T
ucggcauggggucagg

SEQ ID NO: 1940983 - RNA, 14 nt, Shigella flexneri 2a str. 2457T
ucggcauuggcaua

SEQ ID NO: 1940984 - RNA, 17 nt, Shigella flexneri 2a str. 2457T
ucggacgauauuuuucc

SEQ ID NO: 1940985 - RNA, 16 nt, Shigella flexneri 2a str. 2457T
ucggagguucgaaucc

SEQ ID NO: 1940986 - RNA, 17 nt, Shigella flexneri 2a str. 2457T
ucggaaauaaucaccug

SEQ ID NO: 1940987 - RNA, 13 nt, Shigella flexneri 2a str. 2457T
ucgcuuaagccau

SEQ ID NO: 1940988 - RNA, 20 nt, Shigella flexneri 2a str. 2457T
ucgcuguuuuuacucggucu

SEQ ID NO: 1940989 - RNA, 20 nt, Shigella flexneri 2a str. 2457T
ucgcuuaauggaaaacuguu

SEQ ID NO: 1940990 - RNA, 15 nt, Shigella flexneri 2a str. 2457T
ucgcugucggcagua

SEQ ID NO: 1940991 - RNA, 19 nt, Shigella flexneri 2a str. 2457T
ucgcugucuuccugguuuc

SEQ ID NO: 1940992 - RNA, 13 nt, Shigella flexneri 2a str. 2457T
ucgcuuacgccug

SEQ ID NO: 1940993 - RNA, 12 nt, Shigella flexneri 2a str. 2457T
ucgcuucauuua

SEQ ID NO: 1940994 - RNA, 18 nt, Shigella flexneri 2a str. 2457T
ucgcuuucgcuuucucuu

SEQ ID NO: 1940995 - RNA, 13 nt, Shigella flexneri 2a str. 2457T
ucgcuuucucuuc

SEQ ID NO: 1940996 - RNA, 14 nt, Shigella flexneri 2a str. 2457T
ucgcuuugugcugg

SEQ ID NO: 1940997 - RNA, 14 nt, Shigella flexneri 2a str. 2457T
ucggaaaauuauuu

SEQ ID NO: 1940998 - RNA, 17 nt, Shigella flexneri 2a str. 2457T
ucgcgccuuacgcugcg

SEQ ID NO: 1940999 - RNA, 19 nt, Shigella flexneri 2a str. 2457T
ucgcgcgggaaaucaaguu

SEQ ID NO: 1941000 - RNA, 12 nt, Shigella flexneri 2a str. 2457T
ucgcgcgcugcc

SEQ ID NO: 1941001 - RNA, 15 nt, Shigella flexneri 2a str. 2457T
ucgcgcuaauuccag

SEQ ID NO: 1941002 - RNA, 17 nt, Shigella flexneri 2a str. 2457T
ucgcgcguuaucccuua

SEQ ID NO: 1941003 - RNA, 16 nt, Shigella flexneri 2a str. 2457T
ucgcgguuagcggcuu

SEQ ID NO: 1941004 - RNA, 19 nt, Shigella flexneri 2a str. 2457T
ucgcguuacuaccggcgug

SEQ ID NO: 1941005 - RNA, 14 nt, Shigella flexneri 2a str. 2457T
ucgcguucggaaau

SEQ ID NO: 1941006 - RNA, 23 nt, Shigella flexneri 2a str. 2457T
ucgcuauagacaccuugcaacuc

SEQ ID NO: 1941007 - RNA, 17 nt, Shigella flexneri 2a str. 2457T
ucgcucaauauccugac

SEQ ID NO: 1941008 - RNA, 19 nt, Shigella flexneri 2a str. 2457T
ucgcucaauauccugaccu

SEQ ID NO: 1941009 - RNA, 18 nt, Shigella flexneri 2a str. 2457T
ucgcuccagucaucgcuu

SEQ ID NO: 1941010 - RNA, 22 nt, Shigella flexneri 2a str. 2457T
ucgcucgagagagaaaauaauc

SEQ ID NO: 1941011 - RNA, 21 nt, Shigella flexneri 2a str. 2457T
ucgcugcgcucuaaaaucauc

SEQ ID NO: 1941012 - RNA, 15 nt, Shigella flexneri 2a str. 2457T
ucgcugcugguucug

SEQ ID NO: 1941013 - RNA, 12 nt, Shigella flexneri 2a str. 2457T
ucgcuggcagac

SEQ ID NO: 1941014 - RNA, 17 nt, Shigella flexneri 2a str. 2457T
ucgcugauuugcuucaa

SEQ ID NO: 1941015 - RNA, 17 nt, Shigella flexneri 2a str. 2457T
ucgcugcagcucugcgc

SEQ ID NO: 1941016 - RNA, 11 nt, Shigella flexneri 2a str. 2457T
ucgcugccaca

SEQ ID NO: 1941017 - RNA, 15 nt, Shigella flexneri 2a str. 2457T
ucgcugaauaucuuu

SEQ ID NO: 1941018 - RNA, 19 nt, Shigella flexneri 2a str. 2457T
ucgccagcccguagcuucc

SEQ ID NO: 1941019 - RNA, 23 nt, Shigella flexneri 2a str. 2457T
ucgccagcccguagcuucccaua

SEQ ID NO: 1941020 - RNA, 16 nt, Shigella flexneri 2a str. 2457T
ucgccagcaacacaaa

SEQ ID NO: 1941021 - RNA, 12 nt, Shigella flexneri 2a str. 2457T
ucgccagcggca

SEQ ID NO: 1941022 - RNA, 20 nt, Shigella flexneri 2a str. 2457T
ucgccaucccugucguccag

SEQ ID NO: 1941023 - RNA, 21 nt, Shigella flexneri 2a str. 2457T
ucgccaugaagacauacccua

SEQ ID NO: 1941024 - RNA, 22 nt, Shigella flexneri 2a str. 2457T
ucgccaucuuuacaccuuacuu

SEQ ID NO: 1941025 - RNA, 16 nt, Shigella flexneri 2a str. 2457T
ucgccagucccuuuca

SEQ ID NO: 1941026 - RNA, 18 nt, Shigella flexneri 2a str. 2457T
ucgccaguaccagcagcg

SEQ ID NO: 1941027 - RNA, 15 nt, Shigella flexneri 2a str. 2457T
ucgccagucccuuuc

SEQ ID NO: 1941028 - RNA, 20 nt, Shigella flexneri 2a str. 2457T
ucgccaggcuuaccgccacu

SEQ ID NO: 1941029 - RNA, 20 nt, Shigella flexneri 2a str. 2457T
ucgccaggcguuugaaaaag

SEQ ID NO: 1941030 - RNA, 16 nt, Shigella flexneri 2a str. 2457T
uccauaccuaaaaaau

SEQ ID NO: 1941031 - RNA, 21 nt, Shigella flexneri 2a str. 2457T
uccauaccacgaccucaaagg

SEQ ID NO: 1941032 - RNA, 16 nt, Shigella flexneri 2a str. 2457T
uccauacccagcauca

SEQ ID NO: 1941033 - RNA, 18 nt, Shigella flexneri 2a str. 2457T
uccauacccagcaucagu

SEQ ID NO: 1941034 - RNA, 16 nt, Shigella flexneri 2a str. 2457T
uccauacgggcaugug

SEQ ID NO: 1941035 - RNA, 21 nt, Shigella flexneri 2a str. 2457T
ucgccaaauuuggugcucagu

SEQ ID NO: 1941036 - RNA, 19 nt, Shigella flexneri 2a str. 2457T
ucgccaacaaucucuucca

SEQ ID NO: 1941037 - RNA, 20 nt, Shigella flexneri 2a str. 2457T
ucgccaacaaucucuuccag

SEQ ID NO: 1941038 - RNA, 22 nt, Shigella flexneri 2a str. 2457T
ucgcccgaccaucgccagcuca

SEQ ID NO: 1941039 - RNA, 16 nt, Shigella flexneri 2a str. 2457T
ucgccccgagaaaaau

SEQ ID NO: 1941040 - RNA, 18 nt, Shigella flexneri 2a str. 2457T
ucgccccgagaaaaauag

SEQ ID NO: 1941041 - RNA, 12 nt, Shigella flexneri 2a str. 2457T
ucgcccccucuu

SEQ ID NO: 1941042 - RNA, 14 nt, Shigella flexneri 2a str. 2457T
ucgcccggauuaca

SEQ ID NO: 1941043 - RNA, 23 nt, Shigella flexneri 2a str. 2457T
ucgcccaguugaucaccagugcg

SEQ ID NO: 1941044 - RNA, 19 nt, Shigella flexneri 2a str. 2457T
ucgcccaguugaucaccag

SEQ ID NO: 1941045 - RNA, 23 nt, Shigella flexneri 2a str. 2457T
ucgcccagcagacguaaaaauag

SEQ ID NO: 1941046 - RNA, 16 nt, Shigella flexneri 2a str. 2457T
ucgccauuucgucguc

SEQ ID NO: 1941047 - RNA, 19 nt, Shigella flexneri 2a str. 2457T
ucgccauuuucugccgcau

SEQ ID NO: 1941048 - RNA, 15 nt, Shigella flexneri 2a str. 2457T
ucgcccacaccagau

SEQ ID NO: 1941049 - RNA, 16 nt, Shigella flexneri 2a str. 2457T
ucgcccuucaucuuug

SEQ ID NO: 1941050 - RNA, 21 nt, Shigella flexneri 2a str. 2457T
ucgcccugcuccagcaacuca

SEQ ID NO: 1941051 - RNA, 17 nt, Shigella flexneri 2a str. 2457T
ucgcccugcuccagcaa

SEQ ID NO: 1941052 - RNA, 16 nt, Shigella flexneri 2a str. 2457T
ucgcccuggaugcagu

SEQ ID NO: 1941053 - RNA, 17 nt, Shigella flexneri 2a str. 2457T
ucgccgccgcuggcgug

SEQ ID NO: 1941054 - RNA, 13 nt, Shigella flexneri 2a str. 2457T
ucgccgcccagcc

SEQ ID NO: 1941055 - RNA, 18 nt, Shigella flexneri 2a str. 2457T
ucgccgccgcaaacaucg

SEQ ID NO: 1941056 - RNA, 17 nt, Shigella flexneri 2a str. 2457T
ucgccgcacuuucuccu

SEQ ID NO: 1941057 - RNA, 16 nt, Shigella flexneri 2a str. 2457T
ucgccgauuuugccuu

SEQ ID NO: 1941058 - RNA, 14 nt, Shigella flexneri 2a str. 2457T
ucgccgaggcgcug

SEQ ID NO: 1941059 - RNA, 18 nt, Shigella flexneri 2a str. 2457T
ucgccgaggcgcuggcag

SEQ ID NO: 1941060 - RNA, 21 nt, Shigella flexneri 2a str. 2457T
ucgccguuuucuggggcgggg

SEQ ID NO: 1941061 - RNA, 22 nt, Shigella flexneri 2a str. 2457T
ucgccgguaguuucagcggcgu

SEQ ID NO: 1941062 - RNA, 15 nt, Shigella flexneri 2a str. 2457T
ucgccgguuccagcu

SEQ ID NO: 1941063 - RNA, 20 nt, Shigella flexneri 2a str. 2457T
ucgccgguuccagcuucaga

SEQ ID NO: 1941064 - RNA, 16 nt, Shigella flexneri 2a str. 2457T
ucgccugcaucaccau

SEQ ID NO: 1941065 - RNA, 14 nt, Shigella flexneri 2a str. 2457T
ucgccugccgccag

SEQ ID NO: 1941066 - RNA, 14 nt, Shigella flexneri 2a str. 2457T
ucgccucgccgaaa

SEQ ID NO: 1941067 - RNA, 17 nt, Shigella flexneri 2a str. 2457T
ucgccuccuguucugug

SEQ ID NO: 1941068 - RNA, 23 nt, Shigella flexneri 2a str. 2457T
ucgccggaauuucuuucagcagu

SEQ ID NO: 1941069 - RNA, 16 nt, Shigella flexneri 2a str. 2457T
ucgccggaauuucuuu

SEQ ID NO: 1941070 - RNA, 17 nt, Shigella flexneri 2a str. 2457T
ucgccgcggacaaacgg

SEQ ID NO: 1941071 - RNA, 20 nt, Shigella flexneri 2a str. 2457T
ucgccgcgacgcccccugcg

SEQ ID NO: 1941072 - RNA, 20 nt, Shigella flexneri 2a str. 2457T
ucgccgcugacggcucgccc

SEQ ID NO: 1941073 - RNA, 23 nt, Shigella flexneri 2a str. 2457T
ucgccggaaccugaucagacacg

SEQ ID NO: 1941074 - RNA, 15 nt, Shigella flexneri 2a str. 2457T
ucgcgcaaccagucc

SEQ ID NO: 1941075 - RNA, 14 nt, Shigella flexneri 2a str. 2457T
ucgcgcacggugca

SEQ ID NO: 1941076 - RNA, 19 nt, Shigella flexneri 2a str. 2457T
ucgcgcacuaugugccagc

SEQ ID NO: 1941077 - RNA, 13 nt, Shigella flexneri 2a str. 2457T
ucgcgcagcacuu

SEQ ID NO: 1941078 - RNA, 20 nt, Shigella flexneri 2a str. 2457T
ucgcgccaaucagcgcagca

SEQ ID NO: 1941079 - RNA, 16 nt, Shigella flexneri 2a str. 2457T
ucgcgcaucagcaguu

SEQ ID NO: 1941080 - RNA, 18 nt, Shigella flexneri 2a str. 2457T
ucgcgcccaaaccaccca

SEQ ID NO: 1941081 - RNA, 16 nt, Shigella flexneri 2a str. 2457T
ucgcgaaucgccacaa

SEQ ID NO: 1941082 - RNA, 12 nt, Shigella flexneri 2a str. 2457T
ucgcgacgcuga

SEQ ID NO: 1941083 - RNA, 21 nt, Shigella flexneri 2a str. 2457T
ucgcgauagccgcuuucuaac

SEQ ID NO: 1941084 - RNA, 16 nt, Shigella flexneri 2a str. 2457T
ucgcgauagcgcaccg

SEQ ID NO: 1941085 - RNA, 22 nt, Shigella flexneri 2a str. 2457T
ucgcgaccuguucuccuggccg

SEQ ID NO: 1941086 - RNA, 17 nt, Shigella flexneri 2a str. 2457T
ucgcgaggagaggccuu

SEQ ID NO: 1941087 - RNA, 22 nt, Shigella flexneri 2a str. 2457T
ucgcgaaccgccuggcgcugcu

SEQ ID NO: 1941088 - RNA, 13 nt, Shigella flexneri 2a str. 2457T
ucgccuuaauaac

SEQ ID NO: 1941089 - RNA, 19 nt, Shigella flexneri 2a str. 2457T
ucgccugguaccagcaccg

SEQ ID NO: 1941090 - RNA, 21 nt, Shigella flexneri 2a str. 2457T
ugaacgccacgcucacucauc

SEQ ID NO: 1941091 - RNA, 22 nt, Shigella flexneri 2a str. 2457T
ugaacgagaaaagccaaccugc

SEQ ID NO: 1941092 - RNA, 18 nt, Shigella flexneri 2a str. 2457T
ugaacgagucaacgcuuc

SEQ ID NO: 1941093 - RNA, 23 nt, Shigella flexneri 2a str. 2457T
ugaagaaaucaguugauuaugau

SEQ ID NO: 1941094 - RNA, 14 nt, Shigella flexneri 2a str. 2457T
ugaagaaccgcacc

SEQ ID NO: 1941095 - RNA, 19 nt, Shigella flexneri 2a str. 2457T
ugaagguguuugacuguaa

SEQ ID NO: 1941096 - RNA, 23 nt, Shigella flexneri 2a str. 2457T
ugaagcucacuucgcuuacgccu

SEQ ID NO: 1941097 - RNA, 22 nt, Shigella flexneri 2a str. 2457T
ugaagcccucgacauguucuau

SEQ ID NO: 1941098 - RNA, 18 nt, Shigella flexneri 2a str. 2457T
ugaauauauccgaaaaag

SEQ ID NO: 1941099 - RNA, 14 nt, Shigella flexneri 2a str. 2457T
ugaauaucuuucuc

SEQ ID NO: 1941100 - RNA, 14 nt, Shigella flexneri 2a str. 2457T
ugaauauucagaau

SEQ ID NO: 1941101 - RNA, 20 nt, Shigella flexneri 2a str. 2457T
ugaauauuccacagcucacg

SEQ ID NO: 1941102 - RNA, 16 nt, Shigella flexneri 2a str. 2457T
ugaauauuccuuaugg

SEQ ID NO: 1941103 - RNA, 18 nt, Shigella flexneri 2a str. 2457T
ugaauauuccuuaugguu

SEQ ID NO: 1941104 - RNA, 19 nt, Shigella flexneri 2a str. 2457T
ugaauagugccacaccagc

SEQ ID NO: 1941105 - RNA, 20 nt, Shigella flexneri 2a str. 2457T
ugaauagugccacaccagcu

SEQ ID NO: 1941106 - RNA, 20 nt, Shigella flexneri 2a str. 2457T
ugaauagcggaaaucuccag

SEQ ID NO: 1941107 - RNA, 16 nt, Shigella flexneri 2a str. 2457T
ugaauagcggaaaucu

SEQ ID NO: 1941108 - RNA, 18 nt, Shigella flexneri 2a str. 2457T
ugaauagcgcaaaauuau

SEQ ID NO: 1941109 - RNA, 20 nt, Shigella flexneri 2a str. 2457T
ugaagguuguuaaccaccag

SEQ ID NO: 1941110 - RNA, 18 nt, Shigella flexneri 2a str. 2457T
ugaagugagaauuuuuca

SEQ ID NO: 1941111 - RNA, 23 nt, Shigella flexneri 2a str. 2457T
ugaaguugccggauguguugcau

SEQ ID NO: 1941112 - RNA, 13 nt, Shigella flexneri 2a str. 2457T
ugaaguuuauacg

SEQ ID NO: 1941113 - RNA, 18 nt, Shigella flexneri 2a str. 2457T
ugaauaccaagucucaag

SEQ ID NO: 1941114 - RNA, 13 nt, Shigella flexneri 2a str. 2457T
ugaacaauuucag

SEQ ID NO: 1941115 - RNA, 20 nt, Shigella flexneri 2a str. 2457T
ugaacaccaaacccugagug

SEQ ID NO: 1941116 - RNA, 21 nt, Shigella flexneri 2a str. 2457T
ugaacaccaaacccugaguga

SEQ ID NO: 1941117 - RNA, 19 nt, Shigella flexneri 2a str. 2457T
ugaacaagguggugaggcc

SEQ ID NO: 1941118 - RNA, 14 nt, Shigella flexneri 2a str. 2457T
ugaacaaaaaagag

SEQ ID NO: 1941119 - RNA, 17 nt, Shigella flexneri 2a str. 2457T
ugaacaaaaaagaguaa

SEQ ID NO: 1941120 - RNA, 22 nt, Shigella flexneri 2a str. 2457T
ugaacaaaaaagaguaaaguua

SEQ ID NO: 1941121 - RNA, 19 nt, Shigella flexneri 2a str. 2457T
ugaaccagccaacuugccc

SEQ ID NO: 1941122 - RNA, 13 nt, Shigella flexneri 2a str. 2457T
ugaacauuuucuu

SEQ ID NO: 1941123 - RNA, 18 nt, Shigella flexneri 2a str. 2457T
ugaacauuuucuucugcc

SEQ ID NO: 1941124 - RNA, 16 nt, Shigella flexneri 2a str. 2457T
ugaacauugcugcuga

SEQ ID NO: 1941125 - RNA, 16 nt, Shigella flexneri 2a str. 2457T
ugaacauuacuuuccg

SEQ ID NO: 1941126 - RNA, 15 nt, Shigella flexneri 2a str. 2457T
ugaacaccuucucag

SEQ ID NO: 1941127 - RNA, 20 nt, Shigella flexneri 2a str. 2457T
ugaacacgaucucacgcuga

SEQ ID NO: 1941128 - RNA, 19 nt, Shigella flexneri 2a str. 2457T
ugaacagaccacauuccag

SEQ ID NO: 1941129 - RNA, 22 nt, Shigella flexneri 2a str. 2457T
ugaaaugccaaauauuucuuua

SEQ ID NO: 1941130 - RNA, 14 nt, Shigella flexneri 2a str. 2457T
ugaaaucacgcauc

SEQ ID NO: 1941131 - RNA, 16 nt, Shigella flexneri 2a str. 2457T
ugaaaguaaaaaagaa

SEQ ID NO: 1941132 - RNA, 15 nt, Shigella flexneri 2a str. 2457T
ugaaaguaaaaaaga

SEQ ID NO: 1941133 - RNA, 15 nt, Shigella flexneri 2a str. 2457T
ugaaaggcuucccaa

SEQ ID NO: 1941134 - RNA, 19 nt, Shigella flexneri 2a str. 2457T
ugaaagaagcggugaaaaa

SEQ ID NO: 1941135 - RNA, 16 nt, Shigella flexneri 2a str. 2457T
ugaaaccuuuaugcag

SEQ ID NO: 1941136 - RNA, 22 nt, Shigella flexneri 2a str. 2457T
ugaaagugggggauuuacucuc

SEQ ID NO: 1941137 - RNA, 22 nt, Shigella flexneri 2a str. 2457T
ugaaauaguugcauuccagucc

SEQ ID NO: 1941138 - RNA, 19 nt, Shigella flexneri 2a str. 2457T
ugaaauagaauggcaucag

SEQ ID NO: 1941139 - RNA, 20 nt, Shigella flexneri 2a str. 2457T
ugaaaguauuugacuguucu

SEQ ID NO: 1941140 - RNA, 17 nt, Shigella flexneri 2a str. 2457T
ucuucggcaaguguugg

SEQ ID NO: 1941141 - RNA, 18 nt, Shigella flexneri 2a str. 2457T
ucuucggccauugaauau

SEQ ID NO: 1941142 - RNA, 21 nt, Shigella flexneri 2a str. 2457T
ucuucgguggucauuuuauug

SEQ ID NO: 1941143 - RNA, 16 nt, Shigella flexneri 2a str. 2457T
ucuucggucagagaau

SEQ ID NO: 1941144 - RNA, 13 nt, Shigella flexneri 2a str. 2457T
ucuucgucgucuu

SEQ ID NO: 1941145 - RNA, 15 nt, Shigella flexneri 2a str. 2457T
ucuucgucccagucg

SEQ ID NO: 1941146 - RNA, 17 nt, Shigella flexneri 2a str. 2457T
ucuucgguucaaguccc

SEQ ID NO: 1941147 - RNA, 20 nt, Shigella flexneri 2a str. 2457T
ucuucgguucguaagcaaga

SEQ ID NO: 1941148 - RNA, 17 nt, Shigella flexneri 2a str. 2457T
ugaaacaugauguggug

SEQ ID NO: 1941149 - RNA, 17 nt, Shigella flexneri 2a str. 2457T
ugaaaccagacacuuca

SEQ ID NO: 1941150 - RNA, 14 nt, Shigella flexneri 2a str. 2457T
ugaaacgaaaucuu

SEQ ID NO: 1941151 - RNA, 15 nt, Shigella flexneri 2a str. 2457T
ugaaacgaaaucuug

SEQ ID NO: 1941152 - RNA, 16 nt, Shigella flexneri 2a str. 2457T
ugaaaccgaaggcacc

SEQ ID NO: 1941153 - RNA, 14 nt, Shigella flexneri 2a str. 2457T
ugacagucuggaag

SEQ ID NO: 1941154 - RNA, 16 nt, Shigella flexneri 2a str. 2457T
ugacaguuuauuuucu

SEQ ID NO: 1941155 - RNA, 19 nt, Shigella flexneri 2a str. 2457T
ugacauaguagccagccag

SEQ ID NO: 1941156 - RNA, 13 nt, Shigella flexneri 2a str. 2457T
ugacauaauuggc

SEQ ID NO: 1941157 - RNA, 16 nt, Shigella flexneri 2a str. 2457T
ugacaucauuuuuucc

SEQ ID NO: 1941158 - RNA, 21 nt, Shigella flexneri 2a str. 2457T
ugacauauaaccggcaacaga

SEQ ID NO: 1941159 - RNA, 18 nt, Shigella flexneri 2a str. 2457T
ugacauaguagccagcca

SEQ ID NO: 1941160 - RNA, 19 nt, Shigella flexneri 2a str. 2457T
ugaccaguaauauccccag

SEQ ID NO: 1941161 - RNA, 16 nt, Shigella flexneri 2a str. 2457T
ugaccaguccggcuuu

SEQ ID NO: 1941162 - RNA, 23 nt, Shigella flexneri 2a str. 2457T
ugaccagugaauuucacuucgcc

SEQ ID NO: 1941163 - RNA, 20 nt, Shigella flexneri 2a str. 2457T
ugaccaguugcuccagcaau

SEQ ID NO: 1941164 - RNA, 17 nt, Shigella flexneri 2a str. 2457T
ugaccagcgauaaaaau

SEQ ID NO: 1941165 - RNA, 19 nt, Shigella flexneri 2a str. 2457T
ugaccaggacuuugaaagc

SEQ ID NO: 1941166 - RNA, 15 nt, Shigella flexneri 2a str. 2457T
ugaccugacauuaag

SEQ ID NO: 1941167 - RNA, 14 nt, Shigella flexneri 2a str. 2457T
ugaccugcagcguu

SEQ ID NO: 1941168 - RNA, 21 nt, Shigella flexneri 2a str. 2457T
ugaccgaugcaucggccucaa

SEQ ID NO: 1941169 - RNA, 19 nt, Shigella flexneri 2a str. 2457T
ugaccgcguugcagcauau

SEQ ID NO: 1941170 - RNA, 24 nt, Shigella flexneri 2a str. 2457T
ugacacgggaaaccaacuccagcg

SEQ ID NO: 1941171 - RNA, 20 nt, Shigella flexneri 2a str. 2457T
ugacacuauucgccagcacg

SEQ ID NO: 1941172 - RNA, 14 nt, Shigella flexneri 2a str. 2457T
ugacacggaacaac

SEQ ID NO: 1941173 - RNA, 19 nt, Shigella flexneri 2a str. 2457T
ugacacaggcagcaaucac

SEQ ID NO: 1941174 - RNA, 17 nt, Shigella flexneri 2a str. 2457T
ugacacaucaccuccag

SEQ ID NO: 1941175 - RNA, 15 nt, Shigella flexneri 2a str. 2457T
ugacaccagcacauc

SEQ ID NO: 1941176 - RNA, 16 nt, Shigella flexneri 2a str. 2457T
ugacaccagcauaaua

SEQ ID NO: 1941177 - RNA, 15 nt, Shigella flexneri 2a str. 2457T
ugacaccauaacaga

SEQ ID NO: 1941178 - RNA, 16 nt, Shigella flexneri 2a str. 2457T
ugacagacuccgccuc

SEQ ID NO: 1941179 - RNA, 18 nt, Shigella flexneri 2a str. 2457T
ugacagaggcuuauauug

SEQ ID NO: 1941180 - RNA, 17 nt, Shigella flexneri 2a str. 2457T
ugacagcauaccuucac

SEQ ID NO: 1941181 - RNA, 23 nt, Shigella flexneri 2a str. 2457T
ugacagccccugugccagcucgu

SEQ ID NO: 1941182 - RNA, 17 nt, Shigella flexneri 2a str. 2457T
ugacaggcgggaagaac

SEQ ID NO: 1941183 - RNA, 15 nt, Shigella flexneri 2a str. 2457T
ugacagggugagcag

SEQ ID NO: 1941184 - RNA, 21 nt, Shigella flexneri 2a str. 2457T
ugacagguugcucauaaaaug

SEQ ID NO: 1941185 - RNA, 15 nt, Shigella flexneri 2a str. 2457T
ugacagguuuaaaca

SEQ ID NO: 1941186 - RNA, 18 nt, Shigella flexneri 2a str. 2457T
ugacagguuuaaacagag

SEQ ID NO: 1941187 - RNA, 22 nt, Shigella flexneri 2a str. 2457T
ugacaaaucaugcggauauaaa

SEQ ID NO: 1941188 - RNA, 22 nt, Shigella flexneri 2a str. 2457T
ugacaaacgcaaaacugccuga

SEQ ID NO: 1941189 - RNA, 15 nt, Shigella flexneri 2a str. 2457T
ugacacaaucaaauc

SEQ ID NO: 1941190 - RNA, 19 nt, Shigella flexneri 2a str. 2457T
ugacacaaucaaauccugc

SEQ ID NO: 1941191 - RNA, 23 nt, Shigella flexneri 2a str. 2457T
ugaaucaucguucauauauuccu

SEQ ID NO: 1941192 - RNA, 16 nt, Shigella flexneri 2a str. 2457T
ugaaucacgacaaaca

SEQ ID NO: 1941193 - RNA, 18 nt, Shigella flexneri 2a str. 2457T
ugaaugauaaaauucauu

SEQ ID NO: 1941194 - RNA, 13 nt, Shigella flexneri 2a str. 2457T
ugaaucuuuucau

SEQ ID NO: 1941195 - RNA, 23 nt, Shigella flexneri 2a str. 2457T
ugaaucucuuaucauccagguga

SEQ ID NO: 1941196 - RNA, 14 nt, Shigella flexneri 2a str. 2457T
ugaaugcuuucaua

SEQ ID NO: 1941197 - RNA, 20 nt, Shigella flexneri 2a str. 2457T
ugaaugcuuucauauuccag

SEQ ID NO: 1941198 - RNA, 14 nt, Shigella flexneri 2a str. 2457T
ugaauuaaugccuc

SEQ ID NO: 1941199 - RNA, 15 nt, Shigella flexneri 2a str. 2457T
ugaauguugcgcggu

SEQ ID NO: 1941200 - RNA, 22 nt, Shigella flexneri 2a str. 2457T
ugaaugguggcgaugauuuccg

SEQ ID NO: 1941201 - RNA, 17 nt, Shigella flexneri 2a str. 2457T
ugaauuacuucucuuuc

SEQ ID NO: 1941202 - RNA, 23 nt, Shigella flexneri 2a str. 2457T
ugaauuccgaauuucauccugua

SEQ ID NO: 1941203 - RNA, 18 nt, Shigella flexneri 2a str. 2457T
ugaauuugugaacagccu

SEQ ID NO: 1941204 - RNA, 23 nt, Shigella flexneri 2a str. 2457T
ugaauuuuaggaugcugcaauaa

SEQ ID NO: 1941205 - RNA, 14 nt, Shigella flexneri 2a str. 2457T
ugaauuguuuuaua

SEQ ID NO: 1941206 - RNA, 15 nt, Shigella flexneri 2a str. 2457T
ugaauugugaugguu

SEQ ID NO: 1941207 - RNA, 16 nt, Shigella flexneri 2a str. 2457T
ugaugggcagaauaac

SEQ ID NO: 1941208 - RNA, 20 nt, Shigella flexneri 2a str. 2457T
ugaugggggcguuuuuauuu

SEQ ID NO: 1941209 - RNA, 21 nt, Shigella flexneri 2a str. 2457T
ugaugguaacgcgccaggauc

SEQ ID NO: 1941210 - RNA, 16 nt, Shigella flexneri 2a str. 2457T
ugauggugguggggga

SEQ ID NO: 1941211 - RNA, 19 nt, Shigella flexneri 2a str. 2457T
ugaugucggcauaaagcug

SEQ ID NO: 1941212 - RNA, 21 nt, Shigella flexneri 2a str. 2457T
ugaugucguguuaauuaccua

SEQ ID NO: 1941213 - RNA, 21 nt, Shigella flexneri 2a str. 2457T
ugaugugacgcugucuuauca

SEQ ID NO: 1941214 - RNA, 20 nt, Shigella flexneri 2a str. 2457T
ugaugucagcacuuccagcu

SEQ ID NO: 1941215 - RNA, 22 nt, Shigella flexneri 2a str. 2457T
ugaugucagcacuuccagcucc

SEQ ID NO: 1941216 - RNA, 19 nt, Shigella flexneri 2a str. 2457T
ugauguggugcaaggaaau

SEQ ID NO: 1941217 - RNA, 23 nt, Shigella flexneri 2a str. 2457T
ugauuacuuccuucauggggaug

SEQ ID NO: 1941218 - RNA, 20 nt, Shigella flexneri 2a str. 2457T
ugauuaccaauaucaaauaa

SEQ ID NO: 1941219 - RNA, 16 nt, Shigella flexneri 2a str. 2457T
ugauuaagugaauaua

SEQ ID NO: 1941220 - RNA, 23 nt, Shigella flexneri 2a str. 2457T
ugauuaacgcuuguaaaugaacu

SEQ ID NO: 1941221 - RNA, 14 nt, Shigella flexneri 2a str. 2457T
ugauuaacuguucu

SEQ ID NO: 1941222 - RNA, 20 nt, Shigella flexneri 2a str. 2457T
ugauuaacuguucugaaaac

SEQ ID NO: 1941223 - RNA, 20 nt, Shigella flexneri 2a str. 2457T
ugauuaacgcuuguaaauga

SEQ ID NO: 1941224 - RNA, 21 nt, Shigella flexneri 2a str. 2457T
ugauuaacgcuuguaaaugaa

SEQ ID NO: 1941225 - RNA, 13 nt, Shigella flexneri 2a str. 2457T
ugauuaaagaaaa

SEQ ID NO: 1941226 - RNA, 16 nt, Shigella flexneri 2a str. 2457T
ugauuaaagcaucugc

SEQ ID NO: 1941227 - RNA, 19 nt, Shigella flexneri 2a str. 2457T
ugauuaacgcuuguaaaug

SEQ ID NO: 1941228 - RNA, 12 nt, Shigella flexneri 2a str. 2457T
ugauucauacag

SEQ ID NO: 1941229 - RNA, 15 nt, Shigella flexneri 2a str. 2457T
ugauucacuggcaaa

SEQ ID NO: 1941230 - RNA, 12 nt, Shigella flexneri 2a str. 2457T
ugauucagauaa

SEQ ID NO: 1941231 - RNA, 13 nt, Shigella flexneri 2a str. 2457T
ugauuaucggcau

SEQ ID NO: 1941232 - RNA, 15 nt, Shigella flexneri 2a str. 2457T
ugauuaugucaucau

SEQ ID NO: 1941233 - RNA, 17 nt, Shigella flexneri 2a str. 2457T
ugauuguuaacaacgug

SEQ ID NO: 1941234 - RNA, 12 nt, Shigella flexneri 2a str. 2457T
ugauugucggug

SEQ ID NO: 1941235 - RNA, 21 nt, Shigella flexneri 2a str. 2457T
ugauuucguccauguuggaga

SEQ ID NO: 1941236 - RNA, 16 nt, Shigella flexneri 2a str. 2457T
ugauuuauagauuuac

SEQ ID NO: 1941237 - RNA, 15 nt, Shigella flexneri 2a str. 2457T
ugauugccuuccacc

SEQ ID NO: 1941238 - RNA, 19 nt, Shigella flexneri 2a str. 2457T
ugauugaaauagccaauac

SEQ ID NO: 1941239 - RNA, 21 nt, Shigella flexneri 2a str. 2457T
ugauucugauccugcacuuuc

SEQ ID NO: 1941240 - RNA, 17 nt, Shigella flexneri 2a str. 2457T
ugauucugagaaacuca

SEQ ID NO: 1941241 - RNA, 16 nt, Shigella flexneri 2a str. 2457T
ugauucugauccugca

SEQ ID NO: 1941242 - RNA, 13 nt, Shigella flexneri 2a str. 2457T
ugauucucccuca

SEQ ID NO: 1941243 - RNA, 17 nt, Shigella flexneri 2a str. 2457T
ugauucucccucaucau

SEQ ID NO: 1941244 - RNA, 13 nt, Shigella flexneri 2a str. 2457T
ugauugcggagaa

SEQ ID NO: 1941245 - RNA, 20 nt, Shigella flexneri 2a str. 2457T
ugauugcucugguuguggug

SEQ ID NO: 1941246 - RNA, 19 nt, Shigella flexneri 2a str. 2457T
ugauugcuuuaucaaucac

SEQ ID NO: 1941247 - RNA, 20 nt, Shigella flexneri 2a str. 2457T
ugauugcuuuaucaaucacc

SEQ ID NO: 1941248 - RNA, 18 nt, Shigella flexneri 2a str. 2457T
ugauugggucauuuccca

SEQ ID NO: 1941249 - RNA, 22 nt, Shigella flexneri 2a str. 2457T
ugauuggcgcgaaccaucaccu

SEQ ID NO: 1941250 - RNA, 11 nt, Shigella flexneri 2a str. 2457T
ugaucuuuuuu

SEQ ID NO: 1941251 - RNA, 14 nt, Shigella flexneri 2a str. 2457T
ugaugaacccgguc

SEQ ID NO: 1941252 - RNA, 14 nt, Shigella flexneri 2a str. 2457T
ugaugaagacagac

SEQ ID NO: 1941253 - RNA, 14 nt, Shigella flexneri 2a str. 2457T
ugaucuuucuucag

SEQ ID NO: 1941254 - RNA, 14 nt, Shigella flexneri 2a str. 2457T
ugaucuuuuuauug

SEQ ID NO: 1941255 - RNA, 15 nt, Shigella flexneri 2a str. 2457T
ugaugcgacgcuggc

SEQ ID NO: 1941256 - RNA, 17 nt, Shigella flexneri 2a str. 2457T
ugaugcgacgcuugacg

SEQ ID NO: 1941257 - RNA, 14 nt, Shigella flexneri 2a str. 2457T
ugaugccgugcagc

SEQ ID NO: 1941258 - RNA, 15 nt, Shigella flexneri 2a str. 2457T
ugaugccgugcagca

SEQ ID NO: 1941259 - RNA, 14 nt, Shigella flexneri 2a str. 2457T
ugaugccgccagaa

SEQ ID NO: 1941260 - RNA, 14 nt, Shigella flexneri 2a str. 2457T
ugaugcauaaaaaa

SEQ ID NO: 1941261 - RNA, 15 nt, Shigella flexneri 2a str. 2457T
ugaugggcgaagaga

SEQ ID NO: 1941262 - RNA, 21 nt, Shigella flexneri 2a str. 2457T
ugauggacauucuccggcagg

SEQ ID NO: 1941263 - RNA, 20 nt, Shigella flexneri 2a str. 2457T
ugaugcguugcgcuucucag

SEQ ID NO: 1941264 - RNA, 17 nt, Shigella flexneri 2a str. 2457T
ugaugcgaugcuugacg

SEQ ID NO: 1941265 - RNA, 22 nt, Shigella flexneri 2a str. 2457T
ugaugcgugagguaacaauaaa

SEQ ID NO: 1941266 - RNA, 21 nt, Shigella flexneri 2a str. 2457T
ugaugcgcugcgcuuaucagg

SEQ ID NO: 1941267 - RNA, 17 nt, Shigella flexneri 2a str. 2457T
ugaugcgcuacgcuuau

SEQ ID NO: 1941268 - RNA, 14 nt, Shigella flexneri 2a str. 2457T
ugaugcgcuaugcu

SEQ ID NO: 1941269 - RNA, 16 nt, Shigella flexneri 2a str. 2457T
ugaugcucuugaaaug

SEQ ID NO: 1941270 - RNA, 14 nt, Shigella flexneri 2a str. 2457T
ugauggaauuucau

SEQ ID NO: 1941271 - RNA, 22 nt, Shigella flexneri 2a str. 2457T
ugauggaaaauuguuccgucag

SEQ ID NO: 1941272 - RNA, 18 nt, Shigella flexneri 2a str. 2457T
ugauauuucgaauuuucc

SEQ ID NO: 1941273 - RNA, 19 nt, Shigella flexneri 2a str. 2457T
ugaucacccacaucagcgg

SEQ ID NO: 1941274 - RNA, 12 nt, Shigella flexneri 2a str. 2457T
ugaucaccagug

SEQ ID NO: 1941275 - RNA, 13 nt, Shigella flexneri 2a str. 2457T
ugaucacccacau

SEQ ID NO: 1941276 - RNA, 18 nt, Shigella flexneri 2a str. 2457T
ugauauuucggcauuuuu

SEQ ID NO: 1941277 - RNA, 22 nt, Shigella flexneri 2a str. 2457T
ugaucaaaaucauauaauuguu

SEQ ID NO: 1941278 - RNA, 13 nt, Shigella flexneri 2a str. 2457T
ugaucaacagcau

SEQ ID NO: 1941279 - RNA, 14 nt, Shigella flexneri 2a str. 2457T
ugaucaaacacaaa

SEQ ID NO: 1941280 - RNA, 21 nt, Shigella flexneri 2a str. 2457T
ugaucaaacacaaaguccuga

SEQ ID NO: 1941281 - RNA, 21 nt, Shigella flexneri 2a str. 2457T
ugaucggcuggcgaaccagga

SEQ ID NO: 1941282 - RNA, 21 nt, Shigella flexneri 2a str. 2457T
ugauccccgcuuccugcagcg

SEQ ID NO: 1941283 - RNA, 19 nt, Shigella flexneri 2a str. 2457T
ugauccaucagguaguguu

SEQ ID NO: 1941284 - RNA, 18 nt, Shigella flexneri 2a str. 2457T
ugaucaccugcauacaaa

SEQ ID NO: 1941285 - RNA, 13 nt, Shigella flexneri 2a str. 2457T
ugaucaccugcau

SEQ ID NO: 1941286 - RNA, 14 nt, Shigella flexneri 2a str. 2457T
ugaucauucaccag

SEQ ID NO: 1941287 - RNA, 16 nt, Shigella flexneri 2a str. 2457T
ugaucauucaccagcc

SEQ ID NO: 1941288 - RNA, 22 nt, Shigella flexneri 2a str. 2457T
ugauccaggagcuccagguccu

SEQ ID NO: 1941289 - RNA, 18 nt, Shigella flexneri 2a str. 2457T
ugauccacgguucuccac

SEQ ID NO: 1941290 - RNA, 20 nt, Shigella flexneri 2a str. 2457T
ugauccagaugugcaccuuu

SEQ ID NO: 1941291 - RNA, 13 nt, Shigella flexneri 2a str. 2457T
ugaguugccauca

SEQ ID NO: 1941292 - RNA, 19 nt, Shigella flexneri 2a str. 2457T
ugaguugaguaucagagaa

SEQ ID NO: 1941293 - RNA, 16 nt, Shigella flexneri 2a str. 2457T
ugagucgcaaaacuca

SEQ ID NO: 1941294 - RNA, 19 nt, Shigella flexneri 2a str. 2457T
ugaguauuacuuuguaaau

SEQ ID NO: 1941295 - RNA, 16 nt, Shigella flexneri 2a str. 2457T
ugauaauguuauuuaa

SEQ ID NO: 1941296 - RNA, 18 nt, Shigella flexneri 2a str. 2457T
ugauaacgcggcagcagg

SEQ ID NO: 1941297 - RNA, 20 nt, Shigella flexneri 2a str. 2457T
ugauaaccccgcaauuucau

SEQ ID NO: 1941298 - RNA, 18 nt, Shigella flexneri 2a str. 2457T
ugauaaucagaaggcaga

SEQ ID NO: 1941299 - RNA, 16 nt, Shigella flexneri 2a str. 2457T
ugauacaggaacagcc

SEQ ID NO: 1941300 - RNA, 14 nt, Shigella flexneri 2a str. 2457T
ugauacaucaaguc

SEQ ID NO: 1941301 - RNA, 22 nt, Shigella flexneri 2a str. 2457T
ugauaauuguuaucguuugcau

SEQ ID NO: 1941302 - RNA, 21 nt, Shigella flexneri 2a str. 2457T
ugauaauuuucgguaaugacu

SEQ ID NO: 1941303 - RNA, 18 nt, Shigella flexneri 2a str. 2457T
ugauaauuauuauaauaa

SEQ ID NO: 1941304 - RNA, 17 nt, Shigella flexneri 2a str. 2457T
ugaggcagcaaggaaaa

SEQ ID NO: 1941305 - RNA, 19 nt, Shigella flexneri 2a str. 2457T
ugaggcauaagcgacaucu

SEQ ID NO: 1941306 - RNA, 23 nt, Shigella flexneri 2a str. 2457T
ugagguuguggcauuagauauuu

SEQ ID NO: 1941307 - RNA, 16 nt, Shigella flexneri 2a str. 2457T
ugaguaaacuuuugga

SEQ ID NO: 1941308 - RNA, 15 nt, Shigella flexneri 2a str. 2457T
ugagguuuuugacga

SEQ ID NO: 1941309 - RNA, 14 nt, Shigella flexneri 2a str. 2457T
ugagguuucccgcc

SEQ ID NO: 1941310 - RNA, 20 nt, Shigella flexneri 2a str. 2457T
ugaggauuacgucuuuacua

SEQ ID NO: 1941311 - RNA, 18 nt, Shigella flexneri 2a str. 2457T
ugagcugucgacuaaccu

SEQ ID NO: 1941312 - RNA, 16 nt, Shigella flexneri 2a str. 2457T
ugagcgauaaacaagu

SEQ ID NO: 1941313 - RNA, 20 nt, Shigella flexneri 2a str. 2457T
ugagcgauacccauuuuauu

SEQ ID NO: 1941314 - RNA, 14 nt, Shigella flexneri 2a str. 2457T
ugagcgauauuuau

SEQ ID NO: 1941315 - RNA, 23 nt, Shigella flexneri 2a str. 2457T
ugagcgauuuuuuauaguacuuc

SEQ ID NO: 1941316 - RNA, 16 nt, Shigella flexneri 2a str. 2457T
ugacuguacagauccg

SEQ ID NO: 1941317 - RNA, 19 nt, Shigella flexneri 2a str. 2457T
ugacugguagugcaguaca

SEQ ID NO: 1941318 - RNA, 22 nt, Shigella flexneri 2a str. 2457T
ugacugcuuuuacaaaaucuuc

SEQ ID NO: 1941319 - RNA, 23 nt, Shigella flexneri 2a str. 2457T
ugacuggcaacaacgcaacucca

SEQ ID NO: 1941320 - RNA, 14 nt, Shigella flexneri 2a str. 2457T
ugacuggcuacugu

SEQ ID NO: 1941321 - RNA, 19 nt, Shigella flexneri 2a str. 2457T
ugacuguaggccggauaag

SEQ ID NO: 1941322 - RNA, 16 nt, Shigella flexneri 2a str. 2457T
ugaccuuaccaccuua

SEQ ID NO: 1941323 - RNA, 14 nt, Shigella flexneri 2a str. 2457T
ugaccuuuuuucag

SEQ ID NO: 1941324 - RNA, 16 nt, Shigella flexneri 2a str. 2457T
ugacugcggcgugggc

SEQ ID NO: 1941325 - RNA, 15 nt, Shigella flexneri 2a str. 2457T
ugacugcggcguggg

SEQ ID NO: 1941326 - RNA, 22 nt, Shigella flexneri 2a str. 2457T
ugagaauaaucaccuuuaaccu

SEQ ID NO: 1941327 - RNA, 16 nt, Shigella flexneri 2a str. 2457T
ugagaaaauuucauua

SEQ ID NO: 1941328 - RNA, 19 nt, Shigella flexneri 2a str. 2457T
ugagaauuccgacagagaa

SEQ ID NO: 1941329 - RNA, 21 nt, Shigella flexneri 2a str. 2457T
ugagaauuccgacagagaaag

SEQ ID NO: 1941330 - RNA, 16 nt, Shigella flexneri 2a str. 2457T
ugacuuuugcccggca

SEQ ID NO: 1941331 - RNA, 10 nt, Shigella flexneri 2a str. 2457T
ugagaaaaag

SEQ ID NO: 1941332 - RNA, 21 nt, Shigella flexneri 2a str. 2457T
ugacuuucuggcacgaccugg

SEQ ID NO: 1941333 - RNA, 22 nt, Shigella flexneri 2a str. 2457T
ugacuuugccgauuuaacccug

SEQ ID NO: 1941334 - RNA, 16 nt, Shigella flexneri 2a str. 2457T
ugagcagccaccacuu

SEQ ID NO: 1941335 - RNA, 13 nt, Shigella flexneri 2a str. 2457T
ugagcacuggggc

SEQ ID NO: 1941336 - RNA, 12 nt, Shigella flexneri 2a str. 2457T
ugagcagaaaaa

SEQ ID NO: 1941337 - RNA, 15 nt, Shigella flexneri 2a str. 2457T
ugagaugcuggagaa

SEQ ID NO: 1941338 - RNA, 17 nt, Shigella flexneri 2a str. 2457T
ugagcaguccccacauc

SEQ ID NO: 1941339 - RNA, 19 nt, Shigella flexneri 2a str. 2457T
ugagcaguggcaaacugag

SEQ ID NO: 1941340 - RNA, 12 nt, Shigella flexneri 2a str. 2457T
ugagcaugaugc

SEQ ID NO: 1941341 - RNA, 19 nt, Shigella flexneri 2a str. 2457T
ugagcaugaugccugaugc

SEQ ID NO: 1941342 - RNA, 21 nt, Shigella flexneri 2a str. 2457T
ugagccagugccgaaaugucu

SEQ ID NO: 1941343 - RNA, 23 nt, Shigella flexneri 2a str. 2457T
ugcgcgucuuaucaggccugugg

SEQ ID NO: 1941344 - RNA, 21 nt, Shigella flexneri 2a str. 2457T
ugcgcuacgcucaucaggccu

SEQ ID NO: 1941345 - RNA, 21 nt, Shigella flexneri 2a str. 2457T
ugcgcuacgcuuaucaggccu

SEQ ID NO: 1941346 - RNA, 14 nt, Shigella flexneri 2a str. 2457T
ugcgcuaccaggaa

SEQ ID NO: 1941347 - RNA, 21 nt, Shigella flexneri 2a str. 2457T
ugcgcucuucaacuucagcag

SEQ ID NO: 1941348 - RNA, 17 nt, Shigella flexneri 2a str. 2457T
ugcgcucuucgaggccg

SEQ ID NO: 1941349 - RNA, 12 nt, Shigella flexneri 2a str. 2457T
ugcgcucuuccg

SEQ ID NO: 1941350 - RNA, 22 nt, Shigella flexneri 2a str. 2457T
ugcggacagucacguagcggcg

SEQ ID NO: 1941351 - RNA, 18 nt, Shigella flexneri 2a str. 2457T
ugcggagaaggugaagaa

SEQ ID NO: 1941352 - RNA, 13 nt, Shigella flexneri 2a str. 2457T
ugcggccagcagc

SEQ ID NO: 1941353 - RNA, 13 nt, Shigella flexneri 2a str. 2457T
ugcgggccaaaga

SEQ ID NO: 1941354 - RNA, 19 nt, Shigella flexneri 2a str. 2457T
ugcggcgaaaacgccacau

SEQ ID NO: 1941355 - RNA, 16 nt, Shigella flexneri 2a str. 2457T
ugcgggaugguugguc

SEQ ID NO: 1941356 - RNA, 20 nt, Shigella flexneri 2a str. 2457T
ugcgggaugguuggucuggc

SEQ ID NO: 1941357 - RNA, 17 nt, Shigella flexneri 2a str. 2457T
ugcgggcgcaagggcug

SEQ ID NO: 1941358 - RNA, 19 nt, Shigella flexneri 2a str. 2457T
ugcgggcgcaagggcugga

SEQ ID NO: 1941359 - RNA, 22 nt, Shigella flexneri 2a str. 2457T
ugcgguaguuucuccccaugga

SEQ ID NO: 1941360 - RNA, 18 nt, Shigella flexneri 2a str. 2457T
ugcgguaaccuggcaguu

SEQ ID NO: 1941361 - RNA, 14 nt, Shigella flexneri 2a str. 2457T
ugcgguaagcugcg

SEQ ID NO: 1941362 - RNA, 18 nt, Shigella flexneri 2a str. 2457T
ugcgguaaucgcccggau

SEQ ID NO: 1941363 - RNA, 15 nt, Shigella flexneri 2a str. 2457T
ugcgggucaggccag

SEQ ID NO: 1941364 - RNA, 16 nt, Shigella flexneri 2a str. 2457T
ugcgggucaggccagg

SEQ ID NO: 1941365 - RNA, 17 nt, Shigella flexneri 2a str. 2457T
ugcgggucaggccagga

SEQ ID NO: 1941366 - RNA, 14 nt, Shigella flexneri 2a str. 2457T
ugcguacaccaaca

SEQ ID NO: 1941367 - RNA, 15 nt, Shigella flexneri 2a str. 2457T
ugcguacuucuuacc

SEQ ID NO: 1941368 - RNA, 15 nt, Shigella flexneri 2a str. 2457T
ugcguagcugagcaa

SEQ ID NO: 1941369 - RNA, 20 nt, Shigella flexneri 2a str. 2457T
ugcguagucugaccucuucu

SEQ ID NO: 1941370 - RNA, 21 nt, Shigella flexneri 2a str. 2457T
ugcguagucugaccucuucua

SEQ ID NO: 1941371 - RNA, 19 nt, Shigella flexneri 2a str. 2457T
ugcgccuguucccuucuca

SEQ ID NO: 1941372 - RNA, 17 nt, Shigella flexneri 2a str. 2457T
ugcgccuggauuuucuc

SEQ ID NO: 1941373 - RNA, 13 nt, Shigella flexneri 2a str. 2457T
ugcgcgcaaucag

SEQ ID NO: 1941374 - RNA, 14 nt, Shigella flexneri 2a str. 2457T
aaaugguaaagaag

SEQ ID NO: 1941375 - RNA, 16 nt, Shigella flexneri 2a str. 2457T
aaauggugugcauggu

SEQ ID NO: 1941376 - RNA, 18 nt, Shigella flexneri 2a str. 2457T
aaauggccagccagcaga

SEQ ID NO: 1941377 - RNA, 23 nt, Shigella flexneri 2a str. 2457T
aaauggcgcuucguguuuaagaa

SEQ ID NO: 1941378 - RNA, 14 nt, Shigella flexneri 2a str. 2457T
ugcgcaucaugcca

SEQ ID NO: 1941379 - RNA, 20 nt, Shigella flexneri 2a str. 2457T
ugcgcaucaugccacccagg

SEQ ID NO: 1941380 - RNA, 14 nt, Shigella flexneri 2a str. 2457T
ugcgcaucaaagcc

SEQ ID NO: 1941381 - RNA, 17 nt, Shigella flexneri 2a str. 2457T
ugcgcaguacugugaac

SEQ ID NO: 1941382 - RNA, 23 nt, Shigella flexneri 2a str. 2457T
ugcgacgcuuacgcgucuuauca

SEQ ID NO: 1941383 - RNA, 14 nt, Shigella flexneri 2a str. 2457T
ugcgaccaaacugc

SEQ ID NO: 1941384 - RNA, 12 nt, Shigella flexneri 2a str. 2457T
ugcgaccgcucu

SEQ ID NO: 1941385 - RNA, 22 nt, Shigella flexneri 2a str. 2457T
ugcgaccguacaaccaaaucug

SEQ ID NO: 1941386 - RNA, 16 nt, Shigella flexneri 2a str. 2457T
ugcgacaggagccgca

SEQ ID NO: 1941387 - RNA, 17 nt, Shigella flexneri 2a str. 2457T
ugccugcgaagcucuuu

SEQ ID NO: 1941388 - RNA, 20 nt, Shigella flexneri 2a str. 2457T
ugccugcugugccagugcca

SEQ ID NO: 1941389 - RNA, 19 nt, Shigella flexneri 2a str. 2457T
ugccugcugugccagugcc

SEQ ID NO: 1941390 - RNA, 23 nt, Shigella flexneri 2a str. 2457T
ugccugcuggcuagccucccugc

SEQ ID NO: 1941391 - RNA, 11 nt, Shigella flexneri 2a str. 2457T
ugccugcggca

SEQ ID NO: 1941392 - RNA, 21 nt, Shigella flexneri 2a str. 2457T
ugcgagacggcggaaagggcc

SEQ ID NO: 1941393 - RNA, 18 nt, Shigella flexneri 2a str. 2457T
ugcgagaaguucugcagc

SEQ ID NO: 1941394 - RNA, 17 nt, Shigella flexneri 2a str. 2457T
ugcgcaaacuucuucag

SEQ ID NO: 1941395 - RNA, 19 nt, Shigella flexneri 2a str. 2457T
ugcccuuuucaccaugggc

SEQ ID NO: 1941396 - RNA, 14 nt, Shigella flexneri 2a str. 2457T
ugccgaaaugucuu

SEQ ID NO: 1941397 - RNA, 13 nt, Shigella flexneri 2a str. 2457T
ugccgacaaaugc

SEQ ID NO: 1941398 - RNA, 22 nt, Shigella flexneri 2a str. 2457T
ugccgaagccuguaaagucauc

SEQ ID NO: 1941399 - RNA, 17 nt, Shigella flexneri 2a str. 2457T
ugccgaccaucuguucu

SEQ ID NO: 1941400 - RNA, 22 nt, Shigella flexneri 2a str. 2457T
ugcccuguuugucgaucaucag

SEQ ID NO: 1941401 - RNA, 12 nt, Shigella flexneri 2a str. 2457T
ugcccuuucaac

SEQ ID NO: 1941402 - RNA, 14 nt, Shigella flexneri 2a str. 2457T
ugcccuugccaacg

SEQ ID NO: 1941403 - RNA, 14 nt, Shigella flexneri 2a str. 2457T
ugcccguuccaggc

SEQ ID NO: 1941404 - RNA, 14 nt, Shigella flexneri 2a str. 2457T
ugcccucugaauaa

SEQ ID NO: 1941405 - RNA, 13 nt, Shigella flexneri 2a str. 2457T
ugcccugcuggug

SEQ ID NO: 1941406 - RNA, 13 nt, Shigella flexneri 2a str. 2457T
ugccgcacaucac

SEQ ID NO: 1941407 - RNA, 20 nt, Shigella flexneri 2a str. 2457T
ugccgcaauugucuguuugc

SEQ ID NO: 1941408 - RNA, 15 nt, Shigella flexneri 2a str. 2457T
ugccgcacaucaccg

SEQ ID NO: 1941409 - RNA, 13 nt, Shigella flexneri 2a str. 2457T
ugccgcagaagau

SEQ ID NO: 1941410 - RNA, 13 nt, Shigella flexneri 2a str. 2457T
ugccgcagcaccc

SEQ ID NO: 1941411 - RNA, 13 nt, Shigella flexneri 2a str. 2457T
ugccgauggucac

SEQ ID NO: 1941412 - RNA, 23 nt, Shigella flexneri 2a str. 2457T
ugccgaugaacggcggcggcgcg

SEQ ID NO: 1941413 - RNA, 16 nt, Shigella flexneri 2a str. 2457T
ugccgcccguuuucuc

SEQ ID NO: 1941414 - RNA, 15 nt, Shigella flexneri 2a str. 2457T
ugccgcccagaagca

SEQ ID NO: 1941415 - RNA, 18 nt, Shigella flexneri 2a str. 2457T
ugccgccaguucuuccag

SEQ ID NO: 1941416 - RNA, 20 nt, Shigella flexneri 2a str. 2457T
ugccgcauggaaccaguuca

SEQ ID NO: 1941417 - RNA, 16 nt, Shigella flexneri 2a str. 2457T
ugccgcauccugcacc

SEQ ID NO: 1941418 - RNA, 21 nt, Shigella flexneri 2a str. 2457T
ugccggauauacccgccaaac

SEQ ID NO: 1941419 - RNA, 23 nt, Shigella flexneri 2a str. 2457T
ugccggaugcggcguaaaugccu

SEQ ID NO: 1941420 - RNA, 20 nt, Shigella flexneri 2a str. 2457T
ugccggaugcgccagcaucc

SEQ ID NO: 1941421 - RNA, 14 nt, Shigella flexneri 2a str. 2457T
ugccggaugacaga

SEQ ID NO: 1941422 - RNA, 15 nt, Shigella flexneri 2a str. 2457T
ugccggaugacagac

SEQ ID NO: 1941423 - RNA, 21 nt, Shigella flexneri 2a str. 2457T
ugccgucaauuuuaagcagau

SEQ ID NO: 1941424 - RNA, 14 nt, Shigella flexneri 2a str. 2457T
ugccgucaccagca

SEQ ID NO: 1941425 - RNA, 18 nt, Shigella flexneri 2a str. 2457T
ugccguauacacacuuuc

SEQ ID NO: 1941426 - RNA, 21 nt, Shigella flexneri 2a str. 2457T
ugccggggagauauuccccag

SEQ ID NO: 1941427 - RNA, 21 nt, Shigella flexneri 2a str. 2457T
ugccgucauguuacugagcgg

SEQ ID NO: 1941428 - RNA, 13 nt, Shigella flexneri 2a str. 2457T
ugccgucagcagg

SEQ ID NO: 1941429 - RNA, 19 nt, Shigella flexneri 2a str. 2457T
ugccgucagccacuucuuc

SEQ ID NO: 1941430 - RNA, 21 nt, Shigella flexneri 2a str. 2457T
ugccuaacaauucgccagggc

SEQ ID NO: 1941431 - RNA, 18 nt, Shigella flexneri 2a str. 2457T
ugccguuugcugcaugau

SEQ ID NO: 1941432 - RNA, 14 nt, Shigella flexneri 2a str. 2457T
ugccgcucaccuga

SEQ ID NO: 1941433 - RNA, 22 nt, Shigella flexneri 2a str. 2457T
ugccgcuaauggugcgcgcacu

SEQ ID NO: 1941434 - RNA, 18 nt, Shigella flexneri 2a str. 2457T
ugccggaagacacauugc

SEQ ID NO: 1941435 - RNA, 17 nt, Shigella flexneri 2a str. 2457T
ugccgcuuccagcagac

SEQ ID NO: 1941436 - RNA, 15 nt, Shigella flexneri 2a str. 2457T
ugccggaauauauuc

SEQ ID NO: 1941437 - RNA, 22 nt, Shigella flexneri 2a str. 2457T
ugccggaaggcagccuuucuca

SEQ ID NO: 1941438 - RNA, 20 nt, Shigella flexneri 2a str. 2457T
ugccggacagaucugccugu

SEQ ID NO: 1941439 - RNA, 18 nt, Shigella flexneri 2a str. 2457T
ugccgccggaaacauaaa

SEQ ID NO: 1941440 - RNA, 17 nt, Shigella flexneri 2a str. 2457T
ugccgccggaaacauaa

SEQ ID NO: 1941441 - RNA, 15 nt, Shigella flexneri 2a str. 2457T
ugcccagugaccaaa

SEQ ID NO: 1941442 - RNA, 15 nt, Shigella flexneri 2a str. 2457T
ugcccagaaaccagu

SEQ ID NO: 1941443 - RNA, 22 nt, Shigella flexneri 2a str. 2457T
ugcccacgcgcacgcugguaac

SEQ ID NO: 1941444 - RNA, 21 nt, Shigella flexneri 2a str. 2457T
ugcccaccgacgcagucaugc

SEQ ID NO: 1941445 - RNA, 17 nt, Shigella flexneri 2a str. 2457T
ugcccacgcgcacgcug

SEQ ID NO: 1941446 - RNA, 14 nt, Shigella flexneri 2a str. 2457T
ugcccccagcagcg

SEQ ID NO: 1941447 - RNA, 14 nt, Shigella flexneri 2a str. 2457T
ugccccauauggcc

SEQ ID NO: 1941448 - RNA, 16 nt, Shigella flexneri 2a str. 2457T
ugcccccucacaugag

SEQ ID NO: 1941449 - RNA, 13 nt, Shigella flexneri 2a str. 2457T
ugcccauggcaag

SEQ ID NO: 1941450 - RNA, 14 nt, Shigella flexneri 2a str. 2457T
ugcccgcagaucca

SEQ ID NO: 1941451 - RNA, 23 nt, Shigella flexneri 2a str. 2457T
ugcccgaugaccuugucaugcag

SEQ ID NO: 1941452 - RNA, 19 nt, Shigella flexneri 2a str. 2457T
ugcccgaugcgcaaacuua

SEQ ID NO: 1941453 - RNA, 17 nt, Shigella flexneri 2a str. 2457T
ugcccgcccgacaaagc

SEQ ID NO: 1941454 - RNA, 19 nt, Shigella flexneri 2a str. 2457T
ugcccgagcgccauuucuu

SEQ ID NO: 1941455 - RNA, 22 nt, Shigella flexneri 2a str. 2457T
ugcccgagauacaucaccgcca

SEQ ID NO: 1941456 - RNA, 16 nt, Shigella flexneri 2a str. 2457T
ugcccgugacucccac

SEQ ID NO: 1941457 - RNA, 23 nt, Shigella flexneri 2a str. 2457T
ugcccguaaaaaauggcuggcua

SEQ ID NO: 1941458 - RNA, 17 nt, Shigella flexneri 2a str. 2457T
ugcccgggucagcgcca

SEQ ID NO: 1941459 - RNA, 22 nt, Shigella flexneri 2a str. 2457T
ugcccgcuuaacguacugcuga

SEQ ID NO: 1941460 - RNA, 15 nt, Shigella flexneri 2a str. 2457T
ugcccgcuugagaca

SEQ ID NO: 1941461 - RNA, 16 nt, Shigella flexneri 2a str. 2457T
ugcccggagcagcagu

SEQ ID NO: 1941462 - RNA, 17 nt, Shigella flexneri 2a str. 2457T
ugcccggagcagcaguc

SEQ ID NO: 1941463 - RNA, 17 nt, Shigella flexneri 2a str. 2457T
ugcccgcuuaacguacu

SEQ ID NO: 1941464 - RNA, 21 nt, Shigella flexneri 2a str. 2457T
ugcccggaaguaccaauggca

SEQ ID NO: 1941465 - RNA, 23 nt, Shigella flexneri 2a str. 2457T
ugccagcguaccaugauccugca

SEQ ID NO: 1941466 - RNA, 22 nt, Shigella flexneri 2a str. 2457T
ugccagcgguggugacugguuu

SEQ ID NO: 1941467 - RNA, 18 nt, Shigella flexneri 2a str. 2457T
ugccagccaugagacaaa

SEQ ID NO: 1941468 - RNA, 22 nt, Shigella flexneri 2a str. 2457T
ugccagccaggauaugcgccuu

SEQ ID NO: 1941469 - RNA, 23 nt, Shigella flexneri 2a str. 2457T
ugccaggcuggcagaugcgucuu

SEQ ID NO: 1941470 - RNA, 14 nt, Shigella flexneri 2a str. 2457T
ugccaggaccauuc

SEQ ID NO: 1941471 - RNA, 18 nt, Shigella flexneri 2a str. 2457T
ugccaggaacacugguuc

SEQ ID NO: 1941472 - RNA, 20 nt, Shigella flexneri 2a str. 2457T
ugccagcucggauaaggcuu

SEQ ID NO: 1941473 - RNA, 15 nt, Shigella flexneri 2a str. 2457T
ugccagcguugagga

SEQ ID NO: 1941474 - RNA, 17 nt, Shigella flexneri 2a str. 2457T
ugccagcuucagcgcgu

SEQ ID NO: 1941475 - RNA, 19 nt, Shigella flexneri 2a str. 2457T
ugccagcuugcuuuccagc

SEQ ID NO: 1941476 - RNA, 22 nt, Shigella flexneri 2a str. 2457T
ugccagcucuuucgacagcgau

SEQ ID NO: 1941477 - RNA, 16 nt, Shigella flexneri 2a str. 2457T
ugccagcugcugugga

SEQ ID NO: 1941478 - RNA, 15 nt, Shigella flexneri 2a str. 2457T
ugccagguagucacg

SEQ ID NO: 1941479 - RNA, 15 nt, Shigella flexneri 2a str. 2457T
ugccaguaaagcagc

SEQ ID NO: 1941480 - RNA, 18 nt, Shigella flexneri 2a str. 2457T
ugccagucaaucauccau

SEQ ID NO: 1941481 - RNA, 17 nt, Shigella flexneri 2a str. 2457T
ugccagucaaugaaauu

SEQ ID NO: 1941482 - RNA, 15 nt, Shigella flexneri 2a str. 2457T
ugccaguccuaaaaa

SEQ ID NO: 1941483 - RNA, 15 nt, Shigella flexneri 2a str. 2457T
ugccaguucccccug

SEQ ID NO: 1941484 - RNA, 21 nt, Shigella flexneri 2a str. 2457T
ugccauaaccugugcaccaga

SEQ ID NO: 1941485 - RNA, 13 nt, Shigella flexneri 2a str. 2457T
ugccaguuuuucc

SEQ ID NO: 1941486 - RNA, 16 nt, Shigella flexneri 2a str. 2457T
ugccagugaaaguuuu

SEQ ID NO: 1941487 - RNA, 19 nt, Shigella flexneri 2a str. 2457T
ugccagucgcgccuuacgc

SEQ ID NO: 1941488 - RNA, 14 nt, Shigella flexneri 2a str. 2457T
ugccagugcugcuu

SEQ ID NO: 1941489 - RNA, 15 nt, Shigella flexneri 2a str. 2457T
ugccagugaugcgca

SEQ ID NO: 1941490 - RNA, 21 nt, Shigella flexneri 2a str. 2457T
ugccagugaugcgcaggguaa

SEQ ID NO: 1941491 - RNA, 17 nt, Shigella flexneri 2a str. 2457T
ugccaucagcgccugau

SEQ ID NO: 1941492 - RNA, 15 nt, Shigella flexneri 2a str. 2457T
ugccaucaucaccag

SEQ ID NO: 1941493 - RNA, 18 nt, Shigella flexneri 2a str. 2457T
ugccaugcacgcaagaac

SEQ ID NO: 1941494 - RNA, 20 nt, Shigella flexneri 2a str. 2457T
ugccaugacuuucuggcacg

SEQ ID NO: 1941495 - RNA, 13 nt, Shigella flexneri 2a str. 2457T
ugccaugcauauc

SEQ ID NO: 1941496 - RNA, 14 nt, Shigella flexneri 2a str. 2457T
ugccaucucugcaa

SEQ ID NO: 1941497 - RNA, 17 nt, Shigella flexneri 2a str. 2457T
ugccauccguaauuuuu

SEQ ID NO: 1941498 - RNA, 22 nt, Shigella flexneri 2a str. 2457T
ugccauccguaauuuuuacucc

SEQ ID NO: 1941499 - RNA, 13 nt, Shigella flexneri 2a str. 2457T
ugccauccagcuu

SEQ ID NO: 1941500 - RNA, 19 nt, Shigella flexneri 2a str. 2457T
ugccaucgacgaaauggug

SEQ ID NO: 1941501 - RNA, 16 nt, Shigella flexneri 2a str. 2457T
ugccauccugauuuau

SEQ ID NO: 1941502 - RNA, 22 nt, Shigella flexneri 2a str. 2457T
ugccaugguuuggaucuguugc

SEQ ID NO: 1941503 - RNA, 15 nt, Shigella flexneri 2a str. 2457T
ugccaugccaaucag

SEQ ID NO: 1941504 - RNA, 18 nt, Shigella flexneri 2a str. 2457T
ugccauucgccaguccuu

SEQ ID NO: 1941505 - RNA, 21 nt, Shigella flexneri 2a str. 2457T
ugccauuaacaggccaaaugc

SEQ ID NO: 1941506 - RNA, 17 nt, Shigella flexneri 2a str. 2457T
ugccauuucugcugcca

SEQ ID NO: 1941507 - RNA, 22 nt, Shigella flexneri 2a str. 2457T
ugccauuguuuucucacuguug

SEQ ID NO: 1941508 - RNA, 13 nt, Shigella flexneri 2a str. 2457T
ugcccaacugccu

SEQ ID NO: 1941509 - RNA, 15 nt, Shigella flexneri 2a str. 2457T
ugcccaacaggcgcu

SEQ ID NO: 1941510 - RNA, 14 nt, Shigella flexneri 2a str. 2457T
ugcccaacauacug

SEQ ID NO: 1941511 - RNA, 24 nt, Shigella flexneri 2a str. 2457T
ugccauuucuggcgucaaagcugc

SEQ ID NO: 1941512 - RNA, 22 nt, Shigella flexneri 2a str. 2457T
ugcccaagcggggaaggaugag

SEQ ID NO: 1941513 - RNA, 18 nt, Shigella flexneri 2a str. 2457T
ugccacacgcccaacuaa

SEQ ID NO: 1941514 - RNA, 19 nt, Shigella flexneri 2a str. 2457T
ugccacacgcccaacuaaa

SEQ ID NO: 1941515 - RNA, 21 nt, Shigella flexneri 2a str. 2457T
ugccacauuagauaaaaauga

SEQ ID NO: 1941516 - RNA, 23 nt, Shigella flexneri 2a str. 2457T
ugccacauuagauaaaaaugaag

SEQ ID NO: 1941517 - RNA, 22 nt, Shigella flexneri 2a str. 2457T
ugccaccacaccggaccagacg

SEQ ID NO: 1941518 - RNA, 16 nt, Shigella flexneri 2a str. 2457T
ugccacgccacgcugc

SEQ ID NO: 1941519 - RNA, 16 nt, Shigella flexneri 2a str. 2457T
ugccacgccacagccg

SEQ ID NO: 1941520 - RNA, 13 nt, Shigella flexneri 2a str. 2457T
ugccaccacaccg

SEQ ID NO: 1941521 - RNA, 18 nt, Shigella flexneri 2a str. 2457T
ugccaccacaccggacca

SEQ ID NO: 1941522 - RNA, 22 nt, Shigella flexneri 2a str. 2457T
ugccacgguaugacccagcgcg

SEQ ID NO: 1941523 - RNA, 18 nt, Shigella flexneri 2a str. 2457T
ugccacugccggugucga

SEQ ID NO: 1941524 - RNA, 22 nt, Shigella flexneri 2a str. 2457T
ugccacugguuuuccugagcaa

SEQ ID NO: 1941525 - RNA, 16 nt, Shigella flexneri 2a str. 2457T
ugccacuggccccacc

SEQ ID NO: 1941526 - RNA, 22 nt, Shigella flexneri 2a str. 2457T
ugccagcaacggccaaauaucc

SEQ ID NO: 1941527 - RNA, 19 nt, Shigella flexneri 2a str. 2457T
ugccagauggcauccagag

SEQ ID NO: 1941528 - RNA, 16 nt, Shigella flexneri 2a str. 2457T
ugccagaugcagcggu

SEQ ID NO: 1941529 - RNA, 12 nt, Shigella flexneri 2a str. 2457T
ugccagcaccac

SEQ ID NO: 1941530 - RNA, 15 nt, Shigella flexneri 2a str. 2457T
ugccaacggcacgau

SEQ ID NO: 1941531 - RNA, 14 nt, Shigella flexneri 2a str. 2457T
ugccaaauauuucu

SEQ ID NO: 1941532 - RNA, 16 nt, Shigella flexneri 2a str. 2457T
ugccacacaggccauu

SEQ ID NO: 1941533 - RNA, 13 nt, Shigella flexneri 2a str. 2457T
ugccaaagccagu

SEQ ID NO: 1941534 - RNA, 11 nt, Shigella flexneri 2a str. 2457T
ugcaggcuggu

SEQ ID NO: 1941535 - RNA, 14 nt, Shigella flexneri 2a str. 2457T
ugcauccagcagcc

SEQ ID NO: 1941536 - RNA, 19 nt, Shigella flexneri 2a str. 2457T
ugcauccacuuugguuaca

SEQ ID NO: 1941537 - RNA, 16 nt, Shigella flexneri 2a str. 2457T
ugcauaucucccagua

SEQ ID NO: 1941538 - RNA, 17 nt, Shigella flexneri 2a str. 2457T
ugcauaucaguugggga

SEQ ID NO: 1941539 - RNA, 23 nt, Shigella flexneri 2a str. 2457T
ugcauauccaggcuaauccaguc

SEQ ID NO: 1941540 - RNA, 13 nt, Shigella flexneri 2a str. 2457T
ugcauaggcggca

SEQ ID NO: 1941541 - RNA, 23 nt, Shigella flexneri 2a str. 2457T
ugcauuaaauugugaacgagaaa

SEQ ID NO: 1941542 - RNA, 16 nt, Shigella flexneri 2a str. 2457T
ugcauguaaaucaagc

SEQ ID NO: 1941543 - RNA, 20 nt, Shigella flexneri 2a str. 2457T
ugcauguaaaucaagcgccg

SEQ ID NO: 1941544 - RNA, 14 nt, Shigella flexneri 2a str. 2457T
ugcaugacagcgcc

SEQ ID NO: 1941545 - RNA, 18 nt, Shigella flexneri 2a str. 2457T
ugcaugcgaaugcagggc

SEQ ID NO: 1941546 - RNA, 17 nt, Shigella flexneri 2a str. 2457T
ugcaucgcgcugaacau

SEQ ID NO: 1941547 - RNA, 21 nt, Shigella flexneri 2a str. 2457T
ugcaucgccaaucugcugaua

SEQ ID NO: 1941548 - RNA, 21 nt, Shigella flexneri 2a str. 2457T
ugcaucgccugauucaaugag

SEQ ID NO: 1941549 - RNA, 14 nt, Shigella flexneri 2a str. 2457T
ugcaucgccugauu

SEQ ID NO: 1941550 - RNA, 15 nt, Shigella flexneri 2a str. 2457T
ugcauccguucuucg

SEQ ID NO: 1941551 - RNA, 22 nt, Shigella flexneri 2a str. 2457T
ugcagaccgcugacggcagcga

SEQ ID NO: 1941552 - RNA, 17 nt, Shigella flexneri 2a str. 2457T
ugcagacggcucaucac

SEQ ID NO: 1941553 - RNA, 22 nt, Shigella flexneri 2a str. 2457T
ugcagacaugacgcccggcaag

SEQ ID NO: 1941554 - RNA, 14 nt, Shigella flexneri 2a str. 2457T
ugcagaaucaaucu

SEQ ID NO: 1941555 - RNA, 16 nt, Shigella flexneri 2a str. 2457T
ugcagcaugcacccuc

SEQ ID NO: 1941556 - RNA, 16 nt, Shigella flexneri 2a str. 2457T
ugcagcagcuguuucu

SEQ ID NO: 1941557 - RNA, 17 nt, Shigella flexneri 2a str. 2457T
ugcagauaccacaucaa

SEQ ID NO: 1941558 - RNA, 21 nt, Shigella flexneri 2a str. 2457T
ugcagcuucuuauccagcugc

SEQ ID NO: 1941559 - RNA, 20 nt, Shigella flexneri 2a str. 2457T
ugcagcuuuaacgaucacug

SEQ ID NO: 1941560 - RNA, 22 nt, Shigella flexneri 2a str. 2457T
ugcaggaaaagguaggccugau

SEQ ID NO: 1941561 - RNA, 22 nt, Shigella flexneri 2a str. 2457T
ugcaggagcgauuaugaaacaa

SEQ ID NO: 1941562 - RNA, 17 nt, Shigella flexneri 2a str. 2457T
ugcaggacuuaaccguu

SEQ ID NO: 1941563 - RNA, 17 nt, Shigella flexneri 2a str. 2457T
ugcacggagauauccag

SEQ ID NO: 1941564 - RNA, 21 nt, Shigella flexneri 2a str. 2457T
ugcacggagauauccagcgcc

SEQ ID NO: 1941565 - RNA, 22 nt, Shigella flexneri 2a str. 2457T
ugcacggagauauccagcgccg

SEQ ID NO: 1941566 - RNA, 23 nt, Shigella flexneri 2a str. 2457T
ugcacgcccugauaaaucaccug

SEQ ID NO: 1941567 - RNA, 15 nt, Shigella flexneri 2a str. 2457T
ugcacgcagaucggu

SEQ ID NO: 1941568 - RNA, 22 nt, Shigella flexneri 2a str. 2457T
ugcacgaugacugaacaggcaa

SEQ ID NO: 1941569 - RNA, 14 nt, Shigella flexneri 2a str. 2457T
ugcacuuuucuggg

SEQ ID NO: 1941570 - RNA, 21 nt, Shigella flexneri 2a str. 2457T
ugcagaaauugucuccaccaa

SEQ ID NO: 1941571 - RNA, 17 nt, Shigella flexneri 2a str. 2457T
ugcacccgcuucaguga

SEQ ID NO: 1941572 - RNA, 22 nt, Shigella flexneri 2a str. 2457T
ugcacccuuuuuuuaaauuuau

SEQ ID NO: 1941573 - RNA, 19 nt, Shigella flexneri 2a str. 2457T
ugcaccccgagcuuaugca

SEQ ID NO: 1941574 - RNA, 17 nt, Shigella flexneri 2a str. 2457T
ugcaccuuuuccaccaa

SEQ ID NO: 1941575 - RNA, 21 nt, Shigella flexneri 2a str. 2457T
uccagauuuauaaaagaaaaa

SEQ ID NO: 1941576 - RNA, 15 nt, Shigella flexneri 2a str. 2457T
uccagcaacaacagc

SEQ ID NO: 1941577 - RNA, 19 nt, Shigella flexneri 2a str. 2457T
uccagcaaccaaugccacc

SEQ ID NO: 1941578 - RNA, 13 nt, Shigella flexneri 2a str. 2457T
uccagcaccacuu

SEQ ID NO: 1941579 - RNA, 23 nt, Shigella flexneri 2a str. 2457T
uccagcacuugcaggaacagugc

SEQ ID NO: 1941580 - RNA, 17 nt, Shigella flexneri 2a str. 2457T
uccagcagaccagcaaa

SEQ ID NO: 1941581 - RNA, 18 nt, Shigella flexneri 2a str. 2457T
uccagcagaccagcaaaa

SEQ ID NO: 1941582 - RNA, 22 nt, Shigella flexneri 2a str. 2457T
uccagcagaccuucugccagac

SEQ ID NO: 1941583 - RNA, 19 nt, Shigella flexneri 2a str. 2457T
uccagccacggcuccagca

SEQ ID NO: 1941584 - RNA, 14 nt, Shigella flexneri 2a str. 2457T
uccagcagcggauc

SEQ ID NO: 1941585 - RNA, 21 nt, Shigella flexneri 2a str. 2457T
uccagcgauaccggugcaccu

SEQ ID NO: 1941586 - RNA, 20 nt, Shigella flexneri 2a str. 2457T
uccagcgcaucccauuucuc

SEQ ID NO: 1941587 - RNA, 16 nt, Shigella flexneri 2a str. 2457T
uccagcgacuccaguu

SEQ ID NO: 1941588 - RNA, 15 nt, Shigella flexneri 2a str. 2457T
uccagcccugccagg

SEQ ID NO: 1941589 - RNA, 17 nt, Shigella flexneri 2a str. 2457T
uccagccaguguuaacc

SEQ ID NO: 1941590 - RNA, 18 nt, Shigella flexneri 2a str. 2457T
uccauaagcccagaacaa

SEQ ID NO: 1941591 - RNA, 20 nt, Shigella flexneri 2a str. 2457T
uccaguagauucaacauaau

SEQ ID NO: 1941592 - RNA, 17 nt, Shigella flexneri 2a str. 2457T
uccaguagauucaacau

SEQ ID NO: 1941593 - RNA, 22 nt, Shigella flexneri 2a str. 2457T
uccaguacgcguacacuuuccu

SEQ ID NO: 1941594 - RNA, 22 nt, Shigella flexneri 2a str. 2457T
uccaguacaugaagcacugcau

SEQ ID NO: 1941595 - RNA, 15 nt, Shigella flexneri 2a str. 2457T
uccaguaccugcaaa

SEQ ID NO: 1941596 - RNA, 23 nt, Shigella flexneri 2a str. 2457T
uccaguuugcucaaauccaucag

SEQ ID NO: 1941597 - RNA, 19 nt, Shigella flexneri 2a str. 2457T
uccagucagugguuugccc

SEQ ID NO: 1941598 - RNA, 16 nt, Shigella flexneri 2a str. 2457T
uccaguuuucaaauau

SEQ ID NO: 1941599 - RNA, 22 nt, Shigella flexneri 2a str. 2457T
uccaguuuucuuugccacuccu

SEQ ID NO: 1941600 - RNA, 18 nt, Shigella flexneri 2a str. 2457T
uccagcucuuuuccagcc

SEQ ID NO: 1941601 - RNA, 14 nt, Shigella flexneri 2a str. 2457T
uccagcucuucuuc

SEQ ID NO: 1941602 - RNA, 15 nt, Shigella flexneri 2a str. 2457T
uccagcucuucuuca

SEQ ID NO: 1941603 - RNA, 17 nt, Shigella flexneri 2a str. 2457T
uccaggaacagaagaaa

SEQ ID NO: 1941604 - RNA, 17 nt, Shigella flexneri 2a str. 2457T
uccaggaaggccagcag

SEQ ID NO: 1941605 - RNA, 13 nt, Shigella flexneri 2a str. 2457T
uccaggaacucca

SEQ ID NO: 1941606 - RNA, 23 nt, Shigella flexneri 2a str. 2457T
uccagcuuauuagggaucaucuu

SEQ ID NO: 1941607 - RNA, 20 nt, Shigella flexneri 2a str. 2457T
uccaggcugcaaagucuggg

SEQ ID NO: 1941608 - RNA, 22 nt, Shigella flexneri 2a str. 2457T
uccaggcugcaaagucugggcu

SEQ ID NO: 1941609 - RNA, 12 nt, Shigella flexneri 2a str. 2457T
uccaguaagcug

SEQ ID NO: 1941610 - RNA, 16 nt, Shigella flexneri 2a str. 2457T
uccaguaagcugugcg

SEQ ID NO: 1941611 - RNA, 23 nt, Shigella flexneri 2a str. 2457T
uccagggccucuccuuuaccacu

SEQ ID NO: 1941612 - RNA, 23 nt, Shigella flexneri 2a str. 2457T
uccagggcgaaaagcuucuuccu

SEQ ID NO: 1941613 - RNA, 15 nt, Shigella flexneri 2a str. 2457T
uccagggccucuccu

SEQ ID NO: 1941614 - RNA, 19 nt, Shigella flexneri 2a str. 2457T
uccacaggguguauucaug

SEQ ID NO: 1941615 - RNA, 13 nt, Shigella flexneri 2a str. 2457T
uccacagucaggc

SEQ ID NO: 1941616 - RNA, 11 nt, Shigella flexneri 2a str. 2457T
uccacaaaccg

SEQ ID NO: 1941617 - RNA, 19 nt, Shigella flexneri 2a str. 2457T
uccaaauccuucagcaacu

SEQ ID NO: 1941618 - RNA, 21 nt, Shigella flexneri 2a str. 2457T
uccacaugguuggccaucgua

SEQ ID NO: 1941619 - RNA, 16 nt, Shigella flexneri 2a str. 2457T
uccacaucggcaucag

SEQ ID NO: 1941620 - RNA, 14 nt, Shigella flexneri 2a str. 2457T
uccaccacguuuuu

SEQ ID NO: 1941621 - RNA, 17 nt, Shigella flexneri 2a str. 2457T
uccaccacguuuuucaa

SEQ ID NO: 1941622 - RNA, 23 nt, Shigella flexneri 2a str. 2457T
uccaccacgcuguagccgccguc

SEQ ID NO: 1941623 - RNA, 16 nt, Shigella flexneri 2a str. 2457T
uccaccagauggcuuu

SEQ ID NO: 1941624 - RNA, 12 nt, Shigella flexneri 2a str. 2457T
uccagcaaaaag

SEQ ID NO: 1941625 - RNA, 14 nt, Shigella flexneri 2a str. 2457T
uccagauucucaua

SEQ ID NO: 1941626 - RNA, 22 nt, Shigella flexneri 2a str. 2457T
uccagauucaguuucaccgcgu

SEQ ID NO: 1941627 - RNA, 22 nt, Shigella flexneri 2a str. 2457T
uccagaugugcaccuuuuccac

SEQ ID NO: 1941628 - RNA, 20 nt, Shigella flexneri 2a str. 2457T
uccagauccauaagguccuc

SEQ ID NO: 1941629 - RNA, 23 nt, Shigella flexneri 2a str. 2457T
uccagauccauaagguccuccag

SEQ ID NO: 1941630 - RNA, 18 nt, Shigella flexneri 2a str. 2457T
uccagaucgaucauauuu

SEQ ID NO: 1941631 - RNA, 19 nt, Shigella flexneri 2a str. 2457T
uccagauaauuaugccgau

SEQ ID NO: 1941632 - RNA, 17 nt, Shigella flexneri 2a str. 2457T
uccagaucugaaucauu

SEQ ID NO: 1941633 - RNA, 21 nt, Shigella flexneri 2a str. 2457T
uccagacgggucauaaucaga

SEQ ID NO: 1941634 - RNA, 13 nt, Shigella flexneri 2a str. 2457T
uccagacgcugca

SEQ ID NO: 1941635 - RNA, 20 nt, Shigella flexneri 2a str. 2457T
uccagacgcgcagcuucacu

SEQ ID NO: 1941636 - RNA, 18 nt, Shigella flexneri 2a str. 2457T
uccagaccauauuuucau

SEQ ID NO: 1941637 - RNA, 12 nt, Shigella flexneri 2a str. 2457T
uccacugucaaa

SEQ ID NO: 1941638 - RNA, 14 nt, Shigella flexneri 2a str. 2457T
uccacugucaaauc

SEQ ID NO: 1941639 - RNA, 15 nt, Shigella flexneri 2a str. 2457T
uccacugucaaaucc

SEQ ID NO: 1941640 - RNA, 19 nt, Shigella flexneri 2a str. 2457T
uccacucauuaauuuccug

SEQ ID NO: 1941641 - RNA, 16 nt, Shigella flexneri 2a str. 2457T
uccacugucaaaucca

SEQ ID NO: 1941642 - RNA, 17 nt, Shigella flexneri 2a str. 2457T
uccagaauaucuucaac

SEQ ID NO: 1941643 - RNA, 19 nt, Shigella flexneri 2a str. 2457T
uccacuccgguguuuucuc

SEQ ID NO: 1941644 - RNA, 20 nt, Shigella flexneri 2a str. 2457T
uccacuccgguguuuucucu

SEQ ID NO: 1941645 - RNA, 18 nt, Shigella flexneri 2a str. 2457T
uccaccgcguucagcagc

SEQ ID NO: 1941646 - RNA, 17 nt, Shigella flexneri 2a str. 2457T
uccaccgcguucagcag

SEQ ID NO: 1941647 - RNA, 21 nt, Shigella flexneri 2a str. 2457T
uccaccugcgucgcgccguag

SEQ ID NO: 1941648 - RNA, 22 nt, Shigella flexneri 2a str. 2457T
uccacgaaacggcguugagcaa

SEQ ID NO: 1941649 - RNA, 14 nt, Shigella flexneri 2a str. 2457T
ucaucuuugccuga

SEQ ID NO: 1941650 - RNA, 20 nt, Shigella flexneri 2a str. 2457T
ucaucuuugaaaucacgcau

SEQ ID NO: 1941651 - RNA, 21 nt, Shigella flexneri 2a str. 2457T
ucaucuuugagcaugauuuca

SEQ ID NO: 1941652 - RNA, 15 nt, Shigella flexneri 2a str. 2457T
ucaucuuugaaauca

SEQ ID NO: 1941653 - RNA, 16 nt, Shigella flexneri 2a str. 2457T
ucaugaaaaccguuag

SEQ ID NO: 1941654 - RNA, 13 nt, Shigella flexneri 2a str. 2457T
ucaucuucuucug

SEQ ID NO: 1941655 - RNA, 16 nt, Shigella flexneri 2a str. 2457T
ucaucuucaacugcca

SEQ ID NO: 1941656 - RNA, 14 nt, Shigella flexneri 2a str. 2457T
ucaucuuaacuucg

SEQ ID NO: 1941657 - RNA, 15 nt, Shigella flexneri 2a str. 2457T
ucaucuucagucagg

SEQ ID NO: 1941658 - RNA, 21 nt, Shigella flexneri 2a str. 2457T
ucaucuucacuucaucccuga

SEQ ID NO: 1941659 - RNA, 16 nt, Shigella flexneri 2a str. 2457T
ucaucugauaucucac

SEQ ID NO: 1941660 - RNA, 19 nt, Shigella flexneri 2a str. 2457T
ucaucugauaucucaccag

SEQ ID NO: 1941661 - RNA, 16 nt, Shigella flexneri 2a str. 2457T
ucaucugccacuucug

SEQ ID NO: 1941662 - RNA, 19 nt, Shigella flexneri 2a str. 2457T
ucaucuggcguaccaauca

SEQ ID NO: 1941663 - RNA, 22 nt, Shigella flexneri 2a str. 2457T
ucaucggugguguaaccuucac

SEQ ID NO: 1941664 - RNA, 22 nt, Shigella flexneri 2a str. 2457T
ucaucgggaagaggaucugcuc

SEQ ID NO: 1941665 - RNA, 16 nt, Shigella flexneri 2a str. 2457T
ucaucgguauaaccaa

SEQ ID NO: 1941666 - RNA, 16 nt, Shigella flexneri 2a str. 2457T
ucaucugaccacggcc

SEQ ID NO: 1941667 - RNA, 19 nt, Shigella flexneri 2a str. 2457T
ucaucucuucuuccggcac

SEQ ID NO: 1941668 - RNA, 23 nt, Shigella flexneri 2a str. 2457T
ucaugaauauauaauuaaaaaua

SEQ ID NO: 1941669 - RNA, 20 nt, Shigella flexneri 2a str. 2457T
ucaugcagcuccaccgauuu

SEQ ID NO: 1941670 - RNA, 18 nt, Shigella flexneri 2a str. 2457T
ucaugcaucgguuuugcg

SEQ ID NO: 1941671 - RNA, 15 nt, Shigella flexneri 2a str. 2457T
ucaugccaaaaggga

SEQ ID NO: 1941672 - RNA, 13 nt, Shigella flexneri 2a str. 2457T
ucaugccagugau

SEQ ID NO: 1941673 - RNA, 23 nt, Shigella flexneri 2a str. 2457T
ucaugcccugcccguugccagga

SEQ ID NO: 1941674 - RNA, 15 nt, Shigella flexneri 2a str. 2457T
ucaugccuacauauu

SEQ ID NO: 1941675 - RNA, 18 nt, Shigella flexneri 2a str. 2457T
ucaugccgaucgucuggg

SEQ ID NO: 1941676 - RNA, 19 nt, Shigella flexneri 2a str. 2457T
ucaugccgaucgucugggc

SEQ ID NO: 1941677 - RNA, 16 nt, Shigella flexneri 2a str. 2457T
ucauggcagucuuaau

SEQ ID NO: 1941678 - RNA, 16 nt, Shigella flexneri 2a str. 2457T
ucaugcuauuccuuga

SEQ ID NO: 1941679 - RNA, 15 nt, Shigella flexneri 2a str. 2457T
ucaugcgccagguaa

SEQ ID NO: 1941680 - RNA, 20 nt, Shigella flexneri 2a str. 2457T
ucaugcucagaugccugaug

SEQ ID NO: 1941681 - RNA, 21 nt, Shigella flexneri 2a str. 2457T
ucauucgacgcgcgcacacaa

SEQ ID NO: 1941682 - RNA, 19 nt, Shigella flexneri 2a str. 2457T
ucauucgcgccagauggca

SEQ ID NO: 1941683 - RNA, 19 nt, Shigella flexneri 2a str. 2457T
ucauucgccgguuccagcu

SEQ ID NO: 1941684 - RNA, 16 nt, Shigella flexneri 2a str. 2457T
ucauucgguuuucaau

SEQ ID NO: 1941685 - RNA, 21 nt, Shigella flexneri 2a str. 2457T
ucauucucuauucuuaaaaua

SEQ ID NO: 1941686 - RNA, 13 nt, Shigella flexneri 2a str. 2457T
ucauucaccaguu

SEQ ID NO: 1941687 - RNA, 18 nt, Shigella flexneri 2a str. 2457T
ucauucaacuuaagucuc

SEQ ID NO: 1941688 - RNA, 19 nt, Shigella flexneri 2a str. 2457T
ucauuacgaaguuuaauuc

SEQ ID NO: 1941689 - RNA, 12 nt, Shigella flexneri 2a str. 2457T
ucauuaccuuca

SEQ ID NO: 1941690 - RNA, 15 nt, Shigella flexneri 2a str. 2457T
ucauuaccuucaaca

SEQ ID NO: 1941691 - RNA, 21 nt, Shigella flexneri 2a str. 2457T
ucauuacgcgguuuauuaugc

SEQ ID NO: 1941692 - RNA, 13 nt, Shigella flexneri 2a str. 2457T
ucauuauuaauau

SEQ ID NO: 1941693 - RNA, 16 nt, Shigella flexneri 2a str. 2457T
ucauuaugaucaaaau

SEQ ID NO: 1941694 - RNA, 19 nt, Shigella flexneri 2a str. 2457T
ucauuaagaacuccugaaa

SEQ ID NO: 1941695 - RNA, 13 nt, Shigella flexneri 2a str. 2457T
ucauuaaagccgc

SEQ ID NO: 1941696 - RNA, 19 nt, Shigella flexneri 2a str. 2457T
ucauuuuuucccauuacca

SEQ ID NO: 1941697 - RNA, 22 nt, Shigella flexneri 2a str. 2457T
ucauuuuuucgacaucaagaaa

SEQ ID NO: 1941698 - RNA, 22 nt, Shigella flexneri 2a str. 2457T
ucauuuuacguugcauuuccau

SEQ ID NO: 1941699 - RNA, 24 nt, Shigella flexneri 2a str. 2457T
ucauuuuauugcguaaucuuuuca

SEQ ID NO: 1941700 - RNA, 15 nt, Shigella flexneri 2a str. 2457T
ucauuuuucucaacg

SEQ ID NO: 1941701 - RNA, 22 nt, Shigella flexneri 2a str. 2457T
ucauugcugguauuuccagucc

SEQ ID NO: 1941702 - RNA, 19 nt, Shigella flexneri 2a str. 2457T
ucauuggccggaauaccac

SEQ ID NO: 1941703 - RNA, 17 nt, Shigella flexneri 2a str. 2457T
ucauugcuaucuccugu

SEQ ID NO: 1941704 - RNA, 17 nt, Shigella flexneri 2a str. 2457T
ucauugguccaucuuuu

SEQ ID NO: 1941705 - RNA, 21 nt, Shigella flexneri 2a str. 2457T
ucauuucccaucucaauauua

SEQ ID NO: 1941706 - RNA, 17 nt, Shigella flexneri 2a str. 2457T
ucagcgagagcaaugcg

SEQ ID NO: 1941707 - RNA, 19 nt, Shigella flexneri 2a str. 2457T
ucagcgaucguuuuuaacc

SEQ ID NO: 1941708 - RNA, 11 nt, Shigella flexneri 2a str. 2457T
ucagccucugc

SEQ ID NO: 1941709 - RNA, 20 nt, Shigella flexneri 2a str. 2457T
ucagccugcucaguugcauc

SEQ ID NO: 1941710 - RNA, 15 nt, Shigella flexneri 2a str. 2457T
ucagccgcaaaccug

SEQ ID NO: 1941711 - RNA, 14 nt, Shigella flexneri 2a str. 2457T
ucagccgcaaacuc

SEQ ID NO: 1941712 - RNA, 18 nt, Shigella flexneri 2a str. 2457T
ucagccguacccaggccc

SEQ ID NO: 1941713 - RNA, 17 nt, Shigella flexneri 2a str. 2457T
ucagccgucauccagga

SEQ ID NO: 1941714 - RNA, 18 nt, Shigella flexneri 2a str. 2457T
ucagccgucauccaggaa

SEQ ID NO: 1941715 - RNA, 16 nt, Shigella flexneri 2a str. 2457T
ucagccagcuggcaga

SEQ ID NO: 1941716 - RNA, 15 nt, Shigella flexneri 2a str. 2457T
ucacuucaaauuuaa

SEQ ID NO: 1941717 - RNA, 14 nt, Shigella flexneri 2a str. 2457T
ucagccagaaagaa

SEQ ID NO: 1941718 - RNA, 13 nt, Shigella flexneri 2a str. 2457T
ucagccacuuccu

SEQ ID NO: 1941719 - RNA, 13 nt, Shigella flexneri 2a str. 2457T
ucagccacuucuu

SEQ ID NO: 1941720 - RNA, 21 nt, Shigella flexneri 2a str. 2457T
ucacuuaaucguucugugccg

SEQ ID NO: 1941721 - RNA, 20 nt, Shigella flexneri 2a str. 2457T
ucacuguugaguaagaggcc

SEQ ID NO: 1941722 - RNA, 17 nt, Shigella flexneri 2a str. 2457T
ucacuguugaagccgcc

SEQ ID NO: 1941723 - RNA, 17 nt, Shigella flexneri 2a str. 2457T
ucacuuaacccauuaca

SEQ ID NO: 1941724 - RNA, 23 nt, Shigella flexneri 2a str. 2457T
ucacuuaacccauuacaagcccg

SEQ ID NO: 1941725 - RNA, 21 nt, Shigella flexneri 2a str. 2457T
ucacucuauagucuuuucgcu

SEQ ID NO: 1941726 - RNA, 17 nt, Shigella flexneri 2a str. 2457T
ucacucggggcuuuucu

SEQ ID NO: 1941727 - RNA, 15 nt, Shigella flexneri 2a str. 2457T
ucacugacaccagca

SEQ ID NO: 1941728 - RNA, 15 nt, Shigella flexneri 2a str. 2457T
ucacugacuuuucgu

SEQ ID NO: 1941729 - RNA, 13 nt, Shigella flexneri 2a str. 2457T
ucacugacaccau

SEQ ID NO: 1941730 - RNA, 18 nt, Shigella flexneri 2a str. 2457T
ucacugucgaacuggcag

SEQ ID NO: 1941731 - RNA, 20 nt, Shigella flexneri 2a str. 2457T
ucacugugauggaccgugcc

SEQ ID NO: 1941732 - RNA, 20 nt, Shigella flexneri 2a str. 2457T
ucacugaugacaagcguaug

SEQ ID NO: 1941733 - RNA, 16 nt, Shigella flexneri 2a str. 2457T
ucaggaaauaaauaau

SEQ ID NO: 1941734 - RNA, 22 nt, Shigella flexneri 2a str. 2457T
ucaggaauagcggcaagcccag

SEQ ID NO: 1941735 - RNA, 15 nt, Shigella flexneri 2a str. 2457T
ucaggaauauguuca

SEQ ID NO: 1941736 - RNA, 13 nt, Shigella flexneri 2a str. 2457T
ucagcuucaccuu

SEQ ID NO: 1941737 - RNA, 14 nt, Shigella flexneri 2a str. 2457T
ucagcuuuuccaua

SEQ ID NO: 1941738 - RNA, 19 nt, Shigella flexneri 2a str. 2457T
ucagcuuuggugaaaaaau

SEQ ID NO: 1941739 - RNA, 15 nt, Shigella flexneri 2a str. 2457T
ucagcugccagggca

SEQ ID NO: 1941740 - RNA, 23 nt, Shigella flexneri 2a str. 2457T
ucagcuauucuuauaaagaaaau

SEQ ID NO: 1941741 - RNA, 14 nt, Shigella flexneri 2a str. 2457T
ucaggugucuggca

SEQ ID NO: 1941742 - RNA, 13 nt, Shigella flexneri 2a str. 2457T
ucagguaccagca

SEQ ID NO: 1941743 - RNA, 18 nt, Shigella flexneri 2a str. 2457T
ucaguaaaguuaccuucg

SEQ ID NO: 1941744 - RNA, 23 nt, Shigella flexneri 2a str. 2457T
ucaguaaaguuaccuucgaagaa

SEQ ID NO: 1941745 - RNA, 14 nt, Shigella flexneri 2a str. 2457T
ucaguaaacgcuuu

SEQ ID NO: 1941746 - RNA, 13 nt, Shigella flexneri 2a str. 2457T
ucaguacaccacc

SEQ ID NO: 1941747 - RNA, 15 nt, Shigella flexneri 2a str. 2457T
ucaguacaccaccua

SEQ ID NO: 1941748 - RNA, 21 nt, Shigella flexneri 2a str. 2457T
ucaggguaaauuuauagucau

SEQ ID NO: 1941749 - RNA, 22 nt, Shigella flexneri 2a str. 2457T
ucaggcuuuuuuauugccaucu

SEQ ID NO: 1941750 - RNA, 17 nt, Shigella flexneri 2a str. 2457T
ucaggcaacccagaaga

SEQ ID NO: 1941751 - RNA, 22 nt, Shigella flexneri 2a str. 2457T
ucaggcaagccgcuaacagcag

SEQ ID NO: 1941752 - RNA, 15 nt, Shigella flexneri 2a str. 2457T
ucaguucaaauucau

SEQ ID NO: 1941753 - RNA, 21 nt, Shigella flexneri 2a str. 2457T
ucaguucauggugcaagaaau

SEQ ID NO: 1941754 - RNA, 20 nt, Shigella flexneri 2a str. 2457T
ucaguuaaucgcgaaauaac

SEQ ID NO: 1941755 - RNA, 21 nt, Shigella flexneri 2a str. 2457T
ucagucacgacaaagacauca

SEQ ID NO: 1941756 - RNA, 13 nt, Shigella flexneri 2a str. 2457T
ucagucagcagug

SEQ ID NO: 1941757 - RNA, 23 nt, Shigella flexneri 2a str. 2457T
ucagucacgacaaagacaucaaa

SEQ ID NO: 1941758 - RNA, 21 nt, Shigella flexneri 2a str. 2457T
ucauaaacacgguuuuucauu

SEQ ID NO: 1941759 - RNA, 14 nt, Shigella flexneri 2a str. 2457T
ucauaaaaauuaaa

SEQ ID NO: 1941760 - RNA, 18 nt, Shigella flexneri 2a str. 2457T
ucauaaauacagagcacg

SEQ ID NO: 1941761 - RNA, 14 nt, Shigella flexneri 2a str. 2457T
ucauaaauacagag

SEQ ID NO: 1941762 - RNA, 17 nt, Shigella flexneri 2a str. 2457T
ucauaaauucaaagugu

SEQ ID NO: 1941763 - RNA, 18 nt, Shigella flexneri 2a str. 2457T
ucaucaggccuggacucu

SEQ ID NO: 1941764 - RNA, 23 nt, Shigella flexneri 2a str. 2457T
ucaucagguuggaucaacaggca

SEQ ID NO: 1941765 - RNA, 21 nt, Shigella flexneri 2a str. 2457T
ucaucaguucaggaucugaca

SEQ ID NO: 1941766 - RNA, 19 nt, Shigella flexneri 2a str. 2457T
ucaucaguuccaguucauu

SEQ ID NO: 1941767 - RNA, 21 nt, Shigella flexneri 2a str. 2457T
ucaucaucgcagauuucuucu

SEQ ID NO: 1941768 - RNA, 14 nt, Shigella flexneri 2a str. 2457T
ucaucauccagcac

SEQ ID NO: 1941769 - RNA, 18 nt, Shigella flexneri 2a str. 2457T
ucaucauagacuucccuc

SEQ ID NO: 1941770 - RNA, 22 nt, Shigella flexneri 2a str. 2457T
ucaucagcaaaggcgugaacuu

SEQ ID NO: 1941771 - RNA, 23 nt, Shigella flexneri 2a str. 2457T
ucaucacuccccgcaacagugaa

SEQ ID NO: 1941772 - RNA, 15 nt, Shigella flexneri 2a str. 2457T
ucaucacgcgguuac

SEQ ID NO: 1941773 - RNA, 18 nt, Shigella flexneri 2a str. 2457T
ucaucagaaaugccagua

SEQ ID NO: 1941774 - RNA, 15 nt, Shigella flexneri 2a str. 2457T
ucaucagcauucuca

SEQ ID NO: 1941775 - RNA, 20 nt, Shigella flexneri 2a str. 2457T
ucaucagcauaaucaccagu

SEQ ID NO: 1941776 - RNA, 21 nt, Shigella flexneri 2a str. 2457T
ucaucagcauaaucaccagua

SEQ ID NO: 1941777 - RNA, 18 nt, Shigella flexneri 2a str. 2457T
ucaucaugggcaagguau

SEQ ID NO: 1941778 - RNA, 19 nt, Shigella flexneri 2a str. 2457T
ucaucaugggcaagguauu

SEQ ID NO: 1941779 - RNA, 13 nt, Shigella flexneri 2a str. 2457T
ucaucauugcagu

SEQ ID NO: 1941780 - RNA, 17 nt, Shigella flexneri 2a str. 2457T
ucaucauugcagucaua

SEQ ID NO: 1941781 - RNA, 16 nt, Shigella flexneri 2a str. 2457T
ucaucaucgccaggcu

SEQ ID NO: 1941782 - RNA, 21 nt, Shigella flexneri 2a str. 2457T
ucaucaucgcgcccaaaccac

SEQ ID NO: 1941783 - RNA, 22 nt, Shigella flexneri 2a str. 2457T
ucauccagaccgcucagcuccu

SEQ ID NO: 1941784 - RNA, 16 nt, Shigella flexneri 2a str. 2457T
ucauccagacugcuca

SEQ ID NO: 1941785 - RNA, 17 nt, Shigella flexneri 2a str. 2457T
ucauccagacugcucag

SEQ ID NO: 1941786 - RNA, 18 nt, Shigella flexneri 2a str. 2457T
ucauccagacugcucagc

SEQ ID NO: 1941787 - RNA, 11 nt, Shigella flexneri 2a str. 2457T
ucauccagcac

SEQ ID NO: 1941788 - RNA, 23 nt, Shigella flexneri 2a str. 2457T
ucauccagcacggugaagaagcg

SEQ ID NO: 1941789 - RNA, 13 nt, Shigella flexneri 2a str. 2457T
ucauccagcacuu

SEQ ID NO: 1941790 - RNA, 17 nt, Shigella flexneri 2a str. 2457T
ucauccagcgcacgggc

SEQ ID NO: 1941791 - RNA, 17 nt, Shigella flexneri 2a str. 2457T
ucauccaggaacuccag

SEQ ID NO: 1941792 - RNA, 16 nt, Shigella flexneri 2a str. 2457T
ucauccgccgcucaau

SEQ ID NO: 1941793 - RNA, 18 nt, Shigella flexneri 2a str. 2457T
ucauccggcuuucuucug

SEQ ID NO: 1941794 - RNA, 21 nt, Shigella flexneri 2a str. 2457T
ucauccggcuuuuuuacauca

SEQ ID NO: 1941795 - RNA, 20 nt, Shigella flexneri 2a str. 2457T
ucauccggcaccuuuucauc

SEQ ID NO: 1941796 - RNA, 19 nt, Shigella flexneri 2a str. 2457T
ucauccguuucucuguuca

SEQ ID NO: 1941797 - RNA, 13 nt, Shigella flexneri 2a str. 2457T
ucaucgaauaaau

SEQ ID NO: 1941798 - RNA, 23 nt, Shigella flexneri 2a str. 2457T
ucauccuuugggcauuugcacaa

SEQ ID NO: 1941799 - RNA, 17 nt, Shigella flexneri 2a str. 2457T
ucauccugcugcacgcc

SEQ ID NO: 1941800 - RNA, 13 nt, Shigella flexneri 2a str. 2457T
ucauccucuucug

SEQ ID NO: 1941801 - RNA, 15 nt, Shigella flexneri 2a str. 2457T
ucauccucuucugcc

SEQ ID NO: 1941802 - RNA, 19 nt, Shigella flexneri 2a str. 2457T
ucauccuaaacgcuggcag

SEQ ID NO: 1941803 - RNA, 14 nt, Shigella flexneri 2a str. 2457T
ucauccccucuucc

SEQ ID NO: 1941804 - RNA, 17 nt, Shigella flexneri 2a str. 2457T
ucaucccaguggauauc

SEQ ID NO: 1941805 - RNA, 15 nt, Shigella flexneri 2a str. 2457T
ucauccagugccgcc

SEQ ID NO: 1941806 - RNA, 17 nt, Shigella flexneri 2a str. 2457T
ucauccaucaaauuacc

SEQ ID NO: 1941807 - RNA, 15 nt, Shigella flexneri 2a str. 2457T
ucaucgccagcgaau

SEQ ID NO: 1941808 - RNA, 14 nt, Shigella flexneri 2a str. 2457T
ucaucgcaaugauu

SEQ ID NO: 1941809 - RNA, 14 nt, Shigella flexneri 2a str. 2457T
ucaucgaauaaauu

SEQ ID NO: 1941810 - RNA, 15 nt, Shigella flexneri 2a str. 2457T
ucaucgauaccaaua

SEQ ID NO: 1941811 - RNA, 19 nt, Shigella flexneri 2a str. 2457T
ucaucgauauuaucuucau

SEQ ID NO: 1941812 - RNA, 15 nt, Shigella flexneri 2a str. 2457T
ucaucgccuuccagc

SEQ ID NO: 1941813 - RNA, 16 nt, Shigella flexneri 2a str. 2457T
ucaucgccuuccagcg

SEQ ID NO: 1941814 - RNA, 18 nt, Shigella flexneri 2a str. 2457T
ucaucgccgucacgguaa

SEQ ID NO: 1941815 - RNA, 21 nt, Shigella flexneri 2a str. 2457T
ucaucgccgcuggccauuucu

SEQ ID NO: 1941816 - RNA, 22 nt, Shigella flexneri 2a str. 2457T
ucaucgcccaguugaucaccag

SEQ ID NO: 1941817 - RNA, 23 nt, Shigella flexneri 2a str. 2457T
ucaucgcccaguugaucaccagu

SEQ ID NO: 1941818 - RNA, 16 nt, Shigella flexneri 2a str. 2457T
ucaucggaucauuagu

SEQ ID NO: 1941819 - RNA, 16 nt, Shigella flexneri 2a str. 2457T
ucaucgcuaauaauaa

SEQ ID NO: 1941820 - RNA, 15 nt, Shigella flexneri 2a str. 2457T
ucauauugcucugga

SEQ ID NO: 1941821 - RNA, 13 nt, Shigella flexneri 2a str. 2457T
ucauauucugaaa

SEQ ID NO: 1941822 - RNA, 16 nt, Shigella flexneri 2a str. 2457T
ucauauucugaaauau

SEQ ID NO: 1941823 - RNA, 14 nt, Shigella flexneri 2a str. 2457T
ucauaucacaaauu

SEQ ID NO: 1941824 - RNA, 15 nt, Shigella flexneri 2a str. 2457T
ucauaugauucauau

SEQ ID NO: 1941825 - RNA, 21 nt, Shigella flexneri 2a str. 2457T
ucaucaaauuacgauaaucag

SEQ ID NO: 1941826 - RNA, 14 nt, Shigella flexneri 2a str. 2457T
ucaucaacguuuuu

SEQ ID NO: 1941827 - RNA, 21 nt, Shigella flexneri 2a str. 2457T
ucaucaacugacuauccugga

SEQ ID NO: 1941828 - RNA, 15 nt, Shigella flexneri 2a str. 2457T
ucaucaacuggcaac

SEQ ID NO: 1941829 - RNA, 20 nt, Shigella flexneri 2a str. 2457T
ucaucaagcaaggccagguu

SEQ ID NO: 1941830 - RNA, 14 nt, Shigella flexneri 2a str. 2457T
ucaucaagcuguuc

SEQ ID NO: 1941831 - RNA, 18 nt, Shigella flexneri 2a str. 2457T
ucaucaaaaucaucauug

SEQ ID NO: 1941832 - RNA, 21 nt, Shigella flexneri 2a str. 2457T
ucaucaauugcgcaccagcuu

SEQ ID NO: 1941833 - RNA, 18 nt, Shigella flexneri 2a str. 2457T
ucaucacaucccagcaga

SEQ ID NO: 1941834 - RNA, 12 nt, Shigella flexneri 2a str. 2457T
ucaucacaccgc

SEQ ID NO: 1941835 - RNA, 21 nt, Shigella flexneri 2a str. 2457T
ucaucaauaccugguccuuca

SEQ ID NO: 1941836 - RNA, 13 nt, Shigella flexneri 2a str. 2457T
ucaucaauaccug

SEQ ID NO: 1941837 - RNA, 20 nt, Shigella flexneri 2a str. 2457T
ucaucaaucgcaaucuggca

SEQ ID NO: 1941838 - RNA, 18 nt, Shigella flexneri 2a str. 2457T
ucaucaccuccagccuga

SEQ ID NO: 1941839 - RNA, 17 nt, Shigella flexneri 2a str. 2457T
ucauacugauuguacug

SEQ ID NO: 1941840 - RNA, 13 nt, Shigella flexneri 2a str. 2457T
ucauacugaacuu

SEQ ID NO: 1941841 - RNA, 24 nt, Shigella flexneri 2a str. 2457T
ucauacugccgaccaucuguucug

SEQ ID NO: 1941842 - RNA, 13 nt, Shigella flexneri 2a str. 2457T
ucauagaccauug

SEQ ID NO: 1941843 - RNA, 22 nt, Shigella flexneri 2a str. 2457T
ucauagauuaauuucccaccac

SEQ ID NO: 1941844 - RNA, 22 nt, Shigella flexneri 2a str. 2457T
ucauagcaguaccuccuucaca

SEQ ID NO: 1941845 - RNA, 15 nt, Shigella flexneri 2a str. 2457T
ucauagccuuucaau

SEQ ID NO: 1941846 - RNA, 22 nt, Shigella flexneri 2a str. 2457T
ucauagggugugacgacaccau

SEQ ID NO: 1941847 - RNA, 17 nt, Shigella flexneri 2a str. 2457T
ucauagguucuuuuaaa

SEQ ID NO: 1941848 - RNA, 19 nt, Shigella flexneri 2a str. 2457T
ucauacgcguaaaacagcc

SEQ ID NO: 1941849 - RNA, 21 nt, Shigella flexneri 2a str. 2457T
ucauacgcggcagaaugguuu

SEQ ID NO: 1941850 - RNA, 21 nt, Shigella flexneri 2a str. 2457T
ucauacacuucacacacuuuu

SEQ ID NO: 1941851 - RNA, 17 nt, Shigella flexneri 2a str. 2457T
ucauacaagcggaaacg

SEQ ID NO: 1941852 - RNA, 13 nt, Shigella flexneri 2a str. 2457T
ucauacaccagcg

SEQ ID NO: 1941853 - RNA, 16 nt, Shigella flexneri 2a str. 2457T
ucauacaccagcggca

SEQ ID NO: 1941854 - RNA, 20 nt, Shigella flexneri 2a str. 2457T
ucauacccaacguaacaaaa

SEQ ID NO: 1941855 - RNA, 18 nt, Shigella flexneri 2a str. 2457T
ucauaccccacauaguuu

SEQ ID NO: 1941856 - RNA, 17 nt, Shigella flexneri 2a str. 2457T
ucauaauaugaccugac

SEQ ID NO: 1941857 - RNA, 14 nt, Shigella flexneri 2a str. 2457T
ucacucaaaauauc

SEQ ID NO: 1941858 - RNA, 22 nt, Shigella flexneri 2a str. 2457T
ucacucacgccguuaacuucac

SEQ ID NO: 1941859 - RNA, 23 nt, Shigella flexneri 2a str. 2457T
ucacucccggauaaaucuccauu

SEQ ID NO: 1941860 - RNA, 19 nt, Shigella flexneri 2a str. 2457T
ucacuccccgcaacaguga

SEQ ID NO: 1941861 - RNA, 16 nt, Shigella flexneri 2a str. 2457T
ucacuccauccagcaa

SEQ ID NO: 1941862 - RNA, 12 nt, Shigella flexneri 2a str. 2457T
ucacucaucaac

SEQ ID NO: 1941863 - RNA, 12 nt, Shigella flexneri 2a str. 2457T
ucacucaguguu

SEQ ID NO: 1941864 - RNA, 19 nt, Shigella flexneri 2a str. 2457T
ucacuaaacccgaccacuu

SEQ ID NO: 1941865 - RNA, 20 nt, Shigella flexneri 2a str. 2457T
ucacuaagaauguccauuau

SEQ ID NO: 1941866 - RNA, 13 nt, Shigella flexneri 2a str. 2457T
ucacuacaaucag

SEQ ID NO: 1941867 - RNA, 22 nt, Shigella flexneri 2a str. 2457T
ucacgcuauacaaccaccccac

SEQ ID NO: 1941868 - RNA, 12 nt, Shigella flexneri 2a str. 2457T
ucacgcgcugcc

SEQ ID NO: 1941869 - RNA, 15 nt, Shigella flexneri 2a str. 2457T
ucacgcgucuuauca

SEQ ID NO: 1941870 - RNA, 17 nt, Shigella flexneri 2a str. 2457T
ucacgauuguuaaucac

SEQ ID NO: 1941871 - RNA, 21 nt, Shigella flexneri 2a str. 2457T
ucacgauuguuaaucacaucg

SEQ ID NO: 1941872 - RNA, 18 nt, Shigella flexneri 2a str. 2457T
ucacgcagcuucucguga

SEQ ID NO: 1941873 - RNA, 16 nt, Shigella flexneri 2a str. 2457T
ucacgcagcucacgca

SEQ ID NO: 1941874 - RNA, 13 nt, Shigella flexneri 2a str. 2457T
ucacgcgccagcu

SEQ ID NO: 1941875 - RNA, 23 nt, Shigella flexneri 2a str. 2457T
ucacgcagggugugcuccagucg

SEQ ID NO: 1941876 - RNA, 21 nt, Shigella flexneri 2a str. 2457T
ucacgccuugcggaaauucca

SEQ ID NO: 1941877 - RNA, 18 nt, Shigella flexneri 2a str. 2457T
ucaccugcgccugcgguu

SEQ ID NO: 1941878 - RNA, 17 nt, Shigella flexneri 2a str. 2457T
ucaccugcggugcagcc

SEQ ID NO: 1941879 - RNA, 21 nt, Shigella flexneri 2a str. 2457T
ucaccugcccgguauccauca

SEQ ID NO: 1941880 - RNA, 18 nt, Shigella flexneri 2a str. 2457T
ucaccugcauacaaauaa

SEQ ID NO: 1941881 - RNA, 21 nt, Shigella flexneri 2a str. 2457T
ucaccugaugcccguacgcug

SEQ ID NO: 1941882 - RNA, 18 nt, Shigella flexneri 2a str. 2457T
ucaccucaucaccacaga

SEQ ID NO: 1941883 - RNA, 15 nt, Shigella flexneri 2a str. 2457T
ucaccuacgcuggca

SEQ ID NO: 1941884 - RNA, 17 nt, Shigella flexneri 2a str. 2457T
ucaccucuuuuuccacu

SEQ ID NO: 1941885 - RNA, 16 nt, Shigella flexneri 2a str. 2457T
ucacgaaucuauucau

SEQ ID NO: 1941886 - RNA, 20 nt, Shigella flexneri 2a str. 2457T
ucacgacaaaugcgccgcca

SEQ ID NO: 1941887 - RNA, 14 nt, Shigella flexneri 2a str. 2457T
ucacgagagauacg

SEQ ID NO: 1941888 - RNA, 18 nt, Shigella flexneri 2a str. 2457T
ucacgaccuguaccuuca

SEQ ID NO: 1941889 - RNA, 16 nt, Shigella flexneri 2a str. 2457T
ucaccgcgucuucgcu

SEQ ID NO: 1941890 - RNA, 14 nt, Shigella flexneri 2a str. 2457T
ucaccgcgaccaga

SEQ ID NO: 1941891 - RNA, 13 nt, Shigella flexneri 2a str. 2457T
ucaccgccgccuu

SEQ ID NO: 1941892 - RNA, 18 nt, Shigella flexneri 2a str. 2457T
ucaccggcguucccgucc

SEQ ID NO: 1941893 - RNA, 16 nt, Shigella flexneri 2a str. 2457T
ucaccggugagcugca

SEQ ID NO: 1941894 - RNA, 18 nt, Shigella flexneri 2a str. 2457T
ucaccguucagcuugcgu

SEQ ID NO: 1941895 - RNA, 19 nt, Shigella flexneri 2a str. 2457T
ucaccgccacuaccaucag

SEQ ID NO: 1941896 - RNA, 14 nt, Shigella flexneri 2a str. 2457T
ucaccgccaccagc

SEQ ID NO: 1941897 - RNA, 22 nt, Shigella flexneri 2a str. 2457T
ucaccgcaucgucacugauagu

SEQ ID NO: 1941898 - RNA, 15 nt, Shigella flexneri 2a str. 2457T
ucaccgcaucgucac

SEQ ID NO: 1941899 - RNA, 20 nt, Shigella flexneri 2a str. 2457T
ucaccgagcagcacaaugcc

SEQ ID NO: 1941900 - RNA, 13 nt, Shigella flexneri 2a str. 2457T
ucaccgaucauca

SEQ ID NO: 1941901 - RNA, 20 nt, Shigella flexneri 2a str. 2457T
ucaccccgcgcucacaccac

SEQ ID NO: 1941902 - RNA, 23 nt, Shigella flexneri 2a str. 2457T
ucaccgaagcggccgucagaucg

SEQ ID NO: 1941903 - RNA, 23 nt, Shigella flexneri 2a str. 2457T
ucaccgaagacgugcgccacaac

SEQ ID NO: 1941904 - RNA, 20 nt, Shigella flexneri 2a str. 2457T
ucacccaucacuaccugauu

SEQ ID NO: 1941905 - RNA, 22 nt, Shigella flexneri 2a str. 2457T
ucacccccguuaaccacuucag

SEQ ID NO: 1941906 - RNA, 15 nt, Shigella flexneri 2a str. 2457T
ucaccagauguccca

SEQ ID NO: 1941907 - RNA, 20 nt, Shigella flexneri 2a str. 2457T
ucaccagcaaauccagcggu

SEQ ID NO: 1941908 - RNA, 17 nt, Shigella flexneri 2a str. 2457T
ucaccagcaucagcgau

SEQ ID NO: 1941909 - RNA, 18 nt, Shigella flexneri 2a str. 2457T
ucaccagaaucaauccca

SEQ ID NO: 1941910 - RNA, 20 nt, Shigella flexneri 2a str. 2457T
ucaccagaaucaaucccauc

SEQ ID NO: 1941911 - RNA, 14 nt, Shigella flexneri 2a str. 2457T
ucaccagacaucaa

SEQ ID NO: 1941912 - RNA, 20 nt, Shigella flexneri 2a str. 2457T
ucaccagacaucccagugca

SEQ ID NO: 1941913 - RNA, 22 nt, Shigella flexneri 2a str. 2457T
ucaccaaugaaagccccaccag

SEQ ID NO: 1941914 - RNA, 23 nt, Shigella flexneri 2a str. 2457T
ucaccaaugaaagccccaccagc

SEQ ID NO: 1941915 - RNA, 16 nt, Shigella flexneri 2a str. 2457T
ucaccacagacaaaca

SEQ ID NO: 1941916 - RNA, 17 nt, Shigella flexneri 2a str. 2457T
ucaccacagacaaacag

SEQ ID NO: 1941917 - RNA, 12 nt, Shigella flexneri 2a str. 2457T
ucaccacaucca

SEQ ID NO: 1941918 - RNA, 12 nt, Shigella flexneri 2a str. 2457T
ucacccaacaau

SEQ ID NO: 1941919 - RNA, 13 nt, Shigella flexneri 2a str. 2457T
ucacccacacuuc

SEQ ID NO: 1941920 - RNA, 18 nt, Shigella flexneri 2a str. 2457T
ucacccacgguuacgcua

SEQ ID NO: 1941921 - RNA, 18 nt, Shigella flexneri 2a str. 2457T
ucacccaccgauuuucag

SEQ ID NO: 1941922 - RNA, 16 nt, Shigella flexneri 2a str. 2457T
ucaccauuccgcauga

SEQ ID NO: 1941923 - RNA, 23 nt, Shigella flexneri 2a str. 2457T
ucaccauucugcgcugacucuac

SEQ ID NO: 1941924 - RNA, 22 nt, Shigella flexneri 2a str. 2457T
ucaccauuacgcaaugcguacu

SEQ ID NO: 1941925 - RNA, 14 nt, Shigella flexneri 2a str. 2457T
ucaccauuggcauu

SEQ ID NO: 1941926 - RNA, 23 nt, Shigella flexneri 2a str. 2457T
ucaccauuuccgguacuggcuau

SEQ ID NO: 1941927 - RNA, 19 nt, Shigella flexneri 2a str. 2457T
ucaccagcgcauugacgau

SEQ ID NO: 1941928 - RNA, 15 nt, Shigella flexneri 2a str. 2457T
ucacagaaggccagg

SEQ ID NO: 1941929 - RNA, 16 nt, Shigella flexneri 2a str. 2457T
ucacagaaggccagga

SEQ ID NO: 1941930 - RNA, 17 nt, Shigella flexneri 2a str. 2457T
ucacagaaggccaggau

SEQ ID NO: 1941931 - RNA, 14 nt, Shigella flexneri 2a str. 2457T
ucaccaaugaaagc

SEQ ID NO: 1941932 - RNA, 19 nt, Shigella flexneri 2a str. 2457T
ucaccaaucggcagaacgg

SEQ ID NO: 1941933 - RNA, 17 nt, Shigella flexneri 2a str. 2457T
ucacauuuuuagcagac

SEQ ID NO: 1941934 - RNA, 14 nt, Shigella flexneri 2a str. 2457T
ucacauuuaaacaa

SEQ ID NO: 1941935 - RNA, 20 nt, Shigella flexneri 2a str. 2457T
ucacaccaucaaagaagcuc

SEQ ID NO: 1941936 - RNA, 23 nt, Shigella flexneri 2a str. 2457T
ucacaccaucaaagaagcucuuu

SEQ ID NO: 1941937 - RNA, 17 nt, Shigella flexneri 2a str. 2457T
ucacaccacagcagcca

SEQ ID NO: 1941938 - RNA, 15 nt, Shigella flexneri 2a str. 2457T
ucacaccauugagga

SEQ ID NO: 1941939 - RNA, 18 nt, Shigella flexneri 2a str. 2457T
ucacaccugcucagcccg

SEQ ID NO: 1941940 - RNA, 20 nt, Shigella flexneri 2a str. 2457T
ucacaccuuauuuacauccc

SEQ ID NO: 1941941 - RNA, 22 nt, Shigella flexneri 2a str. 2457T
ucacaccauugauaauccauca

SEQ ID NO: 1941942 - RNA, 17 nt, Shigella flexneri 2a str. 2457T
ucacaauucaucaucag

SEQ ID NO: 1941943 - RNA, 18 nt, Shigella flexneri 2a str. 2457T
ucacacacuuuuauuaac

SEQ ID NO: 1941944 - RNA, 15 nt, Shigella flexneri 2a str. 2457T
ucacacagugaaucu

SEQ ID NO: 1941945 - RNA, 17 nt, Shigella flexneri 2a str. 2457T
ucacacagugaaucucu

SEQ ID NO: 1941946 - RNA, 16 nt, Shigella flexneri 2a str. 2457T
ucacaagacuguaaau

SEQ ID NO: 1941947 - RNA, 22 nt, Shigella flexneri 2a str. 2457T
ucacaaggccauugacgcaucg

SEQ ID NO: 1941948 - RNA, 12 nt, Shigella flexneri 2a str. 2457T
ucacaaucaucg

SEQ ID NO: 1941949 - RNA, 21 nt, Shigella flexneri 2a str. 2457T
ucacaaucaucgcauccagcg

SEQ ID NO: 1941950 - RNA, 19 nt, Shigella flexneri 2a str. 2457T
ucaauuaccacaaguaaaa

SEQ ID NO: 1941951 - RNA, 17 nt, Shigella flexneri 2a str. 2457T
ucaauuucugcaaaaua

SEQ ID NO: 1941952 - RNA, 20 nt, Shigella flexneri 2a str. 2457T
ucaauuuccgucgcaugggg

SEQ ID NO: 1941953 - RNA, 17 nt, Shigella flexneri 2a str. 2457T
ucaaucuuuacacacaa

SEQ ID NO: 1941954 - RNA, 16 nt, Shigella flexneri 2a str. 2457T
ucaaucucuuuuucca

SEQ ID NO: 1941955 - RNA, 21 nt, Shigella flexneri 2a str. 2457T
ucaaucucuuuuuccaccgca

SEQ ID NO: 1941956 - RNA, 13 nt, Shigella flexneri 2a str. 2457T
ucaaucugcugcc

SEQ ID NO: 1941957 - RNA, 16 nt, Shigella flexneri 2a str. 2457T
ucaaucugcugccuga

SEQ ID NO: 1941958 - RNA, 14 nt, Shigella flexneri 2a str. 2457T
ucaaucgccaccac

SEQ ID NO: 1941959 - RNA, 14 nt, Shigella flexneri 2a str. 2457T
ucaaucgagauacg

SEQ ID NO: 1941960 - RNA, 16 nt, Shigella flexneri 2a str. 2457T
ucaaugcccaucacua

SEQ ID NO: 1941961 - RNA, 18 nt, Shigella flexneri 2a str. 2457T
ucaaugccggacuguaaa

SEQ ID NO: 1941962 - RNA, 20 nt, Shigella flexneri 2a str. 2457T
ucaaugcauuaucagagauu

SEQ ID NO: 1941963 - RNA, 22 nt, Shigella flexneri 2a str. 2457T
ucaauggaaggggccgaaaaau

SEQ ID NO: 1941964 - RNA, 15 nt, Shigella flexneri 2a str. 2457T
ucaaugcuuuuugca

SEQ ID NO: 1941965 - RNA, 21 nt, Shigella flexneri 2a str. 2457T
ucaaugcuuuuugcauuuccg

SEQ ID NO: 1941966 - RNA, 17 nt, Shigella flexneri 2a str. 2457T
ucaaugcuuuuugcauu

SEQ ID NO: 1941967 - RNA, 19 nt, Shigella flexneri 2a str. 2457T
ucaaguugacucucaucca

SEQ ID NO: 1941968 - RNA, 13 nt, Shigella flexneri 2a str. 2457T
ucaaguugacucu

SEQ ID NO: 1941969 - RNA, 20 nt, Shigella flexneri 2a str. 2457T
ucaauauuagcauuaaguaa

SEQ ID NO: 1941970 - RNA, 21 nt, Shigella flexneri 2a str. 2457T
ucaagucauugauucgaucaa

SEQ ID NO: 1941971 - RNA, 21 nt, Shigella flexneri 2a str. 2457T
ucaaguguggccgccagugau

SEQ ID NO: 1941972 - RNA, 21 nt, Shigella flexneri 2a str. 2457T
ucaagugcuuucaucaaaaaa

SEQ ID NO: 1941973 - RNA, 16 nt, Shigella flexneri 2a str. 2457T
ucaagugcuacccacu

SEQ ID NO: 1941974 - RNA, 18 nt, Shigella flexneri 2a str. 2457T
ucaauauuugcaccuaaa

SEQ ID NO: 1941975 - RNA, 12 nt, Shigella flexneri 2a str. 2457T
ucaauauuuuca

SEQ ID NO: 1941976 - RNA, 21 nt, Shigella flexneri 2a str. 2457T
ucaaucccuucgacuuucagu

SEQ ID NO: 1941977 - RNA, 15 nt, Shigella flexneri 2a str. 2457T
ucaaucgcaaucugg

SEQ ID NO: 1941978 - RNA, 22 nt, Shigella flexneri 2a str. 2457T
ucaaucgcacccgccaucaucc

SEQ ID NO: 1941979 - RNA, 16 nt, Shigella flexneri 2a str. 2457T
ucaaguauuuuuaauu

SEQ ID NO: 1941980 - RNA, 19 nt, Shigella flexneri 2a str. 2457T
ucaaguauuuuuaauuaaa

SEQ ID NO: 1941981 - RNA, 13 nt, Shigella flexneri 2a str. 2457T
ucaaguaaccuuu

SEQ ID NO: 1941982 - RNA, 14 nt, Shigella flexneri 2a str. 2457T
ucaaggucaacauu

SEQ ID NO: 1941983 - RNA, 18 nt, Shigella flexneri 2a str. 2457T
ucaaggucaacaguucau

SEQ ID NO: 1941984 - RNA, 17 nt, Shigella flexneri 2a str. 2457T
ucaaggugcgcgaugcu

SEQ ID NO: 1941985 - RNA, 20 nt, Shigella flexneri 2a str. 2457T
ucaagcguuucaucuucagu

SEQ ID NO: 1941986 - RNA, 15 nt, Shigella flexneri 2a str. 2457T
ucaaggcgcugcauc

SEQ ID NO: 1941987 - RNA, 22 nt, Shigella flexneri 2a str. 2457T
ucaagcgccgaguaaaaaaaca

SEQ ID NO: 1941988 - RNA, 17 nt, Shigella flexneri 2a str. 2457T
ucaagauauuucaccag

SEQ ID NO: 1941989 - RNA, 18 nt, Shigella flexneri 2a str. 2457T
ucaagauuaaaagugauu

SEQ ID NO: 1941990 - RNA, 15 nt, Shigella flexneri 2a str. 2457T
ucaagauuagccccc

SEQ ID NO: 1941991 - RNA, 22 nt, Shigella flexneri 2a str. 2457T
ucaagauuagcccccguuuugu

SEQ ID NO: 1941992 - RNA, 16 nt, Shigella flexneri 2a str. 2457T
ucaagcaaggccaggu

SEQ ID NO: 1941993 - RNA, 21 nt, Shigella flexneri 2a str. 2457T
ucaagcaaggccagguuuucu

SEQ ID NO: 1941994 - RNA, 13 nt, Shigella flexneri 2a str. 2457T
ucaagcacaauca

SEQ ID NO: 1941995 - RNA, 13 nt, Shigella flexneri 2a str. 2457T
ucaaaucaugccu

SEQ ID NO: 1941996 - RNA, 21 nt, Shigella flexneri 2a str. 2457T
ucaaaucgaaaucaacauguu

SEQ ID NO: 1941997 - RNA, 19 nt, Shigella flexneri 2a str. 2457T
ucaacguacucugccacua

SEQ ID NO: 1941998 - RNA, 17 nt, Shigella flexneri 2a str. 2457T
ucaacgugucuuuuacu

SEQ ID NO: 1941999 - RNA, 19 nt, Shigella flexneri 2a str. 2457T
ucaacguuauucgcuuccu

SEQ ID NO: 1942000 - RNA, 18 nt, Shigella flexneri 2a str. 2457T
ucaacguaguaucguaau

SEQ ID NO: 1942001 - RNA, 17 nt, Shigella flexneri 2a str. 2457T
ucaacgucacuggguuc

SEQ ID NO: 1942002 - RNA, 18 nt, Shigella flexneri 2a str. 2457T
ucaacgucaaaagaugcg

SEQ ID NO: 1942003 - RNA, 12 nt, Shigella flexneri 2a str. 2457T
ucaacgucaaac

SEQ ID NO: 1942004 - RNA, 12 nt, Shigella flexneri 2a str. 2457T
ucaacugcgguu

SEQ ID NO: 1942005 - RNA, 16 nt, Shigella flexneri 2a str. 2457T
ucaacugccaguuccc

SEQ ID NO: 1942006 - RNA, 14 nt, Shigella flexneri 2a str. 2457T
ucaacuggauaaaa

SEQ ID NO: 1942007 - RNA, 15 nt, Shigella flexneri 2a str. 2457T
ucaacuggauaaaau

SEQ ID NO: 1942008 - RNA, 18 nt, Shigella flexneri 2a str. 2457T
ucaagaaaccgaaguugu

SEQ ID NO: 1942009 - RNA, 23 nt, Shigella flexneri 2a str. 2457T
ucaagaaugcucgcuggcaggcc

SEQ ID NO: 1942010 - RNA, 15 nt, Shigella flexneri 2a str. 2457T
ucaagacaucaauaa

SEQ ID NO: 1942011 - RNA, 15 nt, Shigella flexneri 2a str. 2457T
ucaagagacugcugg

SEQ ID NO: 1942012 - RNA, 21 nt, Shigella flexneri 2a str. 2457T
ucaagacgaauaccuucuucc

SEQ ID NO: 1942013 - RNA, 20 nt, Shigella flexneri 2a str. 2457T
uauucacgaaucuauucauu

SEQ ID NO: 1942014 - RNA, 14 nt, Shigella flexneri 2a str. 2457T
uauucagcagcaga

SEQ ID NO: 1942015 - RNA, 21 nt, Shigella flexneri 2a str. 2457T
uauucagcaauucucucuuca

SEQ ID NO: 1942016 - RNA, 21 nt, Shigella flexneri 2a str. 2457T
uauucacuacggucacgccac

SEQ ID NO: 1942017 - RNA, 21 nt, Shigella flexneri 2a str. 2457T
uauucaccgcaucaauauuaa

SEQ ID NO: 1942018 - RNA, 19 nt, Shigella flexneri 2a str. 2457T
uauucaucaauagcaacug

SEQ ID NO: 1942019 - RNA, 11 nt, Shigella flexneri 2a str. 2457T
uauucaucugg

SEQ ID NO: 1942020 - RNA, 12 nt, Shigella flexneri 2a str. 2457T
uauucaugcccu

SEQ ID NO: 1942021 - RNA, 21 nt, Shigella flexneri 2a str. 2457T
uauucauucgcucaggaaaag

SEQ ID NO: 1942022 - RNA, 16 nt, Shigella flexneri 2a str. 2457T
uauucauggugaauau

SEQ ID NO: 1942023 - RNA, 14 nt, Shigella flexneri 2a str. 2457T
uauucauugacuua

SEQ ID NO: 1942024 - RNA, 15 nt, Shigella flexneri 2a str. 2457T
uauucugacgccacc

SEQ ID NO: 1942025 - RNA, 16 nt, Shigella flexneri 2a str. 2457T
uauuaucggcaccauu

SEQ ID NO: 1942026 - RNA, 15 nt, Shigella flexneri 2a str. 2457T
uauuaucggcaccau

SEQ ID NO: 1942027 - RNA, 18 nt, Shigella flexneri 2a str. 2457T
uauuauucauaaugccca

SEQ ID NO: 1942028 - RNA, 16 nt, Shigella flexneri 2a str. 2457T
uauuauucauaaugcc

SEQ ID NO: 1942029 - RNA, 13 nt, Shigella flexneri 2a str. 2457T
uauuauuauuuuu

SEQ ID NO: 1942030 - RNA, 12 nt, Shigella flexneri 2a str. 2457T
uauuauugaaau

SEQ ID NO: 1942031 - RNA, 20 nt, Shigella flexneri 2a str. 2457T
uauuagccgccagcucuuua

SEQ ID NO: 1942032 - RNA, 13 nt, Shigella flexneri 2a str. 2457T
uauuauauauaau

SEQ ID NO: 1942033 - RNA, 12 nt, Shigella flexneri 2a str. 2457T
uauuauagacau

SEQ ID NO: 1942034 - RNA, 20 nt, Shigella flexneri 2a str. 2457T
uauuauagacaucuuuauau

SEQ ID NO: 1942035 - RNA, 23 nt, Shigella flexneri 2a str. 2457T
uaucccuuacgcguucauacuuu

SEQ ID NO: 1942036 - RNA, 19 nt, Shigella flexneri 2a str. 2457T
uauccgacauuucugcugc

SEQ ID NO: 1942037 - RNA, 12 nt, Shigella flexneri 2a str. 2457T
uauuacugcaac

SEQ ID NO: 1942038 - RNA, 22 nt, Shigella flexneri 2a str. 2457T
uauuacugagauggcuucaucc

SEQ ID NO: 1942039 - RNA, 16 nt, Shigella flexneri 2a str. 2457T
uauuacgaauauaaau

SEQ ID NO: 1942040 - RNA, 22 nt, Shigella flexneri 2a str. 2457T
uauuacgagucacaaacaucau

SEQ ID NO: 1942041 - RNA, 15 nt, Shigella flexneri 2a str. 2457T
uauuacguuccuuua

SEQ ID NO: 1942042 - RNA, 19 nt, Shigella flexneri 2a str. 2457T
aaauccuucacuuuugcca

SEQ ID NO: 1942043 - RNA, 20 nt, Shigella flexneri 2a str. 2457T
aaauccuucagcaacuuguu

SEQ ID NO: 1942044 - RNA, 17 nt, Shigella flexneri 2a str. 2457T
uauucugggaacuauau

SEQ ID NO: 1942045 - RNA, 17 nt, Shigella flexneri 2a str. 2457T
uauucuggguaguccau

SEQ ID NO: 1942046 - RNA, 18 nt, Shigella flexneri 2a str. 2457T
uauugaauuagcaauauu

SEQ ID NO: 1942047 - RNA, 13 nt, Shigella flexneri 2a str. 2457T
uauugagaucacc

SEQ ID NO: 1942048 - RNA, 21 nt, Shigella flexneri 2a str. 2457T
uauuuaaagugcaaaaauuca

SEQ ID NO: 1942049 - RNA, 13 nt, Shigella flexneri 2a str. 2457T
uauuguagacaac

SEQ ID NO: 1942050 - RNA, 12 nt, Shigella flexneri 2a str. 2457T
uauugcuguacu

SEQ ID NO: 1942051 - RNA, 14 nt, Shigella flexneri 2a str. 2457T
uauugcgcaggcgc

SEQ ID NO: 1942052 - RNA, 19 nt, Shigella flexneri 2a str. 2457T
uauugcggauaaagcugcc

SEQ ID NO: 1942053 - RNA, 18 nt, Shigella flexneri 2a str. 2457T
uauugcgaaguauggaaa

SEQ ID NO: 1942054 - RNA, 16 nt, Shigella flexneri 2a str. 2457T
uauugcgcaaauguuu

SEQ ID NO: 1942055 - RNA, 23 nt, Shigella flexneri 2a str. 2457T
uauuuaaauugcgguuuuuaagg

SEQ ID NO: 1942056 - RNA, 15 nt, Shigella flexneri 2a str. 2457T
uauuuacucuccugc

SEQ ID NO: 1942057 - RNA, 14 nt, Shigella flexneri 2a str. 2457T
uauuucagaccugu

SEQ ID NO: 1942058 - RNA, 15 nt, Shigella flexneri 2a str. 2457T
uauuucauguuugaa

SEQ ID NO: 1942059 - RNA, 22 nt, Shigella flexneri 2a str. 2457T
uauuucacccgcgaccaccagc

SEQ ID NO: 1942060 - RNA, 16 nt, Shigella flexneri 2a str. 2457T
uauuucaauaugauaa

SEQ ID NO: 1942061 - RNA, 17 nt, Shigella flexneri 2a str. 2457T
uauuucaauaugauaaa

SEQ ID NO: 1942062 - RNA, 16 nt, Shigella flexneri 2a str. 2457T
uauuuauuuuucuuga

SEQ ID NO: 1942063 - RNA, 15 nt, Shigella flexneri 2a str. 2457T
uauuuauuaauccag

SEQ ID NO: 1942064 - RNA, 16 nt, Shigella flexneri 2a str. 2457T
uauuuauccauaauuu

SEQ ID NO: 1942065 - RNA, 13 nt, Shigella flexneri 2a str. 2457T
uauuuauuuccuu

SEQ ID NO: 1942066 - RNA, 20 nt, Shigella flexneri 2a str. 2457T
ucaaaaaaugaaacuggaag

SEQ ID NO: 1942067 - RNA, 22 nt, Shigella flexneri 2a str. 2457T
ucaaaaaaugaaacuggaagau

SEQ ID NO: 1942068 - RNA, 20 nt, Shigella flexneri 2a str. 2457T
ucaaaaaacuucuucacacc

SEQ ID NO: 1942069 - RNA, 22 nt, Shigella flexneri 2a str. 2457T
ucaaaaaaggcugacaaaucag

SEQ ID NO: 1942070 - RNA, 19 nt, Shigella flexneri 2a str. 2457T
ucaaaaaaggcugacaaau

SEQ ID NO: 1942071 - RNA, 19 nt, Shigella flexneri 2a str. 2457T
ucaaaaaacuggaaaaaua

SEQ ID NO: 1942072 - RNA, 17 nt, Shigella flexneri 2a str. 2457T
uauuuuuuuaauuguga

SEQ ID NO: 1942073 - RNA, 22 nt, Shigella flexneri 2a str. 2457T
uauuuuuuuucaggaaauaaau

SEQ ID NO: 1942074 - RNA, 18 nt, Shigella flexneri 2a str. 2457T
uauuuuuuugcauggaua

SEQ ID NO: 1942075 - RNA, 18 nt, Shigella flexneri 2a str. 2457T
uauuuuuuuccuaaaccc

SEQ ID NO: 1942076 - RNA, 19 nt, Shigella flexneri 2a str. 2457T
uauuuuuaucccucauauu

SEQ ID NO: 1942077 - RNA, 21 nt, Shigella flexneri 2a str. 2457T
uauuuuucacccuucaauccc

SEQ ID NO: 1942078 - RNA, 16 nt, Shigella flexneri 2a str. 2457T
ucaaaguuuuuaugag

SEQ ID NO: 1942079 - RNA, 22 nt, Shigella flexneri 2a str. 2457T
ucaaauaaaaagguccuguaau

SEQ ID NO: 1942080 - RNA, 14 nt, Shigella flexneri 2a str. 2457T
ucaaauaaaaauac

SEQ ID NO: 1942081 - RNA, 19 nt, Shigella flexneri 2a str. 2457T
ucaaaggccuugaacaaac

SEQ ID NO: 1942082 - RNA, 20 nt, Shigella flexneri 2a str. 2457T
ucaaaggccuugaacaaaca

SEQ ID NO: 1942083 - RNA, 20 nt, Shigella flexneri 2a str. 2457T
ucaaaggcauuaaacgcaua

SEQ ID NO: 1942084 - RNA, 16 nt, Shigella flexneri 2a str. 2457T
ucaaagacguuaaaaa

SEQ ID NO: 1942085 - RNA, 17 nt, Shigella flexneri 2a str. 2457T
ucaaagaugaugucaca

SEQ ID NO: 1942086 - RNA, 20 nt, Shigella flexneri 2a str. 2457T
ucaaagaugaugucacagcc

SEQ ID NO: 1942087 - RNA, 14 nt, Shigella flexneri 2a str. 2457T
ucaaaguaaucaag

SEQ ID NO: 1942088 - RNA, 20 nt, Shigella flexneri 2a str. 2457T
ucaaagaguuauuucauaaa

SEQ ID NO: 1942089 - RNA, 18 nt, Shigella flexneri 2a str. 2457T
ucaaaguguugcaggaaa

SEQ ID NO: 1942090 - RNA, 18 nt, Shigella flexneri 2a str. 2457T
ucaaagucuccuuugcca

SEQ ID NO: 1942091 - RNA, 20 nt, Shigella flexneri 2a str. 2457T
ucaaaauaucgacauucaau

SEQ ID NO: 1942092 - RNA, 19 nt, Shigella flexneri 2a str. 2457T
ucaaaauaucgacauucaa

SEQ ID NO: 1942093 - RNA, 20 nt, Shigella flexneri 2a str. 2457T
ucaaaccguaguccauaccc

SEQ ID NO: 1942094 - RNA, 19 nt, Shigella flexneri 2a str. 2457T
ucaaacggcauaugccaug

SEQ ID NO: 1942095 - RNA, 16 nt, Shigella flexneri 2a str. 2457T
ucaaacgguugauaaa

SEQ ID NO: 1942096 - RNA, 16 nt, Shigella flexneri 2a str. 2457T
ucaaacgaaucugcaa

SEQ ID NO: 1942097 - RNA, 21 nt, Shigella flexneri 2a str. 2457T
ucaaacgaaucugcaaucaaa

SEQ ID NO: 1942098 - RNA, 18 nt, Shigella flexneri 2a str. 2457T
ucaaacgccgaugaccua

SEQ ID NO: 1942099 - RNA, 21 nt, Shigella flexneri 2a str. 2457T
ucaaacgauuuuuuuaauaau

SEQ ID NO: 1942100 - RNA, 17 nt, Shigella flexneri 2a str. 2457T
ucaaacgcacgucugau

SEQ ID NO: 1942101 - RNA, 17 nt, Shigella flexneri 2a str. 2457T
ucaaacgguugauaaau

SEQ ID NO: 1942102 - RNA, 12 nt, Shigella flexneri 2a str. 2457T
uauuuucugaaa

SEQ ID NO: 1942103 - RNA, 13 nt, Shigella flexneri 2a str. 2457T
uauuuucugaaac

SEQ ID NO: 1942104 - RNA, 17 nt, Shigella flexneri 2a str. 2457T
uauuuugcuuccggcaa

SEQ ID NO: 1942105 - RNA, 15 nt, Shigella flexneri 2a str. 2457T
uauuuugcuuuaagu

SEQ ID NO: 1942106 - RNA, 17 nt, Shigella flexneri 2a str. 2457T
uauuuuacauccggcaa

SEQ ID NO: 1942107 - RNA, 20 nt, Shigella flexneri 2a str. 2457T
uauuuguaguuugauaauuu

SEQ ID NO: 1942108 - RNA, 17 nt, Shigella flexneri 2a str. 2457T
uauuucgcgauucugau

SEQ ID NO: 1942109 - RNA, 15 nt, Shigella flexneri 2a str. 2457T
uauuuccggcgacgu

SEQ ID NO: 1942110 - RNA, 17 nt, Shigella flexneri 2a str. 2457T
uauuuccagggccucuc

SEQ ID NO: 1942111 - RNA, 15 nt, Shigella flexneri 2a str. 2457T
uauuuccagcucaac

SEQ ID NO: 1942112 - RNA, 15 nt, Shigella flexneri 2a str. 2457T
uauuucuuuaucacc

SEQ ID NO: 1942113 - RNA, 20 nt, Shigella flexneri 2a str. 2457T
uauuugcccaccugcggcac

SEQ ID NO: 1942114 - RNA, 22 nt, Shigella flexneri 2a str. 2457T
uauuugccgugcguguucggua

SEQ ID NO: 1942115 - RNA, 19 nt, Shigella flexneri 2a str. 2457T
uauuugcgucagcucacaa

SEQ ID NO: 1942116 - RNA, 21 nt, Shigella flexneri 2a str. 2457T
uauuugccuaauaaaucuaaa

SEQ ID NO: 1942117 - RNA, 22 nt, Shigella flexneri 2a str. 2457T
uauuugacccgcaguaaaucag

SEQ ID NO: 1942118 - RNA, 14 nt, Shigella flexneri 2a str. 2457T
uauuugaguguauu

SEQ ID NO: 1942119 - RNA, 18 nt, Shigella flexneri 2a str. 2457T
uauuugaguucacugccg

SEQ ID NO: 1942120 - RNA, 15 nt, Shigella flexneri 2a str. 2457T
uauuugacuguucua

SEQ ID NO: 1942121 - RNA, 14 nt, Shigella flexneri 2a str. 2457T
uauuucuuuuacau

SEQ ID NO: 1942122 - RNA, 12 nt, Shigella flexneri 2a str. 2457T
uacacccagccc

SEQ ID NO: 1942123 - RNA, 20 nt, Shigella flexneri 2a str. 2457T
uacaccgcagccgccacaau

SEQ ID NO: 1942124 - RNA, 20 nt, Shigella flexneri 2a str. 2457T
uacacucuuucaauauugca

SEQ ID NO: 1942125 - RNA, 18 nt, Shigella flexneri 2a str. 2457T
uacacuaaacgucucacu

SEQ ID NO: 1942126 - RNA, 16 nt, Shigella flexneri 2a str. 2457T
uacagacagauaaaau

SEQ ID NO: 1942127 - RNA, 17 nt, Shigella flexneri 2a str. 2457T
uacagacucaaaccaau

SEQ ID NO: 1942128 - RNA, 21 nt, Shigella flexneri 2a str. 2457T
uacagacucaaaccaauggca

SEQ ID NO: 1942129 - RNA, 21 nt, Shigella flexneri 2a str. 2457T
uacacuucacacacuuuuauu

SEQ ID NO: 1942130 - RNA, 17 nt, Shigella flexneri 2a str. 2457T
uacacuucacacacuuu

SEQ ID NO: 1942131 - RNA, 20 nt, Shigella flexneri 2a str. 2457T
uacacuucacacacuuuuau

SEQ ID NO: 1942132 - RNA, 16 nt, Shigella flexneri 2a str. 2457T
uacagaaaugaaaaaa

SEQ ID NO: 1942133 - RNA, 18 nt, Shigella flexneri 2a str. 2457T
uacagaaaugaaaaaaua

SEQ ID NO: 1942134 - RNA, 13 nt, Shigella flexneri 2a str. 2457T
uacagaagcaccg

SEQ ID NO: 1942135 - RNA, 17 nt, Shigella flexneri 2a str. 2457T
uacaaccugcuggaaag

SEQ ID NO: 1942136 - RNA, 20 nt, Shigella flexneri 2a str. 2457T
uacaacgccguuuaauauua

SEQ ID NO: 1942137 - RNA, 16 nt, Shigella flexneri 2a str. 2457T
uacaacguauugaaau

SEQ ID NO: 1942138 - RNA, 14 nt, Shigella flexneri 2a str. 2457T
uacaacgcuuuauc

SEQ ID NO: 1942139 - RNA, 13 nt, Shigella flexneri 2a str. 2457T
uacaacguuaccg

SEQ ID NO: 1942140 - RNA, 13 nt, Shigella flexneri 2a str. 2457T
uaauuuuaaauau

SEQ ID NO: 1942141 - RNA, 22 nt, Shigella flexneri 2a str. 2457T
uaauuuuaaauaucaucaaaau

SEQ ID NO: 1942142 - RNA, 19 nt, Shigella flexneri 2a str. 2457T
uacaaccaccccaccuuac

SEQ ID NO: 1942143 - RNA, 16 nt, Shigella flexneri 2a str. 2457T
uacaaucugcgcugga

SEQ ID NO: 1942144 - RNA, 19 nt, Shigella flexneri 2a str. 2457T
uacaaucaccguuucuggu

SEQ ID NO: 1942145 - RNA, 19 nt, Shigella flexneri 2a str. 2457T
uacaaucacgauagccaga

SEQ ID NO: 1942146 - RNA, 18 nt, Shigella flexneri 2a str. 2457T
uacaaucguuucaugcca

SEQ ID NO: 1942147 - RNA, 23 nt, Shigella flexneri 2a str. 2457T
uacacaagccaggacgcagucca

SEQ ID NO: 1942148 - RNA, 21 nt, Shigella flexneri 2a str. 2457T
uacacaagccaggacgcaguc

SEQ ID NO: 1942149 - RNA, 14 nt, Shigella flexneri 2a str. 2457T
uacacauuaucuca

SEQ ID NO: 1942150 - RNA, 13 nt, Shigella flexneri 2a str. 2457T
uacaguuuuacaa

SEQ ID NO: 1942151 - RNA, 16 nt, Shigella flexneri 2a str. 2457T
uacagcuuagcgccuu

SEQ ID NO: 1942152 - RNA, 22 nt, Shigella flexneri 2a str. 2457T
uacaggauauauuucaucaacu

SEQ ID NO: 1942153 - RNA, 17 nt, Shigella flexneri 2a str. 2457T
uacaggauauauuucau

SEQ ID NO: 1942154 - RNA, 14 nt, Shigella flexneri 2a str. 2457T
uacaggauauauuu

SEQ ID NO: 1942155 - RNA, 23 nt, Shigella flexneri 2a str. 2457T
uacagcgcggaccccacgcucuc

SEQ ID NO: 1942156 - RNA, 13 nt, Shigella flexneri 2a str. 2457T
uacagcuggagua

SEQ ID NO: 1942157 - RNA, 20 nt, Shigella flexneri 2a str. 2457T
uacagcaauggaaaaaguuu

SEQ ID NO: 1942158 - RNA, 16 nt, Shigella flexneri 2a str. 2457T
uacagcagguguuacc

SEQ ID NO: 1942159 - RNA, 19 nt, Shigella flexneri 2a str. 2457T
uacagcaguacgccgagaa

SEQ ID NO: 1942160 - RNA, 13 nt, Shigella flexneri 2a str. 2457T
uacagcauugucu

SEQ ID NO: 1942161 - RNA, 13 nt, Shigella flexneri 2a str. 2457T
uacagaugcugcu

SEQ ID NO: 1942162 - RNA, 20 nt, Shigella flexneri 2a str. 2457T
uacagaucgugcaucuccug

SEQ ID NO: 1942163 - RNA, 17 nt, Shigella flexneri 2a str. 2457T
uacagccggacccacac

SEQ ID NO: 1942164 - RNA, 15 nt, Shigella flexneri 2a str. 2457T
uacagccgguacauu

SEQ ID NO: 1942165 - RNA, 19 nt, Shigella flexneri 2a str. 2457T
uacagcggcagggaaaacu

SEQ ID NO: 1942166 - RNA, 20 nt, Shigella flexneri 2a str. 2457T
uacagcggcagggaaaacuc

SEQ ID NO: 1942167 - RNA, 16 nt, Shigella flexneri 2a str. 2457T
uacagcggccagccau

SEQ ID NO: 1942168 - RNA, 17 nt, Shigella flexneri 2a str. 2457T
uacagccgacaaugcca

SEQ ID NO: 1942169 - RNA, 19 nt, Shigella flexneri 2a str. 2457T
uacagccgacaaugccaca

SEQ ID NO: 1942170 - RNA, 22 nt, Shigella flexneri 2a str. 2457T
uacagccgacaaugccacaaac

SEQ ID NO: 1942171 - RNA, 19 nt, Shigella flexneri 2a str. 2457T
uacagccaugcgaaugcca

SEQ ID NO: 1942172 - RNA, 13 nt, Shigella flexneri 2a str. 2457T
uacagccaaauca

SEQ ID NO: 1942173 - RNA, 17 nt, Shigella flexneri 2a str. 2457T
uacauaaagucuuucuu

SEQ ID NO: 1942174 - RNA, 15 nt, Shigella flexneri 2a str. 2457T
uacauggugcacauu

SEQ ID NO: 1942175 - RNA, 19 nt, Shigella flexneri 2a str. 2457T
uacauuuccaggaaggcca

SEQ ID NO: 1942176 - RNA, 16 nt, Shigella flexneri 2a str. 2457T
uacauuguuuuccaga

SEQ ID NO: 1942177 - RNA, 17 nt, Shigella flexneri 2a str. 2457T
uacauuuuaauaaugag

SEQ ID NO: 1942178 - RNA, 22 nt, Shigella flexneri 2a str. 2457T
uaccaauaaacuucaauauauu

SEQ ID NO: 1942179 - RNA, 20 nt, Shigella flexneri 2a str. 2457T
uaauccgcuguaauugccgc

SEQ ID NO: 1942180 - RNA, 21 nt, Shigella flexneri 2a str. 2457T
uaauccgguuuacccgcuuga

SEQ ID NO: 1942181 - RNA, 15 nt, Shigella flexneri 2a str. 2457T
uaaucgcuucuucuu

SEQ ID NO: 1942182 - RNA, 19 nt, Shigella flexneri 2a str. 2457T
uaaucgccguauaauaucu

SEQ ID NO: 1942183 - RNA, 16 nt, Shigella flexneri 2a str. 2457T
uaaucgcccucgccuu

SEQ ID NO: 1942184 - RNA, 15 nt, Shigella flexneri 2a str. 2457T
uaauccuuucucaau

SEQ ID NO: 1942185 - RNA, 18 nt, Shigella flexneri 2a str. 2457T
uaauccucuuugcuuccu

SEQ ID NO: 1942186 - RNA, 18 nt, Shigella flexneri 2a str. 2457T
uaauccugaguuaagcaa

SEQ ID NO: 1942187 - RNA, 14 nt, Shigella flexneri 2a str. 2457T
uaaucgcuuuauag

SEQ ID NO: 1942188 - RNA, 19 nt, Shigella flexneri 2a str. 2457T
uaaucggggauaagaauau

SEQ ID NO: 1942189 - RNA, 14 nt, Shigella flexneri 2a str. 2457T
uaaucgucaucagc

SEQ ID NO: 1942190 - RNA, 23 nt, Shigella flexneri 2a str. 2457T
uaaucguccgauuaaaaacccug

SEQ ID NO: 1942191 - RNA, 15 nt, Shigella flexneri 2a str. 2457T
uaaucucuacaccaa

SEQ ID NO: 1942192 - RNA, 13 nt, Shigella flexneri 2a str. 2457T
uaaucucgccuua

SEQ ID NO: 1942193 - RNA, 16 nt, Shigella flexneri 2a str. 2457T
uaaucucgccuuauca

SEQ ID NO: 1942194 - RNA, 17 nt, Shigella flexneri 2a str. 2457T
uaaucugaagaaaacca

SEQ ID NO: 1942195 - RNA, 15 nt, Shigella flexneri 2a str. 2457T
uaaucuauauuucug

SEQ ID NO: 1942196 - RNA, 22 nt, Shigella flexneri 2a str. 2457T
uaaucuuccagaucaccgcaga

SEQ ID NO: 1942197 - RNA, 11 nt, Shigella flexneri 2a str. 2457T
uaaugaaucau

SEQ ID NO: 1942198 - RNA, 20 nt, Shigella flexneri 2a str. 2457T
uaaugacaaaauugcuguua

SEQ ID NO: 1942199 - RNA, 23 nt, Shigella flexneri 2a str. 2457T
uaaugaacuccggagaguauuau

SEQ ID NO: 1942200 - RNA, 22 nt, Shigella flexneri 2a str. 2457T
uaaugcuucuaccgucuguaac

SEQ ID NO: 1942201 - RNA, 12 nt, Shigella flexneri 2a str. 2457T
uaaugcuucaca

SEQ ID NO: 1942202 - RNA, 18 nt, Shigella flexneri 2a str. 2457T
uaaugcugugaagauggc

SEQ ID NO: 1942203 - RNA, 18 nt, Shigella flexneri 2a str. 2457T
uaaugcuguuccagacca

SEQ ID NO: 1942204 - RNA, 23 nt, Shigella flexneri 2a str. 2457T
uaaugccgacauaggccagccgc

SEQ ID NO: 1942205 - RNA, 20 nt, Shigella flexneri 2a str. 2457T
uaauggcaccguucuuuauu

SEQ ID NO: 1942206 - RNA, 13 nt, Shigella flexneri 2a str. 2457T
uaauggacgaacu

SEQ ID NO: 1942207 - RNA, 17 nt, Shigella flexneri 2a str. 2457T
uaaugcccgaugaccuu

SEQ ID NO: 1942208 - RNA, 21 nt, Shigella flexneri 2a str. 2457T
uaaugacuccaacuuacugau

SEQ ID NO: 1942209 - RNA, 22 nt, Shigella flexneri 2a str. 2457T
uaaugacuccaacuuacugaua

SEQ ID NO: 1942210 - RNA, 14 nt, Shigella flexneri 2a str. 2457T
uaaugacccacccc

SEQ ID NO: 1942211 - RNA, 16 nt, Shigella flexneri 2a str. 2457T
uaaugagaauaaucac

SEQ ID NO: 1942212 - RNA, 19 nt, Shigella flexneri 2a str. 2457T
uaauggccuuuucgccacc

SEQ ID NO: 1942213 - RNA, 13 nt, Shigella flexneri 2a str. 2457T
uaauggcgcgggu

SEQ ID NO: 1942214 - RNA, 20 nt, Shigella flexneri 2a str. 2457T
uaauuaacaacguuuuucua

SEQ ID NO: 1942215 - RNA, 17 nt, Shigella flexneri 2a str. 2457T
uaauuaggcuaaauaac

SEQ ID NO: 1942216 - RNA, 20 nt, Shigella flexneri 2a str. 2457T
uaauucgcuuuuauaaaggg

SEQ ID NO: 1942217 - RNA, 12 nt, Shigella flexneri 2a str. 2457T
uaauucaggaaa

SEQ ID NO: 1942218 - RNA, 13 nt, Shigella flexneri 2a str. 2457T
uaauuauccugug

SEQ ID NO: 1942219 - RNA, 15 nt, Shigella flexneri 2a str. 2457T
uaauuuagugaccaa

SEQ ID NO: 1942220 - RNA, 18 nt, Shigella flexneri 2a str. 2457T
uaauuuagugaccaauca

SEQ ID NO: 1942221 - RNA, 15 nt, Shigella flexneri 2a str. 2457T
uaauuucauuuugau

SEQ ID NO: 1942222 - RNA, 18 nt, Shigella flexneri 2a str. 2457T
uaauuucuucguucgcug

SEQ ID NO: 1942223 - RNA, 14 nt, Shigella flexneri 2a str. 2457T
uaauugaaggcuua

SEQ ID NO: 1942224 - RNA, 18 nt, Shigella flexneri 2a str. 2457T
uaauugcuuuuuuccaua

SEQ ID NO: 1942225 - RNA, 15 nt, Shigella flexneri 2a str. 2457T
uaauugcuuuuacca

SEQ ID NO: 1942226 - RNA, 23 nt, Shigella flexneri 2a str. 2457T
uaauugcuuuuaccauacuggau

SEQ ID NO: 1942227 - RNA, 16 nt, Shigella flexneri 2a str. 2457T
uaauuggaauacauau

SEQ ID NO: 1942228 - RNA, 22 nt, Shigella flexneri 2a str. 2457T
uaauuggaauacauauauuaca

SEQ ID NO: 1942229 - RNA, 20 nt, Shigella flexneri 2a str. 2457T
uaauuguuaucguuugcauu

SEQ ID NO: 1942230 - RNA, 22 nt, Shigella flexneri 2a str. 2457T
uacuguccauagcgauguauuu

SEQ ID NO: 1942231 - RNA, 20 nt, Shigella flexneri 2a str. 2457T
uacuuaaacaguacgagaga

SEQ ID NO: 1942232 - RNA, 20 nt, Shigella flexneri 2a str. 2457T
uacugguagcaucugcauuc

SEQ ID NO: 1942233 - RNA, 15 nt, Shigella flexneri 2a str. 2457T
uacuggcuuucauuu

SEQ ID NO: 1942234 - RNA, 19 nt, Shigella flexneri 2a str. 2457T
uacuccugguaucuuuaca

SEQ ID NO: 1942235 - RNA, 13 nt, Shigella flexneri 2a str. 2457T
uacuccuuagcaa

SEQ ID NO: 1942236 - RNA, 18 nt, Shigella flexneri 2a str. 2457T
uacucccgcuucagccgu

SEQ ID NO: 1942237 - RNA, 16 nt, Shigella flexneri 2a str. 2457T
uacuucaucugcuuca

SEQ ID NO: 1942238 - RNA, 20 nt, Shigella flexneri 2a str. 2457T
uacuuccccggcagugcuuu

SEQ ID NO: 1942239 - RNA, 17 nt, Shigella flexneri 2a str. 2457T
uacuuccgcuuccagcu

SEQ ID NO: 1942240 - RNA, 16 nt, Shigella flexneri 2a str. 2457T
uacuuccgggaaaacc

SEQ ID NO: 1942241 - RNA, 21 nt, Shigella flexneri 2a str. 2457T
uacuucucaccgguaaaguca

SEQ ID NO: 1942242 - RNA, 12 nt, Shigella flexneri 2a str. 2457T
uacuuuuucgcc

SEQ ID NO: 1942243 - RNA, 14 nt, Shigella flexneri 2a str. 2457T
uacuuuuuccagua

SEQ ID NO: 1942244 - RNA, 16 nt, Shigella flexneri 2a str. 2457T
uacuuuuuucacccac

SEQ ID NO: 1942245 - RNA, 16 nt, Shigella flexneri 2a str. 2457T
uagaaagugacugcug

SEQ ID NO: 1942246 - RNA, 13 nt, Shigella flexneri 2a str. 2457T
uagaaacaaaaaa

SEQ ID NO: 1942247 - RNA, 17 nt, Shigella flexneri 2a str. 2457T
uagacuuuagucaucag

SEQ ID NO: 1942248 - RNA, 16 nt, Shigella flexneri 2a str. 2457T
uagacguucaguuccg

SEQ ID NO: 1942249 - RNA, 12 nt, Shigella flexneri 2a str. 2457T
uagacugcagcg

SEQ ID NO: 1942250 - RNA, 15 nt, Shigella flexneri 2a str. 2457T
uagacgaugaaaaag

SEQ ID NO: 1942251 - RNA, 15 nt, Shigella flexneri 2a str. 2457T
uagaccugauacaua

SEQ ID NO: 1942252 - RNA, 14 nt, Shigella flexneri 2a str. 2457T
uagacaaaaauucu

SEQ ID NO: 1942253 - RNA, 13 nt, Shigella flexneri 2a str. 2457T
uagaauuguaauc

SEQ ID NO: 1942254 - RNA, 16 nt, Shigella flexneri 2a str. 2457T
uagacaucuuuauaug

SEQ ID NO: 1942255 - RNA, 21 nt, Shigella flexneri 2a str. 2457T
uagacaucuuuauaugcaacg

SEQ ID NO: 1942256 - RNA, 23 nt, Shigella flexneri 2a str. 2457T
uagacaugcccggaaguaccaau

SEQ ID NO: 1942257 - RNA, 15 nt, Shigella flexneri 2a str. 2457T
uagacaguucuuccu

SEQ ID NO: 1942258 - RNA, 18 nt, Shigella flexneri 2a str. 2457T
uagacaguucuuccuggc

SEQ ID NO: 1942259 - RNA, 22 nt, Shigella flexneri 2a str. 2457T
uagaacuaaugggccguuagga

SEQ ID NO: 1942260 - RNA, 18 nt, Shigella flexneri 2a str. 2457T
uagaacuauaauugcuuu

SEQ ID NO: 1942261 - RNA, 22 nt, Shigella flexneri 2a str. 2457T
uagaagccauuaaacaccagua

SEQ ID NO: 1942262 - RNA, 21 nt, Shigella flexneri 2a str. 2457T
uagaagaggaacccagugaua

SEQ ID NO: 1942263 - RNA, 23 nt, Shigella flexneri 2a str. 2457T
uagaagccauuaaacaccaguac

SEQ ID NO: 1942264 - RNA, 16 nt, Shigella flexneri 2a str. 2457T
uagaacggcagagaaa

SEQ ID NO: 1942265 - RNA, 17 nt, Shigella flexneri 2a str. 2457T
uagaacguaacaguaca

SEQ ID NO: 1942266 - RNA, 15 nt, Shigella flexneri 2a str. 2457T
uagaacaucucuucc

SEQ ID NO: 1942267 - RNA, 16 nt, Shigella flexneri 2a str. 2457T
uagaaauuauuucuuu

SEQ ID NO: 1942268 - RNA, 14 nt, Shigella flexneri 2a str. 2457T
uagaaauuauuucu

SEQ ID NO: 1942269 - RNA, 15 nt, Shigella flexneri 2a str. 2457T
uagaaauuauuucuu

SEQ ID NO: 1942270 - RNA, 22 nt, Shigella flexneri 2a str. 2457T
uagaaauuccuaugcaacaacu

SEQ ID NO: 1942271 - RNA, 16 nt, Shigella flexneri 2a str. 2457T
uagaauaccugccugu

SEQ ID NO: 1942272 - RNA, 15 nt, Shigella flexneri 2a str. 2457T
uagaauaaggcuuuc

SEQ ID NO: 1942273 - RNA, 17 nt, Shigella flexneri 2a str. 2457T
uagaaugccaaguaaua

SEQ ID NO: 1942274 - RNA, 14 nt, Shigella flexneri 2a str. 2457T
uagaauauuucuau

SEQ ID NO: 1942275 - RNA, 19 nt, Shigella flexneri 2a str. 2457T
uacgguguucacucaucaa

SEQ ID NO: 1942276 - RNA, 13 nt, Shigella flexneri 2a str. 2457T
uacgguggaacau

SEQ ID NO: 1942277 - RNA, 20 nt, Shigella flexneri 2a str. 2457T
uacgguuuucucgccaccgg

SEQ ID NO: 1942278 - RNA, 12 nt, Shigella flexneri 2a str. 2457T
uacgguuauagu

SEQ ID NO: 1942279 - RNA, 18 nt, Shigella flexneri 2a str. 2457T
uacgaaguuuaauucuuu

SEQ ID NO: 1942280 - RNA, 18 nt, Shigella flexneri 2a str. 2457T
uacgaauucuaucaugca

SEQ ID NO: 1942281 - RNA, 18 nt, Shigella flexneri 2a str. 2457T
uacgauacagaagcaccg

SEQ ID NO: 1942282 - RNA, 20 nt, Shigella flexneri 2a str. 2457T
uacgauaaugccguuuggca

SEQ ID NO: 1942283 - RNA, 19 nt, Shigella flexneri 2a str. 2457T
uacgaauucuaucaugcaa

SEQ ID NO: 1942284 - RNA, 22 nt, Shigella flexneri 2a str. 2457T
uacgauccaccaccgcaaaaua

SEQ ID NO: 1942285 - RNA, 18 nt, Shigella flexneri 2a str. 2457T
uacgauagaauauuucua

SEQ ID NO: 1942286 - RNA, 19 nt, Shigella flexneri 2a str. 2457T
uacgauuaacguaaggcgc

SEQ ID NO: 1942287 - RNA, 20 nt, Shigella flexneri 2a str. 2457T
uacgcugaaaguucaugauu

SEQ ID NO: 1942288 - RNA, 13 nt, Shigella flexneri 2a str. 2457T
uacgcuuaucagg

SEQ ID NO: 1942289 - RNA, 12 nt, Shigella flexneri 2a str. 2457T
uacgcuuuucuu

SEQ ID NO: 1942290 - RNA, 12 nt, Shigella flexneri 2a str. 2457T
uacguucuuaca

SEQ ID NO: 1942291 - RNA, 18 nt, Shigella flexneri 2a str. 2457T
uacguuucgccugcaaau

SEQ ID NO: 1942292 - RNA, 12 nt, Shigella flexneri 2a str. 2457T
uacuaaaaagcg

SEQ ID NO: 1942293 - RNA, 16 nt, Shigella flexneri 2a str. 2457T
uacuccaacccggcag

SEQ ID NO: 1942294 - RNA, 17 nt, Shigella flexneri 2a str. 2457T
uacuccccuuucuuauu

SEQ ID NO: 1942295 - RNA, 18 nt, Shigella flexneri 2a str. 2457T
uacucagcgccugcugca

SEQ ID NO: 1942296 - RNA, 14 nt, Shigella flexneri 2a str. 2457T
uaccuucaucccuu

SEQ ID NO: 1942297 - RNA, 23 nt, Shigella flexneri 2a str. 2457T
uaccuuccggcguaccuuugccu

SEQ ID NO: 1942298 - RNA, 13 nt, Shigella flexneri 2a str. 2457T
uaccuucauuugc

SEQ ID NO: 1942299 - RNA, 14 nt, Shigella flexneri 2a str. 2457T
uaccuuccuccggc

SEQ ID NO: 1942300 - RNA, 22 nt, Shigella flexneri 2a str. 2457T
uaccuucgccgcccagccagcc

SEQ ID NO: 1942301 - RNA, 22 nt, Shigella flexneri 2a str. 2457T
uaccuugcuuauccucuguaaa

SEQ ID NO: 1942302 - RNA, 12 nt, Shigella flexneri 2a str. 2457T
uaccuucuuccu

SEQ ID NO: 1942303 - RNA, 15 nt, Shigella flexneri 2a str. 2457T
uaccuccuucacagu

SEQ ID NO: 1942304 - RNA, 15 nt, Shigella flexneri 2a str. 2457T
uaccugacagcagag

SEQ ID NO: 1942305 - RNA, 15 nt, Shigella flexneri 2a str. 2457T
uaccucuuuuuucaa

SEQ ID NO: 1942306 - RNA, 14 nt, Shigella flexneri 2a str. 2457T
uaccugacagcaga

SEQ ID NO: 1942307 - RNA, 11 nt, Shigella flexneri 2a str. 2457T
uaccugccugu

SEQ ID NO: 1942308 - RNA, 12 nt, Shigella flexneri 2a str. 2457T
uaccugaugaga

SEQ ID NO: 1942309 - RNA, 22 nt, Shigella flexneri 2a str. 2457T
uaccugagucaucaacucaguu

SEQ ID NO: 1942310 - RNA, 23 nt, Shigella flexneri 2a str. 2457T
uaccugaggcgcuacgcuaucag

SEQ ID NO: 1942311 - RNA, 20 nt, Shigella flexneri 2a str. 2457T
uaccuguauaaacuauccug

SEQ ID NO: 1942312 - RNA, 23 nt, Shigella flexneri 2a str. 2457T
uaccuguauaaacuauccugugc

SEQ ID NO: 1942313 - RNA, 19 nt, Shigella flexneri 2a str. 2457T
uaccuuaacgguaucuuuc

SEQ ID NO: 1942314 - RNA, 20 nt, Shigella flexneri 2a str. 2457T
uaccuuaucaaucucagcaa

SEQ ID NO: 1942315 - RNA, 22 nt, Shigella flexneri 2a str. 2457T
uaccuuaucaaucucagcaaga

SEQ ID NO: 1942316 - RNA, 14 nt, Shigella flexneri 2a str. 2457T
uaccucauggagau

SEQ ID NO: 1942317 - RNA, 20 nt, Shigella flexneri 2a str. 2457T
uaccgggccugaacaagcaa

SEQ ID NO: 1942318 - RNA, 20 nt, Shigella flexneri 2a str. 2457T
uaccgggcuguucacugugc

SEQ ID NO: 1942319 - RNA, 14 nt, Shigella flexneri 2a str. 2457T
uaccgggcguccug

SEQ ID NO: 1942320 - RNA, 14 nt, Shigella flexneri 2a str. 2457T
uaccggggacaggc

SEQ ID NO: 1942321 - RNA, 19 nt, Shigella flexneri 2a str. 2457T
uaccacguugacaaacugc

SEQ ID NO: 1942322 - RNA, 13 nt, Shigella flexneri 2a str. 2457T
uaccacuucaucc

SEQ ID NO: 1942323 - RNA, 19 nt, Shigella flexneri 2a str. 2457T
uaccacuuccagcagacca

SEQ ID NO: 1942324 - RNA, 23 nt, Shigella flexneri 2a str. 2457T
uaccgcccgcgcgguaucaccac

SEQ ID NO: 1942325 - RNA, 13 nt, Shigella flexneri 2a str. 2457T
uaccgccgcacaa

SEQ ID NO: 1942326 - RNA, 21 nt, Shigella flexneri 2a str. 2457T
uaccgccaucaauugcucacu

SEQ ID NO: 1942327 - RNA, 16 nt, Shigella flexneri 2a str. 2457T
uaccgccucgcggcag

SEQ ID NO: 1942328 - RNA, 21 nt, Shigella flexneri 2a str. 2457T
uaccgccgccaugcuugaagg

SEQ ID NO: 1942329 - RNA, 19 nt, Shigella flexneri 2a str. 2457T
uaccacggaaaggcaacau

SEQ ID NO: 1942330 - RNA, 20 nt, Shigella flexneri 2a str. 2457T
uaccacgguacgccagagug

SEQ ID NO: 1942331 - RNA, 18 nt, Shigella flexneri 2a str. 2457T
uaccacggcauuuccgcc

SEQ ID NO: 1942332 - RNA, 21 nt, Shigella flexneri 2a str. 2457T
uaccaccuuacuuacacauca

SEQ ID NO: 1942333 - RNA, 13 nt, Shigella flexneri 2a str. 2457T
uagauaagcaagg

SEQ ID NO: 1942334 - RNA, 15 nt, Shigella flexneri 2a str. 2457T
uagaguuugaacuca

SEQ ID NO: 1942335 - RNA, 15 nt, Shigella flexneri 2a str. 2457T
uagauaaaacacucu

SEQ ID NO: 1942336 - RNA, 15 nt, Shigella flexneri 2a str. 2457T
uagagcaaccaccug

SEQ ID NO: 1942337 - RNA, 21 nt, Shigella flexneri 2a str. 2457T
uagagaucucucuugcuauca

SEQ ID NO: 1942338 - RNA, 19 nt, Shigella flexneri 2a str. 2457T
uagagcacaucacucauaa

SEQ ID NO: 1942339 - RNA, 21 nt, Shigella flexneri 2a str. 2457T
uagagcacaucacucauaaug

SEQ ID NO: 1942340 - RNA, 17 nt, Shigella flexneri 2a str. 2457T
uagagguuauaaauaaa

SEQ ID NO: 1942341 - RNA, 19 nt, Shigella flexneri 2a str. 2457T
uagagcuugugcaccagcu

SEQ ID NO: 1942342 - RNA, 18 nt, Shigella flexneri 2a str. 2457T
uagaggcguuccugcaac

SEQ ID NO: 1942343 - RNA, 22 nt, Shigella flexneri 2a str. 2457T
uagaugugggcaaucucacucc

SEQ ID NO: 1942344 - RNA, 21 nt, Shigella flexneri 2a str. 2457T
uagauuaauuucccaccacua

SEQ ID NO: 1942345 - RNA, 21 nt, Shigella flexneri 2a str. 2457T
uagaugaucgccgcacuuucu

SEQ ID NO: 1942346 - RNA, 19 nt, Shigella flexneri 2a str. 2457T
uagaugugcaguuccugca

SEQ ID NO: 1942347 - RNA, 19 nt, Shigella flexneri 2a str. 2457T
uagaugugggcaaucucac

SEQ ID NO: 1942348 - RNA, 14 nt, Shigella flexneri 2a str. 2457T
uagauauucuccag

SEQ ID NO: 1942349 - RNA, 15 nt, Shigella flexneri 2a str. 2457T
uagaucuaaaugcca

SEQ ID NO: 1942350 - RNA, 12 nt, Shigella flexneri 2a str. 2457T
uagauccaggaa

SEQ ID NO: 1942351 - RNA, 14 nt, Shigella flexneri 2a str. 2457T
uagcacgucaucug

SEQ ID NO: 1942352 - RNA, 19 nt, Shigella flexneri 2a str. 2457T
uagcacuguaaaccucuuu

SEQ ID NO: 1942353 - RNA, 21 nt, Shigella flexneri 2a str. 2457T
uagcacuguaaaccucuuucg

SEQ ID NO: 1942354 - RNA, 18 nt, Shigella flexneri 2a str. 2457T
uagcacgacguuucuuuc

SEQ ID NO: 1942355 - RNA, 17 nt, Shigella flexneri 2a str. 2457T
uagcaaugccuucugga

SEQ ID NO: 1942356 - RNA, 18 nt, Shigella flexneri 2a str. 2457T
uagcaauauuuuuaugcc

SEQ ID NO: 1942357 - RNA, 21 nt, Shigella flexneri 2a str. 2457T
uagcaauauuuuuaugccgga

SEQ ID NO: 1942358 - RNA, 15 nt, Shigella flexneri 2a str. 2457T
uagcaacugauuuau

SEQ ID NO: 1942359 - RNA, 20 nt, Shigella flexneri 2a str. 2457T
uagcaaacuaucuguguaau

SEQ ID NO: 1942360 - RNA, 13 nt, Shigella flexneri 2a str. 2457T
uagcaaaacaauu

SEQ ID NO: 1942361 - RNA, 12 nt, Shigella flexneri 2a str. 2457T
uagcaaaacaau

SEQ ID NO: 1942362 - RNA, 15 nt, Shigella flexneri 2a str. 2457T
uagcaacagcagcca

SEQ ID NO: 1942363 - RNA, 19 nt, Shigella flexneri 2a str. 2457T
uagcaaccaaaaaaagaau

SEQ ID NO: 1942364 - RNA, 20 nt, Shigella flexneri 2a str. 2457T
uagcaaaguaauaaugauca

SEQ ID NO: 1942365 - RNA, 23 nt, Shigella flexneri 2a str. 2457T
uagauuuacuauuauuuuucaua

SEQ ID NO: 1942366 - RNA, 17 nt, Shigella flexneri 2a str. 2457T
uagauuuacgcucuucc

SEQ ID NO: 1942367 - RNA, 17 nt, Shigella flexneri 2a str. 2457T
uagauuugguggggcuu

SEQ ID NO: 1942368 - RNA, 20 nt, Shigella flexneri 2a str. 2457T
uagauuuugcagaucgccaa

SEQ ID NO: 1942369 - RNA, 20 nt, Shigella flexneri 2a str. 2457T
uagcaguaauugcagcagcu

SEQ ID NO: 1942370 - RNA, 14 nt, Shigella flexneri 2a str. 2457T
uagcacugcuuucc

SEQ ID NO: 1942371 - RNA, 19 nt, Shigella flexneri 2a str. 2457T
uagcacuuuucgucaggau

SEQ ID NO: 1942372 - RNA, 15 nt, Shigella flexneri 2a str. 2457T
uagcagcuccgccag

SEQ ID NO: 1942373 - RNA, 12 nt, Shigella flexneri 2a str. 2457T
uagcaucccaau

SEQ ID NO: 1942374 - RNA, 23 nt, Shigella flexneri 2a str. 2457T
uagcauccccauaucccggaagg

SEQ ID NO: 1942375 - RNA, 16 nt, Shigella flexneri 2a str. 2457T
uagcaucgcgauggca

SEQ ID NO: 1942376 - RNA, 12 nt, Shigella flexneri 2a str. 2457T
uagcauuaagua

SEQ ID NO: 1942377 - RNA, 21 nt, Shigella flexneri 2a str. 2457T
uagcauugaugcguuagauga

SEQ ID NO: 1942378 - RNA, 22 nt, Shigella flexneri 2a str. 2457T
uagccaaagcaccacuccucaa

SEQ ID NO: 1942379 - RNA, 16 nt, Shigella flexneri 2a str. 2457T
uagccaauaaaugcca

SEQ ID NO: 1942380 - RNA, 11 nt, Shigella flexneri 2a str. 2457T
uagccaauucc

SEQ ID NO: 1942381 - RNA, 21 nt, Shigella flexneri 2a str. 2457T
uaggagguuuccgggucggca

SEQ ID NO: 1942382 - RNA, 16 nt, Shigella flexneri 2a str. 2457T
uaggacgaaaaaucaa

SEQ ID NO: 1942383 - RNA, 17 nt, Shigella flexneri 2a str. 2457T
uaggacgaaaaaucaau

SEQ ID NO: 1942384 - RNA, 15 nt, Shigella flexneri 2a str. 2457T
uaggacgaaaaauca

SEQ ID NO: 1942385 - RNA, 21 nt, Shigella flexneri 2a str. 2457T
uaggacagcguugccagcucg

SEQ ID NO: 1942386 - RNA, 14 nt, Shigella flexneri 2a str. 2457T
uaggcaagccacaa

SEQ ID NO: 1942387 - RNA, 20 nt, Shigella flexneri 2a str. 2457T
uaggaauccgggucuguaaa

SEQ ID NO: 1942388 - RNA, 13 nt, Shigella flexneri 2a str. 2457T
uagcuuuggugcc

SEQ ID NO: 1942389 - RNA, 13 nt, Shigella flexneri 2a str. 2457T
uagcuuggcagag

SEQ ID NO: 1942390 - RNA, 18 nt, Shigella flexneri 2a str. 2457T
uagcucgcuucaucugcc

SEQ ID NO: 1942391 - RNA, 20 nt, Shigella flexneri 2a str. 2457T
uagcugauuccauuauucaa

SEQ ID NO: 1942392 - RNA, 21 nt, Shigella flexneri 2a str. 2457T
uagcuggcuucgguuuuuauu

SEQ ID NO: 1942393 - RNA, 21 nt, Shigella flexneri 2a str. 2457T
uagcuucaaauagugccuggc

SEQ ID NO: 1942394 - RNA, 23 nt, Shigella flexneri 2a str. 2457T
uagcuucaccgcaucgucacuga

SEQ ID NO: 1942395 - RNA, 19 nt, Shigella flexneri 2a str. 2457T
uagcuuaccggucuggguu

SEQ ID NO: 1942396 - RNA, 19 nt, Shigella flexneri 2a str. 2457T
uagcuaauuuuuguuguuu

SEQ ID NO: 1942397 - RNA, 19 nt, Shigella flexneri 2a str. 2457T
uagcucaaaguaaucaagc

SEQ ID NO: 1942398 - RNA, 17 nt, Shigella flexneri 2a str. 2457T
uagcguuaauggcagau

SEQ ID NO: 1942399 - RNA, 14 nt, Shigella flexneri 2a str. 2457T
uagcguuaccagca

SEQ ID NO: 1942400 - RNA, 16 nt, Shigella flexneri 2a str. 2457T
uagccgaucaggcuuu

SEQ ID NO: 1942401 - RNA, 22 nt, Shigella flexneri 2a str. 2457T
uagccgaccgcaaggaagccug

SEQ ID NO: 1942402 - RNA, 23 nt, Shigella flexneri 2a str. 2457T
uagccgccagcucuuuaaacacg

SEQ ID NO: 1942403 - RNA, 17 nt, Shigella flexneri 2a str. 2457T
uagccgaugccgcugca

SEQ ID NO: 1942404 - RNA, 18 nt, Shigella flexneri 2a str. 2457T
uagccgcagccaucagcg

SEQ ID NO: 1942405 - RNA, 17 nt, Shigella flexneri 2a str. 2457T
uagccgcggaucacgcg

SEQ ID NO: 1942406 - RNA, 15 nt, Shigella flexneri 2a str. 2457T
uagccgcuucugcag

SEQ ID NO: 1942407 - RNA, 16 nt, Shigella flexneri 2a str. 2457T
uagccucccugccucc

SEQ ID NO: 1942408 - RNA, 16 nt, Shigella flexneri 2a str. 2457T
uagccacauugcugca

SEQ ID NO: 1942409 - RNA, 12 nt, Shigella flexneri 2a str. 2457T
uagccagcagag

SEQ ID NO: 1942410 - RNA, 13 nt, Shigella flexneri 2a str. 2457T
uagccagcagagc

SEQ ID NO: 1942411 - RNA, 15 nt, Shigella flexneri 2a str. 2457T
uagcccaccuacacc

SEQ ID NO: 1942412 - RNA, 12 nt, Shigella flexneri 2a str. 2457T
uagccccagucu

SEQ ID NO: 1942413 - RNA, 16 nt, Shigella flexneri 2a str. 2457T
uagccauuugauucac

SEQ ID NO: 1942414 - RNA, 13 nt, Shigella flexneri 2a str. 2457T
uagccccaauguu

SEQ ID NO: 1942415 - RNA, 19 nt, Shigella flexneri 2a str. 2457T
uagcgaccauacagcagca

SEQ ID NO: 1942416 - RNA, 14 nt, Shigella flexneri 2a str. 2457T
uagcgaauuuuucg

SEQ ID NO: 1942417 - RNA, 21 nt, Shigella flexneri 2a str. 2457T
uagcgaauuuuucgagggugc

SEQ ID NO: 1942418 - RNA, 19 nt, Shigella flexneri 2a str. 2457T
uagcgaauaaaguagaaau

SEQ ID NO: 1942419 - RNA, 19 nt, Shigella flexneri 2a str. 2457T
uagccuucaucagaugaag

SEQ ID NO: 1942420 - RNA, 18 nt, Shigella flexneri 2a str. 2457T
uagccugccagaggagcc

SEQ ID NO: 1942421 - RNA, 11 nt, Shigella flexneri 2a str. 2457T
uagccugccag

SEQ ID NO: 1942422 - RNA, 13 nt, Shigella flexneri 2a str. 2457T
uagcgcaucacuu

SEQ ID NO: 1942423 - RNA, 16 nt, Shigella flexneri 2a str. 2457T
uagcgcaucacuucca

SEQ ID NO: 1942424 - RNA, 19 nt, Shigella flexneri 2a str. 2457T
uagcgcaugaccagugagg

SEQ ID NO: 1942425 - RNA, 23 nt, Shigella flexneri 2a str. 2457T
uagcgaugacagucuggaagcca

SEQ ID NO: 1942426 - RNA, 12 nt, Shigella flexneri 2a str. 2457T
uagcgccugcug

SEQ ID NO: 1942427 - RNA, 22 nt, Shigella flexneri 2a str. 2457T
uagcgucaacuuuagcgaugug

SEQ ID NO: 1942428 - RNA, 16 nt, Shigella flexneri 2a str. 2457T
uauacagacucaaacc

SEQ ID NO: 1942429 - RNA, 22 nt, Shigella flexneri 2a str. 2457T
uauacaggcggguaaucuuucc

SEQ ID NO: 1942430 - RNA, 17 nt, Shigella flexneri 2a str. 2457T
uauacaucgcuuuccag

SEQ ID NO: 1942431 - RNA, 18 nt, Shigella flexneri 2a str. 2457T
uauacaucgcuuuccagg

SEQ ID NO: 1942432 - RNA, 20 nt, Shigella flexneri 2a str. 2457T
uauaccauggaagaaaaaua

SEQ ID NO: 1942433 - RNA, 18 nt, Shigella flexneri 2a str. 2457T
uauacccuucucagcagu

SEQ ID NO: 1942434 - RNA, 22 nt, Shigella flexneri 2a str. 2457T
uauacgcgccacaucagacuca

SEQ ID NO: 1942435 - RNA, 14 nt, Shigella flexneri 2a str. 2457T
uauacucagucagg

SEQ ID NO: 1942436 - RNA, 14 nt, Shigella flexneri 2a str. 2457T
uauacuccugaugg

SEQ ID NO: 1942437 - RNA, 16 nt, Shigella flexneri 2a str. 2457T
uauacuccugaugguc

SEQ ID NO: 1942438 - RNA, 21 nt, Shigella flexneri 2a str. 2457T
uauagaagccauccagcagac

SEQ ID NO: 1942439 - RNA, 16 nt, Shigella flexneri 2a str. 2457T
uauagcgggaaauacu

SEQ ID NO: 1942440 - RNA, 20 nt, Shigella flexneri 2a str. 2457T
uauagcgcugaauuaguguu

SEQ ID NO: 1942441 - RNA, 14 nt, Shigella flexneri 2a str. 2457T
uauagauuuacuau

SEQ ID NO: 1942442 - RNA, 19 nt, Shigella flexneri 2a str. 2457T
uauagauuuacuauuauuu

SEQ ID NO: 1942443 - RNA, 15 nt, Shigella flexneri 2a str. 2457T
uauagcacccgccag

SEQ ID NO: 1942444 - RNA, 21 nt, Shigella flexneri 2a str. 2457T
uauagccagccucauccauac

SEQ ID NO: 1942445 - RNA, 15 nt, Shigella flexneri 2a str. 2457T
uauagagauuuuucc

SEQ ID NO: 1942446 - RNA, 15 nt, Shigella flexneri 2a str. 2457T
uauagaaugccugug

SEQ ID NO: 1942447 - RNA, 22 nt, Shigella flexneri 2a str. 2457T
uauagaaugccugugcgacaga

SEQ ID NO: 1942448 - RNA, 15 nt, Shigella flexneri 2a str. 2457T
uauauaauaugcauu

SEQ ID NO: 1942449 - RNA, 18 nt, Shigella flexneri 2a str. 2457T
uauauaauuaaaaauagu

SEQ ID NO: 1942450 - RNA, 16 nt, Shigella flexneri 2a str. 2457T
uauagucaauaagucc

SEQ ID NO: 1942451 - RNA, 21 nt, Shigella flexneri 2a str. 2457T
uauaguaucguuaaauucuaa

SEQ ID NO: 1942452 - RNA, 16 nt, Shigella flexneri 2a str. 2457T
uauagcuggauuuuca

SEQ ID NO: 1942453 - RNA, 17 nt, Shigella flexneri 2a str. 2457T
uauagcuggauuuucau

SEQ ID NO: 1942454 - RNA, 21 nt, Shigella flexneri 2a str. 2457T
uauagugugcaaucacuuccu

SEQ ID NO: 1942455 - RNA, 13 nt, Shigella flexneri 2a str. 2457T
uauauaauuaaaa

SEQ ID NO: 1942456 - RNA, 18 nt, Shigella flexneri 2a str. 2457T
uauauaacggaacauuag

SEQ ID NO: 1942457 - RNA, 13 nt, Shigella flexneri 2a str. 2457T
uauaucagugaua

SEQ ID NO: 1942458 - RNA, 20 nt, Shigella flexneri 2a str. 2457T
uauauuuuuaaauauaaaac

SEQ ID NO: 1942459 - RNA, 13 nt, Shigella flexneri 2a str. 2457T
uauauucucuuuu

SEQ ID NO: 1942460 - RNA, 12 nt, Shigella flexneri 2a str. 2457T
uaucaaacguga

SEQ ID NO: 1942461 - RNA, 17 nt, Shigella flexneri 2a str. 2457T
uaucaaucuucucuucc

SEQ ID NO: 1942462 - RNA, 18 nt, Shigella flexneri 2a str. 2457T
uaucaaucucagcaagag

SEQ ID NO: 1942463 - RNA, 19 nt, Shigella flexneri 2a str. 2457T
uaucacgaugcuaaaaaca

SEQ ID NO: 1942464 - RNA, 20 nt, Shigella flexneri 2a str. 2457T
uaucacgaugcuaaaaacau

SEQ ID NO: 1942465 - RNA, 22 nt, Shigella flexneri 2a str. 2457T
uaucacgaugcuaaaaacauca

SEQ ID NO: 1942466 - RNA, 20 nt, Shigella flexneri 2a str. 2457T
uaucaguuggggaaaaguug

SEQ ID NO: 1942467 - RNA, 23 nt, Shigella flexneri 2a str. 2457T
uaucaguuucagccuuaaagaua

SEQ ID NO: 1942468 - RNA, 14 nt, Shigella flexneri 2a str. 2457T
uaucaguucagaag

SEQ ID NO: 1942469 - RNA, 22 nt, Shigella flexneri 2a str. 2457T
uaucaguucagaagcugaagca

SEQ ID NO: 1942470 - RNA, 15 nt, Shigella flexneri 2a str. 2457T
uaucaucauuugcau

SEQ ID NO: 1942471 - RNA, 20 nt, Shigella flexneri 2a str. 2457T
uaucaggccaauugaacucu

SEQ ID NO: 1942472 - RNA, 20 nt, Shigella flexneri 2a str. 2457T
uaucagggagucuugcugga

SEQ ID NO: 1942473 - RNA, 22 nt, Shigella flexneri 2a str. 2457T
uaucaggccuacauuuucuccg

SEQ ID NO: 1942474 - RNA, 17 nt, Shigella flexneri 2a str. 2457T
uaucaggccuacaaugu

SEQ ID NO: 1942475 - RNA, 15 nt, Shigella flexneri 2a str. 2457T
uaucauuuugcugcc

SEQ ID NO: 1942476 - RNA, 14 nt, Shigella flexneri 2a str. 2457T
uaucauuucuggaa

SEQ ID NO: 1942477 - RNA, 13 nt, Shigella flexneri 2a str. 2457T
uauccauauggcu

SEQ ID NO: 1942478 - RNA, 15 nt, Shigella flexneri 2a str. 2457T
uauccaguuucugcc

SEQ ID NO: 1942479 - RNA, 13 nt, Shigella flexneri 2a str. 2457T
uauccaguuucug

SEQ ID NO: 1942480 - RNA, 22 nt, Shigella flexneri 2a str. 2457T
uauccaccgcguucagcagcuc

SEQ ID NO: 1942481 - RNA, 20 nt, Shigella flexneri 2a str. 2457T
uaguuuguugaaguuuauac

SEQ ID NO: 1942482 - RNA, 14 nt, Shigella flexneri 2a str. 2457T
uaguuugauaauuu

SEQ ID NO: 1942483 - RNA, 17 nt, Shigella flexneri 2a str. 2457T
uaguuugauaauuuuag

SEQ ID NO: 1942484 - RNA, 13 nt, Shigella flexneri 2a str. 2457T
uaguuucucccca

SEQ ID NO: 1942485 - RNA, 14 nt, Shigella flexneri 2a str. 2457T
uauaaaaaaacaau

SEQ ID NO: 1942486 - RNA, 23 nt, Shigella flexneri 2a str. 2457T
uauaaacguggggucucugcaaa

SEQ ID NO: 1942487 - RNA, 17 nt, Shigella flexneri 2a str. 2457T
uauaaagaaaaucugaa

SEQ ID NO: 1942488 - RNA, 19 nt, Shigella flexneri 2a str. 2457T
uauaaauuccuaaaguugu

SEQ ID NO: 1942489 - RNA, 14 nt, Shigella flexneri 2a str. 2457T
uagugccgucagca

SEQ ID NO: 1942490 - RNA, 16 nt, Shigella flexneri 2a str. 2457T
uagugccgucagcagg

SEQ ID NO: 1942491 - RNA, 13 nt, Shigella flexneri 2a str. 2457T
uagugcaguacau

SEQ ID NO: 1942492 - RNA, 22 nt, Shigella flexneri 2a str. 2457T
uagugaugccauacuucauaac

SEQ ID NO: 1942493 - RNA, 22 nt, Shigella flexneri 2a str. 2457T
uagugaugcgcauuauggcuuc

SEQ ID NO: 1942494 - RNA, 15 nt, Shigella flexneri 2a str. 2457T
uagucccaaacagca

SEQ ID NO: 1942495 - RNA, 20 nt, Shigella flexneri 2a str. 2457T
uagucccuucgguagcagcu

SEQ ID NO: 1942496 - RNA, 13 nt, Shigella flexneri 2a str. 2457T
uagucauuuuuug

SEQ ID NO: 1942497 - RNA, 18 nt, Shigella flexneri 2a str. 2457T
uaguauuuucuuugacaa

SEQ ID NO: 1942498 - RNA, 16 nt, Shigella flexneri 2a str. 2457T
uaguucauccccucuu

SEQ ID NO: 1942499 - RNA, 18 nt, Shigella flexneri 2a str. 2457T
uaguucauccccucuucc

SEQ ID NO: 1942500 - RNA, 16 nt, Shigella flexneri 2a str. 2457T
uaguuguacaacugcu

SEQ ID NO: 1942501 - RNA, 15 nt, Shigella flexneri 2a str. 2457T
uagugugcaaucacu

SEQ ID NO: 1942502 - RNA, 14 nt, Shigella flexneri 2a str. 2457T
uagugucuuaucug

SEQ ID NO: 1942503 - RNA, 17 nt, Shigella flexneri 2a str. 2457T
uaguguuuguauuagau

SEQ ID NO: 1942504 - RNA, 14 nt, Shigella flexneri 2a str. 2457T
uaguucaacagauu

SEQ ID NO: 1942505 - RNA, 14 nt, Shigella flexneri 2a str. 2457T
uagguaaucauauu

SEQ ID NO: 1942506 - RNA, 14 nt, Shigella flexneri 2a str. 2457T
uagguacaaagcca

SEQ ID NO: 1942507 - RNA, 17 nt, Shigella flexneri 2a str. 2457T
uaggguggggaaaaaca

SEQ ID NO: 1942508 - RNA, 13 nt, Shigella flexneri 2a str. 2457T
uagguaaacaucc

SEQ ID NO: 1942509 - RNA, 22 nt, Shigella flexneri 2a str. 2457T
uaggugacucguuaugugaguu

SEQ ID NO: 1942510 - RNA, 16 nt, Shigella flexneri 2a str. 2457T
uaguaguucauccccu

SEQ ID NO: 1942511 - RNA, 14 nt, Shigella flexneri 2a str. 2457T
uaguauuaagccag

SEQ ID NO: 1942512 - RNA, 11 nt, Shigella flexneri 2a str. 2457T
uaguauuuauc

SEQ ID NO: 1942513 - RNA, 16 nt, Shigella flexneri 2a str. 2457T
uaguaucuauucauca

SEQ ID NO: 1942514 - RNA, 20 nt, Shigella flexneri 2a str. 2457T
uaguauggagcaggaauaua

SEQ ID NO: 1942515 - RNA, 19 nt, Shigella flexneri 2a str. 2457T
uaguaaacgcguagaucuc

SEQ ID NO: 1942516 - RNA, 21 nt, Shigella flexneri 2a str. 2457T
uaggcuucuauaccaaugauu

SEQ ID NO: 1942517 - RNA, 14 nt, Shigella flexneri 2a str. 2457T
uagggaucaucuua

SEQ ID NO: 1942518 - RNA, 18 nt, Shigella flexneri 2a str. 2457T
uaggccugauaagcguag

SEQ ID NO: 1942519 - RNA, 14 nt, Shigella flexneri 2a str. 2457T
uaaaucugccguca

SEQ ID NO: 1942520 - RNA, 14 nt, Shigella flexneri 2a str. 2457T
uaaaucacaccauu

SEQ ID NO: 1942521 - RNA, 20 nt, Shigella flexneri 2a str. 2457T
uaaaucaagcgccgccaguc

SEQ ID NO: 1942522 - RNA, 20 nt, Shigella flexneri 2a str. 2457T
uaaaugccgcaaugugcucu

SEQ ID NO: 1942523 - RNA, 18 nt, Shigella flexneri 2a str. 2457T
uaaaugccgcguggccug

SEQ ID NO: 1942524 - RNA, 18 nt, Shigella flexneri 2a str. 2457T
uaaaugccggaagcugca

SEQ ID NO: 1942525 - RNA, 24 nt, Shigella flexneri 2a str. 2457T
uaaauguauucugaaaacggacau

SEQ ID NO: 1942526 - RNA, 19 nt, Shigella flexneri 2a str. 2457T
uaaaugccacugaauaaag

SEQ ID NO: 1942527 - RNA, 11 nt, Shigella flexneri 2a str. 2457T
uaaaugccacc

SEQ ID NO: 1942528 - RNA, 20 nt, Shigella flexneri 2a str. 2457T
uaaaugcacaauaauauuac

SEQ ID NO: 1942529 - RNA, 15 nt, Shigella flexneri 2a str. 2457T
uaaauuuuauucaua

SEQ ID NO: 1942530 - RNA, 20 nt, Shigella flexneri 2a str. 2457T
uaacaaaugcgcuuuauuca

SEQ ID NO: 1942531 - RNA, 16 nt, Shigella flexneri 2a str. 2457T
uaacaaaugugccauu

SEQ ID NO: 1942532 - RNA, 19 nt, Shigella flexneri 2a str. 2457T
uaacaauagcgaacagaca

SEQ ID NO: 1942533 - RNA, 21 nt, Shigella flexneri 2a str. 2457T
uaaauuucacugcuuaauauu

SEQ ID NO: 1942534 - RNA, 19 nt, Shigella flexneri 2a str. 2457T
uaaauuugccaucucugca

SEQ ID NO: 1942535 - RNA, 21 nt, Shigella flexneri 2a str. 2457T
uaaauuacugagcaauugcuc

SEQ ID NO: 1942536 - RNA, 18 nt, Shigella flexneri 2a str. 2457T
uaaauuacugccgcuguu

SEQ ID NO: 1942537 - RNA, 22 nt, Shigella flexneri 2a str. 2457T
uaaauugcaggguuuuguuuaa

SEQ ID NO: 1942538 - RNA, 17 nt, Shigella flexneri 2a str. 2457T
uaaauugcgauucaccg

SEQ ID NO: 1942539 - RNA, 16 nt, Shigella flexneri 2a str. 2457T
uaacagcaaaacgccc

SEQ ID NO: 1942540 - RNA, 21 nt, Shigella flexneri 2a str. 2457T
uaacagcaacauaggcugcua

SEQ ID NO: 1942541 - RNA, 16 nt, Shigella flexneri 2a str. 2457T
uaacagcgaaaucgcc

SEQ ID NO: 1942542 - RNA, 11 nt, Shigella flexneri 2a str. 2457T
uaacagcagca

SEQ ID NO: 1942543 - RNA, 21 nt, Shigella flexneri 2a str. 2457T
uaacagcaaucccaaaauaau

SEQ ID NO: 1942544 - RNA, 20 nt, Shigella flexneri 2a str. 2457T
uaacaauccgauaaucccuu

SEQ ID NO: 1942545 - RNA, 17 nt, Shigella flexneri 2a str. 2457T
uaacagcguccacagcc

SEQ ID NO: 1942546 - RNA, 18 nt, Shigella flexneri 2a str. 2457T
uaacagcgaaaucgccuu

SEQ ID NO: 1942547 - RNA, 15 nt, Shigella flexneri 2a str. 2457T
uaacaggaagcagcu

SEQ ID NO: 1942548 - RNA, 14 nt, Shigella flexneri 2a str. 2457T
uaacauuaggcauu

SEQ ID NO: 1942549 - RNA, 14 nt, Shigella flexneri 2a str. 2457T
uaacauuuuacuua

SEQ ID NO: 1942550 - RNA, 17 nt, Shigella flexneri 2a str. 2457T
uaacauaccuaaaagca

SEQ ID NO: 1942551 - RNA, 17 nt, Shigella flexneri 2a str. 2457T
uaacagugcaccggaca

SEQ ID NO: 1942552 - RNA, 19 nt, Shigella flexneri 2a str. 2457T
uaaccgcccagugccagca

SEQ ID NO: 1942553 - RNA, 16 nt, Shigella flexneri 2a str. 2457T
uaaccgcugcaaaaaa

SEQ ID NO: 1942554 - RNA, 20 nt, Shigella flexneri 2a str. 2457T
uaaccgcaguguaguucugg

SEQ ID NO: 1942555 - RNA, 22 nt, Shigella flexneri 2a str. 2457T
uaaccgccaguaaucuggccaa

SEQ ID NO: 1942556 - RNA, 13 nt, Shigella flexneri 2a str. 2457T
uaaccccagacca

SEQ ID NO: 1942557 - RNA, 19 nt, Shigella flexneri 2a str. 2457T
uaacccccaaauaaccccu

SEQ ID NO: 1942558 - RNA, 20 nt, Shigella flexneri 2a str. 2457T
uaacccaggggucaguuccc

SEQ ID NO: 1942559 - RNA, 22 nt, Shigella flexneri 2a str. 2457T
uaaccaacaauugucgccacaa

SEQ ID NO: 1942560 - RNA, 17 nt, Shigella flexneri 2a str. 2457T
uaaccaacaaugcaaaa

SEQ ID NO: 1942561 - RNA, 21 nt, Shigella flexneri 2a str. 2457T
uaaccaacaaugcaaaauagg

SEQ ID NO: 1942562 - RNA, 16 nt, Shigella flexneri 2a str. 2457T
uaaccgcuuuuucaau

SEQ ID NO: 1942563 - RNA, 22 nt, Shigella flexneri 2a str. 2457T
uaaccgcuuuuucaauuuccag

SEQ ID NO: 1942564 - RNA, 22 nt, Shigella flexneri 2a str. 2457T
uaaccugaaaccggaaagcuuc

SEQ ID NO: 1942565 - RNA, 21 nt, Shigella flexneri 2a str. 2457T
uaaccugagagugauuaacug

SEQ ID NO: 1942566 - RNA, 23 nt, Shigella flexneri 2a str. 2457T
uaaccugagagugauuaacuguu

SEQ ID NO: 1942567 - RNA, 23 nt, Shigella flexneri 2a str. 2457T
uaaccuuguccaccgugauucac

SEQ ID NO: 1942568 - RNA, 13 nt, Shigella flexneri 2a str. 2457T
uaacgaccaccac

SEQ ID NO: 1942569 - RNA, 23 nt, Shigella flexneri 2a str. 2457T
uaacgaccaccaccgcaguaauc

SEQ ID NO: 1942570 - RNA, 22 nt, Shigella flexneri 2a str. 2457T
uaaccuuuaucgcgcagcagau

SEQ ID NO: 1942571 - RNA, 20 nt, Shigella flexneri 2a str. 2457T
uaaccuugcaauaguuucag

SEQ ID NO: 1942572 - RNA, 20 nt, Shigella flexneri 2a str. 2457T
uaacgaacgcagugauaacu

SEQ ID NO: 1942573 - RNA, 18 nt, Shigella flexneri 2a str. 2457T
uaacgaacucuuugccca

SEQ ID NO: 1942574 - RNA, 15 nt, Shigella flexneri 2a str. 2457T
uaaacgucucacuaa

SEQ ID NO: 1942575 - RNA, 12 nt, Shigella flexneri 2a str. 2457T
uaaacuuucaua

SEQ ID NO: 1942576 - RNA, 19 nt, Shigella flexneri 2a str. 2457T
uaaacuucacuuccccgag

SEQ ID NO: 1942577 - RNA, 20 nt, Shigella flexneri 2a str. 2457T
uaaagaaggcauaacucccc

SEQ ID NO: 1942578 - RNA, 16 nt, Shigella flexneri 2a str. 2457T
uaaacauuaaaauucu

SEQ ID NO: 1942579 - RNA, 19 nt, Shigella flexneri 2a str. 2457T
uaaacccgaccacuuccac

SEQ ID NO: 1942580 - RNA, 23 nt, Shigella flexneri 2a str. 2457T
uaaaccgaaucuguuuuuuggug

SEQ ID NO: 1942581 - RNA, 15 nt, Shigella flexneri 2a str. 2457T
uaaacccuaacauca

SEQ ID NO: 1942582 - RNA, 12 nt, Shigella flexneri 2a str. 2457T
uaaaccuucauc

SEQ ID NO: 1942583 - RNA, 13 nt, Shigella flexneri 2a str. 2457T
uaaacgcauacau

SEQ ID NO: 1942584 - RNA, 17 nt, Shigella flexneri 2a str. 2457T
uaaaauucauucaauua

SEQ ID NO: 1942585 - RNA, 22 nt, Shigella flexneri 2a str. 2457T
uaaaauucuuacguaauuuaua

SEQ ID NO: 1942586 - RNA, 15 nt, Shigella flexneri 2a str. 2457T
uaaaauucaucaaau

SEQ ID NO: 1942587 - RNA, 19 nt, Shigella flexneri 2a str. 2457T
uaaaauuauagggaugcag

SEQ ID NO: 1942588 - RNA, 20 nt, Shigella flexneri 2a str. 2457T
uaaacaauguuauccggcua

SEQ ID NO: 1942589 - RNA, 21 nt, Shigella flexneri 2a str. 2457T
uaaacaaugagauauuuaaau

SEQ ID NO: 1942590 - RNA, 18 nt, Shigella flexneri 2a str. 2457T
uaaacaucaaaccacuua

SEQ ID NO: 1942591 - RNA, 21 nt, Shigella flexneri 2a str. 2457T
uaaacaucgggacaugauaug

SEQ ID NO: 1942592 - RNA, 16 nt, Shigella flexneri 2a str. 2457T
uaaacaguuucgccag

SEQ ID NO: 1942593 - RNA, 12 nt, Shigella flexneri 2a str. 2457T
uaaacaccagca

SEQ ID NO: 1942594 - RNA, 18 nt, Shigella flexneri 2a str. 2457T
uaaacaccagcaauaaug

SEQ ID NO: 1942595 - RNA, 20 nt, Shigella flexneri 2a str. 2457T
uaaacaguacgagagaagag

SEQ ID NO: 1942596 - RNA, 17 nt, Shigella flexneri 2a str. 2457T
uaaauagaggaaucuga

SEQ ID NO: 1942597 - RNA, 19 nt, Shigella flexneri 2a str. 2457T
uaaauagaggaaucugauu

SEQ ID NO: 1942598 - RNA, 16 nt, Shigella flexneri 2a str. 2457T
uaaauacuccauaacu

SEQ ID NO: 1942599 - RNA, 15 nt, Shigella flexneri 2a str. 2457T
uaaauaccguucauu

SEQ ID NO: 1942600 - RNA, 14 nt, Shigella flexneri 2a str. 2457T
uaaauauuauuggc

SEQ ID NO: 1942601 - RNA, 14 nt, Shigella flexneri 2a str. 2457T
uaaauaaucgaucg

SEQ ID NO: 1942602 - RNA, 12 nt, Shigella flexneri 2a str. 2457T
uaaauacagagc

SEQ ID NO: 1942603 - RNA, 21 nt, Shigella flexneri 2a str. 2457T
uaaagagaacucuuuuuuccg

SEQ ID NO: 1942604 - RNA, 20 nt, Shigella flexneri 2a str. 2457T
uaaagagaacucuuuuuucc

SEQ ID NO: 1942605 - RNA, 16 nt, Shigella flexneri 2a str. 2457T
uaaagccugcuggcag

SEQ ID NO: 1942606 - RNA, 24 nt, Shigella flexneri 2a str. 2457T
uaaagaguaaauugcaaaccucag

SEQ ID NO: 1942607 - RNA, 22 nt, Shigella flexneri 2a str. 2457T
uaaaggcggcagaacagaacau

SEQ ID NO: 1942608 - RNA, 16 nt, Shigella flexneri 2a str. 2457T
uaaaggcaaaaugcca

SEQ ID NO: 1942609 - RNA, 15 nt, Shigella flexneri 2a str. 2457T
uaaaggucaucacau

SEQ ID NO: 1942610 - RNA, 18 nt, Shigella flexneri 2a str. 2457T
uaaaggucgacagcagcc

SEQ ID NO: 1942611 - RNA, 17 nt, Shigella flexneri 2a str. 2457T
uaaaggggugaaaaaaa

SEQ ID NO: 1942612 - RNA, 18 nt, Shigella flexneri 2a str. 2457T
uaaaggggugaaaaaaac

SEQ ID NO: 1942613 - RNA, 22 nt, Shigella flexneri 2a str. 2457T
uaaaggugaacaucgcagggaa

SEQ ID NO: 1942614 - RNA, 14 nt, Shigella flexneri 2a str. 2457T
uaaagccuuuuacc

SEQ ID NO: 1942615 - RNA, 19 nt, Shigella flexneri 2a str. 2457T
uaaagcgcgaucgcuaccu

SEQ ID NO: 1942616 - RNA, 23 nt, Shigella flexneri 2a str. 2457T
uaaagcgcgcaguuugucuucaa

SEQ ID NO: 1942617 - RNA, 21 nt, Shigella flexneri 2a str. 2457T
uaaaggagaaggguuaugaug

SEQ ID NO: 1942618 - RNA, 12 nt, Shigella flexneri 2a str. 2457T
uaaaaucacagg

SEQ ID NO: 1942619 - RNA, 18 nt, Shigella flexneri 2a str. 2457T
uaaaaucagaaaucacca

SEQ ID NO: 1942620 - RNA, 14 nt, Shigella flexneri 2a str. 2457T
uaaaauaucacucg

SEQ ID NO: 1942621 - RNA, 15 nt, Shigella flexneri 2a str. 2457T
uaaaauaucuuccac

SEQ ID NO: 1942622 - RNA, 23 nt, Shigella flexneri 2a str. 2457T
uaaaaucuauuauuauuuuugug

SEQ ID NO: 1942623 - RNA, 17 nt, Shigella flexneri 2a str. 2457T
uaaaaugauacgcuccc

SEQ ID NO: 1942624 - RNA, 14 nt, Shigella flexneri 2a str. 2457T
uaaaauguacaugu

SEQ ID NO: 1942625 - RNA, 18 nt, Shigella flexneri 2a str. 2457T
uaaaaugauuucgcaacg

SEQ ID NO: 1942626 - RNA, 14 nt, Shigella flexneri 2a str. 2457T
uaaaaugcgaaaaa

SEQ ID NO: 1942627 - RNA, 13 nt, Shigella flexneri 2a str. 2457T
uaaaauggccgua

SEQ ID NO: 1942628 - RNA, 23 nt, Shigella flexneri 2a str. 2457T
uaaaauggaaauuguuuuugauu

SEQ ID NO: 1942629 - RNA, 18 nt, Shigella flexneri 2a str. 2457T
uaaaaggaaacagcguau

SEQ ID NO: 1942630 - RNA, 15 nt, Shigella flexneri 2a str. 2457T
uaaaaggagauaaac

SEQ ID NO: 1942631 - RNA, 15 nt, Shigella flexneri 2a str. 2457T
uaaaaggauguuuau

SEQ ID NO: 1942632 - RNA, 18 nt, Shigella flexneri 2a str. 2457T
uaaaaggcgccauuuuca

SEQ ID NO: 1942633 - RNA, 23 nt, Shigella flexneri 2a str. 2457T
uaaaacgcacgcugucaccagug

SEQ ID NO: 1942634 - RNA, 18 nt, Shigella flexneri 2a str. 2457T
uaaaacgcagucuuccca

SEQ ID NO: 1942635 - RNA, 23 nt, Shigella flexneri 2a str. 2457T
uaaaacgcagucuucccagcccc

SEQ ID NO: 1942636 - RNA, 23 nt, Shigella flexneri 2a str. 2457T
uaaaacgcgcuacugaaucccug

SEQ ID NO: 1942637 - RNA, 16 nt, Shigella flexneri 2a str. 2457T
uaaaacgagauagcgu

SEQ ID NO: 1942638 - RNA, 16 nt, Shigella flexneri 2a str. 2457T
uaaaaccugacaacaa

SEQ ID NO: 1942639 - RNA, 16 nt, Shigella flexneri 2a str. 2457T
uaaaacuaaaaacagc

SEQ ID NO: 1942640 - RNA, 17 nt, Shigella flexneri 2a str. 2457T
uaaaacgugccauuaau

SEQ ID NO: 1942641 - RNA, 18 nt, Shigella flexneri 2a str. 2457T
uaaaacuaacgccaggaa

SEQ ID NO: 1942642 - RNA, 19 nt, Shigella flexneri 2a str. 2457T
uaaaacuuuuagcaucuua

SEQ ID NO: 1942643 - RNA, 17 nt, Shigella flexneri 2a str. 2457T
uaaaacuuuauucagug

SEQ ID NO: 1942644 - RNA, 12 nt, Shigella flexneri 2a str. 2457T
uaaaacuuucca

SEQ ID NO: 1942645 - RNA, 14 nt, Shigella flexneri 2a str. 2457T
uaaaagccccuucg

SEQ ID NO: 1942646 - RNA, 20 nt, Shigella flexneri 2a str. 2457T
uaaaagcgcgcccaacagua

SEQ ID NO: 1942647 - RNA, 15 nt, Shigella flexneri 2a str. 2457T
uaaaagcgugaaaca

SEQ ID NO: 1942648 - RNA, 20 nt, Shigella flexneri 2a str. 2457T
uaaaagccaggagccaacac

SEQ ID NO: 1942649 - RNA, 21 nt, Shigella flexneri 2a str. 2457T
uaaaagcacagaaucuaagau

SEQ ID NO: 1942650 - RNA, 16 nt, Shigella flexneri 2a str. 2457T
uaaaacagccagcgcu

SEQ ID NO: 1942651 - RNA, 21 nt, Shigella flexneri 2a str. 2457T
uaaaacagacgagggaaaaua

SEQ ID NO: 1942652 - RNA, 22 nt, Shigella flexneri 2a str. 2457T
uaaaacagcacuccugccacca

SEQ ID NO: 1942653 - RNA, 14 nt, Shigella flexneri 2a str. 2457T
uaaaaccccaaaaa

SEQ ID NO: 1942654 - RNA, 20 nt, Shigella flexneri 2a str. 2457T
uaaaaccccgcguacugaau

SEQ ID NO: 1942655 - RNA, 13 nt, Shigella flexneri 2a str. 2457T
uaaaaccaguaau

SEQ ID NO: 1942656 - RNA, 23 nt, Shigella flexneri 2a str. 2457T
uaaaacaacggaacgaaaaaaau

SEQ ID NO: 1942657 - RNA, 21 nt, Shigella flexneri 2a str. 2457T
uaaaacaacggaacgaaaaaa

SEQ ID NO: 1942658 - RNA, 22 nt, Shigella flexneri 2a str. 2457T
uaaaaauugaaucacgacaaac

SEQ ID NO: 1942659 - RNA, 14 nt, Shigella flexneri 2a str. 2457T
uaaaaaugaagccu

SEQ ID NO: 1942660 - RNA, 13 nt, Shigella flexneri 2a str. 2457T
uaaaaauauuucu

SEQ ID NO: 1942661 - RNA, 22 nt, Shigella flexneri 2a str. 2457T
uaaaaauacauacgcaaaaaac

SEQ ID NO: 1942662 - RNA, 17 nt, Shigella flexneri 2a str. 2457T
uaaaaauccuguuccau

SEQ ID NO: 1942663 - RNA, 16 nt, Shigella flexneri 2a str. 2457T
aaaucauccagacugc

SEQ ID NO: 1942664 - RNA, 16 nt, Shigella flexneri 2a str. 2457T
aaaucauccugcugca

SEQ ID NO: 1942665 - RNA, 21 nt, Shigella flexneri 2a str. 2457T
aaaucauccagaccgcucagc

SEQ ID NO: 1942666 - RNA, 14 nt, Shigella flexneri 2a str. 2457T
aaaucauccauccg

SEQ ID NO: 1942667 - RNA, 14 nt, Shigella flexneri 2a str. 2457T
aaaucauccagcac

SEQ ID NO: 1942668 - RNA, 11 nt, Shigella flexneri 2a str. 2457T
guuuucaucau

SEQ ID NO: 1942669 - RNA, 21 nt, Shigella flexneri 2a str. 2457T
guuuuauguucagauaaugcc

SEQ ID NO: 1942670 - RNA, 22 nt, Shigella flexneri 2a str. 2457T
guuuuauuauuccauccugcuc

SEQ ID NO: 1942671 - RNA, 19 nt, Shigella flexneri 2a str. 2457T
guuuuauuauuccauccug

SEQ ID NO: 1942672 - RNA, 14 nt, Shigella flexneri 2a str. 2457T
guuuuaucagaccg

SEQ ID NO: 1942673 - RNA, 14 nt, Shigella flexneri 2a str. 2457T
guuuuccagugcca

SEQ ID NO: 1942674 - RNA, 13 nt, Shigella flexneri 2a str. 2457T
guuuuccuucagg

SEQ ID NO: 1942675 - RNA, 20 nt, Shigella flexneri 2a str. 2457T
guuuucuacuuuguaaacga

SEQ ID NO: 1942676 - RNA, 20 nt, Shigella flexneri 2a str. 2457T
guuuucgucaacguagcuau

SEQ ID NO: 1942677 - RNA, 14 nt, Shigella flexneri 2a str. 2457T
guuuucgccacauc

SEQ ID NO: 1942678 - RNA, 19 nt, Shigella flexneri 2a str. 2457T
guuuucgccggaaccugau

SEQ ID NO: 1942679 - RNA, 19 nt, Shigella flexneri 2a str. 2457T
guuuuggugaagugagaau

SEQ ID NO: 1942680 - RNA, 22 nt, Shigella flexneri 2a str. 2457T
guuuugguuaacugaauauucc

SEQ ID NO: 1942681 - RNA, 14 nt, Shigella flexneri 2a str. 2457T
guuuucuccagcgc

SEQ ID NO: 1942682 - RNA, 12 nt, Shigella flexneri 2a str. 2457T
guuuuuaaaaua

SEQ ID NO: 1942683 - RNA, 11 nt, Shigella flexneri 2a str. 2457T
guuuggcaaau

SEQ ID NO: 1942684 - RNA, 23 nt, Shigella flexneri 2a str. 2457T
guuugcaggguuaauugaugguu

SEQ ID NO: 1942685 - RNA, 16 nt, Shigella flexneri 2a str. 2457T
guuucaaaaacaaaga

SEQ ID NO: 1942686 - RNA, 19 nt, Shigella flexneri 2a str. 2457T
aaaucagguggcuauaaau

SEQ ID NO: 1942687 - RNA, 22 nt, Shigella flexneri 2a str. 2457T
aaaucagcuuuggugaaaaaau

SEQ ID NO: 1942688 - RNA, 19 nt, Shigella flexneri 2a str. 2457T
guuuuaaucacuucuucuu

SEQ ID NO: 1942689 - RNA, 12 nt, Shigella flexneri 2a str. 2457T
guuuggugguuu

SEQ ID NO: 1942690 - RNA, 18 nt, Shigella flexneri 2a str. 2457T
guuuggugaaauauagaa

SEQ ID NO: 1942691 - RNA, 12 nt, Shigella flexneri 2a str. 2457T
guuugccauuuu

SEQ ID NO: 1942692 - RNA, 24 nt, Shigella flexneri 2a str. 2457T
guuuggccaauaguuccacuauuu

SEQ ID NO: 1942693 - RNA, 15 nt, Shigella flexneri 2a str. 2457T
guuuuucuuuuucaa

SEQ ID NO: 1942694 - RNA, 16 nt, Shigella flexneri 2a str. 2457T
guuuuuacccagcagc

SEQ ID NO: 1942695 - RNA, 16 nt, Shigella flexneri 2a str. 2457T
guuuuuacgaaacaga

SEQ ID NO: 1942696 - RNA, 17 nt, Shigella flexneri 2a str. 2457T
guuuuuuuauagcuuau

SEQ ID NO: 1942697 - RNA, 21 nt, Shigella flexneri 2a str. 2457T
guuuuuuaaaggaaaguaaau

SEQ ID NO: 1942698 - RNA, 15 nt, Shigella flexneri 2a str. 2457T
guuuuuguugauaaa

SEQ ID NO: 1942699 - RNA, 17 nt, Shigella flexneri 2a str. 2457T
uaaaaaaggcugcauaa

SEQ ID NO: 1942700 - RNA, 21 nt, Shigella flexneri 2a str. 2457T
uaaaaaaggugcucaaugagc

SEQ ID NO: 1942701 - RNA, 22 nt, Shigella flexneri 2a str. 2457T
uaaaaaaguaaugccugcacuu

SEQ ID NO: 1942702 - RNA, 20 nt, Shigella flexneri 2a str. 2457T
uaaaaaagaaggaaaauaca

SEQ ID NO: 1942703 - RNA, 21 nt, Shigella flexneri 2a str. 2457T
uaaaaaagaaggaaaauacag

SEQ ID NO: 1942704 - RNA, 10 nt, Shigella flexneri 2a str. 2457T
uaaaaaagaa

SEQ ID NO: 1942705 - RNA, 20 nt, Shigella flexneri 2a str. 2457T
uaaaaaaacaucauaauaau

SEQ ID NO: 1942706 - RNA, 13 nt, Shigella flexneri 2a str. 2457T
uaaaaaaagaaac

SEQ ID NO: 1942707 - RNA, 19 nt, Shigella flexneri 2a str. 2457T
uaaaaaaagaaacuaucag

SEQ ID NO: 1942708 - RNA, 23 nt, Shigella flexneri 2a str. 2457T
uaaaaacaguaccagaccaacau

SEQ ID NO: 1942709 - RNA, 15 nt, Shigella flexneri 2a str. 2457T
uaaaaacagcaucaa

SEQ ID NO: 1942710 - RNA, 21 nt, Shigella flexneri 2a str. 2457T
uaaaaaccagagaauauuaac

SEQ ID NO: 1942711 - RNA, 20 nt, Shigella flexneri 2a str. 2457T
uaaaaaguaagaauugauaa

SEQ ID NO: 1942712 - RNA, 18 nt, Shigella flexneri 2a str. 2457T
uaaaaaguaagaauugau

SEQ ID NO: 1942713 - RNA, 20 nt, Shigella flexneri 2a str. 2457T
uaaaaagagauuguauuuaa

SEQ ID NO: 1942714 - RNA, 12 nt, Shigella flexneri 2a str. 2457T
uaaaaagaaagu

SEQ ID NO: 1942715 - RNA, 19 nt, Shigella flexneri 2a str. 2457T
guugugcuaacucaucacc

SEQ ID NO: 1942716 - RNA, 18 nt, Shigella flexneri 2a str. 2457T
guugugccuuccaucccu

SEQ ID NO: 1942717 - RNA, 22 nt, Shigella flexneri 2a str. 2457T
guuguagaccggaaaagguguu

SEQ ID NO: 1942718 - RNA, 15 nt, Shigella flexneri 2a str. 2457T
guugguacuguggca

SEQ ID NO: 1942719 - RNA, 15 nt, Shigella flexneri 2a str. 2457T
guuguaaucaccacu

SEQ ID NO: 1942720 - RNA, 18 nt, Shigella flexneri 2a str. 2457T
guuguaaucauauuaaau

SEQ ID NO: 1942721 - RNA, 23 nt, Shigella flexneri 2a str. 2457T
guuggauaaggcgguuacgccgc

SEQ ID NO: 1942722 - RNA, 12 nt, Shigella flexneri 2a str. 2457T
guugccgcccgu

SEQ ID NO: 1942723 - RNA, 11 nt, Shigella flexneri 2a str. 2457T
guugccgcagc

SEQ ID NO: 1942724 - RNA, 12 nt, Shigella flexneri 2a str. 2457T
guuggcaaaaaa

SEQ ID NO: 1942725 - RNA, 14 nt, Shigella flexneri 2a str. 2457T
guuggcaaaaaaau

SEQ ID NO: 1942726 - RNA, 21 nt, Shigella flexneri 2a str. 2457T
guuggcaugcguauccuccug

SEQ ID NO: 1942727 - RNA, 19 nt, Shigella flexneri 2a str. 2457T
guugccaucaucaccagaa

SEQ ID NO: 1942728 - RNA, 23 nt, Shigella flexneri 2a str. 2457T
guugccaucaucaccagaaucaa

SEQ ID NO: 1942729 - RNA, 12 nt, Shigella flexneri 2a str. 2457T
guugcccugcug

SEQ ID NO: 1942730 - RNA, 18 nt, Shigella flexneri 2a str. 2457T
guugcccagcgcaucagg

SEQ ID NO: 1942731 - RNA, 16 nt, Shigella flexneri 2a str. 2457T
guuuauuugacagccc

SEQ ID NO: 1942732 - RNA, 15 nt, Shigella flexneri 2a str. 2457T
guuuauuucccagau

SEQ ID NO: 1942733 - RNA, 13 nt, Shigella flexneri 2a str. 2457T
guuuaugccuggu

SEQ ID NO: 1942734 - RNA, 23 nt, Shigella flexneri 2a str. 2457T
guuuagcgcggcaauuagcggcu

SEQ ID NO: 1942735 - RNA, 19 nt, Shigella flexneri 2a str. 2457T
guuuagccgcuucugcagc

SEQ ID NO: 1942736 - RNA, 16 nt, Shigella flexneri 2a str. 2457T
guuuauaacggugcug

SEQ ID NO: 1942737 - RNA, 18 nt, Shigella flexneri 2a str. 2457T
guuuaccccgucaccacu

SEQ ID NO: 1942738 - RNA, 13 nt, Shigella flexneri 2a str. 2457T
guuuacaaccuga

SEQ ID NO: 1942739 - RNA, 18 nt, Shigella flexneri 2a str. 2457T
guuuaccugaauaucgcc

SEQ ID NO: 1942740 - RNA, 14 nt, Shigella flexneri 2a str. 2457T
guuuaccggugcca

SEQ ID NO: 1942741 - RNA, 22 nt, Shigella flexneri 2a str. 2457T
guuuagagacgcauugauaaug

SEQ ID NO: 1942742 - RNA, 14 nt, Shigella flexneri 2a str. 2457T
guuguucgcgcaca

SEQ ID NO: 1942743 - RNA, 14 nt, Shigella flexneri 2a str. 2457T
guuguuccuuccag

SEQ ID NO: 1942744 - RNA, 20 nt, Shigella flexneri 2a str. 2457T
guuguugaacggcaaacgca

SEQ ID NO: 1942745 - RNA, 17 nt, Shigella flexneri 2a str. 2457T
guuguugauaagcccca

SEQ ID NO: 1942746 - RNA, 17 nt, Shigella flexneri 2a str. 2457T
guuguuuacaguaugag

SEQ ID NO: 1942747 - RNA, 16 nt, Shigella flexneri 2a str. 2457T
guugacucggagucga

SEQ ID NO: 1942748 - RNA, 13 nt, Shigella flexneri 2a str. 2457T
guugaccgcccgg

SEQ ID NO: 1942749 - RNA, 23 nt, Shigella flexneri 2a str. 2457T
guugaagucagggucuuccagca

SEQ ID NO: 1942750 - RNA, 12 nt, Shigella flexneri 2a str. 2457T
guugaagucagg

SEQ ID NO: 1942751 - RNA, 20 nt, Shigella flexneri 2a str. 2457T
guugcaacucgacuggagcc

SEQ ID NO: 1942752 - RNA, 17 nt, Shigella flexneri 2a str. 2457T
guugcauccggcauggc

SEQ ID NO: 1942753 - RNA, 14 nt, Shigella flexneri 2a str. 2457T
guugcaucgccugc

SEQ ID NO: 1942754 - RNA, 21 nt, Shigella flexneri 2a str. 2457T
guugcaugauuucgucauccg

SEQ ID NO: 1942755 - RNA, 13 nt, Shigella flexneri 2a str. 2457T
guugcauuccagu

SEQ ID NO: 1942756 - RNA, 14 nt, Shigella flexneri 2a str. 2457T
guugcauuugcaga

SEQ ID NO: 1942757 - RNA, 19 nt, Shigella flexneri 2a str. 2457T
guugaugcgcccuugcagg

SEQ ID NO: 1942758 - RNA, 14 nt, Shigella flexneri 2a str. 2457T
guugaugguaaaau

SEQ ID NO: 1942759 - RNA, 16 nt, Shigella flexneri 2a str. 2457T
guugauuggcgcaggu

SEQ ID NO: 1942760 - RNA, 14 nt, Shigella flexneri 2a str. 2457T
guugaucuguaacg

SEQ ID NO: 1942761 - RNA, 19 nt, Shigella flexneri 2a str. 2457T
guugaucuucucgucaauc

SEQ ID NO: 1942762 - RNA, 12 nt, Shigella flexneri 2a str. 2457T
guugauccagga

SEQ ID NO: 1942763 - RNA, 19 nt, Shigella flexneri 2a str. 2457T
guugauccaggagcuccag

SEQ ID NO: 1942764 - RNA, 21 nt, Shigella flexneri 2a str. 2457T
guugaucauaaaaauuaaauc

SEQ ID NO: 1942765 - RNA, 16 nt, Shigella flexneri 2a str. 2457T
guucuucgcugacagu

SEQ ID NO: 1942766 - RNA, 11 nt, Shigella flexneri 2a str. 2457T
guucuucccuc

SEQ ID NO: 1942767 - RNA, 13 nt, Shigella flexneri 2a str. 2457T
guucuuuuuuuaa

SEQ ID NO: 1942768 - RNA, 12 nt, Shigella flexneri 2a str. 2457T
guugaaaaacca

SEQ ID NO: 1942769 - RNA, 14 nt, Shigella flexneri 2a str. 2457T
guugaaaaaccaga

SEQ ID NO: 1942770 - RNA, 22 nt, Shigella flexneri 2a str. 2457T
guugaaaaaucaaaaaacugga

SEQ ID NO: 1942771 - RNA, 21 nt, Shigella flexneri 2a str. 2457T
guucguugaucacuuucaccg

SEQ ID NO: 1942772 - RNA, 14 nt, Shigella flexneri 2a str. 2457T
guucucucagucuu

SEQ ID NO: 1942773 - RNA, 13 nt, Shigella flexneri 2a str. 2457T
guucucuuuaaaa

SEQ ID NO: 1942774 - RNA, 14 nt, Shigella flexneri 2a str. 2457T
guucucuggcccgc

SEQ ID NO: 1942775 - RNA, 23 nt, Shigella flexneri 2a str. 2457T
guucugcgccguccacaaaccgu

SEQ ID NO: 1942776 - RNA, 23 nt, Shigella flexneri 2a str. 2457T
guucuggccuuuaauaugccacg

SEQ ID NO: 1942777 - RNA, 19 nt, Shigella flexneri 2a str. 2457T
guucugugucuuauuggca

SEQ ID NO: 1942778 - RNA, 20 nt, Shigella flexneri 2a str. 2457T
guucugucgauaaacucaug

SEQ ID NO: 1942779 - RNA, 17 nt, Shigella flexneri 2a str. 2457T
guucugcccugaauggu

SEQ ID NO: 1942780 - RNA, 16 nt, Shigella flexneri 2a str. 2457T
guucaauaucuuccug

SEQ ID NO: 1942781 - RNA, 16 nt, Shigella flexneri 2a str. 2457T
guucaaugauaguuca

SEQ ID NO: 1942782 - RNA, 19 nt, Shigella flexneri 2a str. 2457T
guucagauggccaauaacc

SEQ ID NO: 1942783 - RNA, 14 nt, Shigella flexneri 2a str. 2457T
guucagaaagcgcc

SEQ ID NO: 1942784 - RNA, 18 nt, Shigella flexneri 2a str. 2457T
guucaagugcguucaccc

SEQ ID NO: 1942785 - RNA, 13 nt, Shigella flexneri 2a str. 2457T
guucaagaugucu

SEQ ID NO: 1942786 - RNA, 18 nt, Shigella flexneri 2a str. 2457T
guucaguacgaaauaacu

SEQ ID NO: 1942787 - RNA, 14 nt, Shigella flexneri 2a str. 2457T
guucagugaucgcc

SEQ ID NO: 1942788 - RNA, 16 nt, Shigella flexneri 2a str. 2457T
guucagauuguugauu

SEQ ID NO: 1942789 - RNA, 17 nt, Shigella flexneri 2a str. 2457T
guucauuggguucaucu

SEQ ID NO: 1942790 - RNA, 20 nt, Shigella flexneri 2a str. 2457T
guucauuggguucaucugau

SEQ ID NO: 1942791 - RNA, 12 nt, Shigella flexneri 2a str. 2457T
guuccagcagaa

SEQ ID NO: 1942792 - RNA, 16 nt, Shigella flexneri 2a str. 2457T
guuccagccaguguua

SEQ ID NO: 1942793 - RNA, 18 nt, Shigella flexneri 2a str. 2457T
guuccagggccuccugca

SEQ ID NO: 1942794 - RNA, 20 nt, Shigella flexneri 2a str. 2457T
guuccagggccuccugcagc

SEQ ID NO: 1942795 - RNA, 13 nt, Shigella flexneri 2a str. 2457T
guuccccucaccc

SEQ ID NO: 1942796 - RNA, 20 nt, Shigella flexneri 2a str. 2457T
guuccccccacaaucagcca

SEQ ID NO: 1942797 - RNA, 15 nt, Shigella flexneri 2a str. 2457T
guuccgugagcggaa

SEQ ID NO: 1942798 - RNA, 16 nt, Shigella flexneri 2a str. 2457T
guuccuaacaugccac

SEQ ID NO: 1942799 - RNA, 16 nt, Shigella flexneri 2a str. 2457T
guuccgggaucaccag

SEQ ID NO: 1942800 - RNA, 11 nt, Shigella flexneri 2a str. 2457T
guucguccauu

SEQ ID NO: 1942801 - RNA, 20 nt, Shigella flexneri 2a str. 2457T
guucgucgucuuuauccuga

SEQ ID NO: 1942802 - RNA, 14 nt, Shigella flexneri 2a str. 2457T
guucggaguggcag

SEQ ID NO: 1942803 - RNA, 17 nt, Shigella flexneri 2a str. 2457T
guucgcaccaaauccaa

SEQ ID NO: 1942804 - RNA, 20 nt, Shigella flexneri 2a str. 2457T
guucgcguaacugcugcuca

SEQ ID NO: 1942805 - RNA, 19 nt, Shigella flexneri 2a str. 2457T
guucgcguaacugcugcuc

SEQ ID NO: 1942806 - RNA, 16 nt, Shigella flexneri 2a str. 2457T
guucgcuaaagacuuu

SEQ ID NO: 1942807 - RNA, 15 nt, Shigella flexneri 2a str. 2457T
guucgauuucauuca

SEQ ID NO: 1942808 - RNA, 15 nt, Shigella flexneri 2a str. 2457T
guucgauauccaguc

SEQ ID NO: 1942809 - RNA, 19 nt, Shigella flexneri 2a str. 2457T
gugucgccagcaacacaaa

SEQ ID NO: 1942810 - RNA, 14 nt, Shigella flexneri 2a str. 2457T
guguccuguugaug

SEQ ID NO: 1942811 - RNA, 14 nt, Shigella flexneri 2a str. 2457T
guguugguaaauaa

SEQ ID NO: 1942812 - RNA, 18 nt, Shigella flexneri 2a str. 2457T
guguuggggcaagauauu

SEQ ID NO: 1942813 - RNA, 22 nt, Shigella flexneri 2a str. 2457T
guuaaaguugagcgaaaacgaa

SEQ ID NO: 1942814 - RNA, 19 nt, Shigella flexneri 2a str. 2457T
guuaaacuuucauaaacac

SEQ ID NO: 1942815 - RNA, 19 nt, Shigella flexneri 2a str. 2457T
guuaaauuccguugcuguu

SEQ ID NO: 1942816 - RNA, 18 nt, Shigella flexneri 2a str. 2457T
guuaaacccgcucaaaca

SEQ ID NO: 1942817 - RNA, 14 nt, Shigella flexneri 2a str. 2457T
guuaaaccgccagu

SEQ ID NO: 1942818 - RNA, 16 nt, Shigella flexneri 2a str. 2457T
guuaauaaugauuuug

SEQ ID NO: 1942819 - RNA, 21 nt, Shigella flexneri 2a str. 2457T
guuaaauugaucgaugguugc

SEQ ID NO: 1942820 - RNA, 14 nt, Shigella flexneri 2a str. 2457T
guuaaguuuauccc

SEQ ID NO: 1942821 - RNA, 17 nt, Shigella flexneri 2a str. 2457T
guuacauaugcgcuggc

SEQ ID NO: 1942822 - RNA, 18 nt, Shigella flexneri 2a str. 2457T
guuacauaugcgcuggca

SEQ ID NO: 1942823 - RNA, 16 nt, Shigella flexneri 2a str. 2457T
guuacagcagguguua

SEQ ID NO: 1942824 - RNA, 12 nt, Shigella flexneri 2a str. 2457T
guuaccagcggc

SEQ ID NO: 1942825 - RNA, 22 nt, Shigella flexneri 2a str. 2457T
guuacgccggugauuaaaccaa

SEQ ID NO: 1942826 - RNA, 20 nt, Shigella flexneri 2a str. 2457T
guuacgcagauauucguuca

SEQ ID NO: 1942827 - RNA, 23 nt, Shigella flexneri 2a str. 2457T
guuagagccagggaucgggucac

SEQ ID NO: 1942828 - RNA, 13 nt, Shigella flexneri 2a str. 2457T
guuagagaacaac

SEQ ID NO: 1942829 - RNA, 20 nt, Shigella flexneri 2a str. 2457T
guuagacgcguuuacagagc

SEQ ID NO: 1942830 - RNA, 15 nt, Shigella flexneri 2a str. 2457T
guuacguucuccuga

SEQ ID NO: 1942831 - RNA, 14 nt, Shigella flexneri 2a str. 2457T
guuagagcacagau

SEQ ID NO: 1942832 - RNA, 18 nt, Shigella flexneri 2a str. 2457T
guuacggcuggaagguga

SEQ ID NO: 1942833 - RNA, 21 nt, Shigella flexneri 2a str. 2457T
guuacggacuuuuuauuuaug

SEQ ID NO: 1942834 - RNA, 17 nt, Shigella flexneri 2a str. 2457T
guuacggugcgcagccg

SEQ ID NO: 1942835 - RNA, 19 nt, Shigella flexneri 2a str. 2457T
guuagugucuuaucuggca

SEQ ID NO: 1942836 - RNA, 17 nt, Shigella flexneri 2a str. 2457T
guucaaaaacuaauuca

SEQ ID NO: 1942837 - RNA, 20 nt, Shigella flexneri 2a str. 2457T
guuauccgacuuauucuuca

SEQ ID NO: 1942838 - RNA, 18 nt, Shigella flexneri 2a str. 2457T
guuauccgccagcgccau

SEQ ID NO: 1942839 - RNA, 19 nt, Shigella flexneri 2a str. 2457T
guuauacaucgcuuuccag

SEQ ID NO: 1942840 - RNA, 14 nt, Shigella flexneri 2a str. 2457T
guggacuggcugcg

SEQ ID NO: 1942841 - RNA, 16 nt, Shigella flexneri 2a str. 2457T
guggcgcuccacuuca

SEQ ID NO: 1942842 - RNA, 21 nt, Shigella flexneri 2a str. 2457T
guggcgcgaagcccucaaaca

SEQ ID NO: 1942843 - RNA, 13 nt, Shigella flexneri 2a str. 2457T
gugggcguugguc

SEQ ID NO: 1942844 - RNA, 18 nt, Shigella flexneri 2a str. 2457T
gugggaauaaccauggca

SEQ ID NO: 1942845 - RNA, 20 nt, Shigella flexneri 2a str. 2457T
guggugcuggacucccagaa

SEQ ID NO: 1942846 - RNA, 17 nt, Shigella flexneri 2a str. 2457T
guggugaggccagagca

SEQ ID NO: 1942847 - RNA, 19 nt, Shigella flexneri 2a str. 2457T
guggugaaggcacuggucg

SEQ ID NO: 1942848 - RNA, 19 nt, Shigella flexneri 2a str. 2457T
guggucagcagcuuucuuu

SEQ ID NO: 1942849 - RNA, 13 nt, Shigella flexneri 2a str. 2457T
guggucagcacaa

SEQ ID NO: 1942850 - RNA, 14 nt, Shigella flexneri 2a str. 2457T
guguaaaacagcac

SEQ ID NO: 1942851 - RNA, 14 nt, Shigella flexneri 2a str. 2457T
gugguuuggcggcg

SEQ ID NO: 1942852 - RNA, 15 nt, Shigella flexneri 2a str. 2457T
gugguuuggcggcgg

SEQ ID NO: 1942853 - RNA, 19 nt, Shigella flexneri 2a str. 2457T
guguacaaacccagccgcc

SEQ ID NO: 1942854 - RNA, 12 nt, Shigella flexneri 2a str. 2457T
guguagggcagg

SEQ ID NO: 1942855 - RNA, 23 nt, Shigella flexneri 2a str. 2457T
guguaguauuugaguucacugcc

SEQ ID NO: 1942856 - RNA, 21 nt, Shigella flexneri 2a str. 2457T
guguaucugggcgaaacagag

SEQ ID NO: 1942857 - RNA, 17 nt, Shigella flexneri 2a str. 2457T
guguaucuucagcugca

SEQ ID NO: 1942858 - RNA, 17 nt, Shigella flexneri 2a str. 2457T
guguauggcauugucug

SEQ ID NO: 1942859 - RNA, 22 nt, Shigella flexneri 2a str. 2457T
gugcuaguuaucuccuugcugg

SEQ ID NO: 1942860 - RNA, 18 nt, Shigella flexneri 2a str. 2457T
gugcuauuuuagaaaaac

SEQ ID NO: 1942861 - RNA, 17 nt, Shigella flexneri 2a str. 2457T
gugcucaaugagcaccu

SEQ ID NO: 1942862 - RNA, 22 nt, Shigella flexneri 2a str. 2457T
gugcucaaugagcaccuuuuuu

SEQ ID NO: 1942863 - RNA, 18 nt, Shigella flexneri 2a str. 2457T
gugcucaucagcccggca

SEQ ID NO: 1942864 - RNA, 14 nt, Shigella flexneri 2a str. 2457T
gugcucauagacca

SEQ ID NO: 1942865 - RNA, 21 nt, Shigella flexneri 2a str. 2457T
gugcugaacgaaaagcgcaca

SEQ ID NO: 1942866 - RNA, 20 nt, Shigella flexneri 2a str. 2457T
gugcugaaagggcaaauaau

SEQ ID NO: 1942867 - RNA, 14 nt, Shigella flexneri 2a str. 2457T
gugcucgcuuucca

SEQ ID NO: 1942868 - RNA, 22 nt, Shigella flexneri 2a str. 2457T
gugcuccagucguucaaccacu

SEQ ID NO: 1942869 - RNA, 13 nt, Shigella flexneri 2a str. 2457T
gugcuccauuguu

SEQ ID NO: 1942870 - RNA, 18 nt, Shigella flexneri 2a str. 2457T
gugcuuucaucaaaaaau

SEQ ID NO: 1942871 - RNA, 18 nt, Shigella flexneri 2a str. 2457T
gugcugaguuucagacca

SEQ ID NO: 1942872 - RNA, 18 nt, Shigella flexneri 2a str. 2457T
gugcugacagaaguaauc

SEQ ID NO: 1942873 - RNA, 14 nt, Shigella flexneri 2a str. 2457T
gugcgccacagaca

SEQ ID NO: 1942874 - RNA, 21 nt, Shigella flexneri 2a str. 2457T
gugcgcgauagauagcguucu

SEQ ID NO: 1942875 - RNA, 19 nt, Shigella flexneri 2a str. 2457T
gugcgcccuguucugcaag

SEQ ID NO: 1942876 - RNA, 14 nt, Shigella flexneri 2a str. 2457T
gugcgcggcagcca

SEQ ID NO: 1942877 - RNA, 18 nt, Shigella flexneri 2a str. 2457T
gugcgcgugagcugggau

SEQ ID NO: 1942878 - RNA, 17 nt, Shigella flexneri 2a str. 2457T
gugcgguaagcugcggu

SEQ ID NO: 1942879 - RNA, 15 nt, Shigella flexneri 2a str. 2457T
gugcggucaggcauc

SEQ ID NO: 1942880 - RNA, 19 nt, Shigella flexneri 2a str. 2457T
gugcgguuucagcucacgg

SEQ ID NO: 1942881 - RNA, 22 nt, Shigella flexneri 2a str. 2457T
gucucaagggaggagucauccu

SEQ ID NO: 1942882 - RNA, 14 nt, Shigella flexneri 2a str. 2457T
gugauacagcaaaa

SEQ ID NO: 1942883 - RNA, 16 nt, Shigella flexneri 2a str. 2457T
gucuaguaaagcagac

SEQ ID NO: 1942884 - RNA, 20 nt, Shigella flexneri 2a str. 2457T
gugauguuccgcuuguugcu

SEQ ID NO: 1942885 - RNA, 15 nt, Shigella flexneri 2a str. 2457T
gugauuaaagaaaau

SEQ ID NO: 1942886 - RNA, 12 nt, Shigella flexneri 2a str. 2457T
gugaugguggug

SEQ ID NO: 1942887 - RNA, 19 nt, Shigella flexneri 2a str. 2457T
gugauggugauaaucaguu

SEQ ID NO: 1942888 - RNA, 21 nt, Shigella flexneri 2a str. 2457T
gugauguagucaucugcaccg

SEQ ID NO: 1942889 - RNA, 20 nt, Shigella flexneri 2a str. 2457T
gugaugcguccgcuaguggc

SEQ ID NO: 1942890 - RNA, 14 nt, Shigella flexneri 2a str. 2457T
gugaugccaucggg

SEQ ID NO: 1942891 - RNA, 21 nt, Shigella flexneri 2a str. 2457T
gugcauaaauaccggcauguu

SEQ ID NO: 1942892 - RNA, 15 nt, Shigella flexneri 2a str. 2457T
gugcaucauggaagc

SEQ ID NO: 1942893 - RNA, 14 nt, Shigella flexneri 2a str. 2457T
gugcauccagcagc

SEQ ID NO: 1942894 - RNA, 16 nt, Shigella flexneri 2a str. 2457T
gugcaguuccugcaac

SEQ ID NO: 1942895 - RNA, 16 nt, Shigella flexneri 2a str. 2457T
gugcaaccuuuuccau

SEQ ID NO: 1942896 - RNA, 21 nt, Shigella flexneri 2a str. 2457T
gugcaaauugcaccauccauu

SEQ ID NO: 1942897 - RNA, 15 nt, Shigella flexneri 2a str. 2457T
gugcaaaugccagau

SEQ ID NO: 1942898 - RNA, 17 nt, Shigella flexneri 2a str. 2457T
gugcaaaugccagauaa

SEQ ID NO: 1942899 - RNA, 23 nt, Shigella flexneri 2a str. 2457T
gugcaaaugccagauaagacacu

SEQ ID NO: 1942900 - RNA, 16 nt, Shigella flexneri 2a str. 2457T
gugcacccgcuucagu

SEQ ID NO: 1942901 - RNA, 11 nt, Shigella flexneri 2a str. 2457T
gugcagcaucg

SEQ ID NO: 1942902 - RNA, 17 nt, Shigella flexneri 2a str. 2457T
gugcagcaugcacccuc

SEQ ID NO: 1942903 - RNA, 16 nt, Shigella flexneri 2a str. 2457T
gugcacgaaccagaga

SEQ ID NO: 1942904 - RNA, 22 nt, Shigella flexneri 2a str. 2457T
gugcaccggguaccagaaucac

SEQ ID NO: 1942905 - RNA, 21 nt, Shigella flexneri 2a str. 2457T
gugccgcagccccagagccug

SEQ ID NO: 1942906 - RNA, 13 nt, Shigella flexneri 2a str. 2457T
gugccgcagcuuc

SEQ ID NO: 1942907 - RNA, 20 nt, Shigella flexneri 2a str. 2457T
gugccgacaucgccacggca

SEQ ID NO: 1942908 - RNA, 22 nt, Shigella flexneri 2a str. 2457T
gugcccuuguugcuauggggaa

SEQ ID NO: 1942909 - RNA, 15 nt, Shigella flexneri 2a str. 2457T
gugcccguaaaaaau

SEQ ID NO: 1942910 - RNA, 16 nt, Shigella flexneri 2a str. 2457T
gugccaucgauaauca

SEQ ID NO: 1942911 - RNA, 12 nt, Shigella flexneri 2a str. 2457T
gugccauugacc

SEQ ID NO: 1942912 - RNA, 18 nt, Shigella flexneri 2a str. 2457T
gugccagguaaacaccuu

SEQ ID NO: 1942913 - RNA, 12 nt, Shigella flexneri 2a str. 2457T
gugccaggacca

SEQ ID NO: 1942914 - RNA, 23 nt, Shigella flexneri 2a str. 2457T
gugccacgcacaggugcaaaaaa

SEQ ID NO: 1942915 - RNA, 14 nt, Shigella flexneri 2a str. 2457T
gugccacauccagu

SEQ ID NO: 1942916 - RNA, 14 nt, Shigella flexneri 2a str. 2457T
gugccagauagcca

SEQ ID NO: 1942917 - RNA, 19 nt, Shigella flexneri 2a str. 2457T
gugccaccagugcaggcac

SEQ ID NO: 1942918 - RNA, 18 nt, Shigella flexneri 2a str. 2457T
gugcauuucucacuuuuc

SEQ ID NO: 1942919 - RNA, 16 nt, Shigella flexneri 2a str. 2457T
gugccaaaaaucgcaa

SEQ ID NO: 1942920 - RNA, 15 nt, Shigella flexneri 2a str. 2457T
gugccaagcuccagc

SEQ ID NO: 1942921 - RNA, 15 nt, Shigella flexneri 2a str. 2457T
gugccgcauugacgc

SEQ ID NO: 1942922 - RNA, 14 nt, Shigella flexneri 2a str. 2457T
gugccgcgacagau

SEQ ID NO: 1942923 - RNA, 22 nt, Shigella flexneri 2a str. 2457T
gugccgcgauaccacccgcagu

SEQ ID NO: 1942924 - RNA, 18 nt, Shigella flexneri 2a str. 2457T
gugccggaaggaagacgc

SEQ ID NO: 1942925 - RNA, 16 nt, Shigella flexneri 2a str. 2457T
gugccggaagucucuu

SEQ ID NO: 1942926 - RNA, 22 nt, Shigella flexneri 2a str. 2457T
gugccggcaacaauauuaacuc

SEQ ID NO: 1942927 - RNA, 15 nt, Shigella flexneri 2a str. 2457T
gugccggaaggggcg

SEQ ID NO: 1942928 - RNA, 23 nt, Shigella flexneri 2a str. 2457T
gugccguaaaucccagugccugc

SEQ ID NO: 1942929 - RNA, 22 nt, Shigella flexneri 2a str. 2457T
gugccuaacaauucgccagggc

SEQ ID NO: 1942930 - RNA, 22 nt, Shigella flexneri 2a str. 2457T
gugccugagccggaguugcaga

SEQ ID NO: 1942931 - RNA, 17 nt, Shigella flexneri 2a str. 2457T
gugccugcauaaacgcc

SEQ ID NO: 1942932 - RNA, 16 nt, Shigella flexneri 2a str. 2457T
guccacugcgagaaaa

SEQ ID NO: 1942933 - RNA, 19 nt, Shigella flexneri 2a str. 2457T
guccacgguugguuuuauc

SEQ ID NO: 1942934 - RNA, 13 nt, Shigella flexneri 2a str. 2457T
guccacggugcga

SEQ ID NO: 1942935 - RNA, 16 nt, Shigella flexneri 2a str. 2457T
guccagauaauaauca

SEQ ID NO: 1942936 - RNA, 13 nt, Shigella flexneri 2a str. 2457T
gucauuccuucaa

SEQ ID NO: 1942937 - RNA, 14 nt, Shigella flexneri 2a str. 2457T
gucauugacgcugg

SEQ ID NO: 1942938 - RNA, 17 nt, Shigella flexneri 2a str. 2457T
gucauagguucuuuuaa

SEQ ID NO: 1942939 - RNA, 19 nt, Shigella flexneri 2a str. 2457T
gucauagguucuuuuaaau

SEQ ID NO: 1942940 - RNA, 18 nt, Shigella flexneri 2a str. 2457T
gucauacgcguaaaacag

SEQ ID NO: 1942941 - RNA, 13 nt, Shigella flexneri 2a str. 2457T
gucaguuggcugu

SEQ ID NO: 1942942 - RNA, 16 nt, Shigella flexneri 2a str. 2457T
gucaguuggcuguggu

SEQ ID NO: 1942943 - RNA, 17 nt, Shigella flexneri 2a str. 2457T
gucauaauaugaccuga

SEQ ID NO: 1942944 - RNA, 15 nt, Shigella flexneri 2a str. 2457T
gucaugacuacacua

SEQ ID NO: 1942945 - RNA, 21 nt, Shigella flexneri 2a str. 2457T
gucauauagccgcgcaguuuc

SEQ ID NO: 1942946 - RNA, 22 nt, Shigella flexneri 2a str. 2457T
gucauuacgggcaaucaucacc

SEQ ID NO: 1942947 - RNA, 21 nt, Shigella flexneri 2a str. 2457T
guccccacaucacuccaucca

SEQ ID NO: 1942948 - RNA, 22 nt, Shigella flexneri 2a str. 2457T
guccaguuugccuucacaggcc

SEQ ID NO: 1942949 - RNA, 18 nt, Shigella flexneri 2a str. 2457T
guccaguucccaaccauu

SEQ ID NO: 1942950 - RNA, 21 nt, Shigella flexneri 2a str. 2457T
guccagucgcaaaccuggcau

SEQ ID NO: 1942951 - RNA, 18 nt, Shigella flexneri 2a str. 2457T
guccccaguaaucgggca

SEQ ID NO: 1942952 - RNA, 21 nt, Shigella flexneri 2a str. 2457T
guccccaucaggaaacccgcc

SEQ ID NO: 1942953 - RNA, 13 nt, Shigella flexneri 2a str. 2457T
guccccgagcaca

SEQ ID NO: 1942954 - RNA, 15 nt, Shigella flexneri 2a str. 2457T
gucccguacccagca

SEQ ID NO: 1942955 - RNA, 12 nt, Shigella flexneri 2a str. 2457T
gucccuuucagg

SEQ ID NO: 1942956 - RNA, 17 nt, Shigella flexneri 2a str. 2457T
gucccugccgcggucug

SEQ ID NO: 1942957 - RNA, 22 nt, Shigella flexneri 2a str. 2457T
gucccuucgguagcagcuuuca

SEQ ID NO: 1942958 - RNA, 14 nt, Shigella flexneri 2a str. 2457T
gucagcucacaaau

SEQ ID NO: 1942959 - RNA, 13 nt, Shigella flexneri 2a str. 2457T
gucagcugcuguu

SEQ ID NO: 1942960 - RNA, 21 nt, Shigella flexneri 2a str. 2457T
gucagcucucagccagcuggc

SEQ ID NO: 1942961 - RNA, 22 nt, Shigella flexneri 2a str. 2457T
gucagcgucgcaucuggcauaa

SEQ ID NO: 1942962 - RNA, 17 nt, Shigella flexneri 2a str. 2457T
gucagcguuucaacaaa

SEQ ID NO: 1942963 - RNA, 20 nt, Shigella flexneri 2a str. 2457T
gucagaccggcaaccagcac

SEQ ID NO: 1942964 - RNA, 13 nt, Shigella flexneri 2a str. 2457T
gucagacagcgau

SEQ ID NO: 1942965 - RNA, 22 nt, Shigella flexneri 2a str. 2457T
gucacuuuuggugcuuuugcug

SEQ ID NO: 1942966 - RNA, 22 nt, Shigella flexneri 2a str. 2457T
gucagaaacaguuguaaaguac

SEQ ID NO: 1942967 - RNA, 13 nt, Shigella flexneri 2a str. 2457T
gucaggaucgugc

SEQ ID NO: 1942968 - RNA, 12 nt, Shigella flexneri 2a str. 2457T
gucaguaaugac

SEQ ID NO: 1942969 - RNA, 16 nt, Shigella flexneri 2a str. 2457T
gucaguacgccgccgu

SEQ ID NO: 1942970 - RNA, 17 nt, Shigella flexneri 2a str. 2457T
gucagcuucaccuucca

SEQ ID NO: 1942971 - RNA, 13 nt, Shigella flexneri 2a str. 2457T
gucaggagcugga

SEQ ID NO: 1942972 - RNA, 12 nt, Shigella flexneri 2a str. 2457T
gucaggaagccc

SEQ ID NO: 1942973 - RNA, 21 nt, Shigella flexneri 2a str. 2457T
gucaguggacgauaagcaccg

SEQ ID NO: 1942974 - RNA, 14 nt, Shigella flexneri 2a str. 2457T
gucagucaucacuu

SEQ ID NO: 1942975 - RNA, 14 nt, Shigella flexneri 2a str. 2457T
gucaguuccauaau

SEQ ID NO: 1942976 - RNA, 22 nt, Shigella flexneri 2a str. 2457T
gucagugucuuaucuggcauuu

SEQ ID NO: 1942977 - RNA, 15 nt, Shigella flexneri 2a str. 2457T
gucagugucuuaucu

SEQ ID NO: 1942978 - RNA, 17 nt, Shigella flexneri 2a str. 2457T
gucacaugcagcgccug

SEQ ID NO: 1942979 - RNA, 15 nt, Shigella flexneri 2a str. 2457T
gucaccacuucaccc

SEQ ID NO: 1942980 - RNA, 22 nt, Shigella flexneri 2a str. 2457T
gucaccacggccagguuaacca

SEQ ID NO: 1942981 - RNA, 15 nt, Shigella flexneri 2a str. 2457T
gucaccacccugccc

SEQ ID NO: 1942982 - RNA, 19 nt, Shigella flexneri 2a str. 2457T
gucaagggugucggcacac

SEQ ID NO: 1942983 - RNA, 19 nt, Shigella flexneri 2a str. 2457T
gucaauauuaucgauuuuc

SEQ ID NO: 1942984 - RNA, 22 nt, Shigella flexneri 2a str. 2457T
gucaauacuuucacaaaaauaa

SEQ ID NO: 1942985 - RNA, 23 nt, Shigella flexneri 2a str. 2457T
gucaauauuaucgauuuucugcu

SEQ ID NO: 1942986 - RNA, 16 nt, Shigella flexneri 2a str. 2457T
gucacaaaucucccuu

SEQ ID NO: 1942987 - RNA, 15 nt, Shigella flexneri 2a str. 2457T
gucacaucaggccau

SEQ ID NO: 1942988 - RNA, 16 nt, Shigella flexneri 2a str. 2457T
gucacaucaggccauc

SEQ ID NO: 1942989 - RNA, 15 nt, Shigella flexneri 2a str. 2457T
gucguccggcagcag

SEQ ID NO: 1942990 - RNA, 20 nt, Shigella flexneri 2a str. 2457T
gucguccggcagcagaaagc

SEQ ID NO: 1942991 - RNA, 14 nt, Shigella flexneri 2a str. 2457T
gucuaaaucuuccg

SEQ ID NO: 1942992 - RNA, 17 nt, Shigella flexneri 2a str. 2457T
gucuaccagcaccugcu

SEQ ID NO: 1942993 - RNA, 19 nt, Shigella flexneri 2a str. 2457T
gucuaauggugaacugaca

SEQ ID NO: 1942994 - RNA, 21 nt, Shigella flexneri 2a str. 2457T
gucgggugcgacaggagccgc

SEQ ID NO: 1942995 - RNA, 20 nt, Shigella flexneri 2a str. 2457T
gucgguaauuucacaaguug

SEQ ID NO: 1942996 - RNA, 20 nt, Shigella flexneri 2a str. 2457T
gucgucagcaguucacgcag

SEQ ID NO: 1942997 - RNA, 15 nt, Shigella flexneri 2a str. 2457T
gucgccagcaacaca

SEQ ID NO: 1942998 - RNA, 18 nt, Shigella flexneri 2a str. 2457T
gucgcuccugccacauau

SEQ ID NO: 1942999 - RNA, 21 nt, Shigella flexneri 2a str. 2457T
gucggacgcuguuccggcggc

SEQ ID NO: 1943000 - RNA, 22 nt, Shigella flexneri 2a str. 2457T
gucggaucgcugaacgcaccuu

SEQ ID NO: 1943001 - RNA, 22 nt, Shigella flexneri 2a str. 2457T
guccguacccgguugacugcug

SEQ ID NO: 1943002 - RNA, 15 nt, Shigella flexneri 2a str. 2457T
guccgguuuacuucc

SEQ ID NO: 1943003 - RNA, 14 nt, Shigella flexneri 2a str. 2457T
guccgccguagccg

SEQ ID NO: 1943004 - RNA, 15 nt, Shigella flexneri 2a str. 2457T
guccucuucccagac

SEQ ID NO: 1943005 - RNA, 17 nt, Shigella flexneri 2a str. 2457T
guccucgccguuuucug

SEQ ID NO: 1943006 - RNA, 21 nt, Shigella flexneri 2a str. 2457T
guccuguaaugagaauaauca

SEQ ID NO: 1943007 - RNA, 18 nt, Shigella flexneri 2a str. 2457T
guccuguugaaaaaccag

SEQ ID NO: 1943008 - RNA, 20 nt, Shigella flexneri 2a str. 2457T
gucgaacucauacaccagcg

SEQ ID NO: 1943009 - RNA, 13 nt, Shigella flexneri 2a str. 2457T
guccuucaggccc

SEQ ID NO: 1943010 - RNA, 21 nt, Shigella flexneri 2a str. 2457T
guccuucaucuucauccggcu

SEQ ID NO: 1943011 - RNA, 18 nt, Shigella flexneri 2a str. 2457T
gucgaaagcccaucaucc

SEQ ID NO: 1943012 - RNA, 14 nt, Shigella flexneri 2a str. 2457T
gucgaggcaaccag

SEQ ID NO: 1943013 - RNA, 15 nt, Shigella flexneri 2a str. 2457T
gucgaggcaaccagc

SEQ ID NO: 1943014 - RNA, 16 nt, Shigella flexneri 2a str. 2457T
gucgagaauaucgaua

SEQ ID NO: 1943015 - RNA, 17 nt, Shigella flexneri 2a str. 2457T
gucgacuucagauaaau

SEQ ID NO: 1943016 - RNA, 18 nt, Shigella flexneri 2a str. 2457T
gucgaauggcaucuacgc

SEQ ID NO: 1943017 - RNA, 12 nt, Shigella flexneri 2a str. 2457T
gucgacacagau

SEQ ID NO: 1943018 - RNA, 16 nt, Shigella flexneri 2a str. 2457T
gucgcaguagccaugc

SEQ ID NO: 1943019 - RNA, 18 nt, Shigella flexneri 2a str. 2457T
gucgcaucaggcaucaug

SEQ ID NO: 1943020 - RNA, 15 nt, Shigella flexneri 2a str. 2457T
gucgcagcugccugc

SEQ ID NO: 1943021 - RNA, 14 nt, Shigella flexneri 2a str. 2457T
gucgccaacuucau

SEQ ID NO: 1943022 - RNA, 23 nt, Shigella flexneri 2a str. 2457T
gucgcauccggcaugaacaaagc

SEQ ID NO: 1943023 - RNA, 18 nt, Shigella flexneri 2a str. 2457T
gucgcauccggcaauuac

SEQ ID NO: 1943024 - RNA, 13 nt, Shigella flexneri 2a str. 2457T
guauuuuuugcuc

SEQ ID NO: 1943025 - RNA, 12 nt, Shigella flexneri 2a str. 2457T
guauuuuuaauu

SEQ ID NO: 1943026 - RNA, 15 nt, Shigella flexneri 2a str. 2457T
gucaaaauuagagau

SEQ ID NO: 1943027 - RNA, 16 nt, Shigella flexneri 2a str. 2457T
gucaaaaucaaaauaa

SEQ ID NO: 1943028 - RNA, 17 nt, Shigella flexneri 2a str. 2457T
gucaaaaucauccgucg

SEQ ID NO: 1943029 - RNA, 20 nt, Shigella flexneri 2a str. 2457T
gucaaaauccauuuucuauu

SEQ ID NO: 1943030 - RNA, 12 nt, Shigella flexneri 2a str. 2457T
gucaaaaaaacg

SEQ ID NO: 1943031 - RNA, 14 nt, Shigella flexneri 2a str. 2457T
gucaacagggcaga

SEQ ID NO: 1943032 - RNA, 18 nt, Shigella flexneri 2a str. 2457T
gucaaacgggcuucuaau

SEQ ID NO: 1943033 - RNA, 11 nt, Shigella flexneri 2a str. 2457T
guauuuccagg

SEQ ID NO: 1943034 - RNA, 12 nt, Shigella flexneri 2a str. 2457T
guauuuccaggg

SEQ ID NO: 1943035 - RNA, 13 nt, Shigella flexneri 2a str. 2457T
guauuuccagggc

SEQ ID NO: 1943036 - RNA, 14 nt, Shigella flexneri 2a str. 2457T
guauuguccugcaa

SEQ ID NO: 1943037 - RNA, 15 nt, Shigella flexneri 2a str. 2457T
guauuguuaaauauu

SEQ ID NO: 1943038 - RNA, 22 nt, Shigella flexneri 2a str. 2457T
guauuggaagguuaauaaauau

SEQ ID NO: 1943039 - RNA, 21 nt, Shigella flexneri 2a str. 2457T
guauugcucaacuucgcuaaa

SEQ ID NO: 1943040 - RNA, 21 nt, Shigella flexneri 2a str. 2457T
guauugccguuucgcagguuc

SEQ ID NO: 1943041 - RNA, 17 nt, Shigella flexneri 2a str. 2457T
guauuaucgauaaacgc

SEQ ID NO: 1943042 - RNA, 15 nt, Shigella flexneri 2a str. 2457T
guauucagcaauucu

SEQ ID NO: 1943043 - RNA, 19 nt, Shigella flexneri 2a str. 2457T
guauucaaccguuuccagu

SEQ ID NO: 1943044 - RNA, 16 nt, Shigella flexneri 2a str. 2457T
guauuacaacgugcuc

SEQ ID NO: 1943045 - RNA, 15 nt, Shigella flexneri 2a str. 2457T
guauuacuccagaua

SEQ ID NO: 1943046 - RNA, 18 nt, Shigella flexneri 2a str. 2457T
guauuagaugcuaguuau

SEQ ID NO: 1943047 - RNA, 16 nt, Shigella flexneri 2a str. 2457T
guaugucgaucaccca

SEQ ID NO: 1943048 - RNA, 19 nt, Shigella flexneri 2a str. 2457T
guauggagcaggaauauac

SEQ ID NO: 1943049 - RNA, 16 nt, Shigella flexneri 2a str. 2457T
guauggaaaucaccca

SEQ ID NO: 1943050 - RNA, 23 nt, Shigella flexneri 2a str. 2457T
guaugcuuccuaacauaaugcaa

SEQ ID NO: 1943051 - RNA, 12 nt, Shigella flexneri 2a str. 2457T
guaugccuggca

SEQ ID NO: 1943052 - RNA, 14 nt, Shigella flexneri 2a str. 2457T
guaugccuggcauu

SEQ ID NO: 1943053 - RNA, 14 nt, Shigella flexneri 2a str. 2457T
guaucaucgcugaa

SEQ ID NO: 1943054 - RNA, 22 nt, Shigella flexneri 2a str. 2457T
guaucaucauuauuaauauuca

SEQ ID NO: 1943055 - RNA, 19 nt, Shigella flexneri 2a str. 2457T
guaucagcgucauuaccca

SEQ ID NO: 1943056 - RNA, 14 nt, Shigella flexneri 2a str. 2457T
guaucaggcugugu

SEQ ID NO: 1943057 - RNA, 16 nt, Shigella flexneri 2a str. 2457T
guaucaucauuauuaa

SEQ ID NO: 1943058 - RNA, 16 nt, Shigella flexneri 2a str. 2457T
guaucaccccgcccga

SEQ ID NO: 1943059 - RNA, 20 nt, Shigella flexneri 2a str. 2457T
guaucccaguucgauuuccc

SEQ ID NO: 1943060 - RNA, 18 nt, Shigella flexneri 2a str. 2457T
guaucgcgaaaaaaagau

SEQ ID NO: 1943061 - RNA, 15 nt, Shigella flexneri 2a str. 2457T
guaucguggcgcagc

SEQ ID NO: 1943062 - RNA, 14 nt, Shigella flexneri 2a str. 2457T
guauccuguuuuua

SEQ ID NO: 1943063 - RNA, 15 nt, Shigella flexneri 2a str. 2457T
guauccuguuuuuaa

SEQ ID NO: 1943064 - RNA, 17 nt, Shigella flexneri 2a str. 2457T
guauccugucauacgcg

SEQ ID NO: 1943065 - RNA, 12 nt, Shigella flexneri 2a str. 2457T
guaucuauucac

SEQ ID NO: 1943066 - RNA, 17 nt, Shigella flexneri 2a str. 2457T
guaucuucaugcuccag

SEQ ID NO: 1943067 - RNA, 19 nt, Shigella flexneri 2a str. 2457T
guaucuucaugcuccagca

SEQ ID NO: 1943068 - RNA, 11 nt, Shigella flexneri 2a str. 2457T
guaucaaagcg

SEQ ID NO: 1943069 - RNA, 21 nt, Shigella flexneri 2a str. 2457T
guaucaaacacaggcaaaaca

SEQ ID NO: 1943070 - RNA, 20 nt, Shigella flexneri 2a str. 2457T
guauaguguccacaggaaaa

SEQ ID NO: 1943071 - RNA, 12 nt, Shigella flexneri 2a str. 2457T
guaguuucuccc

SEQ ID NO: 1943072 - RNA, 19 nt, Shigella flexneri 2a str. 2457T
guaguuaugaaaauaggaa

SEQ ID NO: 1943073 - RNA, 14 nt, Shigella flexneri 2a str. 2457T
guaguuccagcaug

SEQ ID NO: 1943074 - RNA, 14 nt, Shigella flexneri 2a str. 2457T
guaguugaucgccc

SEQ ID NO: 1943075 - RNA, 18 nt, Shigella flexneri 2a str. 2457T
guauaaacuauccugugc

SEQ ID NO: 1943076 - RNA, 23 nt, Shigella flexneri 2a str. 2457T
guauaaacgugugugccagguuc

SEQ ID NO: 1943077 - RNA, 16 nt, Shigella flexneri 2a str. 2457T
guauaaguccauaacu

SEQ ID NO: 1943078 - RNA, 23 nt, Shigella flexneri 2a str. 2457T
guauaaucaccaaucacaacuaa

SEQ ID NO: 1943079 - RNA, 16 nt, Shigella flexneri 2a str. 2457T
guauacaacauucagg

SEQ ID NO: 1943080 - RNA, 17 nt, Shigella flexneri 2a str. 2457T
guagccuuuuucagccg

SEQ ID NO: 1943081 - RNA, 18 nt, Shigella flexneri 2a str. 2457T
guaggccggauaaggcgc

SEQ ID NO: 1943082 - RNA, 15 nt, Shigella flexneri 2a str. 2457T
guaguauccacacca

SEQ ID NO: 1943083 - RNA, 16 nt, Shigella flexneri 2a str. 2457T
guaguauagaaagaua

SEQ ID NO: 1943084 - RNA, 16 nt, Shigella flexneri 2a str. 2457T
guaguggaucagcaaa

SEQ ID NO: 1943085 - RNA, 14 nt, Shigella flexneri 2a str. 2457T
guaguggccacaga

SEQ ID NO: 1943086 - RNA, 15 nt, Shigella flexneri 2a str. 2457T
guagugcccgcagua

SEQ ID NO: 1943087 - RNA, 15 nt, Shigella flexneri 2a str. 2457T
guagugaaggcaaac

SEQ ID NO: 1943088 - RNA, 14 nt, Shigella flexneri 2a str. 2457T
guagccauucccuc

SEQ ID NO: 1943089 - RNA, 23 nt, Shigella flexneri 2a str. 2457T
guagccauuugauucacaaggcc

SEQ ID NO: 1943090 - RNA, 21 nt, Shigella flexneri 2a str. 2457T
guagccccaauguucguccau

SEQ ID NO: 1943091 - RNA, 18 nt, Shigella flexneri 2a str. 2457T
guagccccagucuuccug

SEQ ID NO: 1943092 - RNA, 23 nt, Shigella flexneri 2a str. 2457T
guagccaaucccggaagccacca

SEQ ID NO: 1943093 - RNA, 14 nt, Shigella flexneri 2a str. 2457T
guagccagacaaug

SEQ ID NO: 1943094 - RNA, 15 nt, Shigella flexneri 2a str. 2457T
guagcaggccggaga

SEQ ID NO: 1943095 - RNA, 15 nt, Shigella flexneri 2a str. 2457T
guagcagcuuucagc

SEQ ID NO: 1943096 - RNA, 13 nt, Shigella flexneri 2a str. 2457T
guagaugauuuuu

SEQ ID NO: 1943097 - RNA, 18 nt, Shigella flexneri 2a str. 2457T
guagcacgucaucugcac

SEQ ID NO: 1943098 - RNA, 18 nt, Shigella flexneri 2a str. 2457T
guagaguuugaacucaca

SEQ ID NO: 1943099 - RNA, 20 nt, Shigella flexneri 2a str. 2457T
guagacgagccguuccuaac

SEQ ID NO: 1943100 - RNA, 13 nt, Shigella flexneri 2a str. 2457T
guagacugcagcg

SEQ ID NO: 1943101 - RNA, 18 nt, Shigella flexneri 2a str. 2457T
guagacugcagcggucac

SEQ ID NO: 1943102 - RNA, 15 nt, Shigella flexneri 2a str. 2457T
guagacucaagcagu

SEQ ID NO: 1943103 - RNA, 21 nt, Shigella flexneri 2a str. 2457T
guagacugcagcggucacaug

SEQ ID NO: 1943104 - RNA, 19 nt, Shigella flexneri 2a str. 2457T
guacuuuuacugucugcuc

SEQ ID NO: 1943105 - RNA, 23 nt, Shigella flexneri 2a str. 2457T
guacuguuucacuguugaagccg

SEQ ID NO: 1943106 - RNA, 21 nt, Shigella flexneri 2a str. 2457T
guagaacccuaccagcugcca

SEQ ID NO: 1943107 - RNA, 16 nt, Shigella flexneri 2a str. 2457T
guagaaauuauuucuu

SEQ ID NO: 1943108 - RNA, 14 nt, Shigella flexneri 2a str. 2457T
guacucaucgcccg

SEQ ID NO: 1943109 - RNA, 15 nt, Shigella flexneri 2a str. 2457T
guacucaccgcucac

SEQ ID NO: 1943110 - RNA, 20 nt, Shigella flexneri 2a str. 2457T
guacucaccagacaucccag

SEQ ID NO: 1943111 - RNA, 13 nt, Shigella flexneri 2a str. 2457T
guacuccagcaga

SEQ ID NO: 1943112 - RNA, 15 nt, Shigella flexneri 2a str. 2457T
guacguggaggaugg

SEQ ID NO: 1943113 - RNA, 13 nt, Shigella flexneri 2a str. 2457T
guacgucgagaau

SEQ ID NO: 1943114 - RNA, 24 nt, Shigella flexneri 2a str. 2457T
guacugaccgucgccuucaacgua

SEQ ID NO: 1943115 - RNA, 21 nt, Shigella flexneri 2a str. 2457T
guacugacggcguucuuuaca

SEQ ID NO: 1943116 - RNA, 18 nt, Shigella flexneri 2a str. 2457T
guacuggcaaucgccagc

SEQ ID NO: 1943117 - RNA, 19 nt, Shigella flexneri 2a str. 2457T
guacuggcgugggcaucga

SEQ ID NO: 1943118 - RNA, 21 nt, Shigella flexneri 2a str. 2457T
guaaaacggauaugauuuaaa

SEQ ID NO: 1943119 - RNA, 21 nt, Shigella flexneri 2a str. 2457T
guaaaaccgcgaugaccaaaa

SEQ ID NO: 1943120 - RNA, 20 nt, Shigella flexneri 2a str. 2457T
guaaaaggcgccauuuucau

SEQ ID NO: 1943121 - RNA, 16 nt, Shigella flexneri 2a str. 2457T
guaaacccagccgcgu

SEQ ID NO: 1943122 - RNA, 16 nt, Shigella flexneri 2a str. 2457T
guaaaccgcucgucac

SEQ ID NO: 1943123 - RNA, 19 nt, Shigella flexneri 2a str. 2457T
guaaaccgcucgucacauc

SEQ ID NO: 1943124 - RNA, 21 nt, Shigella flexneri 2a str. 2457T
guaaacagauaggcaucagca

SEQ ID NO: 1943125 - RNA, 11 nt, Shigella flexneri 2a str. 2457T
guaaacaacau

SEQ ID NO: 1943126 - RNA, 15 nt, Shigella flexneri 2a str. 2457T
guaaacaaacaacgc

SEQ ID NO: 1943127 - RNA, 17 nt, Shigella flexneri 2a str. 2457T
guaaacgugcggcugug

SEQ ID NO: 1943128 - RNA, 14 nt, Shigella flexneri 2a str. 2457T
guaaacgccuaaua

SEQ ID NO: 1943129 - RNA, 14 nt, Shigella flexneri 2a str. 2457T
guaaaccucuuucg

SEQ ID NO: 1943130 - RNA, 14 nt, Shigella flexneri 2a str. 2457T
guaaacucaaaguc

SEQ ID NO: 1943131 - RNA, 22 nt, Shigella flexneri 2a str. 2457T
guaaagugcgagucgucaguuc

SEQ ID NO: 1943132 - RNA, 22 nt, Shigella flexneri 2a str. 2457T
guaaaguacaauaucccugugu

SEQ ID NO: 1943133 - RNA, 14 nt, Shigella flexneri 2a str. 2457T
guaaaggcggcaga

SEQ ID NO: 1943134 - RNA, 18 nt, Shigella flexneri 2a str. 2457T
guaaaggcggcagaacag

SEQ ID NO: 1943135 - RNA, 13 nt, Shigella flexneri 2a str. 2457T
guaaagccgauua

SEQ ID NO: 1943136 - RNA, 20 nt, Shigella flexneri 2a str. 2457T
guaaagcccauaccacagca

SEQ ID NO: 1943137 - RNA, 19 nt, Shigella flexneri 2a str. 2457T
guaaauugaugugaaaacu

SEQ ID NO: 1943138 - RNA, 21 nt, Shigella flexneri 2a str. 2457T
guaaauugaugugaaaacucu

SEQ ID NO: 1943139 - RNA, 17 nt, Shigella flexneri 2a str. 2457T
guaaauugcaaaccuca

SEQ ID NO: 1943140 - RNA, 21 nt, Shigella flexneri 2a str. 2457T
guaaauucucgcuaauuuauu

SEQ ID NO: 1943141 - RNA, 14 nt, Shigella flexneri 2a str. 2457T
guaaaugagcguuu

SEQ ID NO: 1943142 - RNA, 14 nt, Shigella flexneri 2a str. 2457T
guaaaugcagauaa

SEQ ID NO: 1943143 - RNA, 22 nt, Shigella flexneri 2a str. 2457T
guaaaugccgacuuuguuuuua

SEQ ID NO: 1943144 - RNA, 12 nt, Shigella flexneri 2a str. 2457T
guaaaucaccag

SEQ ID NO: 1943145 - RNA, 15 nt, Shigella flexneri 2a str. 2457T
guaaauaucggcauu

SEQ ID NO: 1943146 - RNA, 14 nt, Shigella flexneri 2a str. 2457T
guaaaucaaaccaa

SEQ ID NO: 1943147 - RNA, 15 nt, Shigella flexneri 2a str. 2457T
guaacagcggacggc

SEQ ID NO: 1943148 - RNA, 13 nt, Shigella flexneri 2a str. 2457T
guaacaaaacuca

SEQ ID NO: 1943149 - RNA, 16 nt, Shigella flexneri 2a str. 2457T
guaacaauauuugcag

SEQ ID NO: 1943150 - RNA, 17 nt, Shigella flexneri 2a str. 2457T
guaacaaagccugcacc

SEQ ID NO: 1943151 - RNA, 15 nt, Shigella flexneri 2a str. 2457T
guaaauugccccaga

SEQ ID NO: 1943152 - RNA, 16 nt, Shigella flexneri 2a str. 2457T
guaacagucaguuauc

SEQ ID NO: 1943153 - RNA, 14 nt, Shigella flexneri 2a str. 2457T
guaacaucccugua

SEQ ID NO: 1943154 - RNA, 14 nt, Shigella flexneri 2a str. 2457T
guaaccacgcagcg

SEQ ID NO: 1943155 - RNA, 13 nt, Shigella flexneri 2a str. 2457T
guaacagagcauc

SEQ ID NO: 1943156 - RNA, 22 nt, Shigella flexneri 2a str. 2457T
guaacagugcaccggacacugc

SEQ ID NO: 1943157 - RNA, 16 nt, Shigella flexneri 2a str. 2457T
guaacaguuaccuuua

SEQ ID NO: 1943158 - RNA, 18 nt, Shigella flexneri 2a str. 2457T
guaacaugcucuuugaug

SEQ ID NO: 1943159 - RNA, 20 nt, Shigella flexneri 2a str. 2457T
guaauagauccuuuuuccca

SEQ ID NO: 1943160 - RNA, 19 nt, Shigella flexneri 2a str. 2457T
guaauaaagcccccuguuu

SEQ ID NO: 1943161 - RNA, 16 nt, Shigella flexneri 2a str. 2457T
guaauaaaaucuauua

SEQ ID NO: 1943162 - RNA, 19 nt, Shigella flexneri 2a str. 2457T
guaauaaaaucuauuauua

SEQ ID NO: 1943163 - RNA, 21 nt, Shigella flexneri 2a str. 2457T
guaauaacaauacaucuuuuc

SEQ ID NO: 1943164 - RNA, 15 nt, Shigella flexneri 2a str. 2457T
guaauaacuuccuga

SEQ ID NO: 1943165 - RNA, 18 nt, Shigella flexneri 2a str. 2457T
guaauacaaccugcugga

SEQ ID NO: 1943166 - RNA, 18 nt, Shigella flexneri 2a str. 2457T
guaauaaugcccaucgug

SEQ ID NO: 1943167 - RNA, 17 nt, Shigella flexneri 2a str. 2457T
guaaggcaucuucuuca

SEQ ID NO: 1943168 - RNA, 16 nt, Shigella flexneri 2a str. 2457T
guaaggcuucaaucaa

SEQ ID NO: 1943169 - RNA, 21 nt, Shigella flexneri 2a str. 2457T
guaagcgcggauuuuauucag

SEQ ID NO: 1943170 - RNA, 20 nt, Shigella flexneri 2a str. 2457T
guaagcgcguguuacuggaa

SEQ ID NO: 1943171 - RNA, 22 nt, Shigella flexneri 2a str. 2457T
guaagcugugcgauagcaacga

SEQ ID NO: 1943172 - RNA, 15 nt, Shigella flexneri 2a str. 2457T
guaagcguacagcga

SEQ ID NO: 1943173 - RNA, 14 nt, Shigella flexneri 2a str. 2457T
guaagcgauaacgc

SEQ ID NO: 1943174 - RNA, 23 nt, Shigella flexneri 2a str. 2457T
guaagcgauaaaaauaccgagca

SEQ ID NO: 1943175 - RNA, 14 nt, Shigella flexneri 2a str. 2457T
guaaguaagauaaa

SEQ ID NO: 1943176 - RNA, 13 nt, Shigella flexneri 2a str. 2457T
guaaggucaucaa

SEQ ID NO: 1943177 - RNA, 22 nt, Shigella flexneri 2a str. 2457T
guaaguuacauuuuaauaauga

SEQ ID NO: 1943178 - RNA, 13 nt, Shigella flexneri 2a str. 2457T
guaaguuuaaccu

SEQ ID NO: 1943179 - RNA, 13 nt, Shigella flexneri 2a str. 2457T
guaaguggaugcc

SEQ ID NO: 1943180 - RNA, 15 nt, Shigella flexneri 2a str. 2457T
guaacugaagcauug

SEQ ID NO: 1943181 - RNA, 15 nt, Shigella flexneri 2a str. 2457T
guaacucauugccag

SEQ ID NO: 1943182 - RNA, 16 nt, Shigella flexneri 2a str. 2457T
guaacugagcggccag

SEQ ID NO: 1943183 - RNA, 17 nt, Shigella flexneri 2a str. 2457T
guaacuuaucuguaauu

SEQ ID NO: 1943184 - RNA, 17 nt, Shigella flexneri 2a str. 2457T
guaacugucuucaccau

SEQ ID NO: 1943185 - RNA, 21 nt, Shigella flexneri 2a str. 2457T
guaacugucuucaccauaguu

SEQ ID NO: 1943186 - RNA, 14 nt, Shigella flexneri 2a str. 2457T
guaagaacguaaau

SEQ ID NO: 1943187 - RNA, 15 nt, Shigella flexneri 2a str. 2457T
guaagagaacagaua

SEQ ID NO: 1943188 - RNA, 21 nt, Shigella flexneri 2a str. 2457T
guaagaguuucaacaucaucu

SEQ ID NO: 1943189 - RNA, 16 nt, Shigella flexneri 2a str. 2457T
guaacucacugaugcc

SEQ ID NO: 1943190 - RNA, 18 nt, Shigella flexneri 2a str. 2457T
guaacgcacugguggugc

SEQ ID NO: 1943191 - RNA, 16 nt, Shigella flexneri 2a str. 2457T
guaacgcuugcugaua

SEQ ID NO: 1943192 - RNA, 13 nt, Shigella flexneri 2a str. 2457T
guaacgacugcgg

SEQ ID NO: 1943193 - RNA, 18 nt, Shigella flexneri 2a str. 2457T
guaacgagacaaugcaaa

SEQ ID NO: 1943194 - RNA, 19 nt, Shigella flexneri 2a str. 2457T
guaacgauggcaauuuuca

SEQ ID NO: 1943195 - RNA, 22 nt, Shigella flexneri 2a str. 2457T
guaacgcacacauccacaaugc

SEQ ID NO: 1943196 - RNA, 16 nt, Shigella flexneri 2a str. 2457T
guaacgaccaccaccg

SEQ ID NO: 1943197 - RNA, 18 nt, Shigella flexneri 2a str. 2457T
guaaccguugaccagcau

SEQ ID NO: 1943198 - RNA, 21 nt, Shigella flexneri 2a str. 2457T
guaauugagaaccacaaugaa

SEQ ID NO: 1943199 - RNA, 18 nt, Shigella flexneri 2a str. 2457T
guaauugaucucacaauc

SEQ ID NO: 1943200 - RNA, 20 nt, Shigella flexneri 2a str. 2457T
guaauugcuuuuaccauacu

SEQ ID NO: 1943201 - RNA, 18 nt, Shigella flexneri 2a str. 2457T
guaauuggccugacaggu

SEQ ID NO: 1943202 - RNA, 20 nt, Shigella flexneri 2a str. 2457T
guaauuggccugacagguga

SEQ ID NO: 1943203 - RNA, 19 nt, Shigella flexneri 2a str. 2457T
guaauuuaacaacucacca

SEQ ID NO: 1943204 - RNA, 15 nt, Shigella flexneri 2a str. 2457T
guaauuucacaaguu

SEQ ID NO: 1943205 - RNA, 21 nt, Shigella flexneri 2a str. 2457T
guaaugucggugaaaguaacu

SEQ ID NO: 1943206 - RNA, 14 nt, Shigella flexneri 2a str. 2457T
guaauuaagcccgg

SEQ ID NO: 1943207 - RNA, 12 nt, Shigella flexneri 2a str. 2457T
guacaaccgcaa

SEQ ID NO: 1943208 - RNA, 13 nt, Shigella flexneri 2a str. 2457T
guacaaacaucau

SEQ ID NO: 1943209 - RNA, 17 nt, Shigella flexneri 2a str. 2457T
guacaaagccaacagca

SEQ ID NO: 1943210 - RNA, 19 nt, Shigella flexneri 2a str. 2457T
guacaaucguuucaugcca

SEQ ID NO: 1943211 - RNA, 15 nt, Shigella flexneri 2a str. 2457T
guacaccaacaucac

SEQ ID NO: 1943212 - RNA, 14 nt, Shigella flexneri 2a str. 2457T
guaaugauacuaua

SEQ ID NO: 1943213 - RNA, 15 nt, Shigella flexneri 2a str. 2457T
guaaugacuccaacu

SEQ ID NO: 1943214 - RNA, 19 nt, Shigella flexneri 2a str. 2457T
guaaugacuccaacuuacu

SEQ ID NO: 1943215 - RNA, 22 nt, Shigella flexneri 2a str. 2457T
guaaugccguuuuggguguaca

SEQ ID NO: 1943216 - RNA, 17 nt, Shigella flexneri 2a str. 2457T
guaaugcgguauccaac

SEQ ID NO: 1943217 - RNA, 12 nt, Shigella flexneri 2a str. 2457T
guaauggucagu

SEQ ID NO: 1943218 - RNA, 15 nt, Shigella flexneri 2a str. 2457T
guaaugggaucgaaa

SEQ ID NO: 1943219 - RNA, 23 nt, Shigella flexneri 2a str. 2457T
guaauccgggugaacugccacac

SEQ ID NO: 1943220 - RNA, 23 nt, Shigella flexneri 2a str. 2457T
guaauccucuuugcuuccugagu

SEQ ID NO: 1943221 - RNA, 22 nt, Shigella flexneri 2a str. 2457T
guaaucgcccgcuuccagcgca

SEQ ID NO: 1943222 - RNA, 19 nt, Shigella flexneri 2a str. 2457T
guaaucgccagcaaaauca

SEQ ID NO: 1943223 - RNA, 14 nt, Shigella flexneri 2a str. 2457T
guaaucgccagcaa

SEQ ID NO: 1943224 - RNA, 15 nt, Shigella flexneri 2a str. 2457T
guaaucgacaacgca

SEQ ID NO: 1943225 - RNA, 20 nt, Shigella flexneri 2a str. 2457T
guaaucaacuccgccagcaa

SEQ ID NO: 1943226 - RNA, 17 nt, Shigella flexneri 2a str. 2457T
guaaucaacauauuccc

SEQ ID NO: 1943227 - RNA, 20 nt, Shigella flexneri 2a str. 2457T
guaaucaacauauuccccug

SEQ ID NO: 1943228 - RNA, 14 nt, Shigella flexneri 2a str. 2457T
guaaucauauuaaa

SEQ ID NO: 1943229 - RNA, 15 nt, Shigella flexneri 2a str. 2457T
guaaucauauuaaau

SEQ ID NO: 1943230 - RNA, 16 nt, Shigella flexneri 2a str. 2457T
aaauagacacaagaaa

SEQ ID NO: 1943231 - RNA, 19 nt, Shigella flexneri 2a str. 2457T
aaauagacacaagaaauau

SEQ ID NO: 1943232 - RNA, 23 nt, Shigella flexneri 2a str. 2457T
aaauagagaaaguaaaccaccag

SEQ ID NO: 1943233 - RNA, 20 nt, Shigella flexneri 2a str. 2457T
aaauagaauggcaucagaag

SEQ ID NO: 1943234 - RNA, 22 nt, Shigella flexneri 2a str. 2457T
guacaggugccgcagccccaga

SEQ ID NO: 1943235 - RNA, 17 nt, Shigella flexneri 2a str. 2457T
guacaugaagcacugca

SEQ ID NO: 1943236 - RNA, 19 nt, Shigella flexneri 2a str. 2457T
guacaucaauaccauuauc

SEQ ID NO: 1943237 - RNA, 15 nt, Shigella flexneri 2a str. 2457T
guacaucaauaccau

SEQ ID NO: 1943238 - RNA, 19 nt, Shigella flexneri 2a str. 2457T
guacaucguagugaugcca

SEQ ID NO: 1943239 - RNA, 12 nt, Shigella flexneri 2a str. 2457T
guacaggcacau

SEQ ID NO: 1943240 - RNA, 15 nt, Shigella flexneri 2a str. 2457T
guacagccgccagac

SEQ ID NO: 1943241 - RNA, 22 nt, Shigella flexneri 2a str. 2457T
guacagcggcagggaaaacuca

SEQ ID NO: 1943242 - RNA, 14 nt, Shigella flexneri 2a str. 2457T
guacagccgccaga

SEQ ID NO: 1943243 - RNA, 14 nt, Shigella flexneri 2a str. 2457T
guacacuuuccugg

SEQ ID NO: 1943244 - RNA, 12 nt, Shigella flexneri 2a str. 2457T
guacagaaucug

SEQ ID NO: 1943245 - RNA, 19 nt, Shigella flexneri 2a str. 2457T
guacagacagauaaaaugc

SEQ ID NO: 1943246 - RNA, 18 nt, Shigella flexneri 2a str. 2457T
guacagagggcaggcaac

SEQ ID NO: 1943247 - RNA, 20 nt, Shigella flexneri 2a str. 2457T
guaccaccagaaucgccagc

SEQ ID NO: 1943248 - RNA, 15 nt, Shigella flexneri 2a str. 2457T
guacauuaaaauugg

SEQ ID NO: 1943249 - RNA, 14 nt, Shigella flexneri 2a str. 2457T
guaccaucgccagc

SEQ ID NO: 1943250 - RNA, 17 nt, Shigella flexneri 2a str. 2457T
guaccaugauccugcaa

SEQ ID NO: 1943251 - RNA, 17 nt, Shigella flexneri 2a str. 2457T
guaccaugcgcaucauc

SEQ ID NO: 1943252 - RNA, 18 nt, Shigella flexneri 2a str. 2457T
guaccaccggacgcacac

SEQ ID NO: 1943253 - RNA, 20 nt, Shigella flexneri 2a str. 2457T
guaccacgcaaagcacgcca

SEQ ID NO: 1943254 - RNA, 20 nt, Shigella flexneri 2a str. 2457T
guaccacgguacgccagagu

SEQ ID NO: 1943255 - RNA, 20 nt, Shigella flexneri 2a str. 2457T
guaccagaccaacauaguua

SEQ ID NO: 1943256 - RNA, 12 nt, Shigella flexneri 2a str. 2457T
guaccagcagcg

SEQ ID NO: 1943257 - RNA, 16 nt, Shigella flexneri 2a str. 2457T
guaccagccuugccag

SEQ ID NO: 1943258 - RNA, 15 nt, Shigella flexneri 2a str. 2457T
guaccgugcagcgca

SEQ ID NO: 1943259 - RNA, 15 nt, Shigella flexneri 2a str. 2457T
guaccgugggcggca

SEQ ID NO: 1943260 - RNA, 18 nt, Shigella flexneri 2a str. 2457T
guaccggccuugccagau

SEQ ID NO: 1943261 - RNA, 14 nt, Shigella flexneri 2a str. 2457T
guaccgauuugauc

SEQ ID NO: 1943262 - RNA, 20 nt, Shigella flexneri 2a str. 2457T
guaccgccgccauaaacagc

SEQ ID NO: 1943263 - RNA, 22 nt, Shigella flexneri 2a str. 2457T
guaccgccgccauaaacagcag

SEQ ID NO: 1943264 - RNA, 12 nt, Shigella flexneri 2a str. 2457T
guaccgcagcaa

SEQ ID NO: 1943265 - RNA, 13 nt, Shigella flexneri 2a str. 2457T
guaccaucuucac

SEQ ID NO: 1943266 - RNA, 23 nt, Shigella flexneri 2a str. 2457T
guaccauuaaucgauaaaccagc

SEQ ID NO: 1943267 - RNA, 14 nt, Shigella flexneri 2a str. 2457T
guacccaucaacaa

SEQ ID NO: 1943268 - RNA, 12 nt, Shigella flexneri 2a str. 2457T
guacccgcuggc

SEQ ID NO: 1943269 - RNA, 14 nt, Shigella flexneri 2a str. 2457T
guacgccaaucugc

SEQ ID NO: 1943270 - RNA, 14 nt, Shigella flexneri 2a str. 2457T
guacgacuuccugg

SEQ ID NO: 1943271 - RNA, 15 nt, Shigella flexneri 2a str. 2457T
guacgacaaaagaau

SEQ ID NO: 1943272 - RNA, 18 nt, Shigella flexneri 2a str. 2457T
guaccuccuucacagugg

SEQ ID NO: 1943273 - RNA, 19 nt, Shigella flexneri 2a str. 2457T
guacgccuucaugugcggg

SEQ ID NO: 1943274 - RNA, 21 nt, Shigella flexneri 2a str. 2457T
guacgcggcaauccccgccag

SEQ ID NO: 1943275 - RNA, 18 nt, Shigella flexneri 2a str. 2457T
guacgcguucaaucaaau

SEQ ID NO: 1943276 - RNA, 14 nt, Shigella flexneri 2a str. 2457T
guacgggucgggcu

SEQ ID NO: 1943277 - RNA, 13 nt, Shigella flexneri 2a str. 2457T
ggugccgcgcagc

SEQ ID NO: 1943278 - RNA, 20 nt, Shigella flexneri 2a str. 2457T
ggugcgacaaacauugcugc

SEQ ID NO: 1943279 - RNA, 19 nt, Shigella flexneri 2a str. 2457T
ggugcguaccaggcgugga

SEQ ID NO: 1943280 - RNA, 14 nt, Shigella flexneri 2a str. 2457T
ggugcggcaaaaac

SEQ ID NO: 1943281 - RNA, 16 nt, Shigella flexneri 2a str. 2457T
ggugggcuacggcaug

SEQ ID NO: 1943282 - RNA, 12 nt, Shigella flexneri 2a str. 2457T
ggugggcggcgu

SEQ ID NO: 1943283 - RNA, 13 nt, Shigella flexneri 2a str. 2457T
gguggcgagagcc

SEQ ID NO: 1943284 - RNA, 13 nt, Shigella flexneri 2a str. 2457T
ggugcuuuugcug

SEQ ID NO: 1943285 - RNA, 14 nt, Shigella flexneri 2a str. 2457T
gguggcaaagaaau

SEQ ID NO: 1943286 - RNA, 15 nt, Shigella flexneri 2a str. 2457T
gguggccauccgcgu

SEQ ID NO: 1943287 - RNA, 18 nt, Shigella flexneri 2a str. 2457T
ggcuccgcugacgccugc

SEQ ID NO: 1943288 - RNA, 14 nt, Shigella flexneri 2a str. 2457T
ggcucccgcagcca

SEQ ID NO: 1943289 - RNA, 22 nt, Shigella flexneri 2a str. 2457T
ggcucccggcgguaaaucgccg

SEQ ID NO: 1943290 - RNA, 23 nt, Shigella flexneri 2a str. 2457T
ggcucagcucuggcacaugcaua

SEQ ID NO: 1943291 - RNA, 21 nt, Shigella flexneri 2a str. 2457T
ggcuccgguuaacgccgcgcc

SEQ ID NO: 1943292 - RNA, 18 nt, Shigella flexneri 2a str. 2457T
ggcuccgggcgcaccagu

SEQ ID NO: 1943293 - RNA, 23 nt, Shigella flexneri 2a str. 2457T
ggugacagguuuaaacagagauu

SEQ ID NO: 1943294 - RNA, 21 nt, Shigella flexneri 2a str. 2457T
ggugacaaucaccaggucacc

SEQ ID NO: 1943295 - RNA, 17 nt, Shigella flexneri 2a str. 2457T
ggugacgcgggcagcag

SEQ ID NO: 1943296 - RNA, 17 nt, Shigella flexneri 2a str. 2457T
ggugagcuaaugcaaau

SEQ ID NO: 1943297 - RNA, 14 nt, Shigella flexneri 2a str. 2457T
ggugagcgugcggu

SEQ ID NO: 1943298 - RNA, 15 nt, Shigella flexneri 2a str. 2457T
ggugagcgaugcugc

SEQ ID NO: 1943299 - RNA, 16 nt, Shigella flexneri 2a str. 2457T
ggugaggccagagcag

SEQ ID NO: 1943300 - RNA, 15 nt, Shigella flexneri 2a str. 2457T
ggugcagaaucaauc

SEQ ID NO: 1943301 - RNA, 14 nt, Shigella flexneri 2a str. 2457T
ggugcagccggagc

SEQ ID NO: 1943302 - RNA, 12 nt, Shigella flexneri 2a str. 2457T
ggugcaaucaaa

SEQ ID NO: 1943303 - RNA, 19 nt, Shigella flexneri 2a str. 2457T
ggugauguuuaucgucugg

SEQ ID NO: 1943304 - RNA, 12 nt, Shigella flexneri 2a str. 2457T
ggugauuacauc

SEQ ID NO: 1943305 - RNA, 17 nt, Shigella flexneri 2a str. 2457T
ggugaucaccaguaaca

SEQ ID NO: 1943306 - RNA, 15 nt, Shigella flexneri 2a str. 2457T
ggugaucagccccgg

SEQ ID NO: 1943307 - RNA, 20 nt, Shigella flexneri 2a str. 2457T
ggugauaaucaucccacaug

SEQ ID NO: 1943308 - RNA, 23 nt, Shigella flexneri 2a str. 2457T
ggugauaaucaucccacaugaau

SEQ ID NO: 1943309 - RNA, 19 nt, Shigella flexneri 2a str. 2457T
gguuuccacaugguuggcc

SEQ ID NO: 1943310 - RNA, 11 nt, Shigella flexneri 2a str. 2457T
gguuucuuuuu

SEQ ID NO: 1943311 - RNA, 17 nt, Shigella flexneri 2a str. 2457T
gguuuccggaucgccaa

SEQ ID NO: 1943312 - RNA, 17 nt, Shigella flexneri 2a str. 2457T
gguuucacggcaccagc

SEQ ID NO: 1943313 - RNA, 19 nt, Shigella flexneri 2a str. 2457T
gguuucaagauuagccccc

SEQ ID NO: 1943314 - RNA, 20 nt, Shigella flexneri 2a str. 2457T
gguuucaaauuacgauccac

SEQ ID NO: 1943315 - RNA, 14 nt, Shigella flexneri 2a str. 2457T
gguuuauccccaag

SEQ ID NO: 1943316 - RNA, 16 nt, Shigella flexneri 2a str. 2457T
gguuugaaaaaaccug

SEQ ID NO: 1943317 - RNA, 14 nt, Shigella flexneri 2a str. 2457T
gguuugaaugaaag

SEQ ID NO: 1943318 - RNA, 23 nt, Shigella flexneri 2a str. 2457T
gguuuucaucccgagucgcugag

SEQ ID NO: 1943319 - RNA, 17 nt, Shigella flexneri 2a str. 2457T
gguuuucaaucgacuuu

SEQ ID NO: 1943320 - RNA, 22 nt, Shigella flexneri 2a str. 2457T
gguuuucaaucgacuuuucaua

SEQ ID NO: 1943321 - RNA, 23 nt, Shigella flexneri 2a str. 2457T
gguuuuauuauuccauccugcuc

SEQ ID NO: 1943322 - RNA, 21 nt, Shigella flexneri 2a str. 2457T
gguuuucaacgugucuuuuac

SEQ ID NO: 1943323 - RNA, 16 nt, Shigella flexneri 2a str. 2457T
gguuuuauuuaacaug

SEQ ID NO: 1943324 - RNA, 20 nt, Shigella flexneri 2a str. 2457T
guaaaaagaaaguuugcaga

SEQ ID NO: 1943325 - RNA, 19 nt, Shigella flexneri 2a str. 2457T
guaaaaacgcauuuaucuu

SEQ ID NO: 1943326 - RNA, 12 nt, Shigella flexneri 2a str. 2457T
guaaaaccugac

SEQ ID NO: 1943327 - RNA, 21 nt, Shigella flexneri 2a str. 2457T
guaaaaccgacuuaaaaggaa

SEQ ID NO: 1943328 - RNA, 16 nt, Shigella flexneri 2a str. 2457T
guaaaaccgauauguu

SEQ ID NO: 1943329 - RNA, 22 nt, Shigella flexneri 2a str. 2457T
gguuuuuuauuaauucuaaaac

SEQ ID NO: 1943330 - RNA, 15 nt, Shigella flexneri 2a str. 2457T
gguuuuguuuaaaua

SEQ ID NO: 1943331 - RNA, 21 nt, Shigella flexneri 2a str. 2457T
gguuuugaaacucgcugccag

SEQ ID NO: 1943332 - RNA, 20 nt, Shigella flexneri 2a str. 2457T
gguuuugcccacagagcuga

SEQ ID NO: 1943333 - RNA, 17 nt, Shigella flexneri 2a str. 2457T
guaaaaacggauuucau

SEQ ID NO: 1943334 - RNA, 20 nt, Shigella flexneri 2a str. 2457T
gguucugcggguuagucugc

SEQ ID NO: 1943335 - RNA, 16 nt, Shigella flexneri 2a str. 2457T
gguugaccuggaagga

SEQ ID NO: 1943336 - RNA, 13 nt, Shigella flexneri 2a str. 2457T
gguugauggcagu

SEQ ID NO: 1943337 - RNA, 21 nt, Shigella flexneri 2a str. 2457T
gguuuacccgcuugaguauuu

SEQ ID NO: 1943338 - RNA, 23 nt, Shigella flexneri 2a str. 2457T
gguuuaagacaauuuaauaagaa

SEQ ID NO: 1943339 - RNA, 13 nt, Shigella flexneri 2a str. 2457T
gguuggcgugcgg

SEQ ID NO: 1943340 - RNA, 17 nt, Shigella flexneri 2a str. 2457T
ggugguuuggcggcggc

SEQ ID NO: 1943341 - RNA, 17 nt, Shigella flexneri 2a str. 2457T
gguuaacuguggcguua

SEQ ID NO: 1943342 - RNA, 12 nt, Shigella flexneri 2a str. 2457T
gguuaaccagca

SEQ ID NO: 1943343 - RNA, 13 nt, Shigella flexneri 2a str. 2457T
gguuaaaaacagc

SEQ ID NO: 1943344 - RNA, 13 nt, Shigella flexneri 2a str. 2457T
gguguuugacugu

SEQ ID NO: 1943345 - RNA, 22 nt, Shigella flexneri 2a str. 2457T
gguguugcguuuuuaucuucac

SEQ ID NO: 1943346 - RNA, 20 nt, Shigella flexneri 2a str. 2457T
ggugucguauucucaauaaa

SEQ ID NO: 1943347 - RNA, 17 nt, Shigella flexneri 2a str. 2457T
gguguggcauggcgaau

SEQ ID NO: 1943348 - RNA, 10 nt, Shigella flexneri 2a str. 2457T
gguucaaagu

SEQ ID NO: 1943349 - RNA, 22 nt, Shigella flexneri 2a str. 2457T
gguuauuuguaguuugauaauu

SEQ ID NO: 1943350 - RNA, 16 nt, Shigella flexneri 2a str. 2457T
gguuauccagcaacca

SEQ ID NO: 1943351 - RNA, 21 nt, Shigella flexneri 2a str. 2457T
gguuauuucauuauuaauuuc

SEQ ID NO: 1943352 - RNA, 19 nt, Shigella flexneri 2a str. 2457T
gguuaauaccgagcguuca

SEQ ID NO: 1943353 - RNA, 16 nt, Shigella flexneri 2a str. 2457T
gguuaaucggcaggga

SEQ ID NO: 1943354 - RNA, 19 nt, Shigella flexneri 2a str. 2457T
gguuagaauaccugccugu

SEQ ID NO: 1943355 - RNA, 11 nt, Shigella flexneri 2a str. 2457T
gguuagccugu

SEQ ID NO: 1943356 - RNA, 19 nt, Shigella flexneri 2a str. 2457T
gguuaggcugugaaccgca

SEQ ID NO: 1943357 - RNA, 23 nt, Shigella flexneri 2a str. 2457T
gguucgacugcccgcgagcgugg

SEQ ID NO: 1943358 - RNA, 22 nt, Shigella flexneri 2a str. 2457T
gguucgggaaauugcagagcug

SEQ ID NO: 1943359 - RNA, 23 nt, Shigella flexneri 2a str. 2457T
gguucaucgugcuguuugaaaug

SEQ ID NO: 1943360 - RNA, 19 nt, Shigella flexneri 2a str. 2457T
gguucauugagcgcaaaug

SEQ ID NO: 1943361 - RNA, 11 nt, Shigella flexneri 2a str. 2457T
gguuccagcuu

SEQ ID NO: 1943362 - RNA, 22 nt, Shigella flexneri 2a str. 2457T
gccgggcuaaccgcuuuuccag

SEQ ID NO: 1943363 - RNA, 21 nt, Shigella flexneri 2a str. 2457T
gccgguaacgcuuucucacca

SEQ ID NO: 1943364 - RNA, 23 nt, Shigella flexneri 2a str. 2457T
gccgguagucaccgcccagugca

SEQ ID NO: 1943365 - RNA, 21 nt, Shigella flexneri 2a str. 2457T
gccgguagucaccgcccagug

SEQ ID NO: 1943366 - RNA, 14 nt, Shigella flexneri 2a str. 2457T
gccggugcaugauu

SEQ ID NO: 1943367 - RNA, 13 nt, Shigella flexneri 2a str. 2457T
gccgguggccuug

SEQ ID NO: 1943368 - RNA, 17 nt, Shigella flexneri 2a str. 2457T
gccgucgauggcgcaga

SEQ ID NO: 1943369 - RNA, 22 nt, Shigella flexneri 2a str. 2457T
gccgucgaugucuggcugagca

SEQ ID NO: 1943370 - RNA, 20 nt, Shigella flexneri 2a str. 2457T
gccgucgagggccugaaaaa

SEQ ID NO: 1943371 - RNA, 22 nt, Shigella flexneri 2a str. 2457T
gccgucagccacuucuuccagc

SEQ ID NO: 1943372 - RNA, 22 nt, Shigella flexneri 2a str. 2457T
gccgucauuguuaacgccgcgc

SEQ ID NO: 1943373 - RNA, 18 nt, Shigella flexneri 2a str. 2457T
gccguaaaucccgccauu

SEQ ID NO: 1943374 - RNA, 18 nt, Shigella flexneri 2a str. 2457T
gccgguuuuaaagcaaaa

SEQ ID NO: 1943375 - RNA, 13 nt, Shigella flexneri 2a str. 2457T
gccgguuccagcu

SEQ ID NO: 1943376 - RNA, 18 nt, Shigella flexneri 2a str. 2457T
gccguagagcaccggcgg

SEQ ID NO: 1943377 - RNA, 14 nt, Shigella flexneri 2a str. 2457T
gccguacaggcagc

SEQ ID NO: 1943378 - RNA, 15 nt, Shigella flexneri 2a str. 2457T
gccguacaggcagcu

SEQ ID NO: 1943379 - RNA, 22 nt, Shigella flexneri 2a str. 2457T
gccguacggcguaccgccgcga

SEQ ID NO: 1943380 - RNA, 17 nt, Shigella flexneri 2a str. 2457T
gccguuuuuuugacggu

SEQ ID NO: 1943381 - RNA, 11 nt, Shigella flexneri 2a str. 2457T
gccguuuucuu

SEQ ID NO: 1943382 - RNA, 14 nt, Shigella flexneri 2a str. 2457T
gccguuuucgucaa

SEQ ID NO: 1943383 - RNA, 13 nt, Shigella flexneri 2a str. 2457T
gccguucuucccg

SEQ ID NO: 1943384 - RNA, 16 nt, Shigella flexneri 2a str. 2457T
gccguugaguucaaau

SEQ ID NO: 1943385 - RNA, 14 nt, Shigella flexneri 2a str. 2457T
gccguugauaaaga

SEQ ID NO: 1943386 - RNA, 19 nt, Shigella flexneri 2a str. 2457T
gccuaacaauucgccaggg

SEQ ID NO: 1943387 - RNA, 17 nt, Shigella flexneri 2a str. 2457T
gccgugucggugcucau

SEQ ID NO: 1943388 - RNA, 21 nt, Shigella flexneri 2a str. 2457T
gccgugucggugcucaucagc

SEQ ID NO: 1943389 - RNA, 20 nt, Shigella flexneri 2a str. 2457T
gccgugcacuucugcgguga

SEQ ID NO: 1943390 - RNA, 17 nt, Shigella flexneri 2a str. 2457T
gccggccagcgccacca

SEQ ID NO: 1943391 - RNA, 21 nt, Shigella flexneri 2a str. 2457T
gccggaugugaugcauccggc

SEQ ID NO: 1943392 - RNA, 23 nt, Shigella flexneri 2a str. 2457T
gccggauucacgccaaccagcug

SEQ ID NO: 1943393 - RNA, 20 nt, Shigella flexneri 2a str. 2457T
gccggauuugagaucggaaa

SEQ ID NO: 1943394 - RNA, 23 nt, Shigella flexneri 2a str. 2457T
gccggauaaacaauguuauccgg

SEQ ID NO: 1943395 - RNA, 21 nt, Shigella flexneri 2a str. 2457T
gccggagggauguggcccagc

SEQ ID NO: 1943396 - RNA, 18 nt, Shigella flexneri 2a str. 2457T
gccggacugggcgcgcuc

SEQ ID NO: 1943397 - RNA, 13 nt, Shigella flexneri 2a str. 2457T
gccggagccagcc

SEQ ID NO: 1943398 - RNA, 17 nt, Shigella flexneri 2a str. 2457T
gccggagccagccguug

SEQ ID NO: 1943399 - RNA, 22 nt, Shigella flexneri 2a str. 2457T
gccggaucagcgucgccuggug

SEQ ID NO: 1943400 - RNA, 14 nt, Shigella flexneri 2a str. 2457T
gccggauagacaug

SEQ ID NO: 1943401 - RNA, 23 nt, Shigella flexneri 2a str. 2457T
gccggaugccucuccuguucuca

SEQ ID NO: 1943402 - RNA, 14 nt, Shigella flexneri 2a str. 2457T
gccggaugacagac

SEQ ID NO: 1943403 - RNA, 21 nt, Shigella flexneri 2a str. 2457T
gccggaugacagacuccgccu

SEQ ID NO: 1943404 - RNA, 20 nt, Shigella flexneri 2a str. 2457T
gccggauggaaacauccggc

SEQ ID NO: 1943405 - RNA, 21 nt, Shigella flexneri 2a str. 2457T
gccggaugcgaugcugacgca

SEQ ID NO: 1943406 - RNA, 22 nt, Shigella flexneri 2a str. 2457T
gccggaugcuguauguuccccu

SEQ ID NO: 1943407 - RNA, 20 nt, Shigella flexneri 2a str. 2457T
gccggacgcugagcacguuu

SEQ ID NO: 1943408 - RNA, 18 nt, Shigella flexneri 2a str. 2457T
gccggaccaucuuccagu

SEQ ID NO: 1943409 - RNA, 17 nt, Shigella flexneri 2a str. 2457T
gccggaaucaacggcaa

SEQ ID NO: 1943410 - RNA, 13 nt, Shigella flexneri 2a str. 2457T
gccggaauaauca

SEQ ID NO: 1943411 - RNA, 16 nt, Shigella flexneri 2a str. 2457T
gccggaaguauuucaa

SEQ ID NO: 1943412 - RNA, 21 nt, Shigella flexneri 2a str. 2457T
gccggaaggaagacgcagcau

SEQ ID NO: 1943413 - RNA, 19 nt, Shigella flexneri 2a str. 2457T
gccggaaggaagacgcagc

SEQ ID NO: 1943414 - RNA, 18 nt, Shigella flexneri 2a str. 2457T
gccggaacuauuggucug

SEQ ID NO: 1943415 - RNA, 15 nt, Shigella flexneri 2a str. 2457T
gccuggauggcuugc

SEQ ID NO: 1943416 - RNA, 15 nt, Shigella flexneri 2a str. 2457T
gccuggcaaugcgcu

SEQ ID NO: 1943417 - RNA, 14 nt, Shigella flexneri 2a str. 2457T
gccuggauuuucuc

SEQ ID NO: 1943418 - RNA, 14 nt, Shigella flexneri 2a str. 2457T
gccugcuuuugcca

SEQ ID NO: 1943419 - RNA, 14 nt, Shigella flexneri 2a str. 2457T
gccugcuuugacaa

SEQ ID NO: 1943420 - RNA, 13 nt, Shigella flexneri 2a str. 2457T
gccugugcaaccu

SEQ ID NO: 1943421 - RNA, 15 nt, Shigella flexneri 2a str. 2457T
gccugugcaaccuuu

SEQ ID NO: 1943422 - RNA, 15 nt, Shigella flexneri 2a str. 2457T
gccugugcagcgacg

SEQ ID NO: 1943423 - RNA, 15 nt, Shigella flexneri 2a str. 2457T
gccuguacuuccugu

SEQ ID NO: 1943424 - RNA, 16 nt, Shigella flexneri 2a str. 2457T
gccuguaccagcggcu

SEQ ID NO: 1943425 - RNA, 18 nt, Shigella flexneri 2a str. 2457T
gccuuacgcugcauuuuc

SEQ ID NO: 1943426 - RNA, 13 nt, Shigella flexneri 2a str. 2457T
gccuuaguagaag

SEQ ID NO: 1943427 - RNA, 22 nt, Shigella flexneri 2a str. 2457T
gccuuacccggaccgucuuuuu

SEQ ID NO: 1943428 - RNA, 15 nt, Shigella flexneri 2a str. 2457T
gccugugccugagcc

SEQ ID NO: 1943429 - RNA, 16 nt, Shigella flexneri 2a str. 2457T
gccugugucaggccgg

SEQ ID NO: 1943430 - RNA, 16 nt, Shigella flexneri 2a str. 2457T
gccuguggugauucau

SEQ ID NO: 1943431 - RNA, 17 nt, Shigella flexneri 2a str. 2457T
gccuucauucaggccaa

SEQ ID NO: 1943432 - RNA, 19 nt, Shigella flexneri 2a str. 2457T
gccuucaugcgacgacggu

SEQ ID NO: 1943433 - RNA, 22 nt, Shigella flexneri 2a str. 2457T
gccuuccaccagauggcuuucc

SEQ ID NO: 1943434 - RNA, 13 nt, Shigella flexneri 2a str. 2457T
gccuuauccggcc

SEQ ID NO: 1943435 - RNA, 13 nt, Shigella flexneri 2a str. 2457T
gccuuauccggcu

SEQ ID NO: 1943436 - RNA, 14 nt, Shigella flexneri 2a str. 2457T
gccuuauccugccu

SEQ ID NO: 1943437 - RNA, 21 nt, Shigella flexneri 2a str. 2457T
gccuucagguuuuucagcugc

SEQ ID NO: 1943438 - RNA, 22 nt, Shigella flexneri 2a str. 2457T
gccuugcggaaauuccagcggc

SEQ ID NO: 1943439 - RNA, 21 nt, Shigella flexneri 2a str. 2457T
gccuugcgauuacgcucggca

SEQ ID NO: 1943440 - RNA, 21 nt, Shigella flexneri 2a str. 2457T
gccuucuucgcccacuuucug

SEQ ID NO: 1943441 - RNA, 14 nt, Shigella flexneri 2a str. 2457T
gccuucuucaucca

SEQ ID NO: 1943442 - RNA, 22 nt, Shigella flexneri 2a str. 2457T
gccuucuucgcccacuuucugc

SEQ ID NO: 1943443 - RNA, 21 nt, Shigella flexneri 2a str. 2457T
gccuuccgcaaacaggcgcag

SEQ ID NO: 1943444 - RNA, 18 nt, Shigella flexneri 2a str. 2457T
gccugcuaaaccagcccu

SEQ ID NO: 1943445 - RNA, 10 nt, Shigella flexneri 2a str. 2457T
gccugcucca

SEQ ID NO: 1943446 - RNA, 15 nt, Shigella flexneri 2a str. 2457T
gccugcgacaagaau

SEQ ID NO: 1943447 - RNA, 15 nt, Shigella flexneri 2a str. 2457T
gccugcgaagcucuu

SEQ ID NO: 1943448 - RNA, 17 nt, Shigella flexneri 2a str. 2457T
gccugccugcagcugcu

SEQ ID NO: 1943449 - RNA, 14 nt, Shigella flexneri 2a str. 2457T
gccugccagcucuu

SEQ ID NO: 1943450 - RNA, 16 nt, Shigella flexneri 2a str. 2457T
gccugccaucuggcag

SEQ ID NO: 1943451 - RNA, 19 nt, Shigella flexneri 2a str. 2457T
gccugccaucuggcaggcu

SEQ ID NO: 1943452 - RNA, 16 nt, Shigella flexneri 2a str. 2457T
gccugcauccgccauc

SEQ ID NO: 1943453 - RNA, 22 nt, Shigella flexneri 2a str. 2457T
gccugcagcugcucauuacagu

SEQ ID NO: 1943454 - RNA, 13 nt, Shigella flexneri 2a str. 2457T
gccugcacugcag

SEQ ID NO: 1943455 - RNA, 16 nt, Shigella flexneri 2a str. 2457T
gccugauaagcguagc

SEQ ID NO: 1943456 - RNA, 16 nt, Shigella flexneri 2a str. 2457T
gccugauagcccgcac

SEQ ID NO: 1943457 - RNA, 21 nt, Shigella flexneri 2a str. 2457T
gccugauagcccgcacaaagc

SEQ ID NO: 1943458 - RNA, 19 nt, Shigella flexneri 2a str. 2457T
gccugaugcgacgcuugca

SEQ ID NO: 1943459 - RNA, 16 nt, Shigella flexneri 2a str. 2457T
gccugauguacaacca

SEQ ID NO: 1943460 - RNA, 13 nt, Shigella flexneri 2a str. 2457T
gccugaugcguug

SEQ ID NO: 1943461 - RNA, 22 nt, Shigella flexneri 2a str. 2457T
gccugauucaaugaguuauaca

SEQ ID NO: 1943462 - RNA, 15 nt, Shigella flexneri 2a str. 2457T
gccugauaagacgcg

SEQ ID NO: 1943463 - RNA, 21 nt, Shigella flexneri 2a str. 2457T
gccugacggaaaucauccagc

SEQ ID NO: 1943464 - RNA, 15 nt, Shigella flexneri 2a str. 2457T
gccuacgcguccccu

SEQ ID NO: 1943465 - RNA, 18 nt, Shigella flexneri 2a str. 2457T
gccucaagaaugacgcca

SEQ ID NO: 1943466 - RNA, 20 nt, Shigella flexneri 2a str. 2457T
gccucaagcacccgccgcua

SEQ ID NO: 1943467 - RNA, 20 nt, Shigella flexneri 2a str. 2457T
gccucaacgucaaaagaugc

SEQ ID NO: 1943468 - RNA, 12 nt, Shigella flexneri 2a str. 2457T
gccugaaugcuu

SEQ ID NO: 1943469 - RNA, 17 nt, Shigella flexneri 2a str. 2457T
gccucuuuuaaccucag

SEQ ID NO: 1943470 - RNA, 13 nt, Shigella flexneri 2a str. 2457T
gccucuuuauaaa

SEQ ID NO: 1943471 - RNA, 17 nt, Shigella flexneri 2a str. 2457T
gccugaaaaaacagcag

SEQ ID NO: 1943472 - RNA, 21 nt, Shigella flexneri 2a str. 2457T
gccugaaaacgaaaucguugu

SEQ ID NO: 1943473 - RNA, 12 nt, Shigella flexneri 2a str. 2457T
gccugaaaguau

SEQ ID NO: 1943474 - RNA, 18 nt, Shigella flexneri 2a str. 2457T
gccugaaauaaugcagcg

SEQ ID NO: 1943475 - RNA, 17 nt, Shigella flexneri 2a str. 2457T
gcgauaaucagcgccag

SEQ ID NO: 1943476 - RNA, 11 nt, Shigella flexneri 2a str. 2457T
gcgauaauauu

SEQ ID NO: 1943477 - RNA, 16 nt, Shigella flexneri 2a str. 2457T
gcgauaaugcccagca

SEQ ID NO: 1943478 - RNA, 17 nt, Shigella flexneri 2a str. 2457T
gcgauaaugcccagcaa

SEQ ID NO: 1943479 - RNA, 15 nt, Shigella flexneri 2a str. 2457T
gcgagguccagcucc

SEQ ID NO: 1943480 - RNA, 17 nt, Shigella flexneri 2a str. 2457T
gcgagguuaccgacugc

SEQ ID NO: 1943481 - RNA, 18 nt, Shigella flexneri 2a str. 2457T
gcgagguuauccgccagc

SEQ ID NO: 1943482 - RNA, 19 nt, Shigella flexneri 2a str. 2457T
gcgagguuauccgccagcg

SEQ ID NO: 1943483 - RNA, 14 nt, Shigella flexneri 2a str. 2457T
gcgagucgucaguu

SEQ ID NO: 1943484 - RNA, 19 nt, Shigella flexneri 2a str. 2457T
gcgaggcggggccaauugc

SEQ ID NO: 1943485 - RNA, 12 nt, Shigella flexneri 2a str. 2457T
gcgacgguucau

SEQ ID NO: 1943486 - RNA, 18 nt, Shigella flexneri 2a str. 2457T
gcgacgccucuauuaaaa

SEQ ID NO: 1943487 - RNA, 14 nt, Shigella flexneri 2a str. 2457T
gcgacuugucauca

SEQ ID NO: 1943488 - RNA, 23 nt, Shigella flexneri 2a str. 2457T
gcgagcaaaaucguaagcaggag

SEQ ID NO: 1943489 - RNA, 23 nt, Shigella flexneri 2a str. 2457T
gcgagaucuuuaucaaucaccgc

SEQ ID NO: 1943490 - RNA, 14 nt, Shigella flexneri 2a str. 2457T
gcgagcagcauucc

SEQ ID NO: 1943491 - RNA, 23 nt, Shigella flexneri 2a str. 2457T
gcgacugucuuucaggcagucgc

SEQ ID NO: 1943492 - RNA, 16 nt, Shigella flexneri 2a str. 2457T
gcgacuugcucaggag

SEQ ID NO: 1943493 - RNA, 16 nt, Shigella flexneri 2a str. 2457T
gcgacucucugagcca

SEQ ID NO: 1943494 - RNA, 13 nt, Shigella flexneri 2a str. 2457T
gcgaccgccgcca

SEQ ID NO: 1943495 - RNA, 15 nt, Shigella flexneri 2a str. 2457T
gcgaccguucgccag

SEQ ID NO: 1943496 - RNA, 15 nt, Shigella flexneri 2a str. 2457T
gcgaccguuuucacc

SEQ ID NO: 1943497 - RNA, 16 nt, Shigella flexneri 2a str. 2457T
gcgaccguucgccagg

SEQ ID NO: 1943498 - RNA, 15 nt, Shigella flexneri 2a str. 2457T
gcgaccacacucaau

SEQ ID NO: 1943499 - RNA, 12 nt, Shigella flexneri 2a str. 2457T
gcgaccaccggg

SEQ ID NO: 1943500 - RNA, 20 nt, Shigella flexneri 2a str. 2457T
gcgacccguuuacggcuaaa

SEQ ID NO: 1943501 - RNA, 14 nt, Shigella flexneri 2a str. 2457T
gcgaccgaacagau

SEQ ID NO: 1943502 - RNA, 18 nt, Shigella flexneri 2a str. 2457T
gcgaccgaacagaucacg

SEQ ID NO: 1943503 - RNA, 20 nt, Shigella flexneri 2a str. 2457T
gcgaaucgcuucauuuacau

SEQ ID NO: 1943504 - RNA, 18 nt, Shigella flexneri 2a str. 2457T
gcgaaugacaugcccggu

SEQ ID NO: 1943505 - RNA, 15 nt, Shigella flexneri 2a str. 2457T
gcgaaugaggcagca

SEQ ID NO: 1943506 - RNA, 21 nt, Shigella flexneri 2a str. 2457T
gcgacaaacaggaaguuucag

SEQ ID NO: 1943507 - RNA, 22 nt, Shigella flexneri 2a str. 2457T
gcgaauucuugccuuuccuccu

SEQ ID NO: 1943508 - RNA, 22 nt, Shigella flexneri 2a str. 2457T
gcgaauaguuuccgcuucugcu

SEQ ID NO: 1943509 - RNA, 15 nt, Shigella flexneri 2a str. 2457T
gcgaauauggcggcg

SEQ ID NO: 1943510 - RNA, 17 nt, Shigella flexneri 2a str. 2457T
gcgaaucacguugccgu

SEQ ID NO: 1943511 - RNA, 17 nt, Shigella flexneri 2a str. 2457T
gcgaaacagggcuggaa

SEQ ID NO: 1943512 - RNA, 23 nt, Shigella flexneri 2a str. 2457T
gcgaaaauugguagaccagagcu

SEQ ID NO: 1943513 - RNA, 22 nt, Shigella flexneri 2a str. 2457T
gcgacaccucccagcgcgguga

SEQ ID NO: 1943514 - RNA, 19 nt, Shigella flexneri 2a str. 2457T
gcgacagauucaggcgcag

SEQ ID NO: 1943515 - RNA, 16 nt, Shigella flexneri 2a str. 2457T
gcgacagauucgcggg

SEQ ID NO: 1943516 - RNA, 19 nt, Shigella flexneri 2a str. 2457T
gcgacagacgacgacgcgc

SEQ ID NO: 1943517 - RNA, 20 nt, Shigella flexneri 2a str. 2457T
gcgacagggaucucuuccag

SEQ ID NO: 1943518 - RNA, 20 nt, Shigella flexneri 2a str. 2457T
gcgacaucaucagcgguggc

SEQ ID NO: 1943519 - RNA, 16 nt, Shigella flexneri 2a str. 2457T
gcgacauauuccccuu

SEQ ID NO: 1943520 - RNA, 17 nt, Shigella flexneri 2a str. 2457T
gcgacaucaccgccgga

SEQ ID NO: 1943521 - RNA, 14 nt, Shigella flexneri 2a str. 2457T
gccgcgcagcgugc

SEQ ID NO: 1943522 - RNA, 18 nt, Shigella flexneri 2a str. 2457T
gccgcgcaguuucuuacc

SEQ ID NO: 1943523 - RNA, 22 nt, Shigella flexneri 2a str. 2457T
gccgccauugacguuccuuucu

SEQ ID NO: 1943524 - RNA, 11 nt, Shigella flexneri 2a str. 2457T
gccgcccagcc

SEQ ID NO: 1943525 - RNA, 17 nt, Shigella flexneri 2a str. 2457T
gccgccccagucaguaa

SEQ ID NO: 1943526 - RNA, 18 nt, Shigella flexneri 2a str. 2457T
gccgcccccgacuccagc

SEQ ID NO: 1943527 - RNA, 19 nt, Shigella flexneri 2a str. 2457T
gccgcccccgacuccagca

SEQ ID NO: 1943528 - RNA, 17 nt, Shigella flexneri 2a str. 2457T
gccgcccguuuucucca

SEQ ID NO: 1943529 - RNA, 17 nt, Shigella flexneri 2a str. 2457T
gccgccgcuggcgugca

SEQ ID NO: 1943530 - RNA, 22 nt, Shigella flexneri 2a str. 2457T
gccgccggauagacaugcccgg

SEQ ID NO: 1943531 - RNA, 21 nt, Shigella flexneri 2a str. 2457T
gccgcaauggccguuccggca

SEQ ID NO: 1943532 - RNA, 18 nt, Shigella flexneri 2a str. 2457T
gccgcaaucaucgacccc

SEQ ID NO: 1943533 - RNA, 20 nt, Shigella flexneri 2a str. 2457T
gccgcacaauacauagaaac

SEQ ID NO: 1943534 - RNA, 19 nt, Shigella flexneri 2a str. 2457T
gccgcaccaggaucuuuug

SEQ ID NO: 1943535 - RNA, 15 nt, Shigella flexneri 2a str. 2457T
gccgcaggcggacug

SEQ ID NO: 1943536 - RNA, 15 nt, Shigella flexneri 2a str. 2457T
gccgccagcaucuca

SEQ ID NO: 1943537 - RNA, 16 nt, Shigella flexneri 2a str. 2457T
gccgccaucucuucca

SEQ ID NO: 1943538 - RNA, 18 nt, Shigella flexneri 2a str. 2457T
gccgccaucucuuccagc

SEQ ID NO: 1943539 - RNA, 13 nt, Shigella flexneri 2a str. 2457T
gccgccauccggc

SEQ ID NO: 1943540 - RNA, 15 nt, Shigella flexneri 2a str. 2457T
gccgccauaaacagc

SEQ ID NO: 1943541 - RNA, 16 nt, Shigella flexneri 2a str. 2457T
gccgccaguucuucca

SEQ ID NO: 1943542 - RNA, 19 nt, Shigella flexneri 2a str. 2457T
gccgacgccaguucucuuc

SEQ ID NO: 1943543 - RNA, 16 nt, Shigella flexneri 2a str. 2457T
gccgaguaaaaaaaca

SEQ ID NO: 1943544 - RNA, 22 nt, Shigella flexneri 2a str. 2457T
gccgagguuggcucaucaagca

SEQ ID NO: 1943545 - RNA, 18 nt, Shigella flexneri 2a str. 2457T
gccgaucaauuucacagu

SEQ ID NO: 1943546 - RNA, 21 nt, Shigella flexneri 2a str. 2457T
gccgaucaauuucacaguaau

SEQ ID NO: 1943547 - RNA, 21 nt, Shigella flexneri 2a str. 2457T
gccgauuucaugaagcugaca

SEQ ID NO: 1943548 - RNA, 16 nt, Shigella flexneri 2a str. 2457T
gccgauuaaucuucca

SEQ ID NO: 1943549 - RNA, 15 nt, Shigella flexneri 2a str. 2457T
gccgaugccgcugca

SEQ ID NO: 1943550 - RNA, 14 nt, Shigella flexneri 2a str. 2457T
gccgaucaucaucc

SEQ ID NO: 1943551 - RNA, 16 nt, Shigella flexneri 2a str. 2457T
gccgaucaucauccag

SEQ ID NO: 1943552 - RNA, 18 nt, Shigella flexneri 2a str. 2457T
gccgaagaagaaguuuau

SEQ ID NO: 1943553 - RNA, 19 nt, Shigella flexneri 2a str. 2457T
gcccuuuuuucguaaguaa

SEQ ID NO: 1943554 - RNA, 21 nt, Shigella flexneri 2a str. 2457T
gcccuuuuuuugucuguuugc

SEQ ID NO: 1943555 - RNA, 20 nt, Shigella flexneri 2a str. 2457T
gccgaagaacauaaacagcg

SEQ ID NO: 1943556 - RNA, 23 nt, Shigella flexneri 2a str. 2457T
gccgaagccguuagucaucauca

SEQ ID NO: 1943557 - RNA, 18 nt, Shigella flexneri 2a str. 2457T
gccgaagcgcaguuuaau

SEQ ID NO: 1943558 - RNA, 20 nt, Shigella flexneri 2a str. 2457T
aaagcguacccgccugauag

SEQ ID NO: 1943559 - RNA, 16 nt, Shigella flexneri 2a str. 2457T
aaagcguauccaucac

SEQ ID NO: 1943560 - RNA, 12 nt, Shigella flexneri 2a str. 2457T
gccgacagcagc

SEQ ID NO: 1943561 - RNA, 12 nt, Shigella flexneri 2a str. 2457T
gccgacagagcg

SEQ ID NO: 1943562 - RNA, 22 nt, Shigella flexneri 2a str. 2457T
gccgacgacaacaggguugaau

SEQ ID NO: 1943563 - RNA, 19 nt, Shigella flexneri 2a str. 2457T
gcccugaaaacgcaguucc

SEQ ID NO: 1943564 - RNA, 23 nt, Shigella flexneri 2a str. 2457T
gcccugaaccgacgacagauucc

SEQ ID NO: 1943565 - RNA, 21 nt, Shigella flexneri 2a str. 2457T
gcccugcagcaucaccggaug

SEQ ID NO: 1943566 - RNA, 15 nt, Shigella flexneri 2a str. 2457T
gcccuuugcgcauga

SEQ ID NO: 1943567 - RNA, 23 nt, Shigella flexneri 2a str. 2457T
gcccuuguugcuauggggaaaaa

SEQ ID NO: 1943568 - RNA, 22 nt, Shigella flexneri 2a str. 2457T
gcccuuucugcauccguucuuc

SEQ ID NO: 1943569 - RNA, 12 nt, Shigella flexneri 2a str. 2457T
gcccuuccccuu

SEQ ID NO: 1943570 - RNA, 22 nt, Shigella flexneri 2a str. 2457T
gcccuucggggcuaaugccagu

SEQ ID NO: 1943571 - RNA, 22 nt, Shigella flexneri 2a str. 2457T
gcccuuaauuacguuuccgcua

SEQ ID NO: 1943572 - RNA, 20 nt, Shigella flexneri 2a str. 2457T
gcccuucacccauugccgcc

SEQ ID NO: 1943573 - RNA, 20 nt, Shigella flexneri 2a str. 2457T
gcccuguuugguugccagcc

SEQ ID NO: 1943574 - RNA, 22 nt, Shigella flexneri 2a str. 2457T
gcccugggcuucauccagcagu

SEQ ID NO: 1943575 - RNA, 14 nt, Shigella flexneri 2a str. 2457T
gcccuggcucugca

SEQ ID NO: 1943576 - RNA, 21 nt, Shigella flexneri 2a str. 2457T
gcccguuuucuccagcgccgc

SEQ ID NO: 1943577 - RNA, 22 nt, Shigella flexneri 2a str. 2457T
gcccguuucucuuaaaugcaca

SEQ ID NO: 1943578 - RNA, 23 nt, Shigella flexneri 2a str. 2457T
gcccguuuggugguuuggcggcg

SEQ ID NO: 1943579 - RNA, 18 nt, Shigella flexneri 2a str. 2457T
gcccguuuucuccagcgc

SEQ ID NO: 1943580 - RNA, 17 nt, Shigella flexneri 2a str. 2457T
gcccgucugggcgcggc

SEQ ID NO: 1943581 - RNA, 15 nt, Shigella flexneri 2a str. 2457T
gcccgugacucccac

SEQ ID NO: 1943582 - RNA, 14 nt, Shigella flexneri 2a str. 2457T
gcccucaaacaaca

SEQ ID NO: 1943583 - RNA, 20 nt, Shigella flexneri 2a str. 2457T
gcccuacuccgccuuugaaa

SEQ ID NO: 1943584 - RNA, 17 nt, Shigella flexneri 2a str. 2457T
gcccucgccuuuuugcg

SEQ ID NO: 1943585 - RNA, 21 nt, Shigella flexneri 2a str. 2457T
gcccucgaucggcucuuccgc

SEQ ID NO: 1943586 - RNA, 21 nt, Shigella flexneri 2a str. 2457T
gcccuccgguccgccguagcc

SEQ ID NO: 1943587 - RNA, 18 nt, Shigella flexneri 2a str. 2457T
gcccgguaaacguggugc

SEQ ID NO: 1943588 - RNA, 14 nt, Shigella flexneri 2a str. 2457T
gcccgccguuaugg

SEQ ID NO: 1943589 - RNA, 14 nt, Shigella flexneri 2a str. 2457T
gcccgccagcaccg

SEQ ID NO: 1943590 - RNA, 14 nt, Shigella flexneri 2a str. 2457T
gcccgccgcugguu

SEQ ID NO: 1943591 - RNA, 12 nt, Shigella flexneri 2a str. 2457T
gcccgguaucaa

SEQ ID NO: 1943592 - RNA, 23 nt, Shigella flexneri 2a str. 2457T
gcccgguuucgccacggcgcagc

SEQ ID NO: 1943593 - RNA, 23 nt, Shigella flexneri 2a str. 2457T
gcccguaacucacugaugccguu

SEQ ID NO: 1943594 - RNA, 16 nt, Shigella flexneri 2a str. 2457T
gcccguacgcuguggu

SEQ ID NO: 1943595 - RNA, 17 nt, Shigella flexneri 2a str. 2457T
gcccgucaugccgucgc

SEQ ID NO: 1943596 - RNA, 11 nt, Shigella flexneri 2a str. 2457T
gcccguccauc

SEQ ID NO: 1943597 - RNA, 22 nt, Shigella flexneri 2a str. 2457T
gccaugcuuugcaucccagaaa

SEQ ID NO: 1943598 - RNA, 21 nt, Shigella flexneri 2a str. 2457T
gccauggcugcgauaguggaa

SEQ ID NO: 1943599 - RNA, 15 nt, Shigella flexneri 2a str. 2457T
gccaugacuuucugg

SEQ ID NO: 1943600 - RNA, 18 nt, Shigella flexneri 2a str. 2457T
gccaugaccgcuccgcca

SEQ ID NO: 1943601 - RNA, 15 nt, Shigella flexneri 2a str. 2457T
gccauugaccagcug

SEQ ID NO: 1943602 - RNA, 13 nt, Shigella flexneri 2a str. 2457T
gcccaacuguuga

SEQ ID NO: 1943603 - RNA, 15 nt, Shigella flexneri 2a str. 2457T
gcccaacuguugauc

SEQ ID NO: 1943604 - RNA, 20 nt, Shigella flexneri 2a str. 2457T
gcccaacuguugauccagga

SEQ ID NO: 1943605 - RNA, 15 nt, Shigella flexneri 2a str. 2457T
gccauuuuucagacg

SEQ ID NO: 1943606 - RNA, 16 nt, Shigella flexneri 2a str. 2457T
gccauuuuuuugucug

SEQ ID NO: 1943607 - RNA, 23 nt, Shigella flexneri 2a str. 2457T
gccaguuguugauaagccccagu

SEQ ID NO: 1943608 - RNA, 19 nt, Shigella flexneri 2a str. 2457T
gccaguuucggacgcggca

SEQ ID NO: 1943609 - RNA, 16 nt, Shigella flexneri 2a str. 2457T
gccauaaacagcaggc

SEQ ID NO: 1943610 - RNA, 22 nt, Shigella flexneri 2a str. 2457T
gccaguuuugugcccgcgugga

SEQ ID NO: 1943611 - RNA, 20 nt, Shigella flexneri 2a str. 2457T
gccauaaacugagccaaacg

SEQ ID NO: 1943612 - RNA, 19 nt, Shigella flexneri 2a str. 2457T
gccauaaagaaaucaccug

SEQ ID NO: 1943613 - RNA, 21 nt, Shigella flexneri 2a str. 2457T
gccauacccgccagugcugaa

SEQ ID NO: 1943614 - RNA, 15 nt, Shigella flexneri 2a str. 2457T
gccaucaaugugcug

SEQ ID NO: 1943615 - RNA, 20 nt, Shigella flexneri 2a str. 2457T
gccaucaaucacuuugcgcu

SEQ ID NO: 1943616 - RNA, 24 nt, Shigella flexneri 2a str. 2457T
gccaucaaauagccccugacuggu

SEQ ID NO: 1943617 - RNA, 15 nt, Shigella flexneri 2a str. 2457T
gccaucacugacugc

SEQ ID NO: 1943618 - RNA, 21 nt, Shigella flexneri 2a str. 2457T
gccaucaccaucguugcuaac

SEQ ID NO: 1943619 - RNA, 17 nt, Shigella flexneri 2a str. 2457T
gccauccaccagugacu

SEQ ID NO: 1943620 - RNA, 19 nt, Shigella flexneri 2a str. 2457T
gccaucgccugaucgccau

SEQ ID NO: 1943621 - RNA, 21 nt, Shigella flexneri 2a str. 2457T
gccaucgcgguuaaucggcag

SEQ ID NO: 1943622 - RNA, 11 nt, Shigella flexneri 2a str. 2457T
gccauccggca

SEQ ID NO: 1943623 - RNA, 22 nt, Shigella flexneri 2a str. 2457T
gccaucccuaccgcccgcgcgg

SEQ ID NO: 1943624 - RNA, 20 nt, Shigella flexneri 2a str. 2457T
gccaucccugucguccagac

SEQ ID NO: 1943625 - RNA, 17 nt, Shigella flexneri 2a str. 2457T
gccagguuuaccagcag

SEQ ID NO: 1943626 - RNA, 14 nt, Shigella flexneri 2a str. 2457T
gccaguaacucauu

SEQ ID NO: 1943627 - RNA, 22 nt, Shigella flexneri 2a str. 2457T
gccaguaagacaccccacagcu

SEQ ID NO: 1943628 - RNA, 23 nt, Shigella flexneri 2a str. 2457T
gccagguauucaugcccgcgcaa

SEQ ID NO: 1943629 - RNA, 14 nt, Shigella flexneri 2a str. 2457T
gccagggugcuggc

SEQ ID NO: 1943630 - RNA, 17 nt, Shigella flexneri 2a str. 2457T
gccagggugcuggcgcu

SEQ ID NO: 1943631 - RNA, 19 nt, Shigella flexneri 2a str. 2457T
gccacuguuccggagaagc

SEQ ID NO: 1943632 - RNA, 18 nt, Shigella flexneri 2a str. 2457T
gccacuucguaaccagcc

SEQ ID NO: 1943633 - RNA, 17 nt, Shigella flexneri 2a str. 2457T
gccacuucuguuacucc

SEQ ID NO: 1943634 - RNA, 14 nt, Shigella flexneri 2a str. 2457T
gccacuucuuccag

SEQ ID NO: 1943635 - RNA, 13 nt, Shigella flexneri 2a str. 2457T
gccaggcuggcag

SEQ ID NO: 1943636 - RNA, 14 nt, Shigella flexneri 2a str. 2457T
gccaggcuggcgga

SEQ ID NO: 1943637 - RNA, 21 nt, Shigella flexneri 2a str. 2457T
gccagugauugcuugccccuu

SEQ ID NO: 1943638 - RNA, 16 nt, Shigella flexneri 2a str. 2457T
gccagucuuccgccgg

SEQ ID NO: 1943639 - RNA, 15 nt, Shigella flexneri 2a str. 2457T
gccagucuggcuucg

SEQ ID NO: 1943640 - RNA, 16 nt, Shigella flexneri 2a str. 2457T
gccaguguuaaccaga

SEQ ID NO: 1943641 - RNA, 15 nt, Shigella flexneri 2a str. 2457T
gccagugcugaaggu

SEQ ID NO: 1943642 - RNA, 17 nt, Shigella flexneri 2a str. 2457T
gccagugccgcccacca

SEQ ID NO: 1943643 - RNA, 15 nt, Shigella flexneri 2a str. 2457T
gccaguucuuccagu

SEQ ID NO: 1943644 - RNA, 22 nt, Shigella flexneri 2a str. 2457T
gccaguucggaugugaaccuca

SEQ ID NO: 1943645 - RNA, 23 nt, Shigella flexneri 2a str. 2457T
gccaguucguuguaguguuccug

SEQ ID NO: 1943646 - RNA, 14 nt, Shigella flexneri 2a str. 2457T
gccaguuccgccgg

SEQ ID NO: 1943647 - RNA, 14 nt, Shigella flexneri 2a str. 2457T
gccaguucccccug

SEQ ID NO: 1943648 - RNA, 14 nt, Shigella flexneri 2a str. 2457T
gccaguuacugcca

SEQ ID NO: 1943649 - RNA, 20 nt, Shigella flexneri 2a str. 2457T
gccaguuacugccaccaucc

SEQ ID NO: 1943650 - RNA, 14 nt, Shigella flexneri 2a str. 2457T
gccaguacgcgccc

SEQ ID NO: 1943651 - RNA, 16 nt, Shigella flexneri 2a str. 2457T
gccaguacgcgcccgu

SEQ ID NO: 1943652 - RNA, 18 nt, Shigella flexneri 2a str. 2457T
gccaguaaucuggccaau

SEQ ID NO: 1943653 - RNA, 18 nt, Shigella flexneri 2a str. 2457T
gccaguaccagcagcgcc

SEQ ID NO: 1943654 - RNA, 19 nt, Shigella flexneri 2a str. 2457T
gccaguaauccggcuuccu

SEQ ID NO: 1943655 - RNA, 15 nt, Shigella flexneri 2a str. 2457T
gccaguaagcagucc

SEQ ID NO: 1943656 - RNA, 21 nt, Shigella flexneri 2a str. 2457T
gccagucagcucucagccagc

SEQ ID NO: 1943657 - RNA, 15 nt, Shigella flexneri 2a str. 2457T
gccagucacaucagc

SEQ ID NO: 1943658 - RNA, 17 nt, Shigella flexneri 2a str. 2457T
gccagucaguuaagcaa

SEQ ID NO: 1943659 - RNA, 16 nt, Shigella flexneri 2a str. 2457T
gccagucccuuucagg

SEQ ID NO: 1943660 - RNA, 21 nt, Shigella flexneri 2a str. 2457T
gccagucgcgccuuacgcugc

SEQ ID NO: 1943661 - RNA, 16 nt, Shigella flexneri 2a str. 2457T
gccccagaccugaauu

SEQ ID NO: 1943662 - RNA, 22 nt, Shigella flexneri 2a str. 2457T
gccccagaauucacgcacuucc

SEQ ID NO: 1943663 - RNA, 17 nt, Shigella flexneri 2a str. 2457T
gccccagaauuuucucu

SEQ ID NO: 1943664 - RNA, 16 nt, Shigella flexneri 2a str. 2457T
gccccaccagcaaaua

SEQ ID NO: 1943665 - RNA, 14 nt, Shigella flexneri 2a str. 2457T
gccccaccagcaaa

SEQ ID NO: 1943666 - RNA, 14 nt, Shigella flexneri 2a str. 2457T
gccccacagaccca

SEQ ID NO: 1943667 - RNA, 15 nt, Shigella flexneri 2a str. 2457T
gccccacagacccag

SEQ ID NO: 1943668 - RNA, 17 nt, Shigella flexneri 2a str. 2457T
gccccacaaacccgcca

SEQ ID NO: 1943669 - RNA, 13 nt, Shigella flexneri 2a str. 2457T
gccccacaccgcg

SEQ ID NO: 1943670 - RNA, 17 nt, Shigella flexneri 2a str. 2457T
gcccaguugaucaccag

SEQ ID NO: 1943671 - RNA, 20 nt, Shigella flexneri 2a str. 2457T
gcccaucgcgcccgccgcca

SEQ ID NO: 1943672 - RNA, 16 nt, Shigella flexneri 2a str. 2457T
gcccaguaccgccagu

SEQ ID NO: 1943673 - RNA, 18 nt, Shigella flexneri 2a str. 2457T
gcccagugaccaaaggcg

SEQ ID NO: 1943674 - RNA, 18 nt, Shigella flexneri 2a str. 2457T
gcccagugaguuggggcc

SEQ ID NO: 1943675 - RNA, 19 nt, Shigella flexneri 2a str. 2457T
gcccagugaguuggggcca

SEQ ID NO: 1943676 - RNA, 18 nt, Shigella flexneri 2a str. 2457T
gcccaguaucugacagca

SEQ ID NO: 1943677 - RNA, 19 nt, Shigella flexneri 2a str. 2457T
gcccaguaucugacagcaa

SEQ ID NO: 1943678 - RNA, 22 nt, Shigella flexneri 2a str. 2457T
gcccaguaucugacagcaaaua

SEQ ID NO: 1943679 - RNA, 17 nt, Shigella flexneri 2a str. 2457T
gcccaggcaucccggca

SEQ ID NO: 1943680 - RNA, 17 nt, Shigella flexneri 2a str. 2457T
gcccagccuuuccggca

SEQ ID NO: 1943681 - RNA, 13 nt, Shigella flexneri 2a str. 2457T
gcccagcgcagga

SEQ ID NO: 1943682 - RNA, 10 nt, Shigella flexneri 2a str. 2457T
gcccagcaga

SEQ ID NO: 1943683 - RNA, 11 nt, Shigella flexneri 2a str. 2457T
gcccagcagac

SEQ ID NO: 1943684 - RNA, 17 nt, Shigella flexneri 2a str. 2457T
gcccaaucaucgcggca

SEQ ID NO: 1943685 - RNA, 19 nt, Shigella flexneri 2a str. 2457T
gcccagagaacuggcggca

SEQ ID NO: 1943686 - RNA, 23 nt, Shigella flexneri 2a str. 2457T
gcccaauacagcgcggaccccac

SEQ ID NO: 1943687 - RNA, 22 nt, Shigella flexneri 2a str. 2457T
gcccaauauccauagugaagug

SEQ ID NO: 1943688 - RNA, 13 nt, Shigella flexneri 2a str. 2457T
gcccaagcgggga

SEQ ID NO: 1943689 - RNA, 21 nt, Shigella flexneri 2a str. 2457T
gcccaacuguugauccaggag

SEQ ID NO: 1943690 - RNA, 22 nt, Shigella flexneri 2a str. 2457T
gccccagcaggauguuccggca

SEQ ID NO: 1943691 - RNA, 14 nt, Shigella flexneri 2a str. 2457T
gccccagccuacag

SEQ ID NO: 1943692 - RNA, 20 nt, Shigella flexneri 2a str. 2457T
gccccagcuucauaaggaaa

SEQ ID NO: 1943693 - RNA, 16 nt, Shigella flexneri 2a str. 2457T
gccccaggccagcagc

SEQ ID NO: 1943694 - RNA, 16 nt, Shigella flexneri 2a str. 2457T
gccccaucaacgccau

SEQ ID NO: 1943695 - RNA, 16 nt, Shigella flexneri 2a str. 2457T
gccccagucuuccugc

SEQ ID NO: 1943696 - RNA, 21 nt, Shigella flexneri 2a str. 2457T
gccccgaugccaucauggcga

SEQ ID NO: 1943697 - RNA, 13 nt, Shigella flexneri 2a str. 2457T
gccccgcgcggcg

SEQ ID NO: 1943698 - RNA, 17 nt, Shigella flexneri 2a str. 2457T
gccccgcucgcuggugc

SEQ ID NO: 1943699 - RNA, 16 nt, Shigella flexneri 2a str. 2457T
gccccgagaaaaauag

SEQ ID NO: 1943700 - RNA, 13 nt, Shigella flexneri 2a str. 2457T
gcccccgauccag

SEQ ID NO: 1943701 - RNA, 19 nt, Shigella flexneri 2a str. 2457T
gcccgcagccaucacugac

SEQ ID NO: 1943702 - RNA, 23 nt, Shigella flexneri 2a str. 2457T
gcccgauggugaugccaucgggc

SEQ ID NO: 1943703 - RNA, 22 nt, Shigella flexneri 2a str. 2457T
gcccgcaacaaacuuaugcugc

SEQ ID NO: 1943704 - RNA, 21 nt, Shigella flexneri 2a str. 2457T
gccccugagcguuacccgcag

SEQ ID NO: 1943705 - RNA, 14 nt, Shigella flexneri 2a str. 2457T
gccccugcgccagc

SEQ ID NO: 1943706 - RNA, 15 nt, Shigella flexneri 2a str. 2457T
gccccugaauaaucg

SEQ ID NO: 1943707 - RNA, 18 nt, Shigella flexneri 2a str. 2457T
gccaccgaccaggcaaac

SEQ ID NO: 1943708 - RNA, 21 nt, Shigella flexneri 2a str. 2457T
gccaccgaacaaaacagcgag

SEQ ID NO: 1943709 - RNA, 17 nt, Shigella flexneri 2a str. 2457T
gccaccgcacgcaggcc

SEQ ID NO: 1943710 - RNA, 16 nt, Shigella flexneri 2a str. 2457T
gccacagccagccaac

SEQ ID NO: 1943711 - RNA, 21 nt, Shigella flexneri 2a str. 2457T
gccacagauaauaauguguuc

SEQ ID NO: 1943712 - RNA, 20 nt, Shigella flexneri 2a str. 2457T
gccacagcgccagacacugg

SEQ ID NO: 1943713 - RNA, 16 nt, Shigella flexneri 2a str. 2457T
gccacaacgcaauaaa

SEQ ID NO: 1943714 - RNA, 14 nt, Shigella flexneri 2a str. 2457T
gccacuaucgccau

SEQ ID NO: 1943715 - RNA, 13 nt, Shigella flexneri 2a str. 2457T
gccacuaacgcau

SEQ ID NO: 1943716 - RNA, 13 nt, Shigella flexneri 2a str. 2457T
gccacgucauccg

SEQ ID NO: 1943717 - RNA, 12 nt, Shigella flexneri 2a str. 2457T
gccacuggcgcg

SEQ ID NO: 1943718 - RNA, 20 nt, Shigella flexneri 2a str. 2457T
gccacugcccgagaacagca

SEQ ID NO: 1943719 - RNA, 14 nt, Shigella flexneri 2a str. 2457T
gccaccuuucuguu

SEQ ID NO: 1943720 - RNA, 14 nt, Shigella flexneri 2a str. 2457T
gccacggcuccagc

SEQ ID NO: 1943721 - RNA, 19 nt, Shigella flexneri 2a str. 2457T
gccacgguaucaagcccgc

SEQ ID NO: 1943722 - RNA, 13 nt, Shigella flexneri 2a str. 2457T
gccaagcgccgcc

SEQ ID NO: 1943723 - RNA, 16 nt, Shigella flexneri 2a str. 2457T
gccaaucagcaauaaa

SEQ ID NO: 1943724 - RNA, 22 nt, Shigella flexneri 2a str. 2457T
gccaauacaaaauuuaacacca

SEQ ID NO: 1943725 - RNA, 18 nt, Shigella flexneri 2a str. 2457T
gccacaaccguccuccgu

SEQ ID NO: 1943726 - RNA, 16 nt, Shigella flexneri 2a str. 2457T
gccaauguguuuauaa

SEQ ID NO: 1943727 - RNA, 23 nt, Shigella flexneri 2a str. 2457T
gccaauguguuuauaagccaugu

SEQ ID NO: 1943728 - RNA, 22 nt, Shigella flexneri 2a str. 2457T
gccaauuaaugcaccaacaaau

SEQ ID NO: 1943729 - RNA, 18 nt, Shigella flexneri 2a str. 2457T
gccaaugcaggcaucggu

SEQ ID NO: 1943730 - RNA, 21 nt, Shigella flexneri 2a str. 2457T
gccaauccagaacaccauaau

SEQ ID NO: 1943731 - RNA, 19 nt, Shigella flexneri 2a str. 2457T
gccaaucccggaagccacc

SEQ ID NO: 1943732 - RNA, 18 nt, Shigella flexneri 2a str. 2457T
gccaacguccauaaugcg

SEQ ID NO: 1943733 - RNA, 13 nt, Shigella flexneri 2a str. 2457T
gccaacuggcaaa

SEQ ID NO: 1943734 - RNA, 18 nt, Shigella flexneri 2a str. 2457T
gccaacgcccauaaugcg

SEQ ID NO: 1943735 - RNA, 11 nt, Shigella flexneri 2a str. 2457T
gccaaccugcg

SEQ ID NO: 1943736 - RNA, 14 nt, Shigella flexneri 2a str. 2457T
gccaaccacaugau

SEQ ID NO: 1943737 - RNA, 16 nt, Shigella flexneri 2a str. 2457T
gccaaccaugccgccc

SEQ ID NO: 1943738 - RNA, 18 nt, Shigella flexneri 2a str. 2457T
gccaacaaucucuuccag

SEQ ID NO: 1943739 - RNA, 20 nt, Shigella flexneri 2a str. 2457T
gccaacagcgacaucaaauu

SEQ ID NO: 1943740 - RNA, 15 nt, Shigella flexneri 2a str. 2457T
gccaacaaucucuuc

SEQ ID NO: 1943741 - RNA, 17 nt, Shigella flexneri 2a str. 2457T
gccaacaaucucuucca

SEQ ID NO: 1943742 - RNA, 17 nt, Shigella flexneri 2a str. 2457T
gccaaacagaccaaugg

SEQ ID NO: 1943743 - RNA, 11 nt, Shigella flexneri 2a str. 2457T
gccaaaaugcc

SEQ ID NO: 1943744 - RNA, 15 nt, Shigella flexneri 2a str. 2457T
gccaaaauaacuuaa

SEQ ID NO: 1943745 - RNA, 16 nt, Shigella flexneri 2a str. 2457T
gcaucaauaacccugg

SEQ ID NO: 1943746 - RNA, 17 nt, Shigella flexneri 2a str. 2457T
gcaucaauaaucaacgc

SEQ ID NO: 1943747 - RNA, 17 nt, Shigella flexneri 2a str. 2457T
gcaucacaucgcuggug

SEQ ID NO: 1943748 - RNA, 12 nt, Shigella flexneri 2a str. 2457T
gcaucaccagac

SEQ ID NO: 1943749 - RNA, 19 nt, Shigella flexneri 2a str. 2457T
gcaucacuacaaccgggau

SEQ ID NO: 1943750 - RNA, 23 nt, Shigella flexneri 2a str. 2457T
gcaucacuuucggugacagaaac

SEQ ID NO: 1943751 - RNA, 17 nt, Shigella flexneri 2a str. 2457T
gcauacugcgauugucg

SEQ ID NO: 1943752 - RNA, 23 nt, Shigella flexneri 2a str. 2457T
gcauacugcgugucguaagccac

SEQ ID NO: 1943753 - RNA, 18 nt, Shigella flexneri 2a str. 2457T
gcauacuuucaucaaacg

SEQ ID NO: 1943754 - RNA, 17 nt, Shigella flexneri 2a str. 2457T
gcauagguugaaauaaa

SEQ ID NO: 1943755 - RNA, 16 nt, Shigella flexneri 2a str. 2457T
gcauauaguuuugcau

SEQ ID NO: 1943756 - RNA, 12 nt, Shigella flexneri 2a str. 2457T
gcaguagcugca

SEQ ID NO: 1943757 - RNA, 15 nt, Shigella flexneri 2a str. 2457T
gcaguacgcggcggu

SEQ ID NO: 1943758 - RNA, 15 nt, Shigella flexneri 2a str. 2457T
gcauaauuuccagca

SEQ ID NO: 1943759 - RNA, 14 nt, Shigella flexneri 2a str. 2457T
gcauacaaauaagu

SEQ ID NO: 1943760 - RNA, 20 nt, Shigella flexneri 2a str. 2457T
gcauacucuccuccagguua

SEQ ID NO: 1943761 - RNA, 15 nt, Shigella flexneri 2a str. 2457T
gcauacucuccucca

SEQ ID NO: 1943762 - RNA, 23 nt, Shigella flexneri 2a str. 2457T
gcauaccuucacagaaggccagg

SEQ ID NO: 1943763 - RNA, 15 nt, Shigella flexneri 2a str. 2457T
gcauacggguuuucc

SEQ ID NO: 1943764 - RNA, 15 nt, Shigella flexneri 2a str. 2457T
gcauacggugaaagu

SEQ ID NO: 1943765 - RNA, 13 nt, Shigella flexneri 2a str. 2457T
gcauacccagaac

SEQ ID NO: 1943766 - RNA, 17 nt, Shigella flexneri 2a str. 2457T
gcauacccagaacuauc

SEQ ID NO: 1943767 - RNA, 13 nt, Shigella flexneri 2a str. 2457T
gcauaccccuuca

SEQ ID NO: 1943768 - RNA, 19 nt, Shigella flexneri 2a str. 2457T
gcauaccuucacagaaggc

SEQ ID NO: 1943769 - RNA, 19 nt, Shigella flexneri 2a str. 2457T
gcaucccgguaucaaagcg

SEQ ID NO: 1943770 - RNA, 14 nt, Shigella flexneri 2a str. 2457T
gcauccgacaucaa

SEQ ID NO: 1943771 - RNA, 22 nt, Shigella flexneri 2a str. 2457T
gcaucccggcagccccaaacag

SEQ ID NO: 1943772 - RNA, 23 nt, Shigella flexneri 2a str. 2457T
gcaucccgguaucaaagcgccag

SEQ ID NO: 1943773 - RNA, 21 nt, Shigella flexneri 2a str. 2457T
gcaucccgguaucaaagcgcc

SEQ ID NO: 1943774 - RNA, 18 nt, Shigella flexneri 2a str. 2457T
gcauccggcaaucggugc

SEQ ID NO: 1943775 - RNA, 14 nt, Shigella flexneri 2a str. 2457T
gcauccggcaugaa

SEQ ID NO: 1943776 - RNA, 20 nt, Shigella flexneri 2a str. 2457T
gcauccggcauaaacaaagc

SEQ ID NO: 1943777 - RNA, 20 nt, Shigella flexneri 2a str. 2457T
gcaucagcgccaccagcgcc

SEQ ID NO: 1943778 - RNA, 21 nt, Shigella flexneri 2a str. 2457T
gcaucccauuucuccagcagu

SEQ ID NO: 1943779 - RNA, 22 nt, Shigella flexneri 2a str. 2457T
gcaucagcagaaucgcaaccag

SEQ ID NO: 1943780 - RNA, 16 nt, Shigella flexneri 2a str. 2457T
gcaucagcaacacgcu

SEQ ID NO: 1943781 - RNA, 22 nt, Shigella flexneri 2a str. 2457T
gcaucagcaacacgcugcucau

SEQ ID NO: 1943782 - RNA, 17 nt, Shigella flexneri 2a str. 2457T
gcaucagcgccaccagc

SEQ ID NO: 1943783 - RNA, 14 nt, Shigella flexneri 2a str. 2457T
gcaucagcgccacc

SEQ ID NO: 1943784 - RNA, 14 nt, Shigella flexneri 2a str. 2457T
gcaucagcagcacg

SEQ ID NO: 1943785 - RNA, 17 nt, Shigella flexneri 2a str. 2457T
gcaucagcccaaagcag

SEQ ID NO: 1943786 - RNA, 17 nt, Shigella flexneri 2a str. 2457T
gcauccggugauuuuca

SEQ ID NO: 1943787 - RNA, 20 nt, Shigella flexneri 2a str. 2457T
gcauccgggauggucagcgg

SEQ ID NO: 1943788 - RNA, 18 nt, Shigella flexneri 2a str. 2457T
gcauccggucagacaacu

SEQ ID NO: 1943789 - RNA, 16 nt, Shigella flexneri 2a str. 2457T
gcaucgcgauggcaag

SEQ ID NO: 1943790 - RNA, 23 nt, Shigella flexneri 2a str. 2457T
gcaucgcgacagugcauaaauac

SEQ ID NO: 1943791 - RNA, 17 nt, Shigella flexneri 2a str. 2457T
gcaucgggcagcaucgc

SEQ ID NO: 1943792 - RNA, 14 nt, Shigella flexneri 2a str. 2457T
gcaucggcauaauc

SEQ ID NO: 1943793 - RNA, 23 nt, Shigella flexneri 2a str. 2457T
gcaucggcaaucacaucaccaua

SEQ ID NO: 1943794 - RNA, 23 nt, Shigella flexneri 2a str. 2457T
gcaucggcaaaacgguaguugaa

SEQ ID NO: 1943795 - RNA, 22 nt, Shigella flexneri 2a str. 2457T
gcauugacgauaucgauaaaga

SEQ ID NO: 1943796 - RNA, 15 nt, Shigella flexneri 2a str. 2457T
gcauugacaagcuca

SEQ ID NO: 1943797 - RNA, 16 nt, Shigella flexneri 2a str. 2457T
gcauuggguauucauu

SEQ ID NO: 1943798 - RNA, 22 nt, Shigella flexneri 2a str. 2457T
gccaaaaaucgcaaauugacua

SEQ ID NO: 1943799 - RNA, 13 nt, Shigella flexneri 2a str. 2457T
gcauuuugcugau

SEQ ID NO: 1943800 - RNA, 15 nt, Shigella flexneri 2a str. 2457T
gcauuuuuaucacgu

SEQ ID NO: 1943801 - RNA, 14 nt, Shigella flexneri 2a str. 2457T
gcauuaacagccag

SEQ ID NO: 1943802 - RNA, 13 nt, Shigella flexneri 2a str. 2457T
gcauuaaauugug

SEQ ID NO: 1943803 - RNA, 14 nt, Shigella flexneri 2a str. 2457T
gcauguggcggcgc

SEQ ID NO: 1943804 - RNA, 14 nt, Shigella flexneri 2a str. 2457T
gcauuauucaucug

SEQ ID NO: 1943805 - RNA, 17 nt, Shigella flexneri 2a str. 2457T
gcauuaucucuugccag

SEQ ID NO: 1943806 - RNA, 14 nt, Shigella flexneri 2a str. 2457T
gcauuauccagcga

SEQ ID NO: 1943807 - RNA, 21 nt, Shigella flexneri 2a str. 2457T
gcauucagacacgccgccaga

SEQ ID NO: 1943808 - RNA, 17 nt, Shigella flexneri 2a str. 2457T
gcauucagcagcagcaa

SEQ ID NO: 1943809 - RNA, 18 nt, Shigella flexneri 2a str. 2457T
gcauucucacuccagcca

SEQ ID NO: 1943810 - RNA, 16 nt, Shigella flexneri 2a str. 2457T
gcauucuggagcugga

SEQ ID NO: 1943811 - RNA, 13 nt, Shigella flexneri 2a str. 2457T
gcaugacagcgcc

SEQ ID NO: 1943812 - RNA, 14 nt, Shigella flexneri 2a str. 2457T
gcaugacaggcaac

SEQ ID NO: 1943813 - RNA, 15 nt, Shigella flexneri 2a str. 2457T
gcaugaacaaagcgc

SEQ ID NO: 1943814 - RNA, 13 nt, Shigella flexneri 2a str. 2457T
gcaugaaaugaaa

SEQ ID NO: 1943815 - RNA, 16 nt, Shigella flexneri 2a str. 2457T
gcaugaaagcgaugcu

SEQ ID NO: 1943816 - RNA, 18 nt, Shigella flexneri 2a str. 2457T
gcaucguaguuuuugccc

SEQ ID NO: 1943817 - RNA, 22 nt, Shigella flexneri 2a str. 2457T
gcaucguauugguacauaacac

SEQ ID NO: 1943818 - RNA, 23 nt, Shigella flexneri 2a str. 2457T
gcaucguauugguacauaacaca

SEQ ID NO: 1943819 - RNA, 18 nt, Shigella flexneri 2a str. 2457T
gcaucguauuucagaccu

SEQ ID NO: 1943820 - RNA, 18 nt, Shigella flexneri 2a str. 2457T
gcaucggucagacccagu

SEQ ID NO: 1943821 - RNA, 22 nt, Shigella flexneri 2a str. 2457T
gcaucggugaggaucaccaguc

SEQ ID NO: 1943822 - RNA, 15 nt, Shigella flexneri 2a str. 2457T
gcaucguccgccagc

SEQ ID NO: 1943823 - RNA, 22 nt, Shigella flexneri 2a str. 2457T
gcaucguccgccagccuacaga

SEQ ID NO: 1943824 - RNA, 21 nt, Shigella flexneri 2a str. 2457T
gcaucguccgucgaaagccca

SEQ ID NO: 1943825 - RNA, 12 nt, Shigella flexneri 2a str. 2457T
gcauggggagac

SEQ ID NO: 1943826 - RNA, 14 nt, Shigella flexneri 2a str. 2457T
gcauggcgcuggca

SEQ ID NO: 1943827 - RNA, 18 nt, Shigella flexneri 2a str. 2457T
gcaugccgguagaagcca

SEQ ID NO: 1943828 - RNA, 19 nt, Shigella flexneri 2a str. 2457T
gcaugccgguagaagccag

SEQ ID NO: 1943829 - RNA, 19 nt, Shigella flexneri 2a str. 2457T
gcaugcgaaugcagggccg

SEQ ID NO: 1943830 - RNA, 10 nt, Shigella flexneri 2a str. 2457T
gcaugauaag

SEQ ID NO: 1943831 - RNA, 19 nt, Shigella flexneri 2a str. 2457T
gcaugauaccgauuacuca

SEQ ID NO: 1943832 - RNA, 21 nt, Shigella flexneri 2a str. 2457T
gcaugauagcccggauuucca

SEQ ID NO: 1943833 - RNA, 21 nt, Shigella flexneri 2a str. 2457T
gcaguaccaccggacgcacac

SEQ ID NO: 1943834 - RNA, 12 nt, Shigella flexneri 2a str. 2457T
gcaguaccagau

SEQ ID NO: 1943835 - RNA, 23 nt, Shigella flexneri 2a str. 2457T
gcaggucgcccggauuacagcuc

SEQ ID NO: 1943836 - RNA, 14 nt, Shigella flexneri 2a str. 2457T
gcagguaagaguuu

SEQ ID NO: 1943837 - RNA, 14 nt, Shigella flexneri 2a str. 2457T
gcagguaaucugcc

SEQ ID NO: 1943838 - RNA, 18 nt, Shigella flexneri 2a str. 2457T
gcagguacgguacugaaa

SEQ ID NO: 1943839 - RNA, 14 nt, Shigella flexneri 2a str. 2457T
gcaggcuucaauuu

SEQ ID NO: 1943840 - RNA, 16 nt, Shigella flexneri 2a str. 2457T
gcaggcuuuuuuggua

SEQ ID NO: 1943841 - RNA, 21 nt, Shigella flexneri 2a str. 2457T
gcaggccaacagucuuaaagg

SEQ ID NO: 1943842 - RNA, 19 nt, Shigella flexneri 2a str. 2457T
gcaggcgguggaagcaccu

SEQ ID NO: 1943843 - RNA, 14 nt, Shigella flexneri 2a str. 2457T
gcaggcgcugaaaa

SEQ ID NO: 1943844 - RNA, 18 nt, Shigella flexneri 2a str. 2457T
gcaggcgcuuggcuucca

SEQ ID NO: 1943845 - RNA, 14 nt, Shigella flexneri 2a str. 2457T
gcaggcaucggugc

SEQ ID NO: 1943846 - RNA, 18 nt, Shigella flexneri 2a str. 2457T
gcaggcaccagccccugg

SEQ ID NO: 1943847 - RNA, 23 nt, Shigella flexneri 2a str. 2457T
gcaggcaaccguucggaaaaaua

SEQ ID NO: 1943848 - RNA, 18 nt, Shigella flexneri 2a str. 2457T
gcaggcacaaaaccugcc

SEQ ID NO: 1943849 - RNA, 19 nt, Shigella flexneri 2a str. 2457T
gcaggcaacagggaaauga

SEQ ID NO: 1943850 - RNA, 21 nt, Shigella flexneri 2a str. 2457T
gcagcucgcguucggaaauau

SEQ ID NO: 1943851 - RNA, 18 nt, Shigella flexneri 2a str. 2457T
gcaggaucuccagcuccc

SEQ ID NO: 1943852 - RNA, 17 nt, Shigella flexneri 2a str. 2457T
gcagcgucgcaucaggc

SEQ ID NO: 1943853 - RNA, 19 nt, Shigella flexneri 2a str. 2457T
gcagcguuaaugauauccc

SEQ ID NO: 1943854 - RNA, 23 nt, Shigella flexneri 2a str. 2457T
gcagcgcgcauucagcagcagca

SEQ ID NO: 1943855 - RNA, 21 nt, Shigella flexneri 2a str. 2457T
gcagcgccagcgaagccagcu

SEQ ID NO: 1943856 - RNA, 14 nt, Shigella flexneri 2a str. 2457T
gcagcgccagcgaa

SEQ ID NO: 1943857 - RNA, 16 nt, Shigella flexneri 2a str. 2457T
gcagcgcauuguuucu

SEQ ID NO: 1943858 - RNA, 12 nt, Shigella flexneri 2a str. 2457T
gcagcgccgcgc

SEQ ID NO: 1943859 - RNA, 13 nt, Shigella flexneri 2a str. 2457T
gcagccccgccgg

SEQ ID NO: 1943860 - RNA, 15 nt, Shigella flexneri 2a str. 2457T
gcagccccgccggga

SEQ ID NO: 1943861 - RNA, 18 nt, Shigella flexneri 2a str. 2457T
gcagcccguaagcaaaag

SEQ ID NO: 1943862 - RNA, 14 nt, Shigella flexneri 2a str. 2457T
gcagccgugcccaa

SEQ ID NO: 1943863 - RNA, 16 nt, Shigella flexneri 2a str. 2457T
gcagccgguauccagc

SEQ ID NO: 1943864 - RNA, 15 nt, Shigella flexneri 2a str. 2457T
gcagccgucauugaa

SEQ ID NO: 1943865 - RNA, 17 nt, Shigella flexneri 2a str. 2457T
gcagcgcaaucgccucc

SEQ ID NO: 1943866 - RNA, 18 nt, Shigella flexneri 2a str. 2457T
gcagcgcagcgaguaaaa

SEQ ID NO: 1943867 - RNA, 20 nt, Shigella flexneri 2a str. 2457T
gcagcgauucaacaguagcc

SEQ ID NO: 1943868 - RNA, 16 nt, Shigella flexneri 2a str. 2457T
gcagcaaacgauucaa

SEQ ID NO: 1943869 - RNA, 21 nt, Shigella flexneri 2a str. 2457T
gcagcaaauagccgagcgcgu

SEQ ID NO: 1943870 - RNA, 16 nt, Shigella flexneri 2a str. 2457T
gcagcaaacgaaagca

SEQ ID NO: 1943871 - RNA, 13 nt, Shigella flexneri 2a str. 2457T
gcagcaagccauc

SEQ ID NO: 1943872 - RNA, 21 nt, Shigella flexneri 2a str. 2457T
gcagcaacgaugacaucgcag

SEQ ID NO: 1943873 - RNA, 18 nt, Shigella flexneri 2a str. 2457T
gcagcaaccgguaaagaa

SEQ ID NO: 1943874 - RNA, 19 nt, Shigella flexneri 2a str. 2457T
gcagcaaccgguaaagaag

SEQ ID NO: 1943875 - RNA, 20 nt, Shigella flexneri 2a str. 2457T
gcagcaaccgguaaagaaga

SEQ ID NO: 1943876 - RNA, 16 nt, Shigella flexneri 2a str. 2457T
gcagcaauggcacugu

SEQ ID NO: 1943877 - RNA, 19 nt, Shigella flexneri 2a str. 2457T
gcagcacccugaguuuuca

SEQ ID NO: 1943878 - RNA, 18 nt, Shigella flexneri 2a str. 2457T
gcagcagagcaaucacca

SEQ ID NO: 1943879 - RNA, 17 nt, Shigella flexneri 2a str. 2457T
gcagcagagaaaauauc

SEQ ID NO: 1943880 - RNA, 19 nt, Shigella flexneri 2a str. 2457T
gcagcagagaaaauauccc

SEQ ID NO: 1943881 - RNA, 15 nt, Shigella flexneri 2a str. 2457T
gcagcaugcacccuc

SEQ ID NO: 1943882 - RNA, 16 nt, Shigella flexneri 2a str. 2457T
gcagcaugcacccuca

SEQ ID NO: 1943883 - RNA, 12 nt, Shigella flexneri 2a str. 2457T
gcagccaaaaau

SEQ ID NO: 1943884 - RNA, 19 nt, Shigella flexneri 2a str. 2457T
gcagccaaaaaugacgccc

SEQ ID NO: 1943885 - RNA, 15 nt, Shigella flexneri 2a str. 2457T
gcagccaccgccagc

SEQ ID NO: 1943886 - RNA, 18 nt, Shigella flexneri 2a str. 2457T
gcagccagcacugccgca

SEQ ID NO: 1943887 - RNA, 16 nt, Shigella flexneri 2a str. 2457T
gcagccagcgcgccuu

SEQ ID NO: 1943888 - RNA, 18 nt, Shigella flexneri 2a str. 2457T
gcagccaguuaaccugcu

SEQ ID NO: 1943889 - RNA, 21 nt, Shigella flexneri 2a str. 2457T
gcagccccagagccugaaggu

SEQ ID NO: 1943890 - RNA, 22 nt, Shigella flexneri 2a str. 2457T
gcagcagcguuucgaacaggcc

SEQ ID NO: 1943891 - RNA, 16 nt, Shigella flexneri 2a str. 2457T
gcagcagcgcgcccgg

SEQ ID NO: 1943892 - RNA, 12 nt, Shigella flexneri 2a str. 2457T
gcagcagcgcgc

SEQ ID NO: 1943893 - RNA, 21 nt, Shigella flexneri 2a str. 2457T
gcagcauaugcaaaaggcugg

SEQ ID NO: 1943894 - RNA, 20 nt, Shigella flexneri 2a str. 2457T
gcagcagucaggcgcgcggu

SEQ ID NO: 1943895 - RNA, 19 nt, Shigella flexneri 2a str. 2457T
gcagcaggugcgccagcga

SEQ ID NO: 1943896 - RNA, 15 nt, Shigella flexneri 2a str. 2457T
gcagcaucgccagga

SEQ ID NO: 1943897 - RNA, 13 nt, Shigella flexneri 2a str. 2457T
gcagaacagaaca

SEQ ID NO: 1943898 - RNA, 15 nt, Shigella flexneri 2a str. 2457T
gcagaagcugcagga

SEQ ID NO: 1943899 - RNA, 18 nt, Shigella flexneri 2a str. 2457T
gcagaagcaaucauccca

SEQ ID NO: 1943900 - RNA, 23 nt, Shigella flexneri 2a str. 2457T
gcagaagcauuuuacauccugau

SEQ ID NO: 1943901 - RNA, 20 nt, Shigella flexneri 2a str. 2457T
gcagaagcaaucaucccagu

SEQ ID NO: 1943902 - RNA, 20 nt, Shigella flexneri 2a str. 2457T
gcagaacggugcgaccaaac

SEQ ID NO: 1943903 - RNA, 14 nt, Shigella flexneri 2a str. 2457T
gcagacacugcuga

SEQ ID NO: 1943904 - RNA, 21 nt, Shigella flexneri 2a str. 2457T
gcagacacgcaauaccagcuc

SEQ ID NO: 1943905 - RNA, 15 nt, Shigella flexneri 2a str. 2457T
gcagacaaagugagc

SEQ ID NO: 1943906 - RNA, 18 nt, Shigella flexneri 2a str. 2457T
gcagaaucgcaaccagcg

SEQ ID NO: 1943907 - RNA, 23 nt, Shigella flexneri 2a str. 2457T
gcagaaguuguccaugugcugga

SEQ ID NO: 1943908 - RNA, 20 nt, Shigella flexneri 2a str. 2457T
gcagagaaaauaucccguca

SEQ ID NO: 1943909 - RNA, 23 nt, Shigella flexneri 2a str. 2457T
gcagagaaaaugccgcacaucac

SEQ ID NO: 1943910 - RNA, 21 nt, Shigella flexneri 2a str. 2457T
gcagagaaacgccagcagcag

SEQ ID NO: 1943911 - RNA, 13 nt, Shigella flexneri 2a str. 2457T
gcagacggcuguc

SEQ ID NO: 1943912 - RNA, 17 nt, Shigella flexneri 2a str. 2457T
gcagacuggauugccag

SEQ ID NO: 1943913 - RNA, 16 nt, Shigella flexneri 2a str. 2457T
gcagacgcucguuaaa

SEQ ID NO: 1943914 - RNA, 22 nt, Shigella flexneri 2a str. 2457T
gcagacgcaaaguagcggccug

SEQ ID NO: 1943915 - RNA, 21 nt, Shigella flexneri 2a str. 2457T
gcagaccugcuuuguucagcc

SEQ ID NO: 1943916 - RNA, 11 nt, Shigella flexneri 2a str. 2457T
gcagacgccac

SEQ ID NO: 1943917 - RNA, 22 nt, Shigella flexneri 2a str. 2457T
gcagaccaaggugcuuuaacga

SEQ ID NO: 1943918 - RNA, 14 nt, Shigella flexneri 2a str. 2457T
gcagaccagcaaaa

SEQ ID NO: 1943919 - RNA, 16 nt, Shigella flexneri 2a str. 2457T
gcagaucguuuuccug

SEQ ID NO: 1943920 - RNA, 23 nt, Shigella flexneri 2a str. 2457T
gcagaucgcggcccaccuggcug

SEQ ID NO: 1943921 - RNA, 16 nt, Shigella flexneri 2a str. 2457T
gcagaucgaacacggu

SEQ ID NO: 1943922 - RNA, 12 nt, Shigella flexneri 2a str. 2457T
gcagaucgccaa

SEQ ID NO: 1943923 - RNA, 14 nt, Shigella flexneri 2a str. 2457T
gcagauauugcacc

SEQ ID NO: 1943924 - RNA, 19 nt, Shigella flexneri 2a str. 2457T
gcagaugaagcuggcaaag

SEQ ID NO: 1943925 - RNA, 20 nt, Shigella flexneri 2a str. 2457T
gcagaugaagcuggcaaagu

SEQ ID NO: 1943926 - RNA, 23 nt, Shigella flexneri 2a str. 2457T
gcagaugcgucuucugcagucac

SEQ ID NO: 1943927 - RNA, 12 nt, Shigella flexneri 2a str. 2457T
gcagagcuucac

SEQ ID NO: 1943928 - RNA, 14 nt, Shigella flexneri 2a str. 2457T
gcagagccuguuac

SEQ ID NO: 1943929 - RNA, 14 nt, Shigella flexneri 2a str. 2457T
gcagagccugaaua

SEQ ID NO: 1943930 - RNA, 22 nt, Shigella flexneri 2a str. 2457T
gcagagaucgccccggcaagaa

SEQ ID NO: 1943931 - RNA, 19 nt, Shigella flexneri 2a str. 2457T
gcagagugaagguuucugc

SEQ ID NO: 1943932 - RNA, 13 nt, Shigella flexneri 2a str. 2457T
gcagauaaauauc

SEQ ID NO: 1943933 - RNA, 17 nt, Shigella flexneri 2a str. 2457T
gcagauaucccgccagc

SEQ ID NO: 1943934 - RNA, 23 nt, Shigella flexneri 2a str. 2457T
gcagauaucccgccagcaccagc

SEQ ID NO: 1943935 - RNA, 14 nt, Shigella flexneri 2a str. 2457T
gcacuuacuuuccu

SEQ ID NO: 1943936 - RNA, 14 nt, Shigella flexneri 2a str. 2457T
gcacuuaccuucac

SEQ ID NO: 1943937 - RNA, 23 nt, Shigella flexneri 2a str. 2457T
gcacuuacagcaacgccuaaacu

SEQ ID NO: 1943938 - RNA, 16 nt, Shigella flexneri 2a str. 2457T
gcacuguuucgccagg

SEQ ID NO: 1943939 - RNA, 15 nt, Shigella flexneri 2a str. 2457T
gcacugguacucaac

SEQ ID NO: 1943940 - RNA, 18 nt, Shigella flexneri 2a str. 2457T
gcacugcgcccgccagca

SEQ ID NO: 1943941 - RNA, 14 nt, Shigella flexneri 2a str. 2457T
gcacuggcgagcgc

SEQ ID NO: 1943942 - RNA, 15 nt, Shigella flexneri 2a str. 2457T
gcacugcuugaagcg

SEQ ID NO: 1943943 - RNA, 21 nt, Shigella flexneri 2a str. 2457T
gcacugccagaaucaagguga

SEQ ID NO: 1943944 - RNA, 12 nt, Shigella flexneri 2a str. 2457T
gcacuugcagga

SEQ ID NO: 1943945 - RNA, 19 nt, Shigella flexneri 2a str. 2457T
gcacuucgccaucugccag

SEQ ID NO: 1943946 - RNA, 23 nt, Shigella flexneri 2a str. 2457T
gcacuucgccaucugccagaccc

SEQ ID NO: 1943947 - RNA, 15 nt, Shigella flexneri 2a str. 2457T
gcacuucuuccgggc

SEQ ID NO: 1943948 - RNA, 20 nt, Shigella flexneri 2a str. 2457T
gcacuucacccaucgccaga

SEQ ID NO: 1943949 - RNA, 17 nt, Shigella flexneri 2a str. 2457T
gcacuuucgccugcggc

SEQ ID NO: 1943950 - RNA, 14 nt, Shigella flexneri 2a str. 2457T
gcacuuuguccgcu

SEQ ID NO: 1943951 - RNA, 14 nt, Shigella flexneri 2a str. 2457T
gcacuuuucugggu

SEQ ID NO: 1943952 - RNA, 19 nt, Shigella flexneri 2a str. 2457T
gcagaaacauaauauaaau

SEQ ID NO: 1943953 - RNA, 18 nt, Shigella flexneri 2a str. 2457T
gcacguugggcgcuggcg

SEQ ID NO: 1943954 - RNA, 19 nt, Shigella flexneri 2a str. 2457T
gcacguugucagcaacugu

SEQ ID NO: 1943955 - RNA, 14 nt, Shigella flexneri 2a str. 2457T
gcacguucauccca

SEQ ID NO: 1943956 - RNA, 18 nt, Shigella flexneri 2a str. 2457T
gcacguucgaugcggcuc

SEQ ID NO: 1943957 - RNA, 13 nt, Shigella flexneri 2a str. 2457T
gcacguuccugca

SEQ ID NO: 1943958 - RNA, 17 nt, Shigella flexneri 2a str. 2457T
gcacuacgcagggauau

SEQ ID NO: 1943959 - RNA, 15 nt, Shigella flexneri 2a str. 2457T
gcacgucaucugcac

SEQ ID NO: 1943960 - RNA, 21 nt, Shigella flexneri 2a str. 2457T
gcacgucuuugccgcgcucuu

SEQ ID NO: 1943961 - RNA, 13 nt, Shigella flexneri 2a str. 2457T
gcacuaugugcca

SEQ ID NO: 1943962 - RNA, 17 nt, Shigella flexneri 2a str. 2457T
gcacucaacaaccagaa

SEQ ID NO: 1943963 - RNA, 22 nt, Shigella flexneri 2a str. 2457T
gcacuccuguuaugccucaacc

SEQ ID NO: 1943964 - RNA, 13 nt, Shigella flexneri 2a str. 2457T
gcacucugacgga

SEQ ID NO: 1943965 - RNA, 16 nt, Shigella flexneri 2a str. 2457T
gcacugaaagccgcag

SEQ ID NO: 1943966 - RNA, 16 nt, Shigella flexneri 2a str. 2457T
gcacucgcuggcacuc

SEQ ID NO: 1943967 - RNA, 16 nt, Shigella flexneri 2a str. 2457T
gcacugaccaccacca

SEQ ID NO: 1943968 - RNA, 22 nt, Shigella flexneri 2a str. 2457T
gcacggucaggcuaaagaaaac

SEQ ID NO: 1943969 - RNA, 15 nt, Shigella flexneri 2a str. 2457T
gcacggugaagaagc

SEQ ID NO: 1943970 - RNA, 17 nt, Shigella flexneri 2a str. 2457T
gcacguacaugcagggc

SEQ ID NO: 1943971 - RNA, 18 nt, Shigella flexneri 2a str. 2457T
gcacgcuuuucagugcca

SEQ ID NO: 1943972 - RNA, 18 nt, Shigella flexneri 2a str. 2457T
gcacggauaccgcacgcu

SEQ ID NO: 1943973 - RNA, 18 nt, Shigella flexneri 2a str. 2457T
gcacgcuugccugugcca

SEQ ID NO: 1943974 - RNA, 14 nt, Shigella flexneri 2a str. 2457T
gcacgcuggcguca

SEQ ID NO: 1943975 - RNA, 14 nt, Shigella flexneri 2a str. 2457T
gcacgaaccagaga

SEQ ID NO: 1943976 - RNA, 23 nt, Shigella flexneri 2a str. 2457T
gcacgaauucaacgcguuuuuuc

SEQ ID NO: 1943977 - RNA, 13 nt, Shigella flexneri 2a str. 2457T
gcaccuuuuaugu

SEQ ID NO: 1943978 - RNA, 17 nt, Shigella flexneri 2a str. 2457T
gcaccuuuucaucaggu

SEQ ID NO: 1943979 - RNA, 24 nt, Shigella flexneri 2a str. 2457T
gcaccuuuuccaccaauggcggaa

SEQ ID NO: 1943980 - RNA, 12 nt, Shigella flexneri 2a str. 2457T
gcaccuuuacca

SEQ ID NO: 1943981 - RNA, 23 nt, Shigella flexneri 2a str. 2457T
gcacgcagugguuaacaaucaca

SEQ ID NO: 1943982 - RNA, 18 nt, Shigella flexneri 2a str. 2457T
gcacgaugauauggucaa

SEQ ID NO: 1943983 - RNA, 16 nt, Shigella flexneri 2a str. 2457T
gcacgagaaaaaauga

SEQ ID NO: 1943984 - RNA, 23 nt, Shigella flexneri 2a str. 2457T
gcacgaguguuacgccugccgca

SEQ ID NO: 1943985 - RNA, 22 nt, Shigella flexneri 2a str. 2457T
gcacccauuuauccagcggcag

SEQ ID NO: 1943986 - RNA, 17 nt, Shigella flexneri 2a str. 2457T
gcaccccugauaaccgc

SEQ ID NO: 1943987 - RNA, 21 nt, Shigella flexneri 2a str. 2457T
gcacccgccguuagccagcgc

SEQ ID NO: 1943988 - RNA, 14 nt, Shigella flexneri 2a str. 2457T
gcacccgccagcgc

SEQ ID NO: 1943989 - RNA, 15 nt, Shigella flexneri 2a str. 2457T
gcacccgccagcgcg

SEQ ID NO: 1943990 - RNA, 11 nt, Shigella flexneri 2a str. 2457T
gcaccauucca

SEQ ID NO: 1943991 - RNA, 20 nt, Shigella flexneri 2a str. 2457T
gcaccauugcugccgccagu

SEQ ID NO: 1943992 - RNA, 12 nt, Shigella flexneri 2a str. 2457T
gcaccaguaacg

SEQ ID NO: 1943993 - RNA, 18 nt, Shigella flexneri 2a str. 2457T
gcaccaucaaaguuuuua

SEQ ID NO: 1943994 - RNA, 13 nt, Shigella flexneri 2a str. 2457T
gcaccaucucuua

SEQ ID NO: 1943995 - RNA, 17 nt, Shigella flexneri 2a str. 2457T
gcaccauccgcccacac

SEQ ID NO: 1943996 - RNA, 14 nt, Shigella flexneri 2a str. 2457T
gcaccaccgcccgu

SEQ ID NO: 1943997 - RNA, 19 nt, Shigella flexneri 2a str. 2457T
gcaccaccauugagguuga

SEQ ID NO: 1943998 - RNA, 15 nt, Shigella flexneri 2a str. 2457T
gcaccaccagcagcu

SEQ ID NO: 1943999 - RNA, 16 nt, Shigella flexneri 2a str. 2457T
gcaccaccagcagcug

SEQ ID NO: 1944000 - RNA, 22 nt, Shigella flexneri 2a str. 2457T
gcaccaauagccgcgccgagcg

SEQ ID NO: 1944001 - RNA, 16 nt, Shigella flexneri 2a str. 2457T
gcaccaauauugacug

SEQ ID NO: 1944002 - RNA, 19 nt, Shigella flexneri 2a str. 2457T
gcaccaaucaccgccagca

SEQ ID NO: 1944003 - RNA, 20 nt, Shigella flexneri 2a str. 2457T
gcaccaaucaccgccagcaa

SEQ ID NO: 1944004 - RNA, 22 nt, Shigella flexneri 2a str. 2457T
gcaccaacccuaacccaacauu

SEQ ID NO: 1944005 - RNA, 16 nt, Shigella flexneri 2a str. 2457T
gcaccaacaaauagag

SEQ ID NO: 1944006 - RNA, 21 nt, Shigella flexneri 2a str. 2457T
gcaccaacaaauagagauaga

SEQ ID NO: 1944007 - RNA, 11 nt, Shigella flexneri 2a str. 2457T
gcaccaacaaa

SEQ ID NO: 1944008 - RNA, 14 nt, Shigella flexneri 2a str. 2457T
gcaccaacaaauag

SEQ ID NO: 1944009 - RNA, 15 nt, Shigella flexneri 2a str. 2457T
gcaccaauucaugag

SEQ ID NO: 1944010 - RNA, 19 nt, Shigella flexneri 2a str. 2457T
gcaccaccaaaaacgccau

SEQ ID NO: 1944011 - RNA, 15 nt, Shigella flexneri 2a str. 2457T
gcaccagcuccggca

SEQ ID NO: 1944012 - RNA, 22 nt, Shigella flexneri 2a str. 2457T
gcaccagccccuggaaaaagug

SEQ ID NO: 1944013 - RNA, 13 nt, Shigella flexneri 2a str. 2457T
gcaccagcaacaa

SEQ ID NO: 1944014 - RNA, 14 nt, Shigella flexneri 2a str. 2457T
gcaccacuugcaga

SEQ ID NO: 1944015 - RNA, 19 nt, Shigella flexneri 2a str. 2457T
gcaccacuuccggcaacaa

SEQ ID NO: 1944016 - RNA, 23 nt, Shigella flexneri 2a str. 2457T
gcaccacuuccggcaacaaugcc

SEQ ID NO: 1944017 - RNA, 22 nt, Shigella flexneri 2a str. 2457T
gcaccagaauaccuugcugcuc

SEQ ID NO: 1944018 - RNA, 15 nt, Shigella flexneri 2a str. 2457T
gcaccagaaacaaua

SEQ ID NO: 1944019 - RNA, 14 nt, Shigella flexneri 2a str. 2457T
gcaccuaaagcgcg

SEQ ID NO: 1944020 - RNA, 15 nt, Shigella flexneri 2a str. 2457T
gcaccugccagcgcc

SEQ ID NO: 1944021 - RNA, 21 nt, Shigella flexneri 2a str. 2457T
gcaccuggggcuugccagagc

SEQ ID NO: 1944022 - RNA, 16 nt, Shigella flexneri 2a str. 2457T
gcaccugauccagcuc

SEQ ID NO: 1944023 - RNA, 20 nt, Shigella flexneri 2a str. 2457T
gcaccguaucuucauugugc

SEQ ID NO: 1944024 - RNA, 20 nt, Shigella flexneri 2a str. 2457T
gcaccggugcgaacaaucac

SEQ ID NO: 1944025 - RNA, 18 nt, Shigella flexneri 2a str. 2457T
gcaccggaacaacccagc

SEQ ID NO: 1944026 - RNA, 17 nt, Shigella flexneri 2a str. 2457T
gcaccggacgcuuguca

SEQ ID NO: 1944027 - RNA, 19 nt, Shigella flexneri 2a str. 2457T
gcaccggacuauccgccgc

SEQ ID NO: 1944028 - RNA, 20 nt, Shigella flexneri 2a str. 2457T
gcaccgaggccaaaaccaca

SEQ ID NO: 1944029 - RNA, 14 nt, Shigella flexneri 2a str. 2457T
gcaccgcaccgccc

SEQ ID NO: 1944030 - RNA, 18 nt, Shigella flexneri 2a str. 2457T
gcacccuauuuuuaccca

SEQ ID NO: 1944031 - RNA, 22 nt, Shigella flexneri 2a str. 2457T
gcacccuauuuuuacccaggcc

SEQ ID NO: 1944032 - RNA, 14 nt, Shigella flexneri 2a str. 2457T
gcaccgaagcccau

SEQ ID NO: 1944033 - RNA, 18 nt, Shigella flexneri 2a str. 2457T
gcaccgcgacaaucaggu

SEQ ID NO: 1944034 - RNA, 16 nt, Shigella flexneri 2a str. 2457T
gcaccgccaaccagcg

SEQ ID NO: 1944035 - RNA, 15 nt, Shigella flexneri 2a str. 2457T
gcaccgccaccaccg

SEQ ID NO: 1944036 - RNA, 23 nt, Shigella flexneri 2a str. 2457T
gcacaccugcauucgagccaagc

SEQ ID NO: 1944037 - RNA, 22 nt, Shigella flexneri 2a str. 2457T
gcacaccaggcucuuuaaacag

SEQ ID NO: 1944038 - RNA, 16 nt, Shigella flexneri 2a str. 2457T
gcacaccccggcggcc

SEQ ID NO: 1944039 - RNA, 23 nt, Shigella flexneri 2a str. 2457T
gcacacgacauccgugcagaacu

SEQ ID NO: 1944040 - RNA, 16 nt, Shigella flexneri 2a str. 2457T
gcacacggauauugcu

SEQ ID NO: 1944041 - RNA, 17 nt, Shigella flexneri 2a str. 2457T
gcacacugguucccaac

SEQ ID NO: 1944042 - RNA, 21 nt, Shigella flexneri 2a str. 2457T
gcacagaacaaaauguuuaug

SEQ ID NO: 1944043 - RNA, 21 nt, Shigella flexneri 2a str. 2457T
gcacacugguucccaacaaca

SEQ ID NO: 1944044 - RNA, 22 nt, Shigella flexneri 2a str. 2457T
gcacacugguucccaacaacag

SEQ ID NO: 1944045 - RNA, 21 nt, Shigella flexneri 2a str. 2457T
gcacacuguucauuaaagccg

SEQ ID NO: 1944046 - RNA, 12 nt, Shigella flexneri 2a str. 2457T
gcacacuuagcc

SEQ ID NO: 1944047 - RNA, 12 nt, Shigella flexneri 2a str. 2457T
gcacagaccauc

SEQ ID NO: 1944048 - RNA, 14 nt, Shigella flexneri 2a str. 2457T
gcacagaaccggag

SEQ ID NO: 1944049 - RNA, 21 nt, Shigella flexneri 2a str. 2457T
gcacagacuuaauauugccgu

SEQ ID NO: 1944050 - RNA, 22 nt, Shigella flexneri 2a str. 2457T
gcacaacguuccuucguucaca

SEQ ID NO: 1944051 - RNA, 15 nt, Shigella flexneri 2a str. 2457T
gcacaacucggcggc

SEQ ID NO: 1944052 - RNA, 22 nt, Shigella flexneri 2a str. 2457T
gcacaaauagccagcagagcaa

SEQ ID NO: 1944053 - RNA, 15 nt, Shigella flexneri 2a str. 2457T
gcacaaauagccagc

SEQ ID NO: 1944054 - RNA, 18 nt, Shigella flexneri 2a str. 2457T
gcacaaauagccagcaga

SEQ ID NO: 1944055 - RNA, 23 nt, Shigella flexneri 2a str. 2457T
gcacaaacccagggccaacuggc

SEQ ID NO: 1944056 - RNA, 15 nt, Shigella flexneri 2a str. 2457T
gcacaaaguggcggc

SEQ ID NO: 1944057 - RNA, 16 nt, Shigella flexneri 2a str. 2457T
gcacaaaguggcggcu

SEQ ID NO: 1944058 - RNA, 23 nt, Shigella flexneri 2a str. 2457T
gcacaaguuuuuaggcaugauaa

SEQ ID NO: 1944059 - RNA, 16 nt, Shigella flexneri 2a str. 2457T
gcacaaguuguuuaca

SEQ ID NO: 1944060 - RNA, 15 nt, Shigella flexneri 2a str. 2457T
gcacaauaaucagcc

SEQ ID NO: 1944061 - RNA, 17 nt, Shigella flexneri 2a str. 2457T
gcacaauacauagaaac

SEQ ID NO: 1944062 - RNA, 13 nt, Shigella flexneri 2a str. 2457T
gcacacacaucac

SEQ ID NO: 1944063 - RNA, 11 nt, Shigella flexneri 2a str. 2457T
gcacacacugc

SEQ ID NO: 1944064 - RNA, 24 nt, Shigella flexneri 2a str. 2457T
gcacacacugcuuaacugcgcuuu

SEQ ID NO: 1944065 - RNA, 18 nt, Shigella flexneri 2a str. 2457T
gcacacauuacgccagua

SEQ ID NO: 1944066 - RNA, 23 nt, Shigella flexneri 2a str. 2457T
gcacaaugcuuaaucgcggcggg

SEQ ID NO: 1944067 - RNA, 18 nt, Shigella flexneri 2a str. 2457T
gcacacaagcguaagaga

SEQ ID NO: 1944068 - RNA, 23 nt, Shigella flexneri 2a str. 2457T
gcacaauggagcuaaacagcgcu

SEQ ID NO: 1944069 - RNA, 17 nt, Shigella flexneri 2a str. 2457T
gcacaucaucaaagcca

SEQ ID NO: 1944070 - RNA, 16 nt, Shigella flexneri 2a str. 2457T
gcacaucaucaaagcc

SEQ ID NO: 1944071 - RNA, 15 nt, Shigella flexneri 2a str. 2457T
gcacauagcaccacc

SEQ ID NO: 1944072 - RNA, 23 nt, Shigella flexneri 2a str. 2457T
gcacauauucuggagcauggcug

SEQ ID NO: 1944073 - RNA, 13 nt, Shigella flexneri 2a str. 2457T
gcacauauuuuuc

SEQ ID NO: 1944074 - RNA, 15 nt, Shigella flexneri 2a str. 2457T
gcacaucaauuugcc

SEQ ID NO: 1944075 - RNA, 15 nt, Shigella flexneri 2a str. 2457T
gcacauagcgugaca

SEQ ID NO: 1944076 - RNA, 23 nt, Shigella flexneri 2a str. 2457T
gcacauagcgugacaccagcaca

SEQ ID NO: 1944077 - RNA, 17 nt, Shigella flexneri 2a str. 2457T
gcacaugcauaaagcgg

SEQ ID NO: 1944078 - RNA, 17 nt, Shigella flexneri 2a str. 2457T
gcacaugaugauggcua

SEQ ID NO: 1944079 - RNA, 12 nt, Shigella flexneri 2a str. 2457T
gcacaugcugac

SEQ ID NO: 1944080 - RNA, 21 nt, Shigella flexneri 2a str. 2457T
gcacauuagcgaccuucugaa

SEQ ID NO: 1944081 - RNA, 17 nt, Shigella flexneri 2a str. 2457T
gcaccaaacgggcaagc

SEQ ID NO: 1944082 - RNA, 21 nt, Shigella flexneri 2a str. 2457T
gcaccaaacgggcaagccagc

SEQ ID NO: 1944083 - RNA, 17 nt, Shigella flexneri 2a str. 2457T
gcacauuucacucacgc

SEQ ID NO: 1944084 - RNA, 23 nt, Shigella flexneri 2a str. 2457T
gcacauuucagaaaguauauaaa

SEQ ID NO: 1944085 - RNA, 16 nt, Shigella flexneri 2a str. 2457T
gcacauugugcgccau

SEQ ID NO: 1944086 - RNA, 15 nt, Shigella flexneri 2a str. 2457T
gcacauucugacugg

SEQ ID NO: 1944087 - RNA, 22 nt, Shigella flexneri 2a str. 2457T
gcacauugccguaauggucugc

SEQ ID NO: 1944088 - RNA, 23 nt, Shigella flexneri 2a str. 2457T
gcacagcccgccgccauccugaa

SEQ ID NO: 1944089 - RNA, 16 nt, Shigella flexneri 2a str. 2457T
gcacagcaaaucaccc

SEQ ID NO: 1944090 - RNA, 15 nt, Shigella flexneri 2a str. 2457T
gcacagcaucaggcu

SEQ ID NO: 1944091 - RNA, 16 nt, Shigella flexneri 2a str. 2457T
gcacagcaggccaaga

SEQ ID NO: 1944092 - RNA, 22 nt, Shigella flexneri 2a str. 2457T
gcacagcacgcuuuucagugcc

SEQ ID NO: 1944093 - RNA, 23 nt, Shigella flexneri 2a str. 2457T
gcacagcggaguaaucgccagca

SEQ ID NO: 1944094 - RNA, 15 nt, Shigella flexneri 2a str. 2457T
gcacaguacgcgccc

SEQ ID NO: 1944095 - RNA, 19 nt, Shigella flexneri 2a str. 2457T
gcacaguaaugcgccaggu

SEQ ID NO: 1944096 - RNA, 18 nt, Shigella flexneri 2a str. 2457T
gcacagguggcaaacgcc

SEQ ID NO: 1944097 - RNA, 20 nt, Shigella flexneri 2a str. 2457T
gcacaguacgcgcccgccgc

SEQ ID NO: 1944098 - RNA, 19 nt, Shigella flexneri 2a str. 2457T
gcacaguauagcaucauaa

SEQ ID NO: 1944099 - RNA, 16 nt, Shigella flexneri 2a str. 2457T
gcacaggugcaaaaaa

SEQ ID NO: 1944100 - RNA, 20 nt, Shigella flexneri 2a str. 2457T
gcacaaacauccaucugcuu

SEQ ID NO: 1944101 - RNA, 21 nt, Shigella flexneri 2a str. 2457T
gcacaaacauccaucugcuuu

SEQ ID NO: 1944102 - RNA, 13 nt, Shigella flexneri 2a str. 2457T
gcaauuuccauug

SEQ ID NO: 1944103 - RNA, 14 nt, Shigella flexneri 2a str. 2457T
gcaauuuaaacccu

SEQ ID NO: 1944104 - RNA, 17 nt, Shigella flexneri 2a str. 2457T
gcaauugucgcagaagc

SEQ ID NO: 1944105 - RNA, 22 nt, Shigella flexneri 2a str. 2457T
gcaauuuuccuugaaaaagagg

SEQ ID NO: 1944106 - RNA, 17 nt, Shigella flexneri 2a str. 2457T
gcaauucggauguuagu

SEQ ID NO: 1944107 - RNA, 13 nt, Shigella flexneri 2a str. 2457T
gcaauucuuucuc

SEQ ID NO: 1944108 - RNA, 16 nt, Shigella flexneri 2a str. 2457T
gcaauuccggugacca

SEQ ID NO: 1944109 - RNA, 19 nt, Shigella flexneri 2a str. 2457T
gcaauuagcggcuggcugu

SEQ ID NO: 1944110 - RNA, 14 nt, Shigella flexneri 2a str. 2457T
gcaauucccagaau

SEQ ID NO: 1944111 - RNA, 18 nt, Shigella flexneri 2a str. 2457T
gcaauuggugcacgaugc

SEQ ID NO: 1944112 - RNA, 17 nt, Shigella flexneri 2a str. 2457T
gcaauuggcgcaucaug

SEQ ID NO: 1944113 - RNA, 17 nt, Shigella flexneri 2a str. 2457T
gcaauugccagacaaca

SEQ ID NO: 1944114 - RNA, 16 nt, Shigella flexneri 2a str. 2457T
gcaauuacccaguaga

SEQ ID NO: 1944115 - RNA, 20 nt, Shigella flexneri 2a str. 2457T
gcaauuaccgccaccaggaa

SEQ ID NO: 1944116 - RNA, 13 nt, Shigella flexneri 2a str. 2457T
gcaauucaauuaa

SEQ ID NO: 1944117 - RNA, 14 nt, Shigella flexneri 2a str. 2457T
gcaauuaaauaaag

SEQ ID NO: 1944118 - RNA, 20 nt, Shigella flexneri 2a str. 2457T
gcaauggucgcaucauuuaa

SEQ ID NO: 1944119 - RNA, 15 nt, Shigella flexneri 2a str. 2457T
gcaauggaaaaaguu

SEQ ID NO: 1944120 - RNA, 18 nt, Shigella flexneri 2a str. 2457T
gcaauggaaaaaguuuua

SEQ ID NO: 1944121 - RNA, 16 nt, Shigella flexneri 2a str. 2457T
gcaaugcguuccagca

SEQ ID NO: 1944122 - RNA, 18 nt, Shigella flexneri 2a str. 2457T
gcaaugcggagguuucuu

SEQ ID NO: 1944123 - RNA, 18 nt, Shigella flexneri 2a str. 2457T
gcaaugcguagcugagca

SEQ ID NO: 1944124 - RNA, 14 nt, Shigella flexneri 2a str. 2457T
gcaaugccuucugg

SEQ ID NO: 1944125 - RNA, 22 nt, Shigella flexneri 2a str. 2457T
gcaaucuguuuauuugacagcc

SEQ ID NO: 1944126 - RNA, 16 nt, Shigella flexneri 2a str. 2457T
gcaaucugauugacau

SEQ ID NO: 1944127 - RNA, 16 nt, Shigella flexneri 2a str. 2457T
gcaaucggcugcaccu

SEQ ID NO: 1944128 - RNA, 14 nt, Shigella flexneri 2a str. 2457T
gcaaucgcccagcg

SEQ ID NO: 1944129 - RNA, 22 nt, Shigella flexneri 2a str. 2457T
gcaaucgcccagcgcguaaaua

SEQ ID NO: 1944130 - RNA, 14 nt, Shigella flexneri 2a str. 2457T
gcaaucgagcccag

SEQ ID NO: 1944131 - RNA, 22 nt, Shigella flexneri 2a str. 2457T
gcaaucgaccaggccaucagca

SEQ ID NO: 1944132 - RNA, 16 nt, Shigella flexneri 2a str. 2457T
gcaaugccauccagcu

SEQ ID NO: 1944133 - RNA, 17 nt, Shigella flexneri 2a str. 2457T
gcaaugccauccagcuu

SEQ ID NO: 1944134 - RNA, 22 nt, Shigella flexneri 2a str. 2457T
gcaaugagagggcgauaaaucu

SEQ ID NO: 1944135 - RNA, 23 nt, Shigella flexneri 2a str. 2457T
gcaaucagugguguagggcaggc

SEQ ID NO: 1944136 - RNA, 13 nt, Shigella flexneri 2a str. 2457T
gcaaucaucccag

SEQ ID NO: 1944137 - RNA, 14 nt, Shigella flexneri 2a str. 2457T
gcaaucaucccagu

SEQ ID NO: 1944138 - RNA, 17 nt, Shigella flexneri 2a str. 2457T
gcaaucauauucaccac

SEQ ID NO: 1944139 - RNA, 18 nt, Shigella flexneri 2a str. 2457T
gcaaucauauucaccacg

SEQ ID NO: 1944140 - RNA, 22 nt, Shigella flexneri 2a str. 2457T
gcaaucaucgaugcgaucauua

SEQ ID NO: 1944141 - RNA, 14 nt, Shigella flexneri 2a str. 2457T
gcaaucaucuugua

SEQ ID NO: 1944142 - RNA, 18 nt, Shigella flexneri 2a str. 2457T
gcaaucauucccagaccu

SEQ ID NO: 1944143 - RNA, 20 nt, Shigella flexneri 2a str. 2457T
gcaauccagcucuuuuccag

SEQ ID NO: 1944144 - RNA, 14 nt, Shigella flexneri 2a str. 2457T
gcaauccagcucuu

SEQ ID NO: 1944145 - RNA, 23 nt, Shigella flexneri 2a str. 2457T
gcaauccaguccaccugaccugc

SEQ ID NO: 1944146 - RNA, 16 nt, Shigella flexneri 2a str. 2457T
gcaauccuaaaucgcu

SEQ ID NO: 1944147 - RNA, 14 nt, Shigella flexneri 2a str. 2457T
gcaaucgaccaggc

SEQ ID NO: 1944148 - RNA, 15 nt, Shigella flexneri 2a str. 2457T
gcaauccggaaacca

SEQ ID NO: 1944149 - RNA, 13 nt, Shigella flexneri 2a str. 2457T
gcaaucacaucac

SEQ ID NO: 1944150 - RNA, 12 nt, Shigella flexneri 2a str. 2457T
gcaaucaccacc

SEQ ID NO: 1944151 - RNA, 14 nt, Shigella flexneri 2a str. 2457T
gcaaucacuuccuc

SEQ ID NO: 1944152 - RNA, 23 nt, Shigella flexneri 2a str. 2457T
gcaaucacugccagaauagccgc

SEQ ID NO: 1944153 - RNA, 15 nt, Shigella flexneri 2a str. 2457T
gcaaucacuuccuca

SEQ ID NO: 1944154 - RNA, 18 nt, Shigella flexneri 2a str. 2457T
gcaaucagauaaaauaca

SEQ ID NO: 1944155 - RNA, 12 nt, Shigella flexneri 2a str. 2457T
gcaaucaccaga

SEQ ID NO: 1944156 - RNA, 22 nt, Shigella flexneri 2a str. 2457T
gcaaucagauaaaauacacuuu

SEQ ID NO: 1944157 - RNA, 21 nt, Shigella flexneri 2a str. 2457T
gcaaucaaauaccaccagcga

SEQ ID NO: 1944158 - RNA, 17 nt, Shigella flexneri 2a str. 2457T
gcaagcgacucgguugc

SEQ ID NO: 1944159 - RNA, 13 nt, Shigella flexneri 2a str. 2457T
gcaagccugaaaa

SEQ ID NO: 1944160 - RNA, 15 nt, Shigella flexneri 2a str. 2457T
gcaagccagguuuug

SEQ ID NO: 1944161 - RNA, 15 nt, Shigella flexneri 2a str. 2457T
gcaagcaggucggcu

SEQ ID NO: 1944162 - RNA, 19 nt, Shigella flexneri 2a str. 2457T
gcaagcaggucggcucagc

SEQ ID NO: 1944163 - RNA, 16 nt, Shigella flexneri 2a str. 2457T
gcaagauuccagugcc

SEQ ID NO: 1944164 - RNA, 20 nt, Shigella flexneri 2a str. 2457T
gcaagauuuuguaggucgga

SEQ ID NO: 1944165 - RNA, 19 nt, Shigella flexneri 2a str. 2457T
gcaagaucgcgcaucagcu

SEQ ID NO: 1944166 - RNA, 15 nt, Shigella flexneri 2a str. 2457T
gcaagagcaaauaaa

SEQ ID NO: 1944167 - RNA, 16 nt, Shigella flexneri 2a str. 2457T
gcaagagcaaauaaaa

SEQ ID NO: 1944168 - RNA, 17 nt, Shigella flexneri 2a str. 2457T
gcaagagcaggcuuuug

SEQ ID NO: 1944169 - RNA, 20 nt, Shigella flexneri 2a str. 2457T
gcaaggcgcggguuucaaca

SEQ ID NO: 1944170 - RNA, 15 nt, Shigella flexneri 2a str. 2457T
gcaagggccgcagcu

SEQ ID NO: 1944171 - RNA, 17 nt, Shigella flexneri 2a str. 2457T
gcaaggcaaucugcucu

SEQ ID NO: 1944172 - RNA, 18 nt, Shigella flexneri 2a str. 2457T
gcaauaaaauaucuucca

SEQ ID NO: 1944173 - RNA, 13 nt, Shigella flexneri 2a str. 2457T
gcaauaacacgcg

SEQ ID NO: 1944174 - RNA, 19 nt, Shigella flexneri 2a str. 2457T
gcaaguuucgugcuuagau

SEQ ID NO: 1944175 - RNA, 16 nt, Shigella flexneri 2a str. 2457T
gcaaguccccaguaau

SEQ ID NO: 1944176 - RNA, 16 nt, Shigella flexneri 2a str. 2457T
gcaaguagcgccauac

SEQ ID NO: 1944177 - RNA, 23 nt, Shigella flexneri 2a str. 2457T
gcaaguaauaauaucuccagcua

SEQ ID NO: 1944178 - RNA, 17 nt, Shigella flexneri 2a str. 2457T
gcaauaugcggugccau

SEQ ID NO: 1944179 - RNA, 14 nt, Shigella flexneri 2a str. 2457T
gcaauauuacuuca

SEQ ID NO: 1944180 - RNA, 17 nt, Shigella flexneri 2a str. 2457T
gcaauaaccaucagcuc

SEQ ID NO: 1944181 - RNA, 13 nt, Shigella flexneri 2a str. 2457T
gcaauaacacgcu

SEQ ID NO: 1944182 - RNA, 20 nt, Shigella flexneri 2a str. 2457T
gcaauaaucucuuuacccag

SEQ ID NO: 1944183 - RNA, 21 nt, Shigella flexneri 2a str. 2457T
gcaauaauagccccaaccgaa

SEQ ID NO: 1944184 - RNA, 23 nt, Shigella flexneri 2a str. 2457T
gcaauacgcuugaagccuucgcc

SEQ ID NO: 1944185 - RNA, 13 nt, Shigella flexneri 2a str. 2457T
gcaauagaauaag

SEQ ID NO: 1944186 - RNA, 14 nt, Shigella flexneri 2a str. 2457T
gcaauacguuucau

SEQ ID NO: 1944187 - RNA, 21 nt, Shigella flexneri 2a str. 2457T
gcaauaccuggcgcagcugcg

SEQ ID NO: 1944188 - RNA, 19 nt, Shigella flexneri 2a str. 2457T
gcaauaccgccguuaacac

SEQ ID NO: 1944189 - RNA, 19 nt, Shigella flexneri 2a str. 2457T
gcaauacccugacccagac

SEQ ID NO: 1944190 - RNA, 16 nt, Shigella flexneri 2a str. 2457T
gcaaccggcgcggcag

SEQ ID NO: 1944191 - RNA, 17 nt, Shigella flexneri 2a str. 2457T
gcaaccggaggucagua

SEQ ID NO: 1944192 - RNA, 23 nt, Shigella flexneri 2a str. 2457T
gcaaccgcugagcgauaaaauca

SEQ ID NO: 1944193 - RNA, 15 nt, Shigella flexneri 2a str. 2457T
gcaaccguggugagu

SEQ ID NO: 1944194 - RNA, 22 nt, Shigella flexneri 2a str. 2457T
gcaaccguucggaaaaauauau

SEQ ID NO: 1944195 - RNA, 14 nt, Shigella flexneri 2a str. 2457T
gcaaccuaaccaaa

SEQ ID NO: 1944196 - RNA, 18 nt, Shigella flexneri 2a str. 2457T
gcaacgucaguaaccgcu

SEQ ID NO: 1944197 - RNA, 15 nt, Shigella flexneri 2a str. 2457T
gcaacgucuucccga

SEQ ID NO: 1944198 - RNA, 12 nt, Shigella flexneri 2a str. 2457T
gcaacgucaguc

SEQ ID NO: 1944199 - RNA, 20 nt, Shigella flexneri 2a str. 2457T
gcaacgguugcggaacccag

SEQ ID NO: 1944200 - RNA, 20 nt, Shigella flexneri 2a str. 2457T
gcaacgccguaagcgcggag

SEQ ID NO: 1944201 - RNA, 23 nt, Shigella flexneri 2a str. 2457T
gcaacgccuaaacuaaucgacag

SEQ ID NO: 1944202 - RNA, 21 nt, Shigella flexneri 2a str. 2457T
gcaacgcuucguagaagccau

SEQ ID NO: 1944203 - RNA, 23 nt, Shigella flexneri 2a str. 2457T
gcaacgccuuugucgggcaggcu

SEQ ID NO: 1944204 - RNA, 15 nt, Shigella flexneri 2a str. 2457T
gcaacgcggcgguga

SEQ ID NO: 1944205 - RNA, 13 nt, Shigella flexneri 2a str. 2457T
gcaacgcggcggu

SEQ ID NO: 1944206 - RNA, 13 nt, Shigella flexneri 2a str. 2457T
gcaacgcgcguga

SEQ ID NO: 1944207 - RNA, 14 nt, Shigella flexneri 2a str. 2457T
gcaacugcgcggca

SEQ ID NO: 1944208 - RNA, 23 nt, Shigella flexneri 2a str. 2457T
aaagcgcaaaauaccagcaauuu

SEQ ID NO: 1944209 - RNA, 14 nt, Shigella flexneri 2a str. 2457T
aaagcgcgcaguuu

SEQ ID NO: 1944210 - RNA, 23 nt, Shigella flexneri 2a str. 2457T
aaagcgcggcagugacugcccca

SEQ ID NO: 1944211 - RNA, 15 nt, Shigella flexneri 2a str. 2457T
aaagcgcaccugauc

SEQ ID NO: 1944212 - RNA, 18 nt, Shigella flexneri 2a str. 2457T
aaagcgagcgagcaauau

SEQ ID NO: 1944213 - RNA, 14 nt, Shigella flexneri 2a str. 2457T
aaagcgccaaaucu

SEQ ID NO: 1944214 - RNA, 20 nt, Shigella flexneri 2a str. 2457T
gcaacguuguuccuuccagc

SEQ ID NO: 1944215 - RNA, 17 nt, Shigella flexneri 2a str. 2457T
gcaacuccaucaagcua

SEQ ID NO: 1944216 - RNA, 19 nt, Shigella flexneri 2a str. 2457T
gcaacucauuuacagaaac

SEQ ID NO: 1944217 - RNA, 20 nt, Shigella flexneri 2a str. 2457T
gcaacucauuuacagaaacu

SEQ ID NO: 1944218 - RNA, 18 nt, Shigella flexneri 2a str. 2457T
gcaacugacugacuucaa

SEQ ID NO: 1944219 - RNA, 16 nt, Shigella flexneri 2a str. 2457T
gcaacugacuggcucu

SEQ ID NO: 1944220 - RNA, 19 nt, Shigella flexneri 2a str. 2457T
gcaacucuuuuuccugcug

SEQ ID NO: 1944221 - RNA, 13 nt, Shigella flexneri 2a str. 2457T
gcaacucgaugcu

SEQ ID NO: 1944222 - RNA, 15 nt, Shigella flexneri 2a str. 2457T
gcaacuguaacgcag

SEQ ID NO: 1944223 - RNA, 22 nt, Shigella flexneri 2a str. 2457T
gcaacuguaacgcagaagguua

SEQ ID NO: 1944224 - RNA, 21 nt, Shigella flexneri 2a str. 2457T
aaagcggcccuuuuuuuacuu

SEQ ID NO: 1944225 - RNA, 16 nt, Shigella flexneri 2a str. 2457T
aaagcgcgucaccacc

SEQ ID NO: 1944226 - RNA, 18 nt, Shigella flexneri 2a str. 2457T
aaagcgcugaagaaaaug

SEQ ID NO: 1944227 - RNA, 13 nt, Shigella flexneri 2a str. 2457T
gcaagaaaugaca

SEQ ID NO: 1944228 - RNA, 20 nt, Shigella flexneri 2a str. 2457T
gcaacuuuucaacaaauucu

SEQ ID NO: 1944229 - RNA, 22 nt, Shigella flexneri 2a str. 2457T
gcaacuuuagccgguuuuucaa

SEQ ID NO: 1944230 - RNA, 15 nt, Shigella flexneri 2a str. 2457T
gcaacuggcaaaaac

SEQ ID NO: 1944231 - RNA, 23 nt, Shigella flexneri 2a str. 2457T
gcgcuacggcugauggcgccagu

SEQ ID NO: 1944232 - RNA, 14 nt, Shigella flexneri 2a str. 2457T
gcgcuauccugguu

SEQ ID NO: 1944233 - RNA, 21 nt, Shigella flexneri 2a str. 2457T
gcgcuauguuuaucaggccaa

SEQ ID NO: 1944234 - RNA, 23 nt, Shigella flexneri 2a str. 2457T
gcgcucccgcaggagcgccgaau

SEQ ID NO: 1944235 - RNA, 15 nt, Shigella flexneri 2a str. 2457T
gcgcucagcgccaca

SEQ ID NO: 1944236 - RNA, 14 nt, Shigella flexneri 2a str. 2457T
gcgcucagccagcc

SEQ ID NO: 1944237 - RNA, 15 nt, Shigella flexneri 2a str. 2457T
gcgcgugagcuggga

SEQ ID NO: 1944238 - RNA, 18 nt, Shigella flexneri 2a str. 2457T
gcgcgggcgauaaucuca

SEQ ID NO: 1944239 - RNA, 18 nt, Shigella flexneri 2a str. 2457T
gcgcgguaaagcgcggca

SEQ ID NO: 1944240 - RNA, 20 nt, Shigella flexneri 2a str. 2457T
gcgcgguaaaguuuggcugu

SEQ ID NO: 1944241 - RNA, 13 nt, Shigella flexneri 2a str. 2457T
gcgcgucccugcc

SEQ ID NO: 1944242 - RNA, 15 nt, Shigella flexneri 2a str. 2457T
gcgcgucccugccgc

SEQ ID NO: 1944243 - RNA, 13 nt, Shigella flexneri 2a str. 2457T
gcgaucauuagcc

SEQ ID NO: 1944244 - RNA, 20 nt, Shigella flexneri 2a str. 2457T
gcgcgaacuggaugaaaaaa

SEQ ID NO: 1944245 - RNA, 19 nt, Shigella flexneri 2a str. 2457T
gcgcgaauauggcggcggc

SEQ ID NO: 1944246 - RNA, 19 nt, Shigella flexneri 2a str. 2457T
gcgcgaagcuggcggcggc

SEQ ID NO: 1944247 - RNA, 16 nt, Shigella flexneri 2a str. 2457T
gcgaucgacgcgucca

SEQ ID NO: 1944248 - RNA, 20 nt, Shigella flexneri 2a str. 2457T
gcgcgaauggaaagcccgcc

SEQ ID NO: 1944249 - RNA, 14 nt, Shigella flexneri 2a str. 2457T
gcgcgacaauauuc

SEQ ID NO: 1944250 - RNA, 16 nt, Shigella flexneri 2a str. 2457T
gcgcgauccggcggug

SEQ ID NO: 1944251 - RNA, 12 nt, Shigella flexneri 2a str. 2457T
gcgcgcccgccg

SEQ ID NO: 1944252 - RNA, 18 nt, Shigella flexneri 2a str. 2457T
gcgcggauccacaccuga

SEQ ID NO: 1944253 - RNA, 13 nt, Shigella flexneri 2a str. 2457T
gcgcgcguaaauu

SEQ ID NO: 1944254 - RNA, 15 nt, Shigella flexneri 2a str. 2457T
gcgcugaaagaagcg

SEQ ID NO: 1944255 - RNA, 20 nt, Shigella flexneri 2a str. 2457T
gcgcugaagaaaauggccag

SEQ ID NO: 1944256 - RNA, 23 nt, Shigella flexneri 2a str. 2457T
gcgcugacguuauugaucgccag

SEQ ID NO: 1944257 - RNA, 20 nt, Shigella flexneri 2a str. 2457T
gcgcugaguaauccuucccc

SEQ ID NO: 1944258 - RNA, 12 nt, Shigella flexneri 2a str. 2457T
gcgcuuccagcu

SEQ ID NO: 1944259 - RNA, 16 nt, Shigella flexneri 2a str. 2457T
gcgcuuccagcuccau

SEQ ID NO: 1944260 - RNA, 17 nt, Shigella flexneri 2a str. 2457T
gcgcuugcucuaacggu

SEQ ID NO: 1944261 - RNA, 16 nt, Shigella flexneri 2a str. 2457T
gcggaauuugaugaga

SEQ ID NO: 1944262 - RNA, 13 nt, Shigella flexneri 2a str. 2457T
gcggacaaccagc

SEQ ID NO: 1944263 - RNA, 15 nt, Shigella flexneri 2a str. 2457T
gcggacaaccagcuu

SEQ ID NO: 1944264 - RNA, 20 nt, Shigella flexneri 2a str. 2457T
gcggacaauaauaucuuuuu

SEQ ID NO: 1944265 - RNA, 19 nt, Shigella flexneri 2a str. 2457T
gcggacaaugccuaccgca

SEQ ID NO: 1944266 - RNA, 13 nt, Shigella flexneri 2a str. 2457T
gcgcuuucgccag

SEQ ID NO: 1944267 - RNA, 22 nt, Shigella flexneri 2a str. 2457T
gcggagacucaaaccccgcagc

SEQ ID NO: 1944268 - RNA, 15 nt, Shigella flexneri 2a str. 2457T
gcggaguaaucgcca

SEQ ID NO: 1944269 - RNA, 21 nt, Shigella flexneri 2a str. 2457T
gcggaguaaucgccagcaaaa

SEQ ID NO: 1944270 - RNA, 15 nt, Shigella flexneri 2a str. 2457T
gcggaggggcggcuc

SEQ ID NO: 1944271 - RNA, 22 nt, Shigella flexneri 2a str. 2457T
gcggauaucuacaaaaccacac

SEQ ID NO: 1944272 - RNA, 21 nt, Shigella flexneri 2a str. 2457T
gcggauguuggguuagccaac

SEQ ID NO: 1944273 - RNA, 13 nt, Shigella flexneri 2a str. 2457T
gcggcaagaucgc

SEQ ID NO: 1944274 - RNA, 12 nt, Shigella flexneri 2a str. 2457T
gcggcaauggcu

SEQ ID NO: 1944275 - RNA, 22 nt, Shigella flexneri 2a str. 2457T
gcggcaaugaaagcgagcgagc

SEQ ID NO: 1944276 - RNA, 17 nt, Shigella flexneri 2a str. 2457T
gcggcaaucgccagaau

SEQ ID NO: 1944277 - RNA, 13 nt, Shigella flexneri 2a str. 2457T
gcggcaaucgcca

SEQ ID NO: 1944278 - RNA, 19 nt, Shigella flexneri 2a str. 2457T
gcggcaauccccgccagca

SEQ ID NO: 1944279 - RNA, 16 nt, Shigella flexneri 2a str. 2457T
gcggcacagaaacgcc

SEQ ID NO: 1944280 - RNA, 19 nt, Shigella flexneri 2a str. 2457T
gcggcaauuagcggcuggc

SEQ ID NO: 1944281 - RNA, 20 nt, Shigella flexneri 2a str. 2457T
gcggcacuguuucgccaggu

SEQ ID NO: 1944282 - RNA, 22 nt, Shigella flexneri 2a str. 2457T
gcggcacugguacucaaccgcc

SEQ ID NO: 1944283 - RNA, 24 nt, Shigella flexneri 2a str. 2457T
gcggcacugcucuuuaacaauuua

SEQ ID NO: 1944284 - RNA, 12 nt, Shigella flexneri 2a str. 2457T
gcggcagcaggu

SEQ ID NO: 1944285 - RNA, 15 nt, Shigella flexneri 2a str. 2457T
gcggcagccaccgcc

SEQ ID NO: 1944286 - RNA, 14 nt, Shigella flexneri 2a str. 2457T
gcggcagaaugguu

SEQ ID NO: 1944287 - RNA, 17 nt, Shigella flexneri 2a str. 2457T
gcggcauaucagcgagu

SEQ ID NO: 1944288 - RNA, 14 nt, Shigella flexneri 2a str. 2457T
gcggcagguugaug

SEQ ID NO: 1944289 - RNA, 23 nt, Shigella flexneri 2a str. 2457T
gcggcgaaaacgccacauccggc

SEQ ID NO: 1944290 - RNA, 18 nt, Shigella flexneri 2a str. 2457T
gcggcgaacuuaaucauc

SEQ ID NO: 1944291 - RNA, 20 nt, Shigella flexneri 2a str. 2457T
gcggcgauauccagcgcggc

SEQ ID NO: 1944292 - RNA, 16 nt, Shigella flexneri 2a str. 2457T
gcggcgaugaccgcca

SEQ ID NO: 1944293 - RNA, 14 nt, Shigella flexneri 2a str. 2457T
gcggcgacaauaau

SEQ ID NO: 1944294 - RNA, 18 nt, Shigella flexneri 2a str. 2457T
gcguaccgugggcggcau

SEQ ID NO: 1944295 - RNA, 19 nt, Shigella flexneri 2a str. 2457T
gcguacuggcaaucgccag

SEQ ID NO: 1944296 - RNA, 19 nt, Shigella flexneri 2a str. 2457T
gcguacagagggcaggcaa

SEQ ID NO: 1944297 - RNA, 21 nt, Shigella flexneri 2a str. 2457T
gcguacaauagccacauugcu

SEQ ID NO: 1944298 - RNA, 22 nt, Shigella flexneri 2a str. 2457T
gcguaagcgcauccggcaccag

SEQ ID NO: 1944299 - RNA, 16 nt, Shigella flexneri 2a str. 2457T
gcguaaauccagcggc

SEQ ID NO: 1944300 - RNA, 18 nt, Shigella flexneri 2a str. 2457T
gcguaaacgccuaauaaa

SEQ ID NO: 1944301 - RNA, 19 nt, Shigella flexneri 2a str. 2457T
gcguaaacgccuuauccag

SEQ ID NO: 1944302 - RNA, 12 nt, Shigella flexneri 2a str. 2457T
gcgguuuuucuu

SEQ ID NO: 1944303 - RNA, 17 nt, Shigella flexneri 2a str. 2457T
gcgguuuucucuuguuc

SEQ ID NO: 1944304 - RNA, 21 nt, Shigella flexneri 2a str. 2457T
gcgguuuucucuuuaaacaga

SEQ ID NO: 1944305 - RNA, 23 nt, Shigella flexneri 2a str. 2457T
gcgguuggcaaucaguuuuuguu

SEQ ID NO: 1944306 - RNA, 20 nt, Shigella flexneri 2a str. 2457T
gcgguugcugucggcggcga

SEQ ID NO: 1944307 - RNA, 17 nt, Shigella flexneri 2a str. 2457T
gcgguguauaccagcuc

SEQ ID NO: 1944308 - RNA, 21 nt, Shigella flexneri 2a str. 2457T
gcggugucuaacgaugccagc

SEQ ID NO: 1944309 - RNA, 17 nt, Shigella flexneri 2a str. 2457T
gcggugcgaugccuggc

SEQ ID NO: 1944310 - RNA, 22 nt, Shigella flexneri 2a str. 2457T
gcggugaucccaauauagacaa

SEQ ID NO: 1944311 - RNA, 19 nt, Shigella flexneri 2a str. 2457T
gcggucguaaucgcccgcu

SEQ ID NO: 1944312 - RNA, 16 nt, Shigella flexneri 2a str. 2457T
gcggggcuaccgccag

SEQ ID NO: 1944313 - RNA, 20 nt, Shigella flexneri 2a str. 2457T
gcggggcuaccgccagacca

SEQ ID NO: 1944314 - RNA, 21 nt, Shigella flexneri 2a str. 2457T
gcgggguuuuuuuaugggcac

SEQ ID NO: 1944315 - RNA, 14 nt, Shigella flexneri 2a str. 2457T
gcggguaaccagcc

SEQ ID NO: 1944316 - RNA, 23 nt, Shigella flexneri 2a str. 2457T
gcgggcgguaagccggagcuggc

SEQ ID NO: 1944317 - RNA, 17 nt, Shigella flexneri 2a str. 2457T
gcgguagcacgucaucu

SEQ ID NO: 1944318 - RNA, 15 nt, Shigella flexneri 2a str. 2457T
gcgguacucgcgcag

SEQ ID NO: 1944319 - RNA, 14 nt, Shigella flexneri 2a str. 2457T
gcggucagcugcug

SEQ ID NO: 1944320 - RNA, 20 nt, Shigella flexneri 2a str. 2457T
gcggguaauugcuccaucca

SEQ ID NO: 1944321 - RNA, 16 nt, Shigella flexneri 2a str. 2457T
gcggguuaaccagcac

SEQ ID NO: 1944322 - RNA, 15 nt, Shigella flexneri 2a str. 2457T
gcggcuuauucauua

SEQ ID NO: 1944323 - RNA, 21 nt, Shigella flexneri 2a str. 2457T
gcgggaucgccgcguagagaa

SEQ ID NO: 1944324 - RNA, 15 nt, Shigella flexneri 2a str. 2457T
gcgggcaacagaauu

SEQ ID NO: 1944325 - RNA, 17 nt, Shigella flexneri 2a str. 2457T
gcgggcaaucggcugca

SEQ ID NO: 1944326 - RNA, 13 nt, Shigella flexneri 2a str. 2457T
gcgggcaagcggc

SEQ ID NO: 1944327 - RNA, 14 nt, Shigella flexneri 2a str. 2457T
gcgucggaaccaca

SEQ ID NO: 1944328 - RNA, 15 nt, Shigella flexneri 2a str. 2457T
gcgucuuaucuggcc

SEQ ID NO: 1944329 - RNA, 11 nt, Shigella flexneri 2a str. 2457T
gcgucugggcg

SEQ ID NO: 1944330 - RNA, 14 nt, Shigella flexneri 2a str. 2457T
gcgucucaucuuua

SEQ ID NO: 1944331 - RNA, 16 nt, Shigella flexneri 2a str. 2457T
gcgucucauaccggau

SEQ ID NO: 1944332 - RNA, 19 nt, Shigella flexneri 2a str. 2457T
gcgucucuuuucguuuugg

SEQ ID NO: 1944333 - RNA, 20 nt, Shigella flexneri 2a str. 2457T
gcgugcccgggucagcgcca

SEQ ID NO: 1944334 - RNA, 16 nt, Shigella flexneri 2a str. 2457T
gcgugauuguggcaau

SEQ ID NO: 1944335 - RNA, 12 nt, Shigella flexneri 2a str. 2457T
gcgugauuccag

SEQ ID NO: 1944336 - RNA, 15 nt, Shigella flexneri 2a str. 2457T
gcgugacuaaaaccc

SEQ ID NO: 1944337 - RNA, 17 nt, Shigella flexneri 2a str. 2457T
gcgugagaacaccaccu

SEQ ID NO: 1944338 - RNA, 22 nt, Shigella flexneri 2a str. 2457T
gcgugagccgaaauauggcgcu

SEQ ID NO: 1944339 - RNA, 21 nt, Shigella flexneri 2a str. 2457T
gcgugacgcuggcagaaaguu

SEQ ID NO: 1944340 - RNA, 15 nt, Shigella flexneri 2a str. 2457T
gcgugaaucaacacc

SEQ ID NO: 1944341 - RNA, 23 nt, Shigella flexneri 2a str. 2457T
gcgugaacgccuuauccggccug

SEQ ID NO: 1944342 - RNA, 20 nt, Shigella flexneri 2a str. 2457T
gcgugccuaauuccgcgcga

SEQ ID NO: 1944343 - RNA, 13 nt, Shigella flexneri 2a str. 2457T
gcguggagauguc

SEQ ID NO: 1944344 - RNA, 16 nt, Shigella flexneri 2a str. 2457T
gcgucagcucacaaau

SEQ ID NO: 1944345 - RNA, 15 nt, Shigella flexneri 2a str. 2457T
gcgucagcuuucaga

SEQ ID NO: 1944346 - RNA, 16 nt, Shigella flexneri 2a str. 2457T
gcgucagccagaaaga

SEQ ID NO: 1944347 - RNA, 17 nt, Shigella flexneri 2a str. 2457T
gcgucagccugcucagu

SEQ ID NO: 1944348 - RNA, 14 nt, Shigella flexneri 2a str. 2457T
gcgucaguuuuugc

SEQ ID NO: 1944349 - RNA, 13 nt, Shigella flexneri 2a str. 2457T
gcgucagaaacag

SEQ ID NO: 1944350 - RNA, 18 nt, Shigella flexneri 2a str. 2457T
gcgucagcauaaaaauau

SEQ ID NO: 1944351 - RNA, 22 nt, Shigella flexneri 2a str. 2457T
gcgucaaugccgcuucgagcug

SEQ ID NO: 1944352 - RNA, 16 nt, Shigella flexneri 2a str. 2457T
gcgucaacagggcaga

SEQ ID NO: 1944353 - RNA, 17 nt, Shigella flexneri 2a str. 2457T
gcguauccagcauaccu

SEQ ID NO: 1944354 - RNA, 14 nt, Shigella flexneri 2a str. 2457T
gcguauaacacgcc

SEQ ID NO: 1944355 - RNA, 13 nt, Shigella flexneri 2a str. 2457T
gcguauccuccug

SEQ ID NO: 1944356 - RNA, 19 nt, Shigella flexneri 2a str. 2457T
gcguaucgacaaucaccag

SEQ ID NO: 1944357 - RNA, 22 nt, Shigella flexneri 2a str. 2457T
gcguaucaauuaacgguugcgg

SEQ ID NO: 1944358 - RNA, 16 nt, Shigella flexneri 2a str. 2457T
gcguagugcccgcagu

SEQ ID NO: 1944359 - RNA, 17 nt, Shigella flexneri 2a str. 2457T
gcguaugcccggugcgg

SEQ ID NO: 1944360 - RNA, 18 nt, Shigella flexneri 2a str. 2457T
gcguccugccugggacgg

SEQ ID NO: 1944361 - RNA, 18 nt, Shigella flexneri 2a str. 2457T
gcguccggcgucgcuucu

SEQ ID NO: 1944362 - RNA, 17 nt, Shigella flexneri 2a str. 2457T
gcguccgguaauuuuua

SEQ ID NO: 1944363 - RNA, 20 nt, Shigella flexneri 2a str. 2457T
gcgucgacauagccaucccu

SEQ ID NO: 1944364 - RNA, 19 nt, Shigella flexneri 2a str. 2457T
gcgucgcaucaggcaucug

SEQ ID NO: 1944365 - RNA, 18 nt, Shigella flexneri 2a str. 2457T
gcgucauugacgcuggcu

SEQ ID NO: 1944366 - RNA, 15 nt, Shigella flexneri 2a str. 2457T
gcgucccaucggcaa

SEQ ID NO: 1944367 - RNA, 14 nt, Shigella flexneri 2a str. 2457T
gcgucccaguaacg

SEQ ID NO: 1944368 - RNA, 18 nt, Shigella flexneri 2a str. 2457T
gcgucccagauagcuguc

SEQ ID NO: 1944369 - RNA, 16 nt, Shigella flexneri 2a str. 2457T
gcuggcggcggcgggc

SEQ ID NO: 1944370 - RNA, 22 nt, Shigella flexneri 2a str. 2457T
gcuggccuauuaugacuccagc

SEQ ID NO: 1944371 - RNA, 13 nt, Shigella flexneri 2a str. 2457T
gcuggccuccagu

SEQ ID NO: 1944372 - RNA, 17 nt, Shigella flexneri 2a str. 2457T
gcuggcgaacgugcagg

SEQ ID NO: 1944373 - RNA, 18 nt, Shigella flexneri 2a str. 2457T
gcuggcgaacgugcagga

SEQ ID NO: 1944374 - RNA, 14 nt, Shigella flexneri 2a str. 2457T
gcuggcaggccgcg

SEQ ID NO: 1944375 - RNA, 20 nt, Shigella flexneri 2a str. 2457T
gcuggcauuacaagaaucau

SEQ ID NO: 1944376 - RNA, 16 nt, Shigella flexneri 2a str. 2457T
gcuggcauugauguuu

SEQ ID NO: 1944377 - RNA, 12 nt, Shigella flexneri 2a str. 2457T
gcuggcaucagc

SEQ ID NO: 1944378 - RNA, 22 nt, Shigella flexneri 2a str. 2457T
gcuggcagugggccagaaaaaa

SEQ ID NO: 1944379 - RNA, 20 nt, Shigella flexneri 2a str. 2457T
gcuggcagaagcccagcgac

SEQ ID NO: 1944380 - RNA, 15 nt, Shigella flexneri 2a str. 2457T
gcuggcagaccugcu

SEQ ID NO: 1944381 - RNA, 18 nt, Shigella flexneri 2a str. 2457T
gcuggccgcgucuuaucc

SEQ ID NO: 1944382 - RNA, 19 nt, Shigella flexneri 2a str. 2457T
gcugcuuuguaaguggggg

SEQ ID NO: 1944383 - RNA, 15 nt, Shigella flexneri 2a str. 2457T
gcugcuuuccugcug

SEQ ID NO: 1944384 - RNA, 13 nt, Shigella flexneri 2a str. 2457T
gcugcuuuauauu

SEQ ID NO: 1944385 - RNA, 19 nt, Shigella flexneri 2a str. 2457T
gcugcuuuaucagaucacg

SEQ ID NO: 1944386 - RNA, 17 nt, Shigella flexneri 2a str. 2457T
gcuggagaacuugacuc

SEQ ID NO: 1944387 - RNA, 20 nt, Shigella flexneri 2a str. 2457T
gcuggagcggggaacaccuc

SEQ ID NO: 1944388 - RNA, 22 nt, Shigella flexneri 2a str. 2457T
gcuggacgcgccaacaaaugga

SEQ ID NO: 1944389 - RNA, 16 nt, Shigella flexneri 2a str. 2457T
gcugcugauccagcuu

SEQ ID NO: 1944390 - RNA, 22 nt, Shigella flexneri 2a str. 2457T
gcugcugcacauacugcaucag

SEQ ID NO: 1944391 - RNA, 18 nt, Shigella flexneri 2a str. 2457T
gcugcuguagcaguucca

SEQ ID NO: 1944392 - RNA, 19 nt, Shigella flexneri 2a str. 2457T
gcugcggcguuccccaguu

SEQ ID NO: 1944393 - RNA, 21 nt, Shigella flexneri 2a str. 2457T
gcugcguaugguugccgggcu

SEQ ID NO: 1944394 - RNA, 18 nt, Shigella flexneri 2a str. 2457T
gcugcgugaggcggucug

SEQ ID NO: 1944395 - RNA, 17 nt, Shigella flexneri 2a str. 2457T
gcuggggaaaaucaucu

SEQ ID NO: 1944396 - RNA, 16 nt, Shigella flexneri 2a str. 2457T
gcuggguaaagacauc

SEQ ID NO: 1944397 - RNA, 19 nt, Shigella flexneri 2a str. 2457T
gcuggguaaagacaucgcc

SEQ ID NO: 1944398 - RNA, 14 nt, Shigella flexneri 2a str. 2457T
gcugggcgcaccug

SEQ ID NO: 1944399 - RNA, 22 nt, Shigella flexneri 2a str. 2457T
gcuggguuucgccugccagaug

SEQ ID NO: 1944400 - RNA, 15 nt, Shigella flexneri 2a str. 2457T
gcugguaaucaccac

SEQ ID NO: 1944401 - RNA, 13 nt, Shigella flexneri 2a str. 2457T
gcugguagaagcu

SEQ ID NO: 1944402 - RNA, 18 nt, Shigella flexneri 2a str. 2457T
gcuggcgucacgccgacc

SEQ ID NO: 1944403 - RNA, 19 nt, Shigella flexneri 2a str. 2457T
gcuggcgguucuauggucu

SEQ ID NO: 1944404 - RNA, 14 nt, Shigella flexneri 2a str. 2457T
gcuggcugaacauu

SEQ ID NO: 1944405 - RNA, 15 nt, Shigella flexneri 2a str. 2457T
gcuggcuggcacgcu

SEQ ID NO: 1944406 - RNA, 14 nt, Shigella flexneri 2a str. 2457T
gcugggaaaucacc

SEQ ID NO: 1944407 - RNA, 16 nt, Shigella flexneri 2a str. 2457T
gcugggaaaucaccac

SEQ ID NO: 1944408 - RNA, 15 nt, Shigella flexneri 2a str. 2457T
gcugggauggcaaaa

SEQ ID NO: 1944409 - RNA, 21 nt, Shigella flexneri 2a str. 2457T
gcuguaaaugccgacuuuguu

SEQ ID NO: 1944410 - RNA, 21 nt, Shigella flexneri 2a str. 2457T
gcuguaaaaggcgccauuuuc

SEQ ID NO: 1944411 - RNA, 18 nt, Shigella flexneri 2a str. 2457T
aaagcuucucagagaacu

SEQ ID NO: 1944412 - RNA, 22 nt, Shigella flexneri 2a str. 2457T
gcugucgacuaaccugagagug

SEQ ID NO: 1944413 - RNA, 23 nt, Shigella flexneri 2a str. 2457T
gcugucgccaucccugucgucca

SEQ ID NO: 1944414 - RNA, 19 nt, Shigella flexneri 2a str. 2457T
gcuguccggcgcacuggug

SEQ ID NO: 1944415 - RNA, 21 nt, Shigella flexneri 2a str. 2457T
gcuguccggugauuuaucuuc

SEQ ID NO: 1944416 - RNA, 14 nt, Shigella flexneri 2a str. 2457T
gcuguacagcagua

SEQ ID NO: 1944417 - RNA, 14 nt, Shigella flexneri 2a str. 2457T
gcuguacgccuuca

SEQ ID NO: 1944418 - RNA, 19 nt, Shigella flexneri 2a str. 2457T
gcuguccgcgucuuaucag

SEQ ID NO: 1944419 - RNA, 17 nt, Shigella flexneri 2a str. 2457T
gcuguccgcuucaccac

SEQ ID NO: 1944420 - RNA, 18 nt, Shigella flexneri 2a str. 2457T
gcuguccgcuucaccacc

SEQ ID NO: 1944421 - RNA, 19 nt, Shigella flexneri 2a str. 2457T
gcuguccgcuucaccaccg

SEQ ID NO: 1944422 - RNA, 20 nt, Shigella flexneri 2a str. 2457T
gcugugacagauuuugccag

SEQ ID NO: 1944423 - RNA, 16 nt, Shigella flexneri 2a str. 2457T
gcugucuaccagcacc

SEQ ID NO: 1944424 - RNA, 14 nt, Shigella flexneri 2a str. 2457T
gcugucggcacuga

SEQ ID NO: 1944425 - RNA, 15 nt, Shigella flexneri 2a str. 2457T
gcugucgguuuccac

SEQ ID NO: 1944426 - RNA, 23 nt, Shigella flexneri 2a str. 2457T
gcugucguccggcagcagaaagc

SEQ ID NO: 1944427 - RNA, 12 nt, Shigella flexneri 2a str. 2457T
gcugcaucugaa

SEQ ID NO: 1944428 - RNA, 12 nt, Shigella flexneri 2a str. 2457T
gcugcauugccc

SEQ ID NO: 1944429 - RNA, 17 nt, Shigella flexneri 2a str. 2457T
gcugccaggucgugcca

SEQ ID NO: 1944430 - RNA, 22 nt, Shigella flexneri 2a str. 2457T
gcugcacgucauacugcucaga

SEQ ID NO: 1944431 - RNA, 17 nt, Shigella flexneri 2a str. 2457T
gcugcacgaugacugaa

SEQ ID NO: 1944432 - RNA, 18 nt, Shigella flexneri 2a str. 2457T
gcugcaccaacaucaugc

SEQ ID NO: 1944433 - RNA, 15 nt, Shigella flexneri 2a str. 2457T
gcugcacauccggua

SEQ ID NO: 1944434 - RNA, 17 nt, Shigella flexneri 2a str. 2457T
gcugcaccucgagauca

SEQ ID NO: 1944435 - RNA, 22 nt, Shigella flexneri 2a str. 2457T
gcugaugauuaacagcaaacag

SEQ ID NO: 1944436 - RNA, 12 nt, Shigella flexneri 2a str. 2457T
gcugaugagcaa

SEQ ID NO: 1944437 - RNA, 19 nt, Shigella flexneri 2a str. 2457T
gcugauacuccaugaguaa

SEQ ID NO: 1944438 - RNA, 12 nt, Shigella flexneri 2a str. 2457T
gcugaugacgcg

SEQ ID NO: 1944439 - RNA, 15 nt, Shigella flexneri 2a str. 2457T
gcugaugcaggcgau

SEQ ID NO: 1944440 - RNA, 22 nt, Shigella flexneri 2a str. 2457T
gcugauggucagugccugcgcc

SEQ ID NO: 1944441 - RNA, 19 nt, Shigella flexneri 2a str. 2457T
gcugauggcgccaguuauu

SEQ ID NO: 1944442 - RNA, 16 nt, Shigella flexneri 2a str. 2457T
gcugacggcgauaaau

SEQ ID NO: 1944443 - RNA, 21 nt, Shigella flexneri 2a str. 2457T
gcugaaaccgugcaucuguug

SEQ ID NO: 1944444 - RNA, 13 nt, Shigella flexneri 2a str. 2457T
gcugaccaccagc

SEQ ID NO: 1944445 - RNA, 16 nt, Shigella flexneri 2a str. 2457T
gcugaccaccagcacg

SEQ ID NO: 1944446 - RNA, 15 nt, Shigella flexneri 2a str. 2457T
gcucuuuucugaagu

SEQ ID NO: 1944447 - RNA, 14 nt, Shigella flexneri 2a str. 2457T
gcucuuuuccagcc

SEQ ID NO: 1944448 - RNA, 12 nt, Shigella flexneri 2a str. 2457T
gcucuuuauaau

SEQ ID NO: 1944449 - RNA, 19 nt, Shigella flexneri 2a str. 2457T
gcugauaaaacucucaucu

SEQ ID NO: 1944450 - RNA, 14 nt, Shigella flexneri 2a str. 2457T
gcugauaagacgca

SEQ ID NO: 1944451 - RNA, 18 nt, Shigella flexneri 2a str. 2457T
gcugagguuaugcaaacg

SEQ ID NO: 1944452 - RNA, 23 nt, Shigella flexneri 2a str. 2457T
gcugagcgugccccugaauaauc

SEQ ID NO: 1944453 - RNA, 18 nt, Shigella flexneri 2a str. 2457T
gcugacguuaagaaaacg

SEQ ID NO: 1944454 - RNA, 16 nt, Shigella flexneri 2a str. 2457T
gcugacguagcaguuc

SEQ ID NO: 1944455 - RNA, 21 nt, Shigella flexneri 2a str. 2457T
gcugacggugccagguaaaca

SEQ ID NO: 1944456 - RNA, 19 nt, Shigella flexneri 2a str. 2457T
gcucuggcggagcucccag

SEQ ID NO: 1944457 - RNA, 17 nt, Shigella flexneri 2a str. 2457T
gcucugguguucuuuua

SEQ ID NO: 1944458 - RNA, 20 nt, Shigella flexneri 2a str. 2457T
gcucugcuuucucagcaaau

SEQ ID NO: 1944459 - RNA, 20 nt, Shigella flexneri 2a str. 2457T
gcucuggcaggcuucaauuu

SEQ ID NO: 1944460 - RNA, 20 nt, Shigella flexneri 2a str. 2457T
gcucugguucaccauucugc

SEQ ID NO: 1944461 - RNA, 17 nt, Shigella flexneri 2a str. 2457T
gcucugguugugguggg

SEQ ID NO: 1944462 - RNA, 13 nt, Shigella flexneri 2a str. 2457T
gcucuuccuucag

SEQ ID NO: 1944463 - RNA, 21 nt, Shigella flexneri 2a str. 2457T
gcucuucaucgcuaaaauacu

SEQ ID NO: 1944464 - RNA, 22 nt, Shigella flexneri 2a str. 2457T
gcucuuccaggcauuaaauccu

SEQ ID NO: 1944465 - RNA, 16 nt, Shigella flexneri 2a str. 2457T
gcucuucaauggucag

SEQ ID NO: 1944466 - RNA, 23 nt, Shigella flexneri 2a str. 2457T
gcucuucuucgcgauaaaucaga

SEQ ID NO: 1944467 - RNA, 21 nt, Shigella flexneri 2a str. 2457T
gcucucauuuuucagcguucc

SEQ ID NO: 1944468 - RNA, 18 nt, Shigella flexneri 2a str. 2457T
gcucuccacgcuauacag

SEQ ID NO: 1944469 - RNA, 15 nt, Shigella flexneri 2a str. 2457T
gcucucacuuauuug

SEQ ID NO: 1944470 - RNA, 14 nt, Shigella flexneri 2a str. 2457T
gcucucagccagcu

SEQ ID NO: 1944471 - RNA, 22 nt, Shigella flexneri 2a str. 2457T
gcucucagccagcuggcagaau

SEQ ID NO: 1944472 - RNA, 14 nt, Shigella flexneri 2a str. 2457T
gcucucauuuuuca

SEQ ID NO: 1944473 - RNA, 15 nt, Shigella flexneri 2a str. 2457T
gcucucaaauaucug

SEQ ID NO: 1944474 - RNA, 15 nt, Shigella flexneri 2a str. 2457T
gcucuaucucccuga

SEQ ID NO: 1944475 - RNA, 18 nt, Shigella flexneri 2a str. 2457T
gcucucuuucucgcugac

SEQ ID NO: 1944476 - RNA, 19 nt, Shigella flexneri 2a str. 2457T
gcucugacaccaucaccca

SEQ ID NO: 1944477 - RNA, 14 nt, Shigella flexneri 2a str. 2457T
gcucucuuucucca

SEQ ID NO: 1944478 - RNA, 11 nt, Shigella flexneri 2a str. 2457T
gcucucugcua

SEQ ID NO: 1944479 - RNA, 13 nt, Shigella flexneri 2a str. 2457T
gcucucuuccagu

SEQ ID NO: 1944480 - RNA, 21 nt, Shigella flexneri 2a str. 2457T
gcucugccacugguuuuccug

SEQ ID NO: 1944481 - RNA, 17 nt, Shigella flexneri 2a str. 2457T
gcucggcuccgggcgca

SEQ ID NO: 1944482 - RNA, 15 nt, Shigella flexneri 2a str. 2457T
gcucguuaaucagaa

SEQ ID NO: 1944483 - RNA, 17 nt, Shigella flexneri 2a str. 2457T
gcucguucagcggcccg

SEQ ID NO: 1944484 - RNA, 22 nt, Shigella flexneri 2a str. 2457T
gcucuaacccuuccagauucag

SEQ ID NO: 1944485 - RNA, 19 nt, Shigella flexneri 2a str. 2457T
gcucgcgccgcauccgaca

SEQ ID NO: 1944486 - RNA, 22 nt, Shigella flexneri 2a str. 2457T
gcucgcgccagguguuuaacca

SEQ ID NO: 1944487 - RNA, 18 nt, Shigella flexneri 2a str. 2457T
gcucccgcagccacuccu

SEQ ID NO: 1944488 - RNA, 17 nt, Shigella flexneri 2a str. 2457T
gcucccgcagccacucc

SEQ ID NO: 1944489 - RNA, 16 nt, Shigella flexneri 2a str. 2457T
gcuagguugaccugga

SEQ ID NO: 1944490 - RNA, 14 nt, Shigella flexneri 2a str. 2457T
gcuaguaaguuaca

SEQ ID NO: 1944491 - RNA, 22 nt, Shigella flexneri 2a str. 2457T
gcuaguuaucuccuugcuggug

SEQ ID NO: 1944492 - RNA, 21 nt, Shigella flexneri 2a str. 2457T
gcuaguuaucuccuugcuggu

SEQ ID NO: 1944493 - RNA, 16 nt, Shigella flexneri 2a str. 2457T
gcuacugucuaaaaua

SEQ ID NO: 1944494 - RNA, 13 nt, Shigella flexneri 2a str. 2457T
gcuauccugguua

SEQ ID NO: 1944495 - RNA, 14 nt, Shigella flexneri 2a str. 2457T
gcuauaucgcugau

SEQ ID NO: 1944496 - RNA, 16 nt, Shigella flexneri 2a str. 2457T
gcuauaacauuuuucu

SEQ ID NO: 1944497 - RNA, 17 nt, Shigella flexneri 2a str. 2457T
gcuauaaccugguggug

SEQ ID NO: 1944498 - RNA, 16 nt, Shigella flexneri 2a str. 2457T
gcuauacagcagccau

SEQ ID NO: 1944499 - RNA, 18 nt, Shigella flexneri 2a str. 2457T
gcucaagcguuucaucuu

SEQ ID NO: 1944500 - RNA, 17 nt, Shigella flexneri 2a str. 2457T
gcucaacaauaaacugg

SEQ ID NO: 1944501 - RNA, 22 nt, Shigella flexneri 2a str. 2457T
gcucaaaguaaucaagcccugg

SEQ ID NO: 1944502 - RNA, 10 nt, Shigella flexneri 2a str. 2457T
gcucaaaucc

SEQ ID NO: 1944503 - RNA, 17 nt, Shigella flexneri 2a str. 2457T
gcucaaauccaucagac

SEQ ID NO: 1944504 - RNA, 19 nt, Shigella flexneri 2a str. 2457T
gcucaaacggcguuuucuc

SEQ ID NO: 1944505 - RNA, 14 nt, Shigella flexneri 2a str. 2457T
gcucaaaccagcga

SEQ ID NO: 1944506 - RNA, 22 nt, Shigella flexneri 2a str. 2457T
gcucaaacuucgucacagcggc

SEQ ID NO: 1944507 - RNA, 23 nt, Shigella flexneri 2a str. 2457T
gcucaaaaauccagauuuauaaa

SEQ ID NO: 1944508 - RNA, 17 nt, Shigella flexneri 2a str. 2457T
gcuauuugcccaccugc

SEQ ID NO: 1944509 - RNA, 16 nt, Shigella flexneri 2a str. 2457T
gcuauuuuagaaaaac

SEQ ID NO: 1944510 - RNA, 18 nt, Shigella flexneri 2a str. 2457T
gcuauuuuuugcagugcu

SEQ ID NO: 1944511 - RNA, 13 nt, Shigella flexneri 2a str. 2457T
gcuauuuuuugca

SEQ ID NO: 1944512 - RNA, 18 nt, Shigella flexneri 2a str. 2457T
gcuauucuuauaaagaaa

SEQ ID NO: 1944513 - RNA, 19 nt, Shigella flexneri 2a str. 2457T
gcuauuccgaugguagcag

SEQ ID NO: 1944514 - RNA, 13 nt, Shigella flexneri 2a str. 2457T
gcuauucagcagu

SEQ ID NO: 1944515 - RNA, 14 nt, Shigella flexneri 2a str. 2457T
gcuauucagcaguu

SEQ ID NO: 1944516 - RNA, 18 nt, Shigella flexneri 2a str. 2457T
gcuaugaaagaaaaucaa

SEQ ID NO: 1944517 - RNA, 16 nt, Shigella flexneri 2a str. 2457T
gcucagucacuucaaa

SEQ ID NO: 1944518 - RNA, 18 nt, Shigella flexneri 2a str. 2457T
gcucauugcggcaacaau

SEQ ID NO: 1944519 - RNA, 19 nt, Shigella flexneri 2a str. 2457T
gcucaugcaucauaaccug

SEQ ID NO: 1944520 - RNA, 15 nt, Shigella flexneri 2a str. 2457T
gcuccagguccuccu

SEQ ID NO: 1944521 - RNA, 17 nt, Shigella flexneri 2a str. 2457T
gcuccagguccuccugu

SEQ ID NO: 1944522 - RNA, 12 nt, Shigella flexneri 2a str. 2457T
gcuccacgcugc

SEQ ID NO: 1944523 - RNA, 14 nt, Shigella flexneri 2a str. 2457T
gcucaccugacugu

SEQ ID NO: 1944524 - RNA, 13 nt, Shigella flexneri 2a str. 2457T
gcucaccugcaca

SEQ ID NO: 1944525 - RNA, 17 nt, Shigella flexneri 2a str. 2457T
gcucaccgccagcaucg

SEQ ID NO: 1944526 - RNA, 14 nt, Shigella flexneri 2a str. 2457T
gcucacgcgcugcc

SEQ ID NO: 1944527 - RNA, 14 nt, Shigella flexneri 2a str. 2457T
gcucacgcccauca

SEQ ID NO: 1944528 - RNA, 18 nt, Shigella flexneri 2a str. 2457T
gcucaaugguguuuucca

SEQ ID NO: 1944529 - RNA, 23 nt, Shigella flexneri 2a str. 2457T
gcucaauugacaguuuauuuucu

SEQ ID NO: 1944530 - RNA, 22 nt, Shigella flexneri 2a str. 2457T
gcucaaugagcaccuuuuuucu

SEQ ID NO: 1944531 - RNA, 12 nt, Shigella flexneri 2a str. 2457T
gcucaaucugcg

SEQ ID NO: 1944532 - RNA, 16 nt, Shigella flexneri 2a str. 2457T
gcucaaucgcauggcu

SEQ ID NO: 1944533 - RNA, 16 nt, Shigella flexneri 2a str. 2457T
gcucaauacaacccac

SEQ ID NO: 1944534 - RNA, 21 nt, Shigella flexneri 2a str. 2457T
gcucagcuccucuuucauuuc

SEQ ID NO: 1944535 - RNA, 16 nt, Shigella flexneri 2a str. 2457T
gcucagcgcauccugc

SEQ ID NO: 1944536 - RNA, 16 nt, Shigella flexneri 2a str. 2457T
gcucacucaucacucc

SEQ ID NO: 1944537 - RNA, 16 nt, Shigella flexneri 2a str. 2457T
gcucacugcaaaacag

SEQ ID NO: 1944538 - RNA, 21 nt, Shigella flexneri 2a str. 2457T
gcucacuucgauccagugauu

SEQ ID NO: 1944539 - RNA, 23 nt, Shigella flexneri 2a str. 2457T
gcucagaaucacgccaacaaaca

SEQ ID NO: 1944540 - RNA, 16 nt, Shigella flexneri 2a str. 2457T
gcguucgccaaaccca

SEQ ID NO: 1944541 - RNA, 23 nt, Shigella flexneri 2a str. 2457T
gcguuccaucagauucagcagcg

SEQ ID NO: 1944542 - RNA, 19 nt, Shigella flexneri 2a str. 2457T
gcguuccagcaucuccugc

SEQ ID NO: 1944543 - RNA, 17 nt, Shigella flexneri 2a str. 2457T
gcguuccuggggaaaau

SEQ ID NO: 1944544 - RNA, 22 nt, Shigella flexneri 2a str. 2457T
gcguuccccuguugugccagac

SEQ ID NO: 1944545 - RNA, 11 nt, Shigella flexneri 2a str. 2457T
gcguuccccag

SEQ ID NO: 1944546 - RNA, 21 nt, Shigella flexneri 2a str. 2457T
gcguucaucaguuccaguuca

SEQ ID NO: 1944547 - RNA, 16 nt, Shigella flexneri 2a str. 2457T
gcguucaucaguucca

SEQ ID NO: 1944548 - RNA, 23 nt, Shigella flexneri 2a str. 2457T
gcguucacuguaguuauccgcaa

SEQ ID NO: 1944549 - RNA, 21 nt, Shigella flexneri 2a str. 2457T
gcguuaacuguacaggcuccu

SEQ ID NO: 1944550 - RNA, 22 nt, Shigella flexneri 2a str. 2457T
gcguuaaugucgauauggggau

SEQ ID NO: 1944551 - RNA, 13 nt, Shigella flexneri 2a str. 2457T
gcguuaaaacagg

SEQ ID NO: 1944552 - RNA, 14 nt, Shigella flexneri 2a str. 2457T
gcguuaagcauucg

SEQ ID NO: 1944553 - RNA, 20 nt, Shigella flexneri 2a str. 2457T
gcguuaagccaucccagaca

SEQ ID NO: 1944554 - RNA, 13 nt, Shigella flexneri 2a str. 2457T
gcguguggugagg

SEQ ID NO: 1944555 - RNA, 23 nt, Shigella flexneri 2a str. 2457T
gcguguuccagagaacgaccauc

SEQ ID NO: 1944556 - RNA, 13 nt, Shigella flexneri 2a str. 2457T
gcgugucggacgg

SEQ ID NO: 1944557 - RNA, 13 nt, Shigella flexneri 2a str. 2457T
gcgugucccacug

SEQ ID NO: 1944558 - RNA, 14 nt, Shigella flexneri 2a str. 2457T
gcgugguccagcug

SEQ ID NO: 1944559 - RNA, 14 nt, Shigella flexneri 2a str. 2457T
gcguuuaaucacac

SEQ ID NO: 1944560 - RNA, 15 nt, Shigella flexneri 2a str. 2457T
gcguuuaccugccug

SEQ ID NO: 1944561 - RNA, 16 nt, Shigella flexneri 2a str. 2457T
gcguuucaacaaacga

SEQ ID NO: 1944562 - RNA, 20 nt, Shigella flexneri 2a str. 2457T
gcguuucugcgcuucugcca

SEQ ID NO: 1944563 - RNA, 19 nt, Shigella flexneri 2a str. 2457T
gcguuugaaaaagccaaaa

SEQ ID NO: 1944564 - RNA, 23 nt, Shigella flexneri 2a str. 2457T
gcguuugaaauaccagguugccu

SEQ ID NO: 1944565 - RNA, 17 nt, Shigella flexneri 2a str. 2457T
gcguuuuuaucuucaca

SEQ ID NO: 1944566 - RNA, 16 nt, Shigella flexneri 2a str. 2457T
gcguuugcuccugcuu

SEQ ID NO: 1944567 - RNA, 14 nt, Shigella flexneri 2a str. 2457T
gcguuugcuccugc

SEQ ID NO: 1944568 - RNA, 12 nt, Shigella flexneri 2a str. 2457T
gcguuuguugcg

SEQ ID NO: 1944569 - RNA, 13 nt, Shigella flexneri 2a str. 2457T
gcguuuuucagaa

SEQ ID NO: 1944570 - RNA, 12 nt, Shigella flexneri 2a str. 2457T
gcguuuuuucau

SEQ ID NO: 1944571 - RNA, 19 nt, Shigella flexneri 2a str. 2457T
gcguucuguggcagggcag

SEQ ID NO: 1944572 - RNA, 13 nt, Shigella flexneri 2a str. 2457T
gcguucugccugg

SEQ ID NO: 1944573 - RNA, 16 nt, Shigella flexneri 2a str. 2457T
gcguugcuaugcugaa

SEQ ID NO: 1944574 - RNA, 23 nt, Shigella flexneri 2a str. 2457T
gcuaccaaaaaaucaaugcccau

SEQ ID NO: 1944575 - RNA, 14 nt, Shigella flexneri 2a str. 2457T
gcuaccaccaaacg

SEQ ID NO: 1944576 - RNA, 20 nt, Shigella flexneri 2a str. 2457T
gcuaauugcgaacugugcac

SEQ ID NO: 1944577 - RNA, 13 nt, Shigella flexneri 2a str. 2457T
gcuaauucaacgc

SEQ ID NO: 1944578 - RNA, 17 nt, Shigella flexneri 2a str. 2457T
gcuacaacaucguaucu

SEQ ID NO: 1944579 - RNA, 20 nt, Shigella flexneri 2a str. 2457T
gcuacggcguuucacuucug

SEQ ID NO: 1944580 - RNA, 20 nt, Shigella flexneri 2a str. 2457T
gcuacguucugcguaauguu

SEQ ID NO: 1944581 - RNA, 13 nt, Shigella flexneri 2a str. 2457T
gcuacugauaaua

SEQ ID NO: 1944582 - RNA, 17 nt, Shigella flexneri 2a str. 2457T
gcuacuggcaauccagc

SEQ ID NO: 1944583 - RNA, 20 nt, Shigella flexneri 2a str. 2457T
gcuaccgcccugagcaucaa

SEQ ID NO: 1944584 - RNA, 17 nt, Shigella flexneri 2a str. 2457T
gcuacgcagaaccagaa

SEQ ID NO: 1944585 - RNA, 14 nt, Shigella flexneri 2a str. 2457T
gcuaaugcaaauca

SEQ ID NO: 1944586 - RNA, 19 nt, Shigella flexneri 2a str. 2457T
gcuaaguacguaacgaccc

SEQ ID NO: 1944587 - RNA, 13 nt, Shigella flexneri 2a str. 2457T
gcuaauaaucagc

SEQ ID NO: 1944588 - RNA, 17 nt, Shigella flexneri 2a str. 2457T
gcuaauaaugagcagaa

SEQ ID NO: 1944589 - RNA, 23 nt, Shigella flexneri 2a str. 2457T
gcuaauaaugagcagaaaaaccc

SEQ ID NO: 1944590 - RNA, 14 nt, Shigella flexneri 2a str. 2457T
gcuaacguuuuuaa

SEQ ID NO: 1944591 - RNA, 15 nt, Shigella flexneri 2a str. 2457T
gcuaagauaccccag

SEQ ID NO: 1944592 - RNA, 15 nt, Shigella flexneri 2a str. 2457T
gcuaacugguggcag

SEQ ID NO: 1944593 - RNA, 17 nt, Shigella flexneri 2a str. 2457T
gcuaaauaaccagcaua

SEQ ID NO: 1944594 - RNA, 21 nt, Shigella flexneri 2a str. 2457T
gcuaaauguuuaguauuguua

SEQ ID NO: 1944595 - RNA, 16 nt, Shigella flexneri 2a str. 2457T
gcuaacaggcuuuuac

SEQ ID NO: 1944596 - RNA, 13 nt, Shigella flexneri 2a str. 2457T
gcuaacagcagca

SEQ ID NO: 1944597 - RNA, 18 nt, Shigella flexneri 2a str. 2457T
gcuaaagacuuugcugcc

SEQ ID NO: 1944598 - RNA, 15 nt, Shigella flexneri 2a str. 2457T
gcuuuucccuccacu

SEQ ID NO: 1944599 - RNA, 17 nt, Shigella flexneri 2a str. 2457T
gcuuuuccggucagcaa

SEQ ID NO: 1944600 - RNA, 19 nt, Shigella flexneri 2a str. 2457T
gcuuuuccauaucaagcau

SEQ ID NO: 1944601 - RNA, 22 nt, Shigella flexneri 2a str. 2457T
gcuuuucuaccaccaaaaccac

SEQ ID NO: 1944602 - RNA, 15 nt, Shigella flexneri 2a str. 2457T
gcuuuucucaccuau

SEQ ID NO: 1944603 - RNA, 18 nt, Shigella flexneri 2a str. 2457T
gcuuuuuaguaucuauuc

SEQ ID NO: 1944604 - RNA, 14 nt, Shigella flexneri 2a str. 2457T
gcuuuuuauagcaa

SEQ ID NO: 1944605 - RNA, 19 nt, Shigella flexneri 2a str. 2457T
gcuuuuucccugguaaaaa

SEQ ID NO: 1944606 - RNA, 23 nt, Shigella flexneri 2a str. 2457T
ggaaaacguuucaaacaggcugc

SEQ ID NO: 1944607 - RNA, 16 nt, Shigella flexneri 2a str. 2457T
gcuuuuuugagcagca

SEQ ID NO: 1944608 - RNA, 17 nt, Shigella flexneri 2a str. 2457T
gcuuuuuuacaucauca

SEQ ID NO: 1944609 - RNA, 18 nt, Shigella flexneri 2a str. 2457T
gcuuuuuuacaucaucag

SEQ ID NO: 1944610 - RNA, 17 nt, Shigella flexneri 2a str. 2457T
gcuuuuucugcuucugc

SEQ ID NO: 1944611 - RNA, 18 nt, Shigella flexneri 2a str. 2457T
gcuuuuucugcgcacaca

SEQ ID NO: 1944612 - RNA, 20 nt, Shigella flexneri 2a str. 2457T
gcuuucggaaagaucgccac

SEQ ID NO: 1944613 - RNA, 23 nt, Shigella flexneri 2a str. 2457T
gcugugauguccguuuaccacag

SEQ ID NO: 1944614 - RNA, 19 nt, Shigella flexneri 2a str. 2457T
gcugugcgauagcaacgag

SEQ ID NO: 1944615 - RNA, 14 nt, Shigella flexneri 2a str. 2457T
gcugugcggucuga

SEQ ID NO: 1944616 - RNA, 21 nt, Shigella flexneri 2a str. 2457T
gcuuucugggaugaucaccug

SEQ ID NO: 1944617 - RNA, 15 nt, Shigella flexneri 2a str. 2457T
gcuuucugaacugaa

SEQ ID NO: 1944618 - RNA, 21 nt, Shigella flexneri 2a str. 2457T
gcuuucugaacugaacaaaaa

SEQ ID NO: 1944619 - RNA, 17 nt, Shigella flexneri 2a str. 2457T
gcuuugccacugccggu

SEQ ID NO: 1944620 - RNA, 15 nt, Shigella flexneri 2a str. 2457T
gcuuugcaucccaga

SEQ ID NO: 1944621 - RNA, 14 nt, Shigella flexneri 2a str. 2457T
gcuuugcaggcugg

SEQ ID NO: 1944622 - RNA, 15 nt, Shigella flexneri 2a str. 2457T
gcuuugcaggcuggu

SEQ ID NO: 1944623 - RNA, 14 nt, Shigella flexneri 2a str. 2457T
gcuuugcaacugcu

SEQ ID NO: 1944624 - RNA, 20 nt, Shigella flexneri 2a str. 2457T
gcuuugaauaucuccucugc

SEQ ID NO: 1944625 - RNA, 22 nt, Shigella flexneri 2a str. 2457T
gcuuuuacauuauccagcgacu

SEQ ID NO: 1944626 - RNA, 18 nt, Shigella flexneri 2a str. 2457T
gcuuuguuuaugccagau

SEQ ID NO: 1944627 - RNA, 17 nt, Shigella flexneri 2a str. 2457T
gcuuuguguaaguuuaa

SEQ ID NO: 1944628 - RNA, 16 nt, Shigella flexneri 2a str. 2457T
gcuuugugcuggaaag

SEQ ID NO: 1944629 - RNA, 21 nt, Shigella flexneri 2a str. 2457T
gcuuuggauuugcaaauuuug

SEQ ID NO: 1944630 - RNA, 12 nt, Shigella flexneri 2a str. 2457T
gcuuuggcaaau

SEQ ID NO: 1944631 - RNA, 15 nt, Shigella flexneri 2a str. 2457T
ggaaccggauuuuca

SEQ ID NO: 1944632 - RNA, 23 nt, Shigella flexneri 2a str. 2457T
ggaaauugcacugcaucauggca

SEQ ID NO: 1944633 - RNA, 17 nt, Shigella flexneri 2a str. 2457T
ggaacuggcugccagcg

SEQ ID NO: 1944634 - RNA, 14 nt, Shigella flexneri 2a str. 2457T
ggaacuguuucacc

SEQ ID NO: 1944635 - RNA, 20 nt, Shigella flexneri 2a str. 2457T
ggaacuggcaacaauggcau

SEQ ID NO: 1944636 - RNA, 16 nt, Shigella flexneri 2a str. 2457T
ggaaccugugacagca

SEQ ID NO: 1944637 - RNA, 15 nt, Shigella flexneri 2a str. 2457T
ggaaccuaacgcugu

SEQ ID NO: 1944638 - RNA, 17 nt, Shigella flexneri 2a str. 2457T
ggaagacguugauucac

SEQ ID NO: 1944639 - RNA, 13 nt, Shigella flexneri 2a str. 2457T
ggaagaauuucau

SEQ ID NO: 1944640 - RNA, 20 nt, Shigella flexneri 2a str. 2457T
ggaagaauuugcuaccccug

SEQ ID NO: 1944641 - RNA, 17 nt, Shigella flexneri 2a str. 2457T
ggaagagacuauuucuu

SEQ ID NO: 1944642 - RNA, 21 nt, Shigella flexneri 2a str. 2457T
ggaagaauuugcuaccccuga

SEQ ID NO: 1944643 - RNA, 13 nt, Shigella flexneri 2a str. 2457T
ggaaggcauaacg

SEQ ID NO: 1944644 - RNA, 14 nt, Shigella flexneri 2a str. 2457T
ggaaggccagcagg

SEQ ID NO: 1944645 - RNA, 17 nt, Shigella flexneri 2a str. 2457T
ggaaggacucgaggagc

SEQ ID NO: 1944646 - RNA, 22 nt, Shigella flexneri 2a str. 2457T
ggaaggacucgaggagcuggag

SEQ ID NO: 1944647 - RNA, 18 nt, Shigella flexneri 2a str. 2457T
ggaagcuuucgcaguaga

SEQ ID NO: 1944648 - RNA, 14 nt, Shigella flexneri 2a str. 2457T
ggaagauuuaccga

SEQ ID NO: 1944649 - RNA, 20 nt, Shigella flexneri 2a str. 2457T
ggaagauguacgccagugcu

SEQ ID NO: 1944650 - RNA, 22 nt, Shigella flexneri 2a str. 2457T
ggaaucaacggcaacaauuccc

SEQ ID NO: 1944651 - RNA, 17 nt, Shigella flexneri 2a str. 2457T
ggaaaucaccaccagca

SEQ ID NO: 1944652 - RNA, 21 nt, Shigella flexneri 2a str. 2457T
ggaaauccugccgcaguuucu

SEQ ID NO: 1944653 - RNA, 17 nt, Shigella flexneri 2a str. 2457T
ggaaauccaggucagca

SEQ ID NO: 1944654 - RNA, 14 nt, Shigella flexneri 2a str. 2457T
ggaaauccaacaga

SEQ ID NO: 1944655 - RNA, 17 nt, Shigella flexneri 2a str. 2457T
ggaaaucauccagcacg

SEQ ID NO: 1944656 - RNA, 15 nt, Shigella flexneri 2a str. 2457T
ggaaaucauccagca

SEQ ID NO: 1944657 - RNA, 12 nt, Shigella flexneri 2a str. 2457T
ggaaaucaucca

SEQ ID NO: 1944658 - RNA, 22 nt, Shigella flexneri 2a str. 2457T
ggaaauuaccgcaaagcccacg

SEQ ID NO: 1944659 - RNA, 14 nt, Shigella flexneri 2a str. 2457T
ggaaauucagcagu

SEQ ID NO: 1944660 - RNA, 22 nt, Shigella flexneri 2a str. 2457T
ggaaauacgcuggcugaacauu

SEQ ID NO: 1944661 - RNA, 22 nt, Shigella flexneri 2a str. 2457T
ggaaaguuuaauugccauuucu

SEQ ID NO: 1944662 - RNA, 16 nt, Shigella flexneri 2a str. 2457T
ggaaaguguguauacg

SEQ ID NO: 1944663 - RNA, 14 nt, Shigella flexneri 2a str. 2457T
ggaaagcacaaaau

SEQ ID NO: 1944664 - RNA, 15 nt, Shigella flexneri 2a str. 2457T
ggaaagcaccugcgc

SEQ ID NO: 1944665 - RNA, 13 nt, Shigella flexneri 2a str. 2457T
ggaaacuccagcc

SEQ ID NO: 1944666 - RNA, 14 nt, Shigella flexneri 2a str. 2457T
ggaaacccaacgca

SEQ ID NO: 1944667 - RNA, 18 nt, Shigella flexneri 2a str. 2457T
ggaaaaucaucaggggca

SEQ ID NO: 1944668 - RNA, 13 nt, Shigella flexneri 2a str. 2457T
ggaaacagugcug

SEQ ID NO: 1944669 - RNA, 17 nt, Shigella flexneri 2a str. 2457T
ggaaaccaacuccagcg

SEQ ID NO: 1944670 - RNA, 23 nt, Shigella flexneri 2a str. 2457T
ggauagccgcccccgacuccagc

SEQ ID NO: 1944671 - RNA, 19 nt, Shigella flexneri 2a str. 2457T
ggauagccucucggcauuu

SEQ ID NO: 1944672 - RNA, 21 nt, Shigella flexneri 2a str. 2457T
ggauagccucucggcauuuau

SEQ ID NO: 1944673 - RNA, 15 nt, Shigella flexneri 2a str. 2457T
ggagugaaaauucuc

SEQ ID NO: 1944674 - RNA, 11 nt, Shigella flexneri 2a str. 2457T
ggagugcagca

SEQ ID NO: 1944675 - RNA, 13 nt, Shigella flexneri 2a str. 2457T
ggaguccuuucgu

SEQ ID NO: 1944676 - RNA, 12 nt, Shigella flexneri 2a str. 2457T
ggaguaauaauu

SEQ ID NO: 1944677 - RNA, 16 nt, Shigella flexneri 2a str. 2457T
ggaguaagaauaaaac

SEQ ID NO: 1944678 - RNA, 21 nt, Shigella flexneri 2a str. 2457T
ggauaucuucaaucagaugug

SEQ ID NO: 1944679 - RNA, 21 nt, Shigella flexneri 2a str. 2457T
ggaucaauuaauccuuucgaa

SEQ ID NO: 1944680 - RNA, 18 nt, Shigella flexneri 2a str. 2457T
ggauauccacccgcagcc

SEQ ID NO: 1944681 - RNA, 19 nt, Shigella flexneri 2a str. 2457T
ggauauccacccgcagcca

SEQ ID NO: 1944682 - RNA, 21 nt, Shigella flexneri 2a str. 2457T
ggauaucaacguuauucgcuu

SEQ ID NO: 1944683 - RNA, 22 nt, Shigella flexneri 2a str. 2457T
ggaucagaaugcgcucuuccgg

SEQ ID NO: 1944684 - RNA, 14 nt, Shigella flexneri 2a str. 2457T
ggaucacaucgccg

SEQ ID NO: 1944685 - RNA, 17 nt, Shigella flexneri 2a str. 2457T
ggauccugagcaaacag

SEQ ID NO: 1944686 - RNA, 19 nt, Shigella flexneri 2a str. 2457T
ggagauaucgccaggccag

SEQ ID NO: 1944687 - RNA, 19 nt, Shigella flexneri 2a str. 2457T
ggagaguugcaccagcaac

SEQ ID NO: 1944688 - RNA, 21 nt, Shigella flexneri 2a str. 2457T
ggagaguugcaccagcaacaa

SEQ ID NO: 1944689 - RNA, 20 nt, Shigella flexneri 2a str. 2457T
ggagaguaugcgcgucagag

SEQ ID NO: 1944690 - RNA, 14 nt, Shigella flexneri 2a str. 2457T
ggagacagcuuaga

SEQ ID NO: 1944691 - RNA, 20 nt, Shigella flexneri 2a str. 2457T
ggagacagcuuagacagcgc

SEQ ID NO: 1944692 - RNA, 17 nt, Shigella flexneri 2a str. 2457T
ggagcgauuaugaaaca

SEQ ID NO: 1944693 - RNA, 19 nt, Shigella flexneri 2a str. 2457T
ggagggguuuuugccagca

SEQ ID NO: 1944694 - RNA, 18 nt, Shigella flexneri 2a str. 2457T
ggagcuucacccgcagca

SEQ ID NO: 1944695 - RNA, 16 nt, Shigella flexneri 2a str. 2457T
ggagcugugggguauu

SEQ ID NO: 1944696 - RNA, 13 nt, Shigella flexneri 2a str. 2457T
ggagcuaaacagc

SEQ ID NO: 1944697 - RNA, 19 nt, Shigella flexneri 2a str. 2457T
ggagcuccagguccuccug

SEQ ID NO: 1944698 - RNA, 14 nt, Shigella flexneri 2a str. 2457T
aaaguaaacaauaa

SEQ ID NO: 1944699 - RNA, 15 nt, Shigella flexneri 2a str. 2457T
aaaguaaaccaccag

SEQ ID NO: 1944700 - RNA, 10 nt, Shigella flexneri 2a str. 2457T
aaaguaaauu

SEQ ID NO: 1944701 - RNA, 16 nt, Shigella flexneri 2a str. 2457T
ggacucgaggagcugg

SEQ ID NO: 1944702 - RNA, 20 nt, Shigella flexneri 2a str. 2457T
ggacgcacaucgcugugcug

SEQ ID NO: 1944703 - RNA, 12 nt, Shigella flexneri 2a str. 2457T
ggacgggcaauu

SEQ ID NO: 1944704 - RNA, 13 nt, Shigella flexneri 2a str. 2457T
ggaaucacucauc

SEQ ID NO: 1944705 - RNA, 18 nt, Shigella flexneri 2a str. 2457T
ggaaucgcucucagagag

SEQ ID NO: 1944706 - RNA, 17 nt, Shigella flexneri 2a str. 2457T
ggacagugggauuaaaa

SEQ ID NO: 1944707 - RNA, 20 nt, Shigella flexneri 2a str. 2457T
ggacaguaaaguuuuauccc

SEQ ID NO: 1944708 - RNA, 14 nt, Shigella flexneri 2a str. 2457T
ggacauagcucugc

SEQ ID NO: 1944709 - RNA, 16 nt, Shigella flexneri 2a str. 2457T
ggacaucguccagcuu

SEQ ID NO: 1944710 - RNA, 22 nt, Shigella flexneri 2a str. 2457T
ggacaugauuacugcaaacuca

SEQ ID NO: 1944711 - RNA, 15 nt, Shigella flexneri 2a str. 2457T
ggacaugauucauaa

SEQ ID NO: 1944712 - RNA, 10 nt, Shigella flexneri 2a str. 2457T
ggaccacgga

SEQ ID NO: 1944713 - RNA, 11 nt, Shigella flexneri 2a str. 2457T
aaagggaugcc

SEQ ID NO: 1944714 - RNA, 20 nt, Shigella flexneri 2a str. 2457T
aaagggcuaacgugcagguu

SEQ ID NO: 1944715 - RNA, 15 nt, Shigella flexneri 2a str. 2457T
ggcaacgacugcgag

SEQ ID NO: 1944716 - RNA, 20 nt, Shigella flexneri 2a str. 2457T
ggcaaauugcauacugcgau

SEQ ID NO: 1944717 - RNA, 13 nt, Shigella flexneri 2a str. 2457T
ggcaacguuccag

SEQ ID NO: 1944718 - RNA, 12 nt, Shigella flexneri 2a str. 2457T
ggcaacguucca

SEQ ID NO: 1944719 - RNA, 22 nt, Shigella flexneri 2a str. 2457T
ggcaaauaaucccgcgcaacaa

SEQ ID NO: 1944720 - RNA, 19 nt, Shigella flexneri 2a str. 2457T
ggcaaagugaauacagaac

SEQ ID NO: 1944721 - RNA, 24 nt, Shigella flexneri 2a str. 2457T
ggcaaaggcuucguucaucucaaa

SEQ ID NO: 1944722 - RNA, 20 nt, Shigella flexneri 2a str. 2457T
ggcaaagcugucaccaauca

SEQ ID NO: 1944723 - RNA, 12 nt, Shigella flexneri 2a str. 2457T
ggaucgccaggu

SEQ ID NO: 1944724 - RNA, 15 nt, Shigella flexneri 2a str. 2457T
ggauugccagaugcg

SEQ ID NO: 1944725 - RNA, 16 nt, Shigella flexneri 2a str. 2457T
ggauugccgcuucauu

SEQ ID NO: 1944726 - RNA, 16 nt, Shigella flexneri 2a str. 2457T
ggauugcugaaauaca

SEQ ID NO: 1944727 - RNA, 15 nt, Shigella flexneri 2a str. 2457T
ggauuuaaugccaau

SEQ ID NO: 1944728 - RNA, 17 nt, Shigella flexneri 2a str. 2457T
ggauuuaccuugcucau

SEQ ID NO: 1944729 - RNA, 22 nt, Shigella flexneri 2a str. 2457T
ggcaaacaaacugcgauuuaac

SEQ ID NO: 1944730 - RNA, 23 nt, Shigella flexneri 2a str. 2457T
ggcaaaaucaucacucccuuucu

SEQ ID NO: 1944731 - RNA, 18 nt, Shigella flexneri 2a str. 2457T
ggcaaaaugcaucggcau

SEQ ID NO: 1944732 - RNA, 20 nt, Shigella flexneri 2a str. 2457T
ggcaaacaguuucugcagcu

SEQ ID NO: 1944733 - RNA, 23 nt, Shigella flexneri 2a str. 2457T
ggcaauagcgggacacuaccauu

SEQ ID NO: 1944734 - RNA, 16 nt, Shigella flexneri 2a str. 2457T
ggcaauccacugcuug

SEQ ID NO: 1944735 - RNA, 22 nt, Shigella flexneri 2a str. 2457T
ggcaauucacugucgaacuggc

SEQ ID NO: 1944736 - RNA, 13 nt, Shigella flexneri 2a str. 2457T
ggcaauggugaac

SEQ ID NO: 1944737 - RNA, 23 nt, Shigella flexneri 2a str. 2457T
ggcaaugacuagcgccauaauaa

SEQ ID NO: 1944738 - RNA, 16 nt, Shigella flexneri 2a str. 2457T
ggcacaguagcccacc

SEQ ID NO: 1944739 - RNA, 19 nt, Shigella flexneri 2a str. 2457T
ggcacagucgcgacgcuga

SEQ ID NO: 1944740 - RNA, 16 nt, Shigella flexneri 2a str. 2457T
ggcaccaaucaccgcc

SEQ ID NO: 1944741 - RNA, 22 nt, Shigella flexneri 2a str. 2457T
ggcacaucgacggugacacuuu

SEQ ID NO: 1944742 - RNA, 16 nt, Shigella flexneri 2a str. 2457T
ggcacaucgacgguga

SEQ ID NO: 1944743 - RNA, 15 nt, Shigella flexneri 2a str. 2457T
ggcaccagccccugg

SEQ ID NO: 1944744 - RNA, 13 nt, Shigella flexneri 2a str. 2457T
ggcaccaaagggc

SEQ ID NO: 1944745 - RNA, 16 nt, Shigella flexneri 2a str. 2457T
ggcacaacucggcggc

SEQ ID NO: 1944746 - RNA, 12 nt, Shigella flexneri 2a str. 2457T
ggcagcaggugc

SEQ ID NO: 1944747 - RNA, 17 nt, Shigella flexneri 2a str. 2457T
ggcagccaccgccagcg

SEQ ID NO: 1944748 - RNA, 16 nt, Shigella flexneri 2a str. 2457T
aaaguacuucacaauc

SEQ ID NO: 1944749 - RNA, 18 nt, Shigella flexneri 2a str. 2457T
aaaguagaaauuauuucu

SEQ ID NO: 1944750 - RNA, 23 nt, Shigella flexneri 2a str. 2457T
ggcagcgcgaagcuggcggcggc

SEQ ID NO: 1944751 - RNA, 21 nt, Shigella flexneri 2a str. 2457T
ggcagcgcgcauucagcagca

SEQ ID NO: 1944752 - RNA, 18 nt, Shigella flexneri 2a str. 2457T
ggcacucaacaaccagaa

SEQ ID NO: 1944753 - RNA, 12 nt, Shigella flexneri 2a str. 2457T
ggcacguuaccu

SEQ ID NO: 1944754 - RNA, 19 nt, Shigella flexneri 2a str. 2457T
ggcagaaacggaccuggga

SEQ ID NO: 1944755 - RNA, 14 nt, Shigella flexneri 2a str. 2457T
ggcacuuuuauccu

SEQ ID NO: 1944756 - RNA, 22 nt, Shigella flexneri 2a str. 2457T
ggcagcaaggcuauucagcagu

SEQ ID NO: 1944757 - RNA, 17 nt, Shigella flexneri 2a str. 2457T
ggcagcaaucacugcca

SEQ ID NO: 1944758 - RNA, 18 nt, Shigella flexneri 2a str. 2457T
ggcagcaaucgaccaggc

SEQ ID NO: 1944759 - RNA, 13 nt, Shigella flexneri 2a str. 2457T
ggcaccgcagauc

SEQ ID NO: 1944760 - RNA, 19 nt, Shigella flexneri 2a str. 2457T
ggcaccauuaaggcugaug

SEQ ID NO: 1944761 - RNA, 20 nt, Shigella flexneri 2a str. 2457T
ggcaccauuuaaaucaauaa

SEQ ID NO: 1944762 - RNA, 23 nt, Shigella flexneri 2a str. 2457T
ggcacgauaaauggcucuucacc

SEQ ID NO: 1944763 - RNA, 13 nt, Shigella flexneri 2a str. 2457T
ggcaccuuuucau

SEQ ID NO: 1944764 - RNA, 16 nt, Shigella flexneri 2a str. 2457T
ggcauaagccgucccu

SEQ ID NO: 1944765 - RNA, 16 nt, Shigella flexneri 2a str. 2457T
ggcauaaucauuacaa

SEQ ID NO: 1944766 - RNA, 21 nt, Shigella flexneri 2a str. 2457T
ggcauagccaccuggcugcgu

SEQ ID NO: 1944767 - RNA, 20 nt, Shigella flexneri 2a str. 2457T
ggcaucgccuucgcaaaaaa

SEQ ID NO: 1944768 - RNA, 14 nt, Shigella flexneri 2a str. 2457T
ggcaucuucuucau

SEQ ID NO: 1944769 - RNA, 12 nt, Shigella flexneri 2a str. 2457T
ggcaugaaagcg

SEQ ID NO: 1944770 - RNA, 18 nt, Shigella flexneri 2a str. 2457T
ggcaucccggcauaaccg

SEQ ID NO: 1944771 - RNA, 18 nt, Shigella flexneri 2a str. 2457T
ggcauccuugcuaaccaa

SEQ ID NO: 1944772 - RNA, 19 nt, Shigella flexneri 2a str. 2457T
ggcaguaccugaccaguga

SEQ ID NO: 1944773 - RNA, 13 nt, Shigella flexneri 2a str. 2457T
ggcagcguuaugu

SEQ ID NO: 1944774 - RNA, 14 nt, Shigella flexneri 2a str. 2457T
ggcagucuggacaa

SEQ ID NO: 1944775 - RNA, 14 nt, Shigella flexneri 2a str. 2457T
ggccacagccagcc

SEQ ID NO: 1944776 - RNA, 12 nt, Shigella flexneri 2a str. 2457T
ggccaacuggca

SEQ ID NO: 1944777 - RNA, 18 nt, Shigella flexneri 2a str. 2457T
ggccaaaaaacagccccu

SEQ ID NO: 1944778 - RNA, 22 nt, Shigella flexneri 2a str. 2457T
ggccaaaaaacagccccugagc

SEQ ID NO: 1944779 - RNA, 19 nt, Shigella flexneri 2a str. 2457T
ggcauguguuagcccuguc

SEQ ID NO: 1944780 - RNA, 14 nt, Shigella flexneri 2a str. 2457T
ggccaaaucgccau

SEQ ID NO: 1944781 - RNA, 22 nt, Shigella flexneri 2a str. 2457T
ggcaugucgguuguacaaaaaa

SEQ ID NO: 1944782 - RNA, 22 nt, Shigella flexneri 2a str. 2457T
ggcauggggucaggugggacca

SEQ ID NO: 1944783 - RNA, 17 nt, Shigella flexneri 2a str. 2457T
ggcauggggucaggugg

SEQ ID NO: 1944784 - RNA, 15 nt, Shigella flexneri 2a str. 2457T
ggcauggggucaggu

SEQ ID NO: 1944785 - RNA, 14 nt, Shigella flexneri 2a str. 2457T
ggcaugacacagaa

SEQ ID NO: 1944786 - RNA, 12 nt, Shigella flexneri 2a str. 2457T
ggcaugauucau

SEQ ID NO: 1944787 - RNA, 20 nt, Shigella flexneri 2a str. 2457T
ggcaugcagcguaccugggu

SEQ ID NO: 1944788 - RNA, 14 nt, Shigella flexneri 2a str. 2457T
ggcauggcgcuggc

SEQ ID NO: 1944789 - RNA, 17 nt, Shigella flexneri 2a str. 2457T
ggccagcgccaccacca

SEQ ID NO: 1944790 - RNA, 18 nt, Shigella flexneri 2a str. 2457T
ggccagccauccgucauc

SEQ ID NO: 1944791 - RNA, 14 nt, Shigella flexneri 2a str. 2457T
ggccagccagcaga

SEQ ID NO: 1944792 - RNA, 17 nt, Shigella flexneri 2a str. 2457T
ggccagcaugugguuac

SEQ ID NO: 1944793 - RNA, 14 nt, Shigella flexneri 2a str. 2457T
ggccagcagcagag

SEQ ID NO: 1944794 - RNA, 17 nt, Shigella flexneri 2a str. 2457T
ggccacgucauccggaa

SEQ ID NO: 1944795 - RNA, 18 nt, Shigella flexneri 2a str. 2457T
ggccagguuuucuuucac

SEQ ID NO: 1944796 - RNA, 21 nt, Shigella flexneri 2a str. 2457T
ggccagguuuucuuucaccuc

SEQ ID NO: 1944797 - RNA, 21 nt, Shigella flexneri 2a str. 2457T
ggccaguaagcaguccagcgc

SEQ ID NO: 1944798 - RNA, 23 nt, Shigella flexneri 2a str. 2457T
ggccaguaagcaguccagcgccu

SEQ ID NO: 1944799 - RNA, 17 nt, Shigella flexneri 2a str. 2457T
ggccagguuuucuuuca

SEQ ID NO: 1944800 - RNA, 14 nt, Shigella flexneri 2a str. 2457T
ggccaucagcagcg

SEQ ID NO: 1944801 - RNA, 20 nt, Shigella flexneri 2a str. 2457T
ggccaucagcagcggagaaa

SEQ ID NO: 1944802 - RNA, 20 nt, Shigella flexneri 2a str. 2457T
ggccauccgcgugacgcugg

SEQ ID NO: 1944803 - RNA, 14 nt, Shigella flexneri 2a str. 2457T
ggcguccaccugcg

SEQ ID NO: 1944804 - RNA, 20 nt, Shigella flexneri 2a str. 2457T
ggcguacugaccgucgccuu

SEQ ID NO: 1944805 - RNA, 17 nt, Shigella flexneri 2a str. 2457T
ggcggugaccagcagca

SEQ ID NO: 1944806 - RNA, 17 nt, Shigella flexneri 2a str. 2457T
ggcggucagcgccagcg

SEQ ID NO: 1944807 - RNA, 14 nt, Shigella flexneri 2a str. 2457T
ggcggcucuccuga

SEQ ID NO: 1944808 - RNA, 12 nt, Shigella flexneri 2a str. 2457T
ggcggcgcgcca

SEQ ID NO: 1944809 - RNA, 13 nt, Shigella flexneri 2a str. 2457T
ggcggcgaagcug

SEQ ID NO: 1944810 - RNA, 14 nt, Shigella flexneri 2a str. 2457T
ggcggcgcgcgcug

SEQ ID NO: 1944811 - RNA, 14 nt, Shigella flexneri 2a str. 2457T
ggcggcucaccugc

SEQ ID NO: 1944812 - RNA, 18 nt, Shigella flexneri 2a str. 2457T
ggcggcguucagucgccg

SEQ ID NO: 1944813 - RNA, 20 nt, Shigella flexneri 2a str. 2457T
ggcgcuugucgucccaggca

SEQ ID NO: 1944814 - RNA, 19 nt, Shigella flexneri 2a str. 2457T
ggcggaaaucuuucauuuc

SEQ ID NO: 1944815 - RNA, 14 nt, Shigella flexneri 2a str. 2457T
ggcucagccgauga

SEQ ID NO: 1944816 - RNA, 14 nt, Shigella flexneri 2a str. 2457T
ggcucaaucgccac

SEQ ID NO: 1944817 - RNA, 15 nt, Shigella flexneri 2a str. 2457T
ggcucaaucgccacc

SEQ ID NO: 1944818 - RNA, 22 nt, Shigella flexneri 2a str. 2457T
ggcuauaaucacucaaaauauc

SEQ ID NO: 1944819 - RNA, 15 nt, Shigella flexneri 2a str. 2457T
ggcuagccucccugc

SEQ ID NO: 1944820 - RNA, 14 nt, Shigella flexneri 2a str. 2457T
ggcuauauucaaac

SEQ ID NO: 1944821 - RNA, 20 nt, Shigella flexneri 2a str. 2457T
ggcuauuccacgcaucaagc

SEQ ID NO: 1944822 - RNA, 19 nt, Shigella flexneri 2a str. 2457T
ggcuaaucuugaaaccaga

SEQ ID NO: 1944823 - RNA, 21 nt, Shigella flexneri 2a str. 2457T
ggcuaaucuugaaaccagaca

SEQ ID NO: 1944824 - RNA, 20 nt, Shigella flexneri 2a str. 2457T
ggcguuuguaacccaccaug

SEQ ID NO: 1944825 - RNA, 12 nt, Shigella flexneri 2a str. 2457T
ggcuaaaaaaag

SEQ ID NO: 1944826 - RNA, 15 nt, Shigella flexneri 2a str. 2457T
ggcguucugccuggc

SEQ ID NO: 1944827 - RNA, 18 nt, Shigella flexneri 2a str. 2457T
ggcgugaacgccuuaucc

SEQ ID NO: 1944828 - RNA, 18 nt, Shigella flexneri 2a str. 2457T
ggcgugaacgccuuaucu

SEQ ID NO: 1944829 - RNA, 20 nt, Shigella flexneri 2a str. 2457T
ggcguuaucggguccgggca

SEQ ID NO: 1944830 - RNA, 18 nt, Shigella flexneri 2a str. 2457T
ggcguuagucgucgccga

SEQ ID NO: 1944831 - RNA, 14 nt, Shigella flexneri 2a str. 2457T
ggcguuaucacguu

SEQ ID NO: 1944832 - RNA, 14 nt, Shigella flexneri 2a str. 2457T
ggcguuacagcugg

SEQ ID NO: 1944833 - RNA, 15 nt, Shigella flexneri 2a str. 2457T
ggcgugguccagcug

SEQ ID NO: 1944834 - RNA, 15 nt, Shigella flexneri 2a str. 2457T
ggcgaugggacgcgc

SEQ ID NO: 1944835 - RNA, 20 nt, Shigella flexneri 2a str. 2457T
ggcgaugcuguauucuucag

SEQ ID NO: 1944836 - RNA, 21 nt, Shigella flexneri 2a str. 2457T
ggcgaugcuuugaccucccgc

SEQ ID NO: 1944837 - RNA, 21 nt, Shigella flexneri 2a str. 2457T
ggcgaucgacgugggcguggg

SEQ ID NO: 1944838 - RNA, 19 nt, Shigella flexneri 2a str. 2457T
ggcgcaaggugugggcaau

SEQ ID NO: 1944839 - RNA, 15 nt, Shigella flexneri 2a str. 2457T
ggcgcaagggcugga

SEQ ID NO: 1944840 - RNA, 20 nt, Shigella flexneri 2a str. 2457T
ggcgcaauguugcgggggcu

SEQ ID NO: 1944841 - RNA, 21 nt, Shigella flexneri 2a str. 2457T
ggcgcaaugauaucgcuggca

SEQ ID NO: 1944842 - RNA, 21 nt, Shigella flexneri 2a str. 2457T
ggcgaugggcguuucacuggu

SEQ ID NO: 1944843 - RNA, 22 nt, Shigella flexneri 2a str. 2457T
ggcgaugggcguuucacuggua

SEQ ID NO: 1944844 - RNA, 15 nt, Shigella flexneri 2a str. 2457T
ggcgauguucugguc

SEQ ID NO: 1944845 - RNA, 20 nt, Shigella flexneri 2a str. 2457T
ggcgauaaaguguugagcuu

SEQ ID NO: 1944846 - RNA, 18 nt, Shigella flexneri 2a str. 2457T
ggcgaguuuccaucaggc

SEQ ID NO: 1944847 - RNA, 23 nt, Shigella flexneri 2a str. 2457T
ggcgaggggacgguccgugcgcu

SEQ ID NO: 1944848 - RNA, 21 nt, Shigella flexneri 2a str. 2457T
ggcgaggggacuguccgggca

SEQ ID NO: 1944849 - RNA, 14 nt, Shigella flexneri 2a str. 2457T
aaauacacuuuaau

SEQ ID NO: 1944850 - RNA, 14 nt, Shigella flexneri 2a str. 2457T
ggcgagggcaaacc

SEQ ID NO: 1944851 - RNA, 16 nt, Shigella flexneri 2a str. 2457T
aaauacguucucaccu

SEQ ID NO: 1944852 - RNA, 22 nt, Shigella flexneri 2a str. 2457T
ggcgcaucuguuucgaucagca

SEQ ID NO: 1944853 - RNA, 18 nt, Shigella flexneri 2a str. 2457T
ggcgcaguuucgaggcga

SEQ ID NO: 1944854 - RNA, 13 nt, Shigella flexneri 2a str. 2457T
ggcgcagggugua

SEQ ID NO: 1944855 - RNA, 14 nt, Shigella flexneri 2a str. 2457T
ggcgcgauaaaaau

SEQ ID NO: 1944856 - RNA, 22 nt, Shigella flexneri 2a str. 2457T
ggcgcucgcgccgcauccgaca

SEQ ID NO: 1944857 - RNA, 19 nt, Shigella flexneri 2a str. 2457T
ggcgcuccugcgggagcgc

SEQ ID NO: 1944858 - RNA, 17 nt, Shigella flexneri 2a str. 2457T
aaauacuggcuaagaag

SEQ ID NO: 1944859 - RNA, 19 nt, Shigella flexneri 2a str. 2457T
aaauacuggcuaagaagcc

SEQ ID NO: 1944860 - RNA, 21 nt, Shigella flexneri 2a str. 2457T
aaauacuguuuaucuucccag

SEQ ID NO: 1944861 - RNA, 16 nt, Shigella flexneri 2a str. 2457T
aaauacugauguuugu

SEQ ID NO: 1944862 - RNA, 18 nt, Shigella flexneri 2a str. 2457T
ggccuugauuauuucccu

SEQ ID NO: 1944863 - RNA, 19 nt, Shigella flexneri 2a str. 2457T
ggcgaacucuuccggcagg

SEQ ID NO: 1944864 - RNA, 15 nt, Shigella flexneri 2a str. 2457T
ggcgaagagaaagaa

SEQ ID NO: 1944865 - RNA, 21 nt, Shigella flexneri 2a str. 2457T
ggcgaauagaaagcaagccag

SEQ ID NO: 1944866 - RNA, 21 nt, Shigella flexneri 2a str. 2457T
ggcgaaggcgcacugauucau

SEQ ID NO: 1944867 - RNA, 22 nt, Shigella flexneri 2a str. 2457T
ggcgaagcgauucucgccgccc

SEQ ID NO: 1944868 - RNA, 16 nt, Shigella flexneri 2a str. 2457T
ggcgaagagagcgcca

SEQ ID NO: 1944869 - RNA, 15 nt, Shigella flexneri 2a str. 2457T
aaauaaauauauaaa

SEQ ID NO: 1944870 - RNA, 23 nt, Shigella flexneri 2a str. 2457T
aaauaaaugcuugacucuguagc

SEQ ID NO: 1944871 - RNA, 12 nt, Shigella flexneri 2a str. 2457T
aaauaaaauaag

SEQ ID NO: 1944872 - RNA, 20 nt, Shigella flexneri 2a str. 2457T
aaauaaaaaacauucaagua

SEQ ID NO: 1944873 - RNA, 11 nt, Shigella flexneri 2a str. 2457T
aaauaaaaauu

SEQ ID NO: 1944874 - RNA, 13 nt, Shigella flexneri 2a str. 2457T
ggccugaacaagc

SEQ ID NO: 1944875 - RNA, 15 nt, Shigella flexneri 2a str. 2457T
ggccugaacaagcaa

SEQ ID NO: 1944876 - RNA, 15 nt, Shigella flexneri 2a str. 2457T
ggccugaaagcucau

SEQ ID NO: 1944877 - RNA, 16 nt, Shigella flexneri 2a str. 2457T
ggccucuccucgcgag

SEQ ID NO: 1944878 - RNA, 20 nt, Shigella flexneri 2a str. 2457T
ggccucggguugaugguaaa

SEQ ID NO: 1944879 - RNA, 17 nt, Shigella flexneri 2a str. 2457T
ggccucgcuacgccagc

SEQ ID NO: 1944880 - RNA, 20 nt, Shigella flexneri 2a str. 2457T
ggccuaccguucaggcacaa

SEQ ID NO: 1944881 - RNA, 18 nt, Shigella flexneri 2a str. 2457T
ggccuauuaugacuccag

SEQ ID NO: 1944882 - RNA, 18 nt, Shigella flexneri 2a str. 2457T
ggccucaugugaugguaa

SEQ ID NO: 1944883 - RNA, 13 nt, Shigella flexneri 2a str. 2457T
ggccguuccggca

SEQ ID NO: 1944884 - RNA, 18 nt, Shigella flexneri 2a str. 2457T
aaaguuuucuucagugcc

SEQ ID NO: 1944885 - RNA, 14 nt, Shigella flexneri 2a str. 2457T
aaauaaaaaacauu

SEQ ID NO: 1944886 - RNA, 21 nt, Shigella flexneri 2a str. 2457T
aaauaaaaaaaguauuuuuaa

SEQ ID NO: 1944887 - RNA, 18 nt, Shigella flexneri 2a str. 2457T
ggccgugcagaccgcuga

SEQ ID NO: 1944888 - RNA, 19 nt, Shigella flexneri 2a str. 2457T
ggccguauggcgagcagga

SEQ ID NO: 1944889 - RNA, 23 nt, Shigella flexneri 2a str. 2457T
ggccgguuuuaaagcaaaaaaag

SEQ ID NO: 1944890 - RNA, 14 nt, Shigella flexneri 2a str. 2457T
aaaguuauaaauaa

SEQ ID NO: 1944891 - RNA, 15 nt, Shigella flexneri 2a str. 2457T
aaaguuauaaauaaa

SEQ ID NO: 1944892 - RNA, 16 nt, Shigella flexneri 2a str. 2457T
ggccgccacacagcac

SEQ ID NO: 1944893 - RNA, 20 nt, Shigella flexneri 2a str. 2457T
aaagugggggauuuacucuc

SEQ ID NO: 1944894 - RNA, 17 nt, Shigella flexneri 2a str. 2457T
aaaguggcguuguguuc

SEQ ID NO: 1944895 - RNA, 17 nt, Shigella flexneri 2a str. 2457T
aaaguggaaaaauaaca

SEQ ID NO: 1944896 - RNA, 16 nt, Shigella flexneri 2a str. 2457T
ggccgcaaaccagcgc

SEQ ID NO: 1944897 - RNA, 13 nt, Shigella flexneri 2a str. 2457T
ggccgaggcacag

SEQ ID NO: 1944898 - RNA, 16 nt, Shigella flexneri 2a str. 2457T
ggccgaggcacagcag

SEQ ID NO: 1944899 - RNA, 16 nt, Shigella flexneri 2a str. 2457T
aaagugcccccaacuu

SEQ ID NO: 1944900 - RNA, 18 nt, Shigella flexneri 2a str. 2457T
aaaguugcucucaaagac

SEQ ID NO: 1944901 - RNA, 17 nt, Shigella flexneri 2a str. 2457T
aaaguugcucucaaaga

SEQ ID NO: 1944902 - RNA, 15 nt, Shigella flexneri 2a str. 2457T
aaaguuggcaccaaa

SEQ ID NO: 1944903 - RNA, 22 nt, Shigella flexneri 2a str. 2457T
aaaguugccagauaaauauuau

SEQ ID NO: 1944904 - RNA, 16 nt, Shigella flexneri 2a str. 2457T
ggccggauaaggcgcu

SEQ ID NO: 1944905 - RNA, 16 nt, Shigella flexneri 2a str. 2457T
ggccggauguggcguu

SEQ ID NO: 1944906 - RNA, 16 nt, Shigella flexneri 2a str. 2457T
ggccggagccagccgu

SEQ ID NO: 1944907 - RNA, 16 nt, Shigella flexneri 2a str. 2457T
ggccgcuuccagcauu

SEQ ID NO: 1944908 - RNA, 18 nt, Shigella flexneri 2a str. 2457T
ggccgggcaaacaaggca

SEQ ID NO: 1944909 - RNA, 15 nt, Shigella flexneri 2a str. 2457T
gagcuugauccuaca

SEQ ID NO: 1944910 - RNA, 19 nt, Shigella flexneri 2a str. 2457T
gagcgaauaaaaaaagaaa

SEQ ID NO: 1944911 - RNA, 22 nt, Shigella flexneri 2a str. 2457T
gagcgacaccucccagcgcggu

SEQ ID NO: 1944912 - RNA, 17 nt, Shigella flexneri 2a str. 2457T
gagcgacaucuuccuua

SEQ ID NO: 1944913 - RNA, 17 nt, Shigella flexneri 2a str. 2457T
gagcgaauacuccccuu

SEQ ID NO: 1944914 - RNA, 20 nt, Shigella flexneri 2a str. 2457T
gagcuggcgaacgugcagga

SEQ ID NO: 1944915 - RNA, 19 nt, Shigella flexneri 2a str. 2457T
gagcuggaaguuacucaaa

SEQ ID NO: 1944916 - RNA, 22 nt, Shigella flexneri 2a str. 2457T
gagcuuugacgaccuucuucca

SEQ ID NO: 1944917 - RNA, 15 nt, Shigella flexneri 2a str. 2457T
gaggaugcacucgca

SEQ ID NO: 1944918 - RNA, 14 nt, Shigella flexneri 2a str. 2457T
gagggaauggcaga

SEQ ID NO: 1944919 - RNA, 16 nt, Shigella flexneri 2a str. 2457T
gaggcaauaguucugu

SEQ ID NO: 1944920 - RNA, 15 nt, Shigella flexneri 2a str. 2457T
gaggcagcaaggaaa

SEQ ID NO: 1944921 - RNA, 20 nt, Shigella flexneri 2a str. 2457T
gaggcgucagcguuccacgu

SEQ ID NO: 1944922 - RNA, 21 nt, Shigella flexneri 2a str. 2457T
gaggucaguaaugagcacaga

SEQ ID NO: 1944923 - RNA, 19 nt, Shigella flexneri 2a str. 2457T
gagggcgauuauccgccag

SEQ ID NO: 1944924 - RNA, 17 nt, Shigella flexneri 2a str. 2457T
gagggcaaacaggcgcu

SEQ ID NO: 1944925 - RNA, 22 nt, Shigella flexneri 2a str. 2457T
gagggcaaaggcgcggcggcga

SEQ ID NO: 1944926 - RNA, 14 nt, Shigella flexneri 2a str. 2457T
gauaaaaaguuuuu

SEQ ID NO: 1944927 - RNA, 15 nt, Shigella flexneri 2a str. 2457T
gauaaaggcggccca

SEQ ID NO: 1944928 - RNA, 12 nt, Shigella flexneri 2a str. 2457T
gauaaauauuau

SEQ ID NO: 1944929 - RNA, 14 nt, Shigella flexneri 2a str. 2457T
gauaaauauuauug

SEQ ID NO: 1944930 - RNA, 13 nt, Shigella flexneri 2a str. 2457T
gauaacaaaauaa

SEQ ID NO: 1944931 - RNA, 14 nt, Shigella flexneri 2a str. 2457T
gauaacaaaauaac

SEQ ID NO: 1944932 - RNA, 17 nt, Shigella flexneri 2a str. 2457T
gauaaauuacugccgcu

SEQ ID NO: 1944933 - RNA, 19 nt, Shigella flexneri 2a str. 2457T
gaguucaaagccgaagcug

SEQ ID NO: 1944934 - RNA, 20 nt, Shigella flexneri 2a str. 2457T
gaguucaaagccgaagcugu

SEQ ID NO: 1944935 - RNA, 22 nt, Shigella flexneri 2a str. 2457T
gagugcucaaccguaggccgga

SEQ ID NO: 1944936 - RNA, 21 nt, Shigella flexneri 2a str. 2457T
gagugcguucaccgaagacgu

SEQ ID NO: 1944937 - RNA, 21 nt, Shigella flexneri 2a str. 2457T
gagugcguuccccgaagacgu

SEQ ID NO: 1944938 - RNA, 15 nt, Shigella flexneri 2a str. 2457T
gaguuaagcaaaaaa

SEQ ID NO: 1944939 - RNA, 22 nt, Shigella flexneri 2a str. 2457T
gaguugccaucaucaccagaau

SEQ ID NO: 1944940 - RNA, 21 nt, Shigella flexneri 2a str. 2457T
gaguugagcaguccccacauc

SEQ ID NO: 1944941 - RNA, 14 nt, Shigella flexneri 2a str. 2457T
gaguugaaaaccuc

SEQ ID NO: 1944942 - RNA, 15 nt, Shigella flexneri 2a str. 2457T
gaguaaaaauauuuc

SEQ ID NO: 1944943 - RNA, 13 nt, Shigella flexneri 2a str. 2457T
gaguaaaaagcag

SEQ ID NO: 1944944 - RNA, 16 nt, Shigella flexneri 2a str. 2457T
gaguaaaaaaacauca

SEQ ID NO: 1944945 - RNA, 17 nt, Shigella flexneri 2a str. 2457T
gaguaaaaaaacaucau

SEQ ID NO: 1944946 - RNA, 22 nt, Shigella flexneri 2a str. 2457T
gagguuagcaaugccuucugga

SEQ ID NO: 1944947 - RNA, 14 nt, Shigella flexneri 2a str. 2457T
gagguuaaugaucg

SEQ ID NO: 1944948 - RNA, 20 nt, Shigella flexneri 2a str. 2457T
gagguuggcucaucaagcac

SEQ ID NO: 1944949 - RNA, 16 nt, Shigella flexneri 2a str. 2457T
gagucagcccaacaaa

SEQ ID NO: 1944950 - RNA, 18 nt, Shigella flexneri 2a str. 2457T
gauaucgccaggccagcc

SEQ ID NO: 1944951 - RNA, 13 nt, Shigella flexneri 2a str. 2457T
gauaucgcuggca

SEQ ID NO: 1944952 - RNA, 23 nt, Shigella flexneri 2a str. 2457T
gauaucccagcugccgccaggcu

SEQ ID NO: 1944953 - RNA, 14 nt, Shigella flexneri 2a str. 2457T
gauauccgccaaua

SEQ ID NO: 1944954 - RNA, 21 nt, Shigella flexneri 2a str. 2457T
gauaucgaccacuuuaaccag

SEQ ID NO: 1944955 - RNA, 21 nt, Shigella flexneri 2a str. 2457T
gauaucauuaaaguuaucgcc

SEQ ID NO: 1944956 - RNA, 16 nt, Shigella flexneri 2a str. 2457T
gauaucccgccagcac

SEQ ID NO: 1944957 - RNA, 14 nt, Shigella flexneri 2a str. 2457T
gauauuaucuucau

SEQ ID NO: 1944958 - RNA, 16 nt, Shigella flexneri 2a str. 2457T
gauaucuacaaaacca

SEQ ID NO: 1944959 - RNA, 18 nt, Shigella flexneri 2a str. 2457T
gauauucaucuccagcac

SEQ ID NO: 1944960 - RNA, 20 nt, Shigella flexneri 2a str. 2457T
gauauucaggcguugaaaaa

SEQ ID NO: 1944961 - RNA, 15 nt, Shigella flexneri 2a str. 2457T
gauauucuccagcuu

SEQ ID NO: 1944962 - RNA, 18 nt, Shigella flexneri 2a str. 2457T
gauauugcggaacaucgc

SEQ ID NO: 1944963 - RNA, 23 nt, Shigella flexneri 2a str. 2457T
gauauuucaccagcgcacgcagg

SEQ ID NO: 1944964 - RNA, 21 nt, Shigella flexneri 2a str. 2457T
gauauuuuucccugaaggcug

SEQ ID NO: 1944965 - RNA, 14 nt, Shigella flexneri 2a str. 2457T
gaucaaucugcucu

SEQ ID NO: 1944966 - RNA, 16 nt, Shigella flexneri 2a str. 2457T
gaucaacacauccagu

SEQ ID NO: 1944967 - RNA, 14 nt, Shigella flexneri 2a str. 2457T
gaucaaaucucgcc

SEQ ID NO: 1944968 - RNA, 13 nt, Shigella flexneri 2a str. 2457T
gaucaauuucaca

SEQ ID NO: 1944969 - RNA, 23 nt, Shigella flexneri 2a str. 2457T
gauagccgcccccgacuccagca

SEQ ID NO: 1944970 - RNA, 16 nt, Shigella flexneri 2a str. 2457T
gauaguucaacagauu

SEQ ID NO: 1944971 - RNA, 13 nt, Shigella flexneri 2a str. 2457T
gauauaaauucca

SEQ ID NO: 1944972 - RNA, 13 nt, Shigella flexneri 2a str. 2457T
gauaucaccacca

SEQ ID NO: 1944973 - RNA, 14 nt, Shigella flexneri 2a str. 2457T
gauaucaccaccaa

SEQ ID NO: 1944974 - RNA, 21 nt, Shigella flexneri 2a str. 2457T
gauagccagguuuaccagcag

SEQ ID NO: 1944975 - RNA, 19 nt, Shigella flexneri 2a str. 2457T
gauacucaagcagccaggu

SEQ ID NO: 1944976 - RNA, 19 nt, Shigella flexneri 2a str. 2457T
gauagcacgacguuucuuu

SEQ ID NO: 1944977 - RNA, 18 nt, Shigella flexneri 2a str. 2457T
gauagcacgucacggacu

SEQ ID NO: 1944978 - RNA, 18 nt, Shigella flexneri 2a str. 2457T
gauacggcgcaucuguuu

SEQ ID NO: 1944979 - RNA, 18 nt, Shigella flexneri 2a str. 2457T
gauacguaauucaucguc

SEQ ID NO: 1944980 - RNA, 19 nt, Shigella flexneri 2a str. 2457T
gauaccgguaaucaggcaa

SEQ ID NO: 1944981 - RNA, 15 nt, Shigella flexneri 2a str. 2457T
gauacguugccguau

SEQ ID NO: 1944982 - RNA, 18 nt, Shigella flexneri 2a str. 2457T
gauacuacguucaaucac

SEQ ID NO: 1944983 - RNA, 12 nt, Shigella flexneri 2a str. 2457T
gauaauccacgc

SEQ ID NO: 1944984 - RNA, 23 nt, Shigella flexneri 2a str. 2457T
gauaaucaucccacaugaauucg

SEQ ID NO: 1944985 - RNA, 16 nt, Shigella flexneri 2a str. 2457T
gauaaucagcgccagc

SEQ ID NO: 1944986 - RNA, 22 nt, Shigella flexneri 2a str. 2457T
gauaauauuuuugcguccuggc

SEQ ID NO: 1944987 - RNA, 17 nt, Shigella flexneri 2a str. 2457T
gauaauauuuaucuucc

SEQ ID NO: 1944988 - RNA, 16 nt, Shigella flexneri 2a str. 2457T
gauaaucaacaaacca

SEQ ID NO: 1944989 - RNA, 23 nt, Shigella flexneri 2a str. 2457T
gauaaucaaugacacguuuauua

SEQ ID NO: 1944990 - RNA, 21 nt, Shigella flexneri 2a str. 2457T
gauaaucguauucuggcuucg

SEQ ID NO: 1944991 - RNA, 13 nt, Shigella flexneri 2a str. 2457T
gauaauccaggac

SEQ ID NO: 1944992 - RNA, 18 nt, Shigella flexneri 2a str. 2457T
gauaauccaggacauauc

SEQ ID NO: 1944993 - RNA, 12 nt, Shigella flexneri 2a str. 2457T
gauaauggcugu

SEQ ID NO: 1944994 - RNA, 20 nt, Shigella flexneri 2a str. 2457T
gauaaugguuuccagcaucg

SEQ ID NO: 1944995 - RNA, 18 nt, Shigella flexneri 2a str. 2457T
gauaaugcccgaugaccu

SEQ ID NO: 1944996 - RNA, 15 nt, Shigella flexneri 2a str. 2457T
gauaauaauguguuc

SEQ ID NO: 1944997 - RNA, 19 nt, Shigella flexneri 2a str. 2457T
gauaaggugccaauccuuc

SEQ ID NO: 1944998 - RNA, 22 nt, Shigella flexneri 2a str. 2457T
gauaagugagcgauucaaauuc

SEQ ID NO: 1944999 - RNA, 20 nt, Shigella flexneri 2a str. 2457T
gauaaccacguucauuucau

SEQ ID NO: 1945000 - RNA, 17 nt, Shigella flexneri 2a str. 2457T
gauaaggaauucacgcc

SEQ ID NO: 1945001 - RNA, 17 nt, Shigella flexneri 2a str. 2457T
gauacagcucaugggcu

SEQ ID NO: 1945002 - RNA, 14 nt, Shigella flexneri 2a str. 2457T
gauacaguuuuugc

SEQ ID NO: 1945003 - RNA, 22 nt, Shigella flexneri 2a str. 2457T
gauaccgcacgcucaaagacgc

SEQ ID NO: 1945004 - RNA, 18 nt, Shigella flexneri 2a str. 2457T
aaagcauagccccagcgc

SEQ ID NO: 1945005 - RNA, 15 nt, Shigella flexneri 2a str. 2457T
gauaauuuucuuauc

SEQ ID NO: 1945006 - RNA, 20 nt, Shigella flexneri 2a str. 2457T
aaagccaaccugcggguugg

SEQ ID NO: 1945007 - RNA, 15 nt, Shigella flexneri 2a str. 2457T
aaagccaacagcagc

SEQ ID NO: 1945008 - RNA, 16 nt, Shigella flexneri 2a str. 2457T
gagcaugaugccugau

SEQ ID NO: 1945009 - RNA, 15 nt, Shigella flexneri 2a str. 2457T
gagcaucugcaaaau

SEQ ID NO: 1945010 - RNA, 23 nt, Shigella flexneri 2a str. 2457T
gagcauaucgacgaaccauuucg

SEQ ID NO: 1945011 - RNA, 13 nt, Shigella flexneri 2a str. 2457T
gagcauauuuagg

SEQ ID NO: 1945012 - RNA, 20 nt, Shigella flexneri 2a str. 2457T
gagccagucguuacaacgcu

SEQ ID NO: 1945013 - RNA, 22 nt, Shigella flexneri 2a str. 2457T
gagccaguuggcguaccauuaa

SEQ ID NO: 1945014 - RNA, 16 nt, Shigella flexneri 2a str. 2457T
gagccagccccacagc

SEQ ID NO: 1945015 - RNA, 17 nt, Shigella flexneri 2a str. 2457T
gagcaugcuccggccuu

SEQ ID NO: 1945016 - RNA, 22 nt, Shigella flexneri 2a str. 2457T
gagcaugguaacgccccacaaa

SEQ ID NO: 1945017 - RNA, 18 nt, Shigella flexneri 2a str. 2457T
gagccggauggcauacca

SEQ ID NO: 1945018 - RNA, 23 nt, Shigella flexneri 2a str. 2457T
gagccuguuacauaugcgcuggc

SEQ ID NO: 1945019 - RNA, 18 nt, Shigella flexneri 2a str. 2457T
gagcaggcguuaaaacag

SEQ ID NO: 1945020 - RNA, 12 nt, Shigella flexneri 2a str. 2457T
aaagcagcgaag

SEQ ID NO: 1945021 - RNA, 16 nt, Shigella flexneri 2a str. 2457T
aaagcagcauguagau

SEQ ID NO: 1945022 - RNA, 21 nt, Shigella flexneri 2a str. 2457T
gagcaguagcgucgccagcag

SEQ ID NO: 1945023 - RNA, 21 nt, Shigella flexneri 2a str. 2457T
gagcacugcgcccgccagcau

SEQ ID NO: 1945024 - RNA, 19 nt, Shigella flexneri 2a str. 2457T
gagcacugcgcccgccagc

SEQ ID NO: 1945025 - RNA, 20 nt, Shigella flexneri 2a str. 2457T
gagcacugcgcccgccagca

SEQ ID NO: 1945026 - RNA, 21 nt, Shigella flexneri 2a str. 2457T
gagcagacuguaaaucugccg

SEQ ID NO: 1945027 - RNA, 15 nt, Shigella flexneri 2a str. 2457T
gagcacuauccgaca

SEQ ID NO: 1945028 - RNA, 17 nt, Shigella flexneri 2a str. 2457T
gagcacggcaucccaac

SEQ ID NO: 1945029 - RNA, 18 nt, Shigella flexneri 2a str. 2457T
gagaugcggaaauaucgg

SEQ ID NO: 1945030 - RNA, 13 nt, Shigella flexneri 2a str. 2457T
gagaugcuggaga

SEQ ID NO: 1945031 - RNA, 23 nt, Shigella flexneri 2a str. 2457T
gagaugucgccucucgccgccgg

SEQ ID NO: 1945032 - RNA, 20 nt, Shigella flexneri 2a str. 2457T
gagcacacauuacgccagua

SEQ ID NO: 1945033 - RNA, 14 nt, Shigella flexneri 2a str. 2457T
gagcacaugcagug

SEQ ID NO: 1945034 - RNA, 22 nt, Shigella flexneri 2a str. 2457T
gagcacgacuuucucuucaucu

SEQ ID NO: 1945035 - RNA, 21 nt, Shigella flexneri 2a str. 2457T
gagagugauuaacuguucuga

SEQ ID NO: 1945036 - RNA, 22 nt, Shigella flexneri 2a str. 2457T
gagauaccaguugaucaaauaa

SEQ ID NO: 1945037 - RNA, 21 nt, Shigella flexneri 2a str. 2457T
gagauagauuaguuguacauu

SEQ ID NO: 1945038 - RNA, 20 nt, Shigella flexneri 2a str. 2457T
gagauagaaugccaaguaau

SEQ ID NO: 1945039 - RNA, 14 nt, Shigella flexneri 2a str. 2457T
gagauacucaagca

SEQ ID NO: 1945040 - RNA, 14 nt, Shigella flexneri 2a str. 2457T
gagauaucgccagg

SEQ ID NO: 1945041 - RNA, 12 nt, Shigella flexneri 2a str. 2457T
gagauauucccc

SEQ ID NO: 1945042 - RNA, 21 nt, Shigella flexneri 2a str. 2457T
gagacgguuaaaaacagccag

SEQ ID NO: 1945043 - RNA, 19 nt, Shigella flexneri 2a str. 2457T
gagagccggacugacauua

SEQ ID NO: 1945044 - RNA, 15 nt, Shigella flexneri 2a str. 2457T
gagagcgccagaagu

SEQ ID NO: 1945045 - RNA, 14 nt, Shigella flexneri 2a str. 2457T
gagaaucagcgaga

SEQ ID NO: 1945046 - RNA, 19 nt, Shigella flexneri 2a str. 2457T
gagaauggggucagcaggu

SEQ ID NO: 1945047 - RNA, 14 nt, Shigella flexneri 2a str. 2457T
gagaacugaaccaa

SEQ ID NO: 1945048 - RNA, 15 nt, Shigella flexneri 2a str. 2457T
gagaagaccgccgcu

SEQ ID NO: 1945049 - RNA, 14 nt, Shigella flexneri 2a str. 2457T
gagaagcgguuaaa

SEQ ID NO: 1945050 - RNA, 17 nt, Shigella flexneri 2a str. 2457T
gagaagcugcugccgcu

SEQ ID NO: 1945051 - RNA, 18 nt, Shigella flexneri 2a str. 2457T
gagacaacaacaucagcg

SEQ ID NO: 1945052 - RNA, 19 nt, Shigella flexneri 2a str. 2457T
gagacauuacguccaucac

SEQ ID NO: 1945053 - RNA, 20 nt, Shigella flexneri 2a str. 2457T
gagacagcuuagacagcgcc

SEQ ID NO: 1945054 - RNA, 14 nt, Shigella flexneri 2a str. 2457T
gagacgcuggaagc

SEQ ID NO: 1945055 - RNA, 12 nt, Shigella flexneri 2a str. 2457T
gagacgcgcuug

SEQ ID NO: 1945056 - RNA, 16 nt, Shigella flexneri 2a str. 2457T
aaagcaauuccagcgc

SEQ ID NO: 1945057 - RNA, 11 nt, Shigella flexneri 2a str. 2457T
aaagcaacucc

SEQ ID NO: 1945058 - RNA, 14 nt, Shigella flexneri 2a str. 2457T
aaagcaagccaggu

SEQ ID NO: 1945059 - RNA, 14 nt, Shigella flexneri 2a str. 2457T
aaagcaacguuaaa

SEQ ID NO: 1945060 - RNA, 13 nt, Shigella flexneri 2a str. 2457T
aaagcaaaaauaa

SEQ ID NO: 1945061 - RNA, 14 nt, Shigella flexneri 2a str. 2457T
aaagcaaaaaaaga

SEQ ID NO: 1945062 - RNA, 14 nt, Shigella flexneri 2a str. 2457T
gagaacggaguuga

SEQ ID NO: 1945063 - RNA, 11 nt, Shigella flexneri 2a str. 2457T
gagaacagaua

SEQ ID NO: 1945064 - RNA, 16 nt, Shigella flexneri 2a str. 2457T
gagaacaccaccugcc

SEQ ID NO: 1945065 - RNA, 13 nt, Shigella flexneri 2a str. 2457T
aaagauuuuacca

SEQ ID NO: 1945066 - RNA, 11 nt, Shigella flexneri 2a str. 2457T
gagaaaaaccu

SEQ ID NO: 1945067 - RNA, 15 nt, Shigella flexneri 2a str. 2457T
gacuuuuuccugcuc

SEQ ID NO: 1945068 - RNA, 22 nt, Shigella flexneri 2a str. 2457T
gacuuuucauaagcgucagaaa

SEQ ID NO: 1945069 - RNA, 17 nt, Shigella flexneri 2a str. 2457T
gacuuuugcccggcaug

SEQ ID NO: 1945070 - RNA, 23 nt, Shigella flexneri 2a str. 2457T
gagaaaauuucauuaauaucagg

SEQ ID NO: 1945071 - RNA, 16 nt, Shigella flexneri 2a str. 2457T
gacuuccacuuccugc

SEQ ID NO: 1945072 - RNA, 13 nt, Shigella flexneri 2a str. 2457T
gacuuccacuucc

SEQ ID NO: 1945073 - RNA, 12 nt, Shigella flexneri 2a str. 2457T
gacuuccgggau

SEQ ID NO: 1945074 - RNA, 14 nt, Shigella flexneri 2a str. 2457T
gacuucccucccgu

SEQ ID NO: 1945075 - RNA, 19 nt, Shigella flexneri 2a str. 2457T
gacuuauaagucucagaaa

SEQ ID NO: 1945076 - RNA, 13 nt, Shigella flexneri 2a str. 2457T
gacuuauucuuca

SEQ ID NO: 1945077 - RNA, 20 nt, Shigella flexneri 2a str. 2457T
gacuuaaaaggaaaaucaca

SEQ ID NO: 1945078 - RNA, 19 nt, Shigella flexneri 2a str. 2457T
gacuuuaucgcgcaaaaaa

SEQ ID NO: 1945079 - RNA, 20 nt, Shigella flexneri 2a str. 2457T
gacuuuguuuuuaguuaaau

SEQ ID NO: 1945080 - RNA, 22 nt, Shigella flexneri 2a str. 2457T
gacuuugauccagccauugcca

SEQ ID NO: 1945081 - RNA, 20 nt, Shigella flexneri 2a str. 2457T
gacuuucuccgcauccggca

SEQ ID NO: 1945082 - RNA, 20 nt, Shigella flexneri 2a str. 2457T
gacuuucguuugaaaacugg

SEQ ID NO: 1945083 - RNA, 24 nt, Shigella flexneri 2a str. 2457T
gacuuucuggcacgaccuggcagc

SEQ ID NO: 1945084 - RNA, 15 nt, Shigella flexneri 2a str. 2457T
gacuucugcuuucau

SEQ ID NO: 1945085 - RNA, 21 nt, Shigella flexneri 2a str. 2457T
gacuucuucauucauccgccg

SEQ ID NO: 1945086 - RNA, 21 nt, Shigella flexneri 2a str. 2457T
gacucggagucgacuucagau

SEQ ID NO: 1945087 - RNA, 20 nt, Shigella flexneri 2a str. 2457T
gacuccugacuugccagaua

SEQ ID NO: 1945088 - RNA, 21 nt, Shigella flexneri 2a str. 2457T
gacuccuguaucgucacuggu

SEQ ID NO: 1945089 - RNA, 16 nt, Shigella flexneri 2a str. 2457T
gacucgccgcugugga

SEQ ID NO: 1945090 - RNA, 16 nt, Shigella flexneri 2a str. 2457T
gacucgguugcacaga

SEQ ID NO: 1945091 - RNA, 17 nt, Shigella flexneri 2a str. 2457T
gacucucagccgcacac

SEQ ID NO: 1945092 - RNA, 18 nt, Shigella flexneri 2a str. 2457T
gacucuguagcgggaaag

SEQ ID NO: 1945093 - RNA, 20 nt, Shigella flexneri 2a str. 2457T
gacucuuacucuuucaauuu

SEQ ID NO: 1945094 - RNA, 20 nt, Shigella flexneri 2a str. 2457T
gacugaaaguacuucacaau

SEQ ID NO: 1945095 - RNA, 21 nt, Shigella flexneri 2a str. 2457T
gacgugcgcaaacuucuucag

SEQ ID NO: 1945096 - RNA, 23 nt, Shigella flexneri 2a str. 2457T
gacgugcguaccauuaucaccaa

SEQ ID NO: 1945097 - RNA, 22 nt, Shigella flexneri 2a str. 2457T
gacguugauucacuuucugaag

SEQ ID NO: 1945098 - RNA, 14 nt, Shigella flexneri 2a str. 2457T
gacguuguucaggu

SEQ ID NO: 1945099 - RNA, 17 nt, Shigella flexneri 2a str. 2457T
gacguucuuccugugga

SEQ ID NO: 1945100 - RNA, 23 nt, Shigella flexneri 2a str. 2457T
gacuccggaaaaacagaggcccg

SEQ ID NO: 1945101 - RNA, 21 nt, Shigella flexneri 2a str. 2457T
gacuccggaaaaacggaggcc

SEQ ID NO: 1945102 - RNA, 15 nt, Shigella flexneri 2a str. 2457T
gacuccaguuuguuc

SEQ ID NO: 1945103 - RNA, 19 nt, Shigella flexneri 2a str. 2457T
gacuccaggcguuuugcag

SEQ ID NO: 1945104 - RNA, 12 nt, Shigella flexneri 2a str. 2457T
gacugcgcccug

SEQ ID NO: 1945105 - RNA, 15 nt, Shigella flexneri 2a str. 2457T
gacugcgccugcagg

SEQ ID NO: 1945106 - RNA, 15 nt, Shigella flexneri 2a str. 2457T
gacugccccaguucc

SEQ ID NO: 1945107 - RNA, 14 nt, Shigella flexneri 2a str. 2457T
gacugccgcucacc

SEQ ID NO: 1945108 - RNA, 18 nt, Shigella flexneri 2a str. 2457T
gacugccgcucaccugac

SEQ ID NO: 1945109 - RNA, 14 nt, Shigella flexneri 2a str. 2457T
gacugauaucccgc

SEQ ID NO: 1945110 - RNA, 20 nt, Shigella flexneri 2a str. 2457T
gacugaugugauccaucagg

SEQ ID NO: 1945111 - RNA, 17 nt, Shigella flexneri 2a str. 2457T
gacugaugacaaacgca

SEQ ID NO: 1945112 - RNA, 17 nt, Shigella flexneri 2a str. 2457T
gacugaauacgcuggcg

SEQ ID NO: 1945113 - RNA, 20 nt, Shigella flexneri 2a str. 2457T
gacuguacagauccgccauu

SEQ ID NO: 1945114 - RNA, 16 nt, Shigella flexneri 2a str. 2457T
gacugucgcagccagc

SEQ ID NO: 1945115 - RNA, 16 nt, Shigella flexneri 2a str. 2457T
gacuguacagauccgc

SEQ ID NO: 1945116 - RNA, 21 nt, Shigella flexneri 2a str. 2457T
gacugggucaguauggaucaa

SEQ ID NO: 1945117 - RNA, 21 nt, Shigella flexneri 2a str. 2457T
gacuggaaacucacgccagca

SEQ ID NO: 1945118 - RNA, 21 nt, Shigella flexneri 2a str. 2457T
gacugcuuuuacaaaaucuuc

SEQ ID NO: 1945119 - RNA, 19 nt, Shigella flexneri 2a str. 2457T
gacuggcaugcuguccagc

SEQ ID NO: 1945120 - RNA, 15 nt, Shigella flexneri 2a str. 2457T
gacuggcggugauug

SEQ ID NO: 1945121 - RNA, 14 nt, Shigella flexneri 2a str. 2457T
gacuggaaaucaaa

SEQ ID NO: 1945122 - RNA, 18 nt, Shigella flexneri 2a str. 2457T
gacuggaaaucaaaaaca

SEQ ID NO: 1945123 - RNA, 17 nt, Shigella flexneri 2a str. 2457T
gacuggaauaagccaaa

SEQ ID NO: 1945124 - RNA, 18 nt, Shigella flexneri 2a str. 2457T
gacuggaauaagccaaau

SEQ ID NO: 1945125 - RNA, 22 nt, Shigella flexneri 2a str. 2457T
gacuggaauaagccaaauccag

SEQ ID NO: 1945126 - RNA, 15 nt, Shigella flexneri 2a str. 2457T
gaccgcaaccggccg

SEQ ID NO: 1945127 - RNA, 19 nt, Shigella flexneri 2a str. 2457T
gaccgcacaccccggcggc

SEQ ID NO: 1945128 - RNA, 15 nt, Shigella flexneri 2a str. 2457T
gaccucaaaggccga

SEQ ID NO: 1945129 - RNA, 17 nt, Shigella flexneri 2a str. 2457T
gaccgucgccuucaacg

SEQ ID NO: 1945130 - RNA, 13 nt, Shigella flexneri 2a str. 2457T
gaccgucuuucau

SEQ ID NO: 1945131 - RNA, 12 nt, Shigella flexneri 2a str. 2457T
gacgaauaaucc

SEQ ID NO: 1945132 - RNA, 18 nt, Shigella flexneri 2a str. 2457T
gacgaauaccuucuuccu

SEQ ID NO: 1945133 - RNA, 18 nt, Shigella flexneri 2a str. 2457T
gaccuguugcccaugcuu

SEQ ID NO: 1945134 - RNA, 15 nt, Shigella flexneri 2a str. 2457T
gaccuguucuccugg

SEQ ID NO: 1945135 - RNA, 22 nt, Shigella flexneri 2a str. 2457T
gaccucuucugccuguccacca

SEQ ID NO: 1945136 - RNA, 22 nt, Shigella flexneri 2a str. 2457T
gaccuuacgacugcgccugcag

SEQ ID NO: 1945137 - RNA, 13 nt, Shigella flexneri 2a str. 2457T
gacgagcgcuggu

SEQ ID NO: 1945138 - RNA, 14 nt, Shigella flexneri 2a str. 2457T
gacgaggcgcuggc

SEQ ID NO: 1945139 - RNA, 16 nt, Shigella flexneri 2a str. 2457T
gacgauuacucgccuu

SEQ ID NO: 1945140 - RNA, 23 nt, Shigella flexneri 2a str. 2457T
gacgcugaugucagcacuuccag

SEQ ID NO: 1945141 - RNA, 15 nt, Shigella flexneri 2a str. 2457T
gacgcugcucaaagc

SEQ ID NO: 1945142 - RNA, 23 nt, Shigella flexneri 2a str. 2457T
gacggauaaggcguuuacgccgc

SEQ ID NO: 1945143 - RNA, 19 nt, Shigella flexneri 2a str. 2457T
gacgcucgccauuuuucag

SEQ ID NO: 1945144 - RNA, 23 nt, Shigella flexneri 2a str. 2457T
gacgcgugccuaacaauucgcca

SEQ ID NO: 1945145 - RNA, 19 nt, Shigella flexneri 2a str. 2457T
gacgcgucuuaucuggccu

SEQ ID NO: 1945146 - RNA, 12 nt, Shigella flexneri 2a str. 2457T
gacgcgucagug

SEQ ID NO: 1945147 - RNA, 17 nt, Shigella flexneri 2a str. 2457T
gacgcgguauuggugaa

SEQ ID NO: 1945148 - RNA, 17 nt, Shigella flexneri 2a str. 2457T
gacgcgguaaaagccca

SEQ ID NO: 1945149 - RNA, 16 nt, Shigella flexneri 2a str. 2457T
gacgcgguaaaagccc

SEQ ID NO: 1945150 - RNA, 17 nt, Shigella flexneri 2a str. 2457T
gacgcgcaucacgacaa

SEQ ID NO: 1945151 - RNA, 18 nt, Shigella flexneri 2a str. 2457T
gacgcgcagcuucacuuc

SEQ ID NO: 1945152 - RNA, 16 nt, Shigella flexneri 2a str. 2457T
gacgcgccaacaaaug

SEQ ID NO: 1945153 - RNA, 13 nt, Shigella flexneri 2a str. 2457T
gacgcgacucagc

SEQ ID NO: 1945154 - RNA, 17 nt, Shigella flexneri 2a str. 2457T
gacgcaacuuccccucu

SEQ ID NO: 1945155 - RNA, 18 nt, Shigella flexneri 2a str. 2457T
gacgcaaccgcaaaugau

SEQ ID NO: 1945156 - RNA, 17 nt, Shigella flexneri 2a str. 2457T
gacgggauagcucaaug

SEQ ID NO: 1945157 - RNA, 12 nt, Shigella flexneri 2a str. 2457T
gacgggcggcuu

SEQ ID NO: 1945158 - RNA, 21 nt, Shigella flexneri 2a str. 2457T
gacgggcuaaucgucaucagc

SEQ ID NO: 1945159 - RNA, 20 nt, Shigella flexneri 2a str. 2457T
gacgguaaaaagaaaguuug

SEQ ID NO: 1945160 - RNA, 15 nt, Shigella flexneri 2a str. 2457T
gacgguaaccccucu

SEQ ID NO: 1945161 - RNA, 21 nt, Shigella flexneri 2a str. 2457T
gacgguuuaucucaucuucca

SEQ ID NO: 1945162 - RNA, 16 nt, Shigella flexneri 2a str. 2457T
gacguaaagaagaugu

SEQ ID NO: 1945163 - RNA, 20 nt, Shigella flexneri 2a str. 2457T
gacguaaugauguaaaaaua

SEQ ID NO: 1945164 - RNA, 15 nt, Shigella flexneri 2a str. 2457T
gacauaguagccagc

SEQ ID NO: 1945165 - RNA, 14 nt, Shigella flexneri 2a str. 2457T
gacauauaaccggc

SEQ ID NO: 1945166 - RNA, 22 nt, Shigella flexneri 2a str. 2457T
gacaucaauaaacaaugagaua

SEQ ID NO: 1945167 - RNA, 18 nt, Shigella flexneri 2a str. 2457T
gacaucagcauccgcacg

SEQ ID NO: 1945168 - RNA, 13 nt, Shigella flexneri 2a str. 2457T
gacauaugcuuaa

SEQ ID NO: 1945169 - RNA, 12 nt, Shigella flexneri 2a str. 2457T
gacauauuuuug

SEQ ID NO: 1945170 - RNA, 16 nt, Shigella flexneri 2a str. 2457T
gacaucaagaaaugca

SEQ ID NO: 1945171 - RNA, 17 nt, Shigella flexneri 2a str. 2457T
gacaucugcaauuugug

SEQ ID NO: 1945172 - RNA, 14 nt, Shigella flexneri 2a str. 2457T
gacaucgugcuggu

SEQ ID NO: 1945173 - RNA, 17 nt, Shigella flexneri 2a str. 2457T
gacauuacggauuaaau

SEQ ID NO: 1945174 - RNA, 18 nt, Shigella flexneri 2a str. 2457T
gacauuacggauuaaaua

SEQ ID NO: 1945175 - RNA, 16 nt, Shigella flexneri 2a str. 2457T
gacauucaccucacga

SEQ ID NO: 1945176 - RNA, 21 nt, Shigella flexneri 2a str. 2457T
gacauuauaaauucuggccac

SEQ ID NO: 1945177 - RNA, 15 nt, Shigella flexneri 2a str. 2457T
gacauuaucuggauc

SEQ ID NO: 1945178 - RNA, 20 nt, Shigella flexneri 2a str. 2457T
gacagcucguuaaucagaau

SEQ ID NO: 1945179 - RNA, 22 nt, Shigella flexneri 2a str. 2457T
gacaguuucaccugcugauuau

SEQ ID NO: 1945180 - RNA, 22 nt, Shigella flexneri 2a str. 2457T
gacaguugcugcgugaccgcca

SEQ ID NO: 1945181 - RNA, 21 nt, Shigella flexneri 2a str. 2457T
gacauaagcgcaugaucguuc

SEQ ID NO: 1945182 - RNA, 17 nt, Shigella flexneri 2a str. 2457T
gacauaaacaccagcaa

SEQ ID NO: 1945183 - RNA, 21 nt, Shigella flexneri 2a str. 2457T
gacauaaaauaaccaaauaaa

SEQ ID NO: 1945184 - RNA, 13 nt, Shigella flexneri 2a str. 2457T
gacacuauuuccc

SEQ ID NO: 1945185 - RNA, 21 nt, Shigella flexneri 2a str. 2457T
gacacgcuaccuugagguggu

SEQ ID NO: 1945186 - RNA, 18 nt, Shigella flexneri 2a str. 2457T
gacacgccuccuggcuca

SEQ ID NO: 1945187 - RNA, 15 nt, Shigella flexneri 2a str. 2457T
gacacaucuaaugcu

SEQ ID NO: 1945188 - RNA, 16 nt, Shigella flexneri 2a str. 2457T
gacacaggcagcaauc

SEQ ID NO: 1945189 - RNA, 19 nt, Shigella flexneri 2a str. 2457T
gacacaguucuucaaaaau

SEQ ID NO: 1945190 - RNA, 18 nt, Shigella flexneri 2a str. 2457T
gacagcaaagugccccca

SEQ ID NO: 1945191 - RNA, 15 nt, Shigella flexneri 2a str. 2457T
gacagccucaagcac

SEQ ID NO: 1945192 - RNA, 15 nt, Shigella flexneri 2a str. 2457T
gacagcaggcucaga

SEQ ID NO: 1945193 - RNA, 19 nt, Shigella flexneri 2a str. 2457T
gacagcgauuaccauuuca

SEQ ID NO: 1945194 - RNA, 15 nt, Shigella flexneri 2a str. 2457T
gacagcgauuccagu

SEQ ID NO: 1945195 - RNA, 12 nt, Shigella flexneri 2a str. 2457T
gacagaauauaa

SEQ ID NO: 1945196 - RNA, 19 nt, Shigella flexneri 2a str. 2457T
gacagauuuugccagcaug

SEQ ID NO: 1945197 - RNA, 16 nt, Shigella flexneri 2a str. 2457T
gacagaaucaggccau

SEQ ID NO: 1945198 - RNA, 13 nt, Shigella flexneri 2a str. 2457T
gacacuuuaucua

SEQ ID NO: 1945199 - RNA, 14 nt, Shigella flexneri 2a str. 2457T
gacacuucaagaau

SEQ ID NO: 1945200 - RNA, 22 nt, Shigella flexneri 2a str. 2457T
gaccagaccggcaaucgcgcca

SEQ ID NO: 1945201 - RNA, 17 nt, Shigella flexneri 2a str. 2457T
gaccagaaacgccacca

SEQ ID NO: 1945202 - RNA, 19 nt, Shigella flexneri 2a str. 2457T
gaccagaauaagucuggca

SEQ ID NO: 1945203 - RNA, 16 nt, Shigella flexneri 2a str. 2457T
gaccagaaacgccacc

SEQ ID NO: 1945204 - RNA, 20 nt, Shigella flexneri 2a str. 2457T
gaccacggccacagccagcc

SEQ ID NO: 1945205 - RNA, 16 nt, Shigella flexneri 2a str. 2457T
gaccacggccacagcc

SEQ ID NO: 1945206 - RNA, 18 nt, Shigella flexneri 2a str. 2457T
gaccagcaucccggcagc

SEQ ID NO: 1945207 - RNA, 16 nt, Shigella flexneri 2a str. 2457T
gaccagcaucccggca

SEQ ID NO: 1945208 - RNA, 16 nt, Shigella flexneri 2a str. 2457T
gaccagccaggccgcc

SEQ ID NO: 1945209 - RNA, 17 nt, Shigella flexneri 2a str. 2457T
gaccagcaacaaauaac

SEQ ID NO: 1945210 - RNA, 22 nt, Shigella flexneri 2a str. 2457T
gaccagaugcgacguaaaaacu

SEQ ID NO: 1945211 - RNA, 16 nt, Shigella flexneri 2a str. 2457T
gaccagcagcauuuca

SEQ ID NO: 1945212 - RNA, 20 nt, Shigella flexneri 2a str. 2457T
gaccaggauuugauggucuc

SEQ ID NO: 1945213 - RNA, 15 nt, Shigella flexneri 2a str. 2457T
gaccaggccaucagc

SEQ ID NO: 1945214 - RNA, 19 nt, Shigella flexneri 2a str. 2457T
gaccaggccaucagcagcg

SEQ ID NO: 1945215 - RNA, 20 nt, Shigella flexneri 2a str. 2457T
gaccaggccaucagcagcgg

SEQ ID NO: 1945216 - RNA, 15 nt, Shigella flexneri 2a str. 2457T
gacccggaauaaaug

SEQ ID NO: 1945217 - RNA, 16 nt, Shigella flexneri 2a str. 2457T
gacccugcucuuucag

SEQ ID NO: 1945218 - RNA, 19 nt, Shigella flexneri 2a str. 2457T
gacccugcucuuucagcac

SEQ ID NO: 1945219 - RNA, 23 nt, Shigella flexneri 2a str. 2457T
gacccugcucuuucagcaccgcg

SEQ ID NO: 1945220 - RNA, 16 nt, Shigella flexneri 2a str. 2457T
gacccgcaccguccuc

SEQ ID NO: 1945221 - RNA, 16 nt, Shigella flexneri 2a str. 2457T
gacccagccagacgcc

SEQ ID NO: 1945222 - RNA, 16 nt, Shigella flexneri 2a str. 2457T
gacccaccccagcagc

SEQ ID NO: 1945223 - RNA, 13 nt, Shigella flexneri 2a str. 2457T
gaccaguaccacc

SEQ ID NO: 1945224 - RNA, 20 nt, Shigella flexneri 2a str. 2457T
gaccagggcgucaccuugcc

SEQ ID NO: 1945225 - RNA, 18 nt, Shigella flexneri 2a str. 2457T
gaccaguucacaccagcc

SEQ ID NO: 1945226 - RNA, 13 nt, Shigella flexneri 2a str. 2457T
gaauuugcaugac

SEQ ID NO: 1945227 - RNA, 18 nt, Shigella flexneri 2a str. 2457T
gaauuucucgugccacca

SEQ ID NO: 1945228 - RNA, 20 nt, Shigella flexneri 2a str. 2457T
gaauuucaucaucacgaaau

SEQ ID NO: 1945229 - RNA, 20 nt, Shigella flexneri 2a str. 2457T
gaauuuccuucgcuuccugu

SEQ ID NO: 1945230 - RNA, 21 nt, Shigella flexneri 2a str. 2457T
gaauucgcugaauaccgauuc

SEQ ID NO: 1945231 - RNA, 16 nt, Shigella flexneri 2a str. 2457T
gaauucuaucaugcaa

SEQ ID NO: 1945232 - RNA, 22 nt, Shigella flexneri 2a str. 2457T
gaauuccggcagagaaagcaaa

SEQ ID NO: 1945233 - RNA, 18 nt, Shigella flexneri 2a str. 2457T
gaauuccggcagagaaag

SEQ ID NO: 1945234 - RNA, 20 nt, Shigella flexneri 2a str. 2457T
gaauggaaacagcaccaucc

SEQ ID NO: 1945235 - RNA, 13 nt, Shigella flexneri 2a str. 2457T
gaauggcaucuga

SEQ ID NO: 1945236 - RNA, 18 nt, Shigella flexneri 2a str. 2457T
gaauggcaucuacgcucu

SEQ ID NO: 1945237 - RNA, 18 nt, Shigella flexneri 2a str. 2457T
gaauucaaauccuucaga

SEQ ID NO: 1945238 - RNA, 13 nt, Shigella flexneri 2a str. 2457T
gaauggucgggcu

SEQ ID NO: 1945239 - RNA, 18 nt, Shigella flexneri 2a str. 2457T
gaauucacucuauaccgc

SEQ ID NO: 1945240 - RNA, 12 nt, Shigella flexneri 2a str. 2457T
gacaacuucccu

SEQ ID NO: 1945241 - RNA, 18 nt, Shigella flexneri 2a str. 2457T
gacaacuucugauguugu

SEQ ID NO: 1945242 - RNA, 20 nt, Shigella flexneri 2a str. 2457T
gacaauagcuaacgaaaaug

SEQ ID NO: 1945243 - RNA, 20 nt, Shigella flexneri 2a str. 2457T
gacaaucgccagugauugcu

SEQ ID NO: 1945244 - RNA, 14 nt, Shigella flexneri 2a str. 2457T
gacaaucgccacuu

SEQ ID NO: 1945245 - RNA, 15 nt, Shigella flexneri 2a str. 2457T
gacaaucaaccagca

SEQ ID NO: 1945246 - RNA, 23 nt, Shigella flexneri 2a str. 2457T
gacaaucaccaggucaccagaca

SEQ ID NO: 1945247 - RNA, 15 nt, Shigella flexneri 2a str. 2457T
gacacaaucaaaucc

SEQ ID NO: 1945248 - RNA, 21 nt, Shigella flexneri 2a str. 2457T
gacacacgagaguuaguguua

SEQ ID NO: 1945249 - RNA, 23 nt, Shigella flexneri 2a str. 2457T
gacacagauaccaaaaucggcaa

SEQ ID NO: 1945250 - RNA, 18 nt, Shigella flexneri 2a str. 2457T
gacaacaaaacgggggcu

SEQ ID NO: 1945251 - RNA, 17 nt, Shigella flexneri 2a str. 2457T
gacaaauuccgaacaaa

SEQ ID NO: 1945252 - RNA, 23 nt, Shigella flexneri 2a str. 2457T
gacaaauccuucacuuuugccag

SEQ ID NO: 1945253 - RNA, 10 nt, Shigella flexneri 2a str. 2457T
gacaaaucau

SEQ ID NO: 1945254 - RNA, 19 nt, Shigella flexneri 2a str. 2457T
gacaacaaaacgggggcua

SEQ ID NO: 1945255 - RNA, 20 nt, Shigella flexneri 2a str. 2457T
gacaacaacaucacaccugc

SEQ ID NO: 1945256 - RNA, 13 nt, Shigella flexneri 2a str. 2457T
gacaacaacauca

SEQ ID NO: 1945257 - RNA, 21 nt, Shigella flexneri 2a str. 2457T
gaauuuuccuucggauuuccg

SEQ ID NO: 1945258 - RNA, 23 nt, Shigella flexneri 2a str. 2457T
gaauaguuucagccucugccgcg

SEQ ID NO: 1945259 - RNA, 21 nt, Shigella flexneri 2a str. 2457T
aaagauggcgcgcagaaagag

SEQ ID NO: 1945260 - RNA, 22 nt, Shigella flexneri 2a str. 2457T
aaagaugcgauggauuaucgac

SEQ ID NO: 1945261 - RNA, 18 nt, Shigella flexneri 2a str. 2457T
aaagauggauugcugaaa

SEQ ID NO: 1945262 - RNA, 14 nt, Shigella flexneri 2a str. 2457T
gaauauacgccaga

SEQ ID NO: 1945263 - RNA, 22 nt, Shigella flexneri 2a str. 2457T
gaauauaccauggaagaaaaau

SEQ ID NO: 1945264 - RNA, 19 nt, Shigella flexneri 2a str. 2457T
gaauauaacgcagcgucag

SEQ ID NO: 1945265 - RNA, 14 nt, Shigella flexneri 2a str. 2457T
gaauauaucagccu

SEQ ID NO: 1945266 - RNA, 22 nt, Shigella flexneri 2a str. 2457T
gaauauaucagccugaaugcuu

SEQ ID NO: 1945267 - RNA, 17 nt, Shigella flexneri 2a str. 2457T
gaauaugcgccacacca

SEQ ID NO: 1945268 - RNA, 18 nt, Shigella flexneri 2a str. 2457T
gaauaugucgcgccaggc

SEQ ID NO: 1945269 - RNA, 16 nt, Shigella flexneri 2a str. 2457T
gaauauguuuuugcag

SEQ ID NO: 1945270 - RNA, 16 nt, Shigella flexneri 2a str. 2457T
gaauauucaccgguuc

SEQ ID NO: 1945271 - RNA, 20 nt, Shigella flexneri 2a str. 2457T
gaaucaccgccacgcccucc

SEQ ID NO: 1945272 - RNA, 14 nt, Shigella flexneri 2a str. 2457T
gaaucaccucuuuu

SEQ ID NO: 1945273 - RNA, 20 nt, Shigella flexneri 2a str. 2457T
gaauauugccgaagaccaga

SEQ ID NO: 1945274 - RNA, 18 nt, Shigella flexneri 2a str. 2457T
gaaucacgccaacaaaca

SEQ ID NO: 1945275 - RNA, 17 nt, Shigella flexneri 2a str. 2457T
gaaucacucaucaugca

SEQ ID NO: 1945276 - RNA, 17 nt, Shigella flexneri 2a str. 2457T
gaauaugaacaugaaaa

SEQ ID NO: 1945277 - RNA, 20 nt, Shigella flexneri 2a str. 2457T
gaauaucaagaucaucaaac

SEQ ID NO: 1945278 - RNA, 16 nt, Shigella flexneri 2a str. 2457T
gaauaucaauacauca

SEQ ID NO: 1945279 - RNA, 21 nt, Shigella flexneri 2a str. 2457T
gaauaucauugccgguuggcg

SEQ ID NO: 1945280 - RNA, 15 nt, Shigella flexneri 2a str. 2457T
gaauccgcgacuggc

SEQ ID NO: 1945281 - RNA, 21 nt, Shigella flexneri 2a str. 2457T
gaauccgcaccaacuccacuu

SEQ ID NO: 1945282 - RNA, 14 nt, Shigella flexneri 2a str. 2457T
gaaucucuuuuguu

SEQ ID NO: 1945283 - RNA, 14 nt, Shigella flexneri 2a str. 2457T
gaaucuccagaucu

SEQ ID NO: 1945284 - RNA, 14 nt, Shigella flexneri 2a str. 2457T
gaaucuaagauccc

SEQ ID NO: 1945285 - RNA, 19 nt, Shigella flexneri 2a str. 2457T
gaaugcagucacgccagua

SEQ ID NO: 1945286 - RNA, 17 nt, Shigella flexneri 2a str. 2457T
aaagauaguaagauuau

SEQ ID NO: 1945287 - RNA, 23 nt, Shigella flexneri 2a str. 2457T
gaagugguucauguugcgguggu

SEQ ID NO: 1945288 - RNA, 13 nt, Shigella flexneri 2a str. 2457T
gaauaaccagcga

SEQ ID NO: 1945289 - RNA, 17 nt, Shigella flexneri 2a str. 2457T
gaauaaccaguucccug

SEQ ID NO: 1945290 - RNA, 17 nt, Shigella flexneri 2a str. 2457T
gaauaaugcaaaaaggc

SEQ ID NO: 1945291 - RNA, 17 nt, Shigella flexneri 2a str. 2457T
gaauaaucguaaucagc

SEQ ID NO: 1945292 - RNA, 15 nt, Shigella flexneri 2a str. 2457T
gaauaacaccagcca

SEQ ID NO: 1945293 - RNA, 17 nt, Shigella flexneri 2a str. 2457T
gaauaacaccagccaga

SEQ ID NO: 1945294 - RNA, 23 nt, Shigella flexneri 2a str. 2457T
gaauaacacccauaaaaaaaccc

SEQ ID NO: 1945295 - RNA, 23 nt, Shigella flexneri 2a str. 2457T
gaauacgcucacgcgcugccucu

SEQ ID NO: 1945296 - RNA, 18 nt, Shigella flexneri 2a str. 2457T
gaauacagaacagugcca

SEQ ID NO: 1945297 - RNA, 14 nt, Shigella flexneri 2a str. 2457T
gaaguauucuuuua

SEQ ID NO: 1945298 - RNA, 19 nt, Shigella flexneri 2a str. 2457T
gaagguugccauaucuucc

SEQ ID NO: 1945299 - RNA, 16 nt, Shigella flexneri 2a str. 2457T
gaaguggacgaacagu

SEQ ID NO: 1945300 - RNA, 16 nt, Shigella flexneri 2a str. 2457T
gaagcugaugauuggu

SEQ ID NO: 1945301 - RNA, 12 nt, Shigella flexneri 2a str. 2457T
gaagcugaaagu

SEQ ID NO: 1945302 - RNA, 12 nt, Shigella flexneri 2a str. 2457T
gaagcucuuucg

SEQ ID NO: 1945303 - RNA, 14 nt, Shigella flexneri 2a str. 2457T
gaagcuggcggcgg

SEQ ID NO: 1945304 - RNA, 17 nt, Shigella flexneri 2a str. 2457T
gaagcuggcagaaguug

SEQ ID NO: 1945305 - RNA, 16 nt, Shigella flexneri 2a str. 2457T
gaagcuggucagcauc

SEQ ID NO: 1945306 - RNA, 15 nt, Shigella flexneri 2a str. 2457T
gaagauuugcagauc

SEQ ID NO: 1945307 - RNA, 14 nt, Shigella flexneri 2a str. 2457T
gaagcagucaacac

SEQ ID NO: 1945308 - RNA, 15 nt, Shigella flexneri 2a str. 2457T
gaagcaaaccaggcc

SEQ ID NO: 1945309 - RNA, 19 nt, Shigella flexneri 2a str. 2457T
gaagcaguuucaccagcag

SEQ ID NO: 1945310 - RNA, 18 nt, Shigella flexneri 2a str. 2457T
gaagccaccacgccaaga

SEQ ID NO: 1945311 - RNA, 19 nt, Shigella flexneri 2a str. 2457T
gaagccaccgcgccacgac

SEQ ID NO: 1945312 - RNA, 15 nt, Shigella flexneri 2a str. 2457T
gaagcgaacaucgag

SEQ ID NO: 1945313 - RNA, 21 nt, Shigella flexneri 2a str. 2457T
gaagccuuccgcaaacaggcg

SEQ ID NO: 1945314 - RNA, 13 nt, Shigella flexneri 2a str. 2457T
gaagccugcgaug

SEQ ID NO: 1945315 - RNA, 21 nt, Shigella flexneri 2a str. 2457T
gaagccuaccgggaugcugau

SEQ ID NO: 1945316 - RNA, 16 nt, Shigella flexneri 2a str. 2457T
gaacaucucuucccau

SEQ ID NO: 1945317 - RNA, 18 nt, Shigella flexneri 2a str. 2457T
gaacaucgccugccgcag

SEQ ID NO: 1945318 - RNA, 14 nt, Shigella flexneri 2a str. 2457T
gaagaauuugcccu

SEQ ID NO: 1945319 - RNA, 21 nt, Shigella flexneri 2a str. 2457T
gaagacaucgcagggaucauc

SEQ ID NO: 1945320 - RNA, 24 nt, Shigella flexneri 2a str. 2457T
gaagaaggcuucguaaguggcguu

SEQ ID NO: 1945321 - RNA, 19 nt, Shigella flexneri 2a str. 2457T
gaagaggaacccagugaua

SEQ ID NO: 1945322 - RNA, 18 nt, Shigella flexneri 2a str. 2457T
gaagaucguggagaacaa

SEQ ID NO: 1945323 - RNA, 19 nt, Shigella flexneri 2a str. 2457T
gaagaucguggagaacaau

SEQ ID NO: 1945324 - RNA, 18 nt, Shigella flexneri 2a str. 2457T
gaagaugaauugagacgu

SEQ ID NO: 1945325 - RNA, 13 nt, Shigella flexneri 2a str. 2457T
gaagagauggauc

SEQ ID NO: 1945326 - RNA, 11 nt, Shigella flexneri 2a str. 2457T
gaagagcacac

SEQ ID NO: 1945327 - RNA, 16 nt, Shigella flexneri 2a str. 2457T
gaaagugacagcccgg

SEQ ID NO: 1945328 - RNA, 17 nt, Shigella flexneri 2a str. 2457T
gaaaguguaaagcaggu

SEQ ID NO: 1945329 - RNA, 20 nt, Shigella flexneri 2a str. 2457T
gaaaguggaaaaauaacaaa

SEQ ID NO: 1945330 - RNA, 15 nt, Shigella flexneri 2a str. 2457T
gaaagucauaucagc

SEQ ID NO: 1945331 - RNA, 17 nt, Shigella flexneri 2a str. 2457T
gaaaggaucacaauaau

SEQ ID NO: 1945332 - RNA, 12 nt, Shigella flexneri 2a str. 2457T
gaaagggaagaa

SEQ ID NO: 1945333 - RNA, 20 nt, Shigella flexneri 2a str. 2457T
gaaaggcguuguccuuacca

SEQ ID NO: 1945334 - RNA, 12 nt, Shigella flexneri 2a str. 2457T
gaaauauauccu

SEQ ID NO: 1945335 - RNA, 16 nt, Shigella flexneri 2a str. 2457T
gaaauccaggucagca

SEQ ID NO: 1945336 - RNA, 20 nt, Shigella flexneri 2a str. 2457T
gaaaucaucaauaccagccc

SEQ ID NO: 1945337 - RNA, 18 nt, Shigella flexneri 2a str. 2457T
gaaaucagcuuuggugaa

SEQ ID NO: 1945338 - RNA, 22 nt, Shigella flexneri 2a str. 2457T
gaaaucagagauuugcuccagc

SEQ ID NO: 1945339 - RNA, 19 nt, Shigella flexneri 2a str. 2457T
gaaacgccaucucuuuaug

SEQ ID NO: 1945340 - RNA, 15 nt, Shigella flexneri 2a str. 2457T
gaaacgccaucugaa

SEQ ID NO: 1945341 - RNA, 17 nt, Shigella flexneri 2a str. 2457T
gaaacggaaaucgccga

SEQ ID NO: 1945342 - RNA, 24 nt, Shigella flexneri 2a str. 2457T
gaaacgaaccauaaaaucacaggu

SEQ ID NO: 1945343 - RNA, 16 nt, Shigella flexneri 2a str. 2457T
gaaacgcaccucagca

SEQ ID NO: 1945344 - RNA, 19 nt, Shigella flexneri 2a str. 2457T
gaaacgcaccucagcaagu

SEQ ID NO: 1945345 - RNA, 15 nt, Shigella flexneri 2a str. 2457T
gaaacggcuuccauu

SEQ ID NO: 1945346 - RNA, 19 nt, Shigella flexneri 2a str. 2457T
gaaacgggcugauuucacc

SEQ ID NO: 1945347 - RNA, 14 nt, Shigella flexneri 2a str. 2457T
gaaagaggcggaua

SEQ ID NO: 1945348 - RNA, 16 nt, Shigella flexneri 2a str. 2457T
gaaagaggcgcagaug

SEQ ID NO: 1945349 - RNA, 15 nt, Shigella flexneri 2a str. 2457T
gaaagcccaucaucc

SEQ ID NO: 1945350 - RNA, 16 nt, Shigella flexneri 2a str. 2457T
gaaagccccaccagca

SEQ ID NO: 1945351 - RNA, 15 nt, Shigella flexneri 2a str. 2457T
gaaagccccaccagc

SEQ ID NO: 1945352 - RNA, 18 nt, Shigella flexneri 2a str. 2457T
gaaagcgagcaguacagc

SEQ ID NO: 1945353 - RNA, 15 nt, Shigella flexneri 2a str. 2457T
gaaagcgaugcugau

SEQ ID NO: 1945354 - RNA, 16 nt, Shigella flexneri 2a str. 2457T
gaaagcgaucuuucug

SEQ ID NO: 1945355 - RNA, 17 nt, Shigella flexneri 2a str. 2457T
gaacagcgccagacaaa

SEQ ID NO: 1945356 - RNA, 20 nt, Shigella flexneri 2a str. 2457T
gaacagccugugccugagcc

SEQ ID NO: 1945357 - RNA, 18 nt, Shigella flexneri 2a str. 2457T
gaacagcacaucagccag

SEQ ID NO: 1945358 - RNA, 16 nt, Shigella flexneri 2a str. 2457T
gaacauccuuuccuua

SEQ ID NO: 1945359 - RNA, 15 nt, Shigella flexneri 2a str. 2457T
gaacagaagaaagca

SEQ ID NO: 1945360 - RNA, 22 nt, Shigella flexneri 2a str. 2457T
gaacacuucuucugucgggcau

SEQ ID NO: 1945361 - RNA, 17 nt, Shigella flexneri 2a str. 2457T
gaacacuucuucugucg

SEQ ID NO: 1945362 - RNA, 19 nt, Shigella flexneri 2a str. 2457T
gaacagaggcagcuugauu

SEQ ID NO: 1945363 - RNA, 18 nt, Shigella flexneri 2a str. 2457T
gaacagaauguuugccau

SEQ ID NO: 1945364 - RNA, 14 nt, Shigella flexneri 2a str. 2457T
gaacagaccacauu

SEQ ID NO: 1945365 - RNA, 14 nt, Shigella flexneri 2a str. 2457T
gaacagaccaguaa

SEQ ID NO: 1945366 - RNA, 12 nt, Shigella flexneri 2a str. 2457T
gaacaccagcag

SEQ ID NO: 1945367 - RNA, 13 nt, Shigella flexneri 2a str. 2457T
gaacaccauaaug

SEQ ID NO: 1945368 - RNA, 22 nt, Shigella flexneri 2a str. 2457T
gaacacccgacgugcagcaucg

SEQ ID NO: 1945369 - RNA, 19 nt, Shigella flexneri 2a str. 2457T
gaacaccgacauugccagc

SEQ ID NO: 1945370 - RNA, 23 nt, Shigella flexneri 2a str. 2457T
gaacacccgacgugcagcaucga

SEQ ID NO: 1945371 - RNA, 23 nt, Shigella flexneri 2a str. 2457T
gaacaacccuaaagcacccagca

SEQ ID NO: 1945372 - RNA, 21 nt, Shigella flexneri 2a str. 2457T
gaacaacgcgcgucugauauu

SEQ ID NO: 1945373 - RNA, 17 nt, Shigella flexneri 2a str. 2457T
gaacaacagaucaacau

SEQ ID NO: 1945374 - RNA, 22 nt, Shigella flexneri 2a str. 2457T
gaacaccaccugccagagcuga

SEQ ID NO: 1945375 - RNA, 13 nt, Shigella flexneri 2a str. 2457T
gaacacagugguu

SEQ ID NO: 1945376 - RNA, 13 nt, Shigella flexneri 2a str. 2457T
gaacaagcaagag

SEQ ID NO: 1945377 - RNA, 14 nt, Shigella flexneri 2a str. 2457T
gaacaacugcauua

SEQ ID NO: 1945378 - RNA, 20 nt, Shigella flexneri 2a str. 2457T
gaaauuacgauguguggcau

SEQ ID NO: 1945379 - RNA, 22 nt, Shigella flexneri 2a str. 2457T
gaaauuaccgcaccaccagcag

SEQ ID NO: 1945380 - RNA, 22 nt, Shigella flexneri 2a str. 2457T
gaaauuaaacugucgucgcuuu

SEQ ID NO: 1945381 - RNA, 19 nt, Shigella flexneri 2a str. 2457T
gaaauguuugcaauaaaga

SEQ ID NO: 1945382 - RNA, 15 nt, Shigella flexneri 2a str. 2457T
gaaauuuccugagca

SEQ ID NO: 1945383 - RNA, 21 nt, Shigella flexneri 2a str. 2457T
gaaauuucucgccaacaagcc

SEQ ID NO: 1945384 - RNA, 14 nt, Shigella flexneri 2a str. 2457T
gaacaaagcugauu

SEQ ID NO: 1945385 - RNA, 19 nt, Shigella flexneri 2a str. 2457T
gaaauuguuuuugauuuug

SEQ ID NO: 1945386 - RNA, 15 nt, Shigella flexneri 2a str. 2457T
gaaaugguaaagaag

SEQ ID NO: 1945387 - RNA, 18 nt, Shigella flexneri 2a str. 2457T
gaaaugccaguaacucau

SEQ ID NO: 1945388 - RNA, 17 nt, Shigella flexneri 2a str. 2457T
gaaaucugaucguguaa

SEQ ID NO: 1945389 - RNA, 15 nt, Shigella flexneri 2a str. 2457T
cuuuuacaagcaacu

SEQ ID NO: 1945390 - RNA, 17 nt, Shigella flexneri 2a str. 2457T
cuuuugauacucugucu

SEQ ID NO: 1945391 - RNA, 20 nt, Shigella flexneri 2a str. 2457T
cuuuugauacucugucugau

SEQ ID NO: 1945392 - RNA, 22 nt, Shigella flexneri 2a str. 2457T
cuuuugaggauuaugcccgcag

SEQ ID NO: 1945393 - RNA, 16 nt, Shigella flexneri 2a str. 2457T
cuuuugacuuugccga

SEQ ID NO: 1945394 - RNA, 23 nt, Shigella flexneri 2a str. 2457T
cuuuuuauugaagauguugccac

SEQ ID NO: 1945395 - RNA, 18 nt, Shigella flexneri 2a str. 2457T
cuuuuuaugucauuaacc

SEQ ID NO: 1945396 - RNA, 18 nt, Shigella flexneri 2a str. 2457T
cuuuuuaccaacauacug

SEQ ID NO: 1945397 - RNA, 20 nt, Shigella flexneri 2a str. 2457T
cuuuugucacuuuuggugcu

SEQ ID NO: 1945398 - RNA, 18 nt, Shigella flexneri 2a str. 2457T
cuuuuggugcuuuugcug

SEQ ID NO: 1945399 - RNA, 22 nt, Shigella flexneri 2a str. 2457T
cuuuuggcgcguuccccuguug

SEQ ID NO: 1945400 - RNA, 12 nt, Shigella flexneri 2a str. 2457T
gaaaaacugccc

SEQ ID NO: 1945401 - RNA, 20 nt, Shigella flexneri 2a str. 2457T
gaaaaacuuaauccugaguu

SEQ ID NO: 1945402 - RNA, 19 nt, Shigella flexneri 2a str. 2457T
gaaaaaccguguuuaugaa

SEQ ID NO: 1945403 - RNA, 18 nt, Shigella flexneri 2a str. 2457T
gaaaaacacaaaguaaac

SEQ ID NO: 1945404 - RNA, 21 nt, Shigella flexneri 2a str. 2457T
cuuuuuugguuauccagcaac

SEQ ID NO: 1945405 - RNA, 14 nt, Shigella flexneri 2a str. 2457T
gaaaaaaugaugau

SEQ ID NO: 1945406 - RNA, 14 nt, Shigella flexneri 2a str. 2457T
gaaaaaaucccacu

SEQ ID NO: 1945407 - RNA, 16 nt, Shigella flexneri 2a str. 2457T
cuuuuuuccugccgcu

SEQ ID NO: 1945408 - RNA, 13 nt, Shigella flexneri 2a str. 2457T
cuuuuugcauaau

SEQ ID NO: 1945409 - RNA, 20 nt, Shigella flexneri 2a str. 2457T
cuuuuucccugguaaaaaau

SEQ ID NO: 1945410 - RNA, 20 nt, Shigella flexneri 2a str. 2457T
cuuuuuccacuuccaccagc

SEQ ID NO: 1945411 - RNA, 13 nt, Shigella flexneri 2a str. 2457T
cuuuuucaugcua

SEQ ID NO: 1945412 - RNA, 14 nt, Shigella flexneri 2a str. 2457T
gaaaccgugcccga

SEQ ID NO: 1945413 - RNA, 19 nt, Shigella flexneri 2a str. 2457T
gaaaccgugcccgauccuu

SEQ ID NO: 1945414 - RNA, 12 nt, Shigella flexneri 2a str. 2457T
gaaaccuccgca

SEQ ID NO: 1945415 - RNA, 16 nt, Shigella flexneri 2a str. 2457T
gaaaccuuuaugcagc

SEQ ID NO: 1945416 - RNA, 19 nt, Shigella flexneri 2a str. 2457T
gaaacccgcugccaucgca

SEQ ID NO: 1945417 - RNA, 19 nt, Shigella flexneri 2a str. 2457T
gaaacccggccacagcgcc

SEQ ID NO: 1945418 - RNA, 19 nt, Shigella flexneri 2a str. 2457T
gaaaccacggugauucccg

SEQ ID NO: 1945419 - RNA, 16 nt, Shigella flexneri 2a str. 2457T
gaaaccacugcaacag

SEQ ID NO: 1945420 - RNA, 20 nt, Shigella flexneri 2a str. 2457T
gaaaccaacuccagcggcgc

SEQ ID NO: 1945421 - RNA, 13 nt, Shigella flexneri 2a str. 2457T
gaaaauuauaucu

SEQ ID NO: 1945422 - RNA, 16 nt, Shigella flexneri 2a str. 2457T
gaaacaaauacaugau

SEQ ID NO: 1945423 - RNA, 16 nt, Shigella flexneri 2a str. 2457T
gaaacacacuuuccag

SEQ ID NO: 1945424 - RNA, 23 nt, Shigella flexneri 2a str. 2457T
gaaacagguggcguuugccaccu

SEQ ID NO: 1945425 - RNA, 19 nt, Shigella flexneri 2a str. 2457T
gaaacagugauuucuucau

SEQ ID NO: 1945426 - RNA, 14 nt, Shigella flexneri 2a str. 2457T
gaaacaguguauuu

SEQ ID NO: 1945427 - RNA, 16 nt, Shigella flexneri 2a str. 2457T
gaaacagaaaauuacg

SEQ ID NO: 1945428 - RNA, 19 nt, Shigella flexneri 2a str. 2457T
gaaacagcaccauccgccc

SEQ ID NO: 1945429 - RNA, 13 nt, Shigella flexneri 2a str. 2457T
gaaaaauagcauu

SEQ ID NO: 1945430 - RNA, 18 nt, Shigella flexneri 2a str. 2457T
gaaaaagagcagcugauu

SEQ ID NO: 1945431 - RNA, 18 nt, Shigella flexneri 2a str. 2457T
gaaaagccggaauguacu

SEQ ID NO: 1945432 - RNA, 22 nt, Shigella flexneri 2a str. 2457T
gaaaaauuuauugaaagcauag

SEQ ID NO: 1945433 - RNA, 22 nt, Shigella flexneri 2a str. 2457T
gaaaagcugcaaggugaaagca

SEQ ID NO: 1945434 - RNA, 21 nt, Shigella flexneri 2a str. 2457T
gaaaagguucgggagcaggcc

SEQ ID NO: 1945435 - RNA, 20 nt, Shigella flexneri 2a str. 2457T
gaaaaggugauuuuugagac

SEQ ID NO: 1945436 - RNA, 17 nt, Shigella flexneri 2a str. 2457T
gaaaagguacuccuccc

SEQ ID NO: 1945437 - RNA, 16 nt, Shigella flexneri 2a str. 2457T
gaaaagguagaauaag

SEQ ID NO: 1945438 - RNA, 17 nt, Shigella flexneri 2a str. 2457T
gaaaagguagaauaagg

SEQ ID NO: 1945439 - RNA, 12 nt, Shigella flexneri 2a str. 2457T
gaaaauaucggu

SEQ ID NO: 1945440 - RNA, 17 nt, Shigella flexneri 2a str. 2457T
gaaaauaugcccauguu

SEQ ID NO: 1945441 - RNA, 20 nt, Shigella flexneri 2a str. 2457T
gaaaauugguagaccagagc

SEQ ID NO: 1945442 - RNA, 16 nt, Shigella flexneri 2a str. 2457T
gaaaauuacgcaacca

SEQ ID NO: 1945443 - RNA, 23 nt, Shigella flexneri 2a str. 2457T
cuuucagaccgccaauagaagca

SEQ ID NO: 1945444 - RNA, 21 nt, Shigella flexneri 2a str. 2457T
cuuucacuucagcaacgugcu

SEQ ID NO: 1945445 - RNA, 18 nt, Shigella flexneri 2a str. 2457T
cuuucacgaacacagugg

SEQ ID NO: 1945446 - RNA, 17 nt, Shigella flexneri 2a str. 2457T
cuuucacgcccaguccg

SEQ ID NO: 1945447 - RNA, 20 nt, Shigella flexneri 2a str. 2457T
cuuucacgcccaguccgcuc

SEQ ID NO: 1945448 - RNA, 17 nt, Shigella flexneri 2a str. 2457T
cuuucacggucagcaua

SEQ ID NO: 1945449 - RNA, 15 nt, Shigella flexneri 2a str. 2457T
cuuucacuauuucuu

SEQ ID NO: 1945450 - RNA, 21 nt, Shigella flexneri 2a str. 2457T
cuuucacuauuucuuuguaga

SEQ ID NO: 1945451 - RNA, 17 nt, Shigella flexneri 2a str. 2457T
cuuucaccucuucauua

SEQ ID NO: 1945452 - RNA, 15 nt, Shigella flexneri 2a str. 2457T
cuuucacgccgccaa

SEQ ID NO: 1945453 - RNA, 20 nt, Shigella flexneri 2a str. 2457T
cuuucacgccgggaaauuuu

SEQ ID NO: 1945454 - RNA, 16 nt, Shigella flexneri 2a str. 2457T
cuuucacgcgcugacc

SEQ ID NO: 1945455 - RNA, 13 nt, Shigella flexneri 2a str. 2457T
cuuucaacaaccu

SEQ ID NO: 1945456 - RNA, 22 nt, Shigella flexneri 2a str. 2457T
cuuucaacagguuaacuccccc

SEQ ID NO: 1945457 - RNA, 16 nt, Shigella flexneri 2a str. 2457T
cuuucaacagucgcca

SEQ ID NO: 1945458 - RNA, 18 nt, Shigella flexneri 2a str. 2457T
cuuuauagguggcaaaga

SEQ ID NO: 1945459 - RNA, 16 nt, Shigella flexneri 2a str. 2457T
cuuuaugugcuucuac

SEQ ID NO: 1945460 - RNA, 17 nt, Shigella flexneri 2a str. 2457T
cuuuaugugcuucuacc

SEQ ID NO: 1945461 - RNA, 19 nt, Shigella flexneri 2a str. 2457T
cuuuaauuuugugcagcau

SEQ ID NO: 1945462 - RNA, 16 nt, Shigella flexneri 2a str. 2457T
cuuuaccaccgucaaa

SEQ ID NO: 1945463 - RNA, 14 nt, Shigella flexneri 2a str. 2457T
cuuuacucaacucc

SEQ ID NO: 1945464 - RNA, 21 nt, Shigella flexneri 2a str. 2457T
cuuuaacgaaagcgccucaag

SEQ ID NO: 1945465 - RNA, 22 nt, Shigella flexneri 2a str. 2457T
cuuuaacugccgcacauuuccc

SEQ ID NO: 1945466 - RNA, 22 nt, Shigella flexneri 2a str. 2457T
cuuuaauuggaauacauauauu

SEQ ID NO: 1945467 - RNA, 12 nt, Shigella flexneri 2a str. 2457T
aaagaauugcag

SEQ ID NO: 1945468 - RNA, 13 nt, Shigella flexneri 2a str. 2457T
aaagaaugacacu

SEQ ID NO: 1945469 - RNA, 16 nt, Shigella flexneri 2a str. 2457T
aaagaagucucugaaa

SEQ ID NO: 1945470 - RNA, 13 nt, Shigella flexneri 2a str. 2457T
aaagaagccuccg

SEQ ID NO: 1945471 - RNA, 18 nt, Shigella flexneri 2a str. 2457T
aaagaagcggugaaaaaa

SEQ ID NO: 1945472 - RNA, 18 nt, Shigella flexneri 2a str. 2457T
cuuucguacgagcucuuc

SEQ ID NO: 1945473 - RNA, 15 nt, Shigella flexneri 2a str. 2457T
cuuucugugcaucug

SEQ ID NO: 1945474 - RNA, 21 nt, Shigella flexneri 2a str. 2457T
cuuucuuaaacuucacuuccc

SEQ ID NO: 1945475 - RNA, 21 nt, Shigella flexneri 2a str. 2457T
cuuucuuaccccugauuuugu

SEQ ID NO: 1945476 - RNA, 21 nt, Shigella flexneri 2a str. 2457T
cuuugaauaucuccucugcuu

SEQ ID NO: 1945477 - RNA, 18 nt, Shigella flexneri 2a str. 2457T
cuuucgagcaauuuuccu

SEQ ID NO: 1945478 - RNA, 23 nt, Shigella flexneri 2a str. 2457T
cuuucgacggcaucagaaacaca

SEQ ID NO: 1945479 - RNA, 20 nt, Shigella flexneri 2a str. 2457T
cuuucgacagcgauuccagu

SEQ ID NO: 1945480 - RNA, 22 nt, Shigella flexneri 2a str. 2457T
cuuucgauuucggcgugcgcgc

SEQ ID NO: 1945481 - RNA, 21 nt, Shigella flexneri 2a str. 2457T
cuuucgagcaauuuuccuuga

SEQ ID NO: 1945482 - RNA, 13 nt, Shigella flexneri 2a str. 2457T
cuuucgcaaauau

SEQ ID NO: 1945483 - RNA, 16 nt, Shigella flexneri 2a str. 2457T
cuuucgcgucgggauc

SEQ ID NO: 1945484 - RNA, 14 nt, Shigella flexneri 2a str. 2457T
cuuucgcuucaagu

SEQ ID NO: 1945485 - RNA, 17 nt, Shigella flexneri 2a str. 2457T
cuuucgcuuaacgccca

SEQ ID NO: 1945486 - RNA, 15 nt, Shigella flexneri 2a str. 2457T
cuuucgcuucaagua

SEQ ID NO: 1945487 - RNA, 17 nt, Shigella flexneri 2a str. 2457T
cuuucgcuuuaucgccu

SEQ ID NO: 1945488 - RNA, 18 nt, Shigella flexneri 2a str. 2457T
cuuuccagucuucuugcu

SEQ ID NO: 1945489 - RNA, 18 nt, Shigella flexneri 2a str. 2457T
cuuuccagguggugcagg

SEQ ID NO: 1945490 - RNA, 20 nt, Shigella flexneri 2a str. 2457T
cuuuccagcaaccaaugcca

SEQ ID NO: 1945491 - RNA, 20 nt, Shigella flexneri 2a str. 2457T
cuuuccaggcgugcuccuuc

SEQ ID NO: 1945492 - RNA, 13 nt, Shigella flexneri 2a str. 2457T
cuuuccuccuguc

SEQ ID NO: 1945493 - RNA, 19 nt, Shigella flexneri 2a str. 2457T
cuuuccuccugucuucccu

SEQ ID NO: 1945494 - RNA, 15 nt, Shigella flexneri 2a str. 2457T
cuuuccucacuccuu

SEQ ID NO: 1945495 - RNA, 20 nt, Shigella flexneri 2a str. 2457T
cuuucgaaaucauucgcagu

SEQ ID NO: 1945496 - RNA, 22 nt, Shigella flexneri 2a str. 2457T
cuuuccuggucggcaaacugcu

SEQ ID NO: 1945497 - RNA, 20 nt, Shigella flexneri 2a str. 2457T
cuuuccuuaacuccucgccu

SEQ ID NO: 1945498 - RNA, 18 nt, Shigella flexneri 2a str. 2457T
cuuuccuuaacuccucgc

SEQ ID NO: 1945499 - RNA, 23 nt, Shigella flexneri 2a str. 2457T
cuuugcgaacgcguucacugccg

SEQ ID NO: 1945500 - RNA, 21 nt, Shigella flexneri 2a str. 2457T
cuuugccgugaacaauuucag

SEQ ID NO: 1945501 - RNA, 17 nt, Shigella flexneri 2a str. 2457T
cuuugccgucagccacu

SEQ ID NO: 1945502 - RNA, 20 nt, Shigella flexneri 2a str. 2457T
cuuugccgucagccacuucu

SEQ ID NO: 1945503 - RNA, 23 nt, Shigella flexneri 2a str. 2457T
cuuugagcaucaaacuuuuaaau

SEQ ID NO: 1945504 - RNA, 17 nt, Shigella flexneri 2a str. 2457T
cuuugccaaaaugcugg

SEQ ID NO: 1945505 - RNA, 21 nt, Shigella flexneri 2a str. 2457T
cuuugccacgguauuugccaa

SEQ ID NO: 1945506 - RNA, 14 nt, Shigella flexneri 2a str. 2457T
cuuuggcaaacuac

SEQ ID NO: 1945507 - RNA, 18 nt, Shigella flexneri 2a str. 2457T
cuuuggcaaacuacaaau

SEQ ID NO: 1945508 - RNA, 17 nt, Shigella flexneri 2a str. 2457T
cuuuggguugccgccaa

SEQ ID NO: 1945509 - RNA, 16 nt, Shigella flexneri 2a str. 2457T
cuuguaggccugauaa

SEQ ID NO: 1945510 - RNA, 13 nt, Shigella flexneri 2a str. 2457T
cuuguaggaauca

SEQ ID NO: 1945511 - RNA, 22 nt, Shigella flexneri 2a str. 2457T
cuugucaaacgggcuucuaauc

SEQ ID NO: 1945512 - RNA, 16 nt, Shigella flexneri 2a str. 2457T
cuugucaugcagcucc

SEQ ID NO: 1945513 - RNA, 17 nt, Shigella flexneri 2a str. 2457T
cuugucaugcagcucca

SEQ ID NO: 1945514 - RNA, 15 nt, Shigella flexneri 2a str. 2457T
cuuggcuauaaccug

SEQ ID NO: 1945515 - RNA, 13 nt, Shigella flexneri 2a str. 2457T
cuuggcugggaua

SEQ ID NO: 1945516 - RNA, 12 nt, Shigella flexneri 2a str. 2457T
cuuggcuuccau

SEQ ID NO: 1945517 - RNA, 18 nt, Shigella flexneri 2a str. 2457T
cuuggcagagcaacauac

SEQ ID NO: 1945518 - RNA, 12 nt, Shigella flexneri 2a str. 2457T
cuuguuaugaga

SEQ ID NO: 1945519 - RNA, 13 nt, Shigella flexneri 2a str. 2457T
cuuguuaugagau

SEQ ID NO: 1945520 - RNA, 16 nt, Shigella flexneri 2a str. 2457T
cuuguuccacuucauc

SEQ ID NO: 1945521 - RNA, 22 nt, Shigella flexneri 2a str. 2457T
cuugucugagccgaaaaagaga

SEQ ID NO: 1945522 - RNA, 15 nt, Shigella flexneri 2a str. 2457T
cuugucugagccgaa

SEQ ID NO: 1945523 - RNA, 15 nt, Shigella flexneri 2a str. 2457T
cuugucgucccaggc

SEQ ID NO: 1945524 - RNA, 19 nt, Shigella flexneri 2a str. 2457T
aaagaaaaucgucaaaauu

SEQ ID NO: 1945525 - RNA, 12 nt, Shigella flexneri 2a str. 2457T
aaagaaaauaag

SEQ ID NO: 1945526 - RNA, 15 nt, Shigella flexneri 2a str. 2457T
aaagaaaauaaggcc

SEQ ID NO: 1945527 - RNA, 13 nt, Shigella flexneri 2a str. 2457T
cuuguugaacagg

SEQ ID NO: 1945528 - RNA, 15 nt, Shigella flexneri 2a str. 2457T
cuuguugcaacaaaa

SEQ ID NO: 1945529 - RNA, 15 nt, Shigella flexneri 2a str. 2457T
aaagaacgaguaaaa

SEQ ID NO: 1945530 - RNA, 15 nt, Shigella flexneri 2a str. 2457T
cuuuaaaaaagaaua

SEQ ID NO: 1945531 - RNA, 21 nt, Shigella flexneri 2a str. 2457T
cuuuaaaaagaaaccuccgca

SEQ ID NO: 1945532 - RNA, 13 nt, Shigella flexneri 2a str. 2457T
cuuguuuuuuucg

SEQ ID NO: 1945533 - RNA, 16 nt, Shigella flexneri 2a str. 2457T
cuuuaaaaaaagcauu

SEQ ID NO: 1945534 - RNA, 20 nt, Shigella flexneri 2a str. 2457T
cuuuaaacacgcgaccaaag

SEQ ID NO: 1945535 - RNA, 13 nt, Shigella flexneri 2a str. 2457T
cuucaccagcagc

SEQ ID NO: 1945536 - RNA, 13 nt, Shigella flexneri 2a str. 2457T
cuucaccagccug

SEQ ID NO: 1945537 - RNA, 14 nt, Shigella flexneri 2a str. 2457T
cuucaccaaucaga

SEQ ID NO: 1945538 - RNA, 14 nt, Shigella flexneri 2a str. 2457T
cuucaauggucagc

SEQ ID NO: 1945539 - RNA, 18 nt, Shigella flexneri 2a str. 2457T
cuucaauggucagccaca

SEQ ID NO: 1945540 - RNA, 19 nt, Shigella flexneri 2a str. 2457T
cuucaauggucagccacag

SEQ ID NO: 1945541 - RNA, 17 nt, Shigella flexneri 2a str. 2457T
cuucaaucgccaccaca

SEQ ID NO: 1945542 - RNA, 12 nt, Shigella flexneri 2a str. 2457T
cuucaaugcugc

SEQ ID NO: 1945543 - RNA, 17 nt, Shigella flexneri 2a str. 2457T
cuucacucucaccacgc

SEQ ID NO: 1945544 - RNA, 20 nt, Shigella flexneri 2a str. 2457T
cuucacucuauagucuuuuc

SEQ ID NO: 1945545 - RNA, 13 nt, Shigella flexneri 2a str. 2457T
cuucacguuuuuc

SEQ ID NO: 1945546 - RNA, 20 nt, Shigella flexneri 2a str. 2457T
cuucacggcuuugucauuaa

SEQ ID NO: 1945547 - RNA, 16 nt, Shigella flexneri 2a str. 2457T
cuucacccgcagcacg

SEQ ID NO: 1945548 - RNA, 21 nt, Shigella flexneri 2a str. 2457T
cuucacgcuuugcaggcuggu

SEQ ID NO: 1945549 - RNA, 17 nt, Shigella flexneri 2a str. 2457T
cuucacgcuuugcaggc

SEQ ID NO: 1945550 - RNA, 13 nt, Shigella flexneri 2a str. 2457T
cuucaaucaauaa

SEQ ID NO: 1945551 - RNA, 12 nt, Shigella flexneri 2a str. 2457T
cuucaaucaaua

SEQ ID NO: 1945552 - RNA, 18 nt, Shigella flexneri 2a str. 2457T
cuucaagccaggcuuuaa

SEQ ID NO: 1945553 - RNA, 17 nt, Shigella flexneri 2a str. 2457T
cuucaagaauuaaaaua

SEQ ID NO: 1945554 - RNA, 18 nt, Shigella flexneri 2a str. 2457T
cuucaagaauuaaaauau

SEQ ID NO: 1945555 - RNA, 20 nt, Shigella flexneri 2a str. 2457T
cuucaaaaauaaguugccac

SEQ ID NO: 1945556 - RNA, 21 nt, Shigella flexneri 2a str. 2457T
cuucauugcucucuucuccuu

SEQ ID NO: 1945557 - RNA, 20 nt, Shigella flexneri 2a str. 2457T
cuucauugaacgggugauuu

SEQ ID NO: 1945558 - RNA, 15 nt, Shigella flexneri 2a str. 2457T
cuucauugacgccaa

SEQ ID NO: 1945559 - RNA, 20 nt, Shigella flexneri 2a str. 2457T
cuucauucgcgccagauggc

SEQ ID NO: 1945560 - RNA, 15 nt, Shigella flexneri 2a str. 2457T
cuucauccagcagug

SEQ ID NO: 1945561 - RNA, 16 nt, Shigella flexneri 2a str. 2457T
cuucauccagcaucau

SEQ ID NO: 1945562 - RNA, 15 nt, Shigella flexneri 2a str. 2457T
cuucauccaccgauu

SEQ ID NO: 1945563 - RNA, 22 nt, Shigella flexneri 2a str. 2457T
cuucaucauccuuugggcauuu

SEQ ID NO: 1945564 - RNA, 23 nt, Shigella flexneri 2a str. 2457T
cuucagucaggcgauuguuuaga

SEQ ID NO: 1945565 - RNA, 16 nt, Shigella flexneri 2a str. 2457T
cuucagucaggcgauu

SEQ ID NO: 1945566 - RNA, 19 nt, Shigella flexneri 2a str. 2457T
cuucaguugccugggugca

SEQ ID NO: 1945567 - RNA, 15 nt, Shigella flexneri 2a str. 2457T
cuucagugccugugc

SEQ ID NO: 1945568 - RNA, 21 nt, Shigella flexneri 2a str. 2457T
cuucagcaacuuguucacgcc

SEQ ID NO: 1945569 - RNA, 23 nt, Shigella flexneri 2a str. 2457T
cuucagcaacuuguucacgccau

SEQ ID NO: 1945570 - RNA, 14 nt, Shigella flexneri 2a str. 2457T
cuucagcucccgcu

SEQ ID NO: 1945571 - RNA, 17 nt, Shigella flexneri 2a str. 2457T
cuucagauucagcgucg

SEQ ID NO: 1945572 - RNA, 14 nt, Shigella flexneri 2a str. 2457T
cuucacucucuuuu

SEQ ID NO: 1945573 - RNA, 13 nt, Shigella flexneri 2a str. 2457T
cuucacucucuuu

SEQ ID NO: 1945574 - RNA, 20 nt, Shigella flexneri 2a str. 2457T
cuucaggcccugcuguuuuu

SEQ ID NO: 1945575 - RNA, 21 nt, Shigella flexneri 2a str. 2457T
cuucaggauguacgucauccg

SEQ ID NO: 1945576 - RNA, 11 nt, Shigella flexneri 2a str. 2457T
cuucaggcaca

SEQ ID NO: 1945577 - RNA, 13 nt, Shigella flexneri 2a str. 2457T
cuuccuccagcgg

SEQ ID NO: 1945578 - RNA, 15 nt, Shigella flexneri 2a str. 2457T
cuuccguagcggcuc

SEQ ID NO: 1945579 - RNA, 14 nt, Shigella flexneri 2a str. 2457T
cuuccggugcaauc

SEQ ID NO: 1945580 - RNA, 20 nt, Shigella flexneri 2a str. 2457T
cuuccgguuacgccaccagc

SEQ ID NO: 1945581 - RNA, 15 nt, Shigella flexneri 2a str. 2457T
cuuccugcagcuuca

SEQ ID NO: 1945582 - RNA, 19 nt, Shigella flexneri 2a str. 2457T
cuuccugcggcagacgcuc

SEQ ID NO: 1945583 - RNA, 15 nt, Shigella flexneri 2a str. 2457T
cuuccuggcgcuggc

SEQ ID NO: 1945584 - RNA, 17 nt, Shigella flexneri 2a str. 2457T
cuuccuuaaucccugga

SEQ ID NO: 1945585 - RNA, 12 nt, Shigella flexneri 2a str. 2457T
cuuccuucagcu

SEQ ID NO: 1945586 - RNA, 14 nt, Shigella flexneri 2a str. 2457T
cuuccuucagcucc

SEQ ID NO: 1945587 - RNA, 18 nt, Shigella flexneri 2a str. 2457T
cuuccuucagcucccgcu

SEQ ID NO: 1945588 - RNA, 16 nt, Shigella flexneri 2a str. 2457T
cuuccuuaagccgcug

SEQ ID NO: 1945589 - RNA, 15 nt, Shigella flexneri 2a str. 2457T
cuucgaaugccgcag

SEQ ID NO: 1945590 - RNA, 20 nt, Shigella flexneri 2a str. 2457T
cuuccuuaugcuaagccgug

SEQ ID NO: 1945591 - RNA, 20 nt, Shigella flexneri 2a str. 2457T
cuucgacagcguuucgccac

SEQ ID NO: 1945592 - RNA, 16 nt, Shigella flexneri 2a str. 2457T
cuucgaguacauccac

SEQ ID NO: 1945593 - RNA, 17 nt, Shigella flexneri 2a str. 2457T
cuucgacguuauuuacc

SEQ ID NO: 1945594 - RNA, 21 nt, Shigella flexneri 2a str. 2457T
cuucgccgcccagccagccga

SEQ ID NO: 1945595 - RNA, 13 nt, Shigella flexneri 2a str. 2457T
cuucgccuccugu

SEQ ID NO: 1945596 - RNA, 12 nt, Shigella flexneri 2a str. 2457T
cuucgguagcag

SEQ ID NO: 1945597 - RNA, 19 nt, Shigella flexneri 2a str. 2457T
cuucggucaccgucaugcc

SEQ ID NO: 1945598 - RNA, 17 nt, Shigella flexneri 2a str. 2457T
cuucggugcgacaaaca

SEQ ID NO: 1945599 - RNA, 16 nt, Shigella flexneri 2a str. 2457T
cuucggcgucuccacc

SEQ ID NO: 1945600 - RNA, 14 nt, Shigella flexneri 2a str. 2457T
cuucgcgcaccaac

SEQ ID NO: 1945601 - RNA, 14 nt, Shigella flexneri 2a str. 2457T
cuuccaccagcggc

SEQ ID NO: 1945602 - RNA, 17 nt, Shigella flexneri 2a str. 2457T
cuuccaccacuuccugc

SEQ ID NO: 1945603 - RNA, 16 nt, Shigella flexneri 2a str. 2457T
cuuccaccacuuccug

SEQ ID NO: 1945604 - RNA, 13 nt, Shigella flexneri 2a str. 2457T
cuuccacgccugc

SEQ ID NO: 1945605 - RNA, 12 nt, Shigella flexneri 2a str. 2457T
cuuccacuuccu

SEQ ID NO: 1945606 - RNA, 16 nt, Shigella flexneri 2a str. 2457T
cuuccagaauaaacaa

SEQ ID NO: 1945607 - RNA, 20 nt, Shigella flexneri 2a str. 2457T
cuuccagcguucgccaaacc

SEQ ID NO: 1945608 - RNA, 22 nt, Shigella flexneri 2a str. 2457T
cuuccagcguucgccaaaccca

SEQ ID NO: 1945609 - RNA, 13 nt, Shigella flexneri 2a str. 2457T
cuuccagcuccag

SEQ ID NO: 1945610 - RNA, 15 nt, Shigella flexneri 2a str. 2457T
cuuccaccacgucca

SEQ ID NO: 1945611 - RNA, 15 nt, Shigella flexneri 2a str. 2457T
cuuccggcguggcgu

SEQ ID NO: 1945612 - RNA, 13 nt, Shigella flexneri 2a str. 2457T
cuuccggcagacc

SEQ ID NO: 1945613 - RNA, 18 nt, Shigella flexneri 2a str. 2457T
cuuccggcaacaaugcca

SEQ ID NO: 1945614 - RNA, 21 nt, Shigella flexneri 2a str. 2457T
cuucccgggucgcgacugcca

SEQ ID NO: 1945615 - RNA, 17 nt, Shigella flexneri 2a str. 2457T
cuuccccguucugccag

SEQ ID NO: 1945616 - RNA, 18 nt, Shigella flexneri 2a str. 2457T
cuuccccguucugccagu

SEQ ID NO: 1945617 - RNA, 22 nt, Shigella flexneri 2a str. 2457T
cuuccccucauuaagccacggu

SEQ ID NO: 1945618 - RNA, 14 nt, Shigella flexneri 2a str. 2457T
cuuccccuucucgu

SEQ ID NO: 1945619 - RNA, 13 nt, Shigella flexneri 2a str. 2457T
cuucccgccuguc

SEQ ID NO: 1945620 - RNA, 14 nt, Shigella flexneri 2a str. 2457T
cuucccgcauccag

SEQ ID NO: 1945621 - RNA, 17 nt, Shigella flexneri 2a str. 2457T
cuucccgcauccagaaa

SEQ ID NO: 1945622 - RNA, 17 nt, Shigella flexneri 2a str. 2457T
cuuccaguugcacgcca

SEQ ID NO: 1945623 - RNA, 14 nt, Shigella flexneri 2a str. 2457T
cuuccaguuccggc

SEQ ID NO: 1945624 - RNA, 19 nt, Shigella flexneri 2a str. 2457T
cuuccaguuccggcaucga

SEQ ID NO: 1945625 - RNA, 18 nt, Shigella flexneri 2a str. 2457T
cuuccaggucaaccuagc

SEQ ID NO: 1945626 - RNA, 11 nt, Shigella flexneri 2a str. 2457T
cuuauuuacau

SEQ ID NO: 1945627 - RNA, 15 nt, Shigella flexneri 2a str. 2457T
cuuauuucugugacu

SEQ ID NO: 1945628 - RNA, 20 nt, Shigella flexneri 2a str. 2457T
cuuaucgccagcgccacgca

SEQ ID NO: 1945629 - RNA, 20 nt, Shigella flexneri 2a str. 2457T
cuuaucgcccugcuccagca

SEQ ID NO: 1945630 - RNA, 18 nt, Shigella flexneri 2a str. 2457T
cuuaucgcccugcuccag

SEQ ID NO: 1945631 - RNA, 19 nt, Shigella flexneri 2a str. 2457T
cuuauccggcuuaccgcuc

SEQ ID NO: 1945632 - RNA, 18 nt, Shigella flexneri 2a str. 2457T
cuuaugcccggcacguuu

SEQ ID NO: 1945633 - RNA, 20 nt, Shigella flexneri 2a str. 2457T
cuuaugcugcgccaguugcu

SEQ ID NO: 1945634 - RNA, 11 nt, Shigella flexneri 2a str. 2457T
cuuaugcaaua

SEQ ID NO: 1945635 - RNA, 15 nt, Shigella flexneri 2a str. 2457T
cuuaugcagcugcuc

SEQ ID NO: 1945636 - RNA, 14 nt, Shigella flexneri 2a str. 2457T
cuuauccgaugguu

SEQ ID NO: 1945637 - RNA, 23 nt, Shigella flexneri 2a str. 2457T
cuuauccggcccacaucaacucu

SEQ ID NO: 1945638 - RNA, 19 nt, Shigella flexneri 2a str. 2457T
cuuauccggccuacaaaau

SEQ ID NO: 1945639 - RNA, 13 nt, Shigella flexneri 2a str. 2457T
cuuaucaaucuca

SEQ ID NO: 1945640 - RNA, 17 nt, Shigella flexneri 2a str. 2457T
cuuaucaaucucagcaa

SEQ ID NO: 1945641 - RNA, 14 nt, Shigella flexneri 2a str. 2457T
cuuagccuguguca

SEQ ID NO: 1945642 - RNA, 13 nt, Shigella flexneri 2a str. 2457T
cuuaguagaagag

SEQ ID NO: 1945643 - RNA, 15 nt, Shigella flexneri 2a str. 2457T
cuuaguagaagagga

SEQ ID NO: 1945644 - RNA, 17 nt, Shigella flexneri 2a str. 2457T
cuuaguagaagaggaac

SEQ ID NO: 1945645 - RNA, 18 nt, Shigella flexneri 2a str. 2457T
cuuaccguccucuuccca

SEQ ID NO: 1945646 - RNA, 15 nt, Shigella flexneri 2a str. 2457T
cuuaccuacuugcuc

SEQ ID NO: 1945647 - RNA, 17 nt, Shigella flexneri 2a str. 2457T
cuuacgcaacugccagu

SEQ ID NO: 1945648 - RNA, 20 nt, Shigella flexneri 2a str. 2457T
cuuacgagugcgcucuucaa

SEQ ID NO: 1945649 - RNA, 22 nt, Shigella flexneri 2a str. 2457T
cuuacucauaaauacuccauaa

SEQ ID NO: 1945650 - RNA, 18 nt, Shigella flexneri 2a str. 2457T
cuuacugaugcacacacg

SEQ ID NO: 1945651 - RNA, 12 nt, Shigella flexneri 2a str. 2457T
cuuacuguguug

SEQ ID NO: 1945652 - RNA, 16 nt, Shigella flexneri 2a str. 2457T
cuuagcaacaggccag

SEQ ID NO: 1945653 - RNA, 19 nt, Shigella flexneri 2a str. 2457T
cuuaaugcccaucucuucu

SEQ ID NO: 1945654 - RNA, 21 nt, Shigella flexneri 2a str. 2457T
cuuaaugcccaucucuucuuc

SEQ ID NO: 1945655 - RNA, 12 nt, Shigella flexneri 2a str. 2457T
cuuaaucugcca

SEQ ID NO: 1945656 - RNA, 14 nt, Shigella flexneri 2a str. 2457T
cuuaaucugccaga

SEQ ID NO: 1945657 - RNA, 19 nt, Shigella flexneri 2a str. 2457T
cuuaaucugccagaaggau

SEQ ID NO: 1945658 - RNA, 22 nt, Shigella flexneri 2a str. 2457T
cuuaaugaaucaucguucauau

SEQ ID NO: 1945659 - RNA, 18 nt, Shigella flexneri 2a str. 2457T
cuuaauggacgaacuggc

SEQ ID NO: 1945660 - RNA, 17 nt, Shigella flexneri 2a str. 2457T
cuuaccgcgucuuauca

SEQ ID NO: 1945661 - RNA, 22 nt, Shigella flexneri 2a str. 2457T
cuuacccggaccgucuuuuuuc

SEQ ID NO: 1945662 - RNA, 16 nt, Shigella flexneri 2a str. 2457T
cuuaaaaaccagagaa

SEQ ID NO: 1945663 - RNA, 21 nt, Shigella flexneri 2a str. 2457T
cuguuuuuugguguuacugcu

SEQ ID NO: 1945664 - RNA, 15 nt, Shigella flexneri 2a str. 2457T
cuguuuuuuauacuu

SEQ ID NO: 1945665 - RNA, 19 nt, Shigella flexneri 2a str. 2457T
cuguuuuucguuuggggca

SEQ ID NO: 1945666 - RNA, 19 nt, Shigella flexneri 2a str. 2457T
cuguuugcaggugaccagc

SEQ ID NO: 1945667 - RNA, 15 nt, Shigella flexneri 2a str. 2457T
cuuaaagucuuugua

SEQ ID NO: 1945668 - RNA, 17 nt, Shigella flexneri 2a str. 2457T
cuuaaaggggugaaaaa

SEQ ID NO: 1945669 - RNA, 19 nt, Shigella flexneri 2a str. 2457T
cuuaaaggggugaaaaaaa

SEQ ID NO: 1945670 - RNA, 21 nt, Shigella flexneri 2a str. 2457T
aaacuggcguuuuuccaaaac

SEQ ID NO: 1945671 - RNA, 17 nt, Shigella flexneri 2a str. 2457T
aaacuggcguuuuucca

SEQ ID NO: 1945672 - RNA, 20 nt, Shigella flexneri 2a str. 2457T
aaacuggcugauaaaacucu

SEQ ID NO: 1945673 - RNA, 14 nt, Shigella flexneri 2a str. 2457T
aaacuggaaaaaua

SEQ ID NO: 1945674 - RNA, 22 nt, Shigella flexneri 2a str. 2457T
aaacuggaaaaauaauuuuaaa

SEQ ID NO: 1945675 - RNA, 15 nt, Shigella flexneri 2a str. 2457T
aaacuggauuacaaa

SEQ ID NO: 1945676 - RNA, 13 nt, Shigella flexneri 2a str. 2457T
cuuaaucaccagc

SEQ ID NO: 1945677 - RNA, 17 nt, Shigella flexneri 2a str. 2457T
cuuaaucagaauuuuuc

SEQ ID NO: 1945678 - RNA, 20 nt, Shigella flexneri 2a str. 2457T
cuuaaucagaauuuuucgcu

SEQ ID NO: 1945679 - RNA, 17 nt, Shigella flexneri 2a str. 2457T
cuuaaucaucaaugcca

SEQ ID NO: 1945680 - RNA, 15 nt, Shigella flexneri 2a str. 2457T
cuggcccauagacag

SEQ ID NO: 1945681 - RNA, 22 nt, Shigella flexneri 2a str. 2457T
cuggcccaguugauucgcgcgu

SEQ ID NO: 1945682 - RNA, 20 nt, Shigella flexneri 2a str. 2457T
cuguuacgccagaacagcua

SEQ ID NO: 1945683 - RNA, 12 nt, Shigella flexneri 2a str. 2457T
cuguucccuucu

SEQ ID NO: 1945684 - RNA, 16 nt, Shigella flexneri 2a str. 2457T
cuguuuaaccgcuuca

SEQ ID NO: 1945685 - RNA, 19 nt, Shigella flexneri 2a str. 2457T
cuguucgguuuugcccaca

SEQ ID NO: 1945686 - RNA, 19 nt, Shigella flexneri 2a str. 2457T
cuguugucugaaugauaac

SEQ ID NO: 1945687 - RNA, 15 nt, Shigella flexneri 2a str. 2457T
cuguuccuaucuuca

SEQ ID NO: 1945688 - RNA, 15 nt, Shigella flexneri 2a str. 2457T
cuguuccggcuuugu

SEQ ID NO: 1945689 - RNA, 18 nt, Shigella flexneri 2a str. 2457T
cuguuuaauaugcaauuc

SEQ ID NO: 1945690 - RNA, 18 nt, Shigella flexneri 2a str. 2457T
cuguuuacgcagcucacu

SEQ ID NO: 1945691 - RNA, 19 nt, Shigella flexneri 2a str. 2457T
cuguuuagccgcuucugca

SEQ ID NO: 1945692 - RNA, 15 nt, Shigella flexneri 2a str. 2457T
cuguuuaucuuccca

SEQ ID NO: 1945693 - RNA, 16 nt, Shigella flexneri 2a str. 2457T
cuguuuaucuucccag

SEQ ID NO: 1945694 - RNA, 20 nt, Shigella flexneri 2a str. 2457T
cuguuucaucucuucacgcu

SEQ ID NO: 1945695 - RNA, 19 nt, Shigella flexneri 2a str. 2457T
cuugcgccgcuuucucugc

SEQ ID NO: 1945696 - RNA, 15 nt, Shigella flexneri 2a str. 2457T
cuugcgcgcaaucag

SEQ ID NO: 1945697 - RNA, 20 nt, Shigella flexneri 2a str. 2457T
cuugcgcgcaaucagcaccg

SEQ ID NO: 1945698 - RNA, 12 nt, Shigella flexneri 2a str. 2457T
cuugcgucacau

SEQ ID NO: 1945699 - RNA, 22 nt, Shigella flexneri 2a str. 2457T
cuugcuaaccaacaaugcaaaa

SEQ ID NO: 1945700 - RNA, 14 nt, Shigella flexneri 2a str. 2457T
cuugcggaaacugu

SEQ ID NO: 1945701 - RNA, 15 nt, Shigella flexneri 2a str. 2457T
cuugcggacccggcg

SEQ ID NO: 1945702 - RNA, 23 nt, Shigella flexneri 2a str. 2457T
cuugcggaagcaaccggugucau

SEQ ID NO: 1945703 - RNA, 19 nt, Shigella flexneri 2a str. 2457T
cuugcggaagcgucaaggu

SEQ ID NO: 1945704 - RNA, 18 nt, Shigella flexneri 2a str. 2457T
cuugcuggucacugacca

SEQ ID NO: 1945705 - RNA, 16 nt, Shigella flexneri 2a str. 2457T
cuugcuguuugcgauu

SEQ ID NO: 1945706 - RNA, 14 nt, Shigella flexneri 2a str. 2457T
cuugcuccacguuc

SEQ ID NO: 1945707 - RNA, 19 nt, Shigella flexneri 2a str. 2457T
cuugcuccacguucagaga

SEQ ID NO: 1945708 - RNA, 16 nt, Shigella flexneri 2a str. 2457T
cuugcugaugcacgca

SEQ ID NO: 1945709 - RNA, 19 nt, Shigella flexneri 2a str. 2457T
cuugcugauaacgugcagc

SEQ ID NO: 1945710 - RNA, 12 nt, Shigella flexneri 2a str. 2457T
cuugcugauaac

SEQ ID NO: 1945711 - RNA, 13 nt, Shigella flexneri 2a str. 2457T
aaacuuuuaaauu

SEQ ID NO: 1945712 - RNA, 17 nt, Shigella flexneri 2a str. 2457T
aaacuugcguaucgacc

SEQ ID NO: 1945713 - RNA, 21 nt, Shigella flexneri 2a str. 2457T
aaacuuuaauuuuucaauauc

SEQ ID NO: 1945714 - RNA, 15 nt, Shigella flexneri 2a str. 2457T
cuugcccaggugugu

SEQ ID NO: 1945715 - RNA, 23 nt, Shigella flexneri 2a str. 2457T
cuugcccaggugugucucaaguc

SEQ ID NO: 1945716 - RNA, 13 nt, Shigella flexneri 2a str. 2457T
cuugccccuuccc

SEQ ID NO: 1945717 - RNA, 15 nt, Shigella flexneri 2a str. 2457T
aaacuugauacugaa

SEQ ID NO: 1945718 - RNA, 17 nt, Shigella flexneri 2a str. 2457T
aaacuugauagaacaaa

SEQ ID NO: 1945719 - RNA, 20 nt, Shigella flexneri 2a str. 2457T
cuugcgauauucuucaguau

SEQ ID NO: 1945720 - RNA, 16 nt, Shigella flexneri 2a str. 2457T
cuugcgauccugcaga

SEQ ID NO: 1945721 - RNA, 13 nt, Shigella flexneri 2a str. 2457T
cuugccuuuccuc

SEQ ID NO: 1945722 - RNA, 19 nt, Shigella flexneri 2a str. 2457T
cuugccggacaugcugccu

SEQ ID NO: 1945723 - RNA, 23 nt, Shigella flexneri 2a str. 2457T
cuugccgcgucuuaucaggccua

SEQ ID NO: 1945724 - RNA, 15 nt, Shigella flexneri 2a str. 2457T
cuugccgcgucuuau

SEQ ID NO: 1945725 - RNA, 17 nt, Shigella flexneri 2a str. 2457T
cuugcaucguguaauuc

SEQ ID NO: 1945726 - RNA, 16 nt, Shigella flexneri 2a str. 2457T
cuugccaggcuuacgc

SEQ ID NO: 1945727 - RNA, 17 nt, Shigella flexneri 2a str. 2457T
cuugccagaugccagga

SEQ ID NO: 1945728 - RNA, 20 nt, Shigella flexneri 2a str. 2457T
cuugccauuccacaaaaacc

SEQ ID NO: 1945729 - RNA, 16 nt, Shigella flexneri 2a str. 2457T
cuugcaauaguuucag

SEQ ID NO: 1945730 - RNA, 23 nt, Shigella flexneri 2a str. 2457T
cuugcaauuuuuaccgccgucga

SEQ ID NO: 1945731 - RNA, 16 nt, Shigella flexneri 2a str. 2457T
cuugcaaucuuuagca

SEQ ID NO: 1945732 - RNA, 21 nt, Shigella flexneri 2a str. 2457T
cuugauuauuucccucguuuu

SEQ ID NO: 1945733 - RNA, 17 nt, Shigella flexneri 2a str. 2457T
cuugauucuguucagua

SEQ ID NO: 1945734 - RNA, 13 nt, Shigella flexneri 2a str. 2457T
cuugauuauuucc

SEQ ID NO: 1945735 - RNA, 18 nt, Shigella flexneri 2a str. 2457T
cuugaucuuccugauaac

SEQ ID NO: 1945736 - RNA, 23 nt, Shigella flexneri 2a str. 2457T
cuugaucuuccugauaaccuucc

SEQ ID NO: 1945737 - RNA, 14 nt, Shigella flexneri 2a str. 2457T
cuugaugcacuggg

SEQ ID NO: 1945738 - RNA, 21 nt, Shigella flexneri 2a str. 2457T
cuugacgugucuuaucaggcc

SEQ ID NO: 1945739 - RNA, 18 nt, Shigella flexneri 2a str. 2457T
cuugacucgccugaaagu

SEQ ID NO: 1945740 - RNA, 20 nt, Shigella flexneri 2a str. 2457T
cuugagcccuggccacaaac

SEQ ID NO: 1945741 - RNA, 14 nt, Shigella flexneri 2a str. 2457T
cuugaggugguagu

SEQ ID NO: 1945742 - RNA, 20 nt, Shigella flexneri 2a str. 2457T
cuugauacugaacaacuuaa

SEQ ID NO: 1945743 - RNA, 15 nt, Shigella flexneri 2a str. 2457T
cuugaagccuucgcc

SEQ ID NO: 1945744 - RNA, 16 nt, Shigella flexneri 2a str. 2457T
cuugaacuuaucauca

SEQ ID NO: 1945745 - RNA, 15 nt, Shigella flexneri 2a str. 2457T
cuugaagugucuggu

SEQ ID NO: 1945746 - RNA, 13 nt, Shigella flexneri 2a str. 2457T
cuugaaaagguac

SEQ ID NO: 1945747 - RNA, 20 nt, Shigella flexneri 2a str. 2457T
cuugaaaauuauaucuuauu

SEQ ID NO: 1945748 - RNA, 14 nt, Shigella flexneri 2a str. 2457T
cuucuuuaugaauc

SEQ ID NO: 1945749 - RNA, 18 nt, Shigella flexneri 2a str. 2457T
cuucugugauuccgccag

SEQ ID NO: 1945750 - RNA, 18 nt, Shigella flexneri 2a str. 2457T
cuucugguuauauuuccc

SEQ ID NO: 1945751 - RNA, 14 nt, Shigella flexneri 2a str. 2457T
cuucuggcuacuga

SEQ ID NO: 1945752 - RNA, 17 nt, Shigella flexneri 2a str. 2457T
cuucuggcuacugaugg

SEQ ID NO: 1945753 - RNA, 20 nt, Shigella flexneri 2a str. 2457T
cuucuggcguacgcauucuc

SEQ ID NO: 1945754 - RNA, 20 nt, Shigella flexneri 2a str. 2457T
cuucugguaacagcggacgg

SEQ ID NO: 1945755 - RNA, 23 nt, Shigella flexneri 2a str. 2457T
cuucuggugauaggcguugcggg

SEQ ID NO: 1945756 - RNA, 15 nt, Shigella flexneri 2a str. 2457T
cuucugguaacagcg

SEQ ID NO: 1945757 - RNA, 15 nt, Shigella flexneri 2a str. 2457T
cuucuucacuucuuc

SEQ ID NO: 1945758 - RNA, 16 nt, Shigella flexneri 2a str. 2457T
cuucuguuuuaccugc

SEQ ID NO: 1945759 - RNA, 23 nt, Shigella flexneri 2a str. 2457T
cuucuucguagggucacguucca

SEQ ID NO: 1945760 - RNA, 14 nt, Shigella flexneri 2a str. 2457T
cuucuucucagcca

SEQ ID NO: 1945761 - RNA, 13 nt, Shigella flexneri 2a str. 2457T
cuucuucuuucag

SEQ ID NO: 1945762 - RNA, 12 nt, Shigella flexneri 2a str. 2457T
cuucuucugucg

SEQ ID NO: 1945763 - RNA, 13 nt, Shigella flexneri 2a str. 2457T
cuucuuguaauuc

SEQ ID NO: 1945764 - RNA, 24 nt, Shigella flexneri 2a str. 2457T
cuucuauauucuggcguuagucgu

SEQ ID NO: 1945765 - RNA, 13 nt, Shigella flexneri 2a str. 2457T
cuucucaaucccu

SEQ ID NO: 1945766 - RNA, 13 nt, Shigella flexneri 2a str. 2457T
cuucuauaaugag

SEQ ID NO: 1945767 - RNA, 22 nt, Shigella flexneri 2a str. 2457T
cuucuauaaugagauauuuaau

SEQ ID NO: 1945768 - RNA, 18 nt, Shigella flexneri 2a str. 2457T
cuucuaauuuuuccagca

SEQ ID NO: 1945769 - RNA, 22 nt, Shigella flexneri 2a str. 2457T
cuucuaccgucuguaaccagau

SEQ ID NO: 1945770 - RNA, 22 nt, Shigella flexneri 2a str. 2457T
cuucguuauccucugcaagaua

SEQ ID NO: 1945771 - RNA, 22 nt, Shigella flexneri 2a str. 2457T
cuucguuaacgugucauaacug

SEQ ID NO: 1945772 - RNA, 13 nt, Shigella flexneri 2a str. 2457T
cuucgucccaguc

SEQ ID NO: 1945773 - RNA, 23 nt, Shigella flexneri 2a str. 2457T
cuucgguuuuguugccgcccguu

SEQ ID NO: 1945774 - RNA, 21 nt, Shigella flexneri 2a str. 2457T
cuucucacccggaggaaagca

SEQ ID NO: 1945775 - RNA, 15 nt, Shigella flexneri 2a str. 2457T
cuucucaaucccuuu

SEQ ID NO: 1945776 - RNA, 14 nt, Shigella flexneri 2a str. 2457T
cuucucauccuucc

SEQ ID NO: 1945777 - RNA, 17 nt, Shigella flexneri 2a str. 2457T
cuucuccggcauccuua

SEQ ID NO: 1945778 - RNA, 19 nt, Shigella flexneri 2a str. 2457T
cuucucccagccgcccugc

SEQ ID NO: 1945779 - RNA, 21 nt, Shigella flexneri 2a str. 2457T
cuucucauuucugccauucca

SEQ ID NO: 1945780 - RNA, 12 nt, Shigella flexneri 2a str. 2457T
cuucuccacgcc

SEQ ID NO: 1945781 - RNA, 16 nt, Shigella flexneri 2a str. 2457T
cuucucgccagccucc

SEQ ID NO: 1945782 - RNA, 17 nt, Shigella flexneri 2a str. 2457T
cuucucgcucuuguucu

SEQ ID NO: 1945783 - RNA, 20 nt, Shigella flexneri 2a str. 2457T
cuucucgucaaucugcucca

SEQ ID NO: 1945784 - RNA, 20 nt, Shigella flexneri 2a str. 2457T
cuucugcuuuggcugccgcc

SEQ ID NO: 1945785 - RNA, 16 nt, Shigella flexneri 2a str. 2457T
cuucugccuguccacc

SEQ ID NO: 1945786 - RNA, 13 nt, Shigella flexneri 2a str. 2457T
cuucugccgcuuc

SEQ ID NO: 1945787 - RNA, 14 nt, Shigella flexneri 2a str. 2457T
cuucucuuccccgg

SEQ ID NO: 1945788 - RNA, 15 nt, Shigella flexneri 2a str. 2457T
cuucugaguucggca

SEQ ID NO: 1945789 - RNA, 21 nt, Shigella flexneri 2a str. 2457T
cuucugacauaaccacucacc

SEQ ID NO: 1945790 - RNA, 15 nt, Shigella flexneri 2a str. 2457T
cuucugauguuguuu

SEQ ID NO: 1945791 - RNA, 14 nt, Shigella flexneri 2a str. 2457T
cgggucagcggggu

SEQ ID NO: 1945792 - RNA, 23 nt, Shigella flexneri 2a str. 2457T
cgggucauccaggaacuccagau

SEQ ID NO: 1945793 - RNA, 16 nt, Shigella flexneri 2a str. 2457T
cgggucaccgcggugu

SEQ ID NO: 1945794 - RNA, 14 nt, Shigella flexneri 2a str. 2457T
cgggucaccgccga

SEQ ID NO: 1945795 - RNA, 20 nt, Shigella flexneri 2a str. 2457T
cgggugaagagauccaccag

SEQ ID NO: 1945796 - RNA, 21 nt, Shigella flexneri 2a str. 2457T
cgggugcaaucaacaccacug

SEQ ID NO: 1945797 - RNA, 12 nt, Shigella flexneri 2a str. 2457T
cgggugauuaaa

SEQ ID NO: 1945798 - RNA, 23 nt, Shigella flexneri 2a str. 2457T
cgggugcaaucaacaccacugcc

SEQ ID NO: 1945799 - RNA, 14 nt, Shigella flexneri 2a str. 2457T
cgggugcauuuuca

SEQ ID NO: 1945800 - RNA, 15 nt, Shigella flexneri 2a str. 2457T
cggguuggagcgcgu

SEQ ID NO: 1945801 - RNA, 17 nt, Shigella flexneri 2a str. 2457T
cggguuuggccgggaag

SEQ ID NO: 1945802 - RNA, 19 nt, Shigella flexneri 2a str. 2457T
cggguuuaagcccggcauu

SEQ ID NO: 1945803 - RNA, 16 nt, Shigella flexneri 2a str. 2457T
cgguaacaggaagcag

SEQ ID NO: 1945804 - RNA, 16 nt, Shigella flexneri 2a str. 2457T
cgguaaagcccucacc

SEQ ID NO: 1945805 - RNA, 22 nt, Shigella flexneri 2a str. 2457T
cggguuuucgcugccacaccau

SEQ ID NO: 1945806 - RNA, 21 nt, Shigella flexneri 2a str. 2457T
cggguuuuucgcgcgggcaga

SEQ ID NO: 1945807 - RNA, 14 nt, Shigella flexneri 2a str. 2457T
cgguaaaaucaucc

SEQ ID NO: 1945808 - RNA, 16 nt, Shigella flexneri 2a str. 2457T
cgguaaaaucauccug

SEQ ID NO: 1945809 - RNA, 14 nt, Shigella flexneri 2a str. 2457T
cggguuaaauccug

SEQ ID NO: 1945810 - RNA, 17 nt, Shigella flexneri 2a str. 2457T
cggguuaaccagcacca

SEQ ID NO: 1945811 - RNA, 20 nt, Shigella flexneri 2a str. 2457T
cggguuaaccagcaccagcu

SEQ ID NO: 1945812 - RNA, 19 nt, Shigella flexneri 2a str. 2457T
cggguggugcguaccaggc

SEQ ID NO: 1945813 - RNA, 15 nt, Shigella flexneri 2a str. 2457T
cggggaacgcaaaau

SEQ ID NO: 1945814 - RNA, 16 nt, Shigella flexneri 2a str. 2457T
cggggacaggcggccc

SEQ ID NO: 1945815 - RNA, 19 nt, Shigella flexneri 2a str. 2457T
cggggagauauuccccaga

SEQ ID NO: 1945816 - RNA, 18 nt, Shigella flexneri 2a str. 2457T
cggggagagucauuaugc

SEQ ID NO: 1945817 - RNA, 20 nt, Shigella flexneri 2a str. 2457T
cggggauuacuccccgcaca

SEQ ID NO: 1945818 - RNA, 15 nt, Shigella flexneri 2a str. 2457T
cgggcuuccggcaau

SEQ ID NO: 1945819 - RNA, 19 nt, Shigella flexneri 2a str. 2457T
cgggcuggcguacccauca

SEQ ID NO: 1945820 - RNA, 21 nt, Shigella flexneri 2a str. 2457T
cgggcuuugccauacucccgc

SEQ ID NO: 1945821 - RNA, 23 nt, Shigella flexneri 2a str. 2457T
cgggcuuuuuaauuccugccgcg

SEQ ID NO: 1945822 - RNA, 18 nt, Shigella flexneri 2a str. 2457T
cggggaacaucaggcauu

SEQ ID NO: 1945823 - RNA, 20 nt, Shigella flexneri 2a str. 2457T
cggggcuguuuuccagcacc

SEQ ID NO: 1945824 - RNA, 20 nt, Shigella flexneri 2a str. 2457T
cgggggccauguuuguauua

SEQ ID NO: 1945825 - RNA, 22 nt, Shigella flexneri 2a str. 2457T
cgggggcggcaaucgcugcuaa

SEQ ID NO: 1945826 - RNA, 15 nt, Shigella flexneri 2a str. 2457T
cggggguaaaaccgg

SEQ ID NO: 1945827 - RNA, 14 nt, Shigella flexneri 2a str. 2457T
cggguaccagaauc

SEQ ID NO: 1945828 - RNA, 14 nt, Shigella flexneri 2a str. 2457T
cgggguuugcagau

SEQ ID NO: 1945829 - RNA, 14 nt, Shigella flexneri 2a str. 2457T
cggggucgugcaga

SEQ ID NO: 1945830 - RNA, 23 nt, Shigella flexneri 2a str. 2457T
cggucagcagcaccaccgcccgu

SEQ ID NO: 1945831 - RNA, 20 nt, Shigella flexneri 2a str. 2457T
cggucacggcuguagccagc

SEQ ID NO: 1945832 - RNA, 16 nt, Shigella flexneri 2a str. 2457T
aaacuaacaguguuuc

SEQ ID NO: 1945833 - RNA, 18 nt, Shigella flexneri 2a str. 2457T
aaacuaauaauuauccug

SEQ ID NO: 1945834 - RNA, 15 nt, Shigella flexneri 2a str. 2457T
cggucaaaagcugca

SEQ ID NO: 1945835 - RNA, 17 nt, Shigella flexneri 2a str. 2457T
cggucacaucgcugaca

SEQ ID NO: 1945836 - RNA, 13 nt, Shigella flexneri 2a str. 2457T
cgguaucaaacac

SEQ ID NO: 1945837 - RNA, 20 nt, Shigella flexneri 2a str. 2457T
cgguaucaccacccagcggu

SEQ ID NO: 1945838 - RNA, 16 nt, Shigella flexneri 2a str. 2457T
cgguaucaccacccag

SEQ ID NO: 1945839 - RNA, 14 nt, Shigella flexneri 2a str. 2457T
cgguaucaccaccc

SEQ ID NO: 1945840 - RNA, 16 nt, Shigella flexneri 2a str. 2457T
cgguaguuucucccca

SEQ ID NO: 1945841 - RNA, 19 nt, Shigella flexneri 2a str. 2457T
cgguauagaucagacgaca

SEQ ID NO: 1945842 - RNA, 15 nt, Shigella flexneri 2a str. 2457T
cgguagucaccgccc

SEQ ID NO: 1945843 - RNA, 15 nt, Shigella flexneri 2a str. 2457T
cgguacucgcgcagu

SEQ ID NO: 1945844 - RNA, 16 nt, Shigella flexneri 2a str. 2457T
cgguagaauuguaauc

SEQ ID NO: 1945845 - RNA, 22 nt, Shigella flexneri 2a str. 2457T
cgguacuucgauuucgccaccc

SEQ ID NO: 1945846 - RNA, 17 nt, Shigella flexneri 2a str. 2457T
cgguagcaugaaccauu

SEQ ID NO: 1945847 - RNA, 23 nt, Shigella flexneri 2a str. 2457T
cgguacaaacaucauccagugcc

SEQ ID NO: 1945848 - RNA, 14 nt, Shigella flexneri 2a str. 2457T
cgguaauuucacaa

SEQ ID NO: 1945849 - RNA, 24 nt, Shigella flexneri 2a str. 2457T
cgguaccaguacgcccacgccagc

SEQ ID NO: 1945850 - RNA, 23 nt, Shigella flexneri 2a str. 2457T
cgguaacgauuucaucgcccagg

SEQ ID NO: 1945851 - RNA, 18 nt, Shigella flexneri 2a str. 2457T
cgguaaccccucuucagc

SEQ ID NO: 1945852 - RNA, 13 nt, Shigella flexneri 2a str. 2457T
cgguaacauccag

SEQ ID NO: 1945853 - RNA, 13 nt, Shigella flexneri 2a str. 2457T
cggucgcggaaca

SEQ ID NO: 1945854 - RNA, 22 nt, Shigella flexneri 2a str. 2457T
cggucggaaaauuauuuuaaau

SEQ ID NO: 1945855 - RNA, 15 nt, Shigella flexneri 2a str. 2457T
cggucgcugacgcca

SEQ ID NO: 1945856 - RNA, 19 nt, Shigella flexneri 2a str. 2457T
cggucgccgucaggcaagc

SEQ ID NO: 1945857 - RNA, 11 nt, Shigella flexneri 2a str. 2457T
cgguccuggcg

SEQ ID NO: 1945858 - RNA, 16 nt, Shigella flexneri 2a str. 2457T
cggucgaugcgcaacg

SEQ ID NO: 1945859 - RNA, 12 nt, Shigella flexneri 2a str. 2457T
cggugauaaacc

SEQ ID NO: 1945860 - RNA, 17 nt, Shigella flexneri 2a str. 2457T
cggugauaacuguaugu

SEQ ID NO: 1945861 - RNA, 19 nt, Shigella flexneri 2a str. 2457T
cggugaagcgcccugcaau

SEQ ID NO: 1945862 - RNA, 18 nt, Shigella flexneri 2a str. 2457T
cggugaaggcaaacuguc

SEQ ID NO: 1945863 - RNA, 20 nt, Shigella flexneri 2a str. 2457T
cggugaccgaucgcccgcca

SEQ ID NO: 1945864 - RNA, 14 nt, Shigella flexneri 2a str. 2457T
cggugaccagcagc

SEQ ID NO: 1945865 - RNA, 24 nt, Shigella flexneri 2a str. 2457T
cggugacacuuugcgccaucgcca

SEQ ID NO: 1945866 - RNA, 13 nt, Shigella flexneri 2a str. 2457T
cggugaccagcag

SEQ ID NO: 1945867 - RNA, 12 nt, Shigella flexneri 2a str. 2457T
cggugaaagucc

SEQ ID NO: 1945868 - RNA, 24 nt, Shigella flexneri 2a str. 2457T
cggugaaaaaccaaucucccagcc

SEQ ID NO: 1945869 - RNA, 19 nt, Shigella flexneri 2a str. 2457T
cggucuggauuuggcugcc

SEQ ID NO: 1945870 - RNA, 18 nt, Shigella flexneri 2a str. 2457T
cggucguaaucgcccgcu

SEQ ID NO: 1945871 - RNA, 16 nt, Shigella flexneri 2a str. 2457T
cgggcagaggcaauau

SEQ ID NO: 1945872 - RNA, 19 nt, Shigella flexneri 2a str. 2457T
cgggcagcagaaccaggga

SEQ ID NO: 1945873 - RNA, 20 nt, Shigella flexneri 2a str. 2457T
cgggcaggcuucaacacagg

SEQ ID NO: 1945874 - RNA, 14 nt, Shigella flexneri 2a str. 2457T
cgggcauauuuccg

SEQ ID NO: 1945875 - RNA, 18 nt, Shigella flexneri 2a str. 2457T
cgggcaaauccacugaau

SEQ ID NO: 1945876 - RNA, 16 nt, Shigella flexneri 2a str. 2457T
cgggcaagcaccaggg

SEQ ID NO: 1945877 - RNA, 14 nt, Shigella flexneri 2a str. 2457T
cgggcaacugcugc

SEQ ID NO: 1945878 - RNA, 21 nt, Shigella flexneri 2a str. 2457T
cgggauguguaaguaaugaca

SEQ ID NO: 1945879 - RNA, 17 nt, Shigella flexneri 2a str. 2457T
cgggauugccagaugcg

SEQ ID NO: 1945880 - RNA, 17 nt, Shigella flexneri 2a str. 2457T
cgggacaacaaacgcaa

SEQ ID NO: 1945881 - RNA, 15 nt, Shigella flexneri 2a str. 2457T
cgggaauaaaagcca

SEQ ID NO: 1945882 - RNA, 14 nt, Shigella flexneri 2a str. 2457T
cgggagcaauuugu

SEQ ID NO: 1945883 - RNA, 16 nt, Shigella flexneri 2a str. 2457T
cgggagagauaagaua

SEQ ID NO: 1945884 - RNA, 19 nt, Shigella flexneri 2a str. 2457T
cgggaucaucgcccagccg

SEQ ID NO: 1945885 - RNA, 13 nt, Shigella flexneri 2a str. 2457T
cgggaucaccaga

SEQ ID NO: 1945886 - RNA, 20 nt, Shigella flexneri 2a str. 2457T
cgggaugguguaaaugccgg

SEQ ID NO: 1945887 - RNA, 13 nt, Shigella flexneri 2a str. 2457T
cgggaucugaugg

SEQ ID NO: 1945888 - RNA, 16 nt, Shigella flexneri 2a str. 2457T
cgggcgauccggcaaa

SEQ ID NO: 1945889 - RNA, 15 nt, Shigella flexneri 2a str. 2457T
cgggcuaaucgucau

SEQ ID NO: 1945890 - RNA, 14 nt, Shigella flexneri 2a str. 2457T
cgggcuaaucguca

SEQ ID NO: 1945891 - RNA, 23 nt, Shigella flexneri 2a str. 2457T
cgggcgguguuggggcaagauau

SEQ ID NO: 1945892 - RNA, 16 nt, Shigella flexneri 2a str. 2457T
cgggcguauaacacgc

SEQ ID NO: 1945893 - RNA, 15 nt, Shigella flexneri 2a str. 2457T
cgggcggccucuuca

SEQ ID NO: 1945894 - RNA, 17 nt, Shigella flexneri 2a str. 2457T
cgggccguaacugugcc

SEQ ID NO: 1945895 - RNA, 15 nt, Shigella flexneri 2a str. 2457T
cgggccugaacaagc

SEQ ID NO: 1945896 - RNA, 21 nt, Shigella flexneri 2a str. 2457T
cgggccuccccugauucaucc

SEQ ID NO: 1945897 - RNA, 21 nt, Shigella flexneri 2a str. 2457T
cgggccauaaaaggaagaggc

SEQ ID NO: 1945898 - RNA, 17 nt, Shigella flexneri 2a str. 2457T
cgggccaguuucauagu

SEQ ID NO: 1945899 - RNA, 18 nt, Shigella flexneri 2a str. 2457T
cgggccaguuucauagug

SEQ ID NO: 1945900 - RNA, 13 nt, Shigella flexneri 2a str. 2457T
cggcuaucuacgc

SEQ ID NO: 1945901 - RNA, 14 nt, Shigella flexneri 2a str. 2457T
cggcucaccugcac

SEQ ID NO: 1945902 - RNA, 11 nt, Shigella flexneri 2a str. 2457T
cggcuccagau

SEQ ID NO: 1945903 - RNA, 13 nt, Shigella flexneri 2a str. 2457T
cggcucccgcagc

SEQ ID NO: 1945904 - RNA, 23 nt, Shigella flexneri 2a str. 2457T
cggcucccgcagccacuccuuau

SEQ ID NO: 1945905 - RNA, 13 nt, Shigella flexneri 2a str. 2457T
cggcuccgcccca

SEQ ID NO: 1945906 - RNA, 23 nt, Shigella flexneri 2a str. 2457T
cggcuccgguuaacgccgcgccc

SEQ ID NO: 1945907 - RNA, 24 nt, Shigella flexneri 2a str. 2457T
cggcuccgguuaacgccgcgcccg

SEQ ID NO: 1945908 - RNA, 16 nt, Shigella flexneri 2a str. 2457T
cggcguugagaaacgc

SEQ ID NO: 1945909 - RNA, 14 nt, Shigella flexneri 2a str. 2457T
cggcguuccccagu

SEQ ID NO: 1945910 - RNA, 22 nt, Shigella flexneri 2a str. 2457T
cggcguuguaagguuaagccuc

SEQ ID NO: 1945911 - RNA, 22 nt, Shigella flexneri 2a str. 2457T
cggcguuuuguagagcagcacg

SEQ ID NO: 1945912 - RNA, 13 nt, Shigella flexneri 2a str. 2457T
cggcgugaaugcc

SEQ ID NO: 1945913 - RNA, 16 nt, Shigella flexneri 2a str. 2457T
cggcgugaccucuucg

SEQ ID NO: 1945914 - RNA, 22 nt, Shigella flexneri 2a str. 2457T
cggcgugaacgccuuauccggc

SEQ ID NO: 1945915 - RNA, 19 nt, Shigella flexneri 2a str. 2457T
cggcgucuuguugaacagg

SEQ ID NO: 1945916 - RNA, 15 nt, Shigella flexneri 2a str. 2457T
cggcguacuggcaau

SEQ ID NO: 1945917 - RNA, 22 nt, Shigella flexneri 2a str. 2457T
cggcguacuggcaaucgccagc

SEQ ID NO: 1945918 - RNA, 22 nt, Shigella flexneri 2a str. 2457T
cggcgucaacaccgggugcaga

SEQ ID NO: 1945919 - RNA, 15 nt, Shigella flexneri 2a str. 2457T
cggcguauccggcuc

SEQ ID NO: 1945920 - RNA, 21 nt, Shigella flexneri 2a str. 2457T
cggcgucauaauccggcaaca

SEQ ID NO: 1945921 - RNA, 17 nt, Shigella flexneri 2a str. 2457T
cggcuuugcagguucug

SEQ ID NO: 1945922 - RNA, 16 nt, Shigella flexneri 2a str. 2457T
cggcuuuuuugucucc

SEQ ID NO: 1945923 - RNA, 18 nt, Shigella flexneri 2a str. 2457T
cggcuuuuuacuucucag

SEQ ID NO: 1945924 - RNA, 15 nt, Shigella flexneri 2a str. 2457T
cggcuuguggugaaa

SEQ ID NO: 1945925 - RNA, 24 nt, Shigella flexneri 2a str. 2457T
cggcuuuuuacuucucagcgucag

SEQ ID NO: 1945926 - RNA, 14 nt, Shigella flexneri 2a str. 2457T
cgggaaaucaaguu

SEQ ID NO: 1945927 - RNA, 15 nt, Shigella flexneri 2a str. 2457T
cggcuucgccuccug

SEQ ID NO: 1945928 - RNA, 19 nt, Shigella flexneri 2a str. 2457T
cggcuucgccuccuguucu

SEQ ID NO: 1945929 - RNA, 22 nt, Shigella flexneri 2a str. 2457T
cggcuguugauguccaguuccc

SEQ ID NO: 1945930 - RNA, 17 nt, Shigella flexneri 2a str. 2457T
cggcuuagcguuacguu

SEQ ID NO: 1945931 - RNA, 17 nt, Shigella flexneri 2a str. 2457T
cggcuuauaauccccgg

SEQ ID NO: 1945932 - RNA, 23 nt, Shigella flexneri 2a str. 2457T
cggcuuauugcuucaagaugcca

SEQ ID NO: 1945933 - RNA, 19 nt, Shigella flexneri 2a str. 2457T
cggcucggucagacccggg

SEQ ID NO: 1945934 - RNA, 16 nt, Shigella flexneri 2a str. 2457T
cggcugaaaugaugcu

SEQ ID NO: 1945935 - RNA, 15 nt, Shigella flexneri 2a str. 2457T
cggcuggcugaccug

SEQ ID NO: 1945936 - RNA, 16 nt, Shigella flexneri 2a str. 2457T
cggcuggcugaccuga

SEQ ID NO: 1945937 - RNA, 17 nt, Shigella flexneri 2a str. 2457T
cggcuggguuggcaaug

SEQ ID NO: 1945938 - RNA, 20 nt, Shigella flexneri 2a str. 2457T
cggcugcugauguucgccag

SEQ ID NO: 1945939 - RNA, 18 nt, Shigella flexneri 2a str. 2457T
cggcugcuucggucagca

SEQ ID NO: 1945940 - RNA, 19 nt, Shigella flexneri 2a str. 2457T
cuaaauccgccaucaacac

SEQ ID NO: 1945941 - RNA, 19 nt, Shigella flexneri 2a str. 2457T
cuaaaucuggugcuuuuuc

SEQ ID NO: 1945942 - RNA, 21 nt, Shigella flexneri 2a str. 2457T
cuaaaucuggugcuuuuucaa

SEQ ID NO: 1945943 - RNA, 14 nt, Shigella flexneri 2a str. 2457T
cuaaauguucaaua

SEQ ID NO: 1945944 - RNA, 19 nt, Shigella flexneri 2a str. 2457T
cuaaagccugcuuugacaa

SEQ ID NO: 1945945 - RNA, 16 nt, Shigella flexneri 2a str. 2457T
cuaaaggcaaaaugcc

SEQ ID NO: 1945946 - RNA, 18 nt, Shigella flexneri 2a str. 2457T
cuaaagcacccagcaauc

SEQ ID NO: 1945947 - RNA, 17 nt, Shigella flexneri 2a str. 2457T
cuaaagaagccgccaga

SEQ ID NO: 1945948 - RNA, 16 nt, Shigella flexneri 2a str. 2457T
cuaaacguuuaaaaac

SEQ ID NO: 1945949 - RNA, 11 nt, Shigella flexneri 2a str. 2457T
cuaaacgcugg

SEQ ID NO: 1945950 - RNA, 20 nt, Shigella flexneri 2a str. 2457T
cuaaaaaguuauaaauaaaa

SEQ ID NO: 1945951 - RNA, 15 nt, Shigella flexneri 2a str. 2457T
cuaaaaauugcagac

SEQ ID NO: 1945952 - RNA, 18 nt, Shigella flexneri 2a str. 2457T
cuaaaaauugcagacccg

SEQ ID NO: 1945953 - RNA, 22 nt, Shigella flexneri 2a str. 2457T
cguuucuucgacacguuccuca

SEQ ID NO: 1945954 - RNA, 12 nt, Shigella flexneri 2a str. 2457T
cguuucuuuuuc

SEQ ID NO: 1945955 - RNA, 17 nt, Shigella flexneri 2a str. 2457T
cguuuccagcaguucca

SEQ ID NO: 1945956 - RNA, 17 nt, Shigella flexneri 2a str. 2457T
cguuuccagcaccaguu

SEQ ID NO: 1945957 - RNA, 20 nt, Shigella flexneri 2a str. 2457T
cguuucagauuguugacaaa

SEQ ID NO: 1945958 - RNA, 16 nt, Shigella flexneri 2a str. 2457T
cguuggucucaagcaa

SEQ ID NO: 1945959 - RNA, 18 nt, Shigella flexneri 2a str. 2457T
cguuggucucaagcaagu

SEQ ID NO: 1945960 - RNA, 18 nt, Shigella flexneri 2a str. 2457T
cguuuaugaucaucaagg

SEQ ID NO: 1945961 - RNA, 16 nt, Shigella flexneri 2a str. 2457T
cguuuaugcagguucu

SEQ ID NO: 1945962 - RNA, 16 nt, Shigella flexneri 2a str. 2457T
cguuuaaucacaccau

SEQ ID NO: 1945963 - RNA, 19 nt, Shigella flexneri 2a str. 2457T
cguuuaaucacaccauuga

SEQ ID NO: 1945964 - RNA, 17 nt, Shigella flexneri 2a str. 2457T
cguugcguugcagcagg

SEQ ID NO: 1945965 - RNA, 12 nt, Shigella flexneri 2a str. 2457T
cguugcucagaa

SEQ ID NO: 1945966 - RNA, 20 nt, Shigella flexneri 2a str. 2457T
cguugccggauauacccgcc

SEQ ID NO: 1945967 - RNA, 21 nt, Shigella flexneri 2a str. 2457T
cguuaagacuuuuuucauggg

SEQ ID NO: 1945968 - RNA, 20 nt, Shigella flexneri 2a str. 2457T
cguuaagaaaacggaagcuc

SEQ ID NO: 1945969 - RNA, 20 nt, Shigella flexneri 2a str. 2457T
cguuaaauucuaauguuaaa

SEQ ID NO: 1945970 - RNA, 22 nt, Shigella flexneri 2a str. 2457T
cguucgaugcggcucagccaga

SEQ ID NO: 1945971 - RNA, 17 nt, Shigella flexneri 2a str. 2457T
cguucgauggcgcgcca

SEQ ID NO: 1945972 - RNA, 24 nt, Shigella flexneri 2a str. 2457T
cguucgcggggcuaccgccagacc

SEQ ID NO: 1945973 - RNA, 17 nt, Shigella flexneri 2a str. 2457T
cguuccauggcaggagu

SEQ ID NO: 1945974 - RNA, 13 nt, Shigella flexneri 2a str. 2457T
cguuccaccgcuc

SEQ ID NO: 1945975 - RNA, 19 nt, Shigella flexneri 2a str. 2457T
cguugagagguaaaaccug

SEQ ID NO: 1945976 - RNA, 14 nt, Shigella flexneri 2a str. 2457T
cguugaaagauaau

SEQ ID NO: 1945977 - RNA, 13 nt, Shigella flexneri 2a str. 2457T
cguugaccagcau

SEQ ID NO: 1945978 - RNA, 16 nt, Shigella flexneri 2a str. 2457T
cguugaccagcauccc

SEQ ID NO: 1945979 - RNA, 21 nt, Shigella flexneri 2a str. 2457T
cguugaccugaauacccgcau

SEQ ID NO: 1945980 - RNA, 12 nt, Shigella flexneri 2a str. 2457T
cguucuuccugu

SEQ ID NO: 1945981 - RNA, 13 nt, Shigella flexneri 2a str. 2457T
cguucuucccucc

SEQ ID NO: 1945982 - RNA, 16 nt, Shigella flexneri 2a str. 2457T
cguucugaucuuucuu

SEQ ID NO: 1945983 - RNA, 22 nt, Shigella flexneri 2a str. 2457T
cguguugcaccgaguucuucac

SEQ ID NO: 1945984 - RNA, 15 nt, Shigella flexneri 2a str. 2457T
cguguucugaauaaa

SEQ ID NO: 1945985 - RNA, 17 nt, Shigella flexneri 2a str. 2457T
cguguugaggaagcgca

SEQ ID NO: 1945986 - RNA, 18 nt, Shigella flexneri 2a str. 2457T
cguuaaaacuaaaaacag

SEQ ID NO: 1945987 - RNA, 17 nt, Shigella flexneri 2a str. 2457T
cguguuuccgggccgaa

SEQ ID NO: 1945988 - RNA, 14 nt, Shigella flexneri 2a str. 2457T
cguguuaauuaccu

SEQ ID NO: 1945989 - RNA, 21 nt, Shigella flexneri 2a str. 2457T
cgugucggacggaauuugaaa

SEQ ID NO: 1945990 - RNA, 18 nt, Shigella flexneri 2a str. 2457T
cguggugauaccagacca

SEQ ID NO: 1945991 - RNA, 19 nt, Shigella flexneri 2a str. 2457T
cgugguucauaugauucau

SEQ ID NO: 1945992 - RNA, 21 nt, Shigella flexneri 2a str. 2457T
cgugucauaacuggucaucaa

SEQ ID NO: 1945993 - RNA, 19 nt, Shigella flexneri 2a str. 2457T
cguggagcaacacgccagc

SEQ ID NO: 1945994 - RNA, 16 nt, Shigella flexneri 2a str. 2457T
cgugcuaacguuuagu

SEQ ID NO: 1945995 - RNA, 15 nt, Shigella flexneri 2a str. 2457T
cguggcgcagugccu

SEQ ID NO: 1945996 - RNA, 19 nt, Shigella flexneri 2a str. 2457T
cguggcgagcgauaaccca

SEQ ID NO: 1945997 - RNA, 20 nt, Shigella flexneri 2a str. 2457T
cguggcgauaaucagcgcca

SEQ ID NO: 1945998 - RNA, 13 nt, Shigella flexneri 2a str. 2457T
cguggcgcagugc

SEQ ID NO: 1945999 - RNA, 14 nt, Shigella flexneri 2a str. 2457T
cguggccuccaaaa

SEQ ID NO: 1946000 - RNA, 20 nt, Shigella flexneri 2a str. 2457T
cgugguaagaaggcccauga

SEQ ID NO: 1946001 - RNA, 20 nt, Shigella flexneri 2a str. 2457T
cgugauccaccccugauuaa

SEQ ID NO: 1946002 - RNA, 20 nt, Shigella flexneri 2a str. 2457T
cgugaguuuuuguccccuca

SEQ ID NO: 1946003 - RNA, 20 nt, Shigella flexneri 2a str. 2457T
cgugcacgaacgguccccuc

SEQ ID NO: 1946004 - RNA, 16 nt, Shigella flexneri 2a str. 2457T
cgugcacugaaauuuu

SEQ ID NO: 1946005 - RNA, 17 nt, Shigella flexneri 2a str. 2457T
cgugccagagcaucuac

SEQ ID NO: 1946006 - RNA, 17 nt, Shigella flexneri 2a str. 2457T
cgugcgggcaucaucuu

SEQ ID NO: 1946007 - RNA, 20 nt, Shigella flexneri 2a str. 2457T
cgugcguuccacccacggcg

SEQ ID NO: 1946008 - RNA, 14 nt, Shigella flexneri 2a str. 2457T
cgugcguuuguagg

SEQ ID NO: 1946009 - RNA, 19 nt, Shigella flexneri 2a str. 2457T
cgugcggccguuccauuca

SEQ ID NO: 1946010 - RNA, 19 nt, Shigella flexneri 2a str. 2457T
cgugcccaacugccugaug

SEQ ID NO: 1946011 - RNA, 18 nt, Shigella flexneri 2a str. 2457T
cgugccaggaccauucac

SEQ ID NO: 1946012 - RNA, 23 nt, Shigella flexneri 2a str. 2457T
cgugccagauguuugaacugggc

SEQ ID NO: 1946013 - RNA, 13 nt, Shigella flexneri 2a str. 2457T
cgucgccuucaac

SEQ ID NO: 1946014 - RNA, 20 nt, Shigella flexneri 2a str. 2457T
cgucgcaauacccugaccca

SEQ ID NO: 1946015 - RNA, 13 nt, Shigella flexneri 2a str. 2457T
cgucgcacccggc

SEQ ID NO: 1946016 - RNA, 20 nt, Shigella flexneri 2a str. 2457T
cgucucugguuuuacaacgu

SEQ ID NO: 1946017 - RNA, 19 nt, Shigella flexneri 2a str. 2457T
cgucuguuuuaucucccug

SEQ ID NO: 1946018 - RNA, 18 nt, Shigella flexneri 2a str. 2457T
cgucugcgccaccacaac

SEQ ID NO: 1946019 - RNA, 19 nt, Shigella flexneri 2a str. 2457T
cgucugccggaacugauga

SEQ ID NO: 1946020 - RNA, 15 nt, Shigella flexneri 2a str. 2457T
cgucugacggccuuc

SEQ ID NO: 1946021 - RNA, 18 nt, Shigella flexneri 2a str. 2457T
cgugaacgugggucuguc

SEQ ID NO: 1946022 - RNA, 23 nt, Shigella flexneri 2a str. 2457T
cgugaacggcuucgccuccuguu

SEQ ID NO: 1946023 - RNA, 17 nt, Shigella flexneri 2a str. 2457T
cgugaccgccagaacac

SEQ ID NO: 1946024 - RNA, 20 nt, Shigella flexneri 2a str. 2457T
cgugaacgccuaauccagcc

SEQ ID NO: 1946025 - RNA, 15 nt, Shigella flexneri 2a str. 2457T
cgugaaaaaucaaua

SEQ ID NO: 1946026 - RNA, 13 nt, Shigella flexneri 2a str. 2457T
cgucuuuuuucac

SEQ ID NO: 1946027 - RNA, 20 nt, Shigella flexneri 2a str. 2457T
cgucuuaucuggccuacaga

SEQ ID NO: 1946028 - RNA, 15 nt, Shigella flexneri 2a str. 2457T
cgucuucccgcagcc

SEQ ID NO: 1946029 - RNA, 14 nt, Shigella flexneri 2a str. 2457T
cgucuucccgcagc

SEQ ID NO: 1946030 - RNA, 18 nt, Shigella flexneri 2a str. 2457T
cgguucgacggcuggaca

SEQ ID NO: 1946031 - RNA, 13 nt, Shigella flexneri 2a str. 2457T
cgguucgccauca

SEQ ID NO: 1946032 - RNA, 22 nt, Shigella flexneri 2a str. 2457T
cgguugaugccguuccacccag

SEQ ID NO: 1946033 - RNA, 15 nt, Shigella flexneri 2a str. 2457T
cgguguucacucauc

SEQ ID NO: 1946034 - RNA, 23 nt, Shigella flexneri 2a str. 2457T
cgguuagaacaauuaacccgcga

SEQ ID NO: 1946035 - RNA, 17 nt, Shigella flexneri 2a str. 2457T
cgguuagcucaacgcau

SEQ ID NO: 1946036 - RNA, 23 nt, Shigella flexneri 2a str. 2457T
cgguucaauaucuuccuggcgcu

SEQ ID NO: 1946037 - RNA, 17 nt, Shigella flexneri 2a str. 2457T
cgguucaauaucuuccu

SEQ ID NO: 1946038 - RNA, 14 nt, Shigella flexneri 2a str. 2457T
cgguugggccaccg

SEQ ID NO: 1946039 - RNA, 15 nt, Shigella flexneri 2a str. 2457T
cgguugggccaccga

SEQ ID NO: 1946040 - RNA, 15 nt, Shigella flexneri 2a str. 2457T
cgguugcugaacagc

SEQ ID NO: 1946041 - RNA, 19 nt, Shigella flexneri 2a str. 2457T
cgguugcggaacccagcgc

SEQ ID NO: 1946042 - RNA, 12 nt, Shigella flexneri 2a str. 2457T
cgguugccauaa

SEQ ID NO: 1946043 - RNA, 23 nt, Shigella flexneri 2a str. 2457T
cgguuuauccauccccagagcac

SEQ ID NO: 1946044 - RNA, 17 nt, Shigella flexneri 2a str. 2457T
cgguuuauccccaagga

SEQ ID NO: 1946045 - RNA, 15 nt, Shigella flexneri 2a str. 2457T
cgguuuaucucaucu

SEQ ID NO: 1946046 - RNA, 14 nt, Shigella flexneri 2a str. 2457T
cgguuuacccugcu

SEQ ID NO: 1946047 - RNA, 15 nt, Shigella flexneri 2a str. 2457T
cgguuucaauccagg

SEQ ID NO: 1946048 - RNA, 18 nt, Shigella flexneri 2a str. 2457T
cgguuucaauuucccgcu

SEQ ID NO: 1946049 - RNA, 18 nt, Shigella flexneri 2a str. 2457T
cgguuucaguggggcagg

SEQ ID NO: 1946050 - RNA, 14 nt, Shigella flexneri 2a str. 2457T
cgguuucucuucug

SEQ ID NO: 1946051 - RNA, 16 nt, Shigella flexneri 2a str. 2457T
cgguuucucuucugcu

SEQ ID NO: 1946052 - RNA, 20 nt, Shigella flexneri 2a str. 2457T
cguaaaagccuggaccauau

SEQ ID NO: 1946053 - RNA, 21 nt, Shigella flexneri 2a str. 2457T
cguaaaaccguguugaggcca

SEQ ID NO: 1946054 - RNA, 15 nt, Shigella flexneri 2a str. 2457T
cguaaacaacuggcg

SEQ ID NO: 1946055 - RNA, 18 nt, Shigella flexneri 2a str. 2457T
cguaaaccacugacacag

SEQ ID NO: 1946056 - RNA, 14 nt, Shigella flexneri 2a str. 2457T
cgguuuucaucauc

SEQ ID NO: 1946057 - RNA, 19 nt, Shigella flexneri 2a str. 2457T
cgguuuuguugccgcccgu

SEQ ID NO: 1946058 - RNA, 18 nt, Shigella flexneri 2a str. 2457T
cguaaaaacggauuucau

SEQ ID NO: 1946059 - RNA, 11 nt, Shigella flexneri 2a str. 2457T
cguaaaaaaug

SEQ ID NO: 1946060 - RNA, 18 nt, Shigella flexneri 2a str. 2457T
cguaaaucgucaguagcg

SEQ ID NO: 1946061 - RNA, 18 nt, Shigella flexneri 2a str. 2457T
cguaaauucaauauauug

SEQ ID NO: 1946062 - RNA, 14 nt, Shigella flexneri 2a str. 2457T
cguaaaucccgcca

SEQ ID NO: 1946063 - RNA, 18 nt, Shigella flexneri 2a str. 2457T
cguaaagcgucgcaucag

SEQ ID NO: 1946064 - RNA, 19 nt, Shigella flexneri 2a str. 2457T
cguaaaggcggcagaacag

SEQ ID NO: 1946065 - RNA, 20 nt, Shigella flexneri 2a str. 2457T
cguaaaggcggcagaacaga

SEQ ID NO: 1946066 - RNA, 15 nt, Shigella flexneri 2a str. 2457T
cguaacgaccaccac

SEQ ID NO: 1946067 - RNA, 20 nt, Shigella flexneri 2a str. 2457T
cguaacgaccaccaccgcag

SEQ ID NO: 1946068 - RNA, 14 nt, Shigella flexneri 2a str. 2457T
cguaacauauuccc

SEQ ID NO: 1946069 - RNA, 13 nt, Shigella flexneri 2a str. 2457T
cguaacaaaacuc

SEQ ID NO: 1946070 - RNA, 13 nt, Shigella flexneri 2a str. 2457T
cguaaccaaucac

SEQ ID NO: 1946071 - RNA, 22 nt, Shigella flexneri 2a str. 2457T
cguaacgccacgauagagagca

SEQ ID NO: 1946072 - RNA, 17 nt, Shigella flexneri 2a str. 2457T
cguaagcaacgccaaau

SEQ ID NO: 1946073 - RNA, 18 nt, Shigella flexneri 2a str. 2457T
cguaagaaaguggcaggc

SEQ ID NO: 1946074 - RNA, 14 nt, Shigella flexneri 2a str. 2457T
cggugcacuccgcc

SEQ ID NO: 1946075 - RNA, 15 nt, Shigella flexneri 2a str. 2457T
cggugauuuccgccg

SEQ ID NO: 1946076 - RNA, 22 nt, Shigella flexneri 2a str. 2457T
cggugcaacccgccagguuuca

SEQ ID NO: 1946077 - RNA, 22 nt, Shigella flexneri 2a str. 2457T
cggugauuuccgccgccagcag

SEQ ID NO: 1946078 - RNA, 19 nt, Shigella flexneri 2a str. 2457T
cggugauguuuaucgucug

SEQ ID NO: 1946079 - RNA, 19 nt, Shigella flexneri 2a str. 2457T
cggugccauugaccagcug

SEQ ID NO: 1946080 - RNA, 18 nt, Shigella flexneri 2a str. 2457T
cggugccaaagucaucaa

SEQ ID NO: 1946081 - RNA, 16 nt, Shigella flexneri 2a str. 2457T
cggugcaucuucacac

SEQ ID NO: 1946082 - RNA, 13 nt, Shigella flexneri 2a str. 2457T
cggugcgagcgcc

SEQ ID NO: 1946083 - RNA, 23 nt, Shigella flexneri 2a str. 2457T
cggugccgcgauaccacccgcag

SEQ ID NO: 1946084 - RNA, 23 nt, Shigella flexneri 2a str. 2457T
cggugcggcucucuuucuccagc

SEQ ID NO: 1946085 - RNA, 15 nt, Shigella flexneri 2a str. 2457T
cggugcuccagugcg

SEQ ID NO: 1946086 - RNA, 21 nt, Shigella flexneri 2a str. 2457T
cggugcucaucagcccggcaa

SEQ ID NO: 1946087 - RNA, 23 nt, Shigella flexneri 2a str. 2457T
cgguguaaccaucaaaacgcugg

SEQ ID NO: 1946088 - RNA, 19 nt, Shigella flexneri 2a str. 2457T
cggugguguaaccuucacc

SEQ ID NO: 1946089 - RNA, 21 nt, Shigella flexneri 2a str. 2457T
cgguguuucgacgacaacgcg

SEQ ID NO: 1946090 - RNA, 22 nt, Shigella flexneri 2a str. 2457T
cgguguuguuggucaggaaacu

SEQ ID NO: 1946091 - RNA, 18 nt, Shigella flexneri 2a str. 2457T
cgguguugccgaagcagc

SEQ ID NO: 1946092 - RNA, 15 nt, Shigella flexneri 2a str. 2457T
cgguguccacuuccg

SEQ ID NO: 1946093 - RNA, 23 nt, Shigella flexneri 2a str. 2457T
cgguggcaguagcgccucuucca

SEQ ID NO: 1946094 - RNA, 18 nt, Shigella flexneri 2a str. 2457T
cgguggcguuuccagcag

SEQ ID NO: 1946095 - RNA, 13 nt, Shigella flexneri 2a str. 2457T
cggugggcugaca

SEQ ID NO: 1946096 - RNA, 16 nt, Shigella flexneri 2a str. 2457T
cgucacggacucggcg

SEQ ID NO: 1946097 - RNA, 17 nt, Shigella flexneri 2a str. 2457T
cgucagccacuccacug

SEQ ID NO: 1946098 - RNA, 23 nt, Shigella flexneri 2a str. 2457T
cgucagccacuucuuccagcggc

SEQ ID NO: 1946099 - RNA, 23 nt, Shigella flexneri 2a str. 2457T
cgucacgguaauaacacucggcg

SEQ ID NO: 1946100 - RNA, 18 nt, Shigella flexneri 2a str. 2457T
cgucagugucuuaucugg

SEQ ID NO: 1946101 - RNA, 23 nt, Shigella flexneri 2a str. 2457T
cgucagugucuuaucuggcauuu

SEQ ID NO: 1946102 - RNA, 21 nt, Shigella flexneri 2a str. 2457T
cgucagucacaccgcgcgucc

SEQ ID NO: 1946103 - RNA, 18 nt, Shigella flexneri 2a str. 2457T
cgucaguagcgcaaucac

SEQ ID NO: 1946104 - RNA, 17 nt, Shigella flexneri 2a str. 2457T
cgucaguaaccgcuuuu

SEQ ID NO: 1946105 - RNA, 21 nt, Shigella flexneri 2a str. 2457T
cgucagcggcaauucuuucuc

SEQ ID NO: 1946106 - RNA, 18 nt, Shigella flexneri 2a str. 2457T
cgucaagcgucgcaucag

SEQ ID NO: 1946107 - RNA, 17 nt, Shigella flexneri 2a str. 2457T
cgucaaccugaccaaau

SEQ ID NO: 1946108 - RNA, 20 nt, Shigella flexneri 2a str. 2457T
cgucaacagcguuucuucga

SEQ ID NO: 1946109 - RNA, 18 nt, Shigella flexneri 2a str. 2457T
cgucaaauaauuccugcg

SEQ ID NO: 1946110 - RNA, 21 nt, Shigella flexneri 2a str. 2457T
cgucaacaccgggugcagaca

SEQ ID NO: 1946111 - RNA, 19 nt, Shigella flexneri 2a str. 2457T
cgucacaggcacaccgccg

SEQ ID NO: 1946112 - RNA, 13 nt, Shigella flexneri 2a str. 2457T
cgucacaccuuca

SEQ ID NO: 1946113 - RNA, 23 nt, Shigella flexneri 2a str. 2457T
cgucacagcggcuuccaccgccg

SEQ ID NO: 1946114 - RNA, 18 nt, Shigella flexneri 2a str. 2457T
cguaaucuuuucauauua

SEQ ID NO: 1946115 - RNA, 13 nt, Shigella flexneri 2a str. 2457T
cguagcgcaucag

SEQ ID NO: 1946116 - RNA, 18 nt, Shigella flexneri 2a str. 2457T
cguaaucccggauaucac

SEQ ID NO: 1946117 - RNA, 21 nt, Shigella flexneri 2a str. 2457T
cguaauaguuucugacauuuu

SEQ ID NO: 1946118 - RNA, 17 nt, Shigella flexneri 2a str. 2457T
cguaauacccuugcaga

SEQ ID NO: 1946119 - RNA, 13 nt, Shigella flexneri 2a str. 2457T
cguaaguaagaua

SEQ ID NO: 1946120 - RNA, 12 nt, Shigella flexneri 2a str. 2457T
cguauuaauucc

SEQ ID NO: 1946121 - RNA, 18 nt, Shigella flexneri 2a str. 2457T
cguaugucgaucacccaa

SEQ ID NO: 1946122 - RNA, 18 nt, Shigella flexneri 2a str. 2457T
cguauguucccaccagcc

SEQ ID NO: 1946123 - RNA, 18 nt, Shigella flexneri 2a str. 2457T
cguauucaacgguaaguu

SEQ ID NO: 1946124 - RNA, 13 nt, Shigella flexneri 2a str. 2457T
cgucaaaaucauc

SEQ ID NO: 1946125 - RNA, 18 nt, Shigella flexneri 2a str. 2457T
cguauaauaucuuuucuu

SEQ ID NO: 1946126 - RNA, 14 nt, Shigella flexneri 2a str. 2457T
cguaugcauaauuu

SEQ ID NO: 1946127 - RNA, 14 nt, Shigella flexneri 2a str. 2457T
cguaugcccagcgc

SEQ ID NO: 1946128 - RNA, 15 nt, Shigella flexneri 2a str. 2457T
cguccccaucaggaa

SEQ ID NO: 1946129 - RNA, 17 nt, Shigella flexneri 2a str. 2457T
cgucccacgaccgcagc

SEQ ID NO: 1946130 - RNA, 17 nt, Shigella flexneri 2a str. 2457T
cgucccaugaugcgcgg

SEQ ID NO: 1946131 - RNA, 16 nt, Shigella flexneri 2a str. 2457T
cguccgguuuacuucc

SEQ ID NO: 1946132 - RNA, 20 nt, Shigella flexneri 2a str. 2457T
cguccggcaucgcaaaccag

SEQ ID NO: 1946133 - RNA, 18 nt, Shigella flexneri 2a str. 2457T
cgucauauuacugcaacu

SEQ ID NO: 1946134 - RNA, 17 nt, Shigella flexneri 2a str. 2457T
cgucauacugcucagac

SEQ ID NO: 1946135 - RNA, 18 nt, Shigella flexneri 2a str. 2457T
cguccaguuucacuuuca

SEQ ID NO: 1946136 - RNA, 23 nt, Shigella flexneri 2a str. 2457T
cgucgauuguuauaccaguccac

SEQ ID NO: 1946137 - RNA, 14 nt, Shigella flexneri 2a str. 2457T
cgucgauugcucaa

SEQ ID NO: 1946138 - RNA, 22 nt, Shigella flexneri 2a str. 2457T
cgucgauuguuauaccagucca

SEQ ID NO: 1946139 - RNA, 15 nt, Shigella flexneri 2a str. 2457T
cguccucuucccaga

SEQ ID NO: 1946140 - RNA, 23 nt, Shigella flexneri 2a str. 2457T
cucggcugacgauaccaggugug

SEQ ID NO: 1946141 - RNA, 19 nt, Shigella flexneri 2a str. 2457T
cucggucuggacagacugg

SEQ ID NO: 1946142 - RNA, 15 nt, Shigella flexneri 2a str. 2457T
cucgucagcuuauuc

SEQ ID NO: 1946143 - RNA, 14 nt, Shigella flexneri 2a str. 2457T
cucguaaugcuccg

SEQ ID NO: 1946144 - RNA, 17 nt, Shigella flexneri 2a str. 2457T
cucguaucaccccgccc

SEQ ID NO: 1946145 - RNA, 19 nt, Shigella flexneri 2a str. 2457T
cucguagcugguaccuuga

SEQ ID NO: 1946146 - RNA, 23 nt, Shigella flexneri 2a str. 2457T
cucguauuccgcguuacccauuc

SEQ ID NO: 1946147 - RNA, 18 nt, Shigella flexneri 2a str. 2457T
cucgucacaucaccaaca

SEQ ID NO: 1946148 - RNA, 19 nt, Shigella flexneri 2a str. 2457T
cucgcucgagagagaaaau

SEQ ID NO: 1946149 - RNA, 19 nt, Shigella flexneri 2a str. 2457T
cucgcuccauuccaucgcc

SEQ ID NO: 1946150 - RNA, 20 nt, Shigella flexneri 2a str. 2457T
cucgcucuuguucuuccggc

SEQ ID NO: 1946151 - RNA, 18 nt, Shigella flexneri 2a str. 2457T
cucgcguucuguugccgc

SEQ ID NO: 1946152 - RNA, 21 nt, Shigella flexneri 2a str. 2457T
cucgcguucgauggcgcgcca

SEQ ID NO: 1946153 - RNA, 18 nt, Shigella flexneri 2a str. 2457T
cucggauaaggcuucccg

SEQ ID NO: 1946154 - RNA, 14 nt, Shigella flexneri 2a str. 2457T
cucggauaaggcuu

SEQ ID NO: 1946155 - RNA, 15 nt, Shigella flexneri 2a str. 2457T
cucggcaaagcgcug

SEQ ID NO: 1946156 - RNA, 13 nt, Shigella flexneri 2a str. 2457T
cucggcagaugag

SEQ ID NO: 1946157 - RNA, 14 nt, Shigella flexneri 2a str. 2457T
cucucgacccgaca

SEQ ID NO: 1946158 - RNA, 14 nt, Shigella flexneri 2a str. 2457T
cucucgggcaguaa

SEQ ID NO: 1946159 - RNA, 17 nt, Shigella flexneri 2a str. 2457T
cucucgggcaguaaauc

SEQ ID NO: 1946160 - RNA, 21 nt, Shigella flexneri 2a str. 2457T
cucucgggcaguaaaucaaua

SEQ ID NO: 1946161 - RNA, 23 nt, Shigella flexneri 2a str. 2457T
cucucgucugccggaacugauga

SEQ ID NO: 1946162 - RNA, 21 nt, Shigella flexneri 2a str. 2457T
cucucugaaguagccaguacc

SEQ ID NO: 1946163 - RNA, 13 nt, Shigella flexneri 2a str. 2457T
cucucugagccag

SEQ ID NO: 1946164 - RNA, 20 nt, Shigella flexneri 2a str. 2457T
cucucuggccgcuuccagca

SEQ ID NO: 1946165 - RNA, 18 nt, Shigella flexneri 2a str. 2457T
cucucuucaaacgcuucu

SEQ ID NO: 1946166 - RNA, 12 nt, Shigella flexneri 2a str. 2457T
cucucuucgcug

SEQ ID NO: 1946167 - RNA, 18 nt, Shigella flexneri 2a str. 2457T
cucucuuucuccagcgua

SEQ ID NO: 1946168 - RNA, 12 nt, Shigella flexneri 2a str. 2457T
cucugcugccac

SEQ ID NO: 1946169 - RNA, 21 nt, Shigella flexneri 2a str. 2457T
cucugccguaccaucgccagc

SEQ ID NO: 1946170 - RNA, 21 nt, Shigella flexneri 2a str. 2457T
cucugccagacgguaaccccu

SEQ ID NO: 1946171 - RNA, 15 nt, Shigella flexneri 2a str. 2457T
cucugauuacccuuc

SEQ ID NO: 1946172 - RNA, 22 nt, Shigella flexneri 2a str. 2457T
cucugauugccuuccaccagau

SEQ ID NO: 1946173 - RNA, 16 nt, Shigella flexneri 2a str. 2457T
cucugcaaauauuaau

SEQ ID NO: 1946174 - RNA, 17 nt, Shigella flexneri 2a str. 2457T
cucuauggcaccuguug

SEQ ID NO: 1946175 - RNA, 19 nt, Shigella flexneri 2a str. 2457T
cucgucgcgcacgcccauc

SEQ ID NO: 1946176 - RNA, 11 nt, Shigella flexneri 2a str. 2457T
cucuccuuucg

SEQ ID NO: 1946177 - RNA, 21 nt, Shigella flexneri 2a str. 2457T
cucucccgaaugaccgccccu

SEQ ID NO: 1946178 - RNA, 14 nt, Shigella flexneri 2a str. 2457T
cucuccguaggcca

SEQ ID NO: 1946179 - RNA, 13 nt, Shigella flexneri 2a str. 2457T
cucucaaaccccg

SEQ ID NO: 1946180 - RNA, 19 nt, Shigella flexneri 2a str. 2457T
cucucaccacgcuccauca

SEQ ID NO: 1946181 - RNA, 22 nt, Shigella flexneri 2a str. 2457T
cucucaaucucuuuuuccaccg

SEQ ID NO: 1946182 - RNA, 22 nt, Shigella flexneri 2a str. 2457T
cucucagagagaaccucaacag

SEQ ID NO: 1946183 - RNA, 13 nt, Shigella flexneri 2a str. 2457T
cucgaguccuucc

SEQ ID NO: 1946184 - RNA, 14 nt, Shigella flexneri 2a str. 2457T
cucgaguccuucca

SEQ ID NO: 1946185 - RNA, 17 nt, Shigella flexneri 2a str. 2457T
cucgaguccuuccaggu

SEQ ID NO: 1946186 - RNA, 24 nt, Shigella flexneri 2a str. 2457T
cucgauacgacacgccuccuggcu

SEQ ID NO: 1946187 - RNA, 22 nt, Shigella flexneri 2a str. 2457T
cucgauacgacacgccuccugg

SEQ ID NO: 1946188 - RNA, 22 nt, Shigella flexneri 2a str. 2457T
cucgauaccagauuaauuauug

SEQ ID NO: 1946189 - RNA, 21 nt, Shigella flexneri 2a str. 2457T
cucgaggagcuggaggaccuu

SEQ ID NO: 1946190 - RNA, 15 nt, Shigella flexneri 2a str. 2457T
cucgagaaauuuuua

SEQ ID NO: 1946191 - RNA, 22 nt, Shigella flexneri 2a str. 2457T
cucgagaacacgguaaugacuc

SEQ ID NO: 1946192 - RNA, 14 nt, Shigella flexneri 2a str. 2457T
cuccuguucugugc

SEQ ID NO: 1946193 - RNA, 17 nt, Shigella flexneri 2a str. 2457T
cuccuguuaugccucaa

SEQ ID NO: 1946194 - RNA, 20 nt, Shigella flexneri 2a str. 2457T
cuccuguuuaauaugcaauu

SEQ ID NO: 1946195 - RNA, 17 nt, Shigella flexneri 2a str. 2457T
cucgaaaaccacuccug

SEQ ID NO: 1946196 - RNA, 19 nt, Shigella flexneri 2a str. 2457T
cuccuuucugagcaucaca

SEQ ID NO: 1946197 - RNA, 14 nt, Shigella flexneri 2a str. 2457T
cuccuuucuuucug

SEQ ID NO: 1946198 - RNA, 15 nt, Shigella flexneri 2a str. 2457T
cucgaaguuuuccuc

SEQ ID NO: 1946199 - RNA, 18 nt, Shigella flexneri 2a str. 2457T
cuccucugacuggacucg

SEQ ID NO: 1946200 - RNA, 17 nt, Shigella flexneri 2a str. 2457T
cuccugaacuuucuccc

SEQ ID NO: 1946201 - RNA, 14 nt, Shigella flexneri 2a str. 2457T
cuccucuucacguu

SEQ ID NO: 1946202 - RNA, 18 nt, Shigella flexneri 2a str. 2457T
cuccucuuucaucucccg

SEQ ID NO: 1946203 - RNA, 17 nt, Shigella flexneri 2a str. 2457T
cuccggcgcauccauga

SEQ ID NO: 1946204 - RNA, 18 nt, Shigella flexneri 2a str. 2457T
cuccucgcgaaucuccac

SEQ ID NO: 1946205 - RNA, 19 nt, Shigella flexneri 2a str. 2457T
cuccugcuaugcuuaagaa

SEQ ID NO: 1946206 - RNA, 22 nt, Shigella flexneri 2a str. 2457T
cuccugcuaugcuuaagaaauu

SEQ ID NO: 1946207 - RNA, 15 nt, Shigella flexneri 2a str. 2457T
cuccuggaucacaau

SEQ ID NO: 1946208 - RNA, 22 nt, Shigella flexneri 2a str. 2457T
cuccuguaucgucacugguuca

SEQ ID NO: 1946209 - RNA, 18 nt, Shigella flexneri 2a str. 2457T
cuccugucuucccugcug

SEQ ID NO: 1946210 - RNA, 19 nt, Shigella flexneri 2a str. 2457T
cuccugucaguauaacuac

SEQ ID NO: 1946211 - RNA, 22 nt, Shigella flexneri 2a str. 2457T
cuccuggcgguuaauaaugauu

SEQ ID NO: 1946212 - RNA, 23 nt, Shigella flexneri 2a str. 2457T
cuccuggcgguuaauaaugauuu

SEQ ID NO: 1946213 - RNA, 18 nt, Shigella flexneri 2a str. 2457T
cuccuggcgguuaauaau

SEQ ID NO: 1946214 - RNA, 19 nt, Shigella flexneri 2a str. 2457T
cuccugcaacagguugcgc

SEQ ID NO: 1946215 - RNA, 15 nt, Shigella flexneri 2a str. 2457T
cuccugauaacacag

SEQ ID NO: 1946216 - RNA, 16 nt, Shigella flexneri 2a str. 2457T
cuccugauaacacaga

SEQ ID NO: 1946217 - RNA, 21 nt, Shigella flexneri 2a str. 2457T
cuccugccaccacugcaauga

SEQ ID NO: 1946218 - RNA, 16 nt, Shigella flexneri 2a str. 2457T
cuccaguaccugcaaa

SEQ ID NO: 1946219 - RNA, 15 nt, Shigella flexneri 2a str. 2457T
cuccagucgcgugug

SEQ ID NO: 1946220 - RNA, 16 nt, Shigella flexneri 2a str. 2457T
cuccagguccuccugu

SEQ ID NO: 1946221 - RNA, 21 nt, Shigella flexneri 2a str. 2457T
cuccauacaucuucaucaucc

SEQ ID NO: 1946222 - RNA, 19 nt, Shigella flexneri 2a str. 2457T
cuccaguuuguucagcugc

SEQ ID NO: 1946223 - RNA, 11 nt, Shigella flexneri 2a str. 2457T
cuccauccagc

SEQ ID NO: 1946224 - RNA, 19 nt, Shigella flexneri 2a str. 2457T
cuccauccagcaacaacag

SEQ ID NO: 1946225 - RNA, 22 nt, Shigella flexneri 2a str. 2457T
cuccauccgggaucacaucaua

SEQ ID NO: 1946226 - RNA, 17 nt, Shigella flexneri 2a str. 2457T
cuccauccccagcucuu

SEQ ID NO: 1946227 - RNA, 16 nt, Shigella flexneri 2a str. 2457T
cuccagcgccgccaga

SEQ ID NO: 1946228 - RNA, 18 nt, Shigella flexneri 2a str. 2457T
cucaugggaccgcuacca

SEQ ID NO: 1946229 - RNA, 17 nt, Shigella flexneri 2a str. 2457T
cucaugggucugcggau

SEQ ID NO: 1946230 - RNA, 13 nt, Shigella flexneri 2a str. 2457T
cuccagcuauaac

SEQ ID NO: 1946231 - RNA, 19 nt, Shigella flexneri 2a str. 2457T
cuccccuuucuuauuuuuc

SEQ ID NO: 1946232 - RNA, 23 nt, Shigella flexneri 2a str. 2457T
cuccccuuucuuauuuuucugca

SEQ ID NO: 1946233 - RNA, 15 nt, Shigella flexneri 2a str. 2457T
cucccugccccaucu

SEQ ID NO: 1946234 - RNA, 23 nt, Shigella flexneri 2a str. 2457T
cucccucgucggugguggucccu

SEQ ID NO: 1946235 - RNA, 17 nt, Shigella flexneri 2a str. 2457T
cucccgcaggagcgccg

SEQ ID NO: 1946236 - RNA, 13 nt, Shigella flexneri 2a str. 2457T
cucccgaaaaacc

SEQ ID NO: 1946237 - RNA, 18 nt, Shigella flexneri 2a str. 2457T
cucccgaaugaccgcccc

SEQ ID NO: 1946238 - RNA, 19 nt, Shigella flexneri 2a str. 2457T
cucccgaaugaccgccccu

SEQ ID NO: 1946239 - RNA, 20 nt, Shigella flexneri 2a str. 2457T
cucccgaaugaccgccccug

SEQ ID NO: 1946240 - RNA, 13 nt, Shigella flexneri 2a str. 2457T
cuccgcgccgccg

SEQ ID NO: 1946241 - RNA, 19 nt, Shigella flexneri 2a str. 2457T
cuccgcgccgcgguacagc

SEQ ID NO: 1946242 - RNA, 16 nt, Shigella flexneri 2a str. 2457T
cuccgccgcaucuucc

SEQ ID NO: 1946243 - RNA, 17 nt, Shigella flexneri 2a str. 2457T
cuccgccuuugaaaaua

SEQ ID NO: 1946244 - RNA, 23 nt, Shigella flexneri 2a str. 2457T
cuccgccccggcaauaaaacagg

SEQ ID NO: 1946245 - RNA, 14 nt, Shigella flexneri 2a str. 2457T
cuccgccccggcaa

SEQ ID NO: 1946246 - RNA, 15 nt, Shigella flexneri 2a str. 2457T
cucagcaacuuccug

SEQ ID NO: 1946247 - RNA, 18 nt, Shigella flexneri 2a str. 2457T
cucagauaaaugcaaacg

SEQ ID NO: 1946248 - RNA, 16 nt, Shigella flexneri 2a str. 2457T
cucagaccauauuccc

SEQ ID NO: 1946249 - RNA, 17 nt, Shigella flexneri 2a str. 2457T
cucagaaucacgccaac

SEQ ID NO: 1946250 - RNA, 15 nt, Shigella flexneri 2a str. 2457T
cucagaaucacgcca

SEQ ID NO: 1946251 - RNA, 16 nt, Shigella flexneri 2a str. 2457T
cucagaaucacgccaa

SEQ ID NO: 1946252 - RNA, 13 nt, Shigella flexneri 2a str. 2457T
cucagguucaacc

SEQ ID NO: 1946253 - RNA, 20 nt, Shigella flexneri 2a str. 2457T
cucaggugucuggcagcgug

SEQ ID NO: 1946254 - RNA, 14 nt, Shigella flexneri 2a str. 2457T
cucaguacaggccg

SEQ ID NO: 1946255 - RNA, 17 nt, Shigella flexneri 2a str. 2457T
cucaguaaaguuaccuu

SEQ ID NO: 1946256 - RNA, 19 nt, Shigella flexneri 2a str. 2457T
cucaguugguuagagcaca

SEQ ID NO: 1946257 - RNA, 17 nt, Shigella flexneri 2a str. 2457T
cucagugaccgaaccug

SEQ ID NO: 1946258 - RNA, 19 nt, Shigella flexneri 2a str. 2457T
cucauaccuuccacuuuca

SEQ ID NO: 1946259 - RNA, 14 nt, Shigella flexneri 2a str. 2457T
cucauagaccauug

SEQ ID NO: 1946260 - RNA, 20 nt, Shigella flexneri 2a str. 2457T
cucauaauacaggcuacucc

SEQ ID NO: 1946261 - RNA, 14 nt, Shigella flexneri 2a str. 2457T
cucaucgccgccaa

SEQ ID NO: 1946262 - RNA, 18 nt, Shigella flexneri 2a str. 2457T
cucaucguaugauuaauu

SEQ ID NO: 1946263 - RNA, 20 nt, Shigella flexneri 2a str. 2457T
cucaucuuugaaaucacgca

SEQ ID NO: 1946264 - RNA, 17 nt, Shigella flexneri 2a str. 2457T
cucaucuuugaaaucac

SEQ ID NO: 1946265 - RNA, 19 nt, Shigella flexneri 2a str. 2457T
cucauauuccugcauugcu

SEQ ID NO: 1946266 - RNA, 22 nt, Shigella flexneri 2a str. 2457T
cucauagggugugacgacacca

SEQ ID NO: 1946267 - RNA, 20 nt, Shigella flexneri 2a str. 2457T
cucaucaacguuuuuuugcu

SEQ ID NO: 1946268 - RNA, 18 nt, Shigella flexneri 2a str. 2457T
cucaucaagcuguucuuc

SEQ ID NO: 1946269 - RNA, 18 nt, Shigella flexneri 2a str. 2457T
cucaucagugaacccaua

SEQ ID NO: 1946270 - RNA, 18 nt, Shigella flexneri 2a str. 2457T
cucauccauaaauaccug

SEQ ID NO: 1946271 - RNA, 14 nt, Shigella flexneri 2a str. 2457T
cucauccaucaaau

SEQ ID NO: 1946272 - RNA, 19 nt, Shigella flexneri 2a str. 2457T
cucaacggcaauuuuaccu

SEQ ID NO: 1946273 - RNA, 14 nt, Shigella flexneri 2a str. 2457T
cucaacuccccgca

SEQ ID NO: 1946274 - RNA, 14 nt, Shigella flexneri 2a str. 2457T
cucaacucacgccc

SEQ ID NO: 1946275 - RNA, 23 nt, Shigella flexneri 2a str. 2457T
cucaacugccaguucccccugcc

SEQ ID NO: 1946276 - RNA, 21 nt, Shigella flexneri 2a str. 2457T
cucaacugacugacgugauga

SEQ ID NO: 1946277 - RNA, 14 nt, Shigella flexneri 2a str. 2457T
cucaagacaauuag

SEQ ID NO: 1946278 - RNA, 14 nt, Shigella flexneri 2a str. 2457T
cucaacuuuaccuu

SEQ ID NO: 1946279 - RNA, 16 nt, Shigella flexneri 2a str. 2457T
cucaacuuuaccuuca

SEQ ID NO: 1946280 - RNA, 22 nt, Shigella flexneri 2a str. 2457T
cucaagcguugcuucacgcggg

SEQ ID NO: 1946281 - RNA, 22 nt, Shigella flexneri 2a str. 2457T
cucaagcaguugguuaaucuuu

SEQ ID NO: 1946282 - RNA, 16 nt, Shigella flexneri 2a str. 2457T
cucaagcacccgccgc

SEQ ID NO: 1946283 - RNA, 19 nt, Shigella flexneri 2a str. 2457T
cuauuaauuaugauggggc

SEQ ID NO: 1946284 - RNA, 24 nt, Shigella flexneri 2a str. 2457T
cuauuaagcuuuccggcaucacau

SEQ ID NO: 1946285 - RNA, 21 nt, Shigella flexneri 2a str. 2457T
cucaacaggcccaacuguuga

SEQ ID NO: 1946286 - RNA, 22 nt, Shigella flexneri 2a str. 2457T
cucaacaggcccaacuguugau

SEQ ID NO: 1946287 - RNA, 13 nt, Shigella flexneri 2a str. 2457T
cucaaccagauuc

SEQ ID NO: 1946288 - RNA, 18 nt, Shigella flexneri 2a str. 2457T
cucaacgacugaaccggc

SEQ ID NO: 1946289 - RNA, 13 nt, Shigella flexneri 2a str. 2457T
cucaccggauaau

SEQ ID NO: 1946290 - RNA, 18 nt, Shigella flexneri 2a str. 2457T
cucacuccggccagagca

SEQ ID NO: 1946291 - RNA, 17 nt, Shigella flexneri 2a str. 2457T
cucacuccggccagagc

SEQ ID NO: 1946292 - RNA, 18 nt, Shigella flexneri 2a str. 2457T
cucacuccagccagagcc

SEQ ID NO: 1946293 - RNA, 20 nt, Shigella flexneri 2a str. 2457T
cucacucaucacuccccgca

SEQ ID NO: 1946294 - RNA, 15 nt, Shigella flexneri 2a str. 2457T
cucacuaucgcugag

SEQ ID NO: 1946295 - RNA, 18 nt, Shigella flexneri 2a str. 2457T
cucacuacggcucaguaa

SEQ ID NO: 1946296 - RNA, 15 nt, Shigella flexneri 2a str. 2457T
cucaauauccugacc

SEQ ID NO: 1946297 - RNA, 15 nt, Shigella flexneri 2a str. 2457T
cucaauaucaucauu

SEQ ID NO: 1946298 - RNA, 17 nt, Shigella flexneri 2a str. 2457T
cucaauaucaucauuug

SEQ ID NO: 1946299 - RNA, 22 nt, Shigella flexneri 2a str. 2457T
cucacagaggucuuuucucguu

SEQ ID NO: 1946300 - RNA, 18 nt, Shigella flexneri 2a str. 2457T
cucacacuuaucuggagu

SEQ ID NO: 1946301 - RNA, 13 nt, Shigella flexneri 2a str. 2457T
cucaaucaaaaga

SEQ ID NO: 1946302 - RNA, 16 nt, Shigella flexneri 2a str. 2457T
cucaaucaacuccauu

SEQ ID NO: 1946303 - RNA, 13 nt, Shigella flexneri 2a str. 2457T
cucacccguacag

SEQ ID NO: 1946304 - RNA, 16 nt, Shigella flexneri 2a str. 2457T
cucacccgcuucauaa

SEQ ID NO: 1946305 - RNA, 14 nt, Shigella flexneri 2a str. 2457T
cucacccggaggaa

SEQ ID NO: 1946306 - RNA, 15 nt, Shigella flexneri 2a str. 2457T
cucacaugaguugcu

SEQ ID NO: 1946307 - RNA, 19 nt, Shigella flexneri 2a str. 2457T
cucacaugaguugcuggac

SEQ ID NO: 1946308 - RNA, 20 nt, Shigella flexneri 2a str. 2457T
cucacaugaguugcuggacg

SEQ ID NO: 1946309 - RNA, 15 nt, Shigella flexneri 2a str. 2457T
cucacagcuaaucau

SEQ ID NO: 1946310 - RNA, 19 nt, Shigella flexneri 2a str. 2457T
cucacagaguauuuccagc

SEQ ID NO: 1946311 - RNA, 16 nt, Shigella flexneri 2a str. 2457T
cucacagaguauuucc

SEQ ID NO: 1946312 - RNA, 18 nt, Shigella flexneri 2a str. 2457T
cuaucgaaaguuuaccag

SEQ ID NO: 1946313 - RNA, 17 nt, Shigella flexneri 2a str. 2457T
cuaucccagccuauaac

SEQ ID NO: 1946314 - RNA, 14 nt, Shigella flexneri 2a str. 2457T
cuauccggcauaca

SEQ ID NO: 1946315 - RNA, 11 nt, Shigella flexneri 2a str. 2457T
cuauccagcuc

SEQ ID NO: 1946316 - RNA, 20 nt, Shigella flexneri 2a str. 2457T
cuauccacgucgacaacucc

SEQ ID NO: 1946317 - RNA, 20 nt, Shigella flexneri 2a str. 2457T
cuaucagaccuacaaaaccu

SEQ ID NO: 1946318 - RNA, 23 nt, Shigella flexneri 2a str. 2457T
cuaucagaccuacaaaaccugca

SEQ ID NO: 1946319 - RNA, 13 nt, Shigella flexneri 2a str. 2457T
cuaucauacucau

SEQ ID NO: 1946320 - RNA, 12 nt, Shigella flexneri 2a str. 2457T
cuaucaggcaaa

SEQ ID NO: 1946321 - RNA, 16 nt, Shigella flexneri 2a str. 2457T
cuaucaggcaaaaaaa

SEQ ID NO: 1946322 - RNA, 22 nt, Shigella flexneri 2a str. 2457T
cuaucagcgccaccacaaaagc

SEQ ID NO: 1946323 - RNA, 22 nt, Shigella flexneri 2a str. 2457T
cuaucgcugagauacucaagca

SEQ ID NO: 1946324 - RNA, 20 nt, Shigella flexneri 2a str. 2457T
cuaucgcugauauacccuuc

SEQ ID NO: 1946325 - RNA, 15 nt, Shigella flexneri 2a str. 2457T
cuaucguccacguca

SEQ ID NO: 1946326 - RNA, 14 nt, Shigella flexneri 2a str. 2457T
cuaugauuuuccug

SEQ ID NO: 1946327 - RNA, 17 nt, Shigella flexneri 2a str. 2457T
cuaugauuuuccugagg

SEQ ID NO: 1946328 - RNA, 22 nt, Shigella flexneri 2a str. 2457T
cuaugcaacaacugaaaaaaaa

SEQ ID NO: 1946329 - RNA, 16 nt, Shigella flexneri 2a str. 2457T
cuaugguuuugaagaa

SEQ ID NO: 1946330 - RNA, 16 nt, Shigella flexneri 2a str. 2457T
cuauguaauccugaug

SEQ ID NO: 1946331 - RNA, 16 nt, Shigella flexneri 2a str. 2457T
cuauauuccuuuauca

SEQ ID NO: 1946332 - RNA, 16 nt, Shigella flexneri 2a str. 2457T
cuauauacccuucuca

SEQ ID NO: 1946333 - RNA, 13 nt, Shigella flexneri 2a str. 2457T
cuauacagcagcc

SEQ ID NO: 1946334 - RNA, 23 nt, Shigella flexneri 2a str. 2457T
cuauaauugcuuuuuuccauaag

SEQ ID NO: 1946335 - RNA, 19 nt, Shigella flexneri 2a str. 2457T
cuauaaugagauauuuaau

SEQ ID NO: 1946336 - RNA, 20 nt, Shigella flexneri 2a str. 2457T
cuauaaugagauauuuaaug

SEQ ID NO: 1946337 - RNA, 15 nt, Shigella flexneri 2a str. 2457T
cuaggcgaacauucc

SEQ ID NO: 1946338 - RNA, 13 nt, Shigella flexneri 2a str. 2457T
cuaggcauagaaa

SEQ ID NO: 1946339 - RNA, 18 nt, Shigella flexneri 2a str. 2457T
cuaggcgccaagggcggc

SEQ ID NO: 1946340 - RNA, 11 nt, Shigella flexneri 2a str. 2457T
cuacuucuucg

SEQ ID NO: 1946341 - RNA, 20 nt, Shigella flexneri 2a str. 2457T
cuacuucuuucaccaucgca

SEQ ID NO: 1946342 - RNA, 21 nt, Shigella flexneri 2a str. 2457T
cuacuuuuccagguuauuuua

SEQ ID NO: 1946343 - RNA, 18 nt, Shigella flexneri 2a str. 2457T
cuacuuuuuucacccaca

SEQ ID NO: 1946344 - RNA, 16 nt, Shigella flexneri 2a str. 2457T
cuacucugacccagua

SEQ ID NO: 1946345 - RNA, 21 nt, Shigella flexneri 2a str. 2457T
cuacucuauacaggauaauua

SEQ ID NO: 1946346 - RNA, 16 nt, Shigella flexneri 2a str. 2457T
cuacuccaacccggca

SEQ ID NO: 1946347 - RNA, 21 nt, Shigella flexneri 2a str. 2457T
cuacuaugauuuuccugagga

SEQ ID NO: 1946348 - RNA, 21 nt, Shigella flexneri 2a str. 2457T
cuacugauggcuacguucugc

SEQ ID NO: 1946349 - RNA, 23 nt, Shigella flexneri 2a str. 2457T
cuaacaucauccccguaucuuca

SEQ ID NO: 1946350 - RNA, 15 nt, Shigella flexneri 2a str. 2457T
cuaacauuuuacuua

SEQ ID NO: 1946351 - RNA, 13 nt, Shigella flexneri 2a str. 2457T
cuaacaggcuuuu

SEQ ID NO: 1946352 - RNA, 13 nt, Shigella flexneri 2a str. 2457T
cuaccuucuuccc

SEQ ID NO: 1946353 - RNA, 13 nt, Shigella flexneri 2a str. 2457T
cugcgcccgcagc

SEQ ID NO: 1946354 - RNA, 14 nt, Shigella flexneri 2a str. 2457T
cugcgcccgcccgc

SEQ ID NO: 1946355 - RNA, 20 nt, Shigella flexneri 2a str. 2457T
cugcgcccgcccgcuguaag

SEQ ID NO: 1946356 - RNA, 18 nt, Shigella flexneri 2a str. 2457T
cugcgccccacaccacca

SEQ ID NO: 1946357 - RNA, 19 nt, Shigella flexneri 2a str. 2457T
cugcgccccacaccaccau

SEQ ID NO: 1946358 - RNA, 15 nt, Shigella flexneri 2a str. 2457T
cugcgccgccucugc

SEQ ID NO: 1946359 - RNA, 16 nt, Shigella flexneri 2a str. 2457T
cugcgccagcgcgcgu

SEQ ID NO: 1946360 - RNA, 12 nt, Shigella flexneri 2a str. 2457T
cugcgccagcgc

SEQ ID NO: 1946361 - RNA, 16 nt, Shigella flexneri 2a str. 2457T
cugcgccagcggcagu

SEQ ID NO: 1946362 - RNA, 18 nt, Shigella flexneri 2a str. 2457T
cugcgccagcggcaguaa

SEQ ID NO: 1946363 - RNA, 12 nt, Shigella flexneri 2a str. 2457T
cugcgccagcca

SEQ ID NO: 1946364 - RNA, 15 nt, Shigella flexneri 2a str. 2457T
cugcgcauuucccag

SEQ ID NO: 1946365 - RNA, 16 nt, Shigella flexneri 2a str. 2457T
cugcgccaccacaaca

SEQ ID NO: 1946366 - RNA, 17 nt, Shigella flexneri 2a str. 2457T
cugcgcgacuucauuca

SEQ ID NO: 1946367 - RNA, 13 nt, Shigella flexneri 2a str. 2457T
cugccucgcagag

SEQ ID NO: 1946368 - RNA, 15 nt, Shigella flexneri 2a str. 2457T
cugccucgcagaguu

SEQ ID NO: 1946369 - RNA, 20 nt, Shigella flexneri 2a str. 2457T
cugccucugaaacgccaggc

SEQ ID NO: 1946370 - RNA, 19 nt, Shigella flexneri 2a str. 2457T
cugccucgggauccaugca

SEQ ID NO: 1946371 - RNA, 17 nt, Shigella flexneri 2a str. 2457T
cugccgguacuucacca

SEQ ID NO: 1946372 - RNA, 14 nt, Shigella flexneri 2a str. 2457T
cugccgcaggaaag

SEQ ID NO: 1946373 - RNA, 20 nt, Shigella flexneri 2a str. 2457T
cugccgccaguucuuccagu

SEQ ID NO: 1946374 - RNA, 21 nt, Shigella flexneri 2a str. 2457T
cugccgggaagcucucuucca

SEQ ID NO: 1946375 - RNA, 19 nt, Shigella flexneri 2a str. 2457T
cugccgggguaaagcgcgg

SEQ ID NO: 1946376 - RNA, 23 nt, Shigella flexneri 2a str. 2457T
cugccggggagauauuccccaga

SEQ ID NO: 1946377 - RNA, 10 nt, Shigella flexneri 2a str. 2457T
cugccugaug

SEQ ID NO: 1946378 - RNA, 15 nt, Shigella flexneri 2a str. 2457T
cugccugaugcgcuc

SEQ ID NO: 1946379 - RNA, 17 nt, Shigella flexneri 2a str. 2457T
cugccugauccugggcu

SEQ ID NO: 1946380 - RNA, 18 nt, Shigella flexneri 2a str. 2457T
cugccugauccugggcua

SEQ ID NO: 1946381 - RNA, 14 nt, Shigella flexneri 2a str. 2457T
cugcgcaucaugcc

SEQ ID NO: 1946382 - RNA, 17 nt, Shigella flexneri 2a str. 2457T
cugcgcaucaugccacc

SEQ ID NO: 1946383 - RNA, 17 nt, Shigella flexneri 2a str. 2457T
cugccaguccugcucaa

SEQ ID NO: 1946384 - RNA, 23 nt, Shigella flexneri 2a str. 2457T
cugccagaugcagcgguaauucc

SEQ ID NO: 1946385 - RNA, 13 nt, Shigella flexneri 2a str. 2457T
cugccagaucauc

SEQ ID NO: 1946386 - RNA, 24 nt, Shigella flexneri 2a str. 2457T
cugccagaucaucguuuccgaugg

SEQ ID NO: 1946387 - RNA, 21 nt, Shigella flexneri 2a str. 2457T
cugccaguucccccugccaga

SEQ ID NO: 1946388 - RNA, 14 nt, Shigella flexneri 2a str. 2457T
cugccagccauaaa

SEQ ID NO: 1946389 - RNA, 15 nt, Shigella flexneri 2a str. 2457T
cugccagccauaaau

SEQ ID NO: 1946390 - RNA, 23 nt, Shigella flexneri 2a str. 2457T
cugccagaaggauugaucaauuc

SEQ ID NO: 1946391 - RNA, 19 nt, Shigella flexneri 2a str. 2457T
cugccagacccauaaucag

SEQ ID NO: 1946392 - RNA, 15 nt, Shigella flexneri 2a str. 2457T
cugccagaccugcga

SEQ ID NO: 1946393 - RNA, 17 nt, Shigella flexneri 2a str. 2457T
cugccagacuccaggcg

SEQ ID NO: 1946394 - RNA, 22 nt, Shigella flexneri 2a str. 2457T
cugccagaggagccaucaccau

SEQ ID NO: 1946395 - RNA, 18 nt, Shigella flexneri 2a str. 2457T
cugccagaggagccauca

SEQ ID NO: 1946396 - RNA, 14 nt, Shigella flexneri 2a str. 2457T
cugcccacgcgcac

SEQ ID NO: 1946397 - RNA, 22 nt, Shigella flexneri 2a str. 2457T
cugccaucauggcauccuguuu

SEQ ID NO: 1946398 - RNA, 15 nt, Shigella flexneri 2a str. 2457T
cugccccagugggcu

SEQ ID NO: 1946399 - RNA, 20 nt, Shigella flexneri 2a str. 2457T
cugcccaucauaccugagug

SEQ ID NO: 1946400 - RNA, 13 nt, Shigella flexneri 2a str. 2457T
cugcccgcaccca

SEQ ID NO: 1946401 - RNA, 17 nt, Shigella flexneri 2a str. 2457T
cugcccacgcgcacgcu

SEQ ID NO: 1946402 - RNA, 19 nt, Shigella flexneri 2a str. 2457T
cugcacaccaaccgcuucc

SEQ ID NO: 1946403 - RNA, 16 nt, Shigella flexneri 2a str. 2457T
cugcagucaccugccc

SEQ ID NO: 1946404 - RNA, 21 nt, Shigella flexneri 2a str. 2457T
cugcagugcacgaaccagaga

SEQ ID NO: 1946405 - RNA, 14 nt, Shigella flexneri 2a str. 2457T
cugcagugaaauua

SEQ ID NO: 1946406 - RNA, 20 nt, Shigella flexneri 2a str. 2457T
cugcacaaguuguuuacagu

SEQ ID NO: 1946407 - RNA, 16 nt, Shigella flexneri 2a str. 2457T
cugcaauugcggcagg

SEQ ID NO: 1946408 - RNA, 23 nt, Shigella flexneri 2a str. 2457T
cugcaauugcggcaggucaucgu

SEQ ID NO: 1946409 - RNA, 20 nt, Shigella flexneri 2a str. 2457T
cugcaaugccguuugcugca

SEQ ID NO: 1946410 - RNA, 23 nt, Shigella flexneri 2a str. 2457T
cugcaaucuuuaacggcggcaaa

SEQ ID NO: 1946411 - RNA, 15 nt, Shigella flexneri 2a str. 2457T
cugcaauaccgccgu

SEQ ID NO: 1946412 - RNA, 13 nt, Shigella flexneri 2a str. 2457T
cugcauccguucu

SEQ ID NO: 1946413 - RNA, 22 nt, Shigella flexneri 2a str. 2457T
cugcauaaacgccgucaucaca

SEQ ID NO: 1946414 - RNA, 19 nt, Shigella flexneri 2a str. 2457T
cugcauccgccauccacca

SEQ ID NO: 1946415 - RNA, 22 nt, Shigella flexneri 2a str. 2457T
cugcaucuuccguggaacaaaa

SEQ ID NO: 1946416 - RNA, 13 nt, Shigella flexneri 2a str. 2457T
cugcauugacaag

SEQ ID NO: 1946417 - RNA, 23 nt, Shigella flexneri 2a str. 2457T
cugcauucccaucgcaucgucac

SEQ ID NO: 1946418 - RNA, 14 nt, Shigella flexneri 2a str. 2457T
cugcauucaccagu

SEQ ID NO: 1946419 - RNA, 18 nt, Shigella flexneri 2a str. 2457T
cugcauguaaccuaauuu

SEQ ID NO: 1946420 - RNA, 20 nt, Shigella flexneri 2a str. 2457T
cugccaaacgcucccugcca

SEQ ID NO: 1946421 - RNA, 14 nt, Shigella flexneri 2a str. 2457T
cugcguauuuccug

SEQ ID NO: 1946422 - RNA, 19 nt, Shigella flexneri 2a str. 2457T
cugcguacugagucgggug

SEQ ID NO: 1946423 - RNA, 15 nt, Shigella flexneri 2a str. 2457T
cugcgguucagcuuu

SEQ ID NO: 1946424 - RNA, 16 nt, Shigella flexneri 2a str. 2457T
cugcgguucagcuuuu

SEQ ID NO: 1946425 - RNA, 20 nt, Shigella flexneri 2a str. 2457T
cugcguuccggcaugauuca

SEQ ID NO: 1946426 - RNA, 20 nt, Shigella flexneri 2a str. 2457T
cugcgugucguaagccaccg

SEQ ID NO: 1946427 - RNA, 23 nt, Shigella flexneri 2a str. 2457T
cugcgucauuccggaguuuauga

SEQ ID NO: 1946428 - RNA, 16 nt, Shigella flexneri 2a str. 2457T
cugcucaaguaauaaa

SEQ ID NO: 1946429 - RNA, 19 nt, Shigella flexneri 2a str. 2457T
cugcuauucaccagcaaau

SEQ ID NO: 1946430 - RNA, 21 nt, Shigella flexneri 2a str. 2457T
cugcucaacugccaguucccc

SEQ ID NO: 1946431 - RNA, 21 nt, Shigella flexneri 2a str. 2457T
cugcguuuucgagaaggcgcu

SEQ ID NO: 1946432 - RNA, 19 nt, Shigella flexneri 2a str. 2457T
cugcuaugcaagauguuaa

SEQ ID NO: 1946433 - RNA, 14 nt, Shigella flexneri 2a str. 2457T
cugcuaaauuugca

SEQ ID NO: 1946434 - RNA, 20 nt, Shigella flexneri 2a str. 2457T
cugcuaaauuugcacgucag

SEQ ID NO: 1946435 - RNA, 15 nt, Shigella flexneri 2a str. 2457T
cugcgcucuucuggc

SEQ ID NO: 1946436 - RNA, 19 nt, Shigella flexneri 2a str. 2457T
cugcgcuuacacacccggc

SEQ ID NO: 1946437 - RNA, 15 nt, Shigella flexneri 2a str. 2457T
cugcgcuuccagcuc

SEQ ID NO: 1946438 - RNA, 16 nt, Shigella flexneri 2a str. 2457T
cugcgcuuccugcaac

SEQ ID NO: 1946439 - RNA, 18 nt, Shigella flexneri 2a str. 2457T
cugcgcuuauccggccca

SEQ ID NO: 1946440 - RNA, 14 nt, Shigella flexneri 2a str. 2457T
cugcgcuaccagga

SEQ ID NO: 1946441 - RNA, 16 nt, Shigella flexneri 2a str. 2457T
cugcgcuaaacaggau

SEQ ID NO: 1946442 - RNA, 19 nt, Shigella flexneri 2a str. 2457T
cugcgcuaaacaggaucug

SEQ ID NO: 1946443 - RNA, 19 nt, Shigella flexneri 2a str. 2457T
cugcgggaacauaugcaca

SEQ ID NO: 1946444 - RNA, 18 nt, Shigella flexneri 2a str. 2457T
cugcgggcgaccaaucaa

SEQ ID NO: 1946445 - RNA, 16 nt, Shigella flexneri 2a str. 2457T
cugcggcgugggcgcu

SEQ ID NO: 1946446 - RNA, 16 nt, Shigella flexneri 2a str. 2457T
cugcugcacgcccuga

SEQ ID NO: 1946447 - RNA, 23 nt, Shigella flexneri 2a str. 2457T
cugcugcacgcccugauaaauca

SEQ ID NO: 1946448 - RNA, 19 nt, Shigella flexneri 2a str. 2457T
cugcucuuuuugcauaauu

SEQ ID NO: 1946449 - RNA, 19 nt, Shigella flexneri 2a str. 2457T
cugcucuuucagcaccgcg

SEQ ID NO: 1946450 - RNA, 14 nt, Shigella flexneri 2a str. 2457T
aaacucaaucaggc

SEQ ID NO: 1946451 - RNA, 15 nt, Shigella flexneri 2a str. 2457T
cugcucagcuccucu

SEQ ID NO: 1946452 - RNA, 17 nt, Shigella flexneri 2a str. 2457T
cugcucagcuccucuuu

SEQ ID NO: 1946453 - RNA, 16 nt, Shigella flexneri 2a str. 2457T
cugcucguucagcacu

SEQ ID NO: 1946454 - RNA, 15 nt, Shigella flexneri 2a str. 2457T
cugcucgguucgcug

SEQ ID NO: 1946455 - RNA, 18 nt, Shigella flexneri 2a str. 2457T
cugcucggucugcugggc

SEQ ID NO: 1946456 - RNA, 15 nt, Shigella flexneri 2a str. 2457T
cuggcaaacgucagc

SEQ ID NO: 1946457 - RNA, 15 nt, Shigella flexneri 2a str. 2457T
cuggcaaaguagagc

SEQ ID NO: 1946458 - RNA, 22 nt, Shigella flexneri 2a str. 2457T
cuggcaacaacgcaacuccagc

SEQ ID NO: 1946459 - RNA, 17 nt, Shigella flexneri 2a str. 2457T
cuggcauguugauacac

SEQ ID NO: 1946460 - RNA, 23 nt, Shigella flexneri 2a str. 2457T
cuggcauccccgcccuuccagcu

SEQ ID NO: 1946461 - RNA, 21 nt, Shigella flexneri 2a str. 2457T
cuggacucccagaacaacccg

SEQ ID NO: 1946462 - RNA, 20 nt, Shigella flexneri 2a str. 2457T
cuggacguugcguugcagca

SEQ ID NO: 1946463 - RNA, 23 nt, Shigella flexneri 2a str. 2457T
cuggacguugcguugcagcagga

SEQ ID NO: 1946464 - RNA, 19 nt, Shigella flexneri 2a str. 2457T
cuggacguuugauuuuuaa

SEQ ID NO: 1946465 - RNA, 17 nt, Shigella flexneri 2a str. 2457T
cuggaucucucaugucu

SEQ ID NO: 1946466 - RNA, 18 nt, Shigella flexneri 2a str. 2457T
cuggaugaaaaaauccca

SEQ ID NO: 1946467 - RNA, 22 nt, Shigella flexneri 2a str. 2457T
cuggauuuuagggacaaagaau

SEQ ID NO: 1946468 - RNA, 22 nt, Shigella flexneri 2a str. 2457T
cuggauuuggcugccgagcaaa

SEQ ID NO: 1946469 - RNA, 15 nt, Shigella flexneri 2a str. 2457T
cuggauuugugucag

SEQ ID NO: 1946470 - RNA, 23 nt, Shigella flexneri 2a str. 2457T
cuggaucaaggauugcagcacug

SEQ ID NO: 1946471 - RNA, 23 nt, Shigella flexneri 2a str. 2457T
cuggaucacaauccgcucuuuca

SEQ ID NO: 1946472 - RNA, 15 nt, Shigella flexneri 2a str. 2457T
cuggaucagacgcag

SEQ ID NO: 1946473 - RNA, 22 nt, Shigella flexneri 2a str. 2457T
cuggacaaagagcuuucauuuc

SEQ ID NO: 1946474 - RNA, 22 nt, Shigella flexneri 2a str. 2457T
cuggacagcucguuaaucagaa

SEQ ID NO: 1946475 - RNA, 15 nt, Shigella flexneri 2a str. 2457T
cuggaccagcggguu

SEQ ID NO: 1946476 - RNA, 24 nt, Shigella flexneri 2a str. 2457T
cuggaaauguccgcgaacagcagc

SEQ ID NO: 1946477 - RNA, 16 nt, Shigella flexneri 2a str. 2457T
cuggaaagucugaaug

SEQ ID NO: 1946478 - RNA, 18 nt, Shigella flexneri 2a str. 2457T
cuggaauuccuuucccua

SEQ ID NO: 1946479 - RNA, 22 nt, Shigella flexneri 2a str. 2457T
cuggaauuccuuucccuauuuu

SEQ ID NO: 1946480 - RNA, 23 nt, Shigella flexneri 2a str. 2457T
cugcuuuucguucaggccuaccg

SEQ ID NO: 1946481 - RNA, 19 nt, Shigella flexneri 2a str. 2457T
cugcuuuuccggucagcaa

SEQ ID NO: 1946482 - RNA, 17 nt, Shigella flexneri 2a str. 2457T
cuggaaagagaaaaccc

SEQ ID NO: 1946483 - RNA, 21 nt, Shigella flexneri 2a str. 2457T
cuggaaacucacgccagcagc

SEQ ID NO: 1946484 - RNA, 21 nt, Shigella flexneri 2a str. 2457T
cuggaaaaucuacguuaaaaa

SEQ ID NO: 1946485 - RNA, 20 nt, Shigella flexneri 2a str. 2457T
cuggaaaaagugccccagcu

SEQ ID NO: 1946486 - RNA, 20 nt, Shigella flexneri 2a str. 2457T
cugcugcuguagccgaugcc

SEQ ID NO: 1946487 - RNA, 18 nt, Shigella flexneri 2a str. 2457T
cugcugcguuccggcaug

SEQ ID NO: 1946488 - RNA, 16 nt, Shigella flexneri 2a str. 2457T
cugcuggaucugcggg

SEQ ID NO: 1946489 - RNA, 18 nt, Shigella flexneri 2a str. 2457T
cugcuggaacaaacugcc

SEQ ID NO: 1946490 - RNA, 13 nt, Shigella flexneri 2a str. 2457T
cugcuggaagcug

SEQ ID NO: 1946491 - RNA, 17 nt, Shigella flexneri 2a str. 2457T
cugcuggaagcuggcau

SEQ ID NO: 1946492 - RNA, 19 nt, Shigella flexneri 2a str. 2457T
cugcuguuuuuucaggccc

SEQ ID NO: 1946493 - RNA, 17 nt, Shigella flexneri 2a str. 2457T
cugcuuaauaucccuuc

SEQ ID NO: 1946494 - RNA, 13 nt, Shigella flexneri 2a str. 2457T
cugcuuacaggcu

SEQ ID NO: 1946495 - RNA, 19 nt, Shigella flexneri 2a str. 2457T
cugcuuaguaaaaauagug

SEQ ID NO: 1946496 - RNA, 20 nt, Shigella flexneri 2a str. 2457T
cugcuuaucgcccugcucca

SEQ ID NO: 1946497 - RNA, 22 nt, Shigella flexneri 2a str. 2457T
cugcuuacaggcugguuucucu

SEQ ID NO: 1946498 - RNA, 20 nt, Shigella flexneri 2a str. 2457T
cugcuuucucccaguugugg

SEQ ID NO: 1946499 - RNA, 18 nt, Shigella flexneri 2a str. 2457T
cugcuuuacgccagguug

SEQ ID NO: 1946500 - RNA, 22 nt, Shigella flexneri 2a str. 2457T
cugcuucagccgcacuuuuuaa

SEQ ID NO: 1946501 - RNA, 13 nt, Shigella flexneri 2a str. 2457T
cugcaacugcgcg

SEQ ID NO: 1946502 - RNA, 16 nt, Shigella flexneri 2a str. 2457T
cugcaacuucucuuuc

SEQ ID NO: 1946503 - RNA, 19 nt, Shigella flexneri 2a str. 2457T
cugcaagaggaaauaagca

SEQ ID NO: 1946504 - RNA, 18 nt, Shigella flexneri 2a str. 2457T
cugcaaggccauccgcug

SEQ ID NO: 1946505 - RNA, 21 nt, Shigella flexneri 2a str. 2457T
cugcaauaaaauaucuuccac

SEQ ID NO: 1946506 - RNA, 13 nt, Shigella flexneri 2a str. 2457T
cugcaaauaaaua

SEQ ID NO: 1946507 - RNA, 14 nt, Shigella flexneri 2a str. 2457T
cugcaaauacccaa

SEQ ID NO: 1946508 - RNA, 15 nt, Shigella flexneri 2a str. 2457T
cugcaacgucuuccc

SEQ ID NO: 1946509 - RNA, 20 nt, Shigella flexneri 2a str. 2457T
cugcaaagcugaugguugaa

SEQ ID NO: 1946510 - RNA, 21 nt, Shigella flexneri 2a str. 2457T
cugcaaagucugggcuuuugu

SEQ ID NO: 1946511 - RNA, 16 nt, Shigella flexneri 2a str. 2457T
cugcaaagcauuuuuu

SEQ ID NO: 1946512 - RNA, 17 nt, Shigella flexneri 2a str. 2457T
cugcaaaauaccaauaa

SEQ ID NO: 1946513 - RNA, 19 nt, Shigella flexneri 2a str. 2457T
cugcaaaauagccaaucau

SEQ ID NO: 1946514 - RNA, 17 nt, Shigella flexneri 2a str. 2457T
cugaugcaucagucacg

SEQ ID NO: 1946515 - RNA, 18 nt, Shigella flexneri 2a str. 2457T
cugaugcacgauaacguc

SEQ ID NO: 1946516 - RNA, 15 nt, Shigella flexneri 2a str. 2457T
cugaugcgacgcuga

SEQ ID NO: 1946517 - RNA, 22 nt, Shigella flexneri 2a str. 2457T
cugaugcgacgcuugcgcgucu

SEQ ID NO: 1946518 - RNA, 13 nt, Shigella flexneri 2a str. 2457T
cugaugcgacacu

SEQ ID NO: 1946519 - RNA, 23 nt, Shigella flexneri 2a str. 2457T
cugauuuaaccaacaauaaaauu

SEQ ID NO: 1946520 - RNA, 13 nt, Shigella flexneri 2a str. 2457T
cugauugcauaau

SEQ ID NO: 1946521 - RNA, 18 nt, Shigella flexneri 2a str. 2457T
cugauugaccgccagcgc

SEQ ID NO: 1946522 - RNA, 16 nt, Shigella flexneri 2a str. 2457T
cugauugaaauagcca

SEQ ID NO: 1946523 - RNA, 17 nt, Shigella flexneri 2a str. 2457T
cugauugaacuguggcg

SEQ ID NO: 1946524 - RNA, 18 nt, Shigella flexneri 2a str. 2457T
cugaucgacaaaaucccg

SEQ ID NO: 1946525 - RNA, 14 nt, Shigella flexneri 2a str. 2457T
cugauccugacaag

SEQ ID NO: 1946526 - RNA, 19 nt, Shigella flexneri 2a str. 2457T
cugauccgcgcgguagaga

SEQ ID NO: 1946527 - RNA, 22 nt, Shigella flexneri 2a str. 2457T
cugaucccgauggucagcuuca

SEQ ID NO: 1946528 - RNA, 14 nt, Shigella flexneri 2a str. 2457T
cugauccaucgucu

SEQ ID NO: 1946529 - RNA, 15 nt, Shigella flexneri 2a str. 2457T
cugauauugcccgug

SEQ ID NO: 1946530 - RNA, 18 nt, Shigella flexneri 2a str. 2457T
cugauauuaagcagacgg

SEQ ID NO: 1946531 - RNA, 16 nt, Shigella flexneri 2a str. 2457T
cugauauucgacacca

SEQ ID NO: 1946532 - RNA, 16 nt, Shigella flexneri 2a str. 2457T
cugauaauuuuuucac

SEQ ID NO: 1946533 - RNA, 16 nt, Shigella flexneri 2a str. 2457T
cugaucaauauagaua

SEQ ID NO: 1946534 - RNA, 19 nt, Shigella flexneri 2a str. 2457T
cugauaauccagacuauuu

SEQ ID NO: 1946535 - RNA, 15 nt, Shigella flexneri 2a str. 2457T
cugauaauccacgcg

SEQ ID NO: 1946536 - RNA, 16 nt, Shigella flexneri 2a str. 2457T
cugaguuucagaccaa

SEQ ID NO: 1946537 - RNA, 22 nt, Shigella flexneri 2a str. 2457T
cugaguugccaucaucaccaga

SEQ ID NO: 1946538 - RNA, 16 nt, Shigella flexneri 2a str. 2457T
cugauaaguuucggag

SEQ ID NO: 1946539 - RNA, 23 nt, Shigella flexneri 2a str. 2457T
cugauacuccaugaguaacaguc

SEQ ID NO: 1946540 - RNA, 14 nt, Shigella flexneri 2a str. 2457T
cugauauucauauc

SEQ ID NO: 1946541 - RNA, 17 nt, Shigella flexneri 2a str. 2457T
cugauauggugguaacu

SEQ ID NO: 1946542 - RNA, 17 nt, Shigella flexneri 2a str. 2457T
cugauaugccagacuuc

SEQ ID NO: 1946543 - RNA, 14 nt, Shigella flexneri 2a str. 2457T
cugauacauagcac

SEQ ID NO: 1946544 - RNA, 16 nt, Shigella flexneri 2a str. 2457T
cugaguugcagcaacu

SEQ ID NO: 1946545 - RNA, 21 nt, Shigella flexneri 2a str. 2457T
cugagccaguuuuucuuuuuc

SEQ ID NO: 1946546 - RNA, 18 nt, Shigella flexneri 2a str. 2457T
cugagccaguuuuucuuu

SEQ ID NO: 1946547 - RNA, 18 nt, Shigella flexneri 2a str. 2457T
cugagccaaacgcccagc

SEQ ID NO: 1946548 - RNA, 18 nt, Shigella flexneri 2a str. 2457T
cugagucaucaacucagu

SEQ ID NO: 1946549 - RNA, 22 nt, Shigella flexneri 2a str. 2457T
cugagucgggugcagcgacagg

SEQ ID NO: 1946550 - RNA, 14 nt, Shigella flexneri 2a str. 2457T
cugaaggcgcauug

SEQ ID NO: 1946551 - RNA, 20 nt, Shigella flexneri 2a str. 2457T
cugaaggaauauucaggcuc

SEQ ID NO: 1946552 - RNA, 17 nt, Shigella flexneri 2a str. 2457T
cugaagcgcuggggaaa

SEQ ID NO: 1946553 - RNA, 13 nt, Shigella flexneri 2a str. 2457T
cugacaaaucaug

SEQ ID NO: 1946554 - RNA, 15 nt, Shigella flexneri 2a str. 2457T
cugacaccaucaccc

SEQ ID NO: 1946555 - RNA, 16 nt, Shigella flexneri 2a str. 2457T
cugacacaggcagcaa

SEQ ID NO: 1946556 - RNA, 19 nt, Shigella flexneri 2a str. 2457T
cugaccucuucuaccacau

SEQ ID NO: 1946557 - RNA, 22 nt, Shigella flexneri 2a str. 2457T
cugaccugaauuaaugccucuc

SEQ ID NO: 1946558 - RNA, 16 nt, Shigella flexneri 2a str. 2457T
cugaccagacuggagc

SEQ ID NO: 1946559 - RNA, 13 nt, Shigella flexneri 2a str. 2457T
cugaccaccacca

SEQ ID NO: 1946560 - RNA, 13 nt, Shigella flexneri 2a str. 2457T
cugaccacggcca

SEQ ID NO: 1946561 - RNA, 17 nt, Shigella flexneri 2a str. 2457T
cugaccacggccacagc

SEQ ID NO: 1946562 - RNA, 21 nt, Shigella flexneri 2a str. 2457T
cugacgcucucuacgcccugu

SEQ ID NO: 1946563 - RNA, 16 nt, Shigella flexneri 2a str. 2457T
cugacgcgucuuaucu

SEQ ID NO: 1946564 - RNA, 20 nt, Shigella flexneri 2a str. 2457T
cugacgcgucuuaucuggcc

SEQ ID NO: 1946565 - RNA, 21 nt, Shigella flexneri 2a str. 2457T
cugacgcgucuuaucuggccu

SEQ ID NO: 1946566 - RNA, 22 nt, Shigella flexneri 2a str. 2457T
cugacgcgucuuaucuggccua

SEQ ID NO: 1946567 - RNA, 17 nt, Shigella flexneri 2a str. 2457T
cugacggacgcgcggcg

SEQ ID NO: 1946568 - RNA, 19 nt, Shigella flexneri 2a str. 2457T
cugacgcccguuuucaccu

SEQ ID NO: 1946569 - RNA, 22 nt, Shigella flexneri 2a str. 2457T
cugacuagaugugcaguuccug

SEQ ID NO: 1946570 - RNA, 20 nt, Shigella flexneri 2a str. 2457T
cugacguugcuguuuuucgu

SEQ ID NO: 1946571 - RNA, 19 nt, Shigella flexneri 2a str. 2457T
cugacggcgauaaaucuca

SEQ ID NO: 1946572 - RNA, 22 nt, Shigella flexneri 2a str. 2457T
cugacugacuucaacaggaaaa

SEQ ID NO: 1946573 - RNA, 16 nt, Shigella flexneri 2a str. 2457T
cugacugacgugauga

SEQ ID NO: 1946574 - RNA, 19 nt, Shigella flexneri 2a str. 2457T
cugacugauaacgcggcag

SEQ ID NO: 1946575 - RNA, 20 nt, Shigella flexneri 2a str. 2457T
cugacugauaacgcggcagc

SEQ ID NO: 1946576 - RNA, 14 nt, Shigella flexneri 2a str. 2457T
cugagaaacucagu

SEQ ID NO: 1946577 - RNA, 18 nt, Shigella flexneri 2a str. 2457T
cugacugccggaugcauc

SEQ ID NO: 1946578 - RNA, 17 nt, Shigella flexneri 2a str. 2457T
cugacugcgccacuucc

SEQ ID NO: 1946579 - RNA, 14 nt, Shigella flexneri 2a str. 2457T
cugagcaucacaua

SEQ ID NO: 1946580 - RNA, 18 nt, Shigella flexneri 2a str. 2457T
cugagcaugaugccugau

SEQ ID NO: 1946581 - RNA, 21 nt, Shigella flexneri 2a str. 2457T
cugagcaugaugccugaugcg

SEQ ID NO: 1946582 - RNA, 16 nt, Shigella flexneri 2a str. 2457T
cugagcacuggggcuu

SEQ ID NO: 1946583 - RNA, 16 nt, Shigella flexneri 2a str. 2457T
cugagcagccaccacu

SEQ ID NO: 1946584 - RNA, 21 nt, Shigella flexneri 2a str. 2457T
cugagcaaacaguucugcagc

SEQ ID NO: 1946585 - RNA, 13 nt, Shigella flexneri 2a str. 2457T
cugagcaaacagu

SEQ ID NO: 1946586 - RNA, 19 nt, Shigella flexneri 2a str. 2457T
cugagaaacucaguugauu

SEQ ID NO: 1946587 - RNA, 22 nt, Shigella flexneri 2a str. 2457T
cugagaacaagauugccugaug

SEQ ID NO: 1946588 - RNA, 17 nt, Shigella flexneri 2a str. 2457T
cugagaauuccggcaga

SEQ ID NO: 1946589 - RNA, 15 nt, Shigella flexneri 2a str. 2457T
cugagauacucaagc

SEQ ID NO: 1946590 - RNA, 18 nt, Shigella flexneri 2a str. 2457T
cugagaggaaaaaaauua

SEQ ID NO: 1946591 - RNA, 18 nt, Shigella flexneri 2a str. 2457T
cugagaauuccgacagag

SEQ ID NO: 1946592 - RNA, 23 nt, Shigella flexneri 2a str. 2457T
cugagacgcgcuugcauuacuac

SEQ ID NO: 1946593 - RNA, 21 nt, Shigella flexneri 2a str. 2457T
cugaaaagaguaguaauugcu

SEQ ID NO: 1946594 - RNA, 16 nt, Shigella flexneri 2a str. 2457T
cugaaaaggucacucc

SEQ ID NO: 1946595 - RNA, 19 nt, Shigella flexneri 2a str. 2457T
cugaaaaaaaauuacaaaa

SEQ ID NO: 1946596 - RNA, 16 nt, Shigella flexneri 2a str. 2457T
cugaaagcgugucaug

SEQ ID NO: 1946597 - RNA, 17 nt, Shigella flexneri 2a str. 2457T
cugaaagggcaaauaau

SEQ ID NO: 1946598 - RNA, 18 nt, Shigella flexneri 2a str. 2457T
cugaaacucgaccagcag

SEQ ID NO: 1946599 - RNA, 20 nt, Shigella flexneri 2a str. 2457T
cugaaacucgcguaaaucca

SEQ ID NO: 1946600 - RNA, 14 nt, Shigella flexneri 2a str. 2457T
cugaaaauggcgcu

SEQ ID NO: 1946601 - RNA, 16 nt, Shigella flexneri 2a str. 2457T
cucuuugaugaaacau

SEQ ID NO: 1946602 - RNA, 19 nt, Shigella flexneri 2a str. 2457T
cucuuuuauuucugcuucg

SEQ ID NO: 1946603 - RNA, 23 nt, Shigella flexneri 2a str. 2457T
cucuuuuuauuuacucuccugcg

SEQ ID NO: 1946604 - RNA, 21 nt, Shigella flexneri 2a str. 2457T
cucuuuuguuacuuauuucua

SEQ ID NO: 1946605 - RNA, 23 nt, Shigella flexneri 2a str. 2457T
cucuuucccggcaaucaccgcca

SEQ ID NO: 1946606 - RNA, 12 nt, Shigella flexneri 2a str. 2457T
cucuuuccacaa

SEQ ID NO: 1946607 - RNA, 17 nt, Shigella flexneri 2a str. 2457T
cugaagauugaacagca

SEQ ID NO: 1946608 - RNA, 14 nt, Shigella flexneri 2a str. 2457T
cugaagcaguuuca

SEQ ID NO: 1946609 - RNA, 14 nt, Shigella flexneri 2a str. 2457T
cugaagaugcugca

SEQ ID NO: 1946610 - RNA, 19 nt, Shigella flexneri 2a str. 2457T
cugaagcaguuucaccagc

SEQ ID NO: 1946611 - RNA, 21 nt, Shigella flexneri 2a str. 2457T
cugaagaaaauggccagccag

SEQ ID NO: 1946612 - RNA, 14 nt, Shigella flexneri 2a str. 2457T
cugaagaguaaaaa

SEQ ID NO: 1946613 - RNA, 20 nt, Shigella flexneri 2a str. 2457T
cugaaccgacgacagauucc

SEQ ID NO: 1946614 - RNA, 23 nt, Shigella flexneri 2a str. 2457T
cugaacgugauuaaagaucucaa

SEQ ID NO: 1946615 - RNA, 22 nt, Shigella flexneri 2a str. 2457T
cugaacgugcucugcgccgccu

SEQ ID NO: 1946616 - RNA, 20 nt, Shigella flexneri 2a str. 2457T
cugaacuaaagccuuuugcc

SEQ ID NO: 1946617 - RNA, 12 nt, Shigella flexneri 2a str. 2457T
cugaacaagaau

SEQ ID NO: 1946618 - RNA, 14 nt, Shigella flexneri 2a str. 2457T
cugaacaagcaaga

SEQ ID NO: 1946619 - RNA, 14 nt, Shigella flexneri 2a str. 2457T
cugaacagcuuuuu

SEQ ID NO: 1946620 - RNA, 13 nt, Shigella flexneri 2a str. 2457T
cugaaagguauug

SEQ ID NO: 1946621 - RNA, 20 nt, Shigella flexneri 2a str. 2457T
cugaaaguggaaaaauaaca

SEQ ID NO: 1946622 - RNA, 11 nt, Shigella flexneri 2a str. 2457T
cugaaaucauc

SEQ ID NO: 1946623 - RNA, 18 nt, Shigella flexneri 2a str. 2457T
cugaaauacagacuccac

SEQ ID NO: 1946624 - RNA, 19 nt, Shigella flexneri 2a str. 2457T
cugaaauguuugcaauaaa

SEQ ID NO: 1946625 - RNA, 21 nt, Shigella flexneri 2a str. 2457T
cucuuaaaugcacaauaauau

SEQ ID NO: 1946626 - RNA, 18 nt, Shigella flexneri 2a str. 2457T
cucuucaaacgcuucugg

SEQ ID NO: 1946627 - RNA, 18 nt, Shigella flexneri 2a str. 2457T
cucuucaaacugaagauu

SEQ ID NO: 1946628 - RNA, 18 nt, Shigella flexneri 2a str. 2457T
cucuuacucuuucaauuu

SEQ ID NO: 1946629 - RNA, 19 nt, Shigella flexneri 2a str. 2457T
cucuucagccgcaaaccug

SEQ ID NO: 1946630 - RNA, 18 nt, Shigella flexneri 2a str. 2457T
cucuucagcaaucucuuc

SEQ ID NO: 1946631 - RNA, 15 nt, Shigella flexneri 2a str. 2457T
cucuucaugccucgu

SEQ ID NO: 1946632 - RNA, 14 nt, Shigella flexneri 2a str. 2457T
cucuucauuaccuu

SEQ ID NO: 1946633 - RNA, 19 nt, Shigella flexneri 2a str. 2457T
cucuucauuaccuucaaca

SEQ ID NO: 1946634 - RNA, 17 nt, Shigella flexneri 2a str. 2457T
cucuucaauuaacaaca

SEQ ID NO: 1946635 - RNA, 18 nt, Shigella flexneri 2a str. 2457T
cucuucacgcccgcccca

SEQ ID NO: 1946636 - RNA, 13 nt, Shigella flexneri 2a str. 2457T
cucuucacugacu

SEQ ID NO: 1946637 - RNA, 16 nt, Shigella flexneri 2a str. 2457T
cucuucaacuucagca

SEQ ID NO: 1946638 - RNA, 22 nt, Shigella flexneri 2a str. 2457T
cucuucaacacacugaauaaaa

SEQ ID NO: 1946639 - RNA, 15 nt, Shigella flexneri 2a str. 2457T
cucuucaauggucag

SEQ ID NO: 1946640 - RNA, 17 nt, Shigella flexneri 2a str. 2457T
cucuggauuuauauaaa

SEQ ID NO: 1946641 - RNA, 14 nt, Shigella flexneri 2a str. 2457T
cucugcgcuuugug

SEQ ID NO: 1946642 - RNA, 22 nt, Shigella flexneri 2a str. 2457T
cucugggcugaagaguaaaaaa

SEQ ID NO: 1946643 - RNA, 13 nt, Shigella flexneri 2a str. 2457T
cucuggcgcugga

SEQ ID NO: 1946644 - RNA, 23 nt, Shigella flexneri 2a str. 2457T
cucuggcggagcucccaggcucc

SEQ ID NO: 1946645 - RNA, 13 nt, Shigella flexneri 2a str. 2457T
cucuggccgcuuc

SEQ ID NO: 1946646 - RNA, 22 nt, Shigella flexneri 2a str. 2457T
cucugguccaacgguuaacagu

SEQ ID NO: 1946647 - RNA, 21 nt, Shigella flexneri 2a str. 2457T
cucugguguggagugcagcau

SEQ ID NO: 1946648 - RNA, 20 nt, Shigella flexneri 2a str. 2457T
cucugguguggagugcagca

SEQ ID NO: 1946649 - RNA, 17 nt, Shigella flexneri 2a str. 2457T
cucuguaaacuccuuuc

SEQ ID NO: 1946650 - RNA, 19 nt, Shigella flexneri 2a str. 2457T
cucuguaauugaaggcuua

SEQ ID NO: 1946651 - RNA, 11 nt, Shigella flexneri 2a str. 2457T
cucuucccaga

SEQ ID NO: 1946652 - RNA, 13 nt, Shigella flexneri 2a str. 2457T
cucuuccaguucg

SEQ ID NO: 1946653 - RNA, 17 nt, Shigella flexneri 2a str. 2457T
cucuuccggcucccgca

SEQ ID NO: 1946654 - RNA, 17 nt, Shigella flexneri 2a str. 2457T
cucuuccuucagcuccc

SEQ ID NO: 1946655 - RNA, 17 nt, Shigella flexneri 2a str. 2457T
cucuucgccugccugca

SEQ ID NO: 1946656 - RNA, 17 nt, Shigella flexneri 2a str. 2457T
cucuucgguuggcauca

SEQ ID NO: 1946657 - RNA, 14 nt, Shigella flexneri 2a str. 2457T
cucuucuggcacca

SEQ ID NO: 1946658 - RNA, 14 nt, Shigella flexneri 2a str. 2457T
cucuucugccuguc

SEQ ID NO: 1946659 - RNA, 12 nt, Shigella flexneri 2a str. 2457T
cucuucuccuug

SEQ ID NO: 1946660 - RNA, 16 nt, Shigella flexneri 2a str. 2457T
cucuucuuugcaggga

SEQ ID NO: 1946661 - RNA, 21 nt, Shigella flexneri 2a str. 2457T
cucuucuucgcgauaaaucag

SEQ ID NO: 1946662 - RNA, 16 nt, Shigella flexneri 2a str. 2457T
cucuucugccugucca

SEQ ID NO: 1946663 - RNA, 13 nt, Shigella flexneri 2a str. 2457T
cucuucuuccgcu

SEQ ID NO: 1946664 - RNA, 18 nt, Shigella flexneri 2a str. 2457T
cucuuuaaaaaguaaaac

SEQ ID NO: 1946665 - RNA, 13 nt, Shigella flexneri 2a str. 2457T
cucuuuaaacaga

SEQ ID NO: 1946666 - RNA, 12 nt, Shigella flexneri 2a str. 2457T
aaaaacacaaag

SEQ ID NO: 1946667 - RNA, 19 nt, Shigella flexneri 2a str. 2457T
aaaaacagcaucaauaauc

SEQ ID NO: 1946668 - RNA, 21 nt, Shigella flexneri 2a str. 2457T
aaaaacagcaucaauaaucaa

SEQ ID NO: 1946669 - RNA, 17 nt, Shigella flexneri 2a str. 2457T
aaaaacaacgagccaau

SEQ ID NO: 1946670 - RNA, 15 nt, Shigella flexneri 2a str. 2457T
aaaaaccagacgaua

SEQ ID NO: 1946671 - RNA, 16 nt, Shigella flexneri 2a str. 2457T
aaaaaaugagaaagcc

SEQ ID NO: 1946672 - RNA, 23 nt, Shigella flexneri 2a str. 2457T
aaaaaaucaaugcccaucacuau

SEQ ID NO: 1946673 - RNA, 11 nt, Shigella flexneri 2a str. 2457T
aaaaaauccca

SEQ ID NO: 1946674 - RNA, 12 nt, Shigella flexneri 2a str. 2457T
aaaaaaucacag

SEQ ID NO: 1946675 - RNA, 13 nt, Shigella flexneri 2a str. 2457T
aaaaaaugagaau

SEQ ID NO: 1946676 - RNA, 17 nt, Shigella flexneri 2a str. 2457T
aaaaaaugagaauaacc

SEQ ID NO: 1946677 - RNA, 12 nt, Shigella flexneri 2a str. 2457T
aaaaaaugaaac

SEQ ID NO: 1946678 - RNA, 22 nt, Shigella flexneri 2a str. 2457T
aaaaaaugaaacuggaagauuu

SEQ ID NO: 1946679 - RNA, 15 nt, Shigella flexneri 2a str. 2457T
aaaaacagaggcccg

SEQ ID NO: 1946680 - RNA, 16 nt, Shigella flexneri 2a str. 2457T
aaaaacagccagcagc

SEQ ID NO: 1946681 - RNA, 12 nt, Shigella flexneri 2a str. 2457T
aaaaacagccag

SEQ ID NO: 1946682 - RNA, 13 nt, Shigella flexneri 2a str. 2457T
aaaaacagcauca

SEQ ID NO: 1946683 - RNA, 14 nt, Shigella flexneri 2a str. 2457T
aaaaacaucaugau

SEQ ID NO: 1946684 - RNA, 17 nt, Shigella flexneri 2a str. 2457T
aaaaaaccagaaaggga

SEQ ID NO: 1946685 - RNA, 13 nt, Shigella flexneri 2a str. 2457T
aaaaaauagcaaa

SEQ ID NO: 1946686 - RNA, 13 nt, Shigella flexneri 2a str. 2457T
aaaaaacaauaug

SEQ ID NO: 1946687 - RNA, 13 nt, Shigella flexneri 2a str. 2457T
aaaaaaagaacaa

SEQ ID NO: 1946688 - RNA, 13 nt, Shigella flexneri 2a str. 2457T
aaaaacccuucuu

SEQ ID NO: 1946689 - RNA, 14 nt, Shigella flexneri 2a str. 2457T
aaaaauaaucaucu

SEQ ID NO: 1946690 - RNA, 12 nt, Shigella flexneri 2a str. 2457T
aaaaauaaaugc

SEQ ID NO: 1946691 - RNA, 11 nt, Shigella flexneri 2a str. 2457T
aaaaauaaaag

SEQ ID NO: 1946692 - RNA, 13 nt, Shigella flexneri 2a str. 2457T
aaaaacaucauga

SEQ ID NO: 1946693 - RNA, 13 nt, Shigella flexneri 2a str. 2457T
aaaaacauaauca

SEQ ID NO: 1946694 - RNA, 22 nt, Shigella flexneri 2a str. 2457T
aaaaaccagaaagggaagaaca

SEQ ID NO: 1946695 - RNA, 12 nt, Shigella flexneri 2a str. 2457T
aaaaaccagaga

SEQ ID NO: 1946696 - RNA, 15 nt, Shigella flexneri 2a str. 2457T
aaaaauaaucugauu

SEQ ID NO: 1946697 - RNA, 15 nt, Shigella flexneri 2a str. 2457T
aaaaauaauuuuaaa

SEQ ID NO: 1946698 - RNA, 20 nt, Shigella flexneri 2a str. 2457T
aaaaauacccuguauaauag

SEQ ID NO: 1946699 - RNA, 21 nt, Shigella flexneri 2a str. 2457T
aaaaaucaugcaauaaauaug

SEQ ID NO: 1946700 - RNA, 20 nt, Shigella flexneri 2a str. 2457T
aaaaaucaugcaauaaauau

SEQ ID NO: 1946701 - RNA, 13 nt, Shigella flexneri 2a str. 2457T
aaaacaagccgaa

SEQ ID NO: 1946702 - RNA, 22 nt, Shigella flexneri 2a str. 2457T
aaaaauuuuaguuuaaacauuu

SEQ ID NO: 1946703 - RNA, 17 nt, Shigella flexneri 2a str. 2457T
aaaaauucagaugauga

SEQ ID NO: 1946704 - RNA, 23 nt, Shigella flexneri 2a str. 2457T
aaaaauucagaugaugauacuga

SEQ ID NO: 1946705 - RNA, 17 nt, Shigella flexneri 2a str. 2457T
aaaaauuuauugaaagc

SEQ ID NO: 1946706 - RNA, 24 nt, Shigella flexneri 2a str. 2457T
aaaaaucgccgagcugaacaagaa

SEQ ID NO: 1946707 - RNA, 15 nt, Shigella flexneri 2a str. 2457T
aaaaauuacaaaaag

SEQ ID NO: 1946708 - RNA, 14 nt, Shigella flexneri 2a str. 2457T
aaaacacucuucaa

SEQ ID NO: 1946709 - RNA, 15 nt, Shigella flexneri 2a str. 2457T
aaaacacucuucaac

SEQ ID NO: 1946710 - RNA, 13 nt, Shigella flexneri 2a str. 2457T
aaaacaauauguc

SEQ ID NO: 1946711 - RNA, 18 nt, Shigella flexneri 2a str. 2457T
aaaacaccacaaaacgga

SEQ ID NO: 1946712 - RNA, 21 nt, Shigella flexneri 2a str. 2457T
aaaacauugauuaagugaaua

SEQ ID NO: 1946713 - RNA, 13 nt, Shigella flexneri 2a str. 2457T
aaaacaucaugau

SEQ ID NO: 1946714 - RNA, 18 nt, Shigella flexneri 2a str. 2457T
aaaagaauggacacuauu

SEQ ID NO: 1946715 - RNA, 21 nt, Shigella flexneri 2a str. 2457T
aaaagaaaguuugcagaaauu

SEQ ID NO: 1946716 - RNA, 14 nt, Shigella flexneri 2a str. 2457T
aaaagaaaaaauga

SEQ ID NO: 1946717 - RNA, 15 nt, Shigella flexneri 2a str. 2457T
aaaagaaaagaugau

SEQ ID NO: 1946718 - RNA, 11 nt, Shigella flexneri 2a str. 2457T
aaaagaaaauc

SEQ ID NO: 1946719 - RNA, 15 nt, Shigella flexneri 2a str. 2457T
aaaagaguaaaguua

SEQ ID NO: 1946720 - RNA, 13 nt, Shigella flexneri 2a str. 2457T
aaaagcacagaau

SEQ ID NO: 1946721 - RNA, 21 nt, Shigella flexneri 2a str. 2457T
aaaagcacagaaucuaagauc

SEQ ID NO: 1946722 - RNA, 16 nt, Shigella flexneri 2a str. 2457T
aaaagcacgccagaca

SEQ ID NO: 1946723 - RNA, 15 nt, Shigella flexneri 2a str. 2457T
aaaagcaaaaauaag

SEQ ID NO: 1946724 - RNA, 20 nt, Shigella flexneri 2a str. 2457T
aaaagauugaauuauucacu

SEQ ID NO: 1946725 - RNA, 18 nt, Shigella flexneri 2a str. 2457T
aaaacgggucaccuucug

SEQ ID NO: 1946726 - RNA, 22 nt, Shigella flexneri 2a str. 2457T
aaaacggugaucaaaacgggca

SEQ ID NO: 1946727 - RNA, 17 nt, Shigella flexneri 2a str. 2457T
aaaacggugaucaaaac

SEQ ID NO: 1946728 - RNA, 13 nt, Shigella flexneri 2a str. 2457T
aaaacuaaaaaca

SEQ ID NO: 1946729 - RNA, 20 nt, Shigella flexneri 2a str. 2457T
aaaacguggccuccaaaaaa

SEQ ID NO: 1946730 - RNA, 13 nt, Shigella flexneri 2a str. 2457T
aaaacgugcagcu

SEQ ID NO: 1946731 - RNA, 17 nt, Shigella flexneri 2a str. 2457T
aaaacguggccuccaaa

SEQ ID NO: 1946732 - RNA, 21 nt, Shigella flexneri 2a str. 2457T
aaaacuucuucacaccaucaa

SEQ ID NO: 1946733 - RNA, 17 nt, Shigella flexneri 2a str. 2457T
aaaacuucguuagguuc

SEQ ID NO: 1946734 - RNA, 20 nt, Shigella flexneri 2a str. 2457T
aaaacuuccggcagaaauaa

SEQ ID NO: 1946735 - RNA, 22 nt, Shigella flexneri 2a str. 2457T
aaaacuuccggcagaaauaaaa

SEQ ID NO: 1946736 - RNA, 11 nt, Shigella flexneri 2a str. 2457T
aaaagaaaaaa

SEQ ID NO: 1946737 - RNA, 14 nt, Shigella flexneri 2a str. 2457T
aaaacuggaaaaau

SEQ ID NO: 1946738 - RNA, 16 nt, Shigella flexneri 2a str. 2457T
aaaacuggaaaaauaa

SEQ ID NO: 1946739 - RNA, 21 nt, Shigella flexneri 2a str. 2457T
aaaacugcccgugaugcaacu

SEQ ID NO: 1946740 - RNA, 23 nt, Shigella flexneri 2a str. 2457T
aaaacucucaucuuugaaaucac

SEQ ID NO: 1946741 - RNA, 21 nt, Shigella flexneri 2a str. 2457T
aaaacucuuagcaaacaggau

SEQ ID NO: 1946742 - RNA, 23 nt, Shigella flexneri 2a str. 2457T
aaaacucuccucguuaccccuuc

SEQ ID NO: 1946743 - RNA, 14 nt, Shigella flexneri 2a str. 2457T
aaaagccuaagaag

SEQ ID NO: 1946744 - RNA, 20 nt, Shigella flexneri 2a str. 2457T
aaaaguaguuccagcaugau

SEQ ID NO: 1946745 - RNA, 22 nt, Shigella flexneri 2a str. 2457T
aaaaguaaaccagagagaagcu

SEQ ID NO: 1946746 - RNA, 16 nt, Shigella flexneri 2a str. 2457T
aaaauaaugcgacaac

SEQ ID NO: 1946747 - RNA, 18 nt, Shigella flexneri 2a str. 2457T
aaaauaaucuauugauuu

SEQ ID NO: 1946748 - RNA, 13 nt, Shigella flexneri 2a str. 2457T
aaaauagcauaau

SEQ ID NO: 1946749 - RNA, 19 nt, Shigella flexneri 2a str. 2457T
aaaauagccaaucauuccc

SEQ ID NO: 1946750 - RNA, 23 nt, Shigella flexneri 2a str. 2457T
aaaauaggaauccgggucuguaa

SEQ ID NO: 1946751 - RNA, 21 nt, Shigella flexneri 2a str. 2457T
aaaauagcuguuuauuuauac

SEQ ID NO: 1946752 - RNA, 15 nt, Shigella flexneri 2a str. 2457T
aaaauacguucucac

SEQ ID NO: 1946753 - RNA, 16 nt, Shigella flexneri 2a str. 2457T
aaaauaccgagcagcc

SEQ ID NO: 1946754 - RNA, 19 nt, Shigella flexneri 2a str. 2457T
aaaauaaugcgacaacaga

SEQ ID NO: 1946755 - RNA, 23 nt, Shigella flexneri 2a str. 2457T
aaaauccauuuucuauuuugcau

SEQ ID NO: 1946756 - RNA, 13 nt, Shigella flexneri 2a str. 2457T
aaaaucaccauuu

SEQ ID NO: 1946757 - RNA, 22 nt, Shigella flexneri 2a str. 2457T
aaaaucaccucaucaccacaga

SEQ ID NO: 1946758 - RNA, 14 nt, Shigella flexneri 2a str. 2457T
aaaauccaccagug

SEQ ID NO: 1946759 - RNA, 13 nt, Shigella flexneri 2a str. 2457T
aaaaucaccauca

SEQ ID NO: 1946760 - RNA, 14 nt, Shigella flexneri 2a str. 2457T
aaacaaaucacuau

SEQ ID NO: 1946761 - RNA, 22 nt, Shigella flexneri 2a str. 2457T
aaacaacgagccaauaaaaaua

SEQ ID NO: 1946762 - RNA, 23 nt, Shigella flexneri 2a str. 2457T
aaaauucauucaauuaauaacac

SEQ ID NO: 1946763 - RNA, 14 nt, Shigella flexneri 2a str. 2457T
aaaauucagaugau

SEQ ID NO: 1946764 - RNA, 15 nt, Shigella flexneri 2a str. 2457T
aaaauucaucaaaug

SEQ ID NO: 1946765 - RNA, 14 nt, Shigella flexneri 2a str. 2457T
aaaauucaagacau

SEQ ID NO: 1946766 - RNA, 19 nt, Shigella flexneri 2a str. 2457T
aaaauucaagacaucaaua

SEQ ID NO: 1946767 - RNA, 19 nt, Shigella flexneri 2a str. 2457T
aaaauuucuccuucacucu

SEQ ID NO: 1946768 - RNA, 23 nt, Shigella flexneri 2a str. 2457T
aaaaucgcaaauugacuacacca

SEQ ID NO: 1946769 - RNA, 19 nt, Shigella flexneri 2a str. 2457T
aaaaucguaagcaggagau

SEQ ID NO: 1946770 - RNA, 19 nt, Shigella flexneri 2a str. 2457T
aaaaucuccugccaauaca

SEQ ID NO: 1946771 - RNA, 20 nt, Shigella flexneri 2a str. 2457T
aaaaucucgacuucuucauu

SEQ ID NO: 1946772 - RNA, 22 nt, Shigella flexneri 2a str. 2457T
aaaaugauguagaccugauaca

SEQ ID NO: 1946773 - RNA, 17 nt, Shigella flexneri 2a str. 2457T
aaaauccugccagcgug

SEQ ID NO: 1946774 - RNA, 17 nt, Shigella flexneri 2a str. 2457T
aaaaucgacaucugcaa

SEQ ID NO: 1946775 - RNA, 16 nt, Shigella flexneri 2a str. 2457T
aaaaucguaagcagga

SEQ ID NO: 1946776 - RNA, 17 nt, Shigella flexneri 2a str. 2457T
aaaaucgccgagcugaa

SEQ ID NO: 1946777 - RNA, 23 nt, Shigella flexneri 2a str. 2457T
aaaaucgccgagcugaacaagaa

SEQ ID NO: 1946778 - RNA, 15 nt, Shigella flexneri 2a str. 2457T
aaaauuauuuuaaau

SEQ ID NO: 1946779 - RNA, 19 nt, Shigella flexneri 2a str. 2457T
aaaauuauaucuuauugcu

SEQ ID NO: 1946780 - RNA, 15 nt, Shigella flexneri 2a str. 2457T
aaaaugcgaaaaaaa

SEQ ID NO: 1946781 - RNA, 14 nt, Shigella flexneri 2a str. 2457T
aaaaugcgcaugau

SEQ ID NO: 1946782 - RNA, 23 nt, Shigella flexneri 2a str. 2457T
aaaaugcgcggucagaaaauuau

SEQ ID NO: 1946783 - RNA, 20 nt, Shigella flexneri 2a str. 2457T
aaaaugcaucggcauaauca

SEQ ID NO: 1946784 - RNA, 19 nt, Shigella flexneri 2a str. 2457T
aaaugcugcaauugcggca

SEQ ID NO: 1946785 - RNA, 18 nt, Shigella flexneri 2a str. 2457T
aaaugcccgauaagcaaa

SEQ ID NO: 1946786 - RNA, 16 nt, Shigella flexneri 2a str. 2457T
aaaugccgcacaucac

SEQ ID NO: 1946787 - RNA, 13 nt, Shigella flexneri 2a str. 2457T
aaaugccuuucuc

SEQ ID NO: 1946788 - RNA, 14 nt, Shigella flexneri 2a str. 2457T
aaaugccuuucuca

SEQ ID NO: 1946789 - RNA, 11 nt, Shigella flexneri 2a str. 2457T
aaaugcgcaug

SEQ ID NO: 1946790 - RNA, 15 nt, Shigella flexneri 2a str. 2457T
aaaugcgcucagggu

SEQ ID NO: 1946791 - RNA, 13 nt, Shigella flexneri 2a str. 2457T
aaaucuucguuau

SEQ ID NO: 1946792 - RNA, 17 nt, Shigella flexneri 2a str. 2457T
aaaugaaaaaauagaau

SEQ ID NO: 1946793 - RNA, 13 nt, Shigella flexneri 2a str. 2457T
aaaugauuuccug

SEQ ID NO: 1946794 - RNA, 23 nt, Shigella flexneri 2a str. 2457T
aaaugaucgccgaagugaagagu

SEQ ID NO: 1946795 - RNA, 13 nt, Shigella flexneri 2a str. 2457T
aaaucuccagugg

SEQ ID NO: 1946796 - RNA, 11 nt, Shigella flexneri 2a str. 2457T
aaaucuccauu

SEQ ID NO: 1946797 - RNA, 21 nt, Shigella flexneri 2a str. 2457T
aaaucucagcccgaugauaaa

SEQ ID NO: 1946798 - RNA, 17 nt, Shigella flexneri 2a str. 2457T
aaaucuauuauuauuuu

SEQ ID NO: 1946799 - RNA, 22 nt, Shigella flexneri 2a str. 2457T
aaaucucacccgguacaucaau

SEQ ID NO: 1946800 - RNA, 14 nt, Shigella flexneri 2a str. 2457T
aaaucgcccagcaa

SEQ ID NO: 1946801 - RNA, 18 nt, Shigella flexneri 2a str. 2457T
aaaucgcaagaucucauu

SEQ ID NO: 1946802 - RNA, 12 nt, Shigella flexneri 2a str. 2457T
aaaucauccagc

SEQ ID NO: 1946803 - RNA, 21 nt, Shigella flexneri 2a str. 2457T
aaaucauccagacugcucagc

SEQ ID NO: 1946804 - RNA, 22 nt, Shigella flexneri 2a str. 2457T
aaaucaucauugcuguuuuaca

SEQ ID NO: 1946805 - RNA, 19 nt, Shigella flexneri 2a str. 2457T
aaaucaucauugcuguuuu

SEQ ID NO: 1946806 - RNA, 14 nt, Shigella flexneri 2a str. 2457T
aaaucaugcaauaa

SEQ ID NO: 1946807 - RNA, 14 nt, Shigella flexneri 2a str. 2457T
aaaaagcaugaauu

SEQ ID NO: 1946808 - RNA, 15 nt, Shigella flexneri 2a str. 2457T
aaaaagcauuuaaua

SEQ ID NO: 1946809 - RNA, 16 nt, Shigella flexneri 2a str. 2457T
aaaaagcauuuaauac

SEQ ID NO: 1946810 - RNA, 14 nt, Shigella flexneri 2a str. 2457T
aaaaagccggauga

SEQ ID NO: 1946811 - RNA, 14 nt, Shigella flexneri 2a str. 2457T
aaauuacaaaaagu

SEQ ID NO: 1946812 - RNA, 13 nt, Shigella flexneri 2a str. 2457T
aaaaaggcaugca

SEQ ID NO: 1946813 - RNA, 23 nt, Shigella flexneri 2a str. 2457T
aaauuaacgacgcauacucuuug

SEQ ID NO: 1946814 - RNA, 21 nt, Shigella flexneri 2a str. 2457T
aaauguugucauuacaacaag

SEQ ID NO: 1946815 - RNA, 20 nt, Shigella flexneri 2a str. 2457T
aaauuaaaucgguauuucca

SEQ ID NO: 1946816 - RNA, 18 nt, Shigella flexneri 2a str. 2457T
aaaugugguuucacuuuc

SEQ ID NO: 1946817 - RNA, 19 nt, Shigella flexneri 2a str. 2457T
aaauguuaucgggcauagg

SEQ ID NO: 1946818 - RNA, 19 nt, Shigella flexneri 2a str. 2457T
aaaugugccggaugcauca

SEQ ID NO: 1946819 - RNA, 20 nt, Shigella flexneri 2a str. 2457T
aaauuauccagcuuuuccca

SEQ ID NO: 1946820 - RNA, 23 nt, Shigella flexneri 2a str. 2457T
aaauuaccgcaccaccagcagcu

SEQ ID NO: 1946821 - RNA, 12 nt, Shigella flexneri 2a str. 2457T
aaauuacgaucc

SEQ ID NO: 1946822 - RNA, 15 nt, Shigella flexneri 2a str. 2457T
aaauuauaucuuauu

SEQ ID NO: 1946823 - RNA, 19 nt, Shigella flexneri 2a str. 2457T
aaauucaagacaucaauaa

SEQ ID NO: 1946824 - RNA, 15 nt, Shigella flexneri 2a str. 2457T
aaauucagcauuacc

SEQ ID NO: 1946825 - RNA, 21 nt, Shigella flexneri 2a str. 2457T
aaauucagcauuacccgucug

SEQ ID NO: 1946826 - RNA, 15 nt, Shigella flexneri 2a str. 2457T
aaauuccuaaaguug

SEQ ID NO: 1946827 - RNA, 21 nt, Shigella flexneri 2a str. 2457T
aaauuccuaaccgaauucaaa

SEQ ID NO: 1946828 - RNA, 19 nt, Shigella flexneri 2a str. 2457T
aaauucgcuggauuuuuga

SEQ ID NO: 1946829 - RNA, 18 nt, Shigella flexneri 2a str. 2457T
aaauucgaaauagagaaa

SEQ ID NO: 1946830 - RNA, 22 nt, Shigella flexneri 2a str. 2457T
aaauucuacagaaaugaaaaaa

SEQ ID NO: 1946831 - RNA, 23 nt, Shigella flexneri 2a str. 2457T
aaauucuacagaaaugaaaaaau

SEQ ID NO: 1946832 - RNA, 20 nt, Shigella flexneri 2a str. 2457T
aaauaagaugcgaguaaaca

SEQ ID NO: 1946833 - RNA, 22 nt, Shigella flexneri 2a str. 2457T
aaauaagcgacguuguuuucau

SEQ ID NO: 1946834 - RNA, 13 nt, Shigella flexneri 2a str. 2457T
aaauaagaaaagc

SEQ ID NO: 1946835 - RNA, 22 nt, Shigella flexneri 2a str. 2457T
aaauaacuggugcuaacagcaa

SEQ ID NO: 1946836 - RNA, 16 nt, Shigella flexneri 2a str. 2457T
aaauaacguaaaaacc

SEQ ID NO: 1946837 - RNA, 23 nt, Shigella flexneri 2a str. 2457T
aaauaacgccggagagaaaaacc

SEQ ID NO: 1946838 - RNA, 17 nt, Shigella flexneri 2a str. 2457T
aaauaaccaaauaaaau

SEQ ID NO: 1946839 - RNA, 19 nt, Shigella flexneri 2a str. 2457T
aaauaacaucccuuaacac

SEQ ID NO: 1946840 - RNA, 14 nt, Shigella flexneri 2a str. 2457T
aaauaacaucgcca

SEQ ID NO: 1946841 - RNA, 17 nt, Shigella flexneri 2a str. 2457T
aaagucgaugcgcuggc

SEQ ID NO: 1946842 - RNA, 22 nt, Shigella flexneri 2a str. 2457T
aaagucauccuuaaagaaaaag

SEQ ID NO: 1946843 - RNA, 20 nt, Shigella flexneri 2a str. 2457T
aaagucaucgcauacaaaaa

SEQ ID NO: 1946844 - RNA, 23 nt, Shigella flexneri 2a str. 2457T
aaauacuguuuaccggugccagc

SEQ ID NO: 1946845 - RNA, 14 nt, Shigella flexneri 2a str. 2457T
aaauacuuaaacag

SEQ ID NO: 1946846 - RNA, 16 nt, Shigella flexneri 2a str. 2457T
aaauacuggcuaagaa

SEQ ID NO: 1946847 - RNA, 18 nt, Shigella flexneri 2a str. 2457T
aaauacuggcuaagaagc

SEQ ID NO: 1946848 - RNA, 20 nt, Shigella flexneri 2a str. 2457T
aaauacuguuuaucuuccca

SEQ ID NO: 1946849 - RNA, 22 nt, Shigella flexneri 2a str. 2457T
aaauacuguuuaucuucccagc

SEQ ID NO: 1946850 - RNA, 17 nt, Shigella flexneri 2a str. 2457T
aaauagccccugacugg

SEQ ID NO: 1946851 - RNA, 14 nt, Shigella flexneri 2a str. 2457T
aaauagccugccag

SEQ ID NO: 1946852 - RNA, 17 nt, Shigella flexneri 2a str. 2457T
aaauagccaauucccag

SEQ ID NO: 1946853 - RNA, 23 nt, Shigella flexneri 2a str. 2457T
aaauagccagcagagcaaaaauc

SEQ ID NO: 1946854 - RNA, 17 nt, Shigella flexneri 2a str. 2457T
aaauagcuguuuauuua

SEQ ID NO: 1946855 - RNA, 23 nt, Shigella flexneri 2a str. 2457T
aaauaggaauccgggucuguaaa

SEQ ID NO: 1946856 - RNA, 22 nt, Shigella flexneri 2a str. 2457T
aaauagcgaagacuguagcagg

SEQ ID NO: 1946857 - RNA, 15 nt, Shigella flexneri 2a str. 2457T
aaauagcucaaugaa

SEQ ID NO: 1946858 - RNA, 20 nt, Shigella flexneri 2a str. 2457T
aaauacgcuggcugaacauu

SEQ ID NO: 1946859 - RNA, 19 nt, Shigella flexneri 2a str. 2457T
aaauacguaggccugauaa

SEQ ID NO: 1946860 - RNA, 19 nt, Shigella flexneri 2a str. 2457T
aaauaaucuauugauuuaa

SEQ ID NO: 1946861 - RNA, 21 nt, Shigella flexneri 2a str. 2457T
aaauaaucccgcgcaacaaau

SEQ ID NO: 1946862 - RNA, 19 nt, Shigella flexneri 2a str. 2457T
aaaucaaaaaacuggaaaa

SEQ ID NO: 1946863 - RNA, 15 nt, Shigella flexneri 2a str. 2457T
aaaucaaacagaaua

SEQ ID NO: 1946864 - RNA, 15 nt, Shigella flexneri 2a str. 2457T
aaaucaaaauaaugu

SEQ ID NO: 1946865 - RNA, 17 nt, Shigella flexneri 2a str. 2457T
aaauaugaaaucucuug

SEQ ID NO: 1946866 - RNA, 17 nt, Shigella flexneri 2a str. 2457T
aaaucaccgccaccagc

SEQ ID NO: 1946867 - RNA, 11 nt, Shigella flexneri 2a str. 2457T
aaaucaccaca

SEQ ID NO: 1946868 - RNA, 21 nt, Shigella flexneri 2a str. 2457T
aaaucacagcgagccuggcug

SEQ ID NO: 1946869 - RNA, 12 nt, Shigella flexneri 2a str. 2457T
aaaucaaugguc

SEQ ID NO: 1946870 - RNA, 19 nt, Shigella flexneri 2a str. 2457T
aaaucaacaugaaaauaac

SEQ ID NO: 1946871 - RNA, 22 nt, Shigella flexneri 2a str. 2457T
aaaucaacgacaaaaauaccac

SEQ ID NO: 1946872 - RNA, 14 nt, Shigella flexneri 2a str. 2457T
aaaucaagcgccgc

SEQ ID NO: 1946873 - RNA, 22 nt, Shigella flexneri 2a str. 2457T
aaaucacuauuaaagaaaguaa

SEQ ID NO: 1946874 - RNA, 16 nt, Shigella flexneri 2a str. 2457T
aaaucacgauugcugc

SEQ ID NO: 1946875 - RNA, 18 nt, Shigella flexneri 2a str. 2457T
aaaucacgucgauuuuua

SEQ ID NO: 1946876 - RNA, 21 nt, Shigella flexneri 2a str. 2457T
aaaucacgcugcugauuaaaa

SEQ ID NO: 1946877 - RNA, 14 nt, Shigella flexneri 2a str. 2457T
aaaucagaaaucac

SEQ ID NO: 1946878 - RNA, 14 nt, Shigella flexneri 2a str. 2457T
aaaguauuugacug

SEQ ID NO: 1946879 - RNA, 15 nt, Shigella flexneri 2a str. 2457T
aaagucagauaaaaa

SEQ ID NO: 1946880 - RNA, 16 nt, Shigella flexneri 2a str. 2457T
aaaggccagccaggca

SEQ ID NO: 1946881 - RNA, 17 nt, Shigella flexneri 2a str. 2457T
aaaggccagcaaucccc

SEQ ID NO: 1946882 - RNA, 23 nt, Shigella flexneri 2a str. 2457T
aaaggccgcaggcuguuaccccu

SEQ ID NO: 1946883 - RNA, 12 nt, Shigella flexneri 2a str. 2457T
aaagggcaaagu

SEQ ID NO: 1946884 - RNA, 14 nt, Shigella flexneri 2a str. 2457T
aaagggcaaaguca

SEQ ID NO: 1946885 - RNA, 14 nt, Shigella flexneri 2a str. 2457T
aaagggagcuaucu

SEQ ID NO: 1946886 - RNA, 15 nt, Shigella flexneri 2a str. 2457T
aaagggaugccccca

SEQ ID NO: 1946887 - RNA, 15 nt, Shigella flexneri 2a str. 2457T
aaaggggugaaaaaa

SEQ ID NO: 1946888 - RNA, 12 nt, Shigella flexneri 2a str. 2457T
aaaguaaaaaag

SEQ ID NO: 1946889 - RNA, 14 nt, Shigella flexneri 2a str. 2457T
aaaguaaaaaagaa

SEQ ID NO: 1946890 - RNA, 15 nt, Shigella flexneri 2a str. 2457T
aaagccgaagcuguc

SEQ ID NO: 1946891 - RNA, 20 nt, Shigella flexneri 2a str. 2457T
aaagccgccaucucuuccag

SEQ ID NO: 1946892 - RNA, 15 nt, Shigella flexneri 2a str. 2457T
aaagcugcugaauca

SEQ ID NO: 1946893 - RNA, 16 nt, Shigella flexneri 2a str. 2457T
aaagcguuuaugcgca

SEQ ID NO: 1946894 - RNA, 23 nt, Shigella flexneri 2a str. 2457T
aaagccgcuuaacgguguuuagu

SEQ ID NO: 1946895 - RNA, 15 nt, Shigella flexneri 2a str. 2457T
aaaggcaccuggaaa

SEQ ID NO: 1946896 - RNA, 16 nt, Shigella flexneri 2a str. 2457T
aaaggcaaaaugccag

SEQ ID NO: 1946897 - RNA, 18 nt, Shigella flexneri 2a str. 2457T
aaaggaaggucauccaaa

SEQ ID NO: 1946898 - RNA, 21 nt, Shigella flexneri 2a str. 2457T
aaagcugcugaccaccagcac

SEQ ID NO: 1946899 - RNA, 17 nt, Shigella flexneri 2a str. 2457T
aaagcugucaccaauca

SEQ ID NO: 1946900 - RNA, 16 nt, Shigella flexneri 2a str. 2457T
aaagcuguaucccagc

SEQ ID NO: 1946901 - RNA, 21 nt, Shigella flexneri 2a str. 2457T
aaagauaccagacauguggau

SEQ ID NO: 1946902 - RNA, 23 nt, Shigella flexneri 2a str. 2457T
aaagauauuggggguaauucccu

SEQ ID NO: 1946903 - RNA, 13 nt, Shigella flexneri 2a str. 2457T
aaagcaaaaaaag

SEQ ID NO: 1946904 - RNA, 15 nt, Shigella flexneri 2a str. 2457T
aaagcaaaaaaagaa

SEQ ID NO: 1946905 - RNA, 21 nt, Shigella flexneri 2a str. 2457T
aaagauuguuggcaaaaaaau

SEQ ID NO: 1946906 - RNA, 22 nt, Shigella flexneri 2a str. 2457T
aaagauuugacccaucugccag

SEQ ID NO: 1946907 - RNA, 19 nt, Shigella flexneri 2a str. 2457T
aaagcagacaacccacaca

SEQ ID NO: 1946908 - RNA, 21 nt, Shigella flexneri 2a str. 2457T
aaagcagacaacccacacauu

SEQ ID NO: 1946909 - RNA, 17 nt, Shigella flexneri 2a str. 2457T
aaagcagagcagggaag

SEQ ID NO: 1946910 - RNA, 22 nt, Shigella flexneri 2a str. 2457T
aaagccaauuaacgaaaucuca

SEQ ID NO: 1946911 - RNA, 14 nt, Shigella flexneri 2a str. 2457T
aaagccaaccugcg

SEQ ID NO: 1946912 - RNA, 16 nt, Shigella flexneri 2a str. 2457T
aaagcauuuuuucaca

SEQ ID NO: 1946913 - RNA, 18 nt, Shigella flexneri 2a str. 2457T
aaagcauuuuuucacaug

SEQ ID NO: 1946914 - RNA, 13 nt, Shigella flexneri 2a str. 2457T
aaagccaacagca

SEQ ID NO: 1946915 - RNA, 14 nt, Shigella flexneri 2a str. 2457T
aaagccaacagcag

SEQ ID NO: 1946916 - RNA, 17 nt, Shigella flexneri 2a str. 2457T
aaagacgaagauuuuac

SEQ ID NO: 1946917 - RNA, 15 nt, Shigella flexneri 2a str. 2457T
aaagacgccaucaau

SEQ ID NO: 1946918 - RNA, 20 nt, Shigella flexneri 2a str. 2457T
aaagacguuaaaaaaggugc

SEQ ID NO: 1946919 - RNA, 13 nt, Shigella flexneri 2a str. 2457T
aaagacguuaaaa

SEQ ID NO: 1946920 - RNA, 15 nt, Shigella flexneri 2a str. 2457T
aaagaccugaccaga

SEQ ID NO: 1946921 - RNA, 23 nt, Shigella flexneri 2a str. 2457T
aaacuuuucccuacugcugacau

SEQ ID NO: 1946922 - RNA, 20 nt, Shigella flexneri 2a str. 2457T
aaacuuuucccuacugcuga

SEQ ID NO: 1946923 - RNA, 12 nt, Shigella flexneri 2a str. 2457T
aaacuuuuaaau

SEQ ID NO: 1946924 - RNA, 16 nt, Shigella flexneri 2a str. 2457T
aaagaaggcauaacuc

SEQ ID NO: 1946925 - RNA, 13 nt, Shigella flexneri 2a str. 2457T
aaagaaggaaaau

SEQ ID NO: 1946926 - RNA, 18 nt, Shigella flexneri 2a str. 2457T
aaagaagucucugaaauu

SEQ ID NO: 1946927 - RNA, 16 nt, Shigella flexneri 2a str. 2457T
aaagagaguuacuggc

SEQ ID NO: 1946928 - RNA, 13 nt, Shigella flexneri 2a str. 2457T
aaagagacagaau

SEQ ID NO: 1946929 - RNA, 16 nt, Shigella flexneri 2a str. 2457T
aaagagacgcugaaaa

SEQ ID NO: 1946930 - RNA, 16 nt, Shigella flexneri 2a str. 2457T
aaagagaacucuuuuu

SEQ ID NO: 1946931 - RNA, 19 nt, Shigella flexneri 2a str. 2457T
aaagagcauuacacgcggc

SEQ ID NO: 1946932 - RNA, 18 nt, Shigella flexneri 2a str. 2457T
aaagaguucaaagccgaa

SEQ ID NO: 1946933 - RNA, 14 nt, Shigella flexneri 2a str. 2457T
aaacuugauacuga

SEQ ID NO: 1946934 - RNA, 17 nt, Shigella flexneri 2a str. 2457T
aaacuugauacugaaca

SEQ ID NO: 1946935 - RNA, 18 nt, Shigella flexneri 2a str. 2457T
aaacuugaacgcgagaaa

SEQ ID NO: 1946936 - RNA, 22 nt, Shigella flexneri 2a str. 2457T
aaacuugaacgcgagaaaagca

SEQ ID NO: 1946937 - RNA, 16 nt, Shigella flexneri 2a str. 2457T
aaacuuucauaaacac

SEQ ID NO: 1946938 - RNA, 18 nt, Shigella flexneri 2a str. 2457T
aaacuuaugcagcugcuc

SEQ ID NO: 1946939 - RNA, 15 nt, Shigella flexneri 2a str. 2457T
aaacuucacuucccc

SEQ ID NO: 1946940 - RNA, 16 nt, Shigella flexneri 2a str. 2457T
aaacuucacuuccccg

SEQ ID NO: 1946941 - RNA, 14 nt, Shigella flexneri 2a str. 2457T
aaacuucacuuccc

SEQ ID NO: 1946942 - RNA, 17 nt, Shigella flexneri 2a str. 2457T
aaacuuccggcagaaau

SEQ ID NO: 1946943 - RNA, 15 nt, Shigella flexneri 2a str. 2457T
aaacuucgucacagc

SEQ ID NO: 1946944 - RNA, 17 nt, Shigella flexneri 2a str. 2457T
aaacuucguuagguucu

SEQ ID NO: 1946945 - RNA, 22 nt, Shigella flexneri 2a str. 2457T
aaacugcgucgacauagccauc

SEQ ID NO: 1946946 - RNA, 14 nt, Shigella flexneri 2a str. 2457T
aaacuggaagauuu

SEQ ID NO: 1946947 - RNA, 13 nt, Shigella flexneri 2a str. 2457T
aaacuggcugugc

SEQ ID NO: 1946948 - RNA, 21 nt, Shigella flexneri 2a str. 2457T
aaacuggguuuugaucuccag

SEQ ID NO: 1946949 - RNA, 14 nt, Shigella flexneri 2a str. 2457T
aaacucaugggucu

SEQ ID NO: 1946950 - RNA, 18 nt, Shigella flexneri 2a str. 2457T
aaacucauaaauucaaag

SEQ ID NO: 1946951 - RNA, 14 nt, Shigella flexneri 2a str. 2457T
aaacuccagcccuu

SEQ ID NO: 1946952 - RNA, 20 nt, Shigella flexneri 2a str. 2457T
aaacucgcgcaggcugacau

SEQ ID NO: 1946953 - RNA, 20 nt, Shigella flexneri 2a str. 2457T
aaacucgcugccagcacuuu

SEQ ID NO: 1946954 - RNA, 20 nt, Shigella flexneri 2a str. 2457T
aaacucucaucuuugaaauc

SEQ ID NO: 1946955 - RNA, 15 nt, Shigella flexneri 2a str. 2457T
aaacuacaggcaacg

SEQ ID NO: 1946956 - RNA, 22 nt, Shigella flexneri 2a str. 2457T
aaacuaaucgacaguugcugcg

SEQ ID NO: 1946957 - RNA, 14 nt, Shigella flexneri 2a str. 2457T
aaacgccugcuccu

SEQ ID NO: 1946958 - RNA, 22 nt, Shigella flexneri 2a str. 2457T
aaacgccuuauccagccuacaa

SEQ ID NO: 1946959 - RNA, 14 nt, Shigella flexneri 2a str. 2457T
aaacgcgcgcugga

SEQ ID NO: 1946960 - RNA, 16 nt, Shigella flexneri 2a str. 2457T
aaacgccuuauccggc

SEQ ID NO: 1946961 - RNA, 23 nt, Shigella flexneri 2a str. 2457T
aaacgcguuacucuggcgcugga

SEQ ID NO: 1946962 - RNA, 12 nt, Shigella flexneri 2a str. 2457T
aaacgcucggca

SEQ ID NO: 1946963 - RNA, 21 nt, Shigella flexneri 2a str. 2457T
aaacgcuuauaguaacguuug

SEQ ID NO: 1946964 - RNA, 12 nt, Shigella flexneri 2a str. 2457T
aaacgcuuuuuu

SEQ ID NO: 1946965 - RNA, 20 nt, Shigella flexneri 2a str. 2457T
aaacggcauaugccaugcga

SEQ ID NO: 1946966 - RNA, 22 nt, Shigella flexneri 2a str. 2457T
aaacgggggcgauuuuccucca

SEQ ID NO: 1946967 - RNA, 18 nt, Shigella flexneri 2a str. 2457T
aaacggcguugagcaauc

SEQ ID NO: 1946968 - RNA, 16 nt, Shigella flexneri 2a str. 2457T
aaacggugauacugau

SEQ ID NO: 1946969 - RNA, 15 nt, Shigella flexneri 2a str. 2457T
aaacggugaucaaaa

SEQ ID NO: 1946970 - RNA, 18 nt, Shigella flexneri 2a str. 2457T
aaacgguugauaaaugag

SEQ ID NO: 1946971 - RNA, 20 nt, Shigella flexneri 2a str. 2457T
aaacgguuucagcagcggca

SEQ ID NO: 1946972 - RNA, 15 nt, Shigella flexneri 2a str. 2457T
aaacgucucacuaac

SEQ ID NO: 1946973 - RNA, 20 nt, Shigella flexneri 2a str. 2457T
aaacguugucaguucuuuua

SEQ ID NO: 1946974 - RNA, 22 nt, Shigella flexneri 2a str. 2457T
aaacguugucaguucuuuuauu

SEQ ID NO: 1946975 - RNA, 20 nt, Shigella flexneri 2a str. 2457T
aaacguuagcacgaaccguc

SEQ ID NO: 1946976 - RNA, 14 nt, Shigella flexneri 2a str. 2457T
aaacguuucaaaca

SEQ ID NO: 1946977 - RNA, 12 nt, Shigella flexneri 2a str. 2457T
aaacuaaaaaca

SEQ ID NO: 1946978 - RNA, 14 nt, Shigella flexneri 2a str. 2457T
aaacuaaaaacagc

SEQ ID NO: 1946979 - RNA, 15 nt, Shigella flexneri 2a str. 2457T
aaaccugacaacaaa

SEQ ID NO: 1946980 - RNA, 19 nt, Shigella flexneri 2a str. 2457T
aaaccugcgggaugguugg

SEQ ID NO: 1946981 - RNA, 20 nt, Shigella flexneri 2a str. 2457T
aaacaagaucgcccugaggg

SEQ ID NO: 1946982 - RNA, 22 nt, Shigella flexneri 2a str. 2457T
aaacaagauccaguauccggau

SEQ ID NO: 1946983 - RNA, 18 nt, Shigella flexneri 2a str. 2457T
aaacaagccgaaacggaa

SEQ ID NO: 1946984 - RNA, 15 nt, Shigella flexneri 2a str. 2457T
aaacaagcguacaaa

SEQ ID NO: 1946985 - RNA, 21 nt, Shigella flexneri 2a str. 2457T
aaacaacguggaacaaauaga

SEQ ID NO: 1946986 - RNA, 14 nt, Shigella flexneri 2a str. 2457T
aaacgaaagcaggg

SEQ ID NO: 1946987 - RNA, 16 nt, Shigella flexneri 2a str. 2457T
aaacgaaccauaaaau

SEQ ID NO: 1946988 - RNA, 18 nt, Shigella flexneri 2a str. 2457T
aaacgaaccauaaaauca

SEQ ID NO: 1946989 - RNA, 22 nt, Shigella flexneri 2a str. 2457T
aaacgaauggcaaaacggcucu

SEQ ID NO: 1946990 - RNA, 18 nt, Shigella flexneri 2a str. 2457T
aaaccuguugaaauuauu

SEQ ID NO: 1946991 - RNA, 18 nt, Shigella flexneri 2a str. 2457T
aaacgauuaauuacacag

SEQ ID NO: 1946992 - RNA, 18 nt, Shigella flexneri 2a str. 2457T
aaacgacgcagaacugaa

SEQ ID NO: 1946993 - RNA, 16 nt, Shigella flexneri 2a str. 2457T
aaacgaccaugacacu

SEQ ID NO: 1946994 - RNA, 16 nt, Shigella flexneri 2a str. 2457T
aaacgcagucuuccca

SEQ ID NO: 1946995 - RNA, 15 nt, Shigella flexneri 2a str. 2457T
aaacgcaacauugcc

SEQ ID NO: 1946996 - RNA, 19 nt, Shigella flexneri 2a str. 2457T
aaacgcaagguuguugaaa

SEQ ID NO: 1946997 - RNA, 17 nt, Shigella flexneri 2a str. 2457T
aaacgcccaaugcccag

SEQ ID NO: 1946998 - RNA, 15 nt, Shigella flexneri 2a str. 2457T
auuuaauaauaagua

SEQ ID NO: 1946999 - RNA, 23 nt, Shigella flexneri 2a str. 2457T
auuuaauaagaauaagcuauaaa

SEQ ID NO: 1947000 - RNA, 18 nt, Shigella flexneri 2a str. 2457T
auuuaaccaacaauaaaa

SEQ ID NO: 1947001 - RNA, 16 nt, Shigella flexneri 2a str. 2457T
auuuaaccugagcuug

SEQ ID NO: 1947002 - RNA, 20 nt, Shigella flexneri 2a str. 2457T
auuuaacccuucaagaauua

SEQ ID NO: 1947003 - RNA, 13 nt, Shigella flexneri 2a str. 2457T
auuuauauaaaua

SEQ ID NO: 1947004 - RNA, 19 nt, Shigella flexneri 2a str. 2457T
auuuauauaaauauaauca

SEQ ID NO: 1947005 - RNA, 14 nt, Shigella flexneri 2a str. 2457T
auuuaucuucgagc

SEQ ID NO: 1947006 - RNA, 15 nt, Shigella flexneri 2a str. 2457T
auuuaucuucccagc

SEQ ID NO: 1947007 - RNA, 12 nt, Shigella flexneri 2a str. 2457T
auuuaucuuccc

SEQ ID NO: 1947008 - RNA, 15 nt, Shigella flexneri 2a str. 2457T
aaaaguccaggcugc

SEQ ID NO: 1947009 - RNA, 20 nt, Shigella flexneri 2a str. 2457T
auuuauauuacgaauauaaa

SEQ ID NO: 1947010 - RNA, 21 nt, Shigella flexneri 2a str. 2457T
auuuauuuccuucgcuuuaau

SEQ ID NO: 1947011 - RNA, 22 nt, Shigella flexneri 2a str. 2457T
auuucaaugcauuaucagagau

SEQ ID NO: 1947012 - RNA, 22 nt, Shigella flexneri 2a str. 2457T
auuucacaacgguccgguugca

SEQ ID NO: 1947013 - RNA, 20 nt, Shigella flexneri 2a str. 2457T
auuucaauaugauaaaccuc

SEQ ID NO: 1947014 - RNA, 16 nt, Shigella flexneri 2a str. 2457T
auuucaaucacaucau

SEQ ID NO: 1947015 - RNA, 20 nt, Shigella flexneri 2a str. 2457T
auuucaauaucgccuuuugc

SEQ ID NO: 1947016 - RNA, 22 nt, Shigella flexneri 2a str. 2457T
auuuauugaaagcauaguuuuu

SEQ ID NO: 1947017 - RNA, 16 nt, Shigella flexneri 2a str. 2457T
auuuauuggugagaac

SEQ ID NO: 1947018 - RNA, 21 nt, Shigella flexneri 2a str. 2457T
auuuauuaucuggcaagccug

SEQ ID NO: 1947019 - RNA, 18 nt, Shigella flexneri 2a str. 2457T
auuuauuaccuuuuuacc

SEQ ID NO: 1947020 - RNA, 14 nt, Shigella flexneri 2a str. 2457T
auuuaugauauuuu

SEQ ID NO: 1947021 - RNA, 13 nt, Shigella flexneri 2a str. 2457T
auuuaugacaaac

SEQ ID NO: 1947022 - RNA, 22 nt, Shigella flexneri 2a str. 2457T
auuuaugccauguucaucaagc

SEQ ID NO: 1947023 - RNA, 14 nt, Shigella flexneri 2a str. 2457T
auuucccugacaaa

SEQ ID NO: 1947024 - RNA, 15 nt, Shigella flexneri 2a str. 2457T
auuuccgccaccuga

SEQ ID NO: 1947025 - RNA, 16 nt, Shigella flexneri 2a str. 2457T
auuucccggcacauac

SEQ ID NO: 1947026 - RNA, 16 nt, Shigella flexneri 2a str. 2457T
auuucccgucgaagac

SEQ ID NO: 1947027 - RNA, 20 nt, Shigella flexneri 2a str. 2457T
auuucccagauagcaacagc

SEQ ID NO: 1947028 - RNA, 14 nt, Shigella flexneri 2a str. 2457T
auuucccagcaaga

SEQ ID NO: 1947029 - RNA, 19 nt, Shigella flexneri 2a str. 2457T
auuucccagcaagaaccau

SEQ ID NO: 1947030 - RNA, 18 nt, Shigella flexneri 2a str. 2457T
auuuccccuguugcaaac

SEQ ID NO: 1947031 - RNA, 14 nt, Shigella flexneri 2a str. 2457T
auuucgcugcccau

SEQ ID NO: 1947032 - RNA, 16 nt, Shigella flexneri 2a str. 2457T
auuucggcauuuuugg

SEQ ID NO: 1947033 - RNA, 17 nt, Shigella flexneri 2a str. 2457T
auuucggcgugcgcgcc

SEQ ID NO: 1947034 - RNA, 22 nt, Shigella flexneri 2a str. 2457T
auuucacguucacguaaguacu

SEQ ID NO: 1947035 - RNA, 20 nt, Shigella flexneri 2a str. 2457T
auuucacuauguuaguuaca

SEQ ID NO: 1947036 - RNA, 21 nt, Shigella flexneri 2a str. 2457T
auuucaaugcgcguaauuugc

SEQ ID NO: 1947037 - RNA, 13 nt, Shigella flexneri 2a str. 2457T
auuucacaguaau

SEQ ID NO: 1947038 - RNA, 19 nt, Shigella flexneri 2a str. 2457T
auuucacaguaaugauuua

SEQ ID NO: 1947039 - RNA, 19 nt, Shigella flexneri 2a str. 2457T
auuuccauugcucuggcaa

SEQ ID NO: 1947040 - RNA, 17 nt, Shigella flexneri 2a str. 2457T
auuucucggcaaauuca

SEQ ID NO: 1947041 - RNA, 13 nt, Shigella flexneri 2a str. 2457T
auuucguuguguc

SEQ ID NO: 1947042 - RNA, 19 nt, Shigella flexneri 2a str. 2457T
auuucguagacugcagcgg

SEQ ID NO: 1947043 - RNA, 20 nt, Shigella flexneri 2a str. 2457T
auuucguccauguuggagau

SEQ ID NO: 1947044 - RNA, 22 nt, Shigella flexneri 2a str. 2457T
auuucguccauguuggagauaa

SEQ ID NO: 1947045 - RNA, 16 nt, Shigella flexneri 2a str. 2457T
auuucugauuguuaac

SEQ ID NO: 1947046 - RNA, 21 nt, Shigella flexneri 2a str. 2457T
auuucucuuucguuccggcuu

SEQ ID NO: 1947047 - RNA, 16 nt, Shigella flexneri 2a str. 2457T
auuucugcuucguuaa

SEQ ID NO: 1947048 - RNA, 17 nt, Shigella flexneri 2a str. 2457T
auuucugccuugaguuu

SEQ ID NO: 1947049 - RNA, 19 nt, Shigella flexneri 2a str. 2457T
auuucugccuugaguuuuu

SEQ ID NO: 1947050 - RNA, 21 nt, Shigella flexneri 2a str. 2457T
auuucugccuugaguuuuuca

SEQ ID NO: 1947051 - RNA, 22 nt, Shigella flexneri 2a str. 2457T
auuucuucaucgguauaaccaa

SEQ ID NO: 1947052 - RNA, 13 nt, Shigella flexneri 2a str. 2457T
auuucuucugguu

SEQ ID NO: 1947053 - RNA, 19 nt, Shigella flexneri 2a str. 2457T
auuucuguauuacagaggu

SEQ ID NO: 1947054 - RNA, 15 nt, Shigella flexneri 2a str. 2457T
auuucuguauaauca

SEQ ID NO: 1947055 - RNA, 20 nt, Shigella flexneri 2a str. 2457T
auuucugugcagccaaaaau

SEQ ID NO: 1947056 - RNA, 16 nt, Shigella flexneri 2a str. 2457T
auuuuauuucuguauu

SEQ ID NO: 1947057 - RNA, 22 nt, Shigella flexneri 2a str. 2457T
auuuucaaaauaucgacauuca

SEQ ID NO: 1947058 - RNA, 17 nt, Shigella flexneri 2a str. 2457T
auuuuauacuuuuucgc

SEQ ID NO: 1947059 - RNA, 20 nt, Shigella flexneri 2a str. 2457T
auuuuaggaugcugcaauaa

SEQ ID NO: 1947060 - RNA, 15 nt, Shigella flexneri 2a str. 2457T
auuuuaauaaaucac

SEQ ID NO: 1947061 - RNA, 20 nt, Shigella flexneri 2a str. 2457T
auuuuacaggguaaaaccau

SEQ ID NO: 1947062 - RNA, 13 nt, Shigella flexneri 2a str. 2457T
auuuuacauccug

SEQ ID NO: 1947063 - RNA, 14 nt, Shigella flexneri 2a str. 2457T
auuuuaagcaagug

SEQ ID NO: 1947064 - RNA, 21 nt, Shigella flexneri 2a str. 2457T
auuuuaaauuuccucuuguca

SEQ ID NO: 1947065 - RNA, 16 nt, Shigella flexneri 2a str. 2457T
auuugaucaaauacuu

SEQ ID NO: 1947066 - RNA, 14 nt, Shigella flexneri 2a str. 2457T
auuugaucucuuca

SEQ ID NO: 1947067 - RNA, 13 nt, Shigella flexneri 2a str. 2457T
auuugauauuuau

SEQ ID NO: 1947068 - RNA, 17 nt, Shigella flexneri 2a str. 2457T
auuugaggaagcugccu

SEQ ID NO: 1947069 - RNA, 17 nt, Shigella flexneri 2a str. 2457T
auuugaguucacugccg

SEQ ID NO: 1947070 - RNA, 23 nt, Shigella flexneri 2a str. 2457T
auuuuuaacuucgcguucugugg

SEQ ID NO: 1947071 - RNA, 18 nt, Shigella flexneri 2a str. 2457T
auuuuucacccuucaauc

SEQ ID NO: 1947072 - RNA, 17 nt, Shigella flexneri 2a str. 2457T
auuuuucacuuaaugaa

SEQ ID NO: 1947073 - RNA, 23 nt, Shigella flexneri 2a str. 2457T
auuuugugcagcaugcacccuca

SEQ ID NO: 1947074 - RNA, 20 nt, Shigella flexneri 2a str. 2457T
auuuugugauauguaugaag

SEQ ID NO: 1947075 - RNA, 15 nt, Shigella flexneri 2a str. 2457T
auuuuuaaacaucaa

SEQ ID NO: 1947076 - RNA, 17 nt, Shigella flexneri 2a str. 2457T
auuuuuaaacaucaaac

SEQ ID NO: 1947077 - RNA, 16 nt, Shigella flexneri 2a str. 2457T
auuuugugauauguau

SEQ ID NO: 1947078 - RNA, 19 nt, Shigella flexneri 2a str. 2457T
auuuuggcccgacgcuuga

SEQ ID NO: 1947079 - RNA, 23 nt, Shigella flexneri 2a str. 2457T
auuuugcuuccggcaagcaaaug

SEQ ID NO: 1947080 - RNA, 17 nt, Shigella flexneri 2a str. 2457T
auuuugcuuuugauguu

SEQ ID NO: 1947081 - RNA, 18 nt, Shigella flexneri 2a str. 2457T
auuuugcugugcuuuaca

SEQ ID NO: 1947082 - RNA, 16 nt, Shigella flexneri 2a str. 2457T
auuuugcuggaaaagu

SEQ ID NO: 1947083 - RNA, 21 nt, Shigella flexneri 2a str. 2457T
auuuucauugccgcaucgaau

SEQ ID NO: 1947084 - RNA, 18 nt, Shigella flexneri 2a str. 2457T
auuuuccuugaaaaagag

SEQ ID NO: 1947085 - RNA, 14 nt, Shigella flexneri 2a str. 2457T
auuuucgccacuuc

SEQ ID NO: 1947086 - RNA, 18 nt, Shigella flexneri 2a str. 2457T
auuuucgccaucucaaaa

SEQ ID NO: 1947087 - RNA, 22 nt, Shigella flexneri 2a str. 2457T
auuuuucgagggugcgaauaag

SEQ ID NO: 1947088 - RNA, 15 nt, Shigella flexneri 2a str. 2457T
auuuuucgcuaaaaa

SEQ ID NO: 1947089 - RNA, 12 nt, Shigella flexneri 2a str. 2457T
caaaaaaacaua

SEQ ID NO: 1947090 - RNA, 13 nt, Shigella flexneri 2a str. 2457T
caaaaaaacauaa

SEQ ID NO: 1947091 - RNA, 16 nt, Shigella flexneri 2a str. 2457T
auuuuuuuucaggaaa

SEQ ID NO: 1947092 - RNA, 22 nt, Shigella flexneri 2a str. 2457T
auuuuuucacauguucauuuau

SEQ ID NO: 1947093 - RNA, 12 nt, Shigella flexneri 2a str. 2457T
caaaaaaugaaa

SEQ ID NO: 1947094 - RNA, 19 nt, Shigella flexneri 2a str. 2457T
caaaaaaucaacgacaaaa

SEQ ID NO: 1947095 - RNA, 17 nt, Shigella flexneri 2a str. 2457T
caaaaaaggcugacaaa

SEQ ID NO: 1947096 - RNA, 15 nt, Shigella flexneri 2a str. 2457T
aaaagggcuggaagc

SEQ ID NO: 1947097 - RNA, 18 nt, Shigella flexneri 2a str. 2457T
aaaagggagcuaucuccc

SEQ ID NO: 1947098 - RNA, 15 nt, Shigella flexneri 2a str. 2457T
auugggcgaucuccc

SEQ ID NO: 1947099 - RNA, 17 nt, Shigella flexneri 2a str. 2457T
auugggcgaaagaaaag

SEQ ID NO: 1947100 - RNA, 17 nt, Shigella flexneri 2a str. 2457T
auuggucuggaacuggc

SEQ ID NO: 1947101 - RNA, 16 nt, Shigella flexneri 2a str. 2457T
auugggcgaaagaaaa

SEQ ID NO: 1947102 - RNA, 15 nt, Shigella flexneri 2a str. 2457T
auuggcuucauugau

SEQ ID NO: 1947103 - RNA, 17 nt, Shigella flexneri 2a str. 2457T
auuggcggcguccugga

SEQ ID NO: 1947104 - RNA, 13 nt, Shigella flexneri 2a str. 2457T
auugcuucaagau

SEQ ID NO: 1947105 - RNA, 16 nt, Shigella flexneri 2a str. 2457T
auugcuucaccagcag

SEQ ID NO: 1947106 - RNA, 20 nt, Shigella flexneri 2a str. 2457T
auugcugcugaagcaacagu

SEQ ID NO: 1947107 - RNA, 14 nt, Shigella flexneri 2a str. 2457T
auuguagaaaaucu

SEQ ID NO: 1947108 - RNA, 17 nt, Shigella flexneri 2a str. 2457T
auuguuggcaaaaaaau

SEQ ID NO: 1947109 - RNA, 23 nt, Shigella flexneri 2a str. 2457T
auuuaacaccaucauauuuucca

SEQ ID NO: 1947110 - RNA, 16 nt, Shigella flexneri 2a str. 2457T
auuuaacaguugucca

SEQ ID NO: 1947111 - RNA, 21 nt, Shigella flexneri 2a str. 2457T
auugugguccgcuuguaggcc

SEQ ID NO: 1947112 - RNA, 21 nt, Shigella flexneri 2a str. 2457T
auuguguaaauucaauaaauu

SEQ ID NO: 1947113 - RNA, 17 nt, Shigella flexneri 2a str. 2457T
auugugugauacuucuu

SEQ ID NO: 1947114 - RNA, 16 nt, Shigella flexneri 2a str. 2457T
auugucgauacgccuc

SEQ ID NO: 1947115 - RNA, 17 nt, Shigella flexneri 2a str. 2457T
auugucgcagaagccac

SEQ ID NO: 1947116 - RNA, 18 nt, Shigella flexneri 2a str. 2457T
auuguuauaccaguccac

SEQ ID NO: 1947117 - RNA, 21 nt, Shigella flexneri 2a str. 2457T
auuguuaucguuugcauuauc

SEQ ID NO: 1947118 - RNA, 21 nt, Shigella flexneri 2a str. 2457T
auuguucuguaugccggauaa

SEQ ID NO: 1947119 - RNA, 22 nt, Shigella flexneri 2a str. 2457T
auuguugauaaggaaauucagc

SEQ ID NO: 1947120 - RNA, 18 nt, Shigella flexneri 2a str. 2457T
auugccgaagaccagauu

SEQ ID NO: 1947121 - RNA, 22 nt, Shigella flexneri 2a str. 2457T
auugcccuguuugucgaucauc

SEQ ID NO: 1947122 - RNA, 20 nt, Shigella flexneri 2a str. 2457T
auugccgcgucguccucuuc

SEQ ID NO: 1947123 - RNA, 23 nt, Shigella flexneri 2a str. 2457T
auugccgcgucguccucuucacc

SEQ ID NO: 1947124 - RNA, 15 nt, Shigella flexneri 2a str. 2457T
auugccgccucugcc

SEQ ID NO: 1947125 - RNA, 20 nt, Shigella flexneri 2a str. 2457T
auugccgggcuaacuucuuu

SEQ ID NO: 1947126 - RNA, 20 nt, Shigella flexneri 2a str. 2457T
auugccggacagaucugccu

SEQ ID NO: 1947127 - RNA, 13 nt, Shigella flexneri 2a str. 2457T
auugccaucuaaa

SEQ ID NO: 1947128 - RNA, 20 nt, Shigella flexneri 2a str. 2457T
auugccagaugcgacgcugg

SEQ ID NO: 1947129 - RNA, 18 nt, Shigella flexneri 2a str. 2457T
auugcgugucccacuggu

SEQ ID NO: 1947130 - RNA, 14 nt, Shigella flexneri 2a str. 2457T
auugcgggccaaag

SEQ ID NO: 1947131 - RNA, 23 nt, Shigella flexneri 2a str. 2457T
auugcugccgauggcacaaucuc

SEQ ID NO: 1947132 - RNA, 19 nt, Shigella flexneri 2a str. 2457T
auugcguuuaguuacacca

SEQ ID NO: 1947133 - RNA, 19 nt, Shigella flexneri 2a str. 2457T
auugccguuucgcagguuc

SEQ ID NO: 1947134 - RNA, 18 nt, Shigella flexneri 2a str. 2457T
auugccgggugcaagagu

SEQ ID NO: 1947135 - RNA, 16 nt, Shigella flexneri 2a str. 2457T
auugccuggcuugccg

SEQ ID NO: 1947136 - RNA, 16 nt, Shigella flexneri 2a str. 2457T
auugccugauggccug

SEQ ID NO: 1947137 - RNA, 18 nt, Shigella flexneri 2a str. 2457T
auugcggaacaucgccug

SEQ ID NO: 1947138 - RNA, 13 nt, Shigella flexneri 2a str. 2457T
auugcagucauaa

SEQ ID NO: 1947139 - RNA, 19 nt, Shigella flexneri 2a str. 2457T
auugcagauaccacaucaa

SEQ ID NO: 1947140 - RNA, 17 nt, Shigella flexneri 2a str. 2457T
auugcagauaccacauc

SEQ ID NO: 1947141 - RNA, 14 nt, Shigella flexneri 2a str. 2457T
auugcagacaaagu

SEQ ID NO: 1947142 - RNA, 19 nt, Shigella flexneri 2a str. 2457T
auugcacauucccugcagu

SEQ ID NO: 1947143 - RNA, 16 nt, Shigella flexneri 2a str. 2457T
auugcaacauguugaa

SEQ ID NO: 1947144 - RNA, 14 nt, Shigella flexneri 2a str. 2457T
auugcaaccacaca

SEQ ID NO: 1947145 - RNA, 19 nt, Shigella flexneri 2a str. 2457T
auugaaaaguccaggcugc

SEQ ID NO: 1947146 - RNA, 20 nt, Shigella flexneri 2a str. 2457T
auugaaacacuuaauggucu

SEQ ID NO: 1947147 - RNA, 19 nt, Shigella flexneri 2a str. 2457T
auugaaaaagugccaaaaa

SEQ ID NO: 1947148 - RNA, 20 nt, Shigella flexneri 2a str. 2457T
auugaaaaagugccaaaaau

SEQ ID NO: 1947149 - RNA, 15 nt, Shigella flexneri 2a str. 2457T
auugaugcacaccau

SEQ ID NO: 1947150 - RNA, 17 nt, Shigella flexneri 2a str. 2457T
auugaucucacaaucau

SEQ ID NO: 1947151 - RNA, 18 nt, Shigella flexneri 2a str. 2457T
auugaucucguugaucac

SEQ ID NO: 1947152 - RNA, 17 nt, Shigella flexneri 2a str. 2457T
auucugcgcugacucua

SEQ ID NO: 1947153 - RNA, 23 nt, Shigella flexneri 2a str. 2457T
auucuggacgguggagcaacagg

SEQ ID NO: 1947154 - RNA, 17 nt, Shigella flexneri 2a str. 2457T
auucuggagcauggcug

SEQ ID NO: 1947155 - RNA, 18 nt, Shigella flexneri 2a str. 2457T
auucuggagcuggacggu

SEQ ID NO: 1947156 - RNA, 20 nt, Shigella flexneri 2a str. 2457T
auucuggcaccaccuggcuu

SEQ ID NO: 1947157 - RNA, 17 nt, Shigella flexneri 2a str. 2457T
auucuggcggcaauaac

SEQ ID NO: 1947158 - RNA, 16 nt, Shigella flexneri 2a str. 2457T
auucugggaacuauau

SEQ ID NO: 1947159 - RNA, 19 nt, Shigella flexneri 2a str. 2457T
auucuggugauugucuuuu

SEQ ID NO: 1947160 - RNA, 16 nt, Shigella flexneri 2a str. 2457T
auucuugccuuuccuc

SEQ ID NO: 1947161 - RNA, 17 nt, Shigella flexneri 2a str. 2457T
auucuugacgccauuuu

SEQ ID NO: 1947162 - RNA, 20 nt, Shigella flexneri 2a str. 2457T
auucuugacgccauuuuuua

SEQ ID NO: 1947163 - RNA, 15 nt, Shigella flexneri 2a str. 2457T
auucucuuuuguuac

SEQ ID NO: 1947164 - RNA, 20 nt, Shigella flexneri 2a str. 2457T
auucucuuuuguuacuuauu

SEQ ID NO: 1947165 - RNA, 16 nt, Shigella flexneri 2a str. 2457T
auucugaaaacggaca

SEQ ID NO: 1947166 - RNA, 18 nt, Shigella flexneri 2a str. 2457T
auucucuauuucacccgc

SEQ ID NO: 1947167 - RNA, 18 nt, Shigella flexneri 2a str. 2457T
auucugcccaagcgggga

SEQ ID NO: 1947168 - RNA, 13 nt, Shigella flexneri 2a str. 2457T
auucugauccugc

SEQ ID NO: 1947169 - RNA, 22 nt, Shigella flexneri 2a str. 2457T
auucugcaaggcaaaauacguu

SEQ ID NO: 1947170 - RNA, 17 nt, Shigella flexneri 2a str. 2457T
auucugacgccaccauu

SEQ ID NO: 1947171 - RNA, 15 nt, Shigella flexneri 2a str. 2457T
auucugacuggguca

SEQ ID NO: 1947172 - RNA, 22 nt, Shigella flexneri 2a str. 2457T
auucugacugucagaugcggcu

SEQ ID NO: 1947173 - RNA, 13 nt, Shigella flexneri 2a str. 2457T
auucuaagugaua

SEQ ID NO: 1947174 - RNA, 16 nt, Shigella flexneri 2a str. 2457T
auucuacagaaaugaa

SEQ ID NO: 1947175 - RNA, 20 nt, Shigella flexneri 2a str. 2457T
auucucaaaauacaguagaa

SEQ ID NO: 1947176 - RNA, 16 nt, Shigella flexneri 2a str. 2457T
auucucaaaauacagu

SEQ ID NO: 1947177 - RNA, 18 nt, Shigella flexneri 2a str. 2457T
auucucaauaaaaggaaa

SEQ ID NO: 1947178 - RNA, 21 nt, Shigella flexneri 2a str. 2457T
auucgcuuccucaaccacuuu

SEQ ID NO: 1947179 - RNA, 15 nt, Shigella flexneri 2a str. 2457T
auucgcuuucacuca

SEQ ID NO: 1947180 - RNA, 22 nt, Shigella flexneri 2a str. 2457T
auucgcuuucggugcuauaacc

SEQ ID NO: 1947181 - RNA, 23 nt, Shigella flexneri 2a str. 2457T
auucgcuuucggugcuauaaccg

SEQ ID NO: 1947182 - RNA, 15 nt, Shigella flexneri 2a str. 2457T
auucggucaggugac

SEQ ID NO: 1947183 - RNA, 15 nt, Shigella flexneri 2a str. 2457T
auucgcgaugcugau

SEQ ID NO: 1947184 - RNA, 21 nt, Shigella flexneri 2a str. 2457T
auucauuuugcuggaaaagua

SEQ ID NO: 1947185 - RNA, 22 nt, Shigella flexneri 2a str. 2457T
auucauuuugcuggaaaaguaa

SEQ ID NO: 1947186 - RNA, 13 nt, Shigella flexneri 2a str. 2457T
auucauuuugcug

SEQ ID NO: 1947187 - RNA, 22 nt, Shigella flexneri 2a str. 2457T
auucauucaauuaauaacacau

SEQ ID NO: 1947188 - RNA, 13 nt, Shigella flexneri 2a str. 2457T
auucauuccuuga

SEQ ID NO: 1947189 - RNA, 17 nt, Shigella flexneri 2a str. 2457T
auucauuguucucccau

SEQ ID NO: 1947190 - RNA, 14 nt, Shigella flexneri 2a str. 2457T
auucauuaaaacug

SEQ ID NO: 1947191 - RNA, 16 nt, Shigella flexneri 2a str. 2457T
auucauuaguuuggcc

SEQ ID NO: 1947192 - RNA, 15 nt, Shigella flexneri 2a str. 2457T
auucauuacucaacg

SEQ ID NO: 1947193 - RNA, 16 nt, Shigella flexneri 2a str. 2457T
auucauggugaauauc

SEQ ID NO: 1947194 - RNA, 18 nt, Shigella flexneri 2a str. 2457T
auucauggcauuuucucg

SEQ ID NO: 1947195 - RNA, 13 nt, Shigella flexneri 2a str. 2457T
auucaucaaaugg

SEQ ID NO: 1947196 - RNA, 14 nt, Shigella flexneri 2a str. 2457T
auucaucuccagca

SEQ ID NO: 1947197 - RNA, 19 nt, Shigella flexneri 2a str. 2457T
auucccgcgaacuaaacaa

SEQ ID NO: 1947198 - RNA, 15 nt, Shigella flexneri 2a str. 2457T
auucccgcagcucca

SEQ ID NO: 1947199 - RNA, 20 nt, Shigella flexneri 2a str. 2457T
auuccuaaaguuguuuucuu

SEQ ID NO: 1947200 - RNA, 21 nt, Shigella flexneri 2a str. 2457T
auuccuaaaguuguuuucuug

SEQ ID NO: 1947201 - RNA, 19 nt, Shigella flexneri 2a str. 2457T
auucccugcuuugcaagcg

SEQ ID NO: 1947202 - RNA, 16 nt, Shigella flexneri 2a str. 2457T
auuccuaugcaacaac

SEQ ID NO: 1947203 - RNA, 17 nt, Shigella flexneri 2a str. 2457T
auuccuccgguagccau

SEQ ID NO: 1947204 - RNA, 16 nt, Shigella flexneri 2a str. 2457T
auuccuuaugguucac

SEQ ID NO: 1947205 - RNA, 20 nt, Shigella flexneri 2a str. 2457T
auuccaucaccuuccacaua

SEQ ID NO: 1947206 - RNA, 22 nt, Shigella flexneri 2a str. 2457T
auuccauuucccugacaaauca

SEQ ID NO: 1947207 - RNA, 21 nt, Shigella flexneri 2a str. 2457T
auuccaguuuucaaauaucua

SEQ ID NO: 1947208 - RNA, 13 nt, Shigella flexneri 2a str. 2457T
auuccacgcauca

SEQ ID NO: 1947209 - RNA, 18 nt, Shigella flexneri 2a str. 2457T
auuccaccgaaacuuuua

SEQ ID NO: 1947210 - RNA, 19 nt, Shigella flexneri 2a str. 2457T
auuccacgauaaaauuccu

SEQ ID NO: 1947211 - RNA, 15 nt, Shigella flexneri 2a str. 2457T
aaaagccugccaucu

SEQ ID NO: 1947212 - RNA, 22 nt, Shigella flexneri 2a str. 2457T
aaaagcggcuaaccacgccgcu

SEQ ID NO: 1947213 - RNA, 12 nt, Shigella flexneri 2a str. 2457T
auuagccaggca

SEQ ID NO: 1947214 - RNA, 17 nt, Shigella flexneri 2a str. 2457T
auuagcauggccgccaa

SEQ ID NO: 1947215 - RNA, 22 nt, Shigella flexneri 2a str. 2457T
auuagcaucgcgauggcaagcg

SEQ ID NO: 1947216 - RNA, 20 nt, Shigella flexneri 2a str. 2457T
auuagccgguaaaucaccag

SEQ ID NO: 1947217 - RNA, 19 nt, Shigella flexneri 2a str. 2457T
auuagcccgguagcaugaa

SEQ ID NO: 1947218 - RNA, 14 nt, Shigella flexneri 2a str. 2457T
auuagcccaauaau

SEQ ID NO: 1947219 - RNA, 22 nt, Shigella flexneri 2a str. 2457T
aaaagccgacucacuugcaguc

SEQ ID NO: 1947220 - RNA, 17 nt, Shigella flexneri 2a str. 2457T
aaaagccuaagaaguca

SEQ ID NO: 1947221 - RNA, 13 nt, Shigella flexneri 2a str. 2457T
auuagauaaaaau

SEQ ID NO: 1947222 - RNA, 17 nt, Shigella flexneri 2a str. 2457T
auuagauaaaaaugaag

SEQ ID NO: 1947223 - RNA, 17 nt, Shigella flexneri 2a str. 2457T
auuagcacgauuuugua

SEQ ID NO: 1947224 - RNA, 14 nt, Shigella flexneri 2a str. 2457T
auuagcaauauuuu

SEQ ID NO: 1947225 - RNA, 17 nt, Shigella flexneri 2a str. 2457T
auuagcaauauuuuuau

SEQ ID NO: 1947226 - RNA, 18 nt, Shigella flexneri 2a str. 2457T
auuagcaauauuuuuaug

SEQ ID NO: 1947227 - RNA, 23 nt, Shigella flexneri 2a str. 2457T
auuacugccuugaugaaaaaacc

SEQ ID NO: 1947228 - RNA, 12 nt, Shigella flexneri 2a str. 2457T
auuacugauugc

SEQ ID NO: 1947229 - RNA, 15 nt, Shigella flexneri 2a str. 2457T
auuacuuccuucaug

SEQ ID NO: 1947230 - RNA, 18 nt, Shigella flexneri 2a str. 2457T
auuacuuuaagccuuccg

SEQ ID NO: 1947231 - RNA, 16 nt, Shigella flexneri 2a str. 2457T
auuacuuuauuuauau

SEQ ID NO: 1947232 - RNA, 23 nt, Shigella flexneri 2a str. 2457T
auuacuuuauuuauaucagugau

SEQ ID NO: 1947233 - RNA, 21 nt, Shigella flexneri 2a str. 2457T
auuacuuucggugacuucaaa

SEQ ID NO: 1947234 - RNA, 20 nt, Shigella flexneri 2a str. 2457T
auuaccgcgggaugcucuuu

SEQ ID NO: 1947235 - RNA, 22 nt, Shigella flexneri 2a str. 2457T
auuaccgcgggaugcucuuuuc

SEQ ID NO: 1947236 - RNA, 19 nt, Shigella flexneri 2a str. 2457T
auuacguccaucacaauca

SEQ ID NO: 1947237 - RNA, 15 nt, Shigella flexneri 2a str. 2457T
auuacggucaaauua

SEQ ID NO: 1947238 - RNA, 21 nt, Shigella flexneri 2a str. 2457T
auuacgggcgaaguucgccau

SEQ ID NO: 1947239 - RNA, 14 nt, Shigella flexneri 2a str. 2457T
auuacggauuaaau

SEQ ID NO: 1947240 - RNA, 13 nt, Shigella flexneri 2a str. 2457T
auuaccuucaaca

SEQ ID NO: 1947241 - RNA, 22 nt, Shigella flexneri 2a str. 2457T
auuaccuuaucaaucucagcaa

SEQ ID NO: 1947242 - RNA, 12 nt, Shigella flexneri 2a str. 2457T
auuacugagaac

SEQ ID NO: 1947243 - RNA, 15 nt, Shigella flexneri 2a str. 2457T
auuacucaacgucaa

SEQ ID NO: 1947244 - RNA, 16 nt, Shigella flexneri 2a str. 2457T
auuacucaacagguaa

SEQ ID NO: 1947245 - RNA, 12 nt, Shigella flexneri 2a str. 2457T
auuacucagcaa

SEQ ID NO: 1947246 - RNA, 23 nt, Shigella flexneri 2a str. 2457T
auuauuggcaucguauuucagac

SEQ ID NO: 1947247 - RNA, 19 nt, Shigella flexneri 2a str. 2457T
auuauuucuuuuacauuau

SEQ ID NO: 1947248 - RNA, 16 nt, Shigella flexneri 2a str. 2457T
auucaagacaucaaua

SEQ ID NO: 1947249 - RNA, 15 nt, Shigella flexneri 2a str. 2457T
auucaagaaacagca

SEQ ID NO: 1947250 - RNA, 17 nt, Shigella flexneri 2a str. 2457T
auucaagaaacagcagu

SEQ ID NO: 1947251 - RNA, 18 nt, Shigella flexneri 2a str. 2457T
auucaagacaucaauaaa

SEQ ID NO: 1947252 - RNA, 19 nt, Shigella flexneri 2a str. 2457T
auucaagauuagccugaau

SEQ ID NO: 1947253 - RNA, 16 nt, Shigella flexneri 2a str. 2457T
auucaaguaucuauuc

SEQ ID NO: 1947254 - RNA, 15 nt, Shigella flexneri 2a str. 2457T
auucaaguaucuauu

SEQ ID NO: 1947255 - RNA, 22 nt, Shigella flexneri 2a str. 2457T
auucaaagcgauuauagcuaac

SEQ ID NO: 1947256 - RNA, 22 nt, Shigella flexneri 2a str. 2457T
auucaaaguguugcaggaaaag

SEQ ID NO: 1947257 - RNA, 15 nt, Shigella flexneri 2a str. 2457T
auucaacgucacugg

SEQ ID NO: 1947258 - RNA, 21 nt, Shigella flexneri 2a str. 2457T
auucaacuggauaaaauuaua

SEQ ID NO: 1947259 - RNA, 13 nt, Shigella flexneri 2a str. 2457T
auucaaacgugaa

SEQ ID NO: 1947260 - RNA, 19 nt, Shigella flexneri 2a str. 2457T
auuauuuuuuuaucauuuc

SEQ ID NO: 1947261 - RNA, 15 nt, Shigella flexneri 2a str. 2457T
auuauggcuauaaca

SEQ ID NO: 1947262 - RNA, 16 nt, Shigella flexneri 2a str. 2457T
auuaucggcaccauuu

SEQ ID NO: 1947263 - RNA, 23 nt, Shigella flexneri 2a str. 2457T
auuaucggcucgaucuggugcaa

SEQ ID NO: 1947264 - RNA, 20 nt, Shigella flexneri 2a str. 2457T
auuaucguuacgacgcaauc

SEQ ID NO: 1947265 - RNA, 18 nt, Shigella flexneri 2a str. 2457T
auuaugcgaccauaugaa

SEQ ID NO: 1947266 - RNA, 23 nt, Shigella flexneri 2a str. 2457T
auuaugccgccgacaguuaucaa

SEQ ID NO: 1947267 - RNA, 15 nt, Shigella flexneri 2a str. 2457T
auuaugccugauuac

SEQ ID NO: 1947268 - RNA, 18 nt, Shigella flexneri 2a str. 2457T
auuaucucuugccaggcu

SEQ ID NO: 1947269 - RNA, 18 nt, Shigella flexneri 2a str. 2457T
auuaguguguauauacug

SEQ ID NO: 1947270 - RNA, 15 nt, Shigella flexneri 2a str. 2457T
auuauauggaaaaau

SEQ ID NO: 1947271 - RNA, 18 nt, Shigella flexneri 2a str. 2457T
auuauagggaugcagaau

SEQ ID NO: 1947272 - RNA, 19 nt, Shigella flexneri 2a str. 2457T
auuauaguaucguuaaauu

SEQ ID NO: 1947273 - RNA, 22 nt, Shigella flexneri 2a str. 2457T
auuaacucagcauuauuuuuaa

SEQ ID NO: 1947274 - RNA, 16 nt, Shigella flexneri 2a str. 2457T
auuaacucaauaccug

SEQ ID NO: 1947275 - RNA, 14 nt, Shigella flexneri 2a str. 2457T
auuaacguuuccau

SEQ ID NO: 1947276 - RNA, 15 nt, Shigella flexneri 2a str. 2457T
auuaacgaaaucuca

SEQ ID NO: 1947277 - RNA, 22 nt, Shigella flexneri 2a str. 2457T
auuaacugcgcgauuaucauuu

SEQ ID NO: 1947278 - RNA, 18 nt, Shigella flexneri 2a str. 2457T
auuaacuucccaccuuua

SEQ ID NO: 1947279 - RNA, 20 nt, Shigella flexneri 2a str. 2457T
auuaacgccagccuguucca

SEQ ID NO: 1947280 - RNA, 15 nt, Shigella flexneri 2a str. 2457T
auuaacgcaauaaug

SEQ ID NO: 1947281 - RNA, 14 nt, Shigella flexneri 2a str. 2457T
auuaacgcugggga

SEQ ID NO: 1947282 - RNA, 20 nt, Shigella flexneri 2a str. 2457T
auuaauacaacaacacccau

SEQ ID NO: 1947283 - RNA, 17 nt, Shigella flexneri 2a str. 2457T
auuaauaaaauuaucca

SEQ ID NO: 1947284 - RNA, 16 nt, Shigella flexneri 2a str. 2457T
auuaaggcaagaaaau

SEQ ID NO: 1947285 - RNA, 17 nt, Shigella flexneri 2a str. 2457T
auuaaggcaagaaaauu

SEQ ID NO: 1947286 - RNA, 18 nt, Shigella flexneri 2a str. 2457T
auuaagccaugaaugaug

SEQ ID NO: 1947287 - RNA, 18 nt, Shigella flexneri 2a str. 2457T
auuaaauccugaaaccau

SEQ ID NO: 1947288 - RNA, 21 nt, Shigella flexneri 2a str. 2457T
auuaaaggaaggucauccaaa

SEQ ID NO: 1947289 - RNA, 20 nt, Shigella flexneri 2a str. 2457T
auuaaagcaucugccagcca

SEQ ID NO: 1947290 - RNA, 23 nt, Shigella flexneri 2a str. 2457T
auuaaagcaucugccagccauaa

SEQ ID NO: 1947291 - RNA, 20 nt, Shigella flexneri 2a str. 2457T
auuaaagaaaauaaggccau

SEQ ID NO: 1947292 - RNA, 12 nt, Shigella flexneri 2a str. 2457T
auuaaagaaagu

SEQ ID NO: 1947293 - RNA, 15 nt, Shigella flexneri 2a str. 2457T
auuaaaaaguaagaa

SEQ ID NO: 1947294 - RNA, 20 nt, Shigella flexneri 2a str. 2457T
auguuuucagaccagacugc

SEQ ID NO: 1947295 - RNA, 19 nt, Shigella flexneri 2a str. 2457T
auguuuguauucgcagcga

SEQ ID NO: 1947296 - RNA, 22 nt, Shigella flexneri 2a str. 2457T
auguucgccagauuuuuaucca

SEQ ID NO: 1947297 - RNA, 20 nt, Shigella flexneri 2a str. 2457T
auguucggcgucuuguugaa

SEQ ID NO: 1947298 - RNA, 20 nt, Shigella flexneri 2a str. 2457T
auguugaaauucgccagaca

SEQ ID NO: 1947299 - RNA, 20 nt, Shigella flexneri 2a str. 2457T
auguucuaugaagaacugga

SEQ ID NO: 1947300 - RNA, 21 nt, Shigella flexneri 2a str. 2457T
auguucuggucacucucgacc

SEQ ID NO: 1947301 - RNA, 20 nt, Shigella flexneri 2a str. 2457T
auguuaaccgccugcgaguu

SEQ ID NO: 1947302 - RNA, 17 nt, Shigella flexneri 2a str. 2457T
auguguuuauaagccau

SEQ ID NO: 1947303 - RNA, 23 nt, Shigella flexneri 2a str. 2457T
auguguuuacgcguuuuucagaa

SEQ ID NO: 1947304 - RNA, 19 nt, Shigella flexneri 2a str. 2457T
auguuccggcgacacaucu

SEQ ID NO: 1947305 - RNA, 21 nt, Shigella flexneri 2a str. 2457T
auguuccggcgacacaucuaa

SEQ ID NO: 1947306 - RNA, 22 nt, Shigella flexneri 2a str. 2457T
auguuccggguuugccacauca

SEQ ID NO: 1947307 - RNA, 17 nt, Shigella flexneri 2a str. 2457T
auguuccaucaccagau

SEQ ID NO: 1947308 - RNA, 14 nt, Shigella flexneri 2a str. 2457T
auguuauucaugcc

SEQ ID NO: 1947309 - RNA, 17 nt, Shigella flexneri 2a str. 2457T
auguuauuuaauuacug

SEQ ID NO: 1947310 - RNA, 13 nt, Shigella flexneri 2a str. 2457T
auguggaaacagu

SEQ ID NO: 1947311 - RNA, 16 nt, Shigella flexneri 2a str. 2457T
auguggaaacagugau

SEQ ID NO: 1947312 - RNA, 17 nt, Shigella flexneri 2a str. 2457T
augugcucuaacccuuc

SEQ ID NO: 1947313 - RNA, 13 nt, Shigella flexneri 2a str. 2457T
augugcugagugu

SEQ ID NO: 1947314 - RNA, 14 nt, Shigella flexneri 2a str. 2457T
augugcuucuacca

SEQ ID NO: 1947315 - RNA, 16 nt, Shigella flexneri 2a str. 2457T
augugcaguuccugca

SEQ ID NO: 1947316 - RNA, 18 nt, Shigella flexneri 2a str. 2457T
augugccggaugcaucac

SEQ ID NO: 1947317 - RNA, 19 nt, Shigella flexneri 2a str. 2457T
augugggcaaucucacucc

SEQ ID NO: 1947318 - RNA, 18 nt, Shigella flexneri 2a str. 2457T
auguguuaaauauuuaaa

SEQ ID NO: 1947319 - RNA, 17 nt, Shigella flexneri 2a str. 2457T
auguguuaaaugauacc

SEQ ID NO: 1947320 - RNA, 18 nt, Shigella flexneri 2a str. 2457T
augucugccgcaggaaag

SEQ ID NO: 1947321 - RNA, 12 nt, Shigella flexneri 2a str. 2457T
augucuggcaga

SEQ ID NO: 1947322 - RNA, 21 nt, Shigella flexneri 2a str. 2457T
augucuggcugagcaaacagu

SEQ ID NO: 1947323 - RNA, 18 nt, Shigella flexneri 2a str. 2457T
augucuuuuuuccagcac

SEQ ID NO: 1947324 - RNA, 13 nt, Shigella flexneri 2a str. 2457T
augugaagaggaa

SEQ ID NO: 1947325 - RNA, 21 nt, Shigella flexneri 2a str. 2457T
augugacccggcuggauacca

SEQ ID NO: 1947326 - RNA, 14 nt, Shigella flexneri 2a str. 2457T
augugacagagcca

SEQ ID NO: 1947327 - RNA, 15 nt, Shigella flexneri 2a str. 2457T
augugauaaauacga

SEQ ID NO: 1947328 - RNA, 14 nt, Shigella flexneri 2a str. 2457T
augugacgcugucu

SEQ ID NO: 1947329 - RNA, 18 nt, Shigella flexneri 2a str. 2457T
augugacuggaaaucaaa

SEQ ID NO: 1947330 - RNA, 18 nt, Shigella flexneri 2a str. 2457T
augugaucuuuaucacac

SEQ ID NO: 1947331 - RNA, 16 nt, Shigella flexneri 2a str. 2457T
augugcaccuuuucca

SEQ ID NO: 1947332 - RNA, 17 nt, Shigella flexneri 2a str. 2457T
augugcaguuccugcaa

SEQ ID NO: 1947333 - RNA, 18 nt, Shigella flexneri 2a str. 2457T
augugcaguuccugcaac

SEQ ID NO: 1947334 - RNA, 13 nt, Shigella flexneri 2a str. 2457T
augugaugccuag

SEQ ID NO: 1947335 - RNA, 23 nt, Shigella flexneri 2a str. 2457T
auguacaugucgcuguuucugga

SEQ ID NO: 1947336 - RNA, 18 nt, Shigella flexneri 2a str. 2457T
augucgauauccugcaaa

SEQ ID NO: 1947337 - RNA, 16 nt, Shigella flexneri 2a str. 2457T
augucgcgcacuggau

SEQ ID NO: 1947338 - RNA, 21 nt, Shigella flexneri 2a str. 2457T
augucgcuuccauugagaaag

SEQ ID NO: 1947339 - RNA, 22 nt, Shigella flexneri 2a str. 2457T
augucggauuucgcagccauua

SEQ ID NO: 1947340 - RNA, 20 nt, Shigella flexneri 2a str. 2457T
augucggcagugauuuuccc

SEQ ID NO: 1947341 - RNA, 19 nt, Shigella flexneri 2a str. 2457T
augucgguuguacaaaaaa

SEQ ID NO: 1947342 - RNA, 15 nt, Shigella flexneri 2a str. 2457T
augucgguuguacaa

SEQ ID NO: 1947343 - RNA, 22 nt, Shigella flexneri 2a str. 2457T
augguugaacuauaucccugcu

SEQ ID NO: 1947344 - RNA, 19 nt, Shigella flexneri 2a str. 2457T
augguugaacggauauuuu

SEQ ID NO: 1947345 - RNA, 18 nt, Shigella flexneri 2a str. 2457T
augguggagauaaacucc

SEQ ID NO: 1947346 - RNA, 20 nt, Shigella flexneri 2a str. 2457T
augguggagauaaacuccac

SEQ ID NO: 1947347 - RNA, 14 nt, Shigella flexneri 2a str. 2457T
augguguacucauc

SEQ ID NO: 1947348 - RNA, 22 nt, Shigella flexneri 2a str. 2457T
auggugucgguauaccauuucu

SEQ ID NO: 1947349 - RNA, 17 nt, Shigella flexneri 2a str. 2457T
augguguucaggcauag

SEQ ID NO: 1947350 - RNA, 16 nt, Shigella flexneri 2a str. 2457T
augguaggccggauaa

SEQ ID NO: 1947351 - RNA, 23 nt, Shigella flexneri 2a str. 2457T
auggcugccuuuuuuacaggugu

SEQ ID NO: 1947352 - RNA, 21 nt, Shigella flexneri 2a str. 2457T
auggcugcgggcgaccaauca

SEQ ID NO: 1947353 - RNA, 18 nt, Shigella flexneri 2a str. 2457T
auggcuggcacaaaaaau

SEQ ID NO: 1947354 - RNA, 17 nt, Shigella flexneri 2a str. 2457T
augggcgccauuuuuca

SEQ ID NO: 1947355 - RNA, 21 nt, Shigella flexneri 2a str. 2457T
auggcuguuuucagcaccaga

SEQ ID NO: 1947356 - RNA, 19 nt, Shigella flexneri 2a str. 2457T
auggcucgccauccaguga

SEQ ID NO: 1947357 - RNA, 19 nt, Shigella flexneri 2a str. 2457T
auggcugaaagcgccggga

SEQ ID NO: 1947358 - RNA, 16 nt, Shigella flexneri 2a str. 2457T
augguaacaccagagu

SEQ ID NO: 1947359 - RNA, 21 nt, Shigella flexneri 2a str. 2457T
auggcauccgccacuuuaugc

SEQ ID NO: 1947360 - RNA, 15 nt, Shigella flexneri 2a str. 2457T
auggcaucaccaucg

SEQ ID NO: 1947361 - RNA, 18 nt, Shigella flexneri 2a str. 2457T
auggcaggcucagacuga

SEQ ID NO: 1947362 - RNA, 15 nt, Shigella flexneri 2a str. 2457T
auggcaggaguggca

SEQ ID NO: 1947363 - RNA, 16 nt, Shigella flexneri 2a str. 2457T
auggccgcgcagggca

SEQ ID NO: 1947364 - RNA, 21 nt, Shigella flexneri 2a str. 2457T
auggcguugucggcagauaac

SEQ ID NO: 1947365 - RNA, 20 nt, Shigella flexneri 2a str. 2457T
auggcuauaacauuuuucuc

SEQ ID NO: 1947366 - RNA, 14 nt, Shigella flexneri 2a str. 2457T
auggcucaccagca

SEQ ID NO: 1947367 - RNA, 20 nt, Shigella flexneri 2a str. 2457T
auggcuaaaguacguaaaac

SEQ ID NO: 1947368 - RNA, 15 nt, Shigella flexneri 2a str. 2457T
auggaaaucacccag

SEQ ID NO: 1947369 - RNA, 18 nt, Shigella flexneri 2a str. 2457T
auggaaccguacagcaug

SEQ ID NO: 1947370 - RNA, 14 nt, Shigella flexneri 2a str. 2457T
augcuuuuuccugc

SEQ ID NO: 1947371 - RNA, 13 nt, Shigella flexneri 2a str. 2457T
auggaaacagcac

SEQ ID NO: 1947372 - RNA, 14 nt, Shigella flexneri 2a str. 2457T
auggacaaaagccc

SEQ ID NO: 1947373 - RNA, 18 nt, Shigella flexneri 2a str. 2457T
auggacaccagcucagug

SEQ ID NO: 1947374 - RNA, 19 nt, Shigella flexneri 2a str. 2457T
auggaauggucaauggugg

SEQ ID NO: 1947375 - RNA, 13 nt, Shigella flexneri 2a str. 2457T
auggaagaaaaau

SEQ ID NO: 1947376 - RNA, 14 nt, Shigella flexneri 2a str. 2457T
auggaagaaaaaua

SEQ ID NO: 1947377 - RNA, 16 nt, Shigella flexneri 2a str. 2457T
auggagcuaaacagcg

SEQ ID NO: 1947378 - RNA, 13 nt, Shigella flexneri 2a str. 2457T
auggacgcagacc

SEQ ID NO: 1947379 - RNA, 17 nt, Shigella flexneri 2a str. 2457T
auggauuaccgugaauc

SEQ ID NO: 1947380 - RNA, 13 nt, Shigella flexneri 2a str. 2457T
auggagugagaau

SEQ ID NO: 1947381 - RNA, 19 nt, Shigella flexneri 2a str. 2457T
auggaucagaguugaaaaa

SEQ ID NO: 1947382 - RNA, 18 nt, Shigella flexneri 2a str. 2457T
auggaucccucuuucugg

SEQ ID NO: 1947383 - RNA, 14 nt, Shigella flexneri 2a str. 2457T
augcuuuaaaugcu

SEQ ID NO: 1947384 - RNA, 16 nt, Shigella flexneri 2a str. 2457T
augcuugaugucugcc

SEQ ID NO: 1947385 - RNA, 17 nt, Shigella flexneri 2a str. 2457T
augcuuugcaucccaga

SEQ ID NO: 1947386 - RNA, 18 nt, Shigella flexneri 2a str. 2457T
augcuuaagaaauuauuc

SEQ ID NO: 1947387 - RNA, 19 nt, Shigella flexneri 2a str. 2457T
augcugugcgccacagaca

SEQ ID NO: 1947388 - RNA, 17 nt, Shigella flexneri 2a str. 2457T
augcuucaauuuccuga

SEQ ID NO: 1947389 - RNA, 22 nt, Shigella flexneri 2a str. 2457T
augcuuccgccagcggcggcaa

SEQ ID NO: 1947390 - RNA, 15 nt, Shigella flexneri 2a str. 2457T
augcucucccaaaua

SEQ ID NO: 1947391 - RNA, 15 nt, Shigella flexneri 2a str. 2457T
augcucucaucacua

SEQ ID NO: 1947392 - RNA, 20 nt, Shigella flexneri 2a str. 2457T
augcugcgccaguugcuuau

SEQ ID NO: 1947393 - RNA, 17 nt, Shigella flexneri 2a str. 2457T
augcugugaagauggcu

SEQ ID NO: 1947394 - RNA, 20 nt, Shigella flexneri 2a str. 2457T
augccaauaaauccuuugua

SEQ ID NO: 1947395 - RNA, 16 nt, Shigella flexneri 2a str. 2457T
augccaaucagcagaa

SEQ ID NO: 1947396 - RNA, 19 nt, Shigella flexneri 2a str. 2457T
augccaaucagcagaaccg

SEQ ID NO: 1947397 - RNA, 22 nt, Shigella flexneri 2a str. 2457T
augccaaucuucacaucaucau

SEQ ID NO: 1947398 - RNA, 23 nt, Shigella flexneri 2a str. 2457T
augccacauuagauaaaaaugaa

SEQ ID NO: 1947399 - RNA, 17 nt, Shigella flexneri 2a str. 2457T
augccacauuagauaaa

SEQ ID NO: 1947400 - RNA, 19 nt, Shigella flexneri 2a str. 2457T
augccacaaacgccgugca

SEQ ID NO: 1947401 - RNA, 20 nt, Shigella flexneri 2a str. 2457T
augcagcauggucagguauu

SEQ ID NO: 1947402 - RNA, 18 nt, Shigella flexneri 2a str. 2457T
augcaccgacaauccggu

SEQ ID NO: 1947403 - RNA, 18 nt, Shigella flexneri 2a str. 2457T
augccgccgcagaaaaag

SEQ ID NO: 1947404 - RNA, 18 nt, Shigella flexneri 2a str. 2457T
augccgccgacaguuauc

SEQ ID NO: 1947405 - RNA, 20 nt, Shigella flexneri 2a str. 2457T
augccgacggcgcacaggca

SEQ ID NO: 1947406 - RNA, 19 nt, Shigella flexneri 2a str. 2457T
augccgauaaauacagcgu

SEQ ID NO: 1947407 - RNA, 22 nt, Shigella flexneri 2a str. 2457T
augccgaaaaaagucauuacca

SEQ ID NO: 1947408 - RNA, 23 nt, Shigella flexneri 2a str. 2457T
augccaucauggcgaugagaauc

SEQ ID NO: 1947409 - RNA, 13 nt, Shigella flexneri 2a str. 2457T
augccacccaggu

SEQ ID NO: 1947410 - RNA, 23 nt, Shigella flexneri 2a str. 2457T
augcgccagguaacgaagauggc

SEQ ID NO: 1947411 - RNA, 12 nt, Shigella flexneri 2a str. 2457T
augcgcccagcg

SEQ ID NO: 1947412 - RNA, 15 nt, Shigella flexneri 2a str. 2457T
augcgcgacaaaaau

SEQ ID NO: 1947413 - RNA, 14 nt, Shigella flexneri 2a str. 2457T
augcgacaacagaa

SEQ ID NO: 1947414 - RNA, 14 nt, Shigella flexneri 2a str. 2457T
augcgaaugccaau

SEQ ID NO: 1947415 - RNA, 12 nt, Shigella flexneri 2a str. 2457T
augcgacggcac

SEQ ID NO: 1947416 - RNA, 19 nt, Shigella flexneri 2a str. 2457T
augcgaccauaugaauaua

SEQ ID NO: 1947417 - RNA, 15 nt, Shigella flexneri 2a str. 2457T
augcgacccaugcac

SEQ ID NO: 1947418 - RNA, 23 nt, Shigella flexneri 2a str. 2457T
augcgcauugccagagugaaaau

SEQ ID NO: 1947419 - RNA, 15 nt, Shigella flexneri 2a str. 2457T
augcgccagcauccg

SEQ ID NO: 1947420 - RNA, 19 nt, Shigella flexneri 2a str. 2457T
augccugauguacaaccau

SEQ ID NO: 1947421 - RNA, 21 nt, Shigella flexneri 2a str. 2457T
augccugcgacaagaauacaa

SEQ ID NO: 1947422 - RNA, 18 nt, Shigella flexneri 2a str. 2457T
augccucuuucauccgau

SEQ ID NO: 1947423 - RNA, 20 nt, Shigella flexneri 2a str. 2457T
augccuuaaacaugagcgaa

SEQ ID NO: 1947424 - RNA, 21 nt, Shigella flexneri 2a str. 2457T
augccuucuggaaaucaggaa

SEQ ID NO: 1947425 - RNA, 22 nt, Shigella flexneri 2a str. 2457T
augccuugugggccugaaagcu

SEQ ID NO: 1947426 - RNA, 13 nt, Shigella flexneri 2a str. 2457T
augccuuucucag

SEQ ID NO: 1947427 - RNA, 18 nt, Shigella flexneri 2a str. 2457T
augccuuguuugaucauc

SEQ ID NO: 1947428 - RNA, 15 nt, Shigella flexneri 2a str. 2457T
augccgccguagaaa

SEQ ID NO: 1947429 - RNA, 16 nt, Shigella flexneri 2a str. 2457T
augccucgugcucaga

SEQ ID NO: 1947430 - RNA, 13 nt, Shigella flexneri 2a str. 2457T
augccucuccugu

SEQ ID NO: 1947431 - RNA, 17 nt, Shigella flexneri 2a str. 2457T
augccucguuggucagc

SEQ ID NO: 1947432 - RNA, 13 nt, Shigella flexneri 2a str. 2457T
augagcacagaaa

SEQ ID NO: 1947433 - RNA, 13 nt, Shigella flexneri 2a str. 2457T
augagcagaccaa

SEQ ID NO: 1947434 - RNA, 15 nt, Shigella flexneri 2a str. 2457T
augagcagaccaaua

SEQ ID NO: 1947435 - RNA, 19 nt, Shigella flexneri 2a str. 2457T
augaugccgccagaaaugg

SEQ ID NO: 1947436 - RNA, 16 nt, Shigella flexneri 2a str. 2457T
augauggcgauaaucu

SEQ ID NO: 1947437 - RNA, 15 nt, Shigella flexneri 2a str. 2457T
augaugcugauggcu

SEQ ID NO: 1947438 - RNA, 18 nt, Shigella flexneri 2a str. 2457T
augauggcauucucacuc

SEQ ID NO: 1947439 - RNA, 15 nt, Shigella flexneri 2a str. 2457T
augauggccuuuuug

SEQ ID NO: 1947440 - RNA, 20 nt, Shigella flexneri 2a str. 2457T
augauggccuuuuugugcuu

SEQ ID NO: 1947441 - RNA, 14 nt, Shigella flexneri 2a str. 2457T
augaugucgcuguc

SEQ ID NO: 1947442 - RNA, 16 nt, Shigella flexneri 2a str. 2457T
augauguaaaaauacu

SEQ ID NO: 1947443 - RNA, 19 nt, Shigella flexneri 2a str. 2457T
augauggcauucucacucc

SEQ ID NO: 1947444 - RNA, 22 nt, Shigella flexneri 2a str. 2457T
augaugucaaaaucaaaauaau

SEQ ID NO: 1947445 - RNA, 20 nt, Shigella flexneri 2a str. 2457T
augauuagucuuuaucugcc

SEQ ID NO: 1947446 - RNA, 13 nt, Shigella flexneri 2a str. 2457T
augauuagugcca

SEQ ID NO: 1947447 - RNA, 15 nt, Shigella flexneri 2a str. 2457T
augauuacucguauu

SEQ ID NO: 1947448 - RNA, 15 nt, Shigella flexneri 2a str. 2457T
augauuuaaaaaaug

SEQ ID NO: 1947449 - RNA, 19 nt, Shigella flexneri 2a str. 2457T
augauuuugauggaagaaa

SEQ ID NO: 1947450 - RNA, 23 nt, Shigella flexneri 2a str. 2457T
augauuuccggcagcauguguaa

SEQ ID NO: 1947451 - RNA, 18 nt, Shigella flexneri 2a str. 2457T
augcaacaacugaaaaaa

SEQ ID NO: 1947452 - RNA, 15 nt, Shigella flexneri 2a str. 2457T
augcaacuguuuuac

SEQ ID NO: 1947453 - RNA, 21 nt, Shigella flexneri 2a str. 2457T
augcacaccccgcgcagcuga

SEQ ID NO: 1947454 - RNA, 20 nt, Shigella flexneri 2a str. 2457T
augcaauggaauggcuggca

SEQ ID NO: 1947455 - RNA, 18 nt, Shigella flexneri 2a str. 2457T
augcaaugauucaggcau

SEQ ID NO: 1947456 - RNA, 22 nt, Shigella flexneri 2a str. 2457T
augcaagaggguuauuuguuca

SEQ ID NO: 1947457 - RNA, 13 nt, Shigella flexneri 2a str. 2457T
augcaauaaauau

SEQ ID NO: 1947458 - RNA, 18 nt, Shigella flexneri 2a str. 2457T
augcaauaaauauguuac

SEQ ID NO: 1947459 - RNA, 12 nt, Shigella flexneri 2a str. 2457T
caauuccuucug

SEQ ID NO: 1947460 - RNA, 16 nt, Shigella flexneri 2a str. 2457T
caauuccuucugggcg

SEQ ID NO: 1947461 - RNA, 23 nt, Shigella flexneri 2a str. 2457T
caauucgcguaguaaagccuuca

SEQ ID NO: 1947462 - RNA, 22 nt, Shigella flexneri 2a str. 2457T
caauucgcgucggcgucagcgc

SEQ ID NO: 1947463 - RNA, 15 nt, Shigella flexneri 2a str. 2457T
caauucuaaauguuc

SEQ ID NO: 1947464 - RNA, 15 nt, Shigella flexneri 2a str. 2457T
caauucauuccuuga

SEQ ID NO: 1947465 - RNA, 23 nt, Shigella flexneri 2a str. 2457T
caauguuaccgaucgccagcagg

SEQ ID NO: 1947466 - RNA, 23 nt, Shigella flexneri 2a str. 2457T
caaugucugucauauuaucuauc

SEQ ID NO: 1947467 - RNA, 13 nt, Shigella flexneri 2a str. 2457T
caauuccauuucc

SEQ ID NO: 1947468 - RNA, 21 nt, Shigella flexneri 2a str. 2457T
caauuccauuucccugacaaa

SEQ ID NO: 1947469 - RNA, 20 nt, Shigella flexneri 2a str. 2457T
caauuccagcaagccacugg

SEQ ID NO: 1947470 - RNA, 20 nt, Shigella flexneri 2a str. 2457T
caauucccggaccgucaucu

SEQ ID NO: 1947471 - RNA, 23 nt, Shigella flexneri 2a str. 2457T
caauucccggaccgucaucuucc

SEQ ID NO: 1947472 - RNA, 15 nt, Shigella flexneri 2a str. 2457T
caauuccuauuuugu

SEQ ID NO: 1947473 - RNA, 20 nt, Shigella flexneri 2a str. 2457T
caauuucucguuggucauca

SEQ ID NO: 1947474 - RNA, 22 nt, Shigella flexneri 2a str. 2457T
caauuucugugcagccaaaaau

SEQ ID NO: 1947475 - RNA, 14 nt, Shigella flexneri 2a str. 2457T
caauuucccgcuca

SEQ ID NO: 1947476 - RNA, 17 nt, Shigella flexneri 2a str. 2457T
caauugccccccauaac

SEQ ID NO: 1947477 - RNA, 19 nt, Shigella flexneri 2a str. 2457T
caauugcauauuucaacga

SEQ ID NO: 1947478 - RNA, 18 nt, Shigella flexneri 2a str. 2457T
caauugcgggccaaagac

SEQ ID NO: 1947479 - RNA, 23 nt, Shigella flexneri 2a str. 2457T
caauugcgcaccagcuugcgaca

SEQ ID NO: 1947480 - RNA, 20 nt, Shigella flexneri 2a str. 2457T
caaugacuagcgccauaaua

SEQ ID NO: 1947481 - RNA, 12 nt, Shigella flexneri 2a str. 2457T
caaucugugccg

SEQ ID NO: 1947482 - RNA, 15 nt, Shigella flexneri 2a str. 2457T
caaucuucucuuccc

SEQ ID NO: 1947483 - RNA, 20 nt, Shigella flexneri 2a str. 2457T
caaugaccgcgccauccaua

SEQ ID NO: 1947484 - RNA, 20 nt, Shigella flexneri 2a str. 2457T
caaugacacguuuauuauag

SEQ ID NO: 1947485 - RNA, 23 nt, Shigella flexneri 2a str. 2457T
caauggggugacagguuuaaaca

SEQ ID NO: 1947486 - RNA, 15 nt, Shigella flexneri 2a str. 2457T
caauggucagccaca

SEQ ID NO: 1947487 - RNA, 17 nt, Shigella flexneri 2a str. 2457T
caauggucccuugcugg

SEQ ID NO: 1947488 - RNA, 13 nt, Shigella flexneri 2a str. 2457T
caauggugaacug

SEQ ID NO: 1947489 - RNA, 16 nt, Shigella flexneri 2a str. 2457T
caauguaauacgcuca

SEQ ID NO: 1947490 - RNA, 21 nt, Shigella flexneri 2a str. 2457T
caauguaauacgcucaucugg

SEQ ID NO: 1947491 - RNA, 14 nt, Shigella flexneri 2a str. 2457T
caauguagcgcugc

SEQ ID NO: 1947492 - RNA, 14 nt, Shigella flexneri 2a str. 2457T
caauggcccgccgc

SEQ ID NO: 1947493 - RNA, 18 nt, Shigella flexneri 2a str. 2457T
caauggcgacuucugcuu

SEQ ID NO: 1947494 - RNA, 16 nt, Shigella flexneri 2a str. 2457T
caauggcggugauccc

SEQ ID NO: 1947495 - RNA, 23 nt, Shigella flexneri 2a str. 2457T
caauggcuccgggugugacaaca

SEQ ID NO: 1947496 - RNA, 15 nt, Shigella flexneri 2a str. 2457T
caauggcauuuaucu

SEQ ID NO: 1947497 - RNA, 20 nt, Shigella flexneri 2a str. 2457T
caauggcaggcucagacuga

SEQ ID NO: 1947498 - RNA, 13 nt, Shigella flexneri 2a str. 2457T
caauuugcccaug

SEQ ID NO: 1947499 - RNA, 20 nt, Shigella flexneri 2a str. 2457T
cacaaccaccguuuuuucug

SEQ ID NO: 1947500 - RNA, 15 nt, Shigella flexneri 2a str. 2457T
cacaacgcaauaaac

SEQ ID NO: 1947501 - RNA, 14 nt, Shigella flexneri 2a str. 2457T
cacaacgcuuucaa

SEQ ID NO: 1947502 - RNA, 22 nt, Shigella flexneri 2a str. 2457T
cacaacggcauuauucaucugg

SEQ ID NO: 1947503 - RNA, 20 nt, Shigella flexneri 2a str. 2457T
cacaacgcuuucaacaaccu

SEQ ID NO: 1947504 - RNA, 23 nt, Shigella flexneri 2a str. 2457T
cacaacugcgaccguacaaccaa

SEQ ID NO: 1947505 - RNA, 22 nt, Shigella flexneri 2a str. 2457T
cacaacugcgaccguacaacca

SEQ ID NO: 1947506 - RNA, 14 nt, Shigella flexneri 2a str. 2457T
cacaacuccauaca

SEQ ID NO: 1947507 - RNA, 20 nt, Shigella flexneri 2a str. 2457T
cacaaucauccuaccgccag

SEQ ID NO: 1947508 - RNA, 13 nt, Shigella flexneri 2a str. 2457T
cacaauauuuuua

SEQ ID NO: 1947509 - RNA, 19 nt, Shigella flexneri 2a str. 2457T
cacaaucaaauccugcauc

SEQ ID NO: 1947510 - RNA, 15 nt, Shigella flexneri 2a str. 2457T
cacaaucaaauccug

SEQ ID NO: 1947511 - RNA, 22 nt, Shigella flexneri 2a str. 2457T
cacaaguugucccauacuugca

SEQ ID NO: 1947512 - RNA, 20 nt, Shigella flexneri 2a str. 2457T
cacaaguaaaaggagauaaa

SEQ ID NO: 1947513 - RNA, 11 nt, Shigella flexneri 2a str. 2457T
cacaagacugu

SEQ ID NO: 1947514 - RNA, 13 nt, Shigella flexneri 2a str. 2457T
cacaagaaauaua

SEQ ID NO: 1947515 - RNA, 22 nt, Shigella flexneri 2a str. 2457T
cacaagccaggacgcaguccag

SEQ ID NO: 1947516 - RNA, 21 nt, Shigella flexneri 2a str. 2457T
cacaagccaggacgcagucca

SEQ ID NO: 1947517 - RNA, 20 nt, Shigella flexneri 2a str. 2457T
cacacuucauuuuccacaau

SEQ ID NO: 1947518 - RNA, 23 nt, Shigella flexneri 2a str. 2457T
cacacuguucauuaaagccgccc

SEQ ID NO: 1947519 - RNA, 15 nt, Shigella flexneri 2a str. 2457T
cacagaaggccagga

SEQ ID NO: 1947520 - RNA, 11 nt, Shigella flexneri 2a str. 2457T
cacagaaguga

SEQ ID NO: 1947521 - RNA, 14 nt, Shigella flexneri 2a str. 2457T
cacagccaacacau

SEQ ID NO: 1947522 - RNA, 15 nt, Shigella flexneri 2a str. 2457T
cacagcaguugugug

SEQ ID NO: 1947523 - RNA, 14 nt, Shigella flexneri 2a str. 2457T
cacagcaguccagc

SEQ ID NO: 1947524 - RNA, 17 nt, Shigella flexneri 2a str. 2457T
cacagauugauaaaaau

SEQ ID NO: 1947525 - RNA, 18 nt, Shigella flexneri 2a str. 2457T
cacagauugauaaaaaua

SEQ ID NO: 1947526 - RNA, 19 nt, Shigella flexneri 2a str. 2457T
cacagauugauaaaaauag

SEQ ID NO: 1947527 - RNA, 22 nt, Shigella flexneri 2a str. 2457T
cacagauugauaaaaauaguua

SEQ ID NO: 1947528 - RNA, 20 nt, Shigella flexneri 2a str. 2457T
cacagauuuccaagcgcggc

SEQ ID NO: 1947529 - RNA, 22 nt, Shigella flexneri 2a str. 2457T
cacagauaauaauguguucaac

SEQ ID NO: 1947530 - RNA, 21 nt, Shigella flexneri 2a str. 2457T
cacaaucggcuuucaccgccu

SEQ ID NO: 1947531 - RNA, 14 nt, Shigella flexneri 2a str. 2457T
cacacacgcccagc

SEQ ID NO: 1947532 - RNA, 14 nt, Shigella flexneri 2a str. 2457T
cacacagacaauaa

SEQ ID NO: 1947533 - RNA, 18 nt, Shigella flexneri 2a str. 2457T
cacacgccaggccacgcu

SEQ ID NO: 1947534 - RNA, 22 nt, Shigella flexneri 2a str. 2457T
cacacgagaguuaguguuaacc

SEQ ID NO: 1947535 - RNA, 16 nt, Shigella flexneri 2a str. 2457T
cacacagauguaauga

SEQ ID NO: 1947536 - RNA, 20 nt, Shigella flexneri 2a str. 2457T
cacacgacauccgugcagaa

SEQ ID NO: 1947537 - RNA, 14 nt, Shigella flexneri 2a str. 2457T
cacacggucuauca

SEQ ID NO: 1947538 - RNA, 22 nt, Shigella flexneri 2a str. 2457T
cacacggucuaucaucagcaug

SEQ ID NO: 1947539 - RNA, 14 nt, Shigella flexneri 2a str. 2457T
cacacgcucuucca

SEQ ID NO: 1947540 - RNA, 22 nt, Shigella flexneri 2a str. 2457T
caccagcacuucacugacauug

SEQ ID NO: 1947541 - RNA, 18 nt, Shigella flexneri 2a str. 2457T
caccagcaauaaugccag

SEQ ID NO: 1947542 - RNA, 14 nt, Shigella flexneri 2a str. 2457T
caccagcaccagcg

SEQ ID NO: 1947543 - RNA, 17 nt, Shigella flexneri 2a str. 2457T
caccagcaacaagccag

SEQ ID NO: 1947544 - RNA, 17 nt, Shigella flexneri 2a str. 2457T
caccagauggcuuucca

SEQ ID NO: 1947545 - RNA, 22 nt, Shigella flexneri 2a str. 2457T
caccacuggcgauauugccgcg

SEQ ID NO: 1947546 - RNA, 23 nt, Shigella flexneri 2a str. 2457T
caccacugcgcauaauccacuuu

SEQ ID NO: 1947547 - RNA, 15 nt, Shigella flexneri 2a str. 2457T
caccacuccucaaca

SEQ ID NO: 1947548 - RNA, 14 nt, Shigella flexneri 2a str. 2457T
caccacgaaaacag

SEQ ID NO: 1947549 - RNA, 14 nt, Shigella flexneri 2a str. 2457T
caccacgccaagaa

SEQ ID NO: 1947550 - RNA, 19 nt, Shigella flexneri 2a str. 2457T
caccacgcugagagaagca

SEQ ID NO: 1947551 - RNA, 18 nt, Shigella flexneri 2a str. 2457T
caccacgcugcaugggga

SEQ ID NO: 1947552 - RNA, 14 nt, Shigella flexneri 2a str. 2457T
caccaccagcgaaa

SEQ ID NO: 1947553 - RNA, 14 nt, Shigella flexneri 2a str. 2457T
caccaccagcagcu

SEQ ID NO: 1947554 - RNA, 14 nt, Shigella flexneri 2a str. 2457T
caccaccagcaccg

SEQ ID NO: 1947555 - RNA, 13 nt, Shigella flexneri 2a str. 2457T
caccaccugggug

SEQ ID NO: 1947556 - RNA, 16 nt, Shigella flexneri 2a str. 2457T
caccagcggcacgcca

SEQ ID NO: 1947557 - RNA, 22 nt, Shigella flexneri 2a str. 2457T
caccaggcucuuuaaacaguuu

SEQ ID NO: 1947558 - RNA, 16 nt, Shigella flexneri 2a str. 2457T
caccagggaaauaauc

SEQ ID NO: 1947559 - RNA, 23 nt, Shigella flexneri 2a str. 2457T
caccagccauuaaccagccacug

SEQ ID NO: 1947560 - RNA, 16 nt, Shigella flexneri 2a str. 2457T
caccagcgccgcgcca

SEQ ID NO: 1947561 - RNA, 15 nt, Shigella flexneri 2a str. 2457T
caccagcaucaacaa

SEQ ID NO: 1947562 - RNA, 17 nt, Shigella flexneri 2a str. 2457T
caccagcaucaacaaca

SEQ ID NO: 1947563 - RNA, 16 nt, Shigella flexneri 2a str. 2457T
caccagccaccgcguu

SEQ ID NO: 1947564 - RNA, 12 nt, Shigella flexneri 2a str. 2457T
caccagccagaa

SEQ ID NO: 1947565 - RNA, 20 nt, Shigella flexneri 2a str. 2457T
caccagccagaauuaccccg

SEQ ID NO: 1947566 - RNA, 16 nt, Shigella flexneri 2a str. 2457T
cacauccaguggcaga

SEQ ID NO: 1947567 - RNA, 18 nt, Shigella flexneri 2a str. 2457T
cacaucccagcagagauc

SEQ ID NO: 1947568 - RNA, 14 nt, Shigella flexneri 2a str. 2457T
cacauccaguacgc

SEQ ID NO: 1947569 - RNA, 13 nt, Shigella flexneri 2a str. 2457T
cacaucacuccau

SEQ ID NO: 1947570 - RNA, 19 nt, Shigella flexneri 2a str. 2457T
cacaucacuccauccagca

SEQ ID NO: 1947571 - RNA, 14 nt, Shigella flexneri 2a str. 2457T
cacaucagacucag

SEQ ID NO: 1947572 - RNA, 17 nt, Shigella flexneri 2a str. 2457T
cacaucagacucagucg

SEQ ID NO: 1947573 - RNA, 15 nt, Shigella flexneri 2a str. 2457T
cacaucaaaucccca

SEQ ID NO: 1947574 - RNA, 13 nt, Shigella flexneri 2a str. 2457T
cacaucaccauaa

SEQ ID NO: 1947575 - RNA, 23 nt, Shigella flexneri 2a str. 2457T
cacaucaaugaugaacgccacau

SEQ ID NO: 1947576 - RNA, 12 nt, Shigella flexneri 2a str. 2457T
cacagcucugcu

SEQ ID NO: 1947577 - RNA, 13 nt, Shigella flexneri 2a str. 2457T
cacauauauuaau

SEQ ID NO: 1947578 - RNA, 21 nt, Shigella flexneri 2a str. 2457T
cacauauuauugaaaucacua

SEQ ID NO: 1947579 - RNA, 20 nt, Shigella flexneri 2a str. 2457T
cacauagcgugacaccagca

SEQ ID NO: 1947580 - RNA, 20 nt, Shigella flexneri 2a str. 2457T
cacauacgacgcuucaguuc

SEQ ID NO: 1947581 - RNA, 19 nt, Shigella flexneri 2a str. 2457T
caccaaaaccacagaaccu

SEQ ID NO: 1947582 - RNA, 11 nt, Shigella flexneri 2a str. 2457T
cacauuuuuaa

SEQ ID NO: 1947583 - RNA, 16 nt, Shigella flexneri 2a str. 2457T
cacauuccagaugugc

SEQ ID NO: 1947584 - RNA, 14 nt, Shigella flexneri 2a str. 2457T
cacauuuuccauca

SEQ ID NO: 1947585 - RNA, 16 nt, Shigella flexneri 2a str. 2457T
cacauuccucugucag

SEQ ID NO: 1947586 - RNA, 17 nt, Shigella flexneri 2a str. 2457T
cacauuaucucaacaca

SEQ ID NO: 1947587 - RNA, 13 nt, Shigella flexneri 2a str. 2457T
cacauuagauaaa

SEQ ID NO: 1947588 - RNA, 23 nt, Shigella flexneri 2a str. 2457T
cacaucgccgaccgcaaccggcc

SEQ ID NO: 1947589 - RNA, 17 nt, Shigella flexneri 2a str. 2457T
caccaccaaaaacgcca

SEQ ID NO: 1947590 - RNA, 15 nt, Shigella flexneri 2a str. 2457T
caccaccaaagguua

SEQ ID NO: 1947591 - RNA, 17 nt, Shigella flexneri 2a str. 2457T
caccacacgaauuccaa

SEQ ID NO: 1947592 - RNA, 14 nt, Shigella flexneri 2a str. 2457T
caccacacaaccga

SEQ ID NO: 1947593 - RNA, 14 nt, Shigella flexneri 2a str. 2457T
caccaaccgcggua

SEQ ID NO: 1947594 - RNA, 17 nt, Shigella flexneri 2a str. 2457T
caccaacccuuaccccu

SEQ ID NO: 1947595 - RNA, 15 nt, Shigella flexneri 2a str. 2457T
caccaacgacggcca

SEQ ID NO: 1947596 - RNA, 16 nt, Shigella flexneri 2a str. 2457T
caccaacgacggccag

SEQ ID NO: 1947597 - RNA, 16 nt, Shigella flexneri 2a str. 2457T
caccaaagggcaaagu

SEQ ID NO: 1947598 - RNA, 23 nt, Shigella flexneri 2a str. 2457T
caccaaagaugucaccauuggca

SEQ ID NO: 1947599 - RNA, 21 nt, Shigella flexneri 2a str. 2457T
cacgauggaaccguacagcau

SEQ ID NO: 1947600 - RNA, 12 nt, Shigella flexneri 2a str. 2457T
cacgaugcuaaa

SEQ ID NO: 1947601 - RNA, 16 nt, Shigella flexneri 2a str. 2457T
cacgaugcuaaaaaca

SEQ ID NO: 1947602 - RNA, 18 nt, Shigella flexneri 2a str. 2457T
cacgaguagguagaauau

SEQ ID NO: 1947603 - RNA, 16 nt, Shigella flexneri 2a str. 2457T
cacgaucccuugcagu

SEQ ID NO: 1947604 - RNA, 19 nt, Shigella flexneri 2a str. 2457T
cacgacauacaccgcagcc

SEQ ID NO: 1947605 - RNA, 14 nt, Shigella flexneri 2a str. 2457T
cacgagaaaaaaug

SEQ ID NO: 1947606 - RNA, 18 nt, Shigella flexneri 2a str. 2457T
cacgaaccguaaaagccu

SEQ ID NO: 1947607 - RNA, 22 nt, Shigella flexneri 2a str. 2457T
caccuuuuuuuaugcuuccuuc

SEQ ID NO: 1947608 - RNA, 23 nt, Shigella flexneri 2a str. 2457T
caccuucaacguuaggugggaac

SEQ ID NO: 1947609 - RNA, 22 nt, Shigella flexneri 2a str. 2457T
caccuucagcgaagcccacgcc

SEQ ID NO: 1947610 - RNA, 18 nt, Shigella flexneri 2a str. 2457T
cacgaaaccacugcaaca

SEQ ID NO: 1947611 - RNA, 18 nt, Shigella flexneri 2a str. 2457T
cacgaaaccgacugccau

SEQ ID NO: 1947612 - RNA, 18 nt, Shigella flexneri 2a str. 2457T
cacgaaucgucaguucac

SEQ ID NO: 1947613 - RNA, 14 nt, Shigella flexneri 2a str. 2457T
aaaauagccaauca

SEQ ID NO: 1947614 - RNA, 22 nt, Shigella flexneri 2a str. 2457T
caccugcugauuaucggcauca

SEQ ID NO: 1947615 - RNA, 12 nt, Shigella flexneri 2a str. 2457T
caccugcuggac

SEQ ID NO: 1947616 - RNA, 11 nt, Shigella flexneri 2a str. 2457T
caccuggcgcu

SEQ ID NO: 1947617 - RNA, 21 nt, Shigella flexneri 2a str. 2457T
caccugggcaauggugaacug

SEQ ID NO: 1947618 - RNA, 16 nt, Shigella flexneri 2a str. 2457T
caccuggggcuugcca

SEQ ID NO: 1947619 - RNA, 21 nt, Shigella flexneri 2a str. 2457T
caccucccgucgcccacacca

SEQ ID NO: 1947620 - RNA, 20 nt, Shigella flexneri 2a str. 2457T
caccucccgucgcccacacc

SEQ ID NO: 1947621 - RNA, 14 nt, Shigella flexneri 2a str. 2457T
caccugcugauuau

SEQ ID NO: 1947622 - RNA, 18 nt, Shigella flexneri 2a str. 2457T
caccuccacgcccagcgc

SEQ ID NO: 1947623 - RNA, 12 nt, Shigella flexneri 2a str. 2457T
caccucaucaga

SEQ ID NO: 1947624 - RNA, 15 nt, Shigella flexneri 2a str. 2457T
caccucaucaccaca

SEQ ID NO: 1947625 - RNA, 18 nt, Shigella flexneri 2a str. 2457T
caccucaguacccgcguu

SEQ ID NO: 1947626 - RNA, 22 nt, Shigella flexneri 2a str. 2457T
caccuuacggcacuccucuuca

SEQ ID NO: 1947627 - RNA, 15 nt, Shigella flexneri 2a str. 2457T
aaaauaccagcaauu

SEQ ID NO: 1947628 - RNA, 14 nt, Shigella flexneri 2a str. 2457T
caccuguuccauga

SEQ ID NO: 1947629 - RNA, 15 nt, Shigella flexneri 2a str. 2457T
aaaauaaugugauuu

SEQ ID NO: 1947630 - RNA, 21 nt, Shigella flexneri 2a str. 2457T
aaaauaaugugauuuugugaa

SEQ ID NO: 1947631 - RNA, 22 nt, Shigella flexneri 2a str. 2457T
caccuguugccauuucugcugc

SEQ ID NO: 1947632 - RNA, 19 nt, Shigella flexneri 2a str. 2457T
caccuguugcgcgucgccc

SEQ ID NO: 1947633 - RNA, 18 nt, Shigella flexneri 2a str. 2457T
aaaauaauuuuaaauauc

SEQ ID NO: 1947634 - RNA, 17 nt, Shigella flexneri 2a str. 2457T
aaaauacauacgcaaaa

SEQ ID NO: 1947635 - RNA, 22 nt, Shigella flexneri 2a str. 2457T
cacgcaaauguggcggaauacc

SEQ ID NO: 1947636 - RNA, 16 nt, Shigella flexneri 2a str. 2457T
cacgcaaccacaacgc

SEQ ID NO: 1947637 - RNA, 15 nt, Shigella flexneri 2a str. 2457T
cacgccgaagugcgc

SEQ ID NO: 1947638 - RNA, 22 nt, Shigella flexneri 2a str. 2457T
cacgccgcauccggcaugaaca

SEQ ID NO: 1947639 - RNA, 12 nt, Shigella flexneri 2a str. 2457T
cacgccuccugg

SEQ ID NO: 1947640 - RNA, 17 nt, Shigella flexneri 2a str. 2457T
cacgccgaucgaagaga

SEQ ID NO: 1947641 - RNA, 19 nt, Shigella flexneri 2a str. 2457T
cacgccgacaaagaugcag

SEQ ID NO: 1947642 - RNA, 23 nt, Shigella flexneri 2a str. 2457T
cacgcgaacaacagaucaacaua

SEQ ID NO: 1947643 - RNA, 17 nt, Shigella flexneri 2a str. 2457T
cacgcgauacuuuuuca

SEQ ID NO: 1947644 - RNA, 16 nt, Shigella flexneri 2a str. 2457T
cacgccugccgccagc

SEQ ID NO: 1947645 - RNA, 12 nt, Shigella flexneri 2a str. 2457T
cacgccuucuuc

SEQ ID NO: 1947646 - RNA, 13 nt, Shigella flexneri 2a str. 2457T
cacgcgcuccagg

SEQ ID NO: 1947647 - RNA, 15 nt, Shigella flexneri 2a str. 2457T
cacgcgccacgcacg

SEQ ID NO: 1947648 - RNA, 15 nt, Shigella flexneri 2a str. 2457T
cacgcgcuccaggag

SEQ ID NO: 1947649 - RNA, 13 nt, Shigella flexneri 2a str. 2457T
cacgcucccagca

SEQ ID NO: 1947650 - RNA, 14 nt, Shigella flexneri 2a str. 2457T
cacgcucagcaauu

SEQ ID NO: 1947651 - RNA, 19 nt, Shigella flexneri 2a str. 2457T
cacgcucacucaucacucc

SEQ ID NO: 1947652 - RNA, 15 nt, Shigella flexneri 2a str. 2457T
cacgcucagcaauug

SEQ ID NO: 1947653 - RNA, 13 nt, Shigella flexneri 2a str. 2457T
cacgcuaccuuga

SEQ ID NO: 1947654 - RNA, 21 nt, Shigella flexneri 2a str. 2457T
cacggauauauccguggcuuu

SEQ ID NO: 1947655 - RNA, 13 nt, Shigella flexneri 2a str. 2457T
cacggcagcaacu

SEQ ID NO: 1947656 - RNA, 18 nt, Shigella flexneri 2a str. 2457T
cacggcagcaacuuaauc

SEQ ID NO: 1947657 - RNA, 23 nt, Shigella flexneri 2a str. 2457T
caccgcguuccacggggacucca

SEQ ID NO: 1947658 - RNA, 14 nt, Shigella flexneri 2a str. 2457T
caccgcguuuucca

SEQ ID NO: 1947659 - RNA, 20 nt, Shigella flexneri 2a str. 2457T
caccgcucuucauacgcggc

SEQ ID NO: 1947660 - RNA, 20 nt, Shigella flexneri 2a str. 2457T
caccgcuucacucccugccc

SEQ ID NO: 1947661 - RNA, 18 nt, Shigella flexneri 2a str. 2457T
caccgcuucaacagcggc

SEQ ID NO: 1947662 - RNA, 23 nt, Shigella flexneri 2a str. 2457T
caccggaacaacccagcggauga

SEQ ID NO: 1947663 - RNA, 16 nt, Shigella flexneri 2a str. 2457T
caccgcggaacgcacu

SEQ ID NO: 1947664 - RNA, 22 nt, Shigella flexneri 2a str. 2457T
caccgcguucagcagcucauca

SEQ ID NO: 1947665 - RNA, 15 nt, Shigella flexneri 2a str. 2457T
caccgccugcgaugg

SEQ ID NO: 1947666 - RNA, 23 nt, Shigella flexneri 2a str. 2457T
caccgccaaagauaaaauaacca

SEQ ID NO: 1947667 - RNA, 19 nt, Shigella flexneri 2a str. 2457T
caccgcgaauuuuuucgca

SEQ ID NO: 1947668 - RNA, 21 nt, Shigella flexneri 2a str. 2457T
caccgcgacaaucagguaagc

SEQ ID NO: 1947669 - RNA, 17 nt, Shigella flexneri 2a str. 2457T
caccgccaaagauaaaa

SEQ ID NO: 1947670 - RNA, 14 nt, Shigella flexneri 2a str. 2457T
caccgccaaagaua

SEQ ID NO: 1947671 - RNA, 15 nt, Shigella flexneri 2a str. 2457T
caccgcaucaauauu

SEQ ID NO: 1947672 - RNA, 19 nt, Shigella flexneri 2a str. 2457T
caccgcagagaucgccccg

SEQ ID NO: 1947673 - RNA, 18 nt, Shigella flexneri 2a str. 2457T
caccgcaucaauauuaag

SEQ ID NO: 1947674 - RNA, 20 nt, Shigella flexneri 2a str. 2457T
caccgauacaaucauucccu

SEQ ID NO: 1947675 - RNA, 17 nt, Shigella flexneri 2a str. 2457T
caccgcaccuaaaaauu

SEQ ID NO: 1947676 - RNA, 12 nt, Shigella flexneri 2a str. 2457T
caccgcagaagc

SEQ ID NO: 1947677 - RNA, 22 nt, Shigella flexneri 2a str. 2457T
caccgagucgucugucgggaac

SEQ ID NO: 1947678 - RNA, 22 nt, Shigella flexneri 2a str. 2457T
caccggaauaaugaugucucug

SEQ ID NO: 1947679 - RNA, 20 nt, Shigella flexneri 2a str. 2457T
aaaauaaccaaauaaaauaa

SEQ ID NO: 1947680 - RNA, 15 nt, Shigella flexneri 2a str. 2457T
caccgucgccuucau

SEQ ID NO: 1947681 - RNA, 13 nt, Shigella flexneri 2a str. 2457T
caccucagcaagu

SEQ ID NO: 1947682 - RNA, 23 nt, Shigella flexneri 2a str. 2457T
caccguuuuuucugccucugcca

SEQ ID NO: 1947683 - RNA, 18 nt, Shigella flexneri 2a str. 2457T
cacccauagauaccuucu

SEQ ID NO: 1947684 - RNA, 21 nt, Shigella flexneri 2a str. 2457T
cacccagucccguacccagca

SEQ ID NO: 1947685 - RNA, 16 nt, Shigella flexneri 2a str. 2457T
cacccccaccccggcc

SEQ ID NO: 1947686 - RNA, 13 nt, Shigella flexneri 2a str. 2457T
cacccccaccccg

SEQ ID NO: 1947687 - RNA, 16 nt, Shigella flexneri 2a str. 2457T
caccccaccuuaccug

SEQ ID NO: 1947688 - RNA, 19 nt, Shigella flexneri 2a str. 2457T
caccccgaaaugcccgcuu

SEQ ID NO: 1947689 - RNA, 17 nt, Shigella flexneri 2a str. 2457T
cacccagaacgccgaau

SEQ ID NO: 1947690 - RNA, 14 nt, Shigella flexneri 2a str. 2457T
caccaguccaucgg

SEQ ID NO: 1947691 - RNA, 22 nt, Shigella flexneri 2a str. 2457T
caccagucagcgaacaccagca

SEQ ID NO: 1947692 - RNA, 12 nt, Shigella flexneri 2a str. 2457T
caccaguaaauu

SEQ ID NO: 1947693 - RNA, 23 nt, Shigella flexneri 2a str. 2457T
caccaguaccucuucgcuggcaa

SEQ ID NO: 1947694 - RNA, 21 nt, Shigella flexneri 2a str. 2457T
caccaguaaggcaucuucuuc

SEQ ID NO: 1947695 - RNA, 22 nt, Shigella flexneri 2a str. 2457T
caccaguaaggcaucuucuuca

SEQ ID NO: 1947696 - RNA, 23 nt, Shigella flexneri 2a str. 2457T
cacccagcgaagcaaaccaggcc

SEQ ID NO: 1947697 - RNA, 15 nt, Shigella flexneri 2a str. 2457T
cacccagcgccgcca

SEQ ID NO: 1947698 - RNA, 19 nt, Shigella flexneri 2a str. 2457T
cacccagcgccgccauagc

SEQ ID NO: 1947699 - RNA, 15 nt, Shigella flexneri 2a str. 2457T
cacccagcgaagcaa

SEQ ID NO: 1947700 - RNA, 20 nt, Shigella flexneri 2a str. 2457T
cacccagcagcgccgcgccu

SEQ ID NO: 1947701 - RNA, 11 nt, Shigella flexneri 2a str. 2457T
cacccagcccc

SEQ ID NO: 1947702 - RNA, 16 nt, Shigella flexneri 2a str. 2457T
cacccacuaaucgucc

SEQ ID NO: 1947703 - RNA, 20 nt, Shigella flexneri 2a str. 2457T
caccccgcgcagcugagaaa

SEQ ID NO: 1947704 - RNA, 16 nt, Shigella flexneri 2a str. 2457T
cacccgcagcaagcgu

SEQ ID NO: 1947705 - RNA, 22 nt, Shigella flexneri 2a str. 2457T
cacccgcagcaagcguuugagc

SEQ ID NO: 1947706 - RNA, 22 nt, Shigella flexneri 2a str. 2457T
cacccgccguuagccagcgcac

SEQ ID NO: 1947707 - RNA, 22 nt, Shigella flexneri 2a str. 2457T
cacccgccuguugcgucgccgc

SEQ ID NO: 1947708 - RNA, 23 nt, Shigella flexneri 2a str. 2457T
caccgagauaaugguuuccagca

SEQ ID NO: 1947709 - RNA, 20 nt, Shigella flexneri 2a str. 2457T
caccgaggcauucagccagu

SEQ ID NO: 1947710 - RNA, 17 nt, Shigella flexneri 2a str. 2457T
caccgaggcauucagcc

SEQ ID NO: 1947711 - RNA, 15 nt, Shigella flexneri 2a str. 2457T
caccgaggcauucag

SEQ ID NO: 1947712 - RNA, 14 nt, Shigella flexneri 2a str. 2457T
cacccugugcgcca

SEQ ID NO: 1947713 - RNA, 17 nt, Shigella flexneri 2a str. 2457T
cacccugugcgccaccg

SEQ ID NO: 1947714 - RNA, 18 nt, Shigella flexneri 2a str. 2457T
cacccugugcgccaccgc

SEQ ID NO: 1947715 - RNA, 19 nt, Shigella flexneri 2a str. 2457T
caaaggccagcaaucccca

SEQ ID NO: 1947716 - RNA, 16 nt, Shigella flexneri 2a str. 2457T
caaaggcgugaacuuc

SEQ ID NO: 1947717 - RNA, 21 nt, Shigella flexneri 2a str. 2457T
caaaggccuugaacaaacaau

SEQ ID NO: 1947718 - RNA, 18 nt, Shigella flexneri 2a str. 2457T
caaagccgucgagggccu

SEQ ID NO: 1947719 - RNA, 17 nt, Shigella flexneri 2a str. 2457T
caaagccgcgugcgcug

SEQ ID NO: 1947720 - RNA, 22 nt, Shigella flexneri 2a str. 2457T
caaagauuguuggcaaaaaaau

SEQ ID NO: 1947721 - RNA, 18 nt, Shigella flexneri 2a str. 2457T
caaagaugaugucacagc

SEQ ID NO: 1947722 - RNA, 20 nt, Shigella flexneri 2a str. 2457T
caaagacgcgguaaaagccc

SEQ ID NO: 1947723 - RNA, 18 nt, Shigella flexneri 2a str. 2457T
caaagaaauccacaaauu

SEQ ID NO: 1947724 - RNA, 15 nt, Shigella flexneri 2a str. 2457T
caaacggcuggaaca

SEQ ID NO: 1947725 - RNA, 16 nt, Shigella flexneri 2a str. 2457T
caaacgcuuuacucaa

SEQ ID NO: 1947726 - RNA, 16 nt, Shigella flexneri 2a str. 2457T
caaacuucgucacagc

SEQ ID NO: 1947727 - RNA, 13 nt, Shigella flexneri 2a str. 2457T
caaacuucuucag

SEQ ID NO: 1947728 - RNA, 22 nt, Shigella flexneri 2a str. 2457T
caaacuugauagaacaaaagac

SEQ ID NO: 1947729 - RNA, 13 nt, Shigella flexneri 2a str. 2457T
caaacuuuuaaau

SEQ ID NO: 1947730 - RNA, 17 nt, Shigella flexneri 2a str. 2457T
caaacuuaccgccgcuc

SEQ ID NO: 1947731 - RNA, 15 nt, Shigella flexneri 2a str. 2457T
caaacuuaccgccgc

SEQ ID NO: 1947732 - RNA, 22 nt, Shigella flexneri 2a str. 2457T
caaacgugacauucugacuggu

SEQ ID NO: 1947733 - RNA, 21 nt, Shigella flexneri 2a str. 2457T
caaacgugacauucugacugg

SEQ ID NO: 1947734 - RNA, 15 nt, Shigella flexneri 2a str. 2457T
caaaccucaccgcua

SEQ ID NO: 1947735 - RNA, 15 nt, Shigella flexneri 2a str. 2457T
caaaccucaggaaua

SEQ ID NO: 1947736 - RNA, 15 nt, Shigella flexneri 2a str. 2457T
caaacaacgccucgu

SEQ ID NO: 1947737 - RNA, 13 nt, Shigella flexneri 2a str. 2457T
caaacaagaucca

SEQ ID NO: 1947738 - RNA, 18 nt, Shigella flexneri 2a str. 2457T
caaaagauuauugcuuga

SEQ ID NO: 1947739 - RNA, 18 nt, Shigella flexneri 2a str. 2457T
caaaagaugagaaaaauc

SEQ ID NO: 1947740 - RNA, 16 nt, Shigella flexneri 2a str. 2457T
caaaagauaaagccac

SEQ ID NO: 1947741 - RNA, 14 nt, Shigella flexneri 2a str. 2457T
caaaagaacacgac

SEQ ID NO: 1947742 - RNA, 19 nt, Shigella flexneri 2a str. 2457T
caaaacuggugguaagaau

SEQ ID NO: 1947743 - RNA, 14 nt, Shigella flexneri 2a str. 2457T
caaaaccucuucca

SEQ ID NO: 1947744 - RNA, 16 nt, Shigella flexneri 2a str. 2457T
caaaaccucuuccagc

SEQ ID NO: 1947745 - RNA, 18 nt, Shigella flexneri 2a str. 2457T
caaaaacucauaaauuca

SEQ ID NO: 1947746 - RNA, 12 nt, Shigella flexneri 2a str. 2457T
caaaaacgccau

SEQ ID NO: 1947747 - RNA, 13 nt, Shigella flexneri 2a str. 2457T
caaaaacuuccau

SEQ ID NO: 1947748 - RNA, 16 nt, Shigella flexneri 2a str. 2457T
caaaacgugacagcau

SEQ ID NO: 1947749 - RNA, 18 nt, Shigella flexneri 2a str. 2457T
caaaacgugcagcugccu

SEQ ID NO: 1947750 - RNA, 17 nt, Shigella flexneri 2a str. 2457T
caaaacgaauaauugcu

SEQ ID NO: 1947751 - RNA, 20 nt, Shigella flexneri 2a str. 2457T
caaaauacguucucaccucu

SEQ ID NO: 1947752 - RNA, 21 nt, Shigella flexneri 2a str. 2457T
caaaauacguucucaccucug

SEQ ID NO: 1947753 - RNA, 13 nt, Shigella flexneri 2a str. 2457T
caaaauaccaaua

SEQ ID NO: 1947754 - RNA, 13 nt, Shigella flexneri 2a str. 2457T
caaaagcugggau

SEQ ID NO: 1947755 - RNA, 19 nt, Shigella flexneri 2a str. 2457T
caaaagccccggaauucuc

SEQ ID NO: 1947756 - RNA, 18 nt, Shigella flexneri 2a str. 2457T
caaaaggcaauucaauua

SEQ ID NO: 1947757 - RNA, 14 nt, Shigella flexneri 2a str. 2457T
caaaagggagcuau

SEQ ID NO: 1947758 - RNA, 15 nt, Shigella flexneri 2a str. 2457T
caaaagguccuucag

SEQ ID NO: 1947759 - RNA, 17 nt, Shigella flexneri 2a str. 2457T
caaaauguuuaugccug

SEQ ID NO: 1947760 - RNA, 17 nt, Shigella flexneri 2a str. 2457T
caaaauguuaucgggca

SEQ ID NO: 1947761 - RNA, 24 nt, Shigella flexneri 2a str. 2457T
caaaauguugucauuacaacaagg

SEQ ID NO: 1947762 - RNA, 19 nt, Shigella flexneri 2a str. 2457T
caaaaucggcaacaugacu

SEQ ID NO: 1947763 - RNA, 14 nt, Shigella flexneri 2a str. 2457T
caaaauucugcuga

SEQ ID NO: 1947764 - RNA, 14 nt, Shigella flexneri 2a str. 2457T
caaaauuaucacaa

SEQ ID NO: 1947765 - RNA, 15 nt, Shigella flexneri 2a str. 2457T
caaaauccugccagc

SEQ ID NO: 1947766 - RNA, 12 nt, Shigella flexneri 2a str. 2457T
caaaaucuauug

SEQ ID NO: 1947767 - RNA, 16 nt, Shigella flexneri 2a str. 2457T
caaaaucguaagcagg

SEQ ID NO: 1947768 - RNA, 19 nt, Shigella flexneri 2a str. 2457T
caaaauagucaucucuucc

SEQ ID NO: 1947769 - RNA, 19 nt, Shigella flexneri 2a str. 2457T
caaaauccauuuucuauuu

SEQ ID NO: 1947770 - RNA, 14 nt, Shigella flexneri 2a str. 2457T
caaaauccaccagu

SEQ ID NO: 1947771 - RNA, 18 nt, Shigella flexneri 2a str. 2457T
caaaauagguaucguaau

SEQ ID NO: 1947772 - RNA, 13 nt, Shigella flexneri 2a str. 2457T
caacaacacccau

SEQ ID NO: 1947773 - RNA, 16 nt, Shigella flexneri 2a str. 2457T
caacagcagccacacc

SEQ ID NO: 1947774 - RNA, 15 nt, Shigella flexneri 2a str. 2457T
caacaaauaaaagca

SEQ ID NO: 1947775 - RNA, 14 nt, Shigella flexneri 2a str. 2457T
caacaccacugcca

SEQ ID NO: 1947776 - RNA, 21 nt, Shigella flexneri 2a str. 2457T
caacaucgcaauccuuucccu

SEQ ID NO: 1947777 - RNA, 20 nt, Shigella flexneri 2a str. 2457T
caacauccuguaaacgaaaa

SEQ ID NO: 1947778 - RNA, 11 nt, Shigella flexneri 2a str. 2457T
caacaucaucu

SEQ ID NO: 1947779 - RNA, 23 nt, Shigella flexneri 2a str. 2457T
caacaucagcguggcgagaauag

SEQ ID NO: 1947780 - RNA, 12 nt, Shigella flexneri 2a str. 2457T
caacauaaagcc

SEQ ID NO: 1947781 - RNA, 12 nt, Shigella flexneri 2a str. 2457T
caacagugaaau

SEQ ID NO: 1947782 - RNA, 13 nt, Shigella flexneri 2a str. 2457T
caacaguucaugg

SEQ ID NO: 1947783 - RNA, 22 nt, Shigella flexneri 2a str. 2457T
caacagcgugaacugggccugc

SEQ ID NO: 1947784 - RNA, 15 nt, Shigella flexneri 2a str. 2457T
caacaguaauaaugc

SEQ ID NO: 1947785 - RNA, 16 nt, Shigella flexneri 2a str. 2457T
caaccgaacccagcag

SEQ ID NO: 1947786 - RNA, 20 nt, Shigella flexneri 2a str. 2457T
caacccgugagucuccuuua

SEQ ID NO: 1947787 - RNA, 17 nt, Shigella flexneri 2a str. 2457T
caacccggcgaaagagc

SEQ ID NO: 1947788 - RNA, 20 nt, Shigella flexneri 2a str. 2457T
caacccuaaagcacccagca

SEQ ID NO: 1947789 - RNA, 22 nt, Shigella flexneri 2a str. 2457T
caacccuaaagcacccagcaau

SEQ ID NO: 1947790 - RNA, 12 nt, Shigella flexneri 2a str. 2457T
caacccugcccu

SEQ ID NO: 1947791 - RNA, 23 nt, Shigella flexneri 2a str. 2457T
caaccaucgguacgcuuucaccc

SEQ ID NO: 1947792 - RNA, 13 nt, Shigella flexneri 2a str. 2457T
caaccauccccaa

SEQ ID NO: 1947793 - RNA, 13 nt, Shigella flexneri 2a str. 2457T
caacccacacauu

SEQ ID NO: 1947794 - RNA, 16 nt, Shigella flexneri 2a str. 2457T
caacccggcgaaagag

SEQ ID NO: 1947795 - RNA, 15 nt, Shigella flexneri 2a str. 2457T
caacaugagaacagu

SEQ ID NO: 1947796 - RNA, 18 nt, Shigella flexneri 2a str. 2457T
caacaugaaacagaaaau

SEQ ID NO: 1947797 - RNA, 22 nt, Shigella flexneri 2a str. 2457T
caacaugaaaauaaccauauau

SEQ ID NO: 1947798 - RNA, 14 nt, Shigella flexneri 2a str. 2457T
caacauguugaaau

SEQ ID NO: 1947799 - RNA, 13 nt, Shigella flexneri 2a str. 2457T
caacauuuccccc

SEQ ID NO: 1947800 - RNA, 20 nt, Shigella flexneri 2a str. 2457T
caaccagcaccgaaauauua

SEQ ID NO: 1947801 - RNA, 21 nt, Shigella flexneri 2a str. 2457T
caaccagcuucaacgauucaa

SEQ ID NO: 1947802 - RNA, 20 nt, Shigella flexneri 2a str. 2457T
caaaucacuauuaaagaaag

SEQ ID NO: 1947803 - RNA, 13 nt, Shigella flexneri 2a str. 2457T
caaaucacuauua

SEQ ID NO: 1947804 - RNA, 19 nt, Shigella flexneri 2a str. 2457T
caaaucacuauuaaagaaa

SEQ ID NO: 1947805 - RNA, 14 nt, Shigella flexneri 2a str. 2457T
caaaucaucaguac

SEQ ID NO: 1947806 - RNA, 16 nt, Shigella flexneri 2a str. 2457T
caaaucauccagaccg

SEQ ID NO: 1947807 - RNA, 18 nt, Shigella flexneri 2a str. 2457T
caaauccaucagaccuuc

SEQ ID NO: 1947808 - RNA, 16 nt, Shigella flexneri 2a str. 2457T
caaauccuuccagcuc

SEQ ID NO: 1947809 - RNA, 18 nt, Shigella flexneri 2a str. 2457T
caaaucgcccagcaaaua

SEQ ID NO: 1947810 - RNA, 19 nt, Shigella flexneri 2a str. 2457T
caaaucgauaaaacuuccc

SEQ ID NO: 1947811 - RNA, 15 nt, Shigella flexneri 2a str. 2457T
caaaucgcggcagug

SEQ ID NO: 1947812 - RNA, 16 nt, Shigella flexneri 2a str. 2457T
caaagugaauacagaa

SEQ ID NO: 1947813 - RNA, 17 nt, Shigella flexneri 2a str. 2457T
caaagugaauacagaac

SEQ ID NO: 1947814 - RNA, 21 nt, Shigella flexneri 2a str. 2457T
caaauagugccuggcugcgug

SEQ ID NO: 1947815 - RNA, 20 nt, Shigella flexneri 2a str. 2457T
caaauauacauaaagucuuu

SEQ ID NO: 1947816 - RNA, 18 nt, Shigella flexneri 2a str. 2457T
caaauaucuuauagacua

SEQ ID NO: 1947817 - RNA, 17 nt, Shigella flexneri 2a str. 2457T
caaaguacggacgcggc

SEQ ID NO: 1947818 - RNA, 14 nt, Shigella flexneri 2a str. 2457T
caaagucuccuuug

SEQ ID NO: 1947819 - RNA, 18 nt, Shigella flexneri 2a str. 2457T
caaauguugcaucgccug

SEQ ID NO: 1947820 - RNA, 15 nt, Shigella flexneri 2a str. 2457T
caaauucauuaccaa

SEQ ID NO: 1947821 - RNA, 19 nt, Shigella flexneri 2a str. 2457T
caaauucauugcguaacau

SEQ ID NO: 1947822 - RNA, 16 nt, Shigella flexneri 2a str. 2457T
caaauugcugguauuu

SEQ ID NO: 1947823 - RNA, 21 nt, Shigella flexneri 2a str. 2457T
caaauucuggcggcaauaacu

SEQ ID NO: 1947824 - RNA, 12 nt, Shigella flexneri 2a str. 2457T
caaauucuuaau

SEQ ID NO: 1947825 - RNA, 19 nt, Shigella flexneri 2a str. 2457T
caacaaaaaucucgacuuc

SEQ ID NO: 1947826 - RNA, 12 nt, Shigella flexneri 2a str. 2457T
caaaugaggcuu

SEQ ID NO: 1947827 - RNA, 15 nt, Shigella flexneri 2a str. 2457T
caaaugaacaccaaa

SEQ ID NO: 1947828 - RNA, 15 nt, Shigella flexneri 2a str. 2457T
caaaugucaccagcc

SEQ ID NO: 1947829 - RNA, 17 nt, Shigella flexneri 2a str. 2457T
caaaugucaccagccga

SEQ ID NO: 1947830 - RNA, 17 nt, Shigella flexneri 2a str. 2457T
caaaugucagcugccag

SEQ ID NO: 1947831 - RNA, 14 nt, Shigella flexneri 2a str. 2457T
caaaugaacaccaa

SEQ ID NO: 1947832 - RNA, 15 nt, Shigella flexneri 2a str. 2457T
caaaucuuauaugau

SEQ ID NO: 1947833 - RNA, 18 nt, Shigella flexneri 2a str. 2457T
caaaucgucgguguccac

SEQ ID NO: 1947834 - RNA, 23 nt, Shigella flexneri 2a str. 2457T
caaaucgucgguguccacuuccg

SEQ ID NO: 1947835 - RNA, 19 nt, Shigella flexneri 2a str. 2457T
caacggcgaaagcuggcac

SEQ ID NO: 1947836 - RNA, 15 nt, Shigella flexneri 2a str. 2457T
caacggauauuguuu

SEQ ID NO: 1947837 - RNA, 21 nt, Shigella flexneri 2a str. 2457T
caacggcaacaauucccgcag

SEQ ID NO: 1947838 - RNA, 18 nt, Shigella flexneri 2a str. 2457T
caacggaacgaaaaaaau

SEQ ID NO: 1947839 - RNA, 19 nt, Shigella flexneri 2a str. 2457T
caacggaacgaaaaaaauc

SEQ ID NO: 1947840 - RNA, 22 nt, Shigella flexneri 2a str. 2457T
caacggaccaauaaacgccagg

SEQ ID NO: 1947841 - RNA, 20 nt, Shigella flexneri 2a str. 2457T
caacggaccaauaaacgcca

SEQ ID NO: 1947842 - RNA, 20 nt, Shigella flexneri 2a str. 2457T
caacgcguuuuuucgauauc

SEQ ID NO: 1947843 - RNA, 20 nt, Shigella flexneri 2a str. 2457T
caacgccuuccgucagcaaa

SEQ ID NO: 1947844 - RNA, 14 nt, Shigella flexneri 2a str. 2457T
caacgccuucuucg

SEQ ID NO: 1947845 - RNA, 17 nt, Shigella flexneri 2a str. 2457T
caaccguucggaaaaau

SEQ ID NO: 1947846 - RNA, 21 nt, Shigella flexneri 2a str. 2457T
caaccguggcguaaaucaucg

SEQ ID NO: 1947847 - RNA, 22 nt, Shigella flexneri 2a str. 2457T
caaccgucaacguucagcaucu

SEQ ID NO: 1947848 - RNA, 23 nt, Shigella flexneri 2a str. 2457T
caaccgucaacguucagcaucug

SEQ ID NO: 1947849 - RNA, 17 nt, Shigella flexneri 2a str. 2457T
caaccguccuccguauc

SEQ ID NO: 1947850 - RNA, 14 nt, Shigella flexneri 2a str. 2457T
caacuggcaaaaga

SEQ ID NO: 1947851 - RNA, 16 nt, Shigella flexneri 2a str. 2457T
caacuggagcaggaac

SEQ ID NO: 1947852 - RNA, 20 nt, Shigella flexneri 2a str. 2457T
caacuuaaucaucaaugcca

SEQ ID NO: 1947853 - RNA, 20 nt, Shigella flexneri 2a str. 2457T
caacugcgugcugagcggcg

SEQ ID NO: 1947854 - RNA, 23 nt, Shigella flexneri 2a str. 2457T
caacugcugacgcagauccugau

SEQ ID NO: 1947855 - RNA, 23 nt, Shigella flexneri 2a str. 2457T
caacugcugcgguugaacgccaa

SEQ ID NO: 1947856 - RNA, 14 nt, Shigella flexneri 2a str. 2457T
caacugcuguuaau

SEQ ID NO: 1947857 - RNA, 20 nt, Shigella flexneri 2a str. 2457T
caacugccugaugcgaugcu

SEQ ID NO: 1947858 - RNA, 13 nt, Shigella flexneri 2a str. 2457T
caacucaucgccg

SEQ ID NO: 1947859 - RNA, 18 nt, Shigella flexneri 2a str. 2457T
caacucauuuacagaaac

SEQ ID NO: 1947860 - RNA, 21 nt, Shigella flexneri 2a str. 2457T
caacgugaccaguaccaccgc

SEQ ID NO: 1947861 - RNA, 21 nt, Shigella flexneri 2a str. 2457T
caacgugacucaauggcaucc

SEQ ID NO: 1947862 - RNA, 17 nt, Shigella flexneri 2a str. 2457T
caacguaggcacauucg

SEQ ID NO: 1947863 - RNA, 17 nt, Shigella flexneri 2a str. 2457T
caacguaucaucgcuga

SEQ ID NO: 1947864 - RNA, 19 nt, Shigella flexneri 2a str. 2457T
caacguauuacgaucaaga

SEQ ID NO: 1947865 - RNA, 19 nt, Shigella flexneri 2a str. 2457T
caacguccauaaugcgugc

SEQ ID NO: 1947866 - RNA, 18 nt, Shigella flexneri 2a str. 2457T
caacggugcggcucucuu

SEQ ID NO: 1947867 - RNA, 18 nt, Shigella flexneri 2a str. 2457T
caacgguuugaaugaaag

SEQ ID NO: 1947868 - RNA, 18 nt, Shigella flexneri 2a str. 2457T
caacguagcguuaaaacu

SEQ ID NO: 1947869 - RNA, 14 nt, Shigella flexneri 2a str. 2457T
caacguaacacuuu

SEQ ID NO: 1947870 - RNA, 18 nt, Shigella flexneri 2a str. 2457T
caacgguugcggaaccca

SEQ ID NO: 1947871 - RNA, 21 nt, Shigella flexneri 2a str. 2457T
caacguucagcaucuggaaag

SEQ ID NO: 1947872 - RNA, 17 nt, Shigella flexneri 2a str. 2457T
caacguggaacaaauag

SEQ ID NO: 1947873 - RNA, 17 nt, Shigella flexneri 2a str. 2457T
caacucauuuacagaaa

SEQ ID NO: 1947874 - RNA, 19 nt, Shigella flexneri 2a str. 2457T
caagcaugggugaacugcu

SEQ ID NO: 1947875 - RNA, 17 nt, Shigella flexneri 2a str. 2457T
caagauuaaaagugauu

SEQ ID NO: 1947876 - RNA, 17 nt, Shigella flexneri 2a str. 2457T
caagaugcuugcgauau

SEQ ID NO: 1947877 - RNA, 22 nt, Shigella flexneri 2a str. 2457T
caagccgcuaacagcagcagcg

SEQ ID NO: 1947878 - RNA, 21 nt, Shigella flexneri 2a str. 2457T
caagccggaauuauccgguga

SEQ ID NO: 1947879 - RNA, 17 nt, Shigella flexneri 2a str. 2457T
caagccgaaacggaaau

SEQ ID NO: 1947880 - RNA, 22 nt, Shigella flexneri 2a str. 2457T
caagccgaauaacggcucaaac

SEQ ID NO: 1947881 - RNA, 20 nt, Shigella flexneri 2a str. 2457T
caagcauuaaggcaagaaaa

SEQ ID NO: 1947882 - RNA, 14 nt, Shigella flexneri 2a str. 2457T
caagcgcgcuguca

SEQ ID NO: 1947883 - RNA, 20 nt, Shigella flexneri 2a str. 2457T
caagcgauaacucgcuuugc

SEQ ID NO: 1947884 - RNA, 17 nt, Shigella flexneri 2a str. 2457T
caagcgaaugaggcagc

SEQ ID NO: 1947885 - RNA, 15 nt, Shigella flexneri 2a str. 2457T
caagcgauaauuuau

SEQ ID NO: 1947886 - RNA, 15 nt, Shigella flexneri 2a str. 2457T
caagcucgcagagau

SEQ ID NO: 1947887 - RNA, 20 nt, Shigella flexneri 2a str. 2457T
caagcguuucaucuucaguc

SEQ ID NO: 1947888 - RNA, 18 nt, Shigella flexneri 2a str. 2457T
caagcuccggcuuuuuac

SEQ ID NO: 1947889 - RNA, 13 nt, Shigella flexneri 2a str. 2457T
caagaaucaugcc

SEQ ID NO: 1947890 - RNA, 19 nt, Shigella flexneri 2a str. 2457T
caagaaugccugccagcuu

SEQ ID NO: 1947891 - RNA, 17 nt, Shigella flexneri 2a str. 2457T
caagaaugaccgccugc

SEQ ID NO: 1947892 - RNA, 19 nt, Shigella flexneri 2a str. 2457T
caagaaucaugccaaaaau

SEQ ID NO: 1947893 - RNA, 17 nt, Shigella flexneri 2a str. 2457T
caagaauuacuucuuga

SEQ ID NO: 1947894 - RNA, 15 nt, Shigella flexneri 2a str. 2457T
caagaauuaaaauau

SEQ ID NO: 1947895 - RNA, 19 nt, Shigella flexneri 2a str. 2457T
caagaucagcauccauauc

SEQ ID NO: 1947896 - RNA, 18 nt, Shigella flexneri 2a str. 2457T
caagaucagcauccauau

SEQ ID NO: 1947897 - RNA, 13 nt, Shigella flexneri 2a str. 2457T
caagauagaacca

SEQ ID NO: 1947898 - RNA, 16 nt, Shigella flexneri 2a str. 2457T
caagauacugcauaau

SEQ ID NO: 1947899 - RNA, 15 nt, Shigella flexneri 2a str. 2457T
caaucugaagccgca

SEQ ID NO: 1947900 - RNA, 12 nt, Shigella flexneri 2a str. 2457T
caaucucacucc

SEQ ID NO: 1947901 - RNA, 14 nt, Shigella flexneri 2a str. 2457T
caaucugauugaca

SEQ ID NO: 1947902 - RNA, 17 nt, Shigella flexneri 2a str. 2457T
caaucugcgcuucucgc

SEQ ID NO: 1947903 - RNA, 17 nt, Shigella flexneri 2a str. 2457T
caaucguaugaucaucc

SEQ ID NO: 1947904 - RNA, 21 nt, Shigella flexneri 2a str. 2457T
caaucguaugaucauccgccu

SEQ ID NO: 1947905 - RNA, 13 nt, Shigella flexneri 2a str. 2457T
caaucgagcccag

SEQ ID NO: 1947906 - RNA, 19 nt, Shigella flexneri 2a str. 2457T
caaucccggaagccaccac

SEQ ID NO: 1947907 - RNA, 14 nt, Shigella flexneri 2a str. 2457T
caaucgaccaggcc

SEQ ID NO: 1947908 - RNA, 22 nt, Shigella flexneri 2a str. 2457T
caaucagguaagcgauaaaaau

SEQ ID NO: 1947909 - RNA, 17 nt, Shigella flexneri 2a str. 2457T
caaucaguggcuugguu

SEQ ID NO: 1947910 - RNA, 15 nt, Shigella flexneri 2a str. 2457T
caaucccaaaauaau

SEQ ID NO: 1947911 - RNA, 14 nt, Shigella flexneri 2a str. 2457T
caaucccccacuuu

SEQ ID NO: 1947912 - RNA, 14 nt, Shigella flexneri 2a str. 2457T
caaucacugccaga

SEQ ID NO: 1947913 - RNA, 15 nt, Shigella flexneri 2a str. 2457T
caaucacucaccugc

SEQ ID NO: 1947914 - RNA, 14 nt, Shigella flexneri 2a str. 2457T
caaucagcaauaaa

SEQ ID NO: 1947915 - RNA, 14 nt, Shigella flexneri 2a str. 2457T
caaucagauaaaau

SEQ ID NO: 1947916 - RNA, 12 nt, Shigella flexneri 2a str. 2457T
caaucagcaccg

SEQ ID NO: 1947917 - RNA, 21 nt, Shigella flexneri 2a str. 2457T
caaucagguaagcaaaggugc

SEQ ID NO: 1947918 - RNA, 14 nt, Shigella flexneri 2a str. 2457T
caaucaggcuaucg

SEQ ID NO: 1947919 - RNA, 18 nt, Shigella flexneri 2a str. 2457T
caaucaaauauucugccc

SEQ ID NO: 1947920 - RNA, 12 nt, Shigella flexneri 2a str. 2457T
caaucaaaugac

SEQ ID NO: 1947921 - RNA, 16 nt, Shigella flexneri 2a str. 2457T
caaucaaccagcacuu

SEQ ID NO: 1947922 - RNA, 19 nt, Shigella flexneri 2a str. 2457T
caaucaaaaauggcuuuau

SEQ ID NO: 1947923 - RNA, 14 nt, Shigella flexneri 2a str. 2457T
caaucaaaaaaggc

SEQ ID NO: 1947924 - RNA, 22 nt, Shigella flexneri 2a str. 2457T
caaucaaaaaaggcugacaaau

SEQ ID NO: 1947925 - RNA, 15 nt, Shigella flexneri 2a str. 2457T
caauauuuucaaucu

SEQ ID NO: 1947926 - RNA, 12 nt, Shigella flexneri 2a str. 2457T
caauauuuugaa

SEQ ID NO: 1947927 - RNA, 11 nt, Shigella flexneri 2a str. 2457T
caauauuugca

SEQ ID NO: 1947928 - RNA, 16 nt, Shigella flexneri 2a str. 2457T
caauaucuuccuggcg

SEQ ID NO: 1947929 - RNA, 16 nt, Shigella flexneri 2a str. 2457T
caaucacaucaccaua

SEQ ID NO: 1947930 - RNA, 13 nt, Shigella flexneri 2a str. 2457T
caaucacaaaaag

SEQ ID NO: 1947931 - RNA, 16 nt, Shigella flexneri 2a str. 2457T
caaucacgauagccag

SEQ ID NO: 1947932 - RNA, 14 nt, Shigella flexneri 2a str. 2457T
caaucaccguuucu

SEQ ID NO: 1947933 - RNA, 12 nt, Shigella flexneri 2a str. 2457T
caaucacgcccg

SEQ ID NO: 1947934 - RNA, 21 nt, Shigella flexneri 2a str. 2457T
caaucaccacacgaauuccaa

SEQ ID NO: 1947935 - RNA, 19 nt, Shigella flexneri 2a str. 2457T
caaucaccgccagcggcgu

SEQ ID NO: 1947936 - RNA, 16 nt, Shigella flexneri 2a str. 2457T
caaucaccgccagcgg

SEQ ID NO: 1947937 - RNA, 19 nt, Shigella flexneri 2a str. 2457T
caaucacccccaccccggc

SEQ ID NO: 1947938 - RNA, 20 nt, Shigella flexneri 2a str. 2457T
caauauccugcgcuuccugc

SEQ ID NO: 1947939 - RNA, 23 nt, Shigella flexneri 2a str. 2457T
caauauccugcgcuuccugcaac

SEQ ID NO: 1947940 - RNA, 15 nt, Shigella flexneri 2a str. 2457T
caauauccaacaggu

SEQ ID NO: 1947941 - RNA, 19 nt, Shigella flexneri 2a str. 2457T
caauauauugcaaucaucu

SEQ ID NO: 1947942 - RNA, 13 nt, Shigella flexneri 2a str. 2457T
caauaucaaauaa

SEQ ID NO: 1947943 - RNA, 15 nt, Shigella flexneri 2a str. 2457T
caauaucaucauuug

SEQ ID NO: 1947944 - RNA, 16 nt, Shigella flexneri 2a str. 2457T
caauauauugcaauca

SEQ ID NO: 1947945 - RNA, 20 nt, Shigella flexneri 2a str. 2457T
caauacgauccugagcagcc

SEQ ID NO: 1947946 - RNA, 14 nt, Shigella flexneri 2a str. 2457T
caauacgauuaacg

SEQ ID NO: 1947947 - RNA, 20 nt, Shigella flexneri 2a str. 2457T
caauacaccuccggcugggc

SEQ ID NO: 1947948 - RNA, 21 nt, Shigella flexneri 2a str. 2457T
caauaccgcguaauacaucag

SEQ ID NO: 1947949 - RNA, 22 nt, Shigella flexneri 2a str. 2457T
caauacagccagccagcaccag

SEQ ID NO: 1947950 - RNA, 17 nt, Shigella flexneri 2a str. 2457T
caauaccuucugcgccc

SEQ ID NO: 1947951 - RNA, 12 nt, Shigella flexneri 2a str. 2457T
caauaccgucug

SEQ ID NO: 1947952 - RNA, 23 nt, Shigella flexneri 2a str. 2457T
caauaccuucugcgcccgcccgc

SEQ ID NO: 1947953 - RNA, 16 nt, Shigella flexneri 2a str. 2457T
caauacaccuccggcu

SEQ ID NO: 1947954 - RNA, 18 nt, Shigella flexneri 2a str. 2457T
caauacaaccccuuagga

SEQ ID NO: 1947955 - RNA, 15 nt, Shigella flexneri 2a str. 2457T
caauaauuuuuucgc

SEQ ID NO: 1947956 - RNA, 17 nt, Shigella flexneri 2a str. 2457T
caauaauuuuuucgcca

SEQ ID NO: 1947957 - RNA, 18 nt, Shigella flexneri 2a str. 2457T
caauaauuuuuucgccaa

SEQ ID NO: 1947958 - RNA, 21 nt, Shigella flexneri 2a str. 2457T
caauacaaaauuuaacaccau

SEQ ID NO: 1947959 - RNA, 23 nt, Shigella flexneri 2a str. 2457T
caauaaguuacacaucauuagua

SEQ ID NO: 1947960 - RNA, 14 nt, Shigella flexneri 2a str. 2457T
caaguuacuccugg

SEQ ID NO: 1947961 - RNA, 15 nt, Shigella flexneri 2a str. 2457T
caaguuacuccuggu

SEQ ID NO: 1947962 - RNA, 12 nt, Shigella flexneri 2a str. 2457T
caauaaacuggc

SEQ ID NO: 1947963 - RNA, 21 nt, Shigella flexneri 2a str. 2457T
caagugcuuucaucaaaaaau

SEQ ID NO: 1947964 - RNA, 20 nt, Shigella flexneri 2a str. 2457T
caagcuuacguuacccagca

SEQ ID NO: 1947965 - RNA, 22 nt, Shigella flexneri 2a str. 2457T
caagcuuacguuacccagcacg

SEQ ID NO: 1947966 - RNA, 13 nt, Shigella flexneri 2a str. 2457T
caaguaucuauuc

SEQ ID NO: 1947967 - RNA, 19 nt, Shigella flexneri 2a str. 2457T
caaggcauauaccacaccc

SEQ ID NO: 1947968 - RNA, 18 nt, Shigella flexneri 2a str. 2457T
caaggcagagucauuucu

SEQ ID NO: 1947969 - RNA, 15 nt, Shigella flexneri 2a str. 2457T
caaguauucacucug

SEQ ID NO: 1947970 - RNA, 14 nt, Shigella flexneri 2a str. 2457T
aucaggcuaucuuc

SEQ ID NO: 1947971 - RNA, 12 nt, Shigella flexneri 2a str. 2457T
aucaggcaaaaa

SEQ ID NO: 1947972 - RNA, 15 nt, Shigella flexneri 2a str. 2457T
aucaggcaauuuuac

SEQ ID NO: 1947973 - RNA, 20 nt, Shigella flexneri 2a str. 2457T
aucaggcaauguugcguuug

SEQ ID NO: 1947974 - RNA, 22 nt, Shigella flexneri 2a str. 2457T
aucaggcagauacaaccaaucg

SEQ ID NO: 1947975 - RNA, 18 nt, Shigella flexneri 2a str. 2457T
aucaggcaggucuuucac

SEQ ID NO: 1947976 - RNA, 17 nt, Shigella flexneri 2a str. 2457T
aucaggcuuauuuggca

SEQ ID NO: 1947977 - RNA, 18 nt, Shigella flexneri 2a str. 2457T
aucagggagucuugcugg

SEQ ID NO: 1947978 - RNA, 14 nt, Shigella flexneri 2a str. 2457T
aucaggguaaauuu

SEQ ID NO: 1947979 - RNA, 22 nt, Shigella flexneri 2a str. 2457T
aucaggucaucaaucaguucau

SEQ ID NO: 1947980 - RNA, 20 nt, Shigella flexneri 2a str. 2457T
aucagguaagcgauaaaaau

SEQ ID NO: 1947981 - RNA, 16 nt, Shigella flexneri 2a str. 2457T
aucaguuccaguucau

SEQ ID NO: 1947982 - RNA, 14 nt, Shigella flexneri 2a str. 2457T
aucagucucaaacc

SEQ ID NO: 1947983 - RNA, 19 nt, Shigella flexneri 2a str. 2457T
aaaacgguaguugaacucg

SEQ ID NO: 1947984 - RNA, 16 nt, Shigella flexneri 2a str. 2457T
aaaacgguaaggacaa

SEQ ID NO: 1947985 - RNA, 19 nt, Shigella flexneri 2a str. 2457T
aaaacguccggcaauauag

SEQ ID NO: 1947986 - RNA, 18 nt, Shigella flexneri 2a str. 2457T
aaaacgcuuacgcuucau

SEQ ID NO: 1947987 - RNA, 23 nt, Shigella flexneri 2a str. 2457T
aucaguuucagccuuaaagauaa

SEQ ID NO: 1947988 - RNA, 18 nt, Shigella flexneri 2a str. 2457T
aucaguuguucagaaugc

SEQ ID NO: 1947989 - RNA, 22 nt, Shigella flexneri 2a str. 2457T
aaaacggauugcuuguucgaug

SEQ ID NO: 1947990 - RNA, 13 nt, Shigella flexneri 2a str. 2457T
aucagcaguucag

SEQ ID NO: 1947991 - RNA, 22 nt, Shigella flexneri 2a str. 2457T
aucagcggugccgcgauaccac

SEQ ID NO: 1947992 - RNA, 19 nt, Shigella flexneri 2a str. 2457T
aucagcucugggcuaacac

SEQ ID NO: 1947993 - RNA, 15 nt, Shigella flexneri 2a str. 2457T
aucagcguccagccc

SEQ ID NO: 1947994 - RNA, 23 nt, Shigella flexneri 2a str. 2457T
aucagcgucgccugguguugccc

SEQ ID NO: 1947995 - RNA, 15 nt, Shigella flexneri 2a str. 2457T
aucagcuccggcagc

SEQ ID NO: 1947996 - RNA, 19 nt, Shigella flexneri 2a str. 2457T
aucagcuccggcagcugcu

SEQ ID NO: 1947997 - RNA, 22 nt, Shigella flexneri 2a str. 2457T
aucagcuaauggcugcgggcga

SEQ ID NO: 1947998 - RNA, 19 nt, Shigella flexneri 2a str. 2457T
aucagaaggagcuaauaau

SEQ ID NO: 1947999 - RNA, 13 nt, Shigella flexneri 2a str. 2457T
aucagaaggguug

SEQ ID NO: 1948000 - RNA, 14 nt, Shigella flexneri 2a str. 2457T
aucagaacguaaac

SEQ ID NO: 1948001 - RNA, 14 nt, Shigella flexneri 2a str. 2457T
aucagaaaugccag

SEQ ID NO: 1948002 - RNA, 13 nt, Shigella flexneri 2a str. 2457T
aucacuuaaccca

SEQ ID NO: 1948003 - RNA, 15 nt, Shigella flexneri 2a str. 2457T
aucacuuccagcagu

SEQ ID NO: 1948004 - RNA, 18 nt, Shigella flexneri 2a str. 2457T
aucagcagauaucccgcc

SEQ ID NO: 1948005 - RNA, 15 nt, Shigella flexneri 2a str. 2457T
aucagcagcaacaaa

SEQ ID NO: 1948006 - RNA, 19 nt, Shigella flexneri 2a str. 2457T
aucagcagcggagaaaugu

SEQ ID NO: 1948007 - RNA, 16 nt, Shigella flexneri 2a str. 2457T
aucagcccagcccuga

SEQ ID NO: 1948008 - RNA, 20 nt, Shigella flexneri 2a str. 2457T
aucacugaugugauggccgc

SEQ ID NO: 1948009 - RNA, 22 nt, Shigella flexneri 2a str. 2457T
aucacucccuuucugccacgcc

SEQ ID NO: 1948010 - RNA, 23 nt, Shigella flexneri 2a str. 2457T
aucacuccauccagcaacaacag

SEQ ID NO: 1948011 - RNA, 22 nt, Shigella flexneri 2a str. 2457T
aucaccaauacgcauaugcauc

SEQ ID NO: 1948012 - RNA, 15 nt, Shigella flexneri 2a str. 2457T
aucaccacagacaaa

SEQ ID NO: 1948013 - RNA, 22 nt, Shigella flexneri 2a str. 2457T
aucaccaccaacgcacacaugc

SEQ ID NO: 1948014 - RNA, 15 nt, Shigella flexneri 2a str. 2457T
aucaccaccacgacc

SEQ ID NO: 1948015 - RNA, 12 nt, Shigella flexneri 2a str. 2457T
aucaccagcgca

SEQ ID NO: 1948016 - RNA, 16 nt, Shigella flexneri 2a str. 2457T
aucaccaugauuucug

SEQ ID NO: 1948017 - RNA, 20 nt, Shigella flexneri 2a str. 2457T
aucaccaguaccgccgccau

SEQ ID NO: 1948018 - RNA, 18 nt, Shigella flexneri 2a str. 2457T
aucaccauauucagcagc

SEQ ID NO: 1948019 - RNA, 16 nt, Shigella flexneri 2a str. 2457T
aucaccucuuuuucca

SEQ ID NO: 1948020 - RNA, 22 nt, Shigella flexneri 2a str. 2457T
aucaccucuuuuuccacuucca

SEQ ID NO: 1948021 - RNA, 13 nt, Shigella flexneri 2a str. 2457T
aucaauuugccca

SEQ ID NO: 1948022 - RNA, 13 nt, Shigella flexneri 2a str. 2457T
aucaauuucacag

SEQ ID NO: 1948023 - RNA, 15 nt, Shigella flexneri 2a str. 2457T
aucaauugcaggaag

SEQ ID NO: 1948024 - RNA, 21 nt, Shigella flexneri 2a str. 2457T
aucaauuuaucguauuggccg

SEQ ID NO: 1948025 - RNA, 21 nt, Shigella flexneri 2a str. 2457T
aucaauuuauugaauuuacac

SEQ ID NO: 1948026 - RNA, 12 nt, Shigella flexneri 2a str. 2457T
aucaauuucaca

SEQ ID NO: 1948027 - RNA, 23 nt, Shigella flexneri 2a str. 2457T
aucacaaaacgaauaauugcugg

SEQ ID NO: 1948028 - RNA, 18 nt, Shigella flexneri 2a str. 2457T
aucacaaucggcuuucac

SEQ ID NO: 1948029 - RNA, 23 nt, Shigella flexneri 2a str. 2457T
aucacaaucggcuuucaccgccu

SEQ ID NO: 1948030 - RNA, 16 nt, Shigella flexneri 2a str. 2457T
aucacaauagaaauau

SEQ ID NO: 1948031 - RNA, 15 nt, Shigella flexneri 2a str. 2457T
aucacaauaaucgcc

SEQ ID NO: 1948032 - RNA, 15 nt, Shigella flexneri 2a str. 2457T
aucacauccugauag

SEQ ID NO: 1948033 - RNA, 21 nt, Shigella flexneri 2a str. 2457T
aucacaugcuggaaccacagc

SEQ ID NO: 1948034 - RNA, 18 nt, Shigella flexneri 2a str. 2457T
aucaccaacgauuuuuuc

SEQ ID NO: 1948035 - RNA, 13 nt, Shigella flexneri 2a str. 2457T
aucacaucccagc

SEQ ID NO: 1948036 - RNA, 18 nt, Shigella flexneri 2a str. 2457T
aucacaucaaauccccac

SEQ ID NO: 1948037 - RNA, 18 nt, Shigella flexneri 2a str. 2457T
aucacauaaucgaaaaca

SEQ ID NO: 1948038 - RNA, 20 nt, Shigella flexneri 2a str. 2457T
aucacaccgcgaucuuccac

SEQ ID NO: 1948039 - RNA, 13 nt, Shigella flexneri 2a str. 2457T
aucacaggcgcga

SEQ ID NO: 1948040 - RNA, 17 nt, Shigella flexneri 2a str. 2457T
aucacaguuaagcaaua

SEQ ID NO: 1948041 - RNA, 17 nt, Shigella flexneri 2a str. 2457T
auauuauugaaaucacu

SEQ ID NO: 1948042 - RNA, 17 nt, Shigella flexneri 2a str. 2457T
auauucgccgcccugca

SEQ ID NO: 1948043 - RNA, 23 nt, Shigella flexneri 2a str. 2457T
auauucgacaccaucuuccucac

SEQ ID NO: 1948044 - RNA, 13 nt, Shigella flexneri 2a str. 2457T
auauucgcuuuca

SEQ ID NO: 1948045 - RNA, 11 nt, Shigella flexneri 2a str. 2457T
auauucguuau

SEQ ID NO: 1948046 - RNA, 20 nt, Shigella flexneri 2a str. 2457T
auauuccuuuaucauuaaca

SEQ ID NO: 1948047 - RNA, 21 nt, Shigella flexneri 2a str. 2457T
auauucgacaccaucuuccuc

SEQ ID NO: 1948048 - RNA, 11 nt, Shigella flexneri 2a str. 2457T
auauuccugca

SEQ ID NO: 1948049 - RNA, 20 nt, Shigella flexneri 2a str. 2457T
auauuccugaauggugaccu

SEQ ID NO: 1948050 - RNA, 22 nt, Shigella flexneri 2a str. 2457T
auauuaaauuuuuucacuguuc

SEQ ID NO: 1948051 - RNA, 16 nt, Shigella flexneri 2a str. 2457T
auauuaaauuuuuuca

SEQ ID NO: 1948052 - RNA, 12 nt, Shigella flexneri 2a str. 2457T
auauuaauacaa

SEQ ID NO: 1948053 - RNA, 19 nt, Shigella flexneri 2a str. 2457T
auauuaaggguaaaaggau

SEQ ID NO: 1948054 - RNA, 17 nt, Shigella flexneri 2a str. 2457T
auauuacaucuuaaucu

SEQ ID NO: 1948055 - RNA, 16 nt, Shigella flexneri 2a str. 2457T
auauuacgaauauaaa

SEQ ID NO: 1948056 - RNA, 18 nt, Shigella flexneri 2a str. 2457T
auauuacgaauauaaaua

SEQ ID NO: 1948057 - RNA, 22 nt, Shigella flexneri 2a str. 2457T
auauuacgaauauaaauauuuu

SEQ ID NO: 1948058 - RNA, 18 nt, Shigella flexneri 2a str. 2457T
auaugugaucgaauauau

SEQ ID NO: 1948059 - RNA, 21 nt, Shigella flexneri 2a str. 2457T
auaugucuuuuuuccagcaca

SEQ ID NO: 1948060 - RNA, 16 nt, Shigella flexneri 2a str. 2457T
auauguucccgcgccu

SEQ ID NO: 1948061 - RNA, 13 nt, Shigella flexneri 2a str. 2457T
auaugggugcaau

SEQ ID NO: 1948062 - RNA, 15 nt, Shigella flexneri 2a str. 2457T
auauggcggcggcuu

SEQ ID NO: 1948063 - RNA, 16 nt, Shigella flexneri 2a str. 2457T
auauggcccaucaucu

SEQ ID NO: 1948064 - RNA, 20 nt, Shigella flexneri 2a str. 2457T
auauggugagcgauauuuau

SEQ ID NO: 1948065 - RNA, 18 nt, Shigella flexneri 2a str. 2457T
auauggggcagaugggcu

SEQ ID NO: 1948066 - RNA, 22 nt, Shigella flexneri 2a str. 2457T
auaugccagccccagcgucagc

SEQ ID NO: 1948067 - RNA, 17 nt, Shigella flexneri 2a str. 2457T
auaugcaucaugaaaac

SEQ ID NO: 1948068 - RNA, 14 nt, Shigella flexneri 2a str. 2457T
auaugcauaaaccg

SEQ ID NO: 1948069 - RNA, 12 nt, Shigella flexneri 2a str. 2457T
auauccugcgcu

SEQ ID NO: 1948070 - RNA, 19 nt, Shigella flexneri 2a str. 2457T
auauccugcgcuuccugca

SEQ ID NO: 1948071 - RNA, 15 nt, Shigella flexneri 2a str. 2457T
auaugcuggcagugg

SEQ ID NO: 1948072 - RNA, 22 nt, Shigella flexneri 2a str. 2457T
auaugcggugccauuaaaccaa

SEQ ID NO: 1948073 - RNA, 21 nt, Shigella flexneri 2a str. 2457T
auauggaaaaauauucaccaa

SEQ ID NO: 1948074 - RNA, 18 nt, Shigella flexneri 2a str. 2457T
auauggaagaaacgcuua

SEQ ID NO: 1948075 - RNA, 14 nt, Shigella flexneri 2a str. 2457T
aucaaagguuuuuc

SEQ ID NO: 1948076 - RNA, 15 nt, Shigella flexneri 2a str. 2457T
aucaaagguuuuuca

SEQ ID NO: 1948077 - RNA, 13 nt, Shigella flexneri 2a str. 2457T
aucaaauaaaaau

SEQ ID NO: 1948078 - RNA, 22 nt, Shigella flexneri 2a str. 2457T
aucaaaucaccauauucagcag

SEQ ID NO: 1948079 - RNA, 23 nt, Shigella flexneri 2a str. 2457T
aucaaaucaccauauucagcagc

SEQ ID NO: 1948080 - RNA, 15 nt, Shigella flexneri 2a str. 2457T
aucaaaucaaugccu

SEQ ID NO: 1948081 - RNA, 13 nt, Shigella flexneri 2a str. 2457T
aucaaaucaccau

SEQ ID NO: 1948082 - RNA, 11 nt, Shigella flexneri 2a str. 2457T
aucaaaucucg

SEQ ID NO: 1948083 - RNA, 14 nt, Shigella flexneri 2a str. 2457T
aucaacuaaauauc

SEQ ID NO: 1948084 - RNA, 21 nt, Shigella flexneri 2a str. 2457T
aucaacuuauugguaaacuca

SEQ ID NO: 1948085 - RNA, 18 nt, Shigella flexneri 2a str. 2457T
aucaacugcguucugucg

SEQ ID NO: 1948086 - RNA, 20 nt, Shigella flexneri 2a str. 2457T
aucaacugcguucugucgau

SEQ ID NO: 1948087 - RNA, 18 nt, Shigella flexneri 2a str. 2457T
aucaacuggcaaccagaa

SEQ ID NO: 1948088 - RNA, 21 nt, Shigella flexneri 2a str. 2457T
aucaacuggcaaccagaagag

SEQ ID NO: 1948089 - RNA, 22 nt, Shigella flexneri 2a str. 2457T
aucaacguuauucgcuuccuca

SEQ ID NO: 1948090 - RNA, 19 nt, Shigella flexneri 2a str. 2457T
aucaacgcuggcaugcucu

SEQ ID NO: 1948091 - RNA, 15 nt, Shigella flexneri 2a str. 2457T
aucaacggcaacaau

SEQ ID NO: 1948092 - RNA, 18 nt, Shigella flexneri 2a str. 2457T
aucaacauucagaucggu

SEQ ID NO: 1948093 - RNA, 18 nt, Shigella flexneri 2a str. 2457T
aucaacauguuccugcca

SEQ ID NO: 1948094 - RNA, 14 nt, Shigella flexneri 2a str. 2457T
aucaacaugaaaau

SEQ ID NO: 1948095 - RNA, 15 nt, Shigella flexneri 2a str. 2457T
aucaacaugaaaaua

SEQ ID NO: 1948096 - RNA, 17 nt, Shigella flexneri 2a str. 2457T
aucaacaugaaaauaac

SEQ ID NO: 1948097 - RNA, 15 nt, Shigella flexneri 2a str. 2457T
aucaacauauuaaaa

SEQ ID NO: 1948098 - RNA, 16 nt, Shigella flexneri 2a str. 2457T
aucaacauauuccccu

SEQ ID NO: 1948099 - RNA, 18 nt, Shigella flexneri 2a str. 2457T
auauuuagccagcaacug

SEQ ID NO: 1948100 - RNA, 21 nt, Shigella flexneri 2a str. 2457T
auauuuauaggguaaauuacc

SEQ ID NO: 1948101 - RNA, 22 nt, Shigella flexneri 2a str. 2457T
auauuuauaggguaaauuaccu

SEQ ID NO: 1948102 - RNA, 15 nt, Shigella flexneri 2a str. 2457T
auauuucuauauccu

SEQ ID NO: 1948103 - RNA, 18 nt, Shigella flexneri 2a str. 2457T
auauuucucggcaaauuc

SEQ ID NO: 1948104 - RNA, 22 nt, Shigella flexneri 2a str. 2457T
auauuucugcggcauucccagc

SEQ ID NO: 1948105 - RNA, 17 nt, Shigella flexneri 2a str. 2457T
auauucucaaaauacag

SEQ ID NO: 1948106 - RNA, 16 nt, Shigella flexneri 2a str. 2457T
auauucucaaaauaca

SEQ ID NO: 1948107 - RNA, 13 nt, Shigella flexneri 2a str. 2457T
auauucugaaaua

SEQ ID NO: 1948108 - RNA, 21 nt, Shigella flexneri 2a str. 2457T
auauuuacaaaucuuuauaau

SEQ ID NO: 1948109 - RNA, 14 nt, Shigella flexneri 2a str. 2457T
auauucuucaguau

SEQ ID NO: 1948110 - RNA, 20 nt, Shigella flexneri 2a str. 2457T
aucaaaaaacuggaaaaaua

SEQ ID NO: 1948111 - RNA, 21 nt, Shigella flexneri 2a str. 2457T
auagucccuucgguagcagcu

SEQ ID NO: 1948112 - RNA, 22 nt, Shigella flexneri 2a str. 2457T
auaguccugagucagaaacugu

SEQ ID NO: 1948113 - RNA, 22 nt, Shigella flexneri 2a str. 2457T
auaguguccacaggaaaacuac

SEQ ID NO: 1948114 - RNA, 20 nt, Shigella flexneri 2a str. 2457T
auaguuaaaauucaagacau

SEQ ID NO: 1948115 - RNA, 16 nt, Shigella flexneri 2a str. 2457T
auaguguuuuauguuc

SEQ ID NO: 1948116 - RNA, 23 nt, Shigella flexneri 2a str. 2457T
auauacaggcggguaaucuuucc

SEQ ID NO: 1948117 - RNA, 14 nt, Shigella flexneri 2a str. 2457T
auauagauaucaau

SEQ ID NO: 1948118 - RNA, 19 nt, Shigella flexneri 2a str. 2457T
auauacauaaagucuuucu

SEQ ID NO: 1948119 - RNA, 14 nt, Shigella flexneri 2a str. 2457T
auauagccagccuc

SEQ ID NO: 1948120 - RNA, 19 nt, Shigella flexneri 2a str. 2457T
auauagcgcacaugcaacu

SEQ ID NO: 1948121 - RNA, 22 nt, Shigella flexneri 2a str. 2457T
auauaguagaucuugauuuacu

SEQ ID NO: 1948122 - RNA, 22 nt, Shigella flexneri 2a str. 2457T
auauauuacaacguauuauaua

SEQ ID NO: 1948123 - RNA, 22 nt, Shigella flexneri 2a str. 2457T
auauaugggucguuggugauau

SEQ ID NO: 1948124 - RNA, 14 nt, Shigella flexneri 2a str. 2457T
auaucaagccaugc

SEQ ID NO: 1948125 - RNA, 20 nt, Shigella flexneri 2a str. 2457T
auaucaagaucaucaaacuu

SEQ ID NO: 1948126 - RNA, 12 nt, Shigella flexneri 2a str. 2457T
auaucaaccuga

SEQ ID NO: 1948127 - RNA, 14 nt, Shigella flexneri 2a str. 2457T
auauauucucuuuu

SEQ ID NO: 1948128 - RNA, 22 nt, Shigella flexneri 2a str. 2457T
auauauuccuuacucauaaaua

SEQ ID NO: 1948129 - RNA, 21 nt, Shigella flexneri 2a str. 2457T
auaucacucggggcuuuucuc

SEQ ID NO: 1948130 - RNA, 22 nt, Shigella flexneri 2a str. 2457T
auaucagccugaaugcuuucau

SEQ ID NO: 1948131 - RNA, 22 nt, Shigella flexneri 2a str. 2457T
auauccacgcgauacuuuuuca

SEQ ID NO: 1948132 - RNA, 13 nt, Shigella flexneri 2a str. 2457T
auauccagauaga

SEQ ID NO: 1948133 - RNA, 22 nt, Shigella flexneri 2a str. 2457T
auaucauuuugcugccauguca

SEQ ID NO: 1948134 - RNA, 13 nt, Shigella flexneri 2a str. 2457T
auaucauuaaagu

SEQ ID NO: 1948135 - RNA, 18 nt, Shigella flexneri 2a str. 2457T
auauccguagugaaaaag

SEQ ID NO: 1948136 - RNA, 16 nt, Shigella flexneri 2a str. 2457T
auagucaugaugacgc

SEQ ID NO: 1948137 - RNA, 14 nt, Shigella flexneri 2a str. 2457T
auagucaucucuuc

SEQ ID NO: 1948138 - RNA, 19 nt, Shigella flexneri 2a str. 2457T
auaguacgggcaauuucac

SEQ ID NO: 1948139 - RNA, 15 nt, Shigella flexneri 2a str. 2457T
auaguagccagccag

SEQ ID NO: 1948140 - RNA, 16 nt, Shigella flexneri 2a str. 2457T
auaguaauuucaucug

SEQ ID NO: 1948141 - RNA, 15 nt, Shigella flexneri 2a str. 2457T
auaguaagauuauau

SEQ ID NO: 1948142 - RNA, 14 nt, Shigella flexneri 2a str. 2457T
auaggcuuccaccg

SEQ ID NO: 1948143 - RNA, 14 nt, Shigella flexneri 2a str. 2457T
auaggcaucccgca

SEQ ID NO: 1948144 - RNA, 20 nt, Shigella flexneri 2a str. 2457T
auaggcaggcaucaucagau

SEQ ID NO: 1948145 - RNA, 21 nt, Shigella flexneri 2a str. 2457T
auaggcaggcaucaucagauu

SEQ ID NO: 1948146 - RNA, 15 nt, Shigella flexneri 2a str. 2457T
auagguaaacaucac

SEQ ID NO: 1948147 - RNA, 19 nt, Shigella flexneri 2a str. 2457T
auagguaaacaucacauau

SEQ ID NO: 1948148 - RNA, 16 nt, Shigella flexneri 2a str. 2457T
auagguugaaauaaac

SEQ ID NO: 1948149 - RNA, 14 nt, Shigella flexneri 2a str. 2457T
auagguggcaaaga

SEQ ID NO: 1948150 - RNA, 19 nt, Shigella flexneri 2a str. 2457T
auagguuauauuguuuuaa

SEQ ID NO: 1948151 - RNA, 13 nt, Shigella flexneri 2a str. 2457T
auagcuucaaaua

SEQ ID NO: 1948152 - RNA, 14 nt, Shigella flexneri 2a str. 2457T
auaggcaccgccaa

SEQ ID NO: 1948153 - RNA, 19 nt, Shigella flexneri 2a str. 2457T
auaggagucacucgacagc

SEQ ID NO: 1948154 - RNA, 20 nt, Shigella flexneri 2a str. 2457T
auaggaaagcuuauuuuaca

SEQ ID NO: 1948155 - RNA, 15 nt, Shigella flexneri 2a str. 2457T
auagccgauaccuaa

SEQ ID NO: 1948156 - RNA, 19 nt, Shigella flexneri 2a str. 2457T
auagagcaaccaccugcaa

SEQ ID NO: 1948157 - RNA, 16 nt, Shigella flexneri 2a str. 2457T
auagagcgccugcaga

SEQ ID NO: 1948158 - RNA, 21 nt, Shigella flexneri 2a str. 2457T
auacauaaagucuuucuuacc

SEQ ID NO: 1948159 - RNA, 16 nt, Shigella flexneri 2a str. 2457T
auacauagcacaacag

SEQ ID NO: 1948160 - RNA, 16 nt, Shigella flexneri 2a str. 2457T
auacauacgcaaaaaa

SEQ ID NO: 1948161 - RNA, 12 nt, Shigella flexneri 2a str. 2457T
auaauuauuaua

SEQ ID NO: 1948162 - RNA, 14 nt, Shigella flexneri 2a str. 2457T
auaauuauuauaau

SEQ ID NO: 1948163 - RNA, 21 nt, Shigella flexneri 2a str. 2457T
auaauuccauucaccauuuuu

SEQ ID NO: 1948164 - RNA, 19 nt, Shigella flexneri 2a str. 2457T
auaauuccggcuuggugug

SEQ ID NO: 1948165 - RNA, 15 nt, Shigella flexneri 2a str. 2457T
auacaucagcgacaa

SEQ ID NO: 1948166 - RNA, 19 nt, Shigella flexneri 2a str. 2457T
auacauugcguaaccaauc

SEQ ID NO: 1948167 - RNA, 13 nt, Shigella flexneri 2a str. 2457T
auaccaucggcag

SEQ ID NO: 1948168 - RNA, 22 nt, Shigella flexneri 2a str. 2457T
auaccauccggcauaaacgcua

SEQ ID NO: 1948169 - RNA, 18 nt, Shigella flexneri 2a str. 2457T
auaccagcucgaucagau

SEQ ID NO: 1948170 - RNA, 19 nt, Shigella flexneri 2a str. 2457T
auaccauggaagaaaaaua

SEQ ID NO: 1948171 - RNA, 20 nt, Shigella flexneri 2a str. 2457T
auaccauggaagaaaaauau

SEQ ID NO: 1948172 - RNA, 23 nt, Shigella flexneri 2a str. 2457T
auaccaucggcagcgccaaucgc

SEQ ID NO: 1948173 - RNA, 15 nt, Shigella flexneri 2a str. 2457T
auacccaaaaaauag

SEQ ID NO: 1948174 - RNA, 19 nt, Shigella flexneri 2a str. 2457T
auacccaaaaaauagcaaa

SEQ ID NO: 1948175 - RNA, 12 nt, Shigella flexneri 2a str. 2457T
auacccaaaaaa

SEQ ID NO: 1948176 - RNA, 17 nt, Shigella flexneri 2a str. 2457T
auacccgccaaaccacu

SEQ ID NO: 1948177 - RNA, 13 nt, Shigella flexneri 2a str. 2457T
auaccccagcgca

SEQ ID NO: 1948178 - RNA, 19 nt, Shigella flexneri 2a str. 2457T
auacccaacguaacaaaac

SEQ ID NO: 1948179 - RNA, 20 nt, Shigella flexneri 2a str. 2457T
auacccaacguaacaaaacu

SEQ ID NO: 1948180 - RNA, 21 nt, Shigella flexneri 2a str. 2457T
auacccagaaucucuuuuguu

SEQ ID NO: 1948181 - RNA, 21 nt, Shigella flexneri 2a str. 2457T
auacccacugcgcaguguuug

SEQ ID NO: 1948182 - RNA, 16 nt, Shigella flexneri 2a str. 2457T
auaccaucacaccucg

SEQ ID NO: 1948183 - RNA, 21 nt, Shigella flexneri 2a str. 2457T
auaccaaaaucaucaauugcc

SEQ ID NO: 1948184 - RNA, 23 nt, Shigella flexneri 2a str. 2457T
auaccaagucucaagagugaaca

SEQ ID NO: 1948185 - RNA, 17 nt, Shigella flexneri 2a str. 2457T
auaccagccuucuucau

SEQ ID NO: 1948186 - RNA, 11 nt, Shigella flexneri 2a str. 2457T
auaccagccuu

SEQ ID NO: 1948187 - RNA, 16 nt, Shigella flexneri 2a str. 2457T
auaccaccagugccau

SEQ ID NO: 1948188 - RNA, 17 nt, Shigella flexneri 2a str. 2457T
auaccacuuccagcaga

SEQ ID NO: 1948189 - RNA, 13 nt, Shigella flexneri 2a str. 2457T
auacugguuucug

SEQ ID NO: 1948190 - RNA, 16 nt, Shigella flexneri 2a str. 2457T
auacuuaaauaaugcu

SEQ ID NO: 1948191 - RNA, 18 nt, Shigella flexneri 2a str. 2457T
auacuguuuaucuuccca

SEQ ID NO: 1948192 - RNA, 22 nt, Shigella flexneri 2a str. 2457T
auacuguuuaucuucccagcgc

SEQ ID NO: 1948193 - RNA, 20 nt, Shigella flexneri 2a str. 2457T
auagaaccuaagaaccagaa

SEQ ID NO: 1948194 - RNA, 16 nt, Shigella flexneri 2a str. 2457T
auagaacaucucuucc

SEQ ID NO: 1948195 - RNA, 22 nt, Shigella flexneri 2a str. 2457T
auagaaccuuccauguugguau

SEQ ID NO: 1948196 - RNA, 18 nt, Shigella flexneri 2a str. 2457T
auagaacaaaagaccuga

SEQ ID NO: 1948197 - RNA, 14 nt, Shigella flexneri 2a str. 2457T
auagaaccacgcaa

SEQ ID NO: 1948198 - RNA, 22 nt, Shigella flexneri 2a str. 2457T
auagaaagugacugcuggguua

SEQ ID NO: 1948199 - RNA, 20 nt, Shigella flexneri 2a str. 2457T
auagaauggcaucagaagga

SEQ ID NO: 1948200 - RNA, 11 nt, Shigella flexneri 2a str. 2457T
auagaauagcc

SEQ ID NO: 1948201 - RNA, 16 nt, Shigella flexneri 2a str. 2457T
auacugaacaacuuaa

SEQ ID NO: 1948202 - RNA, 19 nt, Shigella flexneri 2a str. 2457T
auacucuuugacaacauca

SEQ ID NO: 1948203 - RNA, 22 nt, Shigella flexneri 2a str. 2457T
auacucuuugacaacaucaucu

SEQ ID NO: 1948204 - RNA, 21 nt, Shigella flexneri 2a str. 2457T
auacucuuugguauucaaccg

SEQ ID NO: 1948205 - RNA, 17 nt, Shigella flexneri 2a str. 2457T
auacucuuugguauuca

SEQ ID NO: 1948206 - RNA, 16 nt, Shigella flexneri 2a str. 2457T
auacugaucaucauua

SEQ ID NO: 1948207 - RNA, 20 nt, Shigella flexneri 2a str. 2457T
auacgugccgguaaugcuga

SEQ ID NO: 1948208 - RNA, 13 nt, Shigella flexneri 2a str. 2457T
auacguuugccag

SEQ ID NO: 1948209 - RNA, 14 nt, Shigella flexneri 2a str. 2457T
auacguuucaccag

SEQ ID NO: 1948210 - RNA, 18 nt, Shigella flexneri 2a str. 2457T
auacguuucaccagcacu

SEQ ID NO: 1948211 - RNA, 20 nt, Shigella flexneri 2a str. 2457T
auaccgucaggauaaacucc

SEQ ID NO: 1948212 - RNA, 20 nt, Shigella flexneri 2a str. 2457T
auaccgucagcgaucagcau

SEQ ID NO: 1948213 - RNA, 22 nt, Shigella flexneri 2a str. 2457T
auaccguuucgcagucgccagc

SEQ ID NO: 1948214 - RNA, 13 nt, Shigella flexneri 2a str. 2457T
auaccuaaaaaau

SEQ ID NO: 1948215 - RNA, 17 nt, Shigella flexneri 2a str. 2457T
auaccuaacauuuuacu

SEQ ID NO: 1948216 - RNA, 14 nt, Shigella flexneri 2a str. 2457T
auaccuaaaagcac

SEQ ID NO: 1948217 - RNA, 14 nt, Shigella flexneri 2a str. 2457T
augaagacauaccc

SEQ ID NO: 1948218 - RNA, 20 nt, Shigella flexneri 2a str. 2457T
augaagaacaaguucaagau

SEQ ID NO: 1948219 - RNA, 18 nt, Shigella flexneri 2a str. 2457T
augaaagcgaucuuucug

SEQ ID NO: 1948220 - RNA, 21 nt, Shigella flexneri 2a str. 2457T
augaaagccccaccagcaaau

SEQ ID NO: 1948221 - RNA, 17 nt, Shigella flexneri 2a str. 2457T
augaaaaaaguuuuauu

SEQ ID NO: 1948222 - RNA, 22 nt, Shigella flexneri 2a str. 2457T
augaaaaaaccagaaagggaag

SEQ ID NO: 1948223 - RNA, 19 nt, Shigella flexneri 2a str. 2457T
augaauauauaauuaaaaa

SEQ ID NO: 1948224 - RNA, 20 nt, Shigella flexneri 2a str. 2457T
augaauauauaauuaaaaau

SEQ ID NO: 1948225 - RNA, 19 nt, Shigella flexneri 2a str. 2457T
augaauauauccgaaaaag

SEQ ID NO: 1948226 - RNA, 19 nt, Shigella flexneri 2a str. 2457T
augacaaacgcaaaacugc

SEQ ID NO: 1948227 - RNA, 11 nt, Shigella flexneri 2a str. 2457T
augaauuacuu

SEQ ID NO: 1948228 - RNA, 17 nt, Shigella flexneri 2a str. 2457T
augaauguuuuccugcu

SEQ ID NO: 1948229 - RNA, 15 nt, Shigella flexneri 2a str. 2457T
augaauggaguuguc

SEQ ID NO: 1948230 - RNA, 12 nt, Shigella flexneri 2a str. 2457T
augagaauaauc

SEQ ID NO: 1948231 - RNA, 18 nt, Shigella flexneri 2a str. 2457T
augagaaaauuucauuaa

SEQ ID NO: 1948232 - RNA, 15 nt, Shigella flexneri 2a str. 2457T
augagaugcuggaga

SEQ ID NO: 1948233 - RNA, 21 nt, Shigella flexneri 2a str. 2457T
augaccauaaaaggcaccugg

SEQ ID NO: 1948234 - RNA, 23 nt, Shigella flexneri 2a str. 2457T
augacacguuuauuauagacauc

SEQ ID NO: 1948235 - RNA, 19 nt, Shigella flexneri 2a str. 2457T
augaccgacguuaugcucg

SEQ ID NO: 1948236 - RNA, 13 nt, Shigella flexneri 2a str. 2457T
augaccugcaaau

SEQ ID NO: 1948237 - RNA, 19 nt, Shigella flexneri 2a str. 2457T
augaccuugucaugcagcu

SEQ ID NO: 1948238 - RNA, 15 nt, Shigella flexneri 2a str. 2457T
augaccuuucauucu

SEQ ID NO: 1948239 - RNA, 14 nt, Shigella flexneri 2a str. 2457T
aucuucuccacgcc

SEQ ID NO: 1948240 - RNA, 14 nt, Shigella flexneri 2a str. 2457T
aucuucucuucccc

SEQ ID NO: 1948241 - RNA, 22 nt, Shigella flexneri 2a str. 2457T
aucuguaaauugaugugaaaac

SEQ ID NO: 1948242 - RNA, 13 nt, Shigella flexneri 2a str. 2457T
aucugugaacuca

SEQ ID NO: 1948243 - RNA, 14 nt, Shigella flexneri 2a str. 2457T
aucuugagaaaaac

SEQ ID NO: 1948244 - RNA, 16 nt, Shigella flexneri 2a str. 2457T
aucuugaaaccagaca

SEQ ID NO: 1948245 - RNA, 16 nt, Shigella flexneri 2a str. 2457T
aucuuuuugccugaga

SEQ ID NO: 1948246 - RNA, 18 nt, Shigella flexneri 2a str. 2457T
aucuuuugucaugacuac

SEQ ID NO: 1948247 - RNA, 21 nt, Shigella flexneri 2a str. 2457T
aucuuugauugaagaaaucag

SEQ ID NO: 1948248 - RNA, 21 nt, Shigella flexneri 2a str. 2457T
aucuuucugcgcaucuucccc

SEQ ID NO: 1948249 - RNA, 16 nt, Shigella flexneri 2a str. 2457T
aucuuguucauagugc

SEQ ID NO: 1948250 - RNA, 24 nt, Shigella flexneri 2a str. 2457T
aucuuuacugauaauuuuuucacu

SEQ ID NO: 1948251 - RNA, 20 nt, Shigella flexneri 2a str. 2457T
aucuuuaaaaaaagcauuua

SEQ ID NO: 1948252 - RNA, 19 nt, Shigella flexneri 2a str. 2457T
aucugauagugauccauca

SEQ ID NO: 1948253 - RNA, 13 nt, Shigella flexneri 2a str. 2457T
aucucuucuuccg

SEQ ID NO: 1948254 - RNA, 15 nt, Shigella flexneri 2a str. 2457T
aucucuucggcacug

SEQ ID NO: 1948255 - RNA, 23 nt, Shigella flexneri 2a str. 2457T
aucugaguugccaucaucaccag

SEQ ID NO: 1948256 - RNA, 19 nt, Shigella flexneri 2a str. 2457T
aucugcaaaucgaucucaa

SEQ ID NO: 1948257 - RNA, 16 nt, Shigella flexneri 2a str. 2457T
aucugauuugauaaug

SEQ ID NO: 1948258 - RNA, 15 nt, Shigella flexneri 2a str. 2457T
aucugcaauuacugc

SEQ ID NO: 1948259 - RNA, 23 nt, Shigella flexneri 2a str. 2457T
aucugcuugcgauguucuucacc

SEQ ID NO: 1948260 - RNA, 12 nt, Shigella flexneri 2a str. 2457T
aucugcccgcac

SEQ ID NO: 1948261 - RNA, 14 nt, Shigella flexneri 2a str. 2457T
aucugccagaccca

SEQ ID NO: 1948262 - RNA, 18 nt, Shigella flexneri 2a str. 2457T
aucugccagauaauggcu

SEQ ID NO: 1948263 - RNA, 22 nt, Shigella flexneri 2a str. 2457T
aucugcauucaacuggauaaaa

SEQ ID NO: 1948264 - RNA, 16 nt, Shigella flexneri 2a str. 2457T
aucuggaguuccugga

SEQ ID NO: 1948265 - RNA, 14 nt, Shigella flexneri 2a str. 2457T
aucuggauccacga

SEQ ID NO: 1948266 - RNA, 12 nt, Shigella flexneri 2a str. 2457T
aucuggaaaguc

SEQ ID NO: 1948267 - RNA, 23 nt, Shigella flexneri 2a str. 2457T
aucuggaaagucugaaugaugug

SEQ ID NO: 1948268 - RNA, 12 nt, Shigella flexneri 2a str. 2457T
aucuccauuuca

SEQ ID NO: 1948269 - RNA, 16 nt, Shigella flexneri 2a str. 2457T
aucucaaucuucacgu

SEQ ID NO: 1948270 - RNA, 17 nt, Shigella flexneri 2a str. 2457T
aucucaaucgcacccgc

SEQ ID NO: 1948271 - RNA, 17 nt, Shigella flexneri 2a str. 2457T
aucuccagauaauuaug

SEQ ID NO: 1948272 - RNA, 14 nt, Shigella flexneri 2a str. 2457T
aucucaaccgcuuc

SEQ ID NO: 1948273 - RNA, 17 nt, Shigella flexneri 2a str. 2457T
aucucaaacgguucuuu

SEQ ID NO: 1948274 - RNA, 19 nt, Shigella flexneri 2a str. 2457T
aucuauuucaggucaaaag

SEQ ID NO: 1948275 - RNA, 22 nt, Shigella flexneri 2a str. 2457T
aucucuuccagugccucaagaa

SEQ ID NO: 1948276 - RNA, 18 nt, Shigella flexneri 2a str. 2457T
aucucuuccagaauaucu

SEQ ID NO: 1948277 - RNA, 13 nt, Shigella flexneri 2a str. 2457T
aucucuucaccau

SEQ ID NO: 1948278 - RNA, 13 nt, Shigella flexneri 2a str. 2457T
aucucuucgccug

SEQ ID NO: 1948279 - RNA, 20 nt, Shigella flexneri 2a str. 2457T
aucucuuccggcaccacaaa

SEQ ID NO: 1948280 - RNA, 12 nt, Shigella flexneri 2a str. 2457T
aucucuucccau

SEQ ID NO: 1948281 - RNA, 22 nt, Shigella flexneri 2a str. 2457T
aucucuucacgcuuugcaggcu

SEQ ID NO: 1948282 - RNA, 18 nt, Shigella flexneri 2a str. 2457T
aucucuacaccaacgccc

SEQ ID NO: 1948283 - RNA, 20 nt, Shigella flexneri 2a str. 2457T
aucucuacgacuugaaaaag

SEQ ID NO: 1948284 - RNA, 15 nt, Shigella flexneri 2a str. 2457T
aucucgguggaaaau

SEQ ID NO: 1948285 - RNA, 17 nt, Shigella flexneri 2a str. 2457T
aucucgguggaaaauag

SEQ ID NO: 1948286 - RNA, 16 nt, Shigella flexneri 2a str. 2457T
aucucgguggaaaaua

SEQ ID NO: 1948287 - RNA, 17 nt, Shigella flexneri 2a str. 2457T
aucucguggucaauauu

SEQ ID NO: 1948288 - RNA, 18 nt, Shigella flexneri 2a str. 2457T
aucucguugaucacccac

SEQ ID NO: 1948289 - RNA, 15 nt, Shigella flexneri 2a str. 2457T
aucguggugaugauc

SEQ ID NO: 1948290 - RNA, 17 nt, Shigella flexneri 2a str. 2457T
aucgucugcgccaccac

SEQ ID NO: 1948291 - RNA, 23 nt, Shigella flexneri 2a str. 2457T
aucgugacaauaauacccagcac

SEQ ID NO: 1948292 - RNA, 20 nt, Shigella flexneri 2a str. 2457T
aucgucugcgccaccacaac

SEQ ID NO: 1948293 - RNA, 19 nt, Shigella flexneri 2a str. 2457T
aucgugagcguauugguga

SEQ ID NO: 1948294 - RNA, 14 nt, Shigella flexneri 2a str. 2457T
aucgugauuucaac

SEQ ID NO: 1948295 - RNA, 15 nt, Shigella flexneri 2a str. 2457T
aucguucagggagua

SEQ ID NO: 1948296 - RNA, 23 nt, Shigella flexneri 2a str. 2457T
aucguuacgccccgguuucucuu

SEQ ID NO: 1948297 - RNA, 14 nt, Shigella flexneri 2a str. 2457T
aucguuaucaccaa

SEQ ID NO: 1948298 - RNA, 21 nt, Shigella flexneri 2a str. 2457T
aucguguggauaauccauccc

SEQ ID NO: 1948299 - RNA, 15 nt, Shigella flexneri 2a str. 2457T
aucgcuucauuuaca

SEQ ID NO: 1948300 - RNA, 18 nt, Shigella flexneri 2a str. 2457T
aucgcuucggucugcgga

SEQ ID NO: 1948301 - RNA, 16 nt, Shigella flexneri 2a str. 2457T
aucggcaaaaugggua

SEQ ID NO: 1948302 - RNA, 16 nt, Shigella flexneri 2a str. 2457T
aucgucgccagaccaa

SEQ ID NO: 1948303 - RNA, 15 nt, Shigella flexneri 2a str. 2457T
aucgucgccagacca

SEQ ID NO: 1948304 - RNA, 21 nt, Shigella flexneri 2a str. 2457T
aucguccgauuaaaaacccug

SEQ ID NO: 1948305 - RNA, 17 nt, Shigella flexneri 2a str. 2457T
aucguccgccagccuac

SEQ ID NO: 1948306 - RNA, 17 nt, Shigella flexneri 2a str. 2457T
aucguccacuugaaaau

SEQ ID NO: 1948307 - RNA, 21 nt, Shigella flexneri 2a str. 2457T
aucguccacuugaaaauuaua

SEQ ID NO: 1948308 - RNA, 23 nt, Shigella flexneri 2a str. 2457T
aucggcagagugaagguuucugc

SEQ ID NO: 1948309 - RNA, 20 nt, Shigella flexneri 2a str. 2457T
aucuauucaccgcaucaaua

SEQ ID NO: 1948310 - RNA, 17 nt, Shigella flexneri 2a str. 2457T
aucuauucauuuauguu

SEQ ID NO: 1948311 - RNA, 14 nt, Shigella flexneri 2a str. 2457T
aucuaugguuuuuu

SEQ ID NO: 1948312 - RNA, 15 nt, Shigella flexneri 2a str. 2457T
aucuaugguuuuuuc

SEQ ID NO: 1948313 - RNA, 20 nt, Shigella flexneri 2a str. 2457T
aucuacgguggaacauuuac

SEQ ID NO: 1948314 - RNA, 22 nt, Shigella flexneri 2a str. 2457T
aucuacucguuuauuaugccac

SEQ ID NO: 1948315 - RNA, 20 nt, Shigella flexneri 2a str. 2457T
aucuaagaucccugccauuu

SEQ ID NO: 1948316 - RNA, 23 nt, Shigella flexneri 2a str. 2457T
aucguugcgaucgaccugcgccu

SEQ ID NO: 1948317 - RNA, 22 nt, Shigella flexneri 2a str. 2457T
aucguucugugccgucugcccc

SEQ ID NO: 1948318 - RNA, 17 nt, Shigella flexneri 2a str. 2457T
aucuaaaugccacugaa

SEQ ID NO: 1948319 - RNA, 13 nt, Shigella flexneri 2a str. 2457T
aucuaaaacccgg

SEQ ID NO: 1948320 - RNA, 15 nt, Shigella flexneri 2a str. 2457T
aucgcaucaggcaau

SEQ ID NO: 1948321 - RNA, 18 nt, Shigella flexneri 2a str. 2457T
aucgcaucaaucuuuuuc

SEQ ID NO: 1948322 - RNA, 14 nt, Shigella flexneri 2a str. 2457T
aucgcauacaaaaa

SEQ ID NO: 1948323 - RNA, 12 nt, Shigella flexneri 2a str. 2457T
aucgcagaugaa

SEQ ID NO: 1948324 - RNA, 16 nt, Shigella flexneri 2a str. 2457T
aucgccaucaggcaga

SEQ ID NO: 1948325 - RNA, 13 nt, Shigella flexneri 2a str. 2457T
aucgccagugccg

SEQ ID NO: 1948326 - RNA, 19 nt, Shigella flexneri 2a str. 2457T
aucgccagugccgcccacc

SEQ ID NO: 1948327 - RNA, 13 nt, Shigella flexneri 2a str. 2457T
aucgauuuucaaa

SEQ ID NO: 1948328 - RNA, 14 nt, Shigella flexneri 2a str. 2457T
aucgcaauccuuuc

SEQ ID NO: 1948329 - RNA, 17 nt, Shigella flexneri 2a str. 2457T
aucgauuuucaaaauau

SEQ ID NO: 1948330 - RNA, 18 nt, Shigella flexneri 2a str. 2457T
aucgcaaauugacuacac

SEQ ID NO: 1948331 - RNA, 14 nt, Shigella flexneri 2a str. 2457T
aucgcacagaugcg

SEQ ID NO: 1948332 - RNA, 14 nt, Shigella flexneri 2a str. 2457T
aucgcagaaaaaac

SEQ ID NO: 1948333 - RNA, 19 nt, Shigella flexneri 2a str. 2457T
aucgaugggauauaacccu

SEQ ID NO: 1948334 - RNA, 17 nt, Shigella flexneri 2a str. 2457T
aucgauugcacauuccc

SEQ ID NO: 1948335 - RNA, 22 nt, Shigella flexneri 2a str. 2457T
aucgagcgccguugcgcccauc

SEQ ID NO: 1948336 - RNA, 14 nt, Shigella flexneri 2a str. 2457T
aucgagccgauuaa

SEQ ID NO: 1948337 - RNA, 21 nt, Shigella flexneri 2a str. 2457T
aucgcccccgucaccggcaca

SEQ ID NO: 1948338 - RNA, 17 nt, Shigella flexneri 2a str. 2457T
aucgccccggucaucaa

SEQ ID NO: 1948339 - RNA, 22 nt, Shigella flexneri 2a str. 2457T
aucgcccgccaagcaguuggca

SEQ ID NO: 1948340 - RNA, 12 nt, Shigella flexneri 2a str. 2457T
aucgcccgcuuc

SEQ ID NO: 1948341 - RNA, 19 nt, Shigella flexneri 2a str. 2457T
aucgcccgcuuccagcgca

SEQ ID NO: 1948342 - RNA, 23 nt, Shigella flexneri 2a str. 2457T
aucgccgcguagagaaaaccaau

SEQ ID NO: 1948343 - RNA, 15 nt, Shigella flexneri 2a str. 2457T
aucgccugguaccag

SEQ ID NO: 1948344 - RNA, 19 nt, Shigella flexneri 2a str. 2457T
aucgccugguaccagcacc

SEQ ID NO: 1948345 - RNA, 20 nt, Shigella flexneri 2a str. 2457T
aucgcugcgcucuaaaauca

SEQ ID NO: 1948346 - RNA, 20 nt, Shigella flexneri 2a str. 2457T
aucgcugaacgggccaucca

SEQ ID NO: 1948347 - RNA, 14 nt, Shigella flexneri 2a str. 2457T
aucgcuaaaauacu

SEQ ID NO: 1948348 - RNA, 18 nt, Shigella flexneri 2a str. 2457T
aucgcugaacgcaccuuc

SEQ ID NO: 1948349 - RNA, 17 nt, Shigella flexneri 2a str. 2457T
aucgcggggaguucuga

SEQ ID NO: 1948350 - RNA, 18 nt, Shigella flexneri 2a str. 2457T
aucgcgggauugcgaugg

SEQ ID NO: 1948351 - RNA, 14 nt, Shigella flexneri 2a str. 2457T
aucgccuggugacc

SEQ ID NO: 1948352 - RNA, 20 nt, Shigella flexneri 2a str. 2457T
aucgcgaaaaaaagauggcu

SEQ ID NO: 1948353 - RNA, 16 nt, Shigella flexneri 2a str. 2457T
aucgcgaagaaagcgg

SEQ ID NO: 1948354 - RNA, 18 nt, Shigella flexneri 2a str. 2457T
aucgccuuaauaacccac

SEQ ID NO: 1948355 - RNA, 21 nt, Shigella flexneri 2a str. 2457T
aucgccuucgcaaaaaaccau

SEQ ID NO: 1948356 - RNA, 17 nt, Shigella flexneri 2a str. 2457T
aucgcgauacaccagau

SEQ ID NO: 1948357 - RNA, 12 nt, Shigella flexneri 2a str. 2457T
aucgcgaccaau

SEQ ID NO: 1948358 - RNA, 15 nt, Shigella flexneri 2a str. 2457T
aucgcgaccuguucu

SEQ ID NO: 1948359 - RNA, 14 nt, Shigella flexneri 2a str. 2457T
auccucuauauuuc

SEQ ID NO: 1948360 - RNA, 23 nt, Shigella flexneri 2a str. 2457T
auccucucuuuccuuaauaaaaa

SEQ ID NO: 1948361 - RNA, 19 nt, Shigella flexneri 2a str. 2457T
auccucuaucuguuugcca

SEQ ID NO: 1948362 - RNA, 20 nt, Shigella flexneri 2a str. 2457T
auccucuaucuguuugccag

SEQ ID NO: 1948363 - RNA, 12 nt, Shigella flexneri 2a str. 2457T
auccucuucagc

SEQ ID NO: 1948364 - RNA, 20 nt, Shigella flexneri 2a str. 2457T
auccucuucaagaauacugu

SEQ ID NO: 1948365 - RNA, 20 nt, Shigella flexneri 2a str. 2457T
auccucuuuacgcaaaauca

SEQ ID NO: 1948366 - RNA, 14 nt, Shigella flexneri 2a str. 2457T
auccugaaucaccu

SEQ ID NO: 1948367 - RNA, 15 nt, Shigella flexneri 2a str. 2457T
auccucaagaauaug

SEQ ID NO: 1948368 - RNA, 14 nt, Shigella flexneri 2a str. 2457T
auccugagcagcca

SEQ ID NO: 1948369 - RNA, 19 nt, Shigella flexneri 2a str. 2457T
auccugaguuaagcaaaaa

SEQ ID NO: 1948370 - RNA, 15 nt, Shigella flexneri 2a str. 2457T
auccugauacagacc

SEQ ID NO: 1948371 - RNA, 23 nt, Shigella flexneri 2a str. 2457T
auccugauagcacgucacggacu

SEQ ID NO: 1948372 - RNA, 14 nt, Shigella flexneri 2a str. 2457T
auccugaucaagca

SEQ ID NO: 1948373 - RNA, 18 nt, Shigella flexneri 2a str. 2457T
auccugaucaagcacaug

SEQ ID NO: 1948374 - RNA, 18 nt, Shigella flexneri 2a str. 2457T
auccuuccagcuccagcc

SEQ ID NO: 1948375 - RNA, 19 nt, Shigella flexneri 2a str. 2457T
auccuuccagcuccagccg

SEQ ID NO: 1948376 - RNA, 13 nt, Shigella flexneri 2a str. 2457T
auccuucccccac

SEQ ID NO: 1948377 - RNA, 16 nt, Shigella flexneri 2a str. 2457T
auccuuuaccggaugu

SEQ ID NO: 1948378 - RNA, 17 nt, Shigella flexneri 2a str. 2457T
auccuucacacugccuc

SEQ ID NO: 1948379 - RNA, 17 nt, Shigella flexneri 2a str. 2457T
auccuucacuuuugcca

SEQ ID NO: 1948380 - RNA, 18 nt, Shigella flexneri 2a str. 2457T
auccuucacuuuugccag

SEQ ID NO: 1948381 - RNA, 19 nt, Shigella flexneri 2a str. 2457T
auccuucagcaacuuguuc

SEQ ID NO: 1948382 - RNA, 20 nt, Shigella flexneri 2a str. 2457T
auccguccuacgaaucccgc

SEQ ID NO: 1948383 - RNA, 17 nt, Shigella flexneri 2a str. 2457T
auccgucacuucaggau

SEQ ID NO: 1948384 - RNA, 18 nt, Shigella flexneri 2a str. 2457T
auccgguuuacccgcuug

SEQ ID NO: 1948385 - RNA, 18 nt, Shigella flexneri 2a str. 2457T
auccguaaagcccauacc

SEQ ID NO: 1948386 - RNA, 23 nt, Shigella flexneri 2a str. 2457T
auccggugccaaagucaucaauc

SEQ ID NO: 1948387 - RNA, 20 nt, Shigella flexneri 2a str. 2457T
auccguugcagcauuuauga

SEQ ID NO: 1948388 - RNA, 16 nt, Shigella flexneri 2a str. 2457T
auccuaaacgcuggca

SEQ ID NO: 1948389 - RNA, 18 nt, Shigella flexneri 2a str. 2457T
auccuaaacgcuggcagg

SEQ ID NO: 1948390 - RNA, 18 nt, Shigella flexneri 2a str. 2457T
auccuacgaccgcaugcg

SEQ ID NO: 1948391 - RNA, 13 nt, Shigella flexneri 2a str. 2457T
auccggcaauaag

SEQ ID NO: 1948392 - RNA, 13 nt, Shigella flexneri 2a str. 2457T
auccggcaccaau

SEQ ID NO: 1948393 - RNA, 23 nt, Shigella flexneri 2a str. 2457T
auccggcaucguuugcugccuuc

SEQ ID NO: 1948394 - RNA, 14 nt, Shigella flexneri 2a str. 2457T
auccggcaugaaca

SEQ ID NO: 1948395 - RNA, 20 nt, Shigella flexneri 2a str. 2457T
auccggcauuugagcaggau

SEQ ID NO: 1948396 - RNA, 16 nt, Shigella flexneri 2a str. 2457T
auccggcaagaucacc

SEQ ID NO: 1948397 - RNA, 18 nt, Shigella flexneri 2a str. 2457T
auccggauucaaaccuaa

SEQ ID NO: 1948398 - RNA, 15 nt, Shigella flexneri 2a str. 2457T
aucccgccaacagga

SEQ ID NO: 1948399 - RNA, 15 nt, Shigella flexneri 2a str. 2457T
aucccgauuaaucag

SEQ ID NO: 1948400 - RNA, 17 nt, Shigella flexneri 2a str. 2457T
auccccauaucccggaa

SEQ ID NO: 1948401 - RNA, 21 nt, Shigella flexneri 2a str. 2457T
auccccuucucaaucccuuuc

SEQ ID NO: 1948402 - RNA, 18 nt, Shigella flexneri 2a str. 2457T
auccaucgccagcucaaa

SEQ ID NO: 1948403 - RNA, 16 nt, Shigella flexneri 2a str. 2457T
auccaucgccagcuca

SEQ ID NO: 1948404 - RNA, 18 nt, Shigella flexneri 2a str. 2457T
auccaugacaucuccagc

SEQ ID NO: 1948405 - RNA, 22 nt, Shigella flexneri 2a str. 2457T
aucccaacuguagugaucaaac

SEQ ID NO: 1948406 - RNA, 11 nt, Shigella flexneri 2a str. 2457T
aucccaaagcu

SEQ ID NO: 1948407 - RNA, 16 nt, Shigella flexneri 2a str. 2457T
aucccaaccuaaaaag

SEQ ID NO: 1948408 - RNA, 16 nt, Shigella flexneri 2a str. 2457T
aucccacauccuacca

SEQ ID NO: 1948409 - RNA, 13 nt, Shigella flexneri 2a str. 2457T
auccaguuucugc

SEQ ID NO: 1948410 - RNA, 20 nt, Shigella flexneri 2a str. 2457T
auccaguguaaaacagcacu

SEQ ID NO: 1948411 - RNA, 20 nt, Shigella flexneri 2a str. 2457T
auccagugcguaucaauagc

SEQ ID NO: 1948412 - RNA, 14 nt, Shigella flexneri 2a str. 2457T
auccaguacaugaa

SEQ ID NO: 1948413 - RNA, 20 nt, Shigella flexneri 2a str. 2457T
auccagcuuuuagaucacuc

SEQ ID NO: 1948414 - RNA, 17 nt, Shigella flexneri 2a str. 2457T
auccaguacgccuucac

SEQ ID NO: 1948415 - RNA, 16 nt, Shigella flexneri 2a str. 2457T
auccagugauuccagu

SEQ ID NO: 1948416 - RNA, 22 nt, Shigella flexneri 2a str. 2457T
auccauaguguguuccucugcu

SEQ ID NO: 1948417 - RNA, 14 nt, Shigella flexneri 2a str. 2457T
auccauaagguccu

SEQ ID NO: 1948418 - RNA, 18 nt, Shigella flexneri 2a str. 2457T
auccauaucgauuucuac

SEQ ID NO: 1948419 - RNA, 19 nt, Shigella flexneri 2a str. 2457T
auccauaucgauuucuaca

SEQ ID NO: 1948420 - RNA, 19 nt, Shigella flexneri 2a str. 2457T
auccaucaaagguuuuuca

SEQ ID NO: 1948421 - RNA, 21 nt, Shigella flexneri 2a str. 2457T
auccaucagacuuugcgccau

SEQ ID NO: 1948422 - RNA, 18 nt, Shigella flexneri 2a str. 2457T
auccaucacuucaucauc

SEQ ID NO: 1948423 - RNA, 17 nt, Shigella flexneri 2a str. 2457T
auccagcggaucaagaa

SEQ ID NO: 1948424 - RNA, 21 nt, Shigella flexneri 2a str. 2457T
auccagcggaucaagaaaguu

SEQ ID NO: 1948425 - RNA, 21 nt, Shigella flexneri 2a str. 2457T
auccagauuuauaaaagaaaa

SEQ ID NO: 1948426 - RNA, 14 nt, Shigella flexneri 2a str. 2457T
auccagcaacaaca

SEQ ID NO: 1948427 - RNA, 15 nt, Shigella flexneri 2a str. 2457T
auccagcaacaacag

SEQ ID NO: 1948428 - RNA, 16 nt, Shigella flexneri 2a str. 2457T
auccagcucuuuucca

SEQ ID NO: 1948429 - RNA, 23 nt, Shigella flexneri 2a str. 2457T
auccagcucuuuuccagccauca

SEQ ID NO: 1948430 - RNA, 18 nt, Shigella flexneri 2a str. 2457T
auccagcucuucuucacu

SEQ ID NO: 1948431 - RNA, 22 nt, Shigella flexneri 2a str. 2457T
auccacggugcuuugacgaugc

SEQ ID NO: 1948432 - RNA, 23 nt, Shigella flexneri 2a str. 2457T
auccagauggcuauaaucacuca

SEQ ID NO: 1948433 - RNA, 14 nt, Shigella flexneri 2a str. 2457T
auccagacugcuca

SEQ ID NO: 1948434 - RNA, 24 nt, Shigella flexneri 2a str. 2457T
auccagacuaauuuuucccucuuc

SEQ ID NO: 1948435 - RNA, 13 nt, Shigella flexneri 2a str. 2457T
auccacagcaaug

SEQ ID NO: 1948436 - RNA, 15 nt, Shigella flexneri 2a str. 2457T
auccacgauuaucac

SEQ ID NO: 1948437 - RNA, 19 nt, Shigella flexneri 2a str. 2457T
auccacgauacgcugcaca

SEQ ID NO: 1948438 - RNA, 22 nt, Shigella flexneri 2a str. 2457T
auccaccuucuguaacuggaag

SEQ ID NO: 1948439 - RNA, 22 nt, Shigella flexneri 2a str. 2457T
auccacaggguguauucaugcc

SEQ ID NO: 1948440 - RNA, 17 nt, Shigella flexneri 2a str. 2457T
auccaacugauuuucau

SEQ ID NO: 1948441 - RNA, 21 nt, Shigella flexneri 2a str. 2457T
auccaacugauguagucauac

SEQ ID NO: 1948442 - RNA, 15 nt, Shigella flexneri 2a str. 2457T
auccaacaauagugc

SEQ ID NO: 1948443 - RNA, 22 nt, Shigella flexneri 2a str. 2457T
aucauuggcgcuuguggaauua

SEQ ID NO: 1948444 - RNA, 17 nt, Shigella flexneri 2a str. 2457T
aucaugucgcccacgcc

SEQ ID NO: 1948445 - RNA, 20 nt, Shigella flexneri 2a str. 2457T
aaaacuggauuacaaauaaa

SEQ ID NO: 1948446 - RNA, 22 nt, Shigella flexneri 2a str. 2457T
aaaacuggauuacaaauaaaua

SEQ ID NO: 1948447 - RNA, 20 nt, Shigella flexneri 2a str. 2457T
aucaugccugcgacaagaau

SEQ ID NO: 1948448 - RNA, 14 nt, Shigella flexneri 2a str. 2457T
aucauggcucagau

SEQ ID NO: 1948449 - RNA, 19 nt, Shigella flexneri 2a str. 2457T
aucauggcgaugagaauca

SEQ ID NO: 1948450 - RNA, 17 nt, Shigella flexneri 2a str. 2457T
aucauggcauccuguuu

SEQ ID NO: 1948451 - RNA, 20 nt, Shigella flexneri 2a str. 2457T
aucaugguuuauuucccaga

SEQ ID NO: 1948452 - RNA, 19 nt, Shigella flexneri 2a str. 2457T
aaaacucgagccuuuacga

SEQ ID NO: 1948453 - RNA, 23 nt, Shigella flexneri 2a str. 2457T
aucaugagguuguggcauuagau

SEQ ID NO: 1948454 - RNA, 19 nt, Shigella flexneri 2a str. 2457T
aucaugccuacaaccguug

SEQ ID NO: 1948455 - RNA, 22 nt, Shigella flexneri 2a str. 2457T
aucaugccgaucgucugggcau

SEQ ID NO: 1948456 - RNA, 11 nt, Shigella flexneri 2a str. 2457T
aucaugccacc

SEQ ID NO: 1948457 - RNA, 15 nt, Shigella flexneri 2a str. 2457T
aucaugauucacagu

SEQ ID NO: 1948458 - RNA, 16 nt, Shigella flexneri 2a str. 2457T
aucaucugccacuucu

SEQ ID NO: 1948459 - RNA, 19 nt, Shigella flexneri 2a str. 2457T
aucaucguucauauauucc

SEQ ID NO: 1948460 - RNA, 22 nt, Shigella flexneri 2a str. 2457T
aucaucgucguuucuuuuuuau

SEQ ID NO: 1948461 - RNA, 17 nt, Shigella flexneri 2a str. 2457T
aucaucgguaccgccag

SEQ ID NO: 1948462 - RNA, 12 nt, Shigella flexneri 2a str. 2457T
aucauacugauu

SEQ ID NO: 1948463 - RNA, 22 nt, Shigella flexneri 2a str. 2457T
aucauaccuccgcaauaugcgc

SEQ ID NO: 1948464 - RNA, 23 nt, Shigella flexneri 2a str. 2457T
aaaacgugacagcauaccuucac

SEQ ID NO: 1948465 - RNA, 16 nt, Shigella flexneri 2a str. 2457T
aaaacgugcagcugcc

SEQ ID NO: 1948466 - RNA, 19 nt, Shigella flexneri 2a str. 2457T
aaaacguggccuccaaaaa

SEQ ID NO: 1948467 - RNA, 18 nt, Shigella flexneri 2a str. 2457T
aaaacguggccuccaaaa

SEQ ID NO: 1948468 - RNA, 20 nt, Shigella flexneri 2a str. 2457T
aucaucgcuuucaggucagc

SEQ ID NO: 1948469 - RNA, 15 nt, Shigella flexneri 2a str. 2457T
aucaucggcaaacau

SEQ ID NO: 1948470 - RNA, 19 nt, Shigella flexneri 2a str. 2457T
aucaucgcguacucaccgc

SEQ ID NO: 1948471 - RNA, 19 nt, Shigella flexneri 2a str. 2457T
aucaucgcggcacacagca

SEQ ID NO: 1948472 - RNA, 14 nt, Shigella flexneri 2a str. 2457T
auaaagucuuucuu

SEQ ID NO: 1948473 - RNA, 14 nt, Shigella flexneri 2a str. 2457T
auaaaggcggccca

SEQ ID NO: 1948474 - RNA, 17 nt, Shigella flexneri 2a str. 2457T
auaaauuccuaaaguug

SEQ ID NO: 1948475 - RNA, 19 nt, Shigella flexneri 2a str. 2457T
auaaauuccuaaaguuguu

SEQ ID NO: 1948476 - RNA, 13 nt, Shigella flexneri 2a str. 2457T
auaaauuccccgc

SEQ ID NO: 1948477 - RNA, 13 nt, Shigella flexneri 2a str. 2457T
auaaauggcgaac

SEQ ID NO: 1948478 - RNA, 16 nt, Shigella flexneri 2a str. 2457T
auaaagaguuuaucug

SEQ ID NO: 1948479 - RNA, 17 nt, Shigella flexneri 2a str. 2457T
auaaagcugaucacaua

SEQ ID NO: 1948480 - RNA, 19 nt, Shigella flexneri 2a str. 2457T
auaaagcugaucacauaac

SEQ ID NO: 1948481 - RNA, 21 nt, Shigella flexneri 2a str. 2457T
auaaacuuacugacaucaaac

SEQ ID NO: 1948482 - RNA, 16 nt, Shigella flexneri 2a str. 2457T
auaaagaaaaucugaa

SEQ ID NO: 1948483 - RNA, 13 nt, Shigella flexneri 2a str. 2457T
auaaagaaaaucu

SEQ ID NO: 1948484 - RNA, 21 nt, Shigella flexneri 2a str. 2457T
auaaacuuuucccuacugcug

SEQ ID NO: 1948485 - RNA, 19 nt, Shigella flexneri 2a str. 2457T
auaaacaguuucgccaggg

SEQ ID NO: 1948486 - RNA, 20 nt, Shigella flexneri 2a str. 2457T
auaaacaguuucgccagggu

SEQ ID NO: 1948487 - RNA, 19 nt, Shigella flexneri 2a str. 2457T
auaaacaucgggacaugau

SEQ ID NO: 1948488 - RNA, 15 nt, Shigella flexneri 2a str. 2457T
auaaacaucagcuau

SEQ ID NO: 1948489 - RNA, 17 nt, Shigella flexneri 2a str. 2457T
auaaacaccagcaauaa

SEQ ID NO: 1948490 - RNA, 18 nt, Shigella flexneri 2a str. 2457T
auaaacaccagcaauaau

SEQ ID NO: 1948491 - RNA, 14 nt, Shigella flexneri 2a str. 2457T
auaaacgccagguu

SEQ ID NO: 1948492 - RNA, 22 nt, Shigella flexneri 2a str. 2457T
auaaacgccagguucaucaauu

SEQ ID NO: 1948493 - RNA, 22 nt, Shigella flexneri 2a str. 2457T
auaaacgccggaugacacauca

SEQ ID NO: 1948494 - RNA, 21 nt, Shigella flexneri 2a str. 2457T
auaaacgccgucaucacaccg

SEQ ID NO: 1948495 - RNA, 16 nt, Shigella flexneri 2a str. 2457T
auaaacucaugggucu

SEQ ID NO: 1948496 - RNA, 20 nt, Shigella flexneri 2a str. 2457T
auaaacgguuucagcagcgg

SEQ ID NO: 1948497 - RNA, 18 nt, Shigella flexneri 2a str. 2457T
aguuguaaucauauuaaa

SEQ ID NO: 1948498 - RNA, 14 nt, Shigella flexneri 2a str. 2457T
aguuuucuuugcca

SEQ ID NO: 1948499 - RNA, 16 nt, Shigella flexneri 2a str. 2457T
aguugguuaaucuuuu

SEQ ID NO: 1948500 - RNA, 13 nt, Shigella flexneri 2a str. 2457T
auaaaaaaagaaa

SEQ ID NO: 1948501 - RNA, 12 nt, Shigella flexneri 2a str. 2457T
aguuuuuucuuc

SEQ ID NO: 1948502 - RNA, 12 nt, Shigella flexneri 2a str. 2457T
aguuuuucaaca

SEQ ID NO: 1948503 - RNA, 15 nt, Shigella flexneri 2a str. 2457T
aguuuuugcccauca

SEQ ID NO: 1948504 - RNA, 22 nt, Shigella flexneri 2a str. 2457T
aguuuuuucgcuugaucuuccu

SEQ ID NO: 1948505 - RNA, 11 nt, Shigella flexneri 2a str. 2457T
auaaaacacuc

SEQ ID NO: 1948506 - RNA, 14 nt, Shigella flexneri 2a str. 2457T
auaaaaauuaaauc

SEQ ID NO: 1948507 - RNA, 17 nt, Shigella flexneri 2a str. 2457T
auaaaagcccugggcac

SEQ ID NO: 1948508 - RNA, 19 nt, Shigella flexneri 2a str. 2457T
auaaaaggcaccuggaaau

SEQ ID NO: 1948509 - RNA, 16 nt, Shigella flexneri 2a str. 2457T
auaaaagaaaaaauga

SEQ ID NO: 1948510 - RNA, 15 nt, Shigella flexneri 2a str. 2457T
auaaucaauaaaaau

SEQ ID NO: 1948511 - RNA, 20 nt, Shigella flexneri 2a str. 2457T
auaaucaaucuuuacacaca

SEQ ID NO: 1948512 - RNA, 13 nt, Shigella flexneri 2a str. 2457T
auaaucaaugaca

SEQ ID NO: 1948513 - RNA, 14 nt, Shigella flexneri 2a str. 2457T
auaaucacaauggu

SEQ ID NO: 1948514 - RNA, 22 nt, Shigella flexneri 2a str. 2457T
auaauccaguacgcguacacuu

SEQ ID NO: 1948515 - RNA, 19 nt, Shigella flexneri 2a str. 2457T
auaaucccgcgcaacaaau

SEQ ID NO: 1948516 - RNA, 21 nt, Shigella flexneri 2a str. 2457T
auaaucccgcgcaacaaauaa

SEQ ID NO: 1948517 - RNA, 15 nt, Shigella flexneri 2a str. 2457T
auaauccaucacuuc

SEQ ID NO: 1948518 - RNA, 18 nt, Shigella flexneri 2a str. 2457T
auaauccaucacuucauc

SEQ ID NO: 1948519 - RNA, 15 nt, Shigella flexneri 2a str. 2457T
auaauaucuccagcu

SEQ ID NO: 1948520 - RNA, 11 nt, Shigella flexneri 2a str. 2457T
auaauaucuuu

SEQ ID NO: 1948521 - RNA, 14 nt, Shigella flexneri 2a str. 2457T
auaauaucuuuucu

SEQ ID NO: 1948522 - RNA, 19 nt, Shigella flexneri 2a str. 2457T
auaaucaacgcaccgacaa

SEQ ID NO: 1948523 - RNA, 14 nt, Shigella flexneri 2a str. 2457T
auaaguacgauaca

SEQ ID NO: 1948524 - RNA, 20 nt, Shigella flexneri 2a str. 2457T
auaauuaugccgaucaucau

SEQ ID NO: 1948525 - RNA, 15 nt, Shigella flexneri 2a str. 2457T
auaaugucuuuaaug

SEQ ID NO: 1948526 - RNA, 15 nt, Shigella flexneri 2a str. 2457T
auaauuaaaaauagu

SEQ ID NO: 1948527 - RNA, 17 nt, Shigella flexneri 2a str. 2457T
auaauccgcuguaauug

SEQ ID NO: 1948528 - RNA, 14 nt, Shigella flexneri 2a str. 2457T
auaaucgggaauac

SEQ ID NO: 1948529 - RNA, 20 nt, Shigella flexneri 2a str. 2457T
auaaucgcgaauagcuucaa

SEQ ID NO: 1948530 - RNA, 23 nt, Shigella flexneri 2a str. 2457T
auaaucuauugauuuaacagcaa

SEQ ID NO: 1948531 - RNA, 14 nt, Shigella flexneri 2a str. 2457T
auaaucguaaucag

SEQ ID NO: 1948532 - RNA, 21 nt, Shigella flexneri 2a str. 2457T
auaaucguaaucagcaucuca

SEQ ID NO: 1948533 - RNA, 19 nt, Shigella flexneri 2a str. 2457T
auaaugcccagcaacgaaa

SEQ ID NO: 1948534 - RNA, 11 nt, Shigella flexneri 2a str. 2457T
auaaugcccag

SEQ ID NO: 1948535 - RNA, 14 nt, Shigella flexneri 2a str. 2457T
auaaugccggauac

SEQ ID NO: 1948536 - RNA, 16 nt, Shigella flexneri 2a str. 2457T
auaaugcugacaaaac

SEQ ID NO: 1948537 - RNA, 13 nt, Shigella flexneri 2a str. 2457T
auaaugcugacaa

SEQ ID NO: 1948538 - RNA, 22 nt, Shigella flexneri 2a str. 2457T
auaaggucacguccccugggga

SEQ ID NO: 1948539 - RNA, 15 nt, Shigella flexneri 2a str. 2457T
auaaggccaugcugc

SEQ ID NO: 1948540 - RNA, 19 nt, Shigella flexneri 2a str. 2457T
auaaggccaugcugcuuug

SEQ ID NO: 1948541 - RNA, 13 nt, Shigella flexneri 2a str. 2457T
auaaggcuuuaac

SEQ ID NO: 1948542 - RNA, 13 nt, Shigella flexneri 2a str. 2457T
auaagcaaggcaa

SEQ ID NO: 1948543 - RNA, 14 nt, Shigella flexneri 2a str. 2457T
auaagcacuacucu

SEQ ID NO: 1948544 - RNA, 19 nt, Shigella flexneri 2a str. 2457T
auaagcccagaacaaauaa

SEQ ID NO: 1948545 - RNA, 13 nt, Shigella flexneri 2a str. 2457T
auaagcgcagcgc

SEQ ID NO: 1948546 - RNA, 15 nt, Shigella flexneri 2a str. 2457T
auaagcgcaagggua

SEQ ID NO: 1948547 - RNA, 13 nt, Shigella flexneri 2a str. 2457T
auaacuacugaug

SEQ ID NO: 1948548 - RNA, 17 nt, Shigella flexneri 2a str. 2457T
auaacgccuggcagugg

SEQ ID NO: 1948549 - RNA, 20 nt, Shigella flexneri 2a str. 2457T
auaacgcaucggcuaaacca

SEQ ID NO: 1948550 - RNA, 18 nt, Shigella flexneri 2a str. 2457T
auaacgccggagagaaaa

SEQ ID NO: 1948551 - RNA, 16 nt, Shigella flexneri 2a str. 2457T
auaacguuugacauag

SEQ ID NO: 1948552 - RNA, 21 nt, Shigella flexneri 2a str. 2457T
auaaauuugguucaauuuguu

SEQ ID NO: 1948553 - RNA, 21 nt, Shigella flexneri 2a str. 2457T
auaaauuucugccauuuugcu

SEQ ID NO: 1948554 - RNA, 23 nt, Shigella flexneri 2a str. 2457T
auaaauugcuguaaauucucaau

SEQ ID NO: 1948555 - RNA, 12 nt, Shigella flexneri 2a str. 2457T
auaacuuccuga

SEQ ID NO: 1948556 - RNA, 17 nt, Shigella flexneri 2a str. 2457T
auaacucccuauaaugc

SEQ ID NO: 1948557 - RNA, 18 nt, Shigella flexneri 2a str. 2457T
auaacucaccaucaagua

SEQ ID NO: 1948558 - RNA, 22 nt, Shigella flexneri 2a str. 2457T
auaacuauuguuuugaugaauc

SEQ ID NO: 1948559 - RNA, 17 nt, Shigella flexneri 2a str. 2457T
auaagacgcguuagcau

SEQ ID NO: 1948560 - RNA, 21 nt, Shigella flexneri 2a str. 2457T
auaagacguaucaggcaaaau

SEQ ID NO: 1948561 - RNA, 11 nt, Shigella flexneri 2a str. 2457T
auaagauacug

SEQ ID NO: 1948562 - RNA, 21 nt, Shigella flexneri 2a str. 2457T
aguucauccccucuuccauuu

SEQ ID NO: 1948563 - RNA, 16 nt, Shigella flexneri 2a str. 2457T
aguucaggcgcugcau

SEQ ID NO: 1948564 - RNA, 23 nt, Shigella flexneri 2a str. 2457T
aguucaguaugaucuugcccgga

SEQ ID NO: 1948565 - RNA, 12 nt, Shigella flexneri 2a str. 2457T
aguuccugcaac

SEQ ID NO: 1948566 - RNA, 22 nt, Shigella flexneri 2a str. 2457T
aguuccugcaacuucucuuucg

SEQ ID NO: 1948567 - RNA, 22 nt, Shigella flexneri 2a str. 2457T
aguucccuacucucgcaugggg

SEQ ID NO: 1948568 - RNA, 15 nt, Shigella flexneri 2a str. 2457T
aguucccuacucucg

SEQ ID NO: 1948569 - RNA, 19 nt, Shigella flexneri 2a str. 2457T
aguuccgggaucaccagac

SEQ ID NO: 1948570 - RNA, 16 nt, Shigella flexneri 2a str. 2457T
aguuaauccacagcaa

SEQ ID NO: 1948571 - RNA, 18 nt, Shigella flexneri 2a str. 2457T
aguuaauccacagcaaug

SEQ ID NO: 1948572 - RNA, 14 nt, Shigella flexneri 2a str. 2457T
aguuauaaauaaaa

SEQ ID NO: 1948573 - RNA, 15 nt, Shigella flexneri 2a str. 2457T
aguuagucgcuuuca

SEQ ID NO: 1948574 - RNA, 17 nt, Shigella flexneri 2a str. 2457T
aguuagucgcuuucauu

SEQ ID NO: 1948575 - RNA, 17 nt, Shigella flexneri 2a str. 2457T
aguucaacggugucgau

SEQ ID NO: 1948576 - RNA, 21 nt, Shigella flexneri 2a str. 2457T
aguucaacgccgcuaucagau

SEQ ID NO: 1948577 - RNA, 23 nt, Shigella flexneri 2a str. 2457T
aguucaauuggccugauaagaca

SEQ ID NO: 1948578 - RNA, 15 nt, Shigella flexneri 2a str. 2457T
aguuauugcgcugcu

SEQ ID NO: 1948579 - RNA, 21 nt, Shigella flexneri 2a str. 2457T
aguuauacagacucaaaccaa

SEQ ID NO: 1948580 - RNA, 16 nt, Shigella flexneri 2a str. 2457T
aguucgcgaaaguuac

SEQ ID NO: 1948581 - RNA, 19 nt, Shigella flexneri 2a str. 2457T
aguucgcgcgcugccagaa

SEQ ID NO: 1948582 - RNA, 15 nt, Shigella flexneri 2a str. 2457T
aguucgccaucaaau

SEQ ID NO: 1948583 - RNA, 13 nt, Shigella flexneri 2a str. 2457T
aguucgauuuccc

SEQ ID NO: 1948584 - RNA, 13 nt, Shigella flexneri 2a str. 2457T
aguucgagaaaaa

SEQ ID NO: 1948585 - RNA, 14 nt, Shigella flexneri 2a str. 2457T
aguucgagaaaaau

SEQ ID NO: 1948586 - RNA, 22 nt, Shigella flexneri 2a str. 2457T
aguucgaucucuucgccugccu

SEQ ID NO: 1948587 - RNA, 14 nt, Shigella flexneri 2a str. 2457T
aguugaaaaacaug

SEQ ID NO: 1948588 - RNA, 13 nt, Shigella flexneri 2a str. 2457T
aguugaaaaccuc

SEQ ID NO: 1948589 - RNA, 17 nt, Shigella flexneri 2a str. 2457T
aguugaguaucagagaa

SEQ ID NO: 1948590 - RNA, 18 nt, Shigella flexneri 2a str. 2457T
aguugcucugcagcagcc

SEQ ID NO: 1948591 - RNA, 14 nt, Shigella flexneri 2a str. 2457T
aguugcucucaaag

SEQ ID NO: 1948592 - RNA, 17 nt, Shigella flexneri 2a str. 2457T
aguugcugacucgaacg

SEQ ID NO: 1948593 - RNA, 15 nt, Shigella flexneri 2a str. 2457T
aguugcuucaucuca

SEQ ID NO: 1948594 - RNA, 12 nt, Shigella flexneri 2a str. 2457T
aguuaagcaaaa

SEQ ID NO: 1948595 - RNA, 22 nt, Shigella flexneri 2a str. 2457T
aguuaaccaaaaauuuccacaa

SEQ ID NO: 1948596 - RNA, 19 nt, Shigella flexneri 2a str. 2457T
aguuaaacuuucauaaaca

SEQ ID NO: 1948597 - RNA, 19 nt, Shigella flexneri 2a str. 2457T
aguuaaaggugguguugac

SEQ ID NO: 1948598 - RNA, 15 nt, Shigella flexneri 2a str. 2457T
aguguuuaaauuucu

SEQ ID NO: 1948599 - RNA, 17 nt, Shigella flexneri 2a str. 2457T
aguguuggauggcggcu

SEQ ID NO: 1948600 - RNA, 16 nt, Shigella flexneri 2a str. 2457T
aguguuucggucugau

SEQ ID NO: 1948601 - RNA, 15 nt, Shigella flexneri 2a str. 2457T
aguuaaaaaaacaag

SEQ ID NO: 1948602 - RNA, 16 nt, Shigella flexneri 2a str. 2457T
aguguuuugaggugua

SEQ ID NO: 1948603 - RNA, 13 nt, Shigella flexneri 2a str. 2457T
aguguggccagag

SEQ ID NO: 1948604 - RNA, 16 nt, Shigella flexneri 2a str. 2457T
aguguggccagagugc

SEQ ID NO: 1948605 - RNA, 22 nt, Shigella flexneri 2a str. 2457T
aguguggccagagugcguucac

SEQ ID NO: 1948606 - RNA, 21 nt, Shigella flexneri 2a str. 2457T
agugugggaucacaucuucaa

SEQ ID NO: 1948607 - RNA, 19 nt, Shigella flexneri 2a str. 2457T
agugugggaaaaauuguuu

SEQ ID NO: 1948608 - RNA, 12 nt, Shigella flexneri 2a str. 2457T
aguguaguucug

SEQ ID NO: 1948609 - RNA, 21 nt, Shigella flexneri 2a str. 2457T
agugucggugaggccuaugcg

SEQ ID NO: 1948610 - RNA, 20 nt, Shigella flexneri 2a str. 2457T
aguguaaaacagcacuccug

SEQ ID NO: 1948611 - RNA, 18 nt, Shigella flexneri 2a str. 2457T
agugguuucgccagcacc

SEQ ID NO: 1948612 - RNA, 15 nt, Shigella flexneri 2a str. 2457T
agugggauucaccaa

SEQ ID NO: 1948613 - RNA, 18 nt, Shigella flexneri 2a str. 2457T
aguggcuauuuaccaaua

SEQ ID NO: 1948614 - RNA, 17 nt, Shigella flexneri 2a str. 2457T
aguggcucaggcucuca

SEQ ID NO: 1948615 - RNA, 18 nt, Shigella flexneri 2a str. 2457T
aguggaaaaauaacaaau

SEQ ID NO: 1948616 - RNA, 19 nt, Shigella flexneri 2a str. 2457T
agugcuuucaucaaaaaau

SEQ ID NO: 1948617 - RNA, 24 nt, Shigella flexneri 2a str. 2457T
agugcuuucaucaaaaaaugaaac

SEQ ID NO: 1948618 - RNA, 19 nt, Shigella flexneri 2a str. 2457T
aguggaagacguugauuca

SEQ ID NO: 1948619 - RNA, 16 nt, Shigella flexneri 2a str. 2457T
agugcguaagcgcgga

SEQ ID NO: 1948620 - RNA, 13 nt, Shigella flexneri 2a str. 2457T
agugcguacccag

SEQ ID NO: 1948621 - RNA, 15 nt, Shigella flexneri 2a str. 2457T
agugcgugcgcugcu

SEQ ID NO: 1948622 - RNA, 17 nt, Shigella flexneri 2a str. 2457T
agugcguuauucaccuc

SEQ ID NO: 1948623 - RNA, 17 nt, Shigella flexneri 2a str. 2457T
agugagcgauucaaauu

SEQ ID NO: 1948624 - RNA, 21 nt, Shigella flexneri 2a str. 2457T
agugagcacugaauaugaguc

SEQ ID NO: 1948625 - RNA, 18 nt, Shigella flexneri 2a str. 2457T
agugaggcuauuccacgc

SEQ ID NO: 1948626 - RNA, 17 nt, Shigella flexneri 2a str. 2457T
agugauaacgauuuggc

SEQ ID NO: 1948627 - RNA, 23 nt, Shigella flexneri 2a str. 2457T
agugaguguggcguggcgcucca

SEQ ID NO: 1948628 - RNA, 17 nt, Shigella flexneri 2a str. 2457T
aguccuguugucuuucc

SEQ ID NO: 1948629 - RNA, 18 nt, Shigella flexneri 2a str. 2457T
aguccuguugucuuucca

SEQ ID NO: 1948630 - RNA, 16 nt, Shigella flexneri 2a str. 2457T
agucgcacacaacaga

SEQ ID NO: 1948631 - RNA, 12 nt, Shigella flexneri 2a str. 2457T
agucccaguuca

SEQ ID NO: 1948632 - RNA, 19 nt, Shigella flexneri 2a str. 2457T
agucccgcgauggcccggc

SEQ ID NO: 1948633 - RNA, 14 nt, Shigella flexneri 2a str. 2457T
agucgcccaguauc

SEQ ID NO: 1948634 - RNA, 19 nt, Shigella flexneri 2a str. 2457T
agucgcccaguaucugaca

SEQ ID NO: 1948635 - RNA, 19 nt, Shigella flexneri 2a str. 2457T
agucgucgccgauaauuuu

SEQ ID NO: 1948636 - RNA, 13 nt, Shigella flexneri 2a str. 2457T
agucucaagggag

SEQ ID NO: 1948637 - RNA, 17 nt, Shigella flexneri 2a str. 2457T
agucguuuuaguaacaa

SEQ ID NO: 1948638 - RNA, 13 nt, Shigella flexneri 2a str. 2457T
agugaaauuaaac

SEQ ID NO: 1948639 - RNA, 14 nt, Shigella flexneri 2a str. 2457T
agugaaauuaaacu

SEQ ID NO: 1948640 - RNA, 21 nt, Shigella flexneri 2a str. 2457T
agugacaguguuauucccaac

SEQ ID NO: 1948641 - RNA, 18 nt, Shigella flexneri 2a str. 2457T
agugacccgcagccagca

SEQ ID NO: 1948642 - RNA, 21 nt, Shigella flexneri 2a str. 2457T
agucuuaaaggggugaaaaaa

SEQ ID NO: 1948643 - RNA, 18 nt, Shigella flexneri 2a str. 2457T
agucuuaguugugcugaa

SEQ ID NO: 1948644 - RNA, 11 nt, Shigella flexneri 2a str. 2457T
agucuuccugc

SEQ ID NO: 1948645 - RNA, 12 nt, Shigella flexneri 2a str. 2457T
agucuucccagc

SEQ ID NO: 1948646 - RNA, 16 nt, Shigella flexneri 2a str. 2457T
agucuucgccgacuuc

SEQ ID NO: 1948647 - RNA, 20 nt, Shigella flexneri 2a str. 2457T
agugaaaaggucaauguuga

SEQ ID NO: 1948648 - RNA, 19 nt, Shigella flexneri 2a str. 2457T
agugaaaauucuccggcgu

SEQ ID NO: 1948649 - RNA, 21 nt, Shigella flexneri 2a str. 2457T
agugaaagaggcggagguuuu

SEQ ID NO: 1948650 - RNA, 13 nt, Shigella flexneri 2a str. 2457T
agucuugcuggau

SEQ ID NO: 1948651 - RNA, 17 nt, Shigella flexneri 2a str. 2457T
agucauaaccaguccau

SEQ ID NO: 1948652 - RNA, 19 nt, Shigella flexneri 2a str. 2457T
agucaucgcuuucggaaag

SEQ ID NO: 1948653 - RNA, 14 nt, Shigella flexneri 2a str. 2457T
agucaugcggugga

SEQ ID NO: 1948654 - RNA, 13 nt, Shigella flexneri 2a str. 2457T
agucaucaucagg

SEQ ID NO: 1948655 - RNA, 13 nt, Shigella flexneri 2a str. 2457T
agucauccggcgu

SEQ ID NO: 1948656 - RNA, 15 nt, Shigella flexneri 2a str. 2457T
agucaucgcauacaa

SEQ ID NO: 1948657 - RNA, 21 nt, Shigella flexneri 2a str. 2457T
agucaucgcauacaaaaacac

SEQ ID NO: 1948658 - RNA, 23 nt, Shigella flexneri 2a str. 2457T
agucaucgcauacaaaaacacau

SEQ ID NO: 1948659 - RNA, 12 nt, Shigella flexneri 2a str. 2457T
agucaucaaucg

SEQ ID NO: 1948660 - RNA, 16 nt, Shigella flexneri 2a str. 2457T
agucaucacuuucaga

SEQ ID NO: 1948661 - RNA, 17 nt, Shigella flexneri 2a str. 2457T
agucaucacuuucagac

SEQ ID NO: 1948662 - RNA, 14 nt, Shigella flexneri 2a str. 2457T
agucauauucugaa

SEQ ID NO: 1948663 - RNA, 15 nt, Shigella flexneri 2a str. 2457T
agucauagguucuuu

SEQ ID NO: 1948664 - RNA, 20 nt, Shigella flexneri 2a str. 2457T
agucauagguucuuuuaaau

SEQ ID NO: 1948665 - RNA, 22 nt, Shigella flexneri 2a str. 2457T
agucauugauucgaucaaacaa

SEQ ID NO: 1948666 - RNA, 13 nt, Shigella flexneri 2a str. 2457T
agucauuccuuca

SEQ ID NO: 1948667 - RNA, 14 nt, Shigella flexneri 2a str. 2457T
agucauuccuucaa

SEQ ID NO: 1948668 - RNA, 16 nt, Shigella flexneri 2a str. 2457T
agucauuaugcuggaa

SEQ ID NO: 1948669 - RNA, 22 nt, Shigella flexneri 2a str. 2457T
aguccagccccgcgcggcgcag

SEQ ID NO: 1948670 - RNA, 21 nt, Shigella flexneri 2a str. 2457T
aguccagcugccguccccauc

SEQ ID NO: 1948671 - RNA, 21 nt, Shigella flexneri 2a str. 2457T
aguccacguucaaaacgguga

SEQ ID NO: 1948672 - RNA, 15 nt, Shigella flexneri 2a str. 2457T
agucccaaacagcag

SEQ ID NO: 1948673 - RNA, 18 nt, Shigella flexneri 2a str. 2457T
aguccauacccagcauca

SEQ ID NO: 1948674 - RNA, 15 nt, Shigella flexneri 2a str. 2457T
aguagaaacgaggua

SEQ ID NO: 1948675 - RNA, 15 nt, Shigella flexneri 2a str. 2457T
aguagaagaggaacc

SEQ ID NO: 1948676 - RNA, 22 nt, Shigella flexneri 2a str. 2457T
aguagaauaaucuguuuuucau

SEQ ID NO: 1948677 - RNA, 14 nt, Shigella flexneri 2a str. 2457T
aguacuucacaauc

SEQ ID NO: 1948678 - RNA, 13 nt, Shigella flexneri 2a str. 2457T
aguagagauaaac

SEQ ID NO: 1948679 - RNA, 23 nt, Shigella flexneri 2a str. 2457T
agucaaugaaauuacuuuccauc

SEQ ID NO: 1948680 - RNA, 15 nt, Shigella flexneri 2a str. 2457T
agucaaucauccaua

SEQ ID NO: 1948681 - RNA, 14 nt, Shigella flexneri 2a str. 2457T
agucaauuucugca

SEQ ID NO: 1948682 - RNA, 14 nt, Shigella flexneri 2a str. 2457T
agucacaaaucucc

SEQ ID NO: 1948683 - RNA, 20 nt, Shigella flexneri 2a str. 2457T
agucacauuuuuagcagaca

SEQ ID NO: 1948684 - RNA, 15 nt, Shigella flexneri 2a str. 2457T
agucacaaacaucau

SEQ ID NO: 1948685 - RNA, 18 nt, Shigella flexneri 2a str. 2457T
agucacaaacaucaugcc

SEQ ID NO: 1948686 - RNA, 19 nt, Shigella flexneri 2a str. 2457T
agucaauuucugcaaaaua

SEQ ID NO: 1948687 - RNA, 20 nt, Shigella flexneri 2a str. 2457T
agucacggaaucccguaauc

SEQ ID NO: 1948688 - RNA, 15 nt, Shigella flexneri 2a str. 2457T
agucacuuuuuuccg

SEQ ID NO: 1948689 - RNA, 14 nt, Shigella flexneri 2a str. 2457T
agucacuuuuuucc

SEQ ID NO: 1948690 - RNA, 14 nt, Shigella flexneri 2a str. 2457T
agucagaaacugua

SEQ ID NO: 1948691 - RNA, 23 nt, Shigella flexneri 2a str. 2457T
agucagaaacuguaauugagaac

SEQ ID NO: 1948692 - RNA, 22 nt, Shigella flexneri 2a str. 2457T
agucagacccugcucuuucagc

SEQ ID NO: 1948693 - RNA, 22 nt, Shigella flexneri 2a str. 2457T
agucagaugccucguuggucag

SEQ ID NO: 1948694 - RNA, 20 nt, Shigella flexneri 2a str. 2457T
aggucuuugacgucgaaacu

SEQ ID NO: 1948695 - RNA, 15 nt, Shigella flexneri 2a str. 2457T
aggugaccagcagac

SEQ ID NO: 1948696 - RNA, 14 nt, Shigella flexneri 2a str. 2457T
aggugacaucgugc

SEQ ID NO: 1948697 - RNA, 21 nt, Shigella flexneri 2a str. 2457T
aggugacacuucauuaaccac

SEQ ID NO: 1948698 - RNA, 15 nt, Shigella flexneri 2a str. 2457T
aggucgaucagcuga

SEQ ID NO: 1948699 - RNA, 19 nt, Shigella flexneri 2a str. 2457T
agguccuucaggcccugcu

SEQ ID NO: 1948700 - RNA, 20 nt, Shigella flexneri 2a str. 2457T
agguccuccuguaccuucac

SEQ ID NO: 1948701 - RNA, 22 nt, Shigella flexneri 2a str. 2457T
agguccuccuguaccuucacgc

SEQ ID NO: 1948702 - RNA, 13 nt, Shigella flexneri 2a str. 2457T
agguauuuuguca

SEQ ID NO: 1948703 - RNA, 21 nt, Shigella flexneri 2a str. 2457T
aggucacagaagagagauaau

SEQ ID NO: 1948704 - RNA, 16 nt, Shigella flexneri 2a str. 2457T
aggucaaccuagccuu

SEQ ID NO: 1948705 - RNA, 19 nt, Shigella flexneri 2a str. 2457T
aggucagcgccuggcugca

SEQ ID NO: 1948706 - RNA, 17 nt, Shigella flexneri 2a str. 2457T
aggucacuuuuuucgcu

SEQ ID NO: 1948707 - RNA, 13 nt, Shigella flexneri 2a str. 2457T
aggucagagagcc

SEQ ID NO: 1948708 - RNA, 16 nt, Shigella flexneri 2a str. 2457T
aggucagagagccagc

SEQ ID NO: 1948709 - RNA, 21 nt, Shigella flexneri 2a str. 2457T
agguuacgcaccagauaagca

SEQ ID NO: 1948710 - RNA, 17 nt, Shigella flexneri 2a str. 2457T
agguuagaauaaacaaa

SEQ ID NO: 1948711 - RNA, 13 nt, Shigella flexneri 2a str. 2457T
agguuaauauuuu

SEQ ID NO: 1948712 - RNA, 22 nt, Shigella flexneri 2a str. 2457T
agguuaaugcuguuccagacca

SEQ ID NO: 1948713 - RNA, 17 nt, Shigella flexneri 2a str. 2457T
agguuaauauuuucgcc

SEQ ID NO: 1948714 - RNA, 15 nt, Shigella flexneri 2a str. 2457T
agguuauaaauaaaa

SEQ ID NO: 1948715 - RNA, 21 nt, Shigella flexneri 2a str. 2457T
agguuaacucccccuuucuga

SEQ ID NO: 1948716 - RNA, 13 nt, Shigella flexneri 2a str. 2457T
agguguugcguuu

SEQ ID NO: 1948717 - RNA, 15 nt, Shigella flexneri 2a str. 2457T
agguguuugacugua

SEQ ID NO: 1948718 - RNA, 23 nt, Shigella flexneri 2a str. 2457T
agguguguauccguuuuacuggg

SEQ ID NO: 1948719 - RNA, 21 nt, Shigella flexneri 2a str. 2457T
aggugucacaugcagcgccug

SEQ ID NO: 1948720 - RNA, 14 nt, Shigella flexneri 2a str. 2457T
aggugcauugcugg

SEQ ID NO: 1948721 - RNA, 20 nt, Shigella flexneri 2a str. 2457T
aggugagggcuuaaaugaca

SEQ ID NO: 1948722 - RNA, 17 nt, Shigella flexneri 2a str. 2457T
aggugguagcugccccc

SEQ ID NO: 1948723 - RNA, 19 nt, Shigella flexneri 2a str. 2457T
aguaccgccaccaccagac

SEQ ID NO: 1948724 - RNA, 20 nt, Shigella flexneri 2a str. 2457T
aguaccuccuucacaguggc

SEQ ID NO: 1948725 - RNA, 18 nt, Shigella flexneri 2a str. 2457T
aguaccucuucgcuggca

SEQ ID NO: 1948726 - RNA, 15 nt, Shigella flexneri 2a str. 2457T
aguaccugcaaaccg

SEQ ID NO: 1948727 - RNA, 15 nt, Shigella flexneri 2a str. 2457T
aguacgaaauaacug

SEQ ID NO: 1948728 - RNA, 19 nt, Shigella flexneri 2a str. 2457T
aguacgccaaucugcaaaa

SEQ ID NO: 1948729 - RNA, 18 nt, Shigella flexneri 2a str. 2457T
aguacgcguacacuuucc

SEQ ID NO: 1948730 - RNA, 15 nt, Shigella flexneri 2a str. 2457T
aguacgcuuucccuu

SEQ ID NO: 1948731 - RNA, 15 nt, Shigella flexneri 2a str. 2457T
aguacggcagcaauc

SEQ ID NO: 1948732 - RNA, 16 nt, Shigella flexneri 2a str. 2457T
aguacaucuuccacuu

SEQ ID NO: 1948733 - RNA, 20 nt, Shigella flexneri 2a str. 2457T
aguacagcgcauaaaagcua

SEQ ID NO: 1948734 - RNA, 12 nt, Shigella flexneri 2a str. 2457T
aguaaugccagu

SEQ ID NO: 1948735 - RNA, 16 nt, Shigella flexneri 2a str. 2457T
aguaaugcgcccaugc

SEQ ID NO: 1948736 - RNA, 14 nt, Shigella flexneri 2a str. 2457T
aguaaauauugucg

SEQ ID NO: 1948737 - RNA, 16 nt, Shigella flexneri 2a str. 2457T
aguaaauauugucgau

SEQ ID NO: 1948738 - RNA, 13 nt, Shigella flexneri 2a str. 2457T
aguaaauaaccau

SEQ ID NO: 1948739 - RNA, 22 nt, Shigella flexneri 2a str. 2457T
aguaaccgcuuuuucaauuucc

SEQ ID NO: 1948740 - RNA, 22 nt, Shigella flexneri 2a str. 2457T
aguaaccuuuaucgcgcagcag

SEQ ID NO: 1948741 - RNA, 14 nt, Shigella flexneri 2a str. 2457T
aguaaccuuucaga

SEQ ID NO: 1948742 - RNA, 15 nt, Shigella flexneri 2a str. 2457T
aguaaccuuucagau

SEQ ID NO: 1948743 - RNA, 15 nt, Shigella flexneri 2a str. 2457T
aguaaccuuugaaca

SEQ ID NO: 1948744 - RNA, 10 nt, Shigella flexneri 2a str. 2457T
aguaaauggu

SEQ ID NO: 1948745 - RNA, 14 nt, Shigella flexneri 2a str. 2457T
aguaagauuauaua

SEQ ID NO: 1948746 - RNA, 23 nt, Shigella flexneri 2a str. 2457T
aguaagcggcguugcucuucucc

SEQ ID NO: 1948747 - RNA, 14 nt, Shigella flexneri 2a str. 2457T
aguaacuucuccac

SEQ ID NO: 1948748 - RNA, 17 nt, Shigella flexneri 2a str. 2457T
aguaagaauugauaaaa

SEQ ID NO: 1948749 - RNA, 23 nt, Shigella flexneri 2a str. 2457T
aguaaaaaagaaggaaaauacag

SEQ ID NO: 1948750 - RNA, 12 nt, Shigella flexneri 2a str. 2457T
aguaaaaaagaa

SEQ ID NO: 1948751 - RNA, 12 nt, Shigella flexneri 2a str. 2457T
agguuuuuuccu

SEQ ID NO: 1948752 - RNA, 12 nt, Shigella flexneri 2a str. 2457T
aguaaaaaaaca

SEQ ID NO: 1948753 - RNA, 16 nt, Shigella flexneri 2a str. 2457T
agguuuuucagcugcc

SEQ ID NO: 1948754 - RNA, 18 nt, Shigella flexneri 2a str. 2457T
agguucggaguggcagcc

SEQ ID NO: 1948755 - RNA, 11 nt, Shigella flexneri 2a str. 2457T
agggcauggcg

SEQ ID NO: 1948756 - RNA, 17 nt, Shigella flexneri 2a str. 2457T
agggcaugacacagaau

SEQ ID NO: 1948757 - RNA, 18 nt, Shigella flexneri 2a str. 2457T
agggcaugacacagaauc

SEQ ID NO: 1948758 - RNA, 22 nt, Shigella flexneri 2a str. 2457T
agggcacuuuuauccugucagu

SEQ ID NO: 1948759 - RNA, 17 nt, Shigella flexneri 2a str. 2457T
agggcgaauucuugccu

SEQ ID NO: 1948760 - RNA, 16 nt, Shigella flexneri 2a str. 2457T
aggcuucccaauugca

SEQ ID NO: 1948761 - RNA, 15 nt, Shigella flexneri 2a str. 2457T
aggcuucgguaauga

SEQ ID NO: 1948762 - RNA, 22 nt, Shigella flexneri 2a str. 2457T
agggaucauccacccgcagcaa

SEQ ID NO: 1948763 - RNA, 13 nt, Shigella flexneri 2a str. 2457T
agggauauuucac

SEQ ID NO: 1948764 - RNA, 18 nt, Shigella flexneri 2a str. 2457T
aggcuucaaucaauaaca

SEQ ID NO: 1948765 - RNA, 20 nt, Shigella flexneri 2a str. 2457T
aggguggcucaaucgccacc

SEQ ID NO: 1948766 - RNA, 21 nt, Shigella flexneri 2a str. 2457T
agggucuuccagcaaauccau

SEQ ID NO: 1948767 - RNA, 23 nt, Shigella flexneri 2a str. 2457T
agguaaaaccugacaacaaaacg

SEQ ID NO: 1948768 - RNA, 18 nt, Shigella flexneri 2a str. 2457T
aggggucguuuuuuauuc

SEQ ID NO: 1948769 - RNA, 15 nt, Shigella flexneri 2a str. 2457T
agggggauuuucacu

SEQ ID NO: 1948770 - RNA, 18 nt, Shigella flexneri 2a str. 2457T
agggcuuuuuuauuucau

SEQ ID NO: 1948771 - RNA, 20 nt, Shigella flexneri 2a str. 2457T
agggcuuuuucaauuccauu

SEQ ID NO: 1948772 - RNA, 16 nt, Shigella flexneri 2a str. 2457T
agggcuuucacugccc

SEQ ID NO: 1948773 - RNA, 14 nt, Shigella flexneri 2a str. 2457T
aggcguuaaaacag

SEQ ID NO: 1948774 - RNA, 19 nt, Shigella flexneri 2a str. 2457T
aggcguugauuggcgcagg

SEQ ID NO: 1948775 - RNA, 18 nt, Shigella flexneri 2a str. 2457T
aggcguucauaucuacac

SEQ ID NO: 1948776 - RNA, 23 nt, Shigella flexneri 2a str. 2457T
aggcguucacgccgcauccggca

SEQ ID NO: 1948777 - RNA, 15 nt, Shigella flexneri 2a str. 2457T
aggcguucacgccgc

SEQ ID NO: 1948778 - RNA, 23 nt, Shigella flexneri 2a str. 2457T
aggcguucacgccgcauccgaca

SEQ ID NO: 1948779 - RNA, 19 nt, Shigella flexneri 2a str. 2457T
aggcguuuacccuucgcac

SEQ ID NO: 1948780 - RNA, 13 nt, Shigella flexneri 2a str. 2457T
aggcguuucaacu

SEQ ID NO: 1948781 - RNA, 23 nt, Shigella flexneri 2a str. 2457T
aggcguuuacgccgcauccggca

SEQ ID NO: 1948782 - RNA, 19 nt, Shigella flexneri 2a str. 2457T
aggcguuugaaaaagccaa

SEQ ID NO: 1948783 - RNA, 21 nt, Shigella flexneri 2a str. 2457T
aggcguuuguaacccaccaug

SEQ ID NO: 1948784 - RNA, 22 nt, Shigella flexneri 2a str. 2457T
aggcuaauaccgucgaugccaa

SEQ ID NO: 1948785 - RNA, 22 nt, Shigella flexneri 2a str. 2457T
aggcggguacguuucgccugca

SEQ ID NO: 1948786 - RNA, 21 nt, Shigella flexneri 2a str. 2457T
aggcggcucaccugcacacca

SEQ ID NO: 1948787 - RNA, 15 nt, Shigella flexneri 2a str. 2457T
aggcggcgcaucggu

SEQ ID NO: 1948788 - RNA, 15 nt, Shigella flexneri 2a str. 2457T
aggcggcucaccugc

SEQ ID NO: 1948789 - RNA, 19 nt, Shigella flexneri 2a str. 2457T
aggcugaaaaucuucucuc

SEQ ID NO: 1948790 - RNA, 23 nt, Shigella flexneri 2a str. 2457T
aggcuauuccacgcaucaagcau

SEQ ID NO: 1948791 - RNA, 24 nt, Shigella flexneri 2a str. 2457T
aggcuauuuugcguuuagcaucag

SEQ ID NO: 1948792 - RNA, 18 nt, Shigella flexneri 2a str. 2457T
aggcuagguugaccugga

SEQ ID NO: 1948793 - RNA, 15 nt, Shigella flexneri 2a str. 2457T
aggcugguuucucuu

SEQ ID NO: 1948794 - RNA, 20 nt, Shigella flexneri 2a str. 2457T
aggcuggcuuuaucacugag

SEQ ID NO: 1948795 - RNA, 23 nt, Shigella flexneri 2a str. 2457T
aggcuggcguguucugaauaaac

SEQ ID NO: 1948796 - RNA, 16 nt, Shigella flexneri 2a str. 2457T
aggauguuccggcaaa

SEQ ID NO: 1948797 - RNA, 12 nt, Shigella flexneri 2a str. 2457T
aggcaaaccagu

SEQ ID NO: 1948798 - RNA, 22 nt, Shigella flexneri 2a str. 2457T
aggcaaacuucucgccaucaaa

SEQ ID NO: 1948799 - RNA, 14 nt, Shigella flexneri 2a str. 2457T
aggcacaacugcga

SEQ ID NO: 1948800 - RNA, 22 nt, Shigella flexneri 2a str. 2457T
aggcacaaguuuuuaggcauga

SEQ ID NO: 1948801 - RNA, 22 nt, Shigella flexneri 2a str. 2457T
aggcagcaucucgcgcucuucu

SEQ ID NO: 1948802 - RNA, 19 nt, Shigella flexneri 2a str. 2457T
aggcagcaaucacugccag

SEQ ID NO: 1948803 - RNA, 15 nt, Shigella flexneri 2a str. 2457T
aggcagauacaacca

SEQ ID NO: 1948804 - RNA, 16 nt, Shigella flexneri 2a str. 2457T
aggcagcuuagaaauu

SEQ ID NO: 1948805 - RNA, 12 nt, Shigella flexneri 2a str. 2457T
aggcagcuuaga

SEQ ID NO: 1948806 - RNA, 16 nt, Shigella flexneri 2a str. 2457T
aggcagcuuagaaauc

SEQ ID NO: 1948807 - RNA, 17 nt, Shigella flexneri 2a str. 2457T
aggcaucccgcaccagc

SEQ ID NO: 1948808 - RNA, 14 nt, Shigella flexneri 2a str. 2457T
aggcaucagcaauu

SEQ ID NO: 1948809 - RNA, 14 nt, Shigella flexneri 2a str. 2457T
aggcaucagacaaa

SEQ ID NO: 1948810 - RNA, 16 nt, Shigella flexneri 2a str. 2457T
aggcaucagacaaaug

SEQ ID NO: 1948811 - RNA, 21 nt, Shigella flexneri 2a str. 2457T
aggcaucagaucccaauucau

SEQ ID NO: 1948812 - RNA, 20 nt, Shigella flexneri 2a str. 2457T
aggcaucacuuuaccgguuu

SEQ ID NO: 1948813 - RNA, 19 nt, Shigella flexneri 2a str. 2457T
aggcaguuuauccagccac

SEQ ID NO: 1948814 - RNA, 14 nt, Shigella flexneri 2a str. 2457T
aggcauagaaaaag

SEQ ID NO: 1948815 - RNA, 15 nt, Shigella flexneri 2a str. 2457T
aggccagcagcagag

SEQ ID NO: 1948816 - RNA, 12 nt, Shigella flexneri 2a str. 2457T
aggccagccaga

SEQ ID NO: 1948817 - RNA, 19 nt, Shigella flexneri 2a str. 2457T
aggccagcggcuucgacga

SEQ ID NO: 1948818 - RNA, 13 nt, Shigella flexneri 2a str. 2457T
aggccaucagcag

SEQ ID NO: 1948819 - RNA, 16 nt, Shigella flexneri 2a str. 2457T
aggccaucacauccug

SEQ ID NO: 1948820 - RNA, 14 nt, Shigella flexneri 2a str. 2457T
aggccgacagcagg

SEQ ID NO: 1948821 - RNA, 22 nt, Shigella flexneri 2a str. 2457T
aggccgccgucaucacgcaggc

SEQ ID NO: 1948822 - RNA, 15 nt, Shigella flexneri 2a str. 2457T
aggccggagccagcc

SEQ ID NO: 1948823 - RNA, 21 nt, Shigella flexneri 2a str. 2457T
aggauaugcaucaugaaaacc

SEQ ID NO: 1948824 - RNA, 16 nt, Shigella flexneri 2a str. 2457T
aggauaaacuccugca

SEQ ID NO: 1948825 - RNA, 20 nt, Shigella flexneri 2a str. 2457T
aggacucgaggagcuggagg

SEQ ID NO: 1948826 - RNA, 18 nt, Shigella flexneri 2a str. 2457T
aggaggcguaauuuccac

SEQ ID NO: 1948827 - RNA, 22 nt, Shigella flexneri 2a str. 2457T
aggaggucgcacugcucuuuuu

SEQ ID NO: 1948828 - RNA, 13 nt, Shigella flexneri 2a str. 2457T
aggaaaaaaauua

SEQ ID NO: 1948829 - RNA, 23 nt, Shigella flexneri 2a str. 2457T
aggaaaacaauguucaucugcau

SEQ ID NO: 1948830 - RNA, 15 nt, Shigella flexneri 2a str. 2457T
aggaaaacuacaggc

SEQ ID NO: 1948831 - RNA, 15 nt, Shigella flexneri 2a str. 2457T
aggaaaauacagcaa

SEQ ID NO: 1948832 - RNA, 18 nt, Shigella flexneri 2a str. 2457T
aggaaaauacagcaaugg

SEQ ID NO: 1948833 - RNA, 19 nt, Shigella flexneri 2a str. 2457T
aggaaacccaacgcaaaga

SEQ ID NO: 1948834 - RNA, 24 nt, Shigella flexneri 2a str. 2457T
aggaaguuucagcgccagaucguu

SEQ ID NO: 1948835 - RNA, 14 nt, Shigella flexneri 2a str. 2457T
aggaaacuccagcc

SEQ ID NO: 1948836 - RNA, 14 nt, Shigella flexneri 2a str. 2457T
aggaaucagauacu

SEQ ID NO: 1948837 - RNA, 16 nt, Shigella flexneri 2a str. 2457T
aggaaucgcuguugag

SEQ ID NO: 1948838 - RNA, 19 nt, Shigella flexneri 2a str. 2457T
aggaaucugauuacuuccu

SEQ ID NO: 1948839 - RNA, 12 nt, Shigella flexneri 2a str. 2457T
aggaauuaaaac

SEQ ID NO: 1948840 - RNA, 19 nt, Shigella flexneri 2a str. 2457T
aggaccuuauggaucugga

SEQ ID NO: 1948841 - RNA, 18 nt, Shigella flexneri 2a str. 2457T
agcuuauuaacagucagu

SEQ ID NO: 1948842 - RNA, 19 nt, Shigella flexneri 2a str. 2457T
agcuucuuauccagcugcg

SEQ ID NO: 1948843 - RNA, 19 nt, Shigella flexneri 2a str. 2457T
agcuuauuuguugagcugg

SEQ ID NO: 1948844 - RNA, 19 nt, Shigella flexneri 2a str. 2457T
agcuucacgcgccagcuua

SEQ ID NO: 1948845 - RNA, 15 nt, Shigella flexneri 2a str. 2457T
agcuucaccuuccag

SEQ ID NO: 1948846 - RNA, 22 nt, Shigella flexneri 2a str. 2457T
agcuucaaaucauuacaguuuc

SEQ ID NO: 1948847 - RNA, 12 nt, Shigella flexneri 2a str. 2457T
agcuucacccgc

SEQ ID NO: 1948848 - RNA, 21 nt, Shigella flexneri 2a str. 2457T
agcuucaauugccaccaugca

SEQ ID NO: 1948849 - RNA, 17 nt, Shigella flexneri 2a str. 2457T
agcuugaaggguuuuau

SEQ ID NO: 1948850 - RNA, 18 nt, Shigella flexneri 2a str. 2457T
agcuugcgauccugcaga

SEQ ID NO: 1948851 - RNA, 21 nt, Shigella flexneri 2a str. 2457T
agcuucuucaaaaaagucaga

SEQ ID NO: 1948852 - RNA, 14 nt, Shigella flexneri 2a str. 2457T
agcuuucauuucaa

SEQ ID NO: 1948853 - RNA, 16 nt, Shigella flexneri 2a str. 2457T
agcuuucgaccagcca

SEQ ID NO: 1948854 - RNA, 19 nt, Shigella flexneri 2a str. 2457T
agcuuuuuaaucgccaucu

SEQ ID NO: 1948855 - RNA, 13 nt, Shigella flexneri 2a str. 2457T
agcuuggcagagc

SEQ ID NO: 1948856 - RNA, 20 nt, Shigella flexneri 2a str. 2457T
agcuuguuugaagucaacgc

SEQ ID NO: 1948857 - RNA, 14 nt, Shigella flexneri 2a str. 2457T
agcuuguuugaagu

SEQ ID NO: 1948858 - RNA, 21 nt, Shigella flexneri 2a str. 2457T
agcugcgcaucaugccaccca

SEQ ID NO: 1948859 - RNA, 15 nt, Shigella flexneri 2a str. 2457T
agcugauucagauaa

SEQ ID NO: 1948860 - RNA, 18 nt, Shigella flexneri 2a str. 2457T
agcugcacgaugacugaa

SEQ ID NO: 1948861 - RNA, 21 nt, Shigella flexneri 2a str. 2457T
agcugcacgaugacugaacag

SEQ ID NO: 1948862 - RNA, 14 nt, Shigella flexneri 2a str. 2457T
agcugauugcggag

SEQ ID NO: 1948863 - RNA, 19 nt, Shigella flexneri 2a str. 2457T
agcugauugcggagaaggu

SEQ ID NO: 1948864 - RNA, 15 nt, Shigella flexneri 2a str. 2457T
agcugcaagaugaau

SEQ ID NO: 1948865 - RNA, 23 nt, Shigella flexneri 2a str. 2457T
agcugcacacagggcgcuagcca

SEQ ID NO: 1948866 - RNA, 17 nt, Shigella flexneri 2a str. 2457T
agcuggcagaaguuguc

SEQ ID NO: 1948867 - RNA, 15 nt, Shigella flexneri 2a str. 2457T
agcuguucaggagaa

SEQ ID NO: 1948868 - RNA, 20 nt, Shigella flexneri 2a str. 2457T
agcugggcgauuuucuacuu

SEQ ID NO: 1948869 - RNA, 15 nt, Shigella flexneri 2a str. 2457T
agcuggguacgaaaa

SEQ ID NO: 1948870 - RNA, 16 nt, Shigella flexneri 2a str. 2457T
agcugagcacaaaaca

SEQ ID NO: 1948871 - RNA, 13 nt, Shigella flexneri 2a str. 2457T
agcugacguagca

SEQ ID NO: 1948872 - RNA, 13 nt, Shigella flexneri 2a str. 2457T
agcugagaaaaag

SEQ ID NO: 1948873 - RNA, 23 nt, Shigella flexneri 2a str. 2457T
agcugauacgggaggucaucagc

SEQ ID NO: 1948874 - RNA, 21 nt, Shigella flexneri 2a str. 2457T
agcugaauuucaucaccagcu

SEQ ID NO: 1948875 - RNA, 13 nt, Shigella flexneri 2a str. 2457T
agcugaauuucau

SEQ ID NO: 1948876 - RNA, 14 nt, Shigella flexneri 2a str. 2457T
agcucuucuucacu

SEQ ID NO: 1948877 - RNA, 20 nt, Shigella flexneri 2a str. 2457T
agcucguuguuuaugccgga

SEQ ID NO: 1948878 - RNA, 19 nt, Shigella flexneri 2a str. 2457T
agcucgguggcgauguaau

SEQ ID NO: 1948879 - RNA, 18 nt, Shigella flexneri 2a str. 2457T
agcucucagacgauuacu

SEQ ID NO: 1948880 - RNA, 14 nt, Shigella flexneri 2a str. 2457T
agcucucagccagc

SEQ ID NO: 1948881 - RNA, 19 nt, Shigella flexneri 2a str. 2457T
agcucucagccagcuggca

SEQ ID NO: 1948882 - RNA, 18 nt, Shigella flexneri 2a str. 2457T
agcucugguguggagugc

SEQ ID NO: 1948883 - RNA, 14 nt, Shigella flexneri 2a str. 2457T
agcucggauaaggc

SEQ ID NO: 1948884 - RNA, 15 nt, Shigella flexneri 2a str. 2457T
agcuccugcauugac

SEQ ID NO: 1948885 - RNA, 16 nt, Shigella flexneri 2a str. 2457T
agcucgacaccaaaca

SEQ ID NO: 1948886 - RNA, 17 nt, Shigella flexneri 2a str. 2457T
agcucgacaccaaacag

SEQ ID NO: 1948887 - RNA, 18 nt, Shigella flexneri 2a str. 2457T
agcucgcaagccacgccg

SEQ ID NO: 1948888 - RNA, 16 nt, Shigella flexneri 2a str. 2457T
agcgucugagcaggcg

SEQ ID NO: 1948889 - RNA, 16 nt, Shigella flexneri 2a str. 2457T
agcgucaguagauuuc

SEQ ID NO: 1948890 - RNA, 16 nt, Shigella flexneri 2a str. 2457T
agcgucgcauccgaca

SEQ ID NO: 1948891 - RNA, 18 nt, Shigella flexneri 2a str. 2457T
agcgucaaggucaacagu

SEQ ID NO: 1948892 - RNA, 12 nt, Shigella flexneri 2a str. 2457T
agcgucagccug

SEQ ID NO: 1948893 - RNA, 18 nt, Shigella flexneri 2a str. 2457T
agcuccucgaguccuucc

SEQ ID NO: 1948894 - RNA, 18 nt, Shigella flexneri 2a str. 2457T
agcuccgggcugguuuuc

SEQ ID NO: 1948895 - RNA, 17 nt, Shigella flexneri 2a str. 2457T
accgacguagccccaau

SEQ ID NO: 1948896 - RNA, 18 nt, Shigella flexneri 2a str. 2457T
accgacauggugcgauua

SEQ ID NO: 1948897 - RNA, 15 nt, Shigella flexneri 2a str. 2457T
accgaccaucggcac

SEQ ID NO: 1948898 - RNA, 14 nt, Shigella flexneri 2a str. 2457T
accgauaaaagccc

SEQ ID NO: 1948899 - RNA, 17 nt, Shigella flexneri 2a str. 2457T
accgauaaaagcccugg

SEQ ID NO: 1948900 - RNA, 21 nt, Shigella flexneri 2a str. 2457T
accgacuggcuccgggaaaac

SEQ ID NO: 1948901 - RNA, 15 nt, Shigella flexneri 2a str. 2457T
accgacaaauuucau

SEQ ID NO: 1948902 - RNA, 16 nt, Shigella flexneri 2a str. 2457T
accgaauucaaauccu

SEQ ID NO: 1948903 - RNA, 15 nt, Shigella flexneri 2a str. 2457T
accgacaauccggua

SEQ ID NO: 1948904 - RNA, 23 nt, Shigella flexneri 2a str. 2457T
accgaaguggacgaacaguucaa

SEQ ID NO: 1948905 - RNA, 18 nt, Shigella flexneri 2a str. 2457T
accgaacggagucggguc

SEQ ID NO: 1948906 - RNA, 15 nt, Shigella flexneri 2a str. 2457T
accgaacggagucgg

SEQ ID NO: 1948907 - RNA, 20 nt, Shigella flexneri 2a str. 2457T
accgaaggcgauaucuggau

SEQ ID NO: 1948908 - RNA, 13 nt, Shigella flexneri 2a str. 2457T
accgaaaucgcca

SEQ ID NO: 1948909 - RNA, 13 nt, Shigella flexneri 2a str. 2457T
accgaacagauca

SEQ ID NO: 1948910 - RNA, 15 nt, Shigella flexneri 2a str. 2457T
acccugaguuuucag

SEQ ID NO: 1948911 - RNA, 13 nt, Shigella flexneri 2a str. 2457T
acccucacgcauu

SEQ ID NO: 1948912 - RNA, 21 nt, Shigella flexneri 2a str. 2457T
acccucacgcauucucuuuuc

SEQ ID NO: 1948913 - RNA, 14 nt, Shigella flexneri 2a str. 2457T
acccucaacaacag

SEQ ID NO: 1948914 - RNA, 22 nt, Shigella flexneri 2a str. 2457T
acccuucaaucccgccaaugca

SEQ ID NO: 1948915 - RNA, 21 nt, Shigella flexneri 2a str. 2457T
acccuuacucacuaaauuagg

SEQ ID NO: 1948916 - RNA, 15 nt, Shigella flexneri 2a str. 2457T
acccugguucgcaac

SEQ ID NO: 1948917 - RNA, 21 nt, Shigella flexneri 2a str. 2457T
acccuguccgccauggcuucu

SEQ ID NO: 1948918 - RNA, 12 nt, Shigella flexneri 2a str. 2457T
acccuucuucca

SEQ ID NO: 1948919 - RNA, 23 nt, Shigella flexneri 2a str. 2457T
acccuucauauuccugacccagc

SEQ ID NO: 1948920 - RNA, 21 nt, Shigella flexneri 2a str. 2457T
acccuuccuuagcaaaauagc

SEQ ID NO: 1948921 - RNA, 21 nt, Shigella flexneri 2a str. 2457T
acccuugaucaccguaaugau

SEQ ID NO: 1948922 - RNA, 23 nt, Shigella flexneri 2a str. 2457T
acccuuucguuaaauucuucuga

SEQ ID NO: 1948923 - RNA, 21 nt, Shigella flexneri 2a str. 2457T
acccguagcuguucaggagaa

SEQ ID NO: 1948924 - RNA, 23 nt, Shigella flexneri 2a str. 2457T
acccguauguucccaccagccac

SEQ ID NO: 1948925 - RNA, 14 nt, Shigella flexneri 2a str. 2457T
acccuaacaucauc

SEQ ID NO: 1948926 - RNA, 15 nt, Shigella flexneri 2a str. 2457T
acccuaacccucucc

SEQ ID NO: 1948927 - RNA, 17 nt, Shigella flexneri 2a str. 2457T
acccuaacccucucccc

SEQ ID NO: 1948928 - RNA, 13 nt, Shigella flexneri 2a str. 2457T
acccuauccccaa

SEQ ID NO: 1948929 - RNA, 18 nt, Shigella flexneri 2a str. 2457T
acccgccacgaaauugag

SEQ ID NO: 1948930 - RNA, 13 nt, Shigella flexneri 2a str. 2457T
acccgccagacca

SEQ ID NO: 1948931 - RNA, 22 nt, Shigella flexneri 2a str. 2457T
acccgaucgccaucaugcacac

SEQ ID NO: 1948932 - RNA, 21 nt, Shigella flexneri 2a str. 2457T
acccgcaaacaggaacaccag

SEQ ID NO: 1948933 - RNA, 18 nt, Shigella flexneri 2a str. 2457T
acccgcaacaaugccgau

SEQ ID NO: 1948934 - RNA, 14 nt, Shigella flexneri 2a str. 2457T
accccgauggcuug

SEQ ID NO: 1948935 - RNA, 17 nt, Shigella flexneri 2a str. 2457T
accccggcccucucccu

SEQ ID NO: 1948936 - RNA, 14 nt, Shigella flexneri 2a str. 2457T
accccgucaccacu

SEQ ID NO: 1948937 - RNA, 15 nt, Shigella flexneri 2a str. 2457T
accccaauguagccg

SEQ ID NO: 1948938 - RNA, 16 nt, Shigella flexneri 2a str. 2457T
accccaaaaaguugga

SEQ ID NO: 1948939 - RNA, 21 nt, Shigella flexneri 2a str. 2457T
acccauuuauccagcggcagc

SEQ ID NO: 1948940 - RNA, 22 nt, Shigella flexneri 2a str. 2457T
acccaggcccgcgugccggaag

SEQ ID NO: 1948941 - RNA, 17 nt, Shigella flexneri 2a str. 2457T
acccagcgaauccagca

SEQ ID NO: 1948942 - RNA, 15 nt, Shigella flexneri 2a str. 2457T
acccagcagcgccac

SEQ ID NO: 1948943 - RNA, 19 nt, Shigella flexneri 2a str. 2457T
acccagcagcgccgcgccu

SEQ ID NO: 1948944 - RNA, 11 nt, Shigella flexneri 2a str. 2457T
acccagcagca

SEQ ID NO: 1948945 - RNA, 17 nt, Shigella flexneri 2a str. 2457T
acccagcaccaguacca

SEQ ID NO: 1948946 - RNA, 18 nt, Shigella flexneri 2a str. 2457T
acccagcaccaguaccau

SEQ ID NO: 1948947 - RNA, 15 nt, Shigella flexneri 2a str. 2457T
acccagguagacacc

SEQ ID NO: 1948948 - RNA, 14 nt, Shigella flexneri 2a str. 2457T
acccaggccugccc

SEQ ID NO: 1948949 - RNA, 20 nt, Shigella flexneri 2a str. 2457T
acccagggaaaggauugcga

SEQ ID NO: 1948950 - RNA, 17 nt, Shigella flexneri 2a str. 2457T
acccacggauagauuuu

SEQ ID NO: 1948951 - RNA, 16 nt, Shigella flexneri 2a str. 2457T
acccagcaauccugca

SEQ ID NO: 1948952 - RNA, 19 nt, Shigella flexneri 2a str. 2457T
acccagaaucucuuuuguu

SEQ ID NO: 1948953 - RNA, 20 nt, Shigella flexneri 2a str. 2457T
accaucguccagcagcaaug

SEQ ID NO: 1948954 - RNA, 18 nt, Shigella flexneri 2a str. 2457T
accaggcgaccguuuuca

SEQ ID NO: 1948955 - RNA, 14 nt, Shigella flexneri 2a str. 2457T
accaggcguggaua

SEQ ID NO: 1948956 - RNA, 23 nt, Shigella flexneri 2a str. 2457T
accaguaaaccaauuucugugca

SEQ ID NO: 1948957 - RNA, 16 nt, Shigella flexneri 2a str. 2457T
accaguaccgccacca

SEQ ID NO: 1948958 - RNA, 14 nt, Shigella flexneri 2a str. 2457T
accaguaccgccac

SEQ ID NO: 1948959 - RNA, 15 nt, Shigella flexneri 2a str. 2457T
accagguucaacagc

SEQ ID NO: 1948960 - RNA, 14 nt, Shigella flexneri 2a str. 2457T
accagcuccagcag

SEQ ID NO: 1948961 - RNA, 23 nt, Shigella flexneri 2a str. 2457T
accagcucccggagggguuuuug

SEQ ID NO: 1948962 - RNA, 13 nt, Shigella flexneri 2a str. 2457T
accagcguuucca

SEQ ID NO: 1948963 - RNA, 16 nt, Shigella flexneri 2a str. 2457T
accagcuaccacgccg

SEQ ID NO: 1948964 - RNA, 20 nt, Shigella flexneri 2a str. 2457T
accaggaagauguacgccag

SEQ ID NO: 1948965 - RNA, 14 nt, Shigella flexneri 2a str. 2457T
accaggccagcgca

SEQ ID NO: 1948966 - RNA, 17 nt, Shigella flexneri 2a str. 2457T
accaggaagcgacccgg

SEQ ID NO: 1948967 - RNA, 20 nt, Shigella flexneri 2a str. 2457T
accagugcggauaccaccag

SEQ ID NO: 1948968 - RNA, 23 nt, Shigella flexneri 2a str. 2457T
accaguuacguuuaugccacugu

SEQ ID NO: 1948969 - RNA, 15 nt, Shigella flexneri 2a str. 2457T
accaguucacaccag

SEQ ID NO: 1948970 - RNA, 19 nt, Shigella flexneri 2a str. 2457T
accaguucacaccagccac

SEQ ID NO: 1948971 - RNA, 22 nt, Shigella flexneri 2a str. 2457T
accauaaaacgcgcuacugaau

SEQ ID NO: 1948972 - RNA, 21 nt, Shigella flexneri 2a str. 2457T
accauaaaacaaauccgcuug

SEQ ID NO: 1948973 - RNA, 19 nt, Shigella flexneri 2a str. 2457T
accaguugcuccagcaaua

SEQ ID NO: 1948974 - RNA, 16 nt, Shigella flexneri 2a str. 2457T
accaguccaucggcau

SEQ ID NO: 1948975 - RNA, 14 nt, Shigella flexneri 2a str. 2457T
accaguccacccac

SEQ ID NO: 1948976 - RNA, 23 nt, Shigella flexneri 2a str. 2457T
accagucagcgaacaccagcagu

SEQ ID NO: 1948977 - RNA, 18 nt, Shigella flexneri 2a str. 2457T
accaguacgcccacgcca

SEQ ID NO: 1948978 - RNA, 22 nt, Shigella flexneri 2a str. 2457T
accagucagcgaacaccagcag

SEQ ID NO: 1948979 - RNA, 16 nt, Shigella flexneri 2a str. 2457T
accagucgcugacacu

SEQ ID NO: 1948980 - RNA, 19 nt, Shigella flexneri 2a str. 2457T
accaguacgcccacgccag

SEQ ID NO: 1948981 - RNA, 22 nt, Shigella flexneri 2a str. 2457T
accagugaauuucacuucgcca

SEQ ID NO: 1948982 - RNA, 14 nt, Shigella flexneri 2a str. 2457T
accauaaauuucac

SEQ ID NO: 1948983 - RNA, 22 nt, Shigella flexneri 2a str. 2457T
accauaaauuucacgucacgcu

SEQ ID NO: 1948984 - RNA, 17 nt, Shigella flexneri 2a str. 2457T
accauauucagcagcag

SEQ ID NO: 1948985 - RNA, 16 nt, Shigella flexneri 2a str. 2457T
accauauucagcagca

SEQ ID NO: 1948986 - RNA, 22 nt, Shigella flexneri 2a str. 2457T
accauaaauauggugaaaguaa

SEQ ID NO: 1948987 - RNA, 23 nt, Shigella flexneri 2a str. 2457T
accauaguauuuauccauaauuu

SEQ ID NO: 1948988 - RNA, 21 nt, Shigella flexneri 2a str. 2457T
accaucgcuacauaacgcagc

SEQ ID NO: 1948989 - RNA, 17 nt, Shigella flexneri 2a str. 2457T
accaucggcaccaccaa

SEQ ID NO: 1948990 - RNA, 16 nt, Shigella flexneri 2a str. 2457T
accaucggcagcgcca

SEQ ID NO: 1948991 - RNA, 16 nt, Shigella flexneri 2a str. 2457T
accaucgccauuuaac

SEQ ID NO: 1948992 - RNA, 14 nt, Shigella flexneri 2a str. 2457T
accaucgccagccc

SEQ ID NO: 1948993 - RNA, 14 nt, Shigella flexneri 2a str. 2457T
accauccuaaaaaa

SEQ ID NO: 1948994 - RNA, 15 nt, Shigella flexneri 2a str. 2457T
accauccuaaaaaag

SEQ ID NO: 1948995 - RNA, 14 nt, Shigella flexneri 2a str. 2457T
accauccugcuccu

SEQ ID NO: 1948996 - RNA, 22 nt, Shigella flexneri 2a str. 2457T
accaucgagaaucagcgagaca

SEQ ID NO: 1948997 - RNA, 21 nt, Shigella flexneri 2a str. 2457T
accagaucguaauggucguuc

SEQ ID NO: 1948998 - RNA, 20 nt, Shigella flexneri 2a str. 2457T
accagaugcucuuuucugaa

SEQ ID NO: 1948999 - RNA, 16 nt, Shigella flexneri 2a str. 2457T
accagauuaauuauug

SEQ ID NO: 1949000 - RNA, 18 nt, Shigella flexneri 2a str. 2457T
accagauggcuuuccacc

SEQ ID NO: 1949001 - RNA, 22 nt, Shigella flexneri 2a str. 2457T
accagauuauaagccaguaaga

SEQ ID NO: 1949002 - RNA, 21 nt, Shigella flexneri 2a str. 2457T
accagauaagccugcgcgccc

SEQ ID NO: 1949003 - RNA, 12 nt, Shigella flexneri 2a str. 2457T
accagauacaaa

SEQ ID NO: 1949004 - RNA, 17 nt, Shigella flexneri 2a str. 2457T
accagaguaacgggcac

SEQ ID NO: 1949005 - RNA, 22 nt, Shigella flexneri 2a str. 2457T
accagaguaacgggcacguaaa

SEQ ID NO: 1949006 - RNA, 22 nt, Shigella flexneri 2a str. 2457T
accagacugugaaucauggaug

SEQ ID NO: 1949007 - RNA, 23 nt, Shigella flexneri 2a str. 2457T
accagagauguugaagaagucga

SEQ ID NO: 1949008 - RNA, 22 nt, Shigella flexneri 2a str. 2457T
accagcaccagcuccggcaccu

SEQ ID NO: 1949009 - RNA, 15 nt, Shigella flexneri 2a str. 2457T
accagcacaucauca

SEQ ID NO: 1949010 - RNA, 18 nt, Shigella flexneri 2a str. 2457T
accagcaauuuacgcuuu

SEQ ID NO: 1949011 - RNA, 13 nt, Shigella flexneri 2a str. 2457T
accagcaauaaca

SEQ ID NO: 1949012 - RNA, 18 nt, Shigella flexneri 2a str. 2457T
accagcaccguguucuca

SEQ ID NO: 1949013 - RNA, 13 nt, Shigella flexneri 2a str. 2457T
accagcacuucgc

SEQ ID NO: 1949014 - RNA, 10 nt, Shigella flexneri 2a str. 2457T
accagcagca

SEQ ID NO: 1949015 - RNA, 14 nt, Shigella flexneri 2a str. 2457T
accagaaucgccag

SEQ ID NO: 1949016 - RNA, 13 nt, Shigella flexneri 2a str. 2457T
accagaaucaauc

SEQ ID NO: 1949017 - RNA, 20 nt, Shigella flexneri 2a str. 2457T
accagaaucaaucccaucag

SEQ ID NO: 1949018 - RNA, 23 nt, Shigella flexneri 2a str. 2457T
accagaagcguaaaucccagcac

SEQ ID NO: 1949019 - RNA, 24 nt, Shigella flexneri 2a str. 2457T
accagaccugaaaccgccuucugc

SEQ ID NO: 1949020 - RNA, 15 nt, Shigella flexneri 2a str. 2457T
accagaccgcacacc

SEQ ID NO: 1949021 - RNA, 18 nt, Shigella flexneri 2a str. 2457T
accagacaucccagugca

SEQ ID NO: 1949022 - RNA, 17 nt, Shigella flexneri 2a str. 2457T
accagaccaauggcuuu

SEQ ID NO: 1949023 - RNA, 15 nt, Shigella flexneri 2a str. 2457T
accagacauguggau

SEQ ID NO: 1949024 - RNA, 17 nt, Shigella flexneri 2a str. 2457T
accagacgcaacagaaa

SEQ ID NO: 1949025 - RNA, 19 nt, Shigella flexneri 2a str. 2457T
accaagaccaauccgccag

SEQ ID NO: 1949026 - RNA, 16 nt, Shigella flexneri 2a str. 2457T
accagccaggccgcca

SEQ ID NO: 1949027 - RNA, 17 nt, Shigella flexneri 2a str. 2457T
accagccauuaaccagc

SEQ ID NO: 1949028 - RNA, 24 nt, Shigella flexneri 2a str. 2457T
accagccccagaauucacgcacuu

SEQ ID NO: 1949029 - RNA, 17 nt, Shigella flexneri 2a str. 2457T
accagccccagaauuca

SEQ ID NO: 1949030 - RNA, 22 nt, Shigella flexneri 2a str. 2457T
accagccgcuaccagcgcggca

SEQ ID NO: 1949031 - RNA, 17 nt, Shigella flexneri 2a str. 2457T
accagccagaauuaccc

SEQ ID NO: 1949032 - RNA, 11 nt, Shigella flexneri 2a str. 2457T
accagcaucgc

SEQ ID NO: 1949033 - RNA, 13 nt, Shigella flexneri 2a str. 2457T
accagcaguaaac

SEQ ID NO: 1949034 - RNA, 13 nt, Shigella flexneri 2a str. 2457T
accagcagcugcu

SEQ ID NO: 1949035 - RNA, 13 nt, Shigella flexneri 2a str. 2457T
accagcaucaaca

SEQ ID NO: 1949036 - RNA, 17 nt, Shigella flexneri 2a str. 2457T
accagcaucccggcagc

SEQ ID NO: 1949037 - RNA, 17 nt, Shigella flexneri 2a str. 2457T
accagcaucaacaacaa

SEQ ID NO: 1949038 - RNA, 23 nt, Shigella flexneri 2a str. 2457T
accagcaucaacaacaauuucac

SEQ ID NO: 1949039 - RNA, 19 nt, Shigella flexneri 2a str. 2457T
accagcgacggaugacacg

SEQ ID NO: 1949040 - RNA, 22 nt, Shigella flexneri 2a str. 2457T
accagcgaauggguaaaaccgc

SEQ ID NO: 1949041 - RNA, 13 nt, Shigella flexneri 2a str. 2457T
accagcgacauca

SEQ ID NO: 1949042 - RNA, 23 nt, Shigella flexneri 2a str. 2457T
accagccguugucagucaucacu

SEQ ID NO: 1949043 - RNA, 20 nt, Shigella flexneri 2a str. 2457T
accagccguugucagucauc

SEQ ID NO: 1949044 - RNA, 20 nt, Shigella flexneri 2a str. 2457T
accagccuggcggaaagcca

SEQ ID NO: 1949045 - RNA, 18 nt, Shigella flexneri 2a str. 2457T
accagcgaggucaaaauc

SEQ ID NO: 1949046 - RNA, 20 nt, Shigella flexneri 2a str. 2457T
accagcgcagauagcccgga

SEQ ID NO: 1949047 - RNA, 16 nt, Shigella flexneri 2a str. 2457T
accagcgucaucggau

SEQ ID NO: 1949048 - RNA, 17 nt, Shigella flexneri 2a str. 2457T
accagcgucgcaucagg

SEQ ID NO: 1949049 - RNA, 23 nt, Shigella flexneri 2a str. 2457T
accagcggccggaugcgccgcca

SEQ ID NO: 1949050 - RNA, 16 nt, Shigella flexneri 2a str. 2457T
accagcgucagaaaca

SEQ ID NO: 1949051 - RNA, 18 nt, Shigella flexneri 2a str. 2457T
accagcgccugcgcggca

SEQ ID NO: 1949052 - RNA, 21 nt, Shigella flexneri 2a str. 2457T
accgcaaacugccguugcugc

SEQ ID NO: 1949053 - RNA, 16 nt, Shigella flexneri 2a str. 2457T
accgcguaauacauca

SEQ ID NO: 1949054 - RNA, 17 nt, Shigella flexneri 2a str. 2457T
accgcaaagguugcugc

SEQ ID NO: 1949055 - RNA, 15 nt, Shigella flexneri 2a str. 2457T
accgauuucacccac

SEQ ID NO: 1949056 - RNA, 17 nt, Shigella flexneri 2a str. 2457T
accgcgugcgcggcagc

SEQ ID NO: 1949057 - RNA, 17 nt, Shigella flexneri 2a str. 2457T
accgcuauuugcgccug

SEQ ID NO: 1949058 - RNA, 13 nt, Shigella flexneri 2a str. 2457T
accgcucgcgcuu

SEQ ID NO: 1949059 - RNA, 22 nt, Shigella flexneri 2a str. 2457T
accgcuccgccaucuucuugca

SEQ ID NO: 1949060 - RNA, 12 nt, Shigella flexneri 2a str. 2457T
accggaacccac

SEQ ID NO: 1949061 - RNA, 17 nt, Shigella flexneri 2a str. 2457T
accggaauucagguacg

SEQ ID NO: 1949062 - RNA, 14 nt, Shigella flexneri 2a str. 2457T
accggaacccaccg

SEQ ID NO: 1949063 - RNA, 21 nt, Shigella flexneri 2a str. 2457T
accgcuuuuccagcauaaugu

SEQ ID NO: 1949064 - RNA, 17 nt, Shigella flexneri 2a str. 2457T
accgcuuuugucggcac

SEQ ID NO: 1949065 - RNA, 14 nt, Shigella flexneri 2a str. 2457T
accggaaaaggugu

SEQ ID NO: 1949066 - RNA, 13 nt, Shigella flexneri 2a str. 2457T
accggacaauaaa

SEQ ID NO: 1949067 - RNA, 21 nt, Shigella flexneri 2a str. 2457T
accggacacacuucauuuucc

SEQ ID NO: 1949068 - RNA, 19 nt, Shigella flexneri 2a str. 2457T
accggacaguuugaucagu

SEQ ID NO: 1949069 - RNA, 19 nt, Shigella flexneri 2a str. 2457T
accggcacuucaacuucgc

SEQ ID NO: 1949070 - RNA, 21 nt, Shigella flexneri 2a str. 2457T
accgcuucgcucacaucaugc

SEQ ID NO: 1949071 - RNA, 19 nt, Shigella flexneri 2a str. 2457T
accgcuuuacgccaccgca

SEQ ID NO: 1949072 - RNA, 12 nt, Shigella flexneri 2a str. 2457T
accgcuucccuu

SEQ ID NO: 1949073 - RNA, 19 nt, Shigella flexneri 2a str. 2457T
accgcucugcgaucugcgc

SEQ ID NO: 1949074 - RNA, 16 nt, Shigella flexneri 2a str. 2457T
accguaucuaccacug

SEQ ID NO: 1949075 - RNA, 20 nt, Shigella flexneri 2a str. 2457T
accguaucuucauugugcgg

SEQ ID NO: 1949076 - RNA, 21 nt, Shigella flexneri 2a str. 2457T
accguaguccauacccagcau

SEQ ID NO: 1949077 - RNA, 22 nt, Shigella flexneri 2a str. 2457T
accguaguccauacccagcauc

SEQ ID NO: 1949078 - RNA, 14 nt, Shigella flexneri 2a str. 2457T
accgucacuucuuc

SEQ ID NO: 1949079 - RNA, 11 nt, Shigella flexneri 2a str. 2457T
accguauuuug

SEQ ID NO: 1949080 - RNA, 17 nt, Shigella flexneri 2a str. 2457T
accgucaaaaaaacggc

SEQ ID NO: 1949081 - RNA, 18 nt, Shigella flexneri 2a str. 2457T
accgucaaacacagcacu

SEQ ID NO: 1949082 - RNA, 15 nt, Shigella flexneri 2a str. 2457T
accguaaaagccugg

SEQ ID NO: 1949083 - RNA, 13 nt, Shigella flexneri 2a str. 2457T
accguaaacagau

SEQ ID NO: 1949084 - RNA, 18 nt, Shigella flexneri 2a str. 2457T
accguaaacccuaacauc

SEQ ID NO: 1949085 - RNA, 19 nt, Shigella flexneri 2a str. 2457T
accgguuucaauccaggua

SEQ ID NO: 1949086 - RNA, 20 nt, Shigella flexneri 2a str. 2457T
accggucccuucaaucucaa

SEQ ID NO: 1949087 - RNA, 23 nt, Shigella flexneri 2a str. 2457T
accguaaguaagauaaaagcaau

SEQ ID NO: 1949088 - RNA, 19 nt, Shigella flexneri 2a str. 2457T
accguacgcaucaccagac

SEQ ID NO: 1949089 - RNA, 18 nt, Shigella flexneri 2a str. 2457T
accguacauugccgggcg

SEQ ID NO: 1949090 - RNA, 19 nt, Shigella flexneri 2a str. 2457T
accggcuuucgcuucaacc

SEQ ID NO: 1949091 - RNA, 17 nt, Shigella flexneri 2a str. 2457T
accgguaacgauuucau

SEQ ID NO: 1949092 - RNA, 17 nt, Shigella flexneri 2a str. 2457T
accggguuuucaaugau

SEQ ID NO: 1949093 - RNA, 21 nt, Shigella flexneri 2a str. 2457T
accggguuuucaaugauaaag

SEQ ID NO: 1949094 - RNA, 15 nt, Shigella flexneri 2a str. 2457T
accgguaaagaagag

SEQ ID NO: 1949095 - RNA, 19 nt, Shigella flexneri 2a str. 2457T
accgguaaagaagagcggc

SEQ ID NO: 1949096 - RNA, 18 nt, Shigella flexneri 2a str. 2457T
accuacaaacguugcuga

SEQ ID NO: 1949097 - RNA, 15 nt, Shigella flexneri 2a str. 2457T
accuaaaaagaaaau

SEQ ID NO: 1949098 - RNA, 15 nt, Shigella flexneri 2a str. 2457T
accguuuuuucugcc

SEQ ID NO: 1949099 - RNA, 19 nt, Shigella flexneri 2a str. 2457T
accuaaacguuuaaaaacu

SEQ ID NO: 1949100 - RNA, 13 nt, Shigella flexneri 2a str. 2457T
accuaacagcauc

SEQ ID NO: 1949101 - RNA, 16 nt, Shigella flexneri 2a str. 2457T
accuaaaaaaucccac

SEQ ID NO: 1949102 - RNA, 23 nt, Shigella flexneri 2a str. 2457T
accguuuugugcgcgugagcugg

SEQ ID NO: 1949103 - RNA, 21 nt, Shigella flexneri 2a str. 2457T
accguuuuugccgaugucucg

SEQ ID NO: 1949104 - RNA, 19 nt, Shigella flexneri 2a str. 2457T
accuaccugcaguucauca

SEQ ID NO: 1949105 - RNA, 20 nt, Shigella flexneri 2a str. 2457T
accuacuuuuuaauucagga

SEQ ID NO: 1949106 - RNA, 17 nt, Shigella flexneri 2a str. 2457T
accucaucagacaccag

SEQ ID NO: 1949107 - RNA, 12 nt, Shigella flexneri 2a str. 2457T
accgucuguaac

SEQ ID NO: 1949108 - RNA, 14 nt, Shigella flexneri 2a str. 2457T
accgucugcuggaa

SEQ ID NO: 1949109 - RNA, 20 nt, Shigella flexneri 2a str. 2457T
accgucuucccgcagccacg

SEQ ID NO: 1949110 - RNA, 19 nt, Shigella flexneri 2a str. 2457T
accgucuucccgcagccac

SEQ ID NO: 1949111 - RNA, 16 nt, Shigella flexneri 2a str. 2457T
accgucucugcgcccu

SEQ ID NO: 1949112 - RNA, 18 nt, Shigella flexneri 2a str. 2457T
accgugaucguggccaug

SEQ ID NO: 1949113 - RNA, 20 nt, Shigella flexneri 2a str. 2457T
accguccucuucccagaccc

SEQ ID NO: 1949114 - RNA, 22 nt, Shigella flexneri 2a str. 2457T
accguccucuucccagacccag

SEQ ID NO: 1949115 - RNA, 14 nt, Shigella flexneri 2a str. 2457T
accgucgaugaaag

SEQ ID NO: 1949116 - RNA, 18 nt, Shigella flexneri 2a str. 2457T
accgucaucuuccaccug

SEQ ID NO: 1949117 - RNA, 23 nt, Shigella flexneri 2a str. 2457T
accguuggcgcguguuccagaga

SEQ ID NO: 1949118 - RNA, 14 nt, Shigella flexneri 2a str. 2457T
accguucaggcaca

SEQ ID NO: 1949119 - RNA, 20 nt, Shigella flexneri 2a str. 2457T
accguucauuaacgccccaa

SEQ ID NO: 1949120 - RNA, 18 nt, Shigella flexneri 2a str. 2457T
accguguaaaaugacucg

SEQ ID NO: 1949121 - RNA, 18 nt, Shigella flexneri 2a str. 2457T
accguggcguaaaucauc

SEQ ID NO: 1949122 - RNA, 20 nt, Shigella flexneri 2a str. 2457T
accgugggaaacaguaagca

SEQ ID NO: 1949123 - RNA, 23 nt, Shigella flexneri 2a str. 2457T
accgugcugacucagcggcugcc

SEQ ID NO: 1949124 - RNA, 21 nt, Shigella flexneri 2a str. 2457T
acgacaaaaauaccaccaaug

SEQ ID NO: 1949125 - RNA, 14 nt, Shigella flexneri 2a str. 2457T
acgaauugcaggac

SEQ ID NO: 1949126 - RNA, 21 nt, Shigella flexneri 2a str. 2457T
acgacaaggcaggcaucaaug

SEQ ID NO: 1949127 - RNA, 19 nt, Shigella flexneri 2a str. 2457T
acgaaucugcaaucaaaua

SEQ ID NO: 1949128 - RNA, 17 nt, Shigella flexneri 2a str. 2457T
acgaaugacugauugcc

SEQ ID NO: 1949129 - RNA, 13 nt, Shigella flexneri 2a str. 2457T
acgaauuaucacu

SEQ ID NO: 1949130 - RNA, 12 nt, Shigella flexneri 2a str. 2457T
acgacaggcaag

SEQ ID NO: 1949131 - RNA, 22 nt, Shigella flexneri 2a str. 2457T
acgacaaucucaauuuucacuu

SEQ ID NO: 1949132 - RNA, 23 nt, Shigella flexneri 2a str. 2457T
acgaccacucuuucgacggcauc

SEQ ID NO: 1949133 - RNA, 14 nt, Shigella flexneri 2a str. 2457T
acgaccacccaccg

SEQ ID NO: 1949134 - RNA, 13 nt, Shigella flexneri 2a str. 2457T
acgaccaccaccg

SEQ ID NO: 1949135 - RNA, 21 nt, Shigella flexneri 2a str. 2457T
acgaaugacauaaugcaaaau

SEQ ID NO: 1949136 - RNA, 21 nt, Shigella flexneri 2a str. 2457T
acgaaucuauucauuuauguu

SEQ ID NO: 1949137 - RNA, 15 nt, Shigella flexneri 2a str. 2457T
acgaaucuauucauu

SEQ ID NO: 1949138 - RNA, 19 nt, Shigella flexneri 2a str. 2457T
acgaaaguuaauccacagc

SEQ ID NO: 1949139 - RNA, 17 nt, Shigella flexneri 2a str. 2457T
acgaauaccuucuuccu

SEQ ID NO: 1949140 - RNA, 17 nt, Shigella flexneri 2a str. 2457T
acgaaagcgcaguaagc

SEQ ID NO: 1949141 - RNA, 18 nt, Shigella flexneri 2a str. 2457T
accuuuguaugccuggca

SEQ ID NO: 1949142 - RNA, 18 nt, Shigella flexneri 2a str. 2457T
accuuugcgguuaaaaau

SEQ ID NO: 1949143 - RNA, 16 nt, Shigella flexneri 2a str. 2457T
acgaaaccgacugcca

SEQ ID NO: 1949144 - RNA, 21 nt, Shigella flexneri 2a str. 2457T
acgaaacgccggugaccauca

SEQ ID NO: 1949145 - RNA, 16 nt, Shigella flexneri 2a str. 2457T
acgacgguuuccaccg

SEQ ID NO: 1949146 - RNA, 20 nt, Shigella flexneri 2a str. 2457T
acgacucaaaucacgcaguu

SEQ ID NO: 1949147 - RNA, 15 nt, Shigella flexneri 2a str. 2457T
acgacgcagaacuga

SEQ ID NO: 1949148 - RNA, 15 nt, Shigella flexneri 2a str. 2457T
acgacgacaggcaag

SEQ ID NO: 1949149 - RNA, 18 nt, Shigella flexneri 2a str. 2457T
acgacgcugaugucagca

SEQ ID NO: 1949150 - RNA, 19 nt, Shigella flexneri 2a str. 2457T
acgaccguuccauucaaac

SEQ ID NO: 1949151 - RNA, 18 nt, Shigella flexneri 2a str. 2457T
acgaccgcaugcgguuua

SEQ ID NO: 1949152 - RNA, 19 nt, Shigella flexneri 2a str. 2457T
acgaccgauugauucccaa

SEQ ID NO: 1949153 - RNA, 23 nt, Shigella flexneri 2a str. 2457T
acgagugcaucugguaagugcca

SEQ ID NO: 1949154 - RNA, 18 nt, Shigella flexneri 2a str. 2457T
acgagcccuucggggcua

SEQ ID NO: 1949155 - RNA, 17 nt, Shigella flexneri 2a str. 2457T
acgacugccgcucaccu

SEQ ID NO: 1949156 - RNA, 12 nt, Shigella flexneri 2a str. 2457T
acgagaucguca

SEQ ID NO: 1949157 - RNA, 12 nt, Shigella flexneri 2a str. 2457T
accuucuuccca

SEQ ID NO: 1949158 - RNA, 11 nt, Shigella flexneri 2a str. 2457T
accuucuuccu

SEQ ID NO: 1949159 - RNA, 17 nt, Shigella flexneri 2a str. 2457T
accuugcuuugcaacug

SEQ ID NO: 1949160 - RNA, 13 nt, Shigella flexneri 2a str. 2457T
accuugucaugca

SEQ ID NO: 1949161 - RNA, 22 nt, Shigella flexneri 2a str. 2457T
accuucagcgaagcccacgccg

SEQ ID NO: 1949162 - RNA, 23 nt, Shigella flexneri 2a str. 2457T
accuucagcgaagcccacgccgc

SEQ ID NO: 1949163 - RNA, 12 nt, Shigella flexneri 2a str. 2457T
accuucacgcgc

SEQ ID NO: 1949164 - RNA, 14 nt, Shigella flexneri 2a str. 2457T
accuucauuugcca

SEQ ID NO: 1949165 - RNA, 14 nt, Shigella flexneri 2a str. 2457T
accuucaggcacaa

SEQ ID NO: 1949166 - RNA, 22 nt, Shigella flexneri 2a str. 2457T
accuguccuguaggccugauaa

SEQ ID NO: 1949167 - RNA, 21 nt, Shigella flexneri 2a str. 2457T
accugugaauuucuaagcugc

SEQ ID NO: 1949168 - RNA, 21 nt, Shigella flexneri 2a str. 2457T
accuguaacguugcugcgccg

SEQ ID NO: 1949169 - RNA, 16 nt, Shigella flexneri 2a str. 2457T
accugcauacaaauaa

SEQ ID NO: 1949170 - RNA, 23 nt, Shigella flexneri 2a str. 2457T
accugccaggugagauccgggaa

SEQ ID NO: 1949171 - RNA, 14 nt, Shigella flexneri 2a str. 2457T
accugcccuccggu

SEQ ID NO: 1949172 - RNA, 15 nt, Shigella flexneri 2a str. 2457T
accugcccuccggua

SEQ ID NO: 1949173 - RNA, 20 nt, Shigella flexneri 2a str. 2457T
accugauugaccgccagcgc

SEQ ID NO: 1949174 - RNA, 18 nt, Shigella flexneri 2a str. 2457T
accugcaaauucaauaaa

SEQ ID NO: 1949175 - RNA, 18 nt, Shigella flexneri 2a str. 2457T
accuccauguccagcuug

SEQ ID NO: 1949176 - RNA, 14 nt, Shigella flexneri 2a str. 2457T
accugaugagaugc

SEQ ID NO: 1949177 - RNA, 16 nt, Shigella flexneri 2a str. 2457T
accugaugagaugcug

SEQ ID NO: 1949178 - RNA, 19 nt, Shigella flexneri 2a str. 2457T
accuccagcgaaggaucac

SEQ ID NO: 1949179 - RNA, 11 nt, Shigella flexneri 2a str. 2457T
accugcucagc

SEQ ID NO: 1949180 - RNA, 13 nt, Shigella flexneri 2a str. 2457T
accugcguucagc

SEQ ID NO: 1949181 - RNA, 17 nt, Shigella flexneri 2a str. 2457T
accugcgcaggcauuca

SEQ ID NO: 1949182 - RNA, 16 nt, Shigella flexneri 2a str. 2457T
accuggauauugcgga

SEQ ID NO: 1949183 - RNA, 19 nt, Shigella flexneri 2a str. 2457T
accugcuuuguucagcccu

SEQ ID NO: 1949184 - RNA, 17 nt, Shigella flexneri 2a str. 2457T
accugcucgucauccgc

SEQ ID NO: 1949185 - RNA, 23 nt, Shigella flexneri 2a str. 2457T
accugcugauuaucggcaucgcu

SEQ ID NO: 1949186 - RNA, 18 nt, Shigella flexneri 2a str. 2457T
accugcuuaacgagcgca

SEQ ID NO: 1949187 - RNA, 22 nt, Shigella flexneri 2a str. 2457T
accugcuuaaggcagaaacaaa

SEQ ID NO: 1949188 - RNA, 18 nt, Shigella flexneri 2a str. 2457T
acggcccugugccugcgu

SEQ ID NO: 1949189 - RNA, 22 nt, Shigella flexneri 2a str. 2457T
acggccgcacuuacagcaacgc

SEQ ID NO: 1949190 - RNA, 16 nt, Shigella flexneri 2a str. 2457T
acggccacagccagcc

SEQ ID NO: 1949191 - RNA, 18 nt, Shigella flexneri 2a str. 2457T
acggcgaaucaaccgcgc

SEQ ID NO: 1949192 - RNA, 14 nt, Shigella flexneri 2a str. 2457T
acggcgagccagcg

SEQ ID NO: 1949193 - RNA, 19 nt, Shigella flexneri 2a str. 2457T
acggccuucggugcgacaa

SEQ ID NO: 1949194 - RNA, 18 nt, Shigella flexneri 2a str. 2457T
acggcauuuugcugaugc

SEQ ID NO: 1949195 - RNA, 18 nt, Shigella flexneri 2a str. 2457T
acggcaugaaagcgaugc

SEQ ID NO: 1949196 - RNA, 19 nt, Shigella flexneri 2a str. 2457T
acggcagcaacggcaguuu

SEQ ID NO: 1949197 - RNA, 21 nt, Shigella flexneri 2a str. 2457T
acggcagagaaaccacaucaa

SEQ ID NO: 1949198 - RNA, 18 nt, Shigella flexneri 2a str. 2457T
acggcacggaaagcagca

SEQ ID NO: 1949199 - RNA, 17 nt, Shigella flexneri 2a str. 2457T
acggcacggaaagcagc

SEQ ID NO: 1949200 - RNA, 18 nt, Shigella flexneri 2a str. 2457T
acggcacuccucuucacg

SEQ ID NO: 1949201 - RNA, 14 nt, Shigella flexneri 2a str. 2457T
acggucacggcugu

SEQ ID NO: 1949202 - RNA, 20 nt, Shigella flexneri 2a str. 2457T
acggucaggcuaaagaaaac

SEQ ID NO: 1949203 - RNA, 17 nt, Shigella flexneri 2a str. 2457T
acggucaggcuaaagaa

SEQ ID NO: 1949204 - RNA, 13 nt, Shigella flexneri 2a str. 2457T
acgguccggcauc

SEQ ID NO: 1949205 - RNA, 15 nt, Shigella flexneri 2a str. 2457T
acggugaccagaacu

SEQ ID NO: 1949206 - RNA, 19 nt, Shigella flexneri 2a str. 2457T
acggugaacucacacagcg

SEQ ID NO: 1949207 - RNA, 23 nt, Shigella flexneri 2a str. 2457T
acggugaaaaaccaaucucccag

SEQ ID NO: 1949208 - RNA, 17 nt, Shigella flexneri 2a str. 2457T
acggugaaaaucaaucu

SEQ ID NO: 1949209 - RNA, 21 nt, Shigella flexneri 2a str. 2457T
acgguaguggcaaccagcaga

SEQ ID NO: 1949210 - RNA, 19 nt, Shigella flexneri 2a str. 2457T
acggggcugccagcucuca

SEQ ID NO: 1949211 - RNA, 18 nt, Shigella flexneri 2a str. 2457T
acggggugcgguaaaacc

SEQ ID NO: 1949212 - RNA, 23 nt, Shigella flexneri 2a str. 2457T
acgggguugugauuacaggaugc

SEQ ID NO: 1949213 - RNA, 17 nt, Shigella flexneri 2a str. 2457T
acggcgggugacuuccc

SEQ ID NO: 1949214 - RNA, 17 nt, Shigella flexneri 2a str. 2457T
acgggcaagccagcaua

SEQ ID NO: 1949215 - RNA, 14 nt, Shigella flexneri 2a str. 2457T
acgggcaaucucau

SEQ ID NO: 1949216 - RNA, 14 nt, Shigella flexneri 2a str. 2457T
acgucaacuuuguu

SEQ ID NO: 1949217 - RNA, 15 nt, Shigella flexneri 2a str. 2457T
acgucaauggugaga

SEQ ID NO: 1949218 - RNA, 22 nt, Shigella flexneri 2a str. 2457T
acgucacaggccaucacauccu

SEQ ID NO: 1949219 - RNA, 12 nt, Shigella flexneri 2a str. 2457T
acgucaccaucc

SEQ ID NO: 1949220 - RNA, 19 nt, Shigella flexneri 2a str. 2457T
acgucaaauaauuccugcg

SEQ ID NO: 1949221 - RNA, 17 nt, Shigella flexneri 2a str. 2457T
acgguugaugccguucc

SEQ ID NO: 1949222 - RNA, 17 nt, Shigella flexneri 2a str. 2457T
acgguuaaaaacagcca

SEQ ID NO: 1949223 - RNA, 16 nt, Shigella flexneri 2a str. 2457T
acgucacucuuuauga

SEQ ID NO: 1949224 - RNA, 18 nt, Shigella flexneri 2a str. 2457T
acgucacuggugugucau

SEQ ID NO: 1949225 - RNA, 16 nt, Shigella flexneri 2a str. 2457T
acgucauuaccgcgaa

SEQ ID NO: 1949226 - RNA, 15 nt, Shigella flexneri 2a str. 2457T
acgucccaugaugcg

SEQ ID NO: 1949227 - RNA, 12 nt, Shigella flexneri 2a str. 2457T
acguccagccag

SEQ ID NO: 1949228 - RNA, 19 nt, Shigella flexneri 2a str. 2457T
acguccggcaauauagaua

SEQ ID NO: 1949229 - RNA, 14 nt, Shigella flexneri 2a str. 2457T
acguccccugggga

SEQ ID NO: 1949230 - RNA, 16 nt, Shigella flexneri 2a str. 2457T
acgucgcaagacgaaa

SEQ ID NO: 1949231 - RNA, 20 nt, Shigella flexneri 2a str. 2457T
acgucgcaacuccaccagca

SEQ ID NO: 1949232 - RNA, 22 nt, Shigella flexneri 2a str. 2457T
acgucgauuucuggguggcguu

SEQ ID NO: 1949233 - RNA, 14 nt, Shigella flexneri 2a str. 2457T
acgucgcuuuauag

SEQ ID NO: 1949234 - RNA, 14 nt, Shigella flexneri 2a str. 2457T
acgucuacaguacg

SEQ ID NO: 1949235 - RNA, 17 nt, Shigella flexneri 2a str. 2457T
acgucuccgcccaaacu

SEQ ID NO: 1949236 - RNA, 14 nt, Shigella flexneri 2a str. 2457T
acgugagagauaau

SEQ ID NO: 1949237 - RNA, 12 nt, Shigella flexneri 2a str. 2457T
acgucucaucag

SEQ ID NO: 1949238 - RNA, 18 nt, Shigella flexneri 2a str. 2457T
acgucucaaucaccacca

SEQ ID NO: 1949239 - RNA, 20 nt, Shigella flexneri 2a str. 2457T
acguuaacuacaaucacgau

SEQ ID NO: 1949240 - RNA, 20 nt, Shigella flexneri 2a str. 2457T
acguuaaugcaaucaaaaau

SEQ ID NO: 1949241 - RNA, 13 nt, Shigella flexneri 2a str. 2457T
acguuaagaaaac

SEQ ID NO: 1949242 - RNA, 20 nt, Shigella flexneri 2a str. 2457T
acguguaggccugauaagcg

SEQ ID NO: 1949243 - RNA, 16 nt, Shigella flexneri 2a str. 2457T
acguggcacauucuga

SEQ ID NO: 1949244 - RNA, 15 nt, Shigella flexneri 2a str. 2457T
acgugcaaaaucaaa

SEQ ID NO: 1949245 - RNA, 15 nt, Shigella flexneri 2a str. 2457T
acgugcacaggcaac

SEQ ID NO: 1949246 - RNA, 23 nt, Shigella flexneri 2a str. 2457T
acgcgauaaaagacgccgacauc

SEQ ID NO: 1949247 - RNA, 21 nt, Shigella flexneri 2a str. 2457T
acgcgaccgugggcaauuucu

SEQ ID NO: 1949248 - RNA, 22 nt, Shigella flexneri 2a str. 2457T
acgcgcagggugcagaaucaau

SEQ ID NO: 1949249 - RNA, 18 nt, Shigella flexneri 2a str. 2457T
acgcgcagcguucauaaa

SEQ ID NO: 1949250 - RNA, 13 nt, Shigella flexneri 2a str. 2457T
acgcgccagcacc

SEQ ID NO: 1949251 - RNA, 22 nt, Shigella flexneri 2a str. 2457T
acgcgccaggaucagaaugcgc

SEQ ID NO: 1949252 - RNA, 20 nt, Shigella flexneri 2a str. 2457T
acgcgggccauccaccagug

SEQ ID NO: 1949253 - RNA, 15 nt, Shigella flexneri 2a str. 2457T
acgcgggcagcagaa

SEQ ID NO: 1949254 - RNA, 18 nt, Shigella flexneri 2a str. 2457T
acgcggcaacggcuucgc

SEQ ID NO: 1949255 - RNA, 20 nt, Shigella flexneri 2a str. 2457T
acgcggcauuuuuacugcgc

SEQ ID NO: 1949256 - RNA, 16 nt, Shigella flexneri 2a str. 2457T
acgcggcccaggcggc

SEQ ID NO: 1949257 - RNA, 15 nt, Shigella flexneri 2a str. 2457T
acgcgcuccaggagu

SEQ ID NO: 1949258 - RNA, 16 nt, Shigella flexneri 2a str. 2457T
acgcgcuaaucagcuu

SEQ ID NO: 1949259 - RNA, 14 nt, Shigella flexneri 2a str. 2457T
acgcgccuuaaaaa

SEQ ID NO: 1949260 - RNA, 23 nt, Shigella flexneri 2a str. 2457T
acgcugccccugguuaucuucca

SEQ ID NO: 1949261 - RNA, 17 nt, Shigella flexneri 2a str. 2457T
acgcucgaacagcuggu

SEQ ID NO: 1949262 - RNA, 21 nt, Shigella flexneri 2a str. 2457T
acgcucgcgcaguuugccaug

SEQ ID NO: 1949263 - RNA, 16 nt, Shigella flexneri 2a str. 2457T
acgcucccagcagaga

SEQ ID NO: 1949264 - RNA, 20 nt, Shigella flexneri 2a str. 2457T
acgcuggccgcgucuuaucc

SEQ ID NO: 1949265 - RNA, 13 nt, Shigella flexneri 2a str. 2457T
acgcuggcccagu

SEQ ID NO: 1949266 - RNA, 16 nt, Shigella flexneri 2a str. 2457T
acgcugcugccggcac

SEQ ID NO: 1949267 - RNA, 12 nt, Shigella flexneri 2a str. 2457T
acgcuggugagu

SEQ ID NO: 1949268 - RNA, 23 nt, Shigella flexneri 2a str. 2457T
acgcugguaguuguacaacugcu

SEQ ID NO: 1949269 - RNA, 21 nt, Shigella flexneri 2a str. 2457T
acgcuggcuuugcccuggcgc

SEQ ID NO: 1949270 - RNA, 13 nt, Shigella flexneri 2a str. 2457T
acgcgguuacgca

SEQ ID NO: 1949271 - RNA, 17 nt, Shigella flexneri 2a str. 2457T
acgcguaaaacagccag

SEQ ID NO: 1949272 - RNA, 16 nt, Shigella flexneri 2a str. 2457T
acgcguagagaaucca

SEQ ID NO: 1949273 - RNA, 19 nt, Shigella flexneri 2a str. 2457T
acgcguugcgcaugaccuu

SEQ ID NO: 1949274 - RNA, 23 nt, Shigella flexneri 2a str. 2457T
acgcguuuuuucgauaucaagcc

SEQ ID NO: 1949275 - RNA, 15 nt, Shigella flexneri 2a str. 2457T
acgcguucacugccg

SEQ ID NO: 1949276 - RNA, 18 nt, Shigella flexneri 2a str. 2457T
acgcguucauacuuuuca

SEQ ID NO: 1949277 - RNA, 17 nt, Shigella flexneri 2a str. 2457T
acgcguggacuggcugc

SEQ ID NO: 1949278 - RNA, 20 nt, Shigella flexneri 2a str. 2457T
acgcguuauccggcuaacaa

SEQ ID NO: 1949279 - RNA, 14 nt, Shigella flexneri 2a str. 2457T
acgcuaccaaaaaa

SEQ ID NO: 1949280 - RNA, 20 nt, Shigella flexneri 2a str. 2457T
acgcuccaguguggccagag

SEQ ID NO: 1949281 - RNA, 18 nt, Shigella flexneri 2a str. 2457T
acgccgcauccggcauaa

SEQ ID NO: 1949282 - RNA, 16 nt, Shigella flexneri 2a str. 2457T
acgccgccagaccaau

SEQ ID NO: 1949283 - RNA, 20 nt, Shigella flexneri 2a str. 2457T
acgccgcauccggcauuuug

SEQ ID NO: 1949284 - RNA, 23 nt, Shigella flexneri 2a str. 2457T
acgccgagaauaaaacaggcagc

SEQ ID NO: 1949285 - RNA, 19 nt, Shigella flexneri 2a str. 2457T
acgccgacgggucagcggg

SEQ ID NO: 1949286 - RNA, 15 nt, Shigella flexneri 2a str. 2457T
acgccgaagugcgcg

SEQ ID NO: 1949287 - RNA, 19 nt, Shigella flexneri 2a str. 2457T
acgccgaauaacgcgcagc

SEQ ID NO: 1949288 - RNA, 16 nt, Shigella flexneri 2a str. 2457T
acgccgaaugccgggu

SEQ ID NO: 1949289 - RNA, 15 nt, Shigella flexneri 2a str. 2457T
acgccgaccagaccg

SEQ ID NO: 1949290 - RNA, 16 nt, Shigella flexneri 2a str. 2457T
acgcccguuguuuuau

SEQ ID NO: 1949291 - RNA, 22 nt, Shigella flexneri 2a str. 2457T
acgcccguuguuuuauuuaugu

SEQ ID NO: 1949292 - RNA, 19 nt, Shigella flexneri 2a str. 2457T
acgcccugcgcuggugaaa

SEQ ID NO: 1949293 - RNA, 19 nt, Shigella flexneri 2a str. 2457T
acgcccgcauaugcgggcg

SEQ ID NO: 1949294 - RNA, 13 nt, Shigella flexneri 2a str. 2457T
acgccccacaaac

SEQ ID NO: 1949295 - RNA, 17 nt, Shigella flexneri 2a str. 2457T
acgccccacagacccag

SEQ ID NO: 1949296 - RNA, 14 nt, Shigella flexneri 2a str. 2457T
acgccccaacacaa

SEQ ID NO: 1949297 - RNA, 16 nt, Shigella flexneri 2a str. 2457T
acgcccaucauucagu

SEQ ID NO: 1949298 - RNA, 15 nt, Shigella flexneri 2a str. 2457T
acgccccagauugcc

SEQ ID NO: 1949299 - RNA, 17 nt, Shigella flexneri 2a str. 2457T
acgccccgguuucucuu

SEQ ID NO: 1949300 - RNA, 21 nt, Shigella flexneri 2a str. 2457T
acgcccauaaauacgucuuua

SEQ ID NO: 1949301 - RNA, 16 nt, Shigella flexneri 2a str. 2457T
acgcccaaugcccaga

SEQ ID NO: 1949302 - RNA, 12 nt, Shigella flexneri 2a str. 2457T
acgcccagcgca

SEQ ID NO: 1949303 - RNA, 22 nt, Shigella flexneri 2a str. 2457T
acgauauguucaggauauuuau

SEQ ID NO: 1949304 - RNA, 16 nt, Shigella flexneri 2a str. 2457T
acgccaugaagauggu

SEQ ID NO: 1949305 - RNA, 14 nt, Shigella flexneri 2a str. 2457T
acgccaucucuuua

SEQ ID NO: 1949306 - RNA, 17 nt, Shigella flexneri 2a str. 2457T
acgccauuaaccgugcg

SEQ ID NO: 1949307 - RNA, 15 nt, Shigella flexneri 2a str. 2457T
acgcccaaugcccag

SEQ ID NO: 1949308 - RNA, 17 nt, Shigella flexneri 2a str. 2457T
acgccuuccgucagcaa

SEQ ID NO: 1949309 - RNA, 22 nt, Shigella flexneri 2a str. 2457T
acgccuuugucgggcaggcuuc

SEQ ID NO: 1949310 - RNA, 19 nt, Shigella flexneri 2a str. 2457T
acgccuugcggaaauucca

SEQ ID NO: 1949311 - RNA, 23 nt, Shigella flexneri 2a str. 2457T
acgccguuuuuacccagcagcag

SEQ ID NO: 1949312 - RNA, 17 nt, Shigella flexneri 2a str. 2457T
acgccugauagcccgca

SEQ ID NO: 1949313 - RNA, 21 nt, Shigella flexneri 2a str. 2457T
acgccgccgcuucgcccaaau

SEQ ID NO: 1949314 - RNA, 22 nt, Shigella flexneri 2a str. 2457T
acgccgccggaaguauuucaau

SEQ ID NO: 1949315 - RNA, 15 nt, Shigella flexneri 2a str. 2457T
acgccgcccagagaa

SEQ ID NO: 1949316 - RNA, 14 nt, Shigella flexneri 2a str. 2457T
acgccgccgagcac

SEQ ID NO: 1949317 - RNA, 21 nt, Shigella flexneri 2a str. 2457T
acgccgcugucuaccagcacc

SEQ ID NO: 1949318 - RNA, 22 nt, Shigella flexneri 2a str. 2457T
acgccgcugucuaccagcaccu

SEQ ID NO: 1949319 - RNA, 20 nt, Shigella flexneri 2a str. 2457T
acgccgcugucuaccagcac

SEQ ID NO: 1949320 - RNA, 15 nt, Shigella flexneri 2a str. 2457T
acgccgcguuugcgc

SEQ ID NO: 1949321 - RNA, 17 nt, Shigella flexneri 2a str. 2457T
acgccgucaucacaccg

SEQ ID NO: 1949322 - RNA, 22 nt, Shigella flexneri 2a str. 2457T
acgccggugaccaucagcauga

SEQ ID NO: 1949323 - RNA, 18 nt, Shigella flexneri 2a str. 2457T
acgccgggaaauuuuucc

SEQ ID NO: 1949324 - RNA, 17 nt, Shigella flexneri 2a str. 2457T
acuguagugaucaaaca

SEQ ID NO: 1949325 - RNA, 14 nt, Shigella flexneri 2a str. 2457T
acuguaaaucugcc

SEQ ID NO: 1949326 - RNA, 22 nt, Shigella flexneri 2a str. 2457T
acuguaggccggauaaggcauu

SEQ ID NO: 1949327 - RNA, 16 nt, Shigella flexneri 2a str. 2457T
acuguagacaaaaugu

SEQ ID NO: 1949328 - RNA, 14 nt, Shigella flexneri 2a str. 2457T
acugucgcgcagca

SEQ ID NO: 1949329 - RNA, 18 nt, Shigella flexneri 2a str. 2457T
acugucgaacuggcagga

SEQ ID NO: 1949330 - RNA, 14 nt, Shigella flexneri 2a str. 2457T
acugucccauccac

SEQ ID NO: 1949331 - RNA, 18 nt, Shigella flexneri 2a str. 2457T
acugugggauugcuucag

SEQ ID NO: 1949332 - RNA, 17 nt, Shigella flexneri 2a str. 2457T
acugugggauugcuuca

SEQ ID NO: 1949333 - RNA, 13 nt, Shigella flexneri 2a str. 2457T
acuguuucacugu

SEQ ID NO: 1949334 - RNA, 21 nt, Shigella flexneri 2a str. 2457T
acuguuugacaacucaucacu

SEQ ID NO: 1949335 - RNA, 16 nt, Shigella flexneri 2a str. 2457T
acuguuuucuaacuca

SEQ ID NO: 1949336 - RNA, 18 nt, Shigella flexneri 2a str. 2457T
acuguuuucuaacucauu

SEQ ID NO: 1949337 - RNA, 12 nt, Shigella flexneri 2a str. 2457T
acuuaagucucc

SEQ ID NO: 1949338 - RNA, 15 nt, Shigella flexneri 2a str. 2457T
acuuaacuguaaauc

SEQ ID NO: 1949339 - RNA, 21 nt, Shigella flexneri 2a str. 2457T
acuuaauauugccguccggca

SEQ ID NO: 1949340 - RNA, 16 nt, Shigella flexneri 2a str. 2457T
acuuaauaaacaucag

SEQ ID NO: 1949341 - RNA, 20 nt, Shigella flexneri 2a str. 2457T
acuuaaugucauacacuuca

SEQ ID NO: 1949342 - RNA, 22 nt, Shigella flexneri 2a str. 2457T
acugggaaauuggccgacggau

SEQ ID NO: 1949343 - RNA, 19 nt, Shigella flexneri 2a str. 2457T
acugggaagaauggaaaaa

SEQ ID NO: 1949344 - RNA, 13 nt, Shigella flexneri 2a str. 2457T
acuggcuugguaa

SEQ ID NO: 1949345 - RNA, 16 nt, Shigella flexneri 2a str. 2457T
acuggcgcgagccugu

SEQ ID NO: 1949346 - RNA, 18 nt, Shigella flexneri 2a str. 2457T
acuggcgcgagccuguuu

SEQ ID NO: 1949347 - RNA, 16 nt, Shigella flexneri 2a str. 2457T
acuggcuacugucuaa

SEQ ID NO: 1949348 - RNA, 19 nt, Shigella flexneri 2a str. 2457T
acuggcggaugugcuggau

SEQ ID NO: 1949349 - RNA, 14 nt, Shigella flexneri 2a str. 2457T
acuggcuaagaagc

SEQ ID NO: 1949350 - RNA, 16 nt, Shigella flexneri 2a str. 2457T
acuggcgguuuucuuc

SEQ ID NO: 1949351 - RNA, 13 nt, Shigella flexneri 2a str. 2457T
acuggcgugggca

SEQ ID NO: 1949352 - RNA, 18 nt, Shigella flexneri 2a str. 2457T
acuggcuacugucuaaaa

SEQ ID NO: 1949353 - RNA, 16 nt, Shigella flexneri 2a str. 2457T
acugcuuacaggcugg

SEQ ID NO: 1949354 - RNA, 22 nt, Shigella flexneri 2a str. 2457T
acugcuuaucaucacgcaucac

SEQ ID NO: 1949355 - RNA, 13 nt, Shigella flexneri 2a str. 2457T
acugcuugaagcg

SEQ ID NO: 1949356 - RNA, 14 nt, Shigella flexneri 2a str. 2457T
acugcuugaagcgc

SEQ ID NO: 1949357 - RNA, 15 nt, Shigella flexneri 2a str. 2457T
acugcuugagcgggg

SEQ ID NO: 1949358 - RNA, 20 nt, Shigella flexneri 2a str. 2457T
acuggcaugcuguccagcag

SEQ ID NO: 1949359 - RNA, 17 nt, Shigella flexneri 2a str. 2457T
acuggccgaaaaaggau

SEQ ID NO: 1949360 - RNA, 18 nt, Shigella flexneri 2a str. 2457T
acugguggcaggaaaaca

SEQ ID NO: 1949361 - RNA, 17 nt, Shigella flexneri 2a str. 2457T
acugguggcaggaaaac

SEQ ID NO: 1949362 - RNA, 21 nt, Shigella flexneri 2a str. 2457T
acuggugacuuuugcccggca

SEQ ID NO: 1949363 - RNA, 13 nt, Shigella flexneri 2a str. 2457T
acuggugccauga

SEQ ID NO: 1949364 - RNA, 16 nt, Shigella flexneri 2a str. 2457T
acugggccgccuguuu

SEQ ID NO: 1949365 - RNA, 15 nt, Shigella flexneri 2a str. 2457T
acugggaugaaagug

SEQ ID NO: 1949366 - RNA, 13 nt, Shigella flexneri 2a str. 2457T
acugguagugcag

SEQ ID NO: 1949367 - RNA, 15 nt, Shigella flexneri 2a str. 2457T
acucguaagaggcgu

SEQ ID NO: 1949368 - RNA, 23 nt, Shigella flexneri 2a str. 2457T
acucuacugaaggcgcauugcug

SEQ ID NO: 1949369 - RNA, 21 nt, Shigella flexneri 2a str. 2457T
acucgugcgucgcauccggca

SEQ ID NO: 1949370 - RNA, 17 nt, Shigella flexneri 2a str. 2457T
acucucaccacgcucca

SEQ ID NO: 1949371 - RNA, 23 nt, Shigella flexneri 2a str. 2457T
acugaacaaaaaagaguaaaguu

SEQ ID NO: 1949372 - RNA, 13 nt, Shigella flexneri 2a str. 2457T
acugaacaaaaaa

SEQ ID NO: 1949373 - RNA, 14 nt, Shigella flexneri 2a str. 2457T
acugaccaccacca

SEQ ID NO: 1949374 - RNA, 15 nt, Shigella flexneri 2a str. 2457T
acugaccaccaccac

SEQ ID NO: 1949375 - RNA, 19 nt, Shigella flexneri 2a str. 2457T
acugaaugaucacuuguuc

SEQ ID NO: 1949376 - RNA, 18 nt, Shigella flexneri 2a str. 2457T
acugaauaugagucguaa

SEQ ID NO: 1949377 - RNA, 14 nt, Shigella flexneri 2a str. 2457T
acugacaauuugcc

SEQ ID NO: 1949378 - RNA, 19 nt, Shigella flexneri 2a str. 2457T
acugacacaggcagcaauc

SEQ ID NO: 1949379 - RNA, 16 nt, Shigella flexneri 2a str. 2457T
acugacauacagaucg

SEQ ID NO: 1949380 - RNA, 18 nt, Shigella flexneri 2a str. 2457T
acugaauugugaugguuu

SEQ ID NO: 1949381 - RNA, 20 nt, Shigella flexneri 2a str. 2457T
acugacgggaaacucugcug

SEQ ID NO: 1949382 - RNA, 18 nt, Shigella flexneri 2a str. 2457T
acugacgaaucaaauaaa

SEQ ID NO: 1949383 - RNA, 21 nt, Shigella flexneri 2a str. 2457T
acugacggaucccgccaacag

SEQ ID NO: 1949384 - RNA, 15 nt, Shigella flexneri 2a str. 2457T
acugaugacaaacgc

SEQ ID NO: 1949385 - RNA, 22 nt, Shigella flexneri 2a str. 2457T
acugaugacaaacacaaaacug

SEQ ID NO: 1949386 - RNA, 13 nt, Shigella flexneri 2a str. 2457T
acugauugaacug

SEQ ID NO: 1949387 - RNA, 18 nt, Shigella flexneri 2a str. 2457T
acugccaguucccccugc

SEQ ID NO: 1949388 - RNA, 14 nt, Shigella flexneri 2a str. 2457T
acugccaucuuccg

SEQ ID NO: 1949389 - RNA, 22 nt, Shigella flexneri 2a str. 2457T
acugccagaauagccgcagcca

SEQ ID NO: 1949390 - RNA, 13 nt, Shigella flexneri 2a str. 2457T
acugccagaauag

SEQ ID NO: 1949391 - RNA, 17 nt, Shigella flexneri 2a str. 2457T
acugccggaagagagca

SEQ ID NO: 1949392 - RNA, 15 nt, Shigella flexneri 2a str. 2457T
acugccguacagaca

SEQ ID NO: 1949393 - RNA, 16 nt, Shigella flexneri 2a str. 2457T
acugccguugcugccg

SEQ ID NO: 1949394 - RNA, 12 nt, Shigella flexneri 2a str. 2457T
acugcgugguga

SEQ ID NO: 1949395 - RNA, 21 nt, Shigella flexneri 2a str. 2457T
acugcgugucguaagccaccg

SEQ ID NO: 1949396 - RNA, 19 nt, Shigella flexneri 2a str. 2457T
acugcgugucguaagccac

SEQ ID NO: 1949397 - RNA, 17 nt, Shigella flexneri 2a str. 2457T
acugcuccauaauugcc

SEQ ID NO: 1949398 - RNA, 20 nt, Shigella flexneri 2a str. 2457T
acugcucagacggugaccag

SEQ ID NO: 1949399 - RNA, 19 nt, Shigella flexneri 2a str. 2457T
acugcucagcuccucuuuc

SEQ ID NO: 1949400 - RNA, 15 nt, Shigella flexneri 2a str. 2457T
acugcuuaacugcgc

SEQ ID NO: 1949401 - RNA, 14 nt, Shigella flexneri 2a str. 2457T
acugcuuaucauca

SEQ ID NO: 1949402 - RNA, 15 nt, Shigella flexneri 2a str. 2457T
acuccacuuccugcc

SEQ ID NO: 1949403 - RNA, 11 nt, Shigella flexneri 2a str. 2457T
acuccagcaga

SEQ ID NO: 1949404 - RNA, 11 nt, Shigella flexneri 2a str. 2457T
acuccagcccu

SEQ ID NO: 1949405 - RNA, 14 nt, Shigella flexneri 2a str. 2457T
acuccagccagagc

SEQ ID NO: 1949406 - RNA, 15 nt, Shigella flexneri 2a str. 2457T
acuccagccagagcc

SEQ ID NO: 1949407 - RNA, 20 nt, Shigella flexneri 2a str. 2457T
acuccagcuaucguuaucca

SEQ ID NO: 1949408 - RNA, 12 nt, Shigella flexneri 2a str. 2457T
acuccagcgcca

SEQ ID NO: 1949409 - RNA, 16 nt, Shigella flexneri 2a str. 2457T
acuccagucccaguuc

SEQ ID NO: 1949410 - RNA, 15 nt, Shigella flexneri 2a str. 2457T
acuccauccagcaac

SEQ ID NO: 1949411 - RNA, 16 nt, Shigella flexneri 2a str. 2457T
acuccauccagcaaca

SEQ ID NO: 1949412 - RNA, 17 nt, Shigella flexneri 2a str. 2457T
acuccauccagcaacaa

SEQ ID NO: 1949413 - RNA, 19 nt, Shigella flexneri 2a str. 2457T
acuccgccccggcaauaaa

SEQ ID NO: 1949414 - RNA, 21 nt, Shigella flexneri 2a str. 2457T
acuccgagaaucauaaauaca

SEQ ID NO: 1949415 - RNA, 12 nt, Shigella flexneri 2a str. 2457T
acucccagccuc

SEQ ID NO: 1949416 - RNA, 20 nt, Shigella flexneri 2a str. 2457T
acuccauccagcaacaacag

SEQ ID NO: 1949417 - RNA, 21 nt, Shigella flexneri 2a str. 2457T
acuccauccagcaacaacagc

SEQ ID NO: 1949418 - RNA, 16 nt, Shigella flexneri 2a str. 2457T
acucgccgcuguggau

SEQ ID NO: 1949419 - RNA, 24 nt, Shigella flexneri 2a str. 2457T
acucgccccgagaaaaauagcauu

SEQ ID NO: 1949420 - RNA, 22 nt, Shigella flexneri 2a str. 2457T
acucgaugcugccgucuucguu

SEQ ID NO: 1949421 - RNA, 20 nt, Shigella flexneri 2a str. 2457T
acuccugccaccacugcaau

SEQ ID NO: 1949422 - RNA, 12 nt, Shigella flexneri 2a str. 2457T
acuccuggagcg

SEQ ID NO: 1949423 - RNA, 23 nt, Shigella flexneri 2a str. 2457T
acuccggaaaaacggaggcccgc

SEQ ID NO: 1949424 - RNA, 14 nt, Shigella flexneri 2a str. 2457T
acuccaccagcacc

SEQ ID NO: 1949425 - RNA, 12 nt, Shigella flexneri 2a str. 2457T
acuccagaauac

SEQ ID NO: 1949426 - RNA, 13 nt, Shigella flexneri 2a str. 2457T
acucauuuacaga

SEQ ID NO: 1949427 - RNA, 14 nt, Shigella flexneri 2a str. 2457T
acucauuuuuuaau

SEQ ID NO: 1949428 - RNA, 15 nt, Shigella flexneri 2a str. 2457T
acuccaacuuacuga

SEQ ID NO: 1949429 - RNA, 14 nt, Shigella flexneri 2a str. 2457T
acuccaacccggca

SEQ ID NO: 1949430 - RNA, 17 nt, Shigella flexneri 2a str. 2457T
acucaucuuauugauca

SEQ ID NO: 1949431 - RNA, 20 nt, Shigella flexneri 2a str. 2457T
acucaucuuauugaucaucc

SEQ ID NO: 1949432 - RNA, 12 nt, Shigella flexneri 2a str. 2457T
acucauugccag

SEQ ID NO: 1949433 - RNA, 17 nt, Shigella flexneri 2a str. 2457T
acucaucacuguaggcc

SEQ ID NO: 1949434 - RNA, 15 nt, Shigella flexneri 2a str. 2457T
acucauccacugccu

SEQ ID NO: 1949435 - RNA, 18 nt, Shigella flexneri 2a str. 2457T
acucauaugcagcaucca

SEQ ID NO: 1949436 - RNA, 23 nt, Shigella flexneri 2a str. 2457T
acucaucaacguuuuuuugcuuu

SEQ ID NO: 1949437 - RNA, 16 nt, Shigella flexneri 2a str. 2457T
acucauaaauacucca

SEQ ID NO: 1949438 - RNA, 19 nt, Shigella flexneri 2a str. 2457T
acucauaaauucaaagugu

SEQ ID NO: 1949439 - RNA, 12 nt, Shigella flexneri 2a str. 2457T
acucagcgcugc

SEQ ID NO: 1949440 - RNA, 18 nt, Shigella flexneri 2a str. 2457T
acuaucgcugagauacuc

SEQ ID NO: 1949441 - RNA, 17 nt, Shigella flexneri 2a str. 2457T
acuaucaggcaaaaaaa

SEQ ID NO: 1949442 - RNA, 23 nt, Shigella flexneri 2a str. 2457T
acuacucuauacaggauaauuag

SEQ ID NO: 1949443 - RNA, 20 nt, Shigella flexneri 2a str. 2457T
acuacgguguaaccugccug

SEQ ID NO: 1949444 - RNA, 14 nt, Shigella flexneri 2a str. 2457T
acuacguucaauca

SEQ ID NO: 1949445 - RNA, 14 nt, Shigella flexneri 2a str. 2457T
acuacguagaucau

SEQ ID NO: 1949446 - RNA, 21 nt, Shigella flexneri 2a str. 2457T
acuacgugaucgucuucaacc

SEQ ID NO: 1949447 - RNA, 19 nt, Shigella flexneri 2a str. 2457T
acguucaucgggcauugca

SEQ ID NO: 1949448 - RNA, 16 nt, Shigella flexneri 2a str. 2457T
acguuaccggguguuc

SEQ ID NO: 1949449 - RNA, 13 nt, Shigella flexneri 2a str. 2457T
acguucgcccacu

SEQ ID NO: 1949450 - RNA, 12 nt, Shigella flexneri 2a str. 2457T
acguuccuuucu

SEQ ID NO: 1949451 - RNA, 19 nt, Shigella flexneri 2a str. 2457T
acguucucuuucaggccgc

SEQ ID NO: 1949452 - RNA, 14 nt, Shigella flexneri 2a str. 2457T
acucaaacagggca

SEQ ID NO: 1949453 - RNA, 16 nt, Shigella flexneri 2a str. 2457T
acuauuaaagaaagua

SEQ ID NO: 1949454 - RNA, 19 nt, Shigella flexneri 2a str. 2457T
acuaugacugccacaaggg

SEQ ID NO: 1949455 - RNA, 21 nt, Shigella flexneri 2a str. 2457T
acucaauaccugaugagaugc

SEQ ID NO: 1949456 - RNA, 17 nt, Shigella flexneri 2a str. 2457T
acucaacaaccagaagg

SEQ ID NO: 1949457 - RNA, 14 nt, Shigella flexneri 2a str. 2457T
acucaaccccagcc

SEQ ID NO: 1949458 - RNA, 16 nt, Shigella flexneri 2a str. 2457T
acucaaccccagccau

SEQ ID NO: 1949459 - RNA, 22 nt, Shigella flexneri 2a str. 2457T
acucaccugcuuuacccagcca

SEQ ID NO: 1949460 - RNA, 13 nt, Shigella flexneri 2a str. 2457T
acucaccuuuaaa

SEQ ID NO: 1949461 - RNA, 18 nt, Shigella flexneri 2a str. 2457T
acucaccgggcaucucag

SEQ ID NO: 1949462 - RNA, 17 nt, Shigella flexneri 2a str. 2457T
acucaccgagcagcaca

SEQ ID NO: 1949463 - RNA, 15 nt, Shigella flexneri 2a str. 2457T
acucacgccagcagc

SEQ ID NO: 1949464 - RNA, 19 nt, Shigella flexneri 2a str. 2457T
acucacgccguuaacuuca

SEQ ID NO: 1949465 - RNA, 21 nt, Shigella flexneri 2a str. 2457T
acucaccuuuuuuguuguuau

SEQ ID NO: 1949466 - RNA, 17 nt, Shigella flexneri 2a str. 2457T
acucaacuuuaccuuca

SEQ ID NO: 1949467 - RNA, 20 nt, Shigella flexneri 2a str. 2457T
agcaagauaguuaaucaaua

SEQ ID NO: 1949468 - RNA, 22 nt, Shigella flexneri 2a str. 2457T
agcaagugcggcgcaccagcag

SEQ ID NO: 1949469 - RNA, 18 nt, Shigella flexneri 2a str. 2457T
agcaagucggcaucgcca

SEQ ID NO: 1949470 - RNA, 19 nt, Shigella flexneri 2a str. 2457T
agcaagucggcaucgccac

SEQ ID NO: 1949471 - RNA, 15 nt, Shigella flexneri 2a str. 2457T
agcaaggaaaaccag

SEQ ID NO: 1949472 - RNA, 17 nt, Shigella flexneri 2a str. 2457T
agauuauaagccaguaa

SEQ ID NO: 1949473 - RNA, 13 nt, Shigella flexneri 2a str. 2457T
agcaacgcggcgg

SEQ ID NO: 1949474 - RNA, 23 nt, Shigella flexneri 2a str. 2457T
agcaacgccaaauuuaaacgaca

SEQ ID NO: 1949475 - RNA, 13 nt, Shigella flexneri 2a str. 2457T
agcaacgccaaau

SEQ ID NO: 1949476 - RNA, 17 nt, Shigella flexneri 2a str. 2457T
agcaacugacugacuuc

SEQ ID NO: 1949477 - RNA, 20 nt, Shigella flexneri 2a str. 2457T
agcaacugcgacguggauca

SEQ ID NO: 1949478 - RNA, 13 nt, Shigella flexneri 2a str. 2457T
agcaacugacugg

SEQ ID NO: 1949479 - RNA, 11 nt, Shigella flexneri 2a str. 2457T
agcaacugcgc

SEQ ID NO: 1949480 - RNA, 16 nt, Shigella flexneri 2a str. 2457T
agcaacuuaaucauca

SEQ ID NO: 1949481 - RNA, 19 nt, Shigella flexneri 2a str. 2457T
agcaacuuaaucaucaaug

SEQ ID NO: 1949482 - RNA, 14 nt, Shigella flexneri 2a str. 2457T
agcaauaaugccag

SEQ ID NO: 1949483 - RNA, 16 nt, Shigella flexneri 2a str. 2457T
agcaauaauuucaaca

SEQ ID NO: 1949484 - RNA, 16 nt, Shigella flexneri 2a str. 2457T
agcaauagacaguucu

SEQ ID NO: 1949485 - RNA, 20 nt, Shigella flexneri 2a str. 2457T
agcaauagacaguucuuccu

SEQ ID NO: 1949486 - RNA, 19 nt, Shigella flexneri 2a str. 2457T
agcaagugaauaaauuuua

SEQ ID NO: 1949487 - RNA, 21 nt, Shigella flexneri 2a str. 2457T
agcaauaaucucuuuacccag

SEQ ID NO: 1949488 - RNA, 20 nt, Shigella flexneri 2a str. 2457T
agcaaucaucccaguggaua

SEQ ID NO: 1949489 - RNA, 12 nt, Shigella flexneri 2a str. 2457T
agcaaucaccag

SEQ ID NO: 1949490 - RNA, 19 nt, Shigella flexneri 2a str. 2457T
agcaaucaccagauguccc

SEQ ID NO: 1949491 - RNA, 20 nt, Shigella flexneri 2a str. 2457T
agcaaucucuucaagcugcu

SEQ ID NO: 1949492 - RNA, 22 nt, Shigella flexneri 2a str. 2457T
agcaaucugauugacaucauuu

SEQ ID NO: 1949493 - RNA, 16 nt, Shigella flexneri 2a str. 2457T
agcaauccugcaugua

SEQ ID NO: 1949494 - RNA, 22 nt, Shigella flexneri 2a str. 2457T
agcaaucgaccaggccaucagc

SEQ ID NO: 1949495 - RNA, 22 nt, Shigella flexneri 2a str. 2457T
agcaaucggcuuuuuaugacgc

SEQ ID NO: 1949496 - RNA, 19 nt, Shigella flexneri 2a str. 2457T
agcaaugaucucaauaguu

SEQ ID NO: 1949497 - RNA, 17 nt, Shigella flexneri 2a str. 2457T
agcaaugcgcaucaaag

SEQ ID NO: 1949498 - RNA, 21 nt, Shigella flexneri 2a str. 2457T
agcaauuugcgcucaauaauc

SEQ ID NO: 1949499 - RNA, 15 nt, Shigella flexneri 2a str. 2457T
agcaauuucuccgcc

SEQ ID NO: 1949500 - RNA, 14 nt, Shigella flexneri 2a str. 2457T
agcaauuucuccgc

SEQ ID NO: 1949501 - RNA, 16 nt, Shigella flexneri 2a str. 2457T
agcaauggcacugucg

SEQ ID NO: 1949502 - RNA, 20 nt, Shigella flexneri 2a str. 2457T
agcaauggcacugucgagau

SEQ ID NO: 1949503 - RNA, 17 nt, Shigella flexneri 2a str. 2457T
agcaauguaaggugcau

SEQ ID NO: 1949504 - RNA, 19 nt, Shigella flexneri 2a str. 2457T
agcaauguuucucuggcgc

SEQ ID NO: 1949505 - RNA, 17 nt, Shigella flexneri 2a str. 2457T
agcaauuuuuccugguu

SEQ ID NO: 1949506 - RNA, 20 nt, Shigella flexneri 2a str. 2457T
agcacaaacauccaucugcu

SEQ ID NO: 1949507 - RNA, 21 nt, Shigella flexneri 2a str. 2457T
agcacaaaguggcggcuaccc

SEQ ID NO: 1949508 - RNA, 14 nt, Shigella flexneri 2a str. 2457T
agcagaaccgccau

SEQ ID NO: 1949509 - RNA, 16 nt, Shigella flexneri 2a str. 2457T
agcagaccagcaauaa

SEQ ID NO: 1949510 - RNA, 15 nt, Shigella flexneri 2a str. 2457T
aaaaccgggugcaga

SEQ ID NO: 1949511 - RNA, 18 nt, Shigella flexneri 2a str. 2457T
aaaaccgggugcagagcc

SEQ ID NO: 1949512 - RNA, 18 nt, Shigella flexneri 2a str. 2457T
agcacugcgcccgccagc

SEQ ID NO: 1949513 - RNA, 12 nt, Shigella flexneri 2a str. 2457T
agcacuggggcu

SEQ ID NO: 1949514 - RNA, 18 nt, Shigella flexneri 2a str. 2457T
agcacuggcggcagcagg

SEQ ID NO: 1949515 - RNA, 17 nt, Shigella flexneri 2a str. 2457T
agcacuucacugacauu

SEQ ID NO: 1949516 - RNA, 16 nt, Shigella flexneri 2a str. 2457T
agcacgccuggaaagu

SEQ ID NO: 1949517 - RNA, 13 nt, Shigella flexneri 2a str. 2457T
agcacgccagaca

SEQ ID NO: 1949518 - RNA, 17 nt, Shigella flexneri 2a str. 2457T
agcacgccccggcggcc

SEQ ID NO: 1949519 - RNA, 18 nt, Shigella flexneri 2a str. 2457T
agcacgauuuuguaggcc

SEQ ID NO: 1949520 - RNA, 18 nt, Shigella flexneri 2a str. 2457T
agcacggauaccgcacgc

SEQ ID NO: 1949521 - RNA, 15 nt, Shigella flexneri 2a str. 2457T
agcacggcagcaacg

SEQ ID NO: 1949522 - RNA, 14 nt, Shigella flexneri 2a str. 2457T
agcacgacuauuau

SEQ ID NO: 1949523 - RNA, 19 nt, Shigella flexneri 2a str. 2457T
agcaccggacuauccgccg

SEQ ID NO: 1949524 - RNA, 17 nt, Shigella flexneri 2a str. 2457T
agcaccgcgacaaucag

SEQ ID NO: 1949525 - RNA, 23 nt, Shigella flexneri 2a str. 2457T
agcacaucuggcgagucaccaua

SEQ ID NO: 1949526 - RNA, 20 nt, Shigella flexneri 2a str. 2457T
agcacaucuggcgagucacc

SEQ ID NO: 1949527 - RNA, 14 nt, Shigella flexneri 2a str. 2457T
agcacaugcugaca

SEQ ID NO: 1949528 - RNA, 15 nt, Shigella flexneri 2a str. 2457T
agcacaugcugacau

SEQ ID NO: 1949529 - RNA, 13 nt, Shigella flexneri 2a str. 2457T
agcacauuucaga

SEQ ID NO: 1949530 - RNA, 22 nt, Shigella flexneri 2a str. 2457T
agcacacugguucccaacaaca

SEQ ID NO: 1949531 - RNA, 23 nt, Shigella flexneri 2a str. 2457T
agcacacugguucccaacaacag

SEQ ID NO: 1949532 - RNA, 21 nt, Shigella flexneri 2a str. 2457T
agcacaucacucauaaugaug

SEQ ID NO: 1949533 - RNA, 14 nt, Shigella flexneri 2a str. 2457T
agcacaucagccag

SEQ ID NO: 1949534 - RNA, 18 nt, Shigella flexneri 2a str. 2457T
agcacaucaucaaagcca

SEQ ID NO: 1949535 - RNA, 16 nt, Shigella flexneri 2a str. 2457T
agcacaucaucaaagc

SEQ ID NO: 1949536 - RNA, 15 nt, Shigella flexneri 2a str. 2457T
agcacccagcaaucc

SEQ ID NO: 1949537 - RNA, 20 nt, Shigella flexneri 2a str. 2457T
agcacccugaguuuucagua

SEQ ID NO: 1949538 - RNA, 13 nt, Shigella flexneri 2a str. 2457T
agcaccagcaacg

SEQ ID NO: 1949539 - RNA, 19 nt, Shigella flexneri 2a str. 2457T
agcaccagauaaugagaaa

SEQ ID NO: 1949540 - RNA, 17 nt, Shigella flexneri 2a str. 2457T
agccaaaacugcacugg

SEQ ID NO: 1949541 - RNA, 20 nt, Shigella flexneri 2a str. 2457T
agcauuuccuuaaaagugag

SEQ ID NO: 1949542 - RNA, 18 nt, Shigella flexneri 2a str. 2457T
agcauuucuuccagcguu

SEQ ID NO: 1949543 - RNA, 18 nt, Shigella flexneri 2a str. 2457T
agcauugcgccugcaggu

SEQ ID NO: 1949544 - RNA, 12 nt, Shigella flexneri 2a str. 2457T
agcauucaguua

SEQ ID NO: 1949545 - RNA, 17 nt, Shigella flexneri 2a str. 2457T
agcauuggcaugcacgu

SEQ ID NO: 1949546 - RNA, 16 nt, Shigella flexneri 2a str. 2457T
agcaucuuaucacgau

SEQ ID NO: 1949547 - RNA, 23 nt, Shigella flexneri 2a str. 2457T
agcauggcuucuuccccggauga

SEQ ID NO: 1949548 - RNA, 16 nt, Shigella flexneri 2a str. 2457T
agcaucucauccauca

SEQ ID NO: 1949549 - RNA, 14 nt, Shigella flexneri 2a str. 2457T
agcaucgcaacaug

SEQ ID NO: 1949550 - RNA, 22 nt, Shigella flexneri 2a str. 2457T
agcaucuacucguuuauuaugc

SEQ ID NO: 1949551 - RNA, 16 nt, Shigella flexneri 2a str. 2457T
agcauuaaugcgccca

SEQ ID NO: 1949552 - RNA, 17 nt, Shigella flexneri 2a str. 2457T
agcauuaaggcaagaaa

SEQ ID NO: 1949553 - RNA, 13 nt, Shigella flexneri 2a str. 2457T
agcauuauuuuua

SEQ ID NO: 1949554 - RNA, 18 nt, Shigella flexneri 2a str. 2457T
agcauuauuuuuaaacau

SEQ ID NO: 1949555 - RNA, 20 nt, Shigella flexneri 2a str. 2457T
agcauuauuuuuaaacauca

SEQ ID NO: 1949556 - RNA, 18 nt, Shigella flexneri 2a str. 2457T
agccacggcuccagcaau

SEQ ID NO: 1949557 - RNA, 16 nt, Shigella flexneri 2a str. 2457T
agccacggcuccagca

SEQ ID NO: 1949558 - RNA, 16 nt, Shigella flexneri 2a str. 2457T
agccaccacuugcagc

SEQ ID NO: 1949559 - RNA, 22 nt, Shigella flexneri 2a str. 2457T
agccacauuugcggcgaacugc

SEQ ID NO: 1949560 - RNA, 23 nt, Shigella flexneri 2a str. 2457T
agccacaggcuuuccugauaauc

SEQ ID NO: 1949561 - RNA, 18 nt, Shigella flexneri 2a str. 2457T
agccaccacaauugacca

SEQ ID NO: 1949562 - RNA, 12 nt, Shigella flexneri 2a str. 2457T
agccagccaacg

SEQ ID NO: 1949563 - RNA, 12 nt, Shigella flexneri 2a str. 2457T
agccagccaagc

SEQ ID NO: 1949564 - RNA, 12 nt, Shigella flexneri 2a str. 2457T
agccagccagaa

SEQ ID NO: 1949565 - RNA, 18 nt, Shigella flexneri 2a str. 2457T
agccagccguugcccgua

SEQ ID NO: 1949566 - RNA, 15 nt, Shigella flexneri 2a str. 2457T
agccagcagcgaauc

SEQ ID NO: 1949567 - RNA, 17 nt, Shigella flexneri 2a str. 2457T
agccagcagagcaaaaa

SEQ ID NO: 1949568 - RNA, 19 nt, Shigella flexneri 2a str. 2457T
agccagcagcgaaucagcc

SEQ ID NO: 1949569 - RNA, 14 nt, Shigella flexneri 2a str. 2457T
agccagaaagaacc

SEQ ID NO: 1949570 - RNA, 20 nt, Shigella flexneri 2a str. 2457T
agccaaacgcccagcuaauc

SEQ ID NO: 1949571 - RNA, 19 nt, Shigella flexneri 2a str. 2457T
agccaaauccagcgccaca

SEQ ID NO: 1949572 - RNA, 16 nt, Shigella flexneri 2a str. 2457T
agccaaauccagcgca

SEQ ID NO: 1949573 - RNA, 16 nt, Shigella flexneri 2a str. 2457T
agccacagggugauca

SEQ ID NO: 1949574 - RNA, 15 nt, Shigella flexneri 2a str. 2457T
agccacaccuggugc

SEQ ID NO: 1949575 - RNA, 12 nt, Shigella flexneri 2a str. 2457T
agccacaauaaa

SEQ ID NO: 1949576 - RNA, 17 nt, Shigella flexneri 2a str. 2457T
agccacaauaaacgcgc

SEQ ID NO: 1949577 - RNA, 20 nt, Shigella flexneri 2a str. 2457T
agccaaucccggaagccacc

SEQ ID NO: 1949578 - RNA, 16 nt, Shigella flexneri 2a str. 2457T
agccaaucccggaagc

SEQ ID NO: 1949579 - RNA, 13 nt, Shigella flexneri 2a str. 2457T
agccaaugcaggc

SEQ ID NO: 1949580 - RNA, 14 nt, Shigella flexneri 2a str. 2457T
agcaguuccagcau

SEQ ID NO: 1949581 - RNA, 22 nt, Shigella flexneri 2a str. 2457T
agcagguccccgagcacaugca

SEQ ID NO: 1949582 - RNA, 13 nt, Shigella flexneri 2a str. 2457T
agcauaaaaauau

SEQ ID NO: 1949583 - RNA, 22 nt, Shigella flexneri 2a str. 2457T
agcaguucuacuggaauuucau

SEQ ID NO: 1949584 - RNA, 22 nt, Shigella flexneri 2a str. 2457T
agcaguucguaauuaagcccgg

SEQ ID NO: 1949585 - RNA, 23 nt, Shigella flexneri 2a str. 2457T
agcaucccguuaugguuauccac

SEQ ID NO: 1949586 - RNA, 21 nt, Shigella flexneri 2a str. 2457T
agcauccccggcaaccacacc

SEQ ID NO: 1949587 - RNA, 16 nt, Shigella flexneri 2a str. 2457T
agcaucaugaauauau

SEQ ID NO: 1949588 - RNA, 16 nt, Shigella flexneri 2a str. 2457T
agcaucccaccugaaa

SEQ ID NO: 1949589 - RNA, 13 nt, Shigella flexneri 2a str. 2457T
agcaucaauaacc

SEQ ID NO: 1949590 - RNA, 17 nt, Shigella flexneri 2a str. 2457T
agcaucaaacuuuuaaa

SEQ ID NO: 1949591 - RNA, 14 nt, Shigella flexneri 2a str. 2457T
agcauauugcaggc

SEQ ID NO: 1949592 - RNA, 15 nt, Shigella flexneri 2a str. 2457T
agcaucaaacuuuua

SEQ ID NO: 1949593 - RNA, 21 nt, Shigella flexneri 2a str. 2457T
agcaucaacaacaauuucacu

SEQ ID NO: 1949594 - RNA, 18 nt, Shigella flexneri 2a str. 2457T
agcauauuuagguaauga

SEQ ID NO: 1949595 - RNA, 14 nt, Shigella flexneri 2a str. 2457T
agcauaaucaccag

SEQ ID NO: 1949596 - RNA, 18 nt, Shigella flexneri 2a str. 2457T
agcauaaucaccaucagc

SEQ ID NO: 1949597 - RNA, 17 nt, Shigella flexneri 2a str. 2457T
agcagggcaaacagcac

SEQ ID NO: 1949598 - RNA, 14 nt, Shigella flexneri 2a str. 2457T
agcagggcaaacag

SEQ ID NO: 1949599 - RNA, 17 nt, Shigella flexneri 2a str. 2457T
agcagcuuucagcagcg

SEQ ID NO: 1949600 - RNA, 14 nt, Shigella flexneri 2a str. 2457T
agcagcuguagggu

SEQ ID NO: 1949601 - RNA, 22 nt, Shigella flexneri 2a str. 2457T
agcagcgccaacggugaaaaac

SEQ ID NO: 1949602 - RNA, 16 nt, Shigella flexneri 2a str. 2457T
agcagcugaccgccgu

SEQ ID NO: 1949603 - RNA, 15 nt, Shigella flexneri 2a str. 2457T
agcagcgcaauuaac

SEQ ID NO: 1949604 - RNA, 19 nt, Shigella flexneri 2a str. 2457T
agcagcgaaucagcccagc

SEQ ID NO: 1949605 - RNA, 23 nt, Shigella flexneri 2a str. 2457T
agcagacgcuccauugcccgccc

SEQ ID NO: 1949606 - RNA, 18 nt, Shigella flexneri 2a str. 2457T
agcagacgcuccauugcc

SEQ ID NO: 1949607 - RNA, 13 nt, Shigella flexneri 2a str. 2457T
agcagccgguauc

SEQ ID NO: 1949608 - RNA, 15 nt, Shigella flexneri 2a str. 2457T
aaaaccugacaacaa

SEQ ID NO: 1949609 - RNA, 13 nt, Shigella flexneri 2a str. 2457T
agcgcgcugacau

SEQ ID NO: 1949610 - RNA, 15 nt, Shigella flexneri 2a str. 2457T
agcgccgccucagcc

SEQ ID NO: 1949611 - RNA, 20 nt, Shigella flexneri 2a str. 2457T
agcgccgcuuuuugugcgga

SEQ ID NO: 1949612 - RNA, 16 nt, Shigella flexneri 2a str. 2457T
agcgcgaggguaaaca

SEQ ID NO: 1949613 - RNA, 16 nt, Shigella flexneri 2a str. 2457T
agcgcccgccagcacc

SEQ ID NO: 1949614 - RNA, 16 nt, Shigella flexneri 2a str. 2457T
agcgccacgcaacaga

SEQ ID NO: 1949615 - RNA, 19 nt, Shigella flexneri 2a str. 2457T
agcgccaccgucagugcga

SEQ ID NO: 1949616 - RNA, 14 nt, Shigella flexneri 2a str. 2457T
agcgccaccgguuu

SEQ ID NO: 1949617 - RNA, 21 nt, Shigella flexneri 2a str. 2457T
agcgccaccgguuuauuauug

SEQ ID NO: 1949618 - RNA, 20 nt, Shigella flexneri 2a str. 2457T
agcgccaccacaaaagcggu

SEQ ID NO: 1949619 - RNA, 17 nt, Shigella flexneri 2a str. 2457T
agcgccaccaccagcac

SEQ ID NO: 1949620 - RNA, 15 nt, Shigella flexneri 2a str. 2457T
agcgcagucaccagc

SEQ ID NO: 1949621 - RNA, 12 nt, Shigella flexneri 2a str. 2457T
agcgcagugaca

SEQ ID NO: 1949622 - RNA, 20 nt, Shigella flexneri 2a str. 2457T
agcgcagugacauucaccuc

SEQ ID NO: 1949623 - RNA, 21 nt, Shigella flexneri 2a str. 2457T
agcgcacuuugucaucagucu

SEQ ID NO: 1949624 - RNA, 15 nt, Shigella flexneri 2a str. 2457T
agcgcagcagcgcgc

SEQ ID NO: 1949625 - RNA, 24 nt, Shigella flexneri 2a str. 2457T
agcgcaggaaagauaagcgaacau

SEQ ID NO: 1949626 - RNA, 18 nt, Shigella flexneri 2a str. 2457T
agcgaccauacagcagca

SEQ ID NO: 1949627 - RNA, 17 nt, Shigella flexneri 2a str. 2457T
agcgguaaaauggucag

SEQ ID NO: 1949628 - RNA, 21 nt, Shigella flexneri 2a str. 2457T
agcggguuuuuacguuauuug

SEQ ID NO: 1949629 - RNA, 22 nt, Shigella flexneri 2a str. 2457T
agcggcgcgcauucuggagcug

SEQ ID NO: 1949630 - RNA, 18 nt, Shigella flexneri 2a str. 2457T
agcggccuuuuccuuuca

SEQ ID NO: 1949631 - RNA, 19 nt, Shigella flexneri 2a str. 2457T
agcguacaauagccacauu

SEQ ID NO: 1949632 - RNA, 15 nt, Shigella flexneri 2a str. 2457T
agcgguggugacugg

SEQ ID NO: 1949633 - RNA, 19 nt, Shigella flexneri 2a str. 2457T
agcggugaaaaaauuaaac

SEQ ID NO: 1949634 - RNA, 18 nt, Shigella flexneri 2a str. 2457T
agcguacggcaugcguuc

SEQ ID NO: 1949635 - RNA, 16 nt, Shigella flexneri 2a str. 2457T
agcguauccagcauac

SEQ ID NO: 1949636 - RNA, 18 nt, Shigella flexneri 2a str. 2457T
agcguauucgugacaaua

SEQ ID NO: 1949637 - RNA, 20 nt, Shigella flexneri 2a str. 2457T
agcguauucgugacaauauc

SEQ ID NO: 1949638 - RNA, 20 nt, Shigella flexneri 2a str. 2457T
agcgcugaagaaaauggcca

SEQ ID NO: 1949639 - RNA, 19 nt, Shigella flexneri 2a str. 2457T
agcgcugcugcacauacug

SEQ ID NO: 1949640 - RNA, 20 nt, Shigella flexneri 2a str. 2457T
agcgcugcggcgcgcaucuu

SEQ ID NO: 1949641 - RNA, 19 nt, Shigella flexneri 2a str. 2457T
agcgcuggugacaucgcca

SEQ ID NO: 1949642 - RNA, 23 nt, Shigella flexneri 2a str. 2457T
agcgcuggugacaucgccagaga

SEQ ID NO: 1949643 - RNA, 15 nt, Shigella flexneri 2a str. 2457T
agcgcuuuuuuccug

SEQ ID NO: 1949644 - RNA, 20 nt, Shigella flexneri 2a str. 2457T
agcgcuuuugcuacuuuuuu

SEQ ID NO: 1949645 - RNA, 16 nt, Shigella flexneri 2a str. 2457T
agcggaauauuuuuac

SEQ ID NO: 1949646 - RNA, 14 nt, Shigella flexneri 2a str. 2457T
agcggacaaugccu

SEQ ID NO: 1949647 - RNA, 17 nt, Shigella flexneri 2a str. 2457T
agcgcuuuuuuccugcc

SEQ ID NO: 1949648 - RNA, 13 nt, Shigella flexneri 2a str. 2457T
agcggaaaucacg

SEQ ID NO: 1949649 - RNA, 15 nt, Shigella flexneri 2a str. 2457T
agcggaucaagaaag

SEQ ID NO: 1949650 - RNA, 21 nt, Shigella flexneri 2a str. 2457T
agcggacucaccgagcagcac

SEQ ID NO: 1949651 - RNA, 23 nt, Shigella flexneri 2a str. 2457T
agcggcaggccguggaucacauc

SEQ ID NO: 1949652 - RNA, 13 nt, Shigella flexneri 2a str. 2457T
agcggcaggccgu

SEQ ID NO: 1949653 - RNA, 13 nt, Shigella flexneri 2a str. 2457T
agccgggaagaau

SEQ ID NO: 1949654 - RNA, 17 nt, Shigella flexneri 2a str. 2457T
agccggugcuugcaccg

SEQ ID NO: 1949655 - RNA, 23 nt, Shigella flexneri 2a str. 2457T
agccgguugccugaugcgacgcu

SEQ ID NO: 1949656 - RNA, 12 nt, Shigella flexneri 2a str. 2457T
agccgguuuugg

SEQ ID NO: 1949657 - RNA, 21 nt, Shigella flexneri 2a str. 2457T
agccgguuuugguuuucuguc

SEQ ID NO: 1949658 - RNA, 19 nt, Shigella flexneri 2a str. 2457T
agccguacugcauaaugcc

SEQ ID NO: 1949659 - RNA, 18 nt, Shigella flexneri 2a str. 2457T
agccuaccagaccgcaca

SEQ ID NO: 1949660 - RNA, 23 nt, Shigella flexneri 2a str. 2457T
agccguuucgaauuacacagcca

SEQ ID NO: 1949661 - RNA, 22 nt, Shigella flexneri 2a str. 2457T
agccgugaaaacagcaaccucc

SEQ ID NO: 1949662 - RNA, 16 nt, Shigella flexneri 2a str. 2457T
agccgugaaucacucc

SEQ ID NO: 1949663 - RNA, 18 nt, Shigella flexneri 2a str. 2457T
agccgugaaucacuccau

SEQ ID NO: 1949664 - RNA, 15 nt, Shigella flexneri 2a str. 2457T
agcgaaggaucaccc

SEQ ID NO: 1949665 - RNA, 15 nt, Shigella flexneri 2a str. 2457T
agcgaagcccacgcc

SEQ ID NO: 1949666 - RNA, 16 nt, Shigella flexneri 2a str. 2457T
agcgaagcgaacaucg

SEQ ID NO: 1949667 - RNA, 17 nt, Shigella flexneri 2a str. 2457T
agcgaagcgaacaucga

SEQ ID NO: 1949668 - RNA, 21 nt, Shigella flexneri 2a str. 2457T
agcgaacaggaguagcucugg

SEQ ID NO: 1949669 - RNA, 14 nt, Shigella flexneri 2a str. 2457T
agcgaaaucgccuu

SEQ ID NO: 1949670 - RNA, 22 nt, Shigella flexneri 2a str. 2457T
agccuucgcgcaaccaacggcc

SEQ ID NO: 1949671 - RNA, 21 nt, Shigella flexneri 2a str. 2457T
agccuucggacguuugccaug

SEQ ID NO: 1949672 - RNA, 22 nt, Shigella flexneri 2a str. 2457T
agccuucgggcuggcauuuuuu

SEQ ID NO: 1949673 - RNA, 15 nt, Shigella flexneri 2a str. 2457T
agccugaaaacgaaa

SEQ ID NO: 1949674 - RNA, 14 nt, Shigella flexneri 2a str. 2457T
agccucccauuucc

SEQ ID NO: 1949675 - RNA, 17 nt, Shigella flexneri 2a str. 2457T
agccgcgccgagcggga

SEQ ID NO: 1949676 - RNA, 22 nt, Shigella flexneri 2a str. 2457T
agccgcccccgacuccagcagu

SEQ ID NO: 1949677 - RNA, 23 nt, Shigella flexneri 2a str. 2457T
agccgccgagcaaaccacaggcc

SEQ ID NO: 1949678 - RNA, 15 nt, Shigella flexneri 2a str. 2457T
agccgcgugcgcugg

SEQ ID NO: 1949679 - RNA, 16 nt, Shigella flexneri 2a str. 2457T
agccggaccucuuucu

SEQ ID NO: 1949680 - RNA, 14 nt, Shigella flexneri 2a str. 2457T
agccggaauuuucc

SEQ ID NO: 1949681 - RNA, 21 nt, Shigella flexneri 2a str. 2457T
agccggaaaaccaccacuccc

SEQ ID NO: 1949682 - RNA, 14 nt, Shigella flexneri 2a str. 2457T
agccgcuucugcag

SEQ ID NO: 1949683 - RNA, 17 nt, Shigella flexneri 2a str. 2457T
agccggauaaacaaugu

SEQ ID NO: 1949684 - RNA, 15 nt, Shigella flexneri 2a str. 2457T
agccggaggugaaaa

SEQ ID NO: 1949685 - RNA, 17 nt, Shigella flexneri 2a str. 2457T
agccggacugggcgcgc

SEQ ID NO: 1949686 - RNA, 20 nt, Shigella flexneri 2a str. 2457T
agccggagaaauaccacccg

SEQ ID NO: 1949687 - RNA, 21 nt, Shigella flexneri 2a str. 2457T
agccggagaaauaccacccgu

SEQ ID NO: 1949688 - RNA, 19 nt, Shigella flexneri 2a str. 2457T
agcccucaccgaagcgagg

SEQ ID NO: 1949689 - RNA, 14 nt, Shigella flexneri 2a str. 2457T
agcccucaaacaac

SEQ ID NO: 1949690 - RNA, 20 nt, Shigella flexneri 2a str. 2457T
agcccguguuucugauacag

SEQ ID NO: 1949691 - RNA, 16 nt, Shigella flexneri 2a str. 2457T
agcccguguuucugau

SEQ ID NO: 1949692 - RNA, 18 nt, Shigella flexneri 2a str. 2457T
agccagguuuaccagcag

SEQ ID NO: 1949693 - RNA, 19 nt, Shigella flexneri 2a str. 2457T
agccagguuuaccagcagc

SEQ ID NO: 1949694 - RNA, 20 nt, Shigella flexneri 2a str. 2457T
agccaguaccacccccagau

SEQ ID NO: 1949695 - RNA, 17 nt, Shigella flexneri 2a str. 2457T
agccgacaaugccacaa

SEQ ID NO: 1949696 - RNA, 23 nt, Shigella flexneri 2a str. 2457T
agccgaagccguuagucaucauc

SEQ ID NO: 1949697 - RNA, 21 nt, Shigella flexneri 2a str. 2457T
agccgaagcugucagaacggu

SEQ ID NO: 1949698 - RNA, 18 nt, Shigella flexneri 2a str. 2457T
agccgaugaguuaagaag

SEQ ID NO: 1949699 - RNA, 20 nt, Shigella flexneri 2a str. 2457T
agccgauuaaaaucagaauc

SEQ ID NO: 1949700 - RNA, 17 nt, Shigella flexneri 2a str. 2457T
agccgauuaaucuucca

SEQ ID NO: 1949701 - RNA, 15 nt, Shigella flexneri 2a str. 2457T
agccgaugccgcugc

SEQ ID NO: 1949702 - RNA, 21 nt, Shigella flexneri 2a str. 2457T
agccgauuaaucuuccagauc

SEQ ID NO: 1949703 - RNA, 16 nt, Shigella flexneri 2a str. 2457T
agccgcaaacuccgug

SEQ ID NO: 1949704 - RNA, 22 nt, Shigella flexneri 2a str. 2457T
acuugggcgauuuuugcagcaa

SEQ ID NO: 1949705 - RNA, 14 nt, Shigella flexneri 2a str. 2457T
acuuggguaacagc

SEQ ID NO: 1949706 - RNA, 14 nt, Shigella flexneri 2a str. 2457T
acuuguaggacgga

SEQ ID NO: 1949707 - RNA, 18 nt, Shigella flexneri 2a str. 2457T
acuuauaagucucagaaa

SEQ ID NO: 1949708 - RNA, 17 nt, Shigella flexneri 2a str. 2457T
acuugcaaucuuuagca

SEQ ID NO: 1949709 - RNA, 14 nt, Shigella flexneri 2a str. 2457T
acuugcggcaccca

SEQ ID NO: 1949710 - RNA, 21 nt, Shigella flexneri 2a str. 2457T
acuuucaucgcggucagcugc

SEQ ID NO: 1949711 - RNA, 22 nt, Shigella flexneri 2a str. 2457T
acuuucaguggcuuaucuuccu

SEQ ID NO: 1949712 - RNA, 15 nt, Shigella flexneri 2a str. 2457T
acuuucacgcccaua

SEQ ID NO: 1949713 - RNA, 18 nt, Shigella flexneri 2a str. 2457T
acuuuagcgaaaucuucc

SEQ ID NO: 1949714 - RNA, 17 nt, Shigella flexneri 2a str. 2457T
acuuuagcgcaaucgca

SEQ ID NO: 1949715 - RNA, 19 nt, Shigella flexneri 2a str. 2457T
acuuuaauaaucucgccuu

SEQ ID NO: 1949716 - RNA, 16 nt, Shigella flexneri 2a str. 2457T
acuuuaaucaccugcc

SEQ ID NO: 1949717 - RNA, 16 nt, Shigella flexneri 2a str. 2457T
acuuuaauuuugugca

SEQ ID NO: 1949718 - RNA, 23 nt, Shigella flexneri 2a str. 2457T
acuuuaaugccacauuagauaaa

SEQ ID NO: 1949719 - RNA, 16 nt, Shigella flexneri 2a str. 2457T
acuuuaccgguuucaa

SEQ ID NO: 1949720 - RNA, 19 nt, Shigella flexneri 2a str. 2457T
acuuuaauuuugugcagca

SEQ ID NO: 1949721 - RNA, 20 nt, Shigella flexneri 2a str. 2457T
acuuuaauuuugugcagcau

SEQ ID NO: 1949722 - RNA, 15 nt, Shigella flexneri 2a str. 2457T
acuuuaauuuuucaa

SEQ ID NO: 1949723 - RNA, 21 nt, Shigella flexneri 2a str. 2457T
acuuguuuuucaucgcuaaua

SEQ ID NO: 1949724 - RNA, 15 nt, Shigella flexneri 2a str. 2457T
acuuuaagcugaaaa

SEQ ID NO: 1949725 - RNA, 23 nt, Shigella flexneri 2a str. 2457T
agaaaaaaugaccgggcuugaaa

SEQ ID NO: 1949726 - RNA, 13 nt, Shigella flexneri 2a str. 2457T
agaaaaaaaguag

SEQ ID NO: 1949727 - RNA, 17 nt, Shigella flexneri 2a str. 2457T
agaaaaucucaauguau

SEQ ID NO: 1949728 - RNA, 22 nt, Shigella flexneri 2a str. 2457T
agaaaauccagaucugaaucau

SEQ ID NO: 1949729 - RNA, 16 nt, Shigella flexneri 2a str. 2457T
acuuuucccuacugcu

SEQ ID NO: 1949730 - RNA, 16 nt, Shigella flexneri 2a str. 2457T
acuuuuauuaacucag

SEQ ID NO: 1949731 - RNA, 16 nt, Shigella flexneri 2a str. 2457T
acuuuuacagcuuagc

SEQ ID NO: 1949732 - RNA, 14 nt, Shigella flexneri 2a str. 2457T
acuuuuugcacaag

SEQ ID NO: 1949733 - RNA, 20 nt, Shigella flexneri 2a str. 2457T
acuuuugagccaaaaugccu

SEQ ID NO: 1949734 - RNA, 22 nt, Shigella flexneri 2a str. 2457T
acuuuuuccaguccacguucaa

SEQ ID NO: 1949735 - RNA, 13 nt, Shigella flexneri 2a str. 2457T
acuuuuucaagaa

SEQ ID NO: 1949736 - RNA, 13 nt, Shigella flexneri 2a str. 2457T
acuuucugagauu

SEQ ID NO: 1949737 - RNA, 20 nt, Shigella flexneri 2a str. 2457T
acuuucuggcacgaccuggc

SEQ ID NO: 1949738 - RNA, 15 nt, Shigella flexneri 2a str. 2457T
acuuucuggcagcug

SEQ ID NO: 1949739 - RNA, 20 nt, Shigella flexneri 2a str. 2457T
acuuuccagccacaguucga

SEQ ID NO: 1949740 - RNA, 14 nt, Shigella flexneri 2a str. 2457T
acuuuccagccaca

SEQ ID NO: 1949741 - RNA, 20 nt, Shigella flexneri 2a str. 2457T
acuuuccaugccaucugcca

SEQ ID NO: 1949742 - RNA, 20 nt, Shigella flexneri 2a str. 2457T
acuuuccuuaacuccucgcc

SEQ ID NO: 1949743 - RNA, 17 nt, Shigella flexneri 2a str. 2457T
acuuucggugacuucaa

SEQ ID NO: 1949744 - RNA, 19 nt, Shigella flexneri 2a str. 2457T
acuuucggcaaccucgccc

SEQ ID NO: 1949745 - RNA, 16 nt, Shigella flexneri 2a str. 2457T
acuuugcaguuccugc

SEQ ID NO: 1949746 - RNA, 17 nt, Shigella flexneri 2a str. 2457T
acuuugcaguuccugcc

SEQ ID NO: 1949747 - RNA, 18 nt, Shigella flexneri 2a str. 2457T
acuuugccgucagccacu

SEQ ID NO: 1949748 - RNA, 17 nt, Shigella flexneri 2a str. 2457T
acuuuuaaauugaagag

SEQ ID NO: 1949749 - RNA, 23 nt, Shigella flexneri 2a str. 2457T
acuuuuacaugcgcgacaaaaau

SEQ ID NO: 1949750 - RNA, 13 nt, Shigella flexneri 2a str. 2457T
acuuuuaccugcu

SEQ ID NO: 1949751 - RNA, 18 nt, Shigella flexneri 2a str. 2457T
acuuuguuagcgaauaaa

SEQ ID NO: 1949752 - RNA, 18 nt, Shigella flexneri 2a str. 2457T
agaaucagcgagacaaca

SEQ ID NO: 1949753 - RNA, 16 nt, Shigella flexneri 2a str. 2457T
agaaucaagucuauuu

SEQ ID NO: 1949754 - RNA, 18 nt, Shigella flexneri 2a str. 2457T
agaaucuaagaucccugc

SEQ ID NO: 1949755 - RNA, 13 nt, Shigella flexneri 2a str. 2457T
agaaucgguccac

SEQ ID NO: 1949756 - RNA, 16 nt, Shigella flexneri 2a str. 2457T
agaaucauaaauacaa

SEQ ID NO: 1949757 - RNA, 16 nt, Shigella flexneri 2a str. 2457T
agaaucaugccaaaaa

SEQ ID NO: 1949758 - RNA, 18 nt, Shigella flexneri 2a str. 2457T
agaauaucgguaucagcc

SEQ ID NO: 1949759 - RNA, 15 nt, Shigella flexneri 2a str. 2457T
agaauaucuucuguu

SEQ ID NO: 1949760 - RNA, 14 nt, Shigella flexneri 2a str. 2457T
agaauaugcuuugc

SEQ ID NO: 1949761 - RNA, 19 nt, Shigella flexneri 2a str. 2457T
agaauauugccgaagacca

SEQ ID NO: 1949762 - RNA, 11 nt, Shigella flexneri 2a str. 2457T
agaaugcccca

SEQ ID NO: 1949763 - RNA, 23 nt, Shigella flexneri 2a str. 2457T
agaaugcgcaacgccguaaguaa

SEQ ID NO: 1949764 - RNA, 19 nt, Shigella flexneri 2a str. 2457T
agaaugcucgcuggcaggc

SEQ ID NO: 1949765 - RNA, 20 nt, Shigella flexneri 2a str. 2457T
agaaucugcguaaauauggc

SEQ ID NO: 1949766 - RNA, 19 nt, Shigella flexneri 2a str. 2457T
agaaucucuuuuguuuccc

SEQ ID NO: 1949767 - RNA, 19 nt, Shigella flexneri 2a str. 2457T
agaauucccccauugaaac

SEQ ID NO: 1949768 - RNA, 17 nt, Shigella flexneri 2a str. 2457T
agaaugguuucauucca

SEQ ID NO: 1949769 - RNA, 20 nt, Shigella flexneri 2a str. 2457T
agaaugggaugguuuugcuu

SEQ ID NO: 1949770 - RNA, 20 nt, Shigella flexneri 2a str. 2457T
agaauggcaucugauaagcc

SEQ ID NO: 1949771 - RNA, 23 nt, Shigella flexneri 2a str. 2457T
agaagccaccgcgccacgaccua

SEQ ID NO: 1949772 - RNA, 15 nt, Shigella flexneri 2a str. 2457T
agaagcccauacccg

SEQ ID NO: 1949773 - RNA, 13 nt, Shigella flexneri 2a str. 2457T
agaagcauuuuac

SEQ ID NO: 1949774 - RNA, 14 nt, Shigella flexneri 2a str. 2457T
agaauagacaaaaa

SEQ ID NO: 1949775 - RNA, 18 nt, Shigella flexneri 2a str. 2457T
agaauagucggcccggcg

SEQ ID NO: 1949776 - RNA, 22 nt, Shigella flexneri 2a str. 2457T
agaauaccuugcugcuccagcg

SEQ ID NO: 1949777 - RNA, 16 nt, Shigella flexneri 2a str. 2457T
agaauaaaacaggcag

SEQ ID NO: 1949778 - RNA, 23 nt, Shigella flexneri 2a str. 2457T
agaauaaaacaggcagcugccag

SEQ ID NO: 1949779 - RNA, 19 nt, Shigella flexneri 2a str. 2457T
agaaacgcuuaaaacgcuc

SEQ ID NO: 1949780 - RNA, 17 nt, Shigella flexneri 2a str. 2457T
agaaacgcucauaaauu

SEQ ID NO: 1949781 - RNA, 15 nt, Shigella flexneri 2a str. 2457T
agaaacgccagcagc

SEQ ID NO: 1949782 - RNA, 12 nt, Shigella flexneri 2a str. 2457T
agaaacaauaag

SEQ ID NO: 1949783 - RNA, 15 nt, Shigella flexneri 2a str. 2457T
agaaacaccagaaug

SEQ ID NO: 1949784 - RNA, 22 nt, Shigella flexneri 2a str. 2457T
aaaacagcaaagcgugcaaaua

SEQ ID NO: 1949785 - RNA, 20 nt, Shigella flexneri 2a str. 2457T
aaaacagacgagggaaaaua

SEQ ID NO: 1949786 - RNA, 14 nt, Shigella flexneri 2a str. 2457T
aaaacacucuuuuu

SEQ ID NO: 1949787 - RNA, 19 nt, Shigella flexneri 2a str. 2457T
agaaacuaucaggcaaaaa

SEQ ID NO: 1949788 - RNA, 15 nt, Shigella flexneri 2a str. 2457T
agaaaugguaaagaa

SEQ ID NO: 1949789 - RNA, 20 nt, Shigella flexneri 2a str. 2457T
agaaauugucuccaccaaug

SEQ ID NO: 1949790 - RNA, 19 nt, Shigella flexneri 2a str. 2457T
agaaauuuggcuccucuga

SEQ ID NO: 1949791 - RNA, 15 nt, Shigella flexneri 2a str. 2457T
agaaauccacaaauu

SEQ ID NO: 1949792 - RNA, 23 nt, Shigella flexneri 2a str. 2457T
agaaauccaggcccgcauuaaaa

SEQ ID NO: 1949793 - RNA, 16 nt, Shigella flexneri 2a str. 2457T
agaaaucauucaauac

SEQ ID NO: 1949794 - RNA, 18 nt, Shigella flexneri 2a str. 2457T
agaagagcggcaaacgua

SEQ ID NO: 1949795 - RNA, 21 nt, Shigella flexneri 2a str. 2457T
agaagagcucguacgaaagug

SEQ ID NO: 1949796 - RNA, 17 nt, Shigella flexneri 2a str. 2457T
agaagacgccauucacu

SEQ ID NO: 1949797 - RNA, 14 nt, Shigella flexneri 2a str. 2457T
agaagaaagccgga

SEQ ID NO: 1949798 - RNA, 19 nt, Shigella flexneri 2a str. 2457T
agaacuuuaucgaucacau

SEQ ID NO: 1949799 - RNA, 13 nt, Shigella flexneri 2a str. 2457T
agaacuucugcaa

SEQ ID NO: 1949800 - RNA, 21 nt, Shigella flexneri 2a str. 2457T
agaacgguucuugaaaaucaa

SEQ ID NO: 1949801 - RNA, 19 nt, Shigella flexneri 2a str. 2457T
agaacgaccaucagcugcc

SEQ ID NO: 1949802 - RNA, 19 nt, Shigella flexneri 2a str. 2457T
agaacgccuguguccuguu

SEQ ID NO: 1949803 - RNA, 20 nt, Shigella flexneri 2a str. 2457T
agaacgcgccuuaaaaacca

SEQ ID NO: 1949804 - RNA, 21 nt, Shigella flexneri 2a str. 2457T
agaaccacaaugaagaaagua

SEQ ID NO: 1949805 - RNA, 13 nt, Shigella flexneri 2a str. 2457T
agaaccagcugcc

SEQ ID NO: 1949806 - RNA, 21 nt, Shigella flexneri 2a str. 2457T
agaaccagggaaaaaagcccc

SEQ ID NO: 1949807 - RNA, 17 nt, Shigella flexneri 2a str. 2457T
agaacaacugcauuauu

SEQ ID NO: 1949808 - RNA, 22 nt, Shigella flexneri 2a str. 2457T
agaacaacccggcgaaagagcu

SEQ ID NO: 1949809 - RNA, 14 nt, Shigella flexneri 2a str. 2457T
agaacaaauaaaua

SEQ ID NO: 1949810 - RNA, 14 nt, Shigella flexneri 2a str. 2457T
agaaauuuuuauua

SEQ ID NO: 1949811 - RNA, 18 nt, Shigella flexneri 2a str. 2457T
agauaauuuuuucuucca

SEQ ID NO: 1949812 - RNA, 15 nt, Shigella flexneri 2a str. 2457T
agauaauuuuuucuu

SEQ ID NO: 1949813 - RNA, 20 nt, Shigella flexneri 2a str. 2457T
agauaauccccaaugaccuu

SEQ ID NO: 1949814 - RNA, 14 nt, Shigella flexneri 2a str. 2457T
agauaauggcuguu

SEQ ID NO: 1949815 - RNA, 20 nt, Shigella flexneri 2a str. 2457T
agauaaugcccgaugaccuu

SEQ ID NO: 1949816 - RNA, 19 nt, Shigella flexneri 2a str. 2457T
agauacaguuuuugcgcuu

SEQ ID NO: 1949817 - RNA, 12 nt, Shigella flexneri 2a str. 2457T
agauacaucagc

SEQ ID NO: 1949818 - RNA, 15 nt, Shigella flexneri 2a str. 2457T
agauacaaccaaucg

SEQ ID NO: 1949819 - RNA, 15 nt, Shigella flexneri 2a str. 2457T
agauaggcaucagca

SEQ ID NO: 1949820 - RNA, 18 nt, Shigella flexneri 2a str. 2457T
agauaguaagauuauaua

SEQ ID NO: 1949821 - RNA, 15 nt, Shigella flexneri 2a str. 2457T
agauaguugauuaau

SEQ ID NO: 1949822 - RNA, 16 nt, Shigella flexneri 2a str. 2457T
agauaguuuacugacu

SEQ ID NO: 1949823 - RNA, 21 nt, Shigella flexneri 2a str. 2457T
agauauaaacggguauuugau

SEQ ID NO: 1949824 - RNA, 15 nt, Shigella flexneri 2a str. 2457T
agauauuucagagcu

SEQ ID NO: 1949825 - RNA, 15 nt, Shigella flexneri 2a str. 2457T
agaucaacacaucca

SEQ ID NO: 1949826 - RNA, 15 nt, Shigella flexneri 2a str. 2457T
agagugauucuuugu

SEQ ID NO: 1949827 - RNA, 21 nt, Shigella flexneri 2a str. 2457T
agagugacgucauagcaguac

SEQ ID NO: 1949828 - RNA, 20 nt, Shigella flexneri 2a str. 2457T
agaguaugcgcgucagagau

SEQ ID NO: 1949829 - RNA, 21 nt, Shigella flexneri 2a str. 2457T
aaaaccagaaagggaagaaca

SEQ ID NO: 1949830 - RNA, 18 nt, Shigella flexneri 2a str. 2457T
agaguuucaacaucaucu

SEQ ID NO: 1949831 - RNA, 16 nt, Shigella flexneri 2a str. 2457T
agauaacggugcugaa

SEQ ID NO: 1949832 - RNA, 18 nt, Shigella flexneri 2a str. 2457T
agauaaaauacacuuuaa

SEQ ID NO: 1949833 - RNA, 22 nt, Shigella flexneri 2a str. 2457T
agaucguucgcaccaaauccaa

SEQ ID NO: 1949834 - RNA, 20 nt, Shigella flexneri 2a str. 2457T
agaucucucuugcuaucacc

SEQ ID NO: 1949835 - RNA, 16 nt, Shigella flexneri 2a str. 2457T
agaucucucuugcuau

SEQ ID NO: 1949836 - RNA, 15 nt, Shigella flexneri 2a str. 2457T
agaucgguugccaua

SEQ ID NO: 1949837 - RNA, 16 nt, Shigella flexneri 2a str. 2457T
agaucgcgcaucagcu

SEQ ID NO: 1949838 - RNA, 17 nt, Shigella flexneri 2a str. 2457T
agaucgccccggcaaga

SEQ ID NO: 1949839 - RNA, 16 nt, Shigella flexneri 2a str. 2457T
agaucgccgcuguaau

SEQ ID NO: 1949840 - RNA, 14 nt, Shigella flexneri 2a str. 2457T
agaucgaucauauu

SEQ ID NO: 1949841 - RNA, 17 nt, Shigella flexneri 2a str. 2457T
agauccggauugauauc

SEQ ID NO: 1949842 - RNA, 21 nt, Shigella flexneri 2a str. 2457T
agauccagugcucauccuuca

SEQ ID NO: 1949843 - RNA, 15 nt, Shigella flexneri 2a str. 2457T
agauccauaaggucc

SEQ ID NO: 1949844 - RNA, 20 nt, Shigella flexneri 2a str. 2457T
agauccauaagguccuccag

SEQ ID NO: 1949845 - RNA, 14 nt, Shigella flexneri 2a str. 2457T
agaucccuucaccu

SEQ ID NO: 1949846 - RNA, 23 nt, Shigella flexneri 2a str. 2457T
agaugcaccguuucuuugccgag

SEQ ID NO: 1949847 - RNA, 19 nt, Shigella flexneri 2a str. 2457T
agaugauggcauucucacu

SEQ ID NO: 1949848 - RNA, 21 nt, Shigella flexneri 2a str. 2457T
agaugauggcauucucacucc

SEQ ID NO: 1949849 - RNA, 19 nt, Shigella flexneri 2a str. 2457T
agaugaugucacagccgca

SEQ ID NO: 1949850 - RNA, 12 nt, Shigella flexneri 2a str. 2457T
agaugcguucac

SEQ ID NO: 1949851 - RNA, 14 nt, Shigella flexneri 2a str. 2457T
agaugcuacaacau

SEQ ID NO: 1949852 - RNA, 16 nt, Shigella flexneri 2a str. 2457T
agaugcuacaacaucg

SEQ ID NO: 1949853 - RNA, 16 nt, Shigella flexneri 2a str. 2457T
agaugcggcuucgcuu

SEQ ID NO: 1949854 - RNA, 21 nt, Shigella flexneri 2a str. 2457T
agaugcggaauuugaugagaa

SEQ ID NO: 1949855 - RNA, 17 nt, Shigella flexneri 2a str. 2457T
agaucuuuaaugcacgg

SEQ ID NO: 1949856 - RNA, 23 nt, Shigella flexneri 2a str. 2457T
agaugaaauaguugcauuccagu

SEQ ID NO: 1949857 - RNA, 18 nt, Shigella flexneri 2a str. 2457T
agaugaagcuggcaaagu

SEQ ID NO: 1949858 - RNA, 13 nt, Shigella flexneri 2a str. 2457T
agauuaaaaguga

SEQ ID NO: 1949859 - RNA, 21 nt, Shigella flexneri 2a str. 2457T
agauguuugauucacuggcaa

SEQ ID NO: 1949860 - RNA, 18 nt, Shigella flexneri 2a str. 2457T
agauuauauaauaugcau

SEQ ID NO: 1949861 - RNA, 19 nt, Shigella flexneri 2a str. 2457T
agauguaaugagaacguuc

SEQ ID NO: 1949862 - RNA, 20 nt, Shigella flexneri 2a str. 2457T
agaugguuacgcauaaaacc

SEQ ID NO: 1949863 - RNA, 23 nt, Shigella flexneri 2a str. 2457T
agaugguuacuuuuuaugucauu

SEQ ID NO: 1949864 - RNA, 13 nt, Shigella flexneri 2a str. 2457T
agaugguggucau

SEQ ID NO: 1949865 - RNA, 17 nt, Shigella flexneri 2a str. 2457T
agaugguggucauauca

SEQ ID NO: 1949866 - RNA, 21 nt, Shigella flexneri 2a str. 2457T
agauguugucucagauucaga

SEQ ID NO: 1949867 - RNA, 17 nt, Shigella flexneri 2a str. 2457T
agaugcugcaaggugau

SEQ ID NO: 1949868 - RNA, 14 nt, Shigella flexneri 2a str. 2457T
agaugcugcggcgg

SEQ ID NO: 1949869 - RNA, 23 nt, Shigella flexneri 2a str. 2457T
agaugcucuuuucugaaguacac

SEQ ID NO: 1949870 - RNA, 13 nt, Shigella flexneri 2a str. 2457T
agauggguuuuuc

SEQ ID NO: 1949871 - RNA, 23 nt, Shigella flexneri 2a str. 2457T
agauggguuuuucugcguuccug

SEQ ID NO: 1949872 - RNA, 16 nt, Shigella flexneri 2a str. 2457T
agagacgcugaaaagc

SEQ ID NO: 1949873 - RNA, 20 nt, Shigella flexneri 2a str. 2457T
agagacagccgaaaagguag

SEQ ID NO: 1949874 - RNA, 13 nt, Shigella flexneri 2a str. 2457T
agagacagaauca

SEQ ID NO: 1949875 - RNA, 18 nt, Shigella flexneri 2a str. 2457T
agagaauggggucagcag

SEQ ID NO: 1949876 - RNA, 21 nt, Shigella flexneri 2a str. 2457T
agagaauauuaacggucauuc

SEQ ID NO: 1949877 - RNA, 12 nt, Shigella flexneri 2a str. 2457T
agagaaaguaaa

SEQ ID NO: 1949878 - RNA, 13 nt, Shigella flexneri 2a str. 2457T
agagaaccagcug

SEQ ID NO: 1949879 - RNA, 12 nt, Shigella flexneri 2a str. 2457T
agagaaaauaau

SEQ ID NO: 1949880 - RNA, 22 nt, Shigella flexneri 2a str. 2457T
agagaaaaugccgcacaucacc

SEQ ID NO: 1949881 - RNA, 18 nt, Shigella flexneri 2a str. 2457T
agagaaacgccagcagca

SEQ ID NO: 1949882 - RNA, 15 nt, Shigella flexneri 2a str. 2457T
agagaaagcaaaaau

SEQ ID NO: 1949883 - RNA, 18 nt, Shigella flexneri 2a str. 2457T
agacuuuagucaucaguc

SEQ ID NO: 1949884 - RNA, 21 nt, Shigella flexneri 2a str. 2457T
agacuucccucccguuucccu

SEQ ID NO: 1949885 - RNA, 14 nt, Shigella flexneri 2a str. 2457T
agacuuuagcgcaa

SEQ ID NO: 1949886 - RNA, 13 nt, Shigella flexneri 2a str. 2457T
agagagccagccc

SEQ ID NO: 1949887 - RNA, 20 nt, Shigella flexneri 2a str. 2457T
agagagccagccccacagca

SEQ ID NO: 1949888 - RNA, 20 nt, Shigella flexneri 2a str. 2457T
agagagugacgucauagcag

SEQ ID NO: 1949889 - RNA, 22 nt, Shigella flexneri 2a str. 2457T
agagauagcacgacguuucuuu

SEQ ID NO: 1949890 - RNA, 21 nt, Shigella flexneri 2a str. 2457T
agagauaguguugguaaauaa

SEQ ID NO: 1949891 - RNA, 22 nt, Shigella flexneri 2a str. 2457T
agagcaaaaaucgacagcagga

SEQ ID NO: 1949892 - RNA, 16 nt, Shigella flexneri 2a str. 2457T
agagauucuuuuccuu

SEQ ID NO: 1949893 - RNA, 14 nt, Shigella flexneri 2a str. 2457T
agagcggagcaaug

SEQ ID NO: 1949894 - RNA, 14 nt, Shigella flexneri 2a str. 2457T
agagcgcggcgcag

SEQ ID NO: 1949895 - RNA, 19 nt, Shigella flexneri 2a str. 2457T
agagcuacaaaguguuguu

SEQ ID NO: 1949896 - RNA, 18 nt, Shigella flexneri 2a str. 2457T
agagccagccccacagca

SEQ ID NO: 1949897 - RNA, 21 nt, Shigella flexneri 2a str. 2457T
agagcaacccacuggcaauca

SEQ ID NO: 1949898 - RNA, 14 nt, Shigella flexneri 2a str. 2457T
agagcaacauacag

SEQ ID NO: 1949899 - RNA, 20 nt, Shigella flexneri 2a str. 2457T
agagcaucgguaucuuccca

SEQ ID NO: 1949900 - RNA, 14 nt, Shigella flexneri 2a str. 2457T
agacugaugacaaa

SEQ ID NO: 1949901 - RNA, 18 nt, Shigella flexneri 2a str. 2457T
agacugaugacaaacaca

SEQ ID NO: 1949902 - RNA, 19 nt, Shigella flexneri 2a str. 2457T
agacugauaucccgcgcgu

SEQ ID NO: 1949903 - RNA, 17 nt, Shigella flexneri 2a str. 2457T
agacugaugugauccau

SEQ ID NO: 1949904 - RNA, 15 nt, Shigella flexneri 2a str. 2457T
agacugaucaucgcc

SEQ ID NO: 1949905 - RNA, 22 nt, Shigella flexneri 2a str. 2457T
agacugaugacaaacacaaaac

SEQ ID NO: 1949906 - RNA, 23 nt, Shigella flexneri 2a str. 2457T
agacugcagcggucacauguucc

SEQ ID NO: 1949907 - RNA, 14 nt, Shigella flexneri 2a str. 2457T
agacugcaagaaua

SEQ ID NO: 1949908 - RNA, 22 nt, Shigella flexneri 2a str. 2457T
agacuggaaacucacgccagca

SEQ ID NO: 1949909 - RNA, 16 nt, Shigella flexneri 2a str. 2457T
agacuggagcacugcg

SEQ ID NO: 1949910 - RNA, 16 nt, Shigella flexneri 2a str. 2457T
agacuggauugccagc

SEQ ID NO: 1949911 - RNA, 19 nt, Shigella flexneri 2a str. 2457T
agacuggcaaaugacauaa

SEQ ID NO: 1949912 - RNA, 21 nt, Shigella flexneri 2a str. 2457T
agacuggcaaaugacauaaac

SEQ ID NO: 1949913 - RNA, 14 nt, Shigella flexneri 2a str. 2457T
agacugugaaucau

SEQ ID NO: 1949914 - RNA, 19 nt, Shigella flexneri 2a str. 2457T
agacuuaccagcccuaaua

SEQ ID NO: 1949915 - RNA, 15 nt, Shigella flexneri 2a str. 2457T
agacuuaagccuguu

SEQ ID NO: 1949916 - RNA, 20 nt, Shigella flexneri 2a str. 2457T
agacggcugucauccagcag

SEQ ID NO: 1949917 - RNA, 16 nt, Shigella flexneri 2a str. 2457T
agacggaacaucugcc

SEQ ID NO: 1949918 - RNA, 18 nt, Shigella flexneri 2a str. 2457T
agacggcgcuuacucaug

SEQ ID NO: 1949919 - RNA, 18 nt, Shigella flexneri 2a str. 2457T
agaauuucuuuacugaca

SEQ ID NO: 1949920 - RNA, 20 nt, Shigella flexneri 2a str. 2457T
agaauuucuuuacugacagg

SEQ ID NO: 1949921 - RNA, 17 nt, Shigella flexneri 2a str. 2457T
agaccguugcucagaau

SEQ ID NO: 1949922 - RNA, 15 nt, Shigella flexneri 2a str. 2457T
agaccccagguuuuc

SEQ ID NO: 1949923 - RNA, 13 nt, Shigella flexneri 2a str. 2457T
agacccgccaccc

SEQ ID NO: 1949924 - RNA, 14 nt, Shigella flexneri 2a str. 2457T
agacgcgaccggcg

SEQ ID NO: 1949925 - RNA, 18 nt, Shigella flexneri 2a str. 2457T
agacgcguuuacagagcc

SEQ ID NO: 1949926 - RNA, 16 nt, Shigella flexneri 2a str. 2457T
agacgcgucagugucu

SEQ ID NO: 1949927 - RNA, 21 nt, Shigella flexneri 2a str. 2457T
agacgcucguuaaaacgcgcg

SEQ ID NO: 1949928 - RNA, 20 nt, Shigella flexneri 2a str. 2457T
agacgcucuucaauggucag

SEQ ID NO: 1949929 - RNA, 22 nt, Shigella flexneri 2a str. 2457T
aaaacaucaugauucacaguua

SEQ ID NO: 1949930 - RNA, 20 nt, Shigella flexneri 2a str. 2457T
agaccuaacuuggcaaagcu

SEQ ID NO: 1949931 - RNA, 15 nt, Shigella flexneri 2a str. 2457T
agacgagagugacga

SEQ ID NO: 1949932 - RNA, 19 nt, Shigella flexneri 2a str. 2457T
agacgauagaaccuuccau

SEQ ID NO: 1949933 - RNA, 21 nt, Shigella flexneri 2a str. 2457T
acagcaaagcgugcaaauaua

SEQ ID NO: 1949934 - RNA, 19 nt, Shigella flexneri 2a str. 2457T
acagcaaagugcccccaac

SEQ ID NO: 1949935 - RNA, 16 nt, Shigella flexneri 2a str. 2457T
acagcagccacaccaa

SEQ ID NO: 1949936 - RNA, 12 nt, Shigella flexneri 2a str. 2457T
acagcaaaacgc

SEQ ID NO: 1949937 - RNA, 21 nt, Shigella flexneri 2a str. 2457T
acagcaguacgccgagaauaa

SEQ ID NO: 1949938 - RNA, 13 nt, Shigella flexneri 2a str. 2457T
acagcaggcucag

SEQ ID NO: 1949939 - RNA, 22 nt, Shigella flexneri 2a str. 2457T
acagccacagggugaucaccag

SEQ ID NO: 1949940 - RNA, 22 nt, Shigella flexneri 2a str. 2457T
acagccacacaccgcaaacugc

SEQ ID NO: 1949941 - RNA, 18 nt, Shigella flexneri 2a str. 2457T
acagccaaaucaucagua

SEQ ID NO: 1949942 - RNA, 13 nt, Shigella flexneri 2a str. 2457T
acagccagcagcg

SEQ ID NO: 1949943 - RNA, 12 nt, Shigella flexneri 2a str. 2457T
acagccagccag

SEQ ID NO: 1949944 - RNA, 17 nt, Shigella flexneri 2a str. 2457T
acagccagccagcacca

SEQ ID NO: 1949945 - RNA, 19 nt, Shigella flexneri 2a str. 2457T
acagccggacccacacccc

SEQ ID NO: 1949946 - RNA, 13 nt, Shigella flexneri 2a str. 2457T
acagccuaccaga

SEQ ID NO: 1949947 - RNA, 18 nt, Shigella flexneri 2a str. 2457T
acagccuaccagaccgca

SEQ ID NO: 1949948 - RNA, 15 nt, Shigella flexneri 2a str. 2457T
acaggaacagccacu

SEQ ID NO: 1949949 - RNA, 20 nt, Shigella flexneri 2a str. 2457T
acaggaacagccacugguga

SEQ ID NO: 1949950 - RNA, 17 nt, Shigella flexneri 2a str. 2457T
acaggaagcagcuugcu

SEQ ID NO: 1949951 - RNA, 17 nt, Shigella flexneri 2a str. 2457T
acagcuuuuacagccaa

SEQ ID NO: 1949952 - RNA, 16 nt, Shigella flexneri 2a str. 2457T
acagcuuuuuccugcg

SEQ ID NO: 1949953 - RNA, 15 nt, Shigella flexneri 2a str. 2457T
acaggcgggaagaac

SEQ ID NO: 1949954 - RNA, 18 nt, Shigella flexneri 2a str. 2457T
acaggcuuuccugauaau

SEQ ID NO: 1949955 - RNA, 15 nt, Shigella flexneri 2a str. 2457T
acagcgauuccaguu

SEQ ID NO: 1949956 - RNA, 22 nt, Shigella flexneri 2a str. 2457T
acagcgauugcuucgaucucaa

SEQ ID NO: 1949957 - RNA, 15 nt, Shigella flexneri 2a str. 2457T
acagcgacucucuga

SEQ ID NO: 1949958 - RNA, 22 nt, Shigella flexneri 2a str. 2457T
acagcgacucucugagccagcu

SEQ ID NO: 1949959 - RNA, 14 nt, Shigella flexneri 2a str. 2457T
acagcgcccgccag

SEQ ID NO: 1949960 - RNA, 14 nt, Shigella flexneri 2a str. 2457T
acagcguuaaaaag

SEQ ID NO: 1949961 - RNA, 14 nt, Shigella flexneri 2a str. 2457T
acagcguuucgcca

SEQ ID NO: 1949962 - RNA, 22 nt, Shigella flexneri 2a str. 2457T
acagcucacggcccugugccug

SEQ ID NO: 1949963 - RNA, 15 nt, Shigella flexneri 2a str. 2457T
acagcguuucuucga

SEQ ID NO: 1949964 - RNA, 20 nt, Shigella flexneri 2a str. 2457T
acagcuaaucaucaucagug

SEQ ID NO: 1949965 - RNA, 22 nt, Shigella flexneri 2a str. 2457T
acagugcugauuuugcaacaac

SEQ ID NO: 1949966 - RNA, 20 nt, Shigella flexneri 2a str. 2457T
acagugggauuaaaaaguaa

SEQ ID NO: 1949967 - RNA, 20 nt, Shigella flexneri 2a str. 2457T
acaguguaauuaggcuaaau

SEQ ID NO: 1949968 - RNA, 21 nt, Shigella flexneri 2a str. 2457T
acagugauuacuaaaugugca

SEQ ID NO: 1949969 - RNA, 13 nt, Shigella flexneri 2a str. 2457T
acaguuguaaagu

SEQ ID NO: 1949970 - RNA, 23 nt, Shigella flexneri 2a str. 2457T
acaguugucagcccuuuuucacg

SEQ ID NO: 1949971 - RNA, 19 nt, Shigella flexneri 2a str. 2457T
acaguucuucaaaaauaau

SEQ ID NO: 1949972 - RNA, 12 nt, Shigella flexneri 2a str. 2457T
acaguucaaucu

SEQ ID NO: 1949973 - RNA, 12 nt, Shigella flexneri 2a str. 2457T
acaguuaucaaa

SEQ ID NO: 1949974 - RNA, 16 nt, Shigella flexneri 2a str. 2457T
acaguuauaaaaugau

SEQ ID NO: 1949975 - RNA, 15 nt, Shigella flexneri 2a str. 2457T
acaguuucaccugcu

SEQ ID NO: 1949976 - RNA, 20 nt, Shigella flexneri 2a str. 2457T
acaguuuucaagacgccguc

SEQ ID NO: 1949977 - RNA, 17 nt, Shigella flexneri 2a str. 2457T
acauaaacagguaaaga

SEQ ID NO: 1949978 - RNA, 21 nt, Shigella flexneri 2a str. 2457T
acauaaacagguaaagaccau

SEQ ID NO: 1949979 - RNA, 21 nt, Shigella flexneri 2a str. 2457T
acauaaaacgcuuacgcuuca

SEQ ID NO: 1949980 - RNA, 16 nt, Shigella flexneri 2a str. 2457T
acauaaagucuuucuu

SEQ ID NO: 1949981 - RNA, 22 nt, Shigella flexneri 2a str. 2457T
acagucgcccgaccaucgccag

SEQ ID NO: 1949982 - RNA, 13 nt, Shigella flexneri 2a str. 2457T
acagucaggcugu

SEQ ID NO: 1949983 - RNA, 20 nt, Shigella flexneri 2a str. 2457T
acagucaguuaucgcauuau

SEQ ID NO: 1949984 - RNA, 15 nt, Shigella flexneri 2a str. 2457T
acaguaucaucauua

SEQ ID NO: 1949985 - RNA, 17 nt, Shigella flexneri 2a str. 2457T
acaguaaugauuuaaaa

SEQ ID NO: 1949986 - RNA, 15 nt, Shigella flexneri 2a str. 2457T
acaguacaucuucca

SEQ ID NO: 1949987 - RNA, 21 nt, Shigella flexneri 2a str. 2457T
acaguagacaauuuuucauaa

SEQ ID NO: 1949988 - RNA, 20 nt, Shigella flexneri 2a str. 2457T
acaguacgguaaagccgugc

SEQ ID NO: 1949989 - RNA, 15 nt, Shigella flexneri 2a str. 2457T
acaguaacccggcac

SEQ ID NO: 1949990 - RNA, 16 nt, Shigella flexneri 2a str. 2457T
acaguaacccggcacc

SEQ ID NO: 1949991 - RNA, 15 nt, Shigella flexneri 2a str. 2457T
acaguaaagcgcaaa

SEQ ID NO: 1949992 - RNA, 18 nt, Shigella flexneri 2a str. 2457T
acagguuguugccuucac

SEQ ID NO: 1949993 - RNA, 14 nt, Shigella flexneri 2a str. 2457T
acagguuuaaacag

SEQ ID NO: 1949994 - RNA, 15 nt, Shigella flexneri 2a str. 2457T
acagguuuaaacaga

SEQ ID NO: 1949995 - RNA, 18 nt, Shigella flexneri 2a str. 2457T
acagguaucgacaauguc

SEQ ID NO: 1949996 - RNA, 21 nt, Shigella flexneri 2a str. 2457T
acaggucaaaguaaccuuuga

SEQ ID NO: 1949997 - RNA, 22 nt, Shigella flexneri 2a str. 2457T
acaggucgccagucccuuucag

SEQ ID NO: 1949998 - RNA, 16 nt, Shigella flexneri 2a str. 2457T
acaggugcaaaaaaac

SEQ ID NO: 1949999 - RNA, 14 nt, Shigella flexneri 2a str. 2457T
acaggucuguauga

SEQ ID NO: 1950000 - RNA, 23 nt, Shigella flexneri 2a str. 2457T
acagguggcaaauggcgaaggau

SEQ ID NO: 1950001 - RNA, 17 nt, Shigella flexneri 2a str. 2457T
acauccggcaaaaacaa

SEQ ID NO: 1950002 - RNA, 14 nt, Shigella flexneri 2a str. 2457T
acauccucuucaag

SEQ ID NO: 1950003 - RNA, 14 nt, Shigella flexneri 2a str. 2457T
acaucauucccgcc

SEQ ID NO: 1950004 - RNA, 15 nt, Shigella flexneri 2a str. 2457T
acauccugcguuaau

SEQ ID NO: 1950005 - RNA, 22 nt, Shigella flexneri 2a str. 2457T
acauccugcguuaaucgccgua

SEQ ID NO: 1950006 - RNA, 21 nt, Shigella flexneri 2a str. 2457T
acaucgcguugacguucaugc

SEQ ID NO: 1950007 - RNA, 13 nt, Shigella flexneri 2a str. 2457T
acaucgcugugcu

SEQ ID NO: 1950008 - RNA, 19 nt, Shigella flexneri 2a str. 2457T
acaucgcugauuucaccau

SEQ ID NO: 1950009 - RNA, 21 nt, Shigella flexneri 2a str. 2457T
acaucaccguucagcuugcgu

SEQ ID NO: 1950010 - RNA, 14 nt, Shigella flexneri 2a str. 2457T
acaucacgcagcug

SEQ ID NO: 1950011 - RNA, 18 nt, Shigella flexneri 2a str. 2457T
acaucaccaauacgcaua

SEQ ID NO: 1950012 - RNA, 20 nt, Shigella flexneri 2a str. 2457T
acauaacgccaauucauucc

SEQ ID NO: 1950013 - RNA, 12 nt, Shigella flexneri 2a str. 2457T
acauaauggccg

SEQ ID NO: 1950014 - RNA, 14 nt, Shigella flexneri 2a str. 2457T
acauaauccagaca

SEQ ID NO: 1950015 - RNA, 21 nt, Shigella flexneri 2a str. 2457T
acauaauccagacacuccaga

SEQ ID NO: 1950016 - RNA, 17 nt, Shigella flexneri 2a str. 2457T
acauaaucaauaaaaau

SEQ ID NO: 1950017 - RNA, 18 nt, Shigella flexneri 2a str. 2457T
acaugccgaauccgggaa

SEQ ID NO: 1950018 - RNA, 12 nt, Shigella flexneri 2a str. 2457T
acaugcgauaaa

SEQ ID NO: 1950019 - RNA, 17 nt, Shigella flexneri 2a str. 2457T
acaugcgauaaagcaua

SEQ ID NO: 1950020 - RNA, 12 nt, Shigella flexneri 2a str. 2457T
acaugagagaaa

SEQ ID NO: 1950021 - RNA, 19 nt, Shigella flexneri 2a str. 2457T
acaugagguccagcgagcc

SEQ ID NO: 1950022 - RNA, 15 nt, Shigella flexneri 2a str. 2457T
acaugagagaaaauc

SEQ ID NO: 1950023 - RNA, 16 nt, Shigella flexneri 2a str. 2457T
acaugcggugauuuug

SEQ ID NO: 1950024 - RNA, 18 nt, Shigella flexneri 2a str. 2457T
acaugguuuacggcgguc

SEQ ID NO: 1950025 - RNA, 19 nt, Shigella flexneri 2a str. 2457T
acauguguuaaauauuuaa

SEQ ID NO: 1950026 - RNA, 15 nt, Shigella flexneri 2a str. 2457T
acauguacauggugc

SEQ ID NO: 1950027 - RNA, 19 nt, Shigella flexneri 2a str. 2457T
acauguacauggugcacau

SEQ ID NO: 1950028 - RNA, 14 nt, Shigella flexneri 2a str. 2457T
acaucgucgccaga

SEQ ID NO: 1950029 - RNA, 17 nt, Shigella flexneri 2a str. 2457T
acaucuaaccauuauua

SEQ ID NO: 1950030 - RNA, 13 nt, Shigella flexneri 2a str. 2457T
acaucucaacaac

SEQ ID NO: 1950031 - RNA, 16 nt, Shigella flexneri 2a str. 2457T
acaugaagcacugcau

SEQ ID NO: 1950032 - RNA, 22 nt, Shigella flexneri 2a str. 2457T
acaucucgaucgagaagaccau

SEQ ID NO: 1950033 - RNA, 19 nt, Shigella flexneri 2a str. 2457T
acaucuggcgagucaccau

SEQ ID NO: 1950034 - RNA, 12 nt, Shigella flexneri 2a str. 2457T
acaucucuuccc

SEQ ID NO: 1950035 - RNA, 21 nt, Shigella flexneri 2a str. 2457T
acaucugaguugccaucauca

SEQ ID NO: 1950036 - RNA, 12 nt, Shigella flexneri 2a str. 2457T
acauuucuuuug

SEQ ID NO: 1950037 - RNA, 19 nt, Shigella flexneri 2a str. 2457T
acauuuaacccuucaagaa

SEQ ID NO: 1950038 - RNA, 21 nt, Shigella flexneri 2a str. 2457T
acauuuaccgcaacucauuua

SEQ ID NO: 1950039 - RNA, 14 nt, Shigella flexneri 2a str. 2457T
acauuucugcugcc

SEQ ID NO: 1950040 - RNA, 13 nt, Shigella flexneri 2a str. 2457T
acauuuuccauca

SEQ ID NO: 1950041 - RNA, 12 nt, Shigella flexneri 2a str. 2457T
acauuuugaccc

SEQ ID NO: 1950042 - RNA, 20 nt, Shigella flexneri 2a str. 2457T
acauugacgauagcgccgcc

SEQ ID NO: 1950043 - RNA, 21 nt, Shigella flexneri 2a str. 2457T
acauugacgauagcgccgcca

SEQ ID NO: 1950044 - RNA, 18 nt, Shigella flexneri 2a str. 2457T
acauugauguuuucagac

SEQ ID NO: 1950045 - RNA, 23 nt, Shigella flexneri 2a str. 2457T
acauugauuaagugaauauacca

SEQ ID NO: 1950046 - RNA, 14 nt, Shigella flexneri 2a str. 2457T
acauuguuuuccag

SEQ ID NO: 1950047 - RNA, 22 nt, Shigella flexneri 2a str. 2457T
acauuuaaacaauuucagaaua

SEQ ID NO: 1950048 - RNA, 19 nt, Shigella flexneri 2a str. 2457T
acauuaccacgauuuugac

SEQ ID NO: 1950049 - RNA, 19 nt, Shigella flexneri 2a str. 2457T
acauuacguccaucacaau

SEQ ID NO: 1950050 - RNA, 16 nt, Shigella flexneri 2a str. 2457T
acauuagauaaaaaug

SEQ ID NO: 1950051 - RNA, 15 nt, Shigella flexneri 2a str. 2457T
accaaaaacgccaug

SEQ ID NO: 1950052 - RNA, 17 nt, Shigella flexneri 2a str. 2457T
accaaaacagcgacacc

SEQ ID NO: 1950053 - RNA, 20 nt, Shigella flexneri 2a str. 2457T
accaaaacgugcagcugccu

SEQ ID NO: 1950054 - RNA, 14 nt, Shigella flexneri 2a str. 2457T
accaaagaaaucag

SEQ ID NO: 1950055 - RNA, 21 nt, Shigella flexneri 2a str. 2457T
accaaagaaugacacuuucag

SEQ ID NO: 1950056 - RNA, 22 nt, Shigella flexneri 2a str. 2457T
accaaacccugagugaauuguu

SEQ ID NO: 1950057 - RNA, 16 nt, Shigella flexneri 2a str. 2457T
accaaaaucaucaauu

SEQ ID NO: 1950058 - RNA, 15 nt, Shigella flexneri 2a str. 2457T
accaaaacgugcagc

SEQ ID NO: 1950059 - RNA, 12 nt, Shigella flexneri 2a str. 2457T
accaaaaucauc

SEQ ID NO: 1950060 - RNA, 23 nt, Shigella flexneri 2a str. 2457T
accaaaaucaggccgaggcacag

SEQ ID NO: 1950061 - RNA, 21 nt, Shigella flexneri 2a str. 2457T
accaaaucugauuaauauuga

SEQ ID NO: 1950062 - RNA, 14 nt, Shigella flexneri 2a str. 2457T
accaaauaaacgaa

SEQ ID NO: 1950063 - RNA, 19 nt, Shigella flexneri 2a str. 2457T
accaacaauaaaauugagg

SEQ ID NO: 1950064 - RNA, 13 nt, Shigella flexneri 2a str. 2457T
accaacaucacgc

SEQ ID NO: 1950065 - RNA, 18 nt, Shigella flexneri 2a str. 2457T
accaaauuccagaaaaga

SEQ ID NO: 1950066 - RNA, 18 nt, Shigella flexneri 2a str. 2457T
acaaccugaccuuuuuuc

SEQ ID NO: 1950067 - RNA, 21 nt, Shigella flexneri 2a str. 2457T
acaacccgugagucuccuuua

SEQ ID NO: 1950068 - RNA, 13 nt, Shigella flexneri 2a str. 2457T
acaacccacacau

SEQ ID NO: 1950069 - RNA, 23 nt, Shigella flexneri 2a str. 2457T
acaacaugccgaauccgggaagg

SEQ ID NO: 1950070 - RNA, 22 nt, Shigella flexneri 2a str. 2457T
acaacauuccugcugacggcac

SEQ ID NO: 1950071 - RNA, 15 nt, Shigella flexneri 2a str. 2457T
acaacaucaucugcc

SEQ ID NO: 1950072 - RNA, 20 nt, Shigella flexneri 2a str. 2457T
acaacaucacaccugcucag

SEQ ID NO: 1950073 - RNA, 22 nt, Shigella flexneri 2a str. 2457T
acaaauuucaucgcuacaccaa

SEQ ID NO: 1950074 - RNA, 22 nt, Shigella flexneri 2a str. 2457T
acaaauuugugcaaauucaaua

SEQ ID NO: 1950075 - RNA, 15 nt, Shigella flexneri 2a str. 2457T
acaacaaacgcaaac

SEQ ID NO: 1950076 - RNA, 16 nt, Shigella flexneri 2a str. 2457T
acaacacucucugaag

SEQ ID NO: 1950077 - RNA, 18 nt, Shigella flexneri 2a str. 2457T
acaacacgccgauaauca

SEQ ID NO: 1950078 - RNA, 23 nt, Shigella flexneri 2a str. 2457T
acaacacgccgaucgaagagacg

SEQ ID NO: 1950079 - RNA, 19 nt, Shigella flexneri 2a str. 2457T
acaaauaaauagauccagg

SEQ ID NO: 1950080 - RNA, 21 nt, Shigella flexneri 2a str. 2457T
acaaauaaauagauccaggaa

SEQ ID NO: 1950081 - RNA, 21 nt, Shigella flexneri 2a str. 2457T
acaaagugcacuuugucaaua

SEQ ID NO: 1950082 - RNA, 16 nt, Shigella flexneri 2a str. 2457T
acaaauagccagcaga

SEQ ID NO: 1950083 - RNA, 19 nt, Shigella flexneri 2a str. 2457T
acaaauagccaauucccag

SEQ ID NO: 1950084 - RNA, 17 nt, Shigella flexneri 2a str. 2457T
acaaauagccagcagag

SEQ ID NO: 1950085 - RNA, 13 nt, Shigella flexneri 2a str. 2457T
acaaauagacaca

SEQ ID NO: 1950086 - RNA, 19 nt, Shigella flexneri 2a str. 2457T
acaaauacgcuuuuucccu

SEQ ID NO: 1950087 - RNA, 20 nt, Shigella flexneri 2a str. 2457T
acaaauacgcuuuuucccug

SEQ ID NO: 1950088 - RNA, 16 nt, Shigella flexneri 2a str. 2457T
acaaauagacacaaga

SEQ ID NO: 1950089 - RNA, 19 nt, Shigella flexneri 2a str. 2457T
acaaauagagauagaaugc

SEQ ID NO: 1950090 - RNA, 21 nt, Shigella flexneri 2a str. 2457T
acaaauagagauagaaugcca

SEQ ID NO: 1950091 - RNA, 23 nt, Shigella flexneri 2a str. 2457T
acaaauagagauagaaugccaag

SEQ ID NO: 1950092 - RNA, 21 nt, Shigella flexneri 2a str. 2457T
acaaauucuggcggcaauaac

SEQ ID NO: 1950093 - RNA, 14 nt, Shigella flexneri 2a str. 2457T
acaaaugugccauu

SEQ ID NO: 1950094 - RNA, 18 nt, Shigella flexneri 2a str. 2457T
acaaaugcaguuuuuaau

SEQ ID NO: 1950095 - RNA, 18 nt, Shigella flexneri 2a str. 2457T
acaaauggcaaugacuag

SEQ ID NO: 1950096 - RNA, 23 nt, Shigella flexneri 2a str. 2457T
acaaaugucacugcuuuggcucu

SEQ ID NO: 1950097 - RNA, 16 nt, Shigella flexneri 2a str. 2457T
acaaaggcuugcugca

SEQ ID NO: 1950098 - RNA, 18 nt, Shigella flexneri 2a str. 2457T
acaaagcgcacuuugcca

SEQ ID NO: 1950099 - RNA, 15 nt, Shigella flexneri 2a str. 2457T
acaaagccaacagca

SEQ ID NO: 1950100 - RNA, 21 nt, Shigella flexneri 2a str. 2457T
acaaacuugauagaacaaaag

SEQ ID NO: 1950101 - RNA, 13 nt, Shigella flexneri 2a str. 2457T
acaaagagcuuuc

SEQ ID NO: 1950102 - RNA, 19 nt, Shigella flexneri 2a str. 2457T
acaaagacaauuuaccgac

SEQ ID NO: 1950103 - RNA, 18 nt, Shigella flexneri 2a str. 2457T
acaaagacaucaaacccu

SEQ ID NO: 1950104 - RNA, 13 nt, Shigella flexneri 2a str. 2457T
acaaacaucaucc

SEQ ID NO: 1950105 - RNA, 13 nt, Shigella flexneri 2a str. 2457T
acaaacacaauau

SEQ ID NO: 1950106 - RNA, 14 nt, Shigella flexneri 2a str. 2457T
acaaacaauuaaua

SEQ ID NO: 1950107 - RNA, 14 nt, Shigella flexneri 2a str. 2457T
acaaacaggaaguu

SEQ ID NO: 1950108 - RNA, 18 nt, Shigella flexneri 2a str. 2457T
acaaacgcaaaauugccu

SEQ ID NO: 1950109 - RNA, 16 nt, Shigella flexneri 2a str. 2457T
acaaacgcaaacacca

SEQ ID NO: 1950110 - RNA, 14 nt, Shigella flexneri 2a str. 2457T
acaaacgacgggcc

SEQ ID NO: 1950111 - RNA, 21 nt, Shigella flexneri 2a str. 2457T
acaaacgcuuuacucaacucc

SEQ ID NO: 1950112 - RNA, 15 nt, Shigella flexneri 2a str. 2457T
acaaacgcugacaua

SEQ ID NO: 1950113 - RNA, 13 nt, Shigella flexneri 2a str. 2457T
acaaacucuuuuc

SEQ ID NO: 1950114 - RNA, 22 nt, Shigella flexneri 2a str. 2457T
acaaaaucacgucgauuuuuaa

SEQ ID NO: 1950115 - RNA, 22 nt, Shigella flexneri 2a str. 2457T
acaaaaucgugaaaaaucaaua

SEQ ID NO: 1950116 - RNA, 23 nt, Shigella flexneri 2a str. 2457T
acaaaaucgugaaaaaucaauau

SEQ ID NO: 1950117 - RNA, 18 nt, Shigella flexneri 2a str. 2457T
acaaaaucggaaacaaau

SEQ ID NO: 1950118 - RNA, 15 nt, Shigella flexneri 2a str. 2457T
acaaaaucuucguua

SEQ ID NO: 1950119 - RNA, 12 nt, Shigella flexneri 2a str. 2457T
acaaaaccugcc

SEQ ID NO: 1950120 - RNA, 14 nt, Shigella flexneri 2a str. 2457T
acaaaacgggggcu

SEQ ID NO: 1950121 - RNA, 18 nt, Shigella flexneri 2a str. 2457T
acaaaagcacguaaauuc

SEQ ID NO: 1950122 - RNA, 19 nt, Shigella flexneri 2a str. 2457T
aauuuauaaucuuuaaaaa

SEQ ID NO: 1950123 - RNA, 14 nt, Shigella flexneri 2a str. 2457T
aauuuagugaccaa

SEQ ID NO: 1950124 - RNA, 16 nt, Shigella flexneri 2a str. 2457T
acaaaaaagccaauca

SEQ ID NO: 1950125 - RNA, 20 nt, Shigella flexneri 2a str. 2457T
acaaaaagugcuuucugaac

SEQ ID NO: 1950126 - RNA, 18 nt, Shigella flexneri 2a str. 2457T
acaaaaaugcccgauccu

SEQ ID NO: 1950127 - RNA, 15 nt, Shigella flexneri 2a str. 2457T
acaccaaggaacugu

SEQ ID NO: 1950128 - RNA, 18 nt, Shigella flexneri 2a str. 2457T
acacccauggggaugcug

SEQ ID NO: 1950129 - RNA, 12 nt, Shigella flexneri 2a str. 2457T
acacccacauca

SEQ ID NO: 1950130 - RNA, 21 nt, Shigella flexneri 2a str. 2457T
acaccccgcgccgcugagaaa

SEQ ID NO: 1950131 - RNA, 22 nt, Shigella flexneri 2a str. 2457T
acaccgauuuuguaaaagaagg

SEQ ID NO: 1950132 - RNA, 23 nt, Shigella flexneri 2a str. 2457T
acaccgauuuuguaaaagaaggc

SEQ ID NO: 1950133 - RNA, 21 nt, Shigella flexneri 2a str. 2457T
acaccgcagccgccacaauaa

SEQ ID NO: 1950134 - RNA, 22 nt, Shigella flexneri 2a str. 2457T
acaccgcagccgccacaauaaa

SEQ ID NO: 1950135 - RNA, 21 nt, Shigella flexneri 2a str. 2457T
acaccgcgaucuuccacgccu

SEQ ID NO: 1950136 - RNA, 20 nt, Shigella flexneri 2a str. 2457T
acacauugugaaugaucagc

SEQ ID NO: 1950137 - RNA, 14 nt, Shigella flexneri 2a str. 2457T
acaccaacaucacg

SEQ ID NO: 1950138 - RNA, 13 nt, Shigella flexneri 2a str. 2457T
acaccaacaucac

SEQ ID NO: 1950139 - RNA, 21 nt, Shigella flexneri 2a str. 2457T
acacaagcguaagagaacaga

SEQ ID NO: 1950140 - RNA, 17 nt, Shigella flexneri 2a str. 2457T
acacgccgaucgaagag

SEQ ID NO: 1950141 - RNA, 20 nt, Shigella flexneri 2a str. 2457T
acacgccgccagaccaauag

SEQ ID NO: 1950142 - RNA, 18 nt, Shigella flexneri 2a str. 2457T
acacgacauacaccgcag

SEQ ID NO: 1950143 - RNA, 20 nt, Shigella flexneri 2a str. 2457T
acacgcuaccaaaaaaucaa

SEQ ID NO: 1950144 - RNA, 22 nt, Shigella flexneri 2a str. 2457T
acacgcugcgguuuacgccagg

SEQ ID NO: 1950145 - RNA, 13 nt, Shigella flexneri 2a str. 2457T
acaccuuaaggcu

SEQ ID NO: 1950146 - RNA, 22 nt, Shigella flexneri 2a str. 2457T
acaccugggcaauggugaacug

SEQ ID NO: 1950147 - RNA, 19 nt, Shigella flexneri 2a str. 2457T
acaccuucauccagcauca

SEQ ID NO: 1950148 - RNA, 19 nt, Shigella flexneri 2a str. 2457T
acaccuucagcgaagccca

SEQ ID NO: 1950149 - RNA, 20 nt, Shigella flexneri 2a str. 2457T
acaccuucagcgaagcccac

SEQ ID NO: 1950150 - RNA, 15 nt, Shigella flexneri 2a str. 2457T
acaccuuaaggcugu

SEQ ID NO: 1950151 - RNA, 13 nt, Shigella flexneri 2a str. 2457T
acaccggaccaga

SEQ ID NO: 1950152 - RNA, 23 nt, Shigella flexneri 2a str. 2457T
acaccguccggcgggcaaauucu

SEQ ID NO: 1950153 - RNA, 13 nt, Shigella flexneri 2a str. 2457T
acaacgcaauaaa

SEQ ID NO: 1950154 - RNA, 18 nt, Shigella flexneri 2a str. 2457T
acaacgaccggccauucc

SEQ ID NO: 1950155 - RNA, 19 nt, Shigella flexneri 2a str. 2457T
acaacgccauauaaauuuc

SEQ ID NO: 1950156 - RNA, 22 nt, Shigella flexneri 2a str. 2457T
acaagggaaauaagaaaagcga

SEQ ID NO: 1950157 - RNA, 22 nt, Shigella flexneri 2a str. 2457T
acaagggcauauuucgucagca

SEQ ID NO: 1950158 - RNA, 14 nt, Shigella flexneri 2a str. 2457T
acaagguacgaaaa

SEQ ID NO: 1950159 - RNA, 22 nt, Shigella flexneri 2a str. 2457T
acaagguacgaaaaaaauuacu

SEQ ID NO: 1950160 - RNA, 21 nt, Shigella flexneri 2a str. 2457T
acaaggaauguggcaaugagu

SEQ ID NO: 1950161 - RNA, 14 nt, Shigella flexneri 2a str. 2457T
acaaggcaucguga

SEQ ID NO: 1950162 - RNA, 17 nt, Shigella flexneri 2a str. 2457T
acaagcguaugauugcc

SEQ ID NO: 1950163 - RNA, 20 nt, Shigella flexneri 2a str. 2457T
acaauauugaugcucacugc

SEQ ID NO: 1950164 - RNA, 14 nt, Shigella flexneri 2a str. 2457T
acaauagaaauauu

SEQ ID NO: 1950165 - RNA, 15 nt, Shigella flexneri 2a str. 2457T
acaauacaaaugccu

SEQ ID NO: 1950166 - RNA, 12 nt, Shigella flexneri 2a str. 2457T
acaauuugccca

SEQ ID NO: 1950167 - RNA, 18 nt, Shigella flexneri 2a str. 2457T
acaauugcgggccaaaga

SEQ ID NO: 1950168 - RNA, 22 nt, Shigella flexneri 2a str. 2457T
acaaugcggugugcggguuuuc

SEQ ID NO: 1950169 - RNA, 18 nt, Shigella flexneri 2a str. 2457T
acaaugccgauaaauaca

SEQ ID NO: 1950170 - RNA, 22 nt, Shigella flexneri 2a str. 2457T
acaaugagauauuuaaaugauu

SEQ ID NO: 1950171 - RNA, 13 nt, Shigella flexneri 2a str. 2457T
acaaucagccaga

SEQ ID NO: 1950172 - RNA, 23 nt, Shigella flexneri 2a str. 2457T
acaaucagccagaacagcggugc

SEQ ID NO: 1950173 - RNA, 18 nt, Shigella flexneri 2a str. 2457T
acaauauuuuuaucccuc

SEQ ID NO: 1950174 - RNA, 17 nt, Shigella flexneri 2a str. 2457T
acaaucccuuaguaacg

SEQ ID NO: 1950175 - RNA, 21 nt, Shigella flexneri 2a str. 2457T
acaaucccuuaguaacgccag

SEQ ID NO: 1950176 - RNA, 17 nt, Shigella flexneri 2a str. 2457T
acaaucgucagcucgcu

SEQ ID NO: 1950177 - RNA, 24 nt, Shigella flexneri 2a str. 2457T
acaaucgucagcucgcugccauca

SEQ ID NO: 1950178 - RNA, 21 nt, Shigella flexneri 2a str. 2457T
aauccagauccugauccugca

SEQ ID NO: 1950179 - RNA, 12 nt, Shigella flexneri 2a str. 2457T
aauccagaacac

SEQ ID NO: 1950180 - RNA, 22 nt, Shigella flexneri 2a str. 2457T
aauccacguuccuggaaccagu

SEQ ID NO: 1950181 - RNA, 16 nt, Shigella flexneri 2a str. 2457T
aauccacguuccagau

SEQ ID NO: 1950182 - RNA, 15 nt, Shigella flexneri 2a str. 2457T
aauccaaacauggca

SEQ ID NO: 1950183 - RNA, 17 nt, Shigella flexneri 2a str. 2457T
aaucaugccaaaaauaa

SEQ ID NO: 1950184 - RNA, 12 nt, Shigella flexneri 2a str. 2457T
aaucaugcaaua

SEQ ID NO: 1950185 - RNA, 14 nt, Shigella flexneri 2a str. 2457T
aaucaugcaauaaa

SEQ ID NO: 1950186 - RNA, 14 nt, Shigella flexneri 2a str. 2457T
aaucagauaaaaua

SEQ ID NO: 1950187 - RNA, 16 nt, Shigella flexneri 2a str. 2457T
aaucagauaaaauaca

SEQ ID NO: 1950188 - RNA, 23 nt, Shigella flexneri 2a str. 2457T
aaucagauaaaauacacuuuaau

SEQ ID NO: 1950189 - RNA, 22 nt, Shigella flexneri 2a str. 2457T
aaucagaucguugaccugaaua

SEQ ID NO: 1950190 - RNA, 17 nt, Shigella flexneri 2a str. 2457T
aaucagauugccacagg

SEQ ID NO: 1950191 - RNA, 24 nt, Shigella flexneri 2a str. 2457T
aaucagcaauuuuuccugguucuc

SEQ ID NO: 1950192 - RNA, 22 nt, Shigella flexneri 2a str. 2457T
aaucagcaaggaaagccacugu

SEQ ID NO: 1950193 - RNA, 13 nt, Shigella flexneri 2a str. 2457T
aaucagcaauaaa

SEQ ID NO: 1950194 - RNA, 11 nt, Shigella flexneri 2a str. 2457T
aaucagcacac

SEQ ID NO: 1950195 - RNA, 19 nt, Shigella flexneri 2a str. 2457T
aaucgagccgauuaaaauc

SEQ ID NO: 1950196 - RNA, 24 nt, Shigella flexneri 2a str. 2457T
aaucgaucaucaccugagcuggca

SEQ ID NO: 1950197 - RNA, 18 nt, Shigella flexneri 2a str. 2457T
aaucgauaaaacuucccg

SEQ ID NO: 1950198 - RNA, 23 nt, Shigella flexneri 2a str. 2457T
aauccucaacaaaauagaauccg

SEQ ID NO: 1950199 - RNA, 14 nt, Shigella flexneri 2a str. 2457T
aauccuucuuguuc

SEQ ID NO: 1950200 - RNA, 21 nt, Shigella flexneri 2a str. 2457T
aauccuucacuuuugccagac

SEQ ID NO: 1950201 - RNA, 18 nt, Shigella flexneri 2a str. 2457T
aauccgggugaacugcca

SEQ ID NO: 1950202 - RNA, 18 nt, Shigella flexneri 2a str. 2457T
aauccgguagguucaaca

SEQ ID NO: 1950203 - RNA, 19 nt, Shigella flexneri 2a str. 2457T
aauccguaauauucgccuc

SEQ ID NO: 1950204 - RNA, 15 nt, Shigella flexneri 2a str. 2457T
aauccggcagcgaac

SEQ ID NO: 1950205 - RNA, 22 nt, Shigella flexneri 2a str. 2457T
aauccgagaaucguacucacca

SEQ ID NO: 1950206 - RNA, 19 nt, Shigella flexneri 2a str. 2457T
aauccgccagaaaucagcu

SEQ ID NO: 1950207 - RNA, 13 nt, Shigella flexneri 2a str. 2457T
aauccgcaccaac

SEQ ID NO: 1950208 - RNA, 19 nt, Shigella flexneri 2a str. 2457T
aaucccugcgaacugcgca

SEQ ID NO: 1950209 - RNA, 15 nt, Shigella flexneri 2a str. 2457T
aaucucaauuuucac

SEQ ID NO: 1950210 - RNA, 19 nt, Shigella flexneri 2a str. 2457T
aaucgcaacgccuuccguc

SEQ ID NO: 1950211 - RNA, 19 nt, Shigella flexneri 2a str. 2457T
aaucgucaguuuuucacga

SEQ ID NO: 1950212 - RNA, 13 nt, Shigella flexneri 2a str. 2457T
aaucgucaucagc

SEQ ID NO: 1950213 - RNA, 16 nt, Shigella flexneri 2a str. 2457T
aaucgucaucgacagc

SEQ ID NO: 1950214 - RNA, 12 nt, Shigella flexneri 2a str. 2457T
aaucgucaguuc

SEQ ID NO: 1950215 - RNA, 22 nt, Shigella flexneri 2a str. 2457T
aaucgucaaugccgucaccagc

SEQ ID NO: 1950216 - RNA, 17 nt, Shigella flexneri 2a str. 2457T
aaucgucgauuguuaua

SEQ ID NO: 1950217 - RNA, 13 nt, Shigella flexneri 2a str. 2457T
aaucgugaaaaau

SEQ ID NO: 1950218 - RNA, 18 nt, Shigella flexneri 2a str. 2457T
aaucugccagaaggauug

SEQ ID NO: 1950219 - RNA, 14 nt, Shigella flexneri 2a str. 2457T
aaucugauaaucca

SEQ ID NO: 1950220 - RNA, 20 nt, Shigella flexneri 2a str. 2457T
aaucugauagugauccauca

SEQ ID NO: 1950221 - RNA, 14 nt, Shigella flexneri 2a str. 2457T
aaucugauauuuag

SEQ ID NO: 1950222 - RNA, 13 nt, Shigella flexneri 2a str. 2457T
aaucugaaaucau

SEQ ID NO: 1950223 - RNA, 13 nt, Shigella flexneri 2a str. 2457T
aaucugaagaaaa

SEQ ID NO: 1950224 - RNA, 22 nt, Shigella flexneri 2a str. 2457T
aaucugaauuguuuuucguugc

SEQ ID NO: 1950225 - RNA, 21 nt, Shigella flexneri 2a str. 2457T
aaucucuuuuuccaccgcaaa

SEQ ID NO: 1950226 - RNA, 13 nt, Shigella flexneri 2a str. 2457T
aaucucuuccaga

SEQ ID NO: 1950227 - RNA, 12 nt, Shigella flexneri 2a str. 2457T
aaucuuccagaa

SEQ ID NO: 1950228 - RNA, 20 nt, Shigella flexneri 2a str. 2457T
aaucuuccagaucaccgcag

SEQ ID NO: 1950229 - RNA, 17 nt, Shigella flexneri 2a str. 2457T
aaucuguuucaucucuu

SEQ ID NO: 1950230 - RNA, 12 nt, Shigella flexneri 2a str. 2457T
aaucugucuuuu

SEQ ID NO: 1950231 - RNA, 17 nt, Shigella flexneri 2a str. 2457T
aaucugucagguaacaa

SEQ ID NO: 1950232 - RNA, 19 nt, Shigella flexneri 2a str. 2457T
aaucugucguaacugcgcc

SEQ ID NO: 1950233 - RNA, 17 nt, Shigella flexneri 2a str. 2457T
aauauuuucugaaaauc

SEQ ID NO: 1950234 - RNA, 19 nt, Shigella flexneri 2a str. 2457T
aauauuuucugaaaaucau

SEQ ID NO: 1950235 - RNA, 17 nt, Shigella flexneri 2a str. 2457T
aauauuuuucgucaguu

SEQ ID NO: 1950236 - RNA, 14 nt, Shigella flexneri 2a str. 2457T
aauauuuuuaugcc

SEQ ID NO: 1950237 - RNA, 21 nt, Shigella flexneri 2a str. 2457T
aaucaaaaaacuggaaaaaua

SEQ ID NO: 1950238 - RNA, 19 nt, Shigella flexneri 2a str. 2457T
aaucaaaaaaggcugacaa

SEQ ID NO: 1950239 - RNA, 10 nt, Shigella flexneri 2a str. 2457T
aauauuuaau

SEQ ID NO: 1950240 - RNA, 22 nt, Shigella flexneri 2a str. 2457T
aauauugccggaugugaugcau

SEQ ID NO: 1950241 - RNA, 22 nt, Shigella flexneri 2a str. 2457T
aauauucacccgaauaccuuuc

SEQ ID NO: 1950242 - RNA, 23 nt, Shigella flexneri 2a str. 2457T
aauauucuggguaguccaugacc

SEQ ID NO: 1950243 - RNA, 20 nt, Shigella flexneri 2a str. 2457T
aauauggugaaaguaaaaaa

SEQ ID NO: 1950244 - RNA, 23 nt, Shigella flexneri 2a str. 2457T
aauauggugaaaguaaaaaagaa

SEQ ID NO: 1950245 - RNA, 22 nt, Shigella flexneri 2a str. 2457T
aauauguaagaucgaaggcugu

SEQ ID NO: 1950246 - RNA, 14 nt, Shigella flexneri 2a str. 2457T
aauauuacuucaga

SEQ ID NO: 1950247 - RNA, 13 nt, Shigella flexneri 2a str. 2457T
aauauuaaugcug

SEQ ID NO: 1950248 - RNA, 20 nt, Shigella flexneri 2a str. 2457T
aauaugcugguuccugacuc

SEQ ID NO: 1950249 - RNA, 23 nt, Shigella flexneri 2a str. 2457T
aauaugcggugccauuaaaccaa

SEQ ID NO: 1950250 - RNA, 15 nt, Shigella flexneri 2a str. 2457T
aauagaguguuccuc

SEQ ID NO: 1950251 - RNA, 16 nt, Shigella flexneri 2a str. 2457T
aauagcacugcuuucc

SEQ ID NO: 1950252 - RNA, 21 nt, Shigella flexneri 2a str. 2457T
aauagccaauacgauaaugcc

SEQ ID NO: 1950253 - RNA, 14 nt, Shigella flexneri 2a str. 2457T
aauagccaaucauu

SEQ ID NO: 1950254 - RNA, 14 nt, Shigella flexneri 2a str. 2457T
aaucacgcaucacu

SEQ ID NO: 1950255 - RNA, 23 nt, Shigella flexneri 2a str. 2457T
aaucacucuuccccgcuucagcc

SEQ ID NO: 1950256 - RNA, 22 nt, Shigella flexneri 2a str. 2457T
aaucacuauuaaagaaaguaau

SEQ ID NO: 1950257 - RNA, 15 nt, Shigella flexneri 2a str. 2457T
aaucacucaaaauau

SEQ ID NO: 1950258 - RNA, 13 nt, Shigella flexneri 2a str. 2457T
aaucacucaucau

SEQ ID NO: 1950259 - RNA, 19 nt, Shigella flexneri 2a str. 2457T
aaucacuugcgcauaauaa

SEQ ID NO: 1950260 - RNA, 13 nt, Shigella flexneri 2a str. 2457T
aaucacuucuucu

SEQ ID NO: 1950261 - RNA, 20 nt, Shigella flexneri 2a str. 2457T
aaucacuucuucuuguucau

SEQ ID NO: 1950262 - RNA, 13 nt, Shigella flexneri 2a str. 2457T
aaucacugccaga

SEQ ID NO: 1950263 - RNA, 15 nt, Shigella flexneri 2a str. 2457T
aaucacugccagaau

SEQ ID NO: 1950264 - RNA, 14 nt, Shigella flexneri 2a str. 2457T
aaucagaauuuuuc

SEQ ID NO: 1950265 - RNA, 15 nt, Shigella flexneri 2a str. 2457T
aaucagaauuuuucg

SEQ ID NO: 1950266 - RNA, 13 nt, Shigella flexneri 2a str. 2457T
aaucagaaaggcg

SEQ ID NO: 1950267 - RNA, 17 nt, Shigella flexneri 2a str. 2457T
aaucacacaaccaugca

SEQ ID NO: 1950268 - RNA, 17 nt, Shigella flexneri 2a str. 2457T
aaucacaauagaaauau

SEQ ID NO: 1950269 - RNA, 14 nt, Shigella flexneri 2a str. 2457T
aaucacaucaccau

SEQ ID NO: 1950270 - RNA, 19 nt, Shigella flexneri 2a str. 2457T
aaucaccagaugucccauc

SEQ ID NO: 1950271 - RNA, 14 nt, Shigella flexneri 2a str. 2457T
aaucaccacacaac

SEQ ID NO: 1950272 - RNA, 22 nt, Shigella flexneri 2a str. 2457T
aaucaccacaggccugauaaga

SEQ ID NO: 1950273 - RNA, 16 nt, Shigella flexneri 2a str. 2457T
aaucacaucaccauaa

SEQ ID NO: 1950274 - RNA, 23 nt, Shigella flexneri 2a str. 2457T
aaucaccaugccgugaugcgcaa

SEQ ID NO: 1950275 - RNA, 15 nt, Shigella flexneri 2a str. 2457T
aaucaccgccagcaa

SEQ ID NO: 1950276 - RNA, 14 nt, Shigella flexneri 2a str. 2457T
aaucaccgccacca

SEQ ID NO: 1950277 - RNA, 16 nt, Shigella flexneri 2a str. 2457T
aaucaccgcaaacaua

SEQ ID NO: 1950278 - RNA, 17 nt, Shigella flexneri 2a str. 2457T
aaucaccgcaaacauaa

SEQ ID NO: 1950279 - RNA, 19 nt, Shigella flexneri 2a str. 2457T
aaucaccgccaccagcguc

SEQ ID NO: 1950280 - RNA, 21 nt, Shigella flexneri 2a str. 2457T
aaucaccgccacgcccuccug

SEQ ID NO: 1950281 - RNA, 16 nt, Shigella flexneri 2a str. 2457T
aaucaccguuucuggu

SEQ ID NO: 1950282 - RNA, 19 nt, Shigella flexneri 2a str. 2457T
aaucaccucaucaccacag

SEQ ID NO: 1950283 - RNA, 17 nt, Shigella flexneri 2a str. 2457T
aaucaccucaucaccac

SEQ ID NO: 1950284 - RNA, 16 nt, Shigella flexneri 2a str. 2457T
aaucaccucuuuuucc

SEQ ID NO: 1950285 - RNA, 15 nt, Shigella flexneri 2a str. 2457T
aaucaccuuuaaccu

SEQ ID NO: 1950286 - RNA, 19 nt, Shigella flexneri 2a str. 2457T
aaucacgauugcugccgau

SEQ ID NO: 1950287 - RNA, 21 nt, Shigella flexneri 2a str. 2457T
aaucaauggucccgacaaccu

SEQ ID NO: 1950288 - RNA, 13 nt, Shigella flexneri 2a str. 2457T
aaucaaucgcccc

SEQ ID NO: 1950289 - RNA, 14 nt, Shigella flexneri 2a str. 2457T
aaucaauaaaaaua

SEQ ID NO: 1950290 - RNA, 23 nt, Shigella flexneri 2a str. 2457T
aaucacaaaaaguaguuccagca

SEQ ID NO: 1950291 - RNA, 22 nt, Shigella flexneri 2a str. 2457T
aaucaacuuauugguaaacuca

SEQ ID NO: 1950292 - RNA, 14 nt, Shigella flexneri 2a str. 2457T
aaucaaggugauug

SEQ ID NO: 1950293 - RNA, 22 nt, Shigella flexneri 2a str. 2457T
aaucaagcgccgaguaaaaaaa

SEQ ID NO: 1950294 - RNA, 17 nt, Shigella flexneri 2a str. 2457T
aaucaacgcgauauaau

SEQ ID NO: 1950295 - RNA, 18 nt, Shigella flexneri 2a str. 2457T
aaucaaaucaaugccuuu

SEQ ID NO: 1950296 - RNA, 23 nt, Shigella flexneri 2a str. 2457T
aaucaacaauugcgggccaaaga

SEQ ID NO: 1950297 - RNA, 19 nt, Shigella flexneri 2a str. 2457T
aaucaacaccaaacccgga

SEQ ID NO: 1950298 - RNA, 20 nt, Shigella flexneri 2a str. 2457T
aaucaacaccacugccagau

SEQ ID NO: 1950299 - RNA, 15 nt, Shigella flexneri 2a str. 2457T
aaucaaauaaaaaua

SEQ ID NO: 1950300 - RNA, 21 nt, Shigella flexneri 2a str. 2457T
aaucaaauacccuugcagaua

SEQ ID NO: 1950301 - RNA, 19 nt, Shigella flexneri 2a str. 2457T
aaucaaauagccugccaga

SEQ ID NO: 1950302 - RNA, 21 nt, Shigella flexneri 2a str. 2457T
aaaacaagccgaaacggaaau

SEQ ID NO: 1950303 - RNA, 23 nt, Shigella flexneri 2a str. 2457T
aaaacaacgagccaauaaaaaua

SEQ ID NO: 1950304 - RNA, 23 nt, Shigella flexneri 2a str. 2457T
aauugcaggguuuuguuuaaaua

SEQ ID NO: 1950305 - RNA, 15 nt, Shigella flexneri 2a str. 2457T
aauugaugugaaaac

SEQ ID NO: 1950306 - RNA, 17 nt, Shigella flexneri 2a str. 2457T
aauuggaguaucaccau

SEQ ID NO: 1950307 - RNA, 21 nt, Shigella flexneri 2a str. 2457T
aauugccguuaaaacuaaaaa

SEQ ID NO: 1950308 - RNA, 18 nt, Shigella flexneri 2a str. 2457T
aauugccaccaugcaaaa

SEQ ID NO: 1950309 - RNA, 14 nt, Shigella flexneri 2a str. 2457T
aauugccagcuugc

SEQ ID NO: 1950310 - RNA, 19 nt, Shigella flexneri 2a str. 2457T
aauuguuuuauaaagaacu

SEQ ID NO: 1950311 - RNA, 22 nt, Shigella flexneri 2a str. 2457T
aauugugaacgagaaaaugacg

SEQ ID NO: 1950312 - RNA, 17 nt, Shigella flexneri 2a str. 2457T
aauugucuccaccaaug

SEQ ID NO: 1950313 - RNA, 20 nt, Shigella flexneri 2a str. 2457T
aauugguugccggauauucc

SEQ ID NO: 1950314 - RNA, 22 nt, Shigella flexneri 2a str. 2457T
aauuauuguaagcugucgaaaa

SEQ ID NO: 1950315 - RNA, 13 nt, Shigella flexneri 2a str. 2457T
aauuauuauaaua

SEQ ID NO: 1950316 - RNA, 16 nt, Shigella flexneri 2a str. 2457T
aauucagaaaaauaca

SEQ ID NO: 1950317 - RNA, 15 nt, Shigella flexneri 2a str. 2457T
aauucacucuauacc

SEQ ID NO: 1950318 - RNA, 22 nt, Shigella flexneri 2a str. 2457T
aauucaccguaauaguuucuga

SEQ ID NO: 1950319 - RNA, 18 nt, Shigella flexneri 2a str. 2457T
aauucacgaauauuuccc

SEQ ID NO: 1950320 - RNA, 19 nt, Shigella flexneri 2a str. 2457T
aauucacgcaggcgagaau

SEQ ID NO: 1950321 - RNA, 23 nt, Shigella flexneri 2a str. 2457T
aauucacgccacugucauauuug

SEQ ID NO: 1950322 - RNA, 12 nt, Shigella flexneri 2a str. 2457T
aauucaggaaau

SEQ ID NO: 1950323 - RNA, 20 nt, Shigella flexneri 2a str. 2457T
aauuaagcccggucaucagu

SEQ ID NO: 1950324 - RNA, 19 nt, Shigella flexneri 2a str. 2457T
aauuauagggaugcagaau

SEQ ID NO: 1950325 - RNA, 20 nt, Shigella flexneri 2a str. 2457T
aauuauaguaucguuaaauu

SEQ ID NO: 1950326 - RNA, 20 nt, Shigella flexneri 2a str. 2457T
aauuaucaccgcaccuguaa

SEQ ID NO: 1950327 - RNA, 12 nt, Shigella flexneri 2a str. 2457T
aauucccagaau

SEQ ID NO: 1950328 - RNA, 20 nt, Shigella flexneri 2a str. 2457T
aauuccauuucccugacaaa

SEQ ID NO: 1950329 - RNA, 16 nt, Shigella flexneri 2a str. 2457T
aauucccgcagauaaa

SEQ ID NO: 1950330 - RNA, 20 nt, Shigella flexneri 2a str. 2457T
aauucccgcagauaaauauc

SEQ ID NO: 1950331 - RNA, 15 nt, Shigella flexneri 2a str. 2457T
aauuccagaaaagag

SEQ ID NO: 1950332 - RNA, 14 nt, Shigella flexneri 2a str. 2457T
aauucauuccugga

SEQ ID NO: 1950333 - RNA, 22 nt, Shigella flexneri 2a str. 2457T
aauucauucaauuaauaacaca

SEQ ID NO: 1950334 - RNA, 20 nt, Shigella flexneri 2a str. 2457T
aauucauuacgaaguuuaau

SEQ ID NO: 1950335 - RNA, 22 nt, Shigella flexneri 2a str. 2457T
aauucaucuucacuucaucccu

SEQ ID NO: 1950336 - RNA, 19 nt, Shigella flexneri 2a str. 2457T
aauucgaaauagagaaagu

SEQ ID NO: 1950337 - RNA, 18 nt, Shigella flexneri 2a str. 2457T
aauucgacuuucucuggc

SEQ ID NO: 1950338 - RNA, 17 nt, Shigella flexneri 2a str. 2457T
aauucuccgcucucaau

SEQ ID NO: 1950339 - RNA, 20 nt, Shigella flexneri 2a str. 2457T
aauucugagagcaugaaaug

SEQ ID NO: 1950340 - RNA, 23 nt, Shigella flexneri 2a str. 2457T
aauucugagagcaugaaaugaaa

SEQ ID NO: 1950341 - RNA, 20 nt, Shigella flexneri 2a str. 2457T
aauguuguaagcuugacaua

SEQ ID NO: 1950342 - RNA, 15 nt, Shigella flexneri 2a str. 2457T
aauguuuaugccugg

SEQ ID NO: 1950343 - RNA, 15 nt, Shigella flexneri 2a str. 2457T
aauguuugcaauaaa

SEQ ID NO: 1950344 - RNA, 12 nt, Shigella flexneri 2a str. 2457T
aauguuucugca

SEQ ID NO: 1950345 - RNA, 17 nt, Shigella flexneri 2a str. 2457T
aauuaaacccgcaggcg

SEQ ID NO: 1950346 - RNA, 21 nt, Shigella flexneri 2a str. 2457T
aauuaacaccuagugcagaua

SEQ ID NO: 1950347 - RNA, 15 nt, Shigella flexneri 2a str. 2457T
aaugugaaaacccug

SEQ ID NO: 1950348 - RNA, 22 nt, Shigella flexneri 2a str. 2457T
aaugucacaaauaaaaaaugag

SEQ ID NO: 1950349 - RNA, 23 nt, Shigella flexneri 2a str. 2457T
aaugucacaaauaaaaaaugaga

SEQ ID NO: 1950350 - RNA, 23 nt, Shigella flexneri 2a str. 2457T
aaugucgauaaaguuagagccag

SEQ ID NO: 1950351 - RNA, 21 nt, Shigella flexneri 2a str. 2457T
aaugucaucucuggcacgaga

SEQ ID NO: 1950352 - RNA, 18 nt, Shigella flexneri 2a str. 2457T
aauguguuuauaagccau

SEQ ID NO: 1950353 - RNA, 13 nt, Shigella flexneri 2a str. 2457T
aauguuaacgcca

SEQ ID NO: 1950354 - RNA, 13 nt, Shigella flexneri 2a str. 2457T
aauguuaaagaga

SEQ ID NO: 1950355 - RNA, 13 nt, Shigella flexneri 2a str. 2457T
aauguucgucaua

SEQ ID NO: 1950356 - RNA, 19 nt, Shigella flexneri 2a str. 2457T
aauguucguccauuucagc

SEQ ID NO: 1950357 - RNA, 20 nt, Shigella flexneri 2a str. 2457T
aaugcaaucaaaaauggcuu

SEQ ID NO: 1950358 - RNA, 14 nt, Shigella flexneri 2a str. 2457T
aaugcacauauucu

SEQ ID NO: 1950359 - RNA, 17 nt, Shigella flexneri 2a str. 2457T
aaugcaccaacaaauag

SEQ ID NO: 1950360 - RNA, 15 nt, Shigella flexneri 2a str. 2457T
aaucuugcaaauuca

SEQ ID NO: 1950361 - RNA, 13 nt, Shigella flexneri 2a str. 2457T
aaucuugaaacca

SEQ ID NO: 1950362 - RNA, 22 nt, Shigella flexneri 2a str. 2457T
aaugccuucuggaaaucaggaa

SEQ ID NO: 1950363 - RNA, 14 nt, Shigella flexneri 2a str. 2457T
aaugccuuucucag

SEQ ID NO: 1950364 - RNA, 21 nt, Shigella flexneri 2a str. 2457T
aaugcgaaaacgauguuugcu

SEQ ID NO: 1950365 - RNA, 16 nt, Shigella flexneri 2a str. 2457T
aaugcgacaacagaaa

SEQ ID NO: 1950366 - RNA, 14 nt, Shigella flexneri 2a str. 2457T
aaugcgcaaaauuc

SEQ ID NO: 1950367 - RNA, 16 nt, Shigella flexneri 2a str. 2457T
aaugcgauggcaaaag

SEQ ID NO: 1950368 - RNA, 17 nt, Shigella flexneri 2a str. 2457T
aaugccagauaagacac

SEQ ID NO: 1950369 - RNA, 19 nt, Shigella flexneri 2a str. 2457T
aaugccaaauauuucuuua

SEQ ID NO: 1950370 - RNA, 17 nt, Shigella flexneri 2a str. 2457T
aaugccaccagggauaa

SEQ ID NO: 1950371 - RNA, 19 nt, Shigella flexneri 2a str. 2457T
aaugccacauuagauaaaa

SEQ ID NO: 1950372 - RNA, 23 nt, Shigella flexneri 2a str. 2457T
aaugccacaaacgccgugcacac

SEQ ID NO: 1950373 - RNA, 14 nt, Shigella flexneri 2a str. 2457T
aauggaaacagcac

SEQ ID NO: 1950374 - RNA, 12 nt, Shigella flexneri 2a str. 2457T
aauggaaaacug

SEQ ID NO: 1950375 - RNA, 15 nt, Shigella flexneri 2a str. 2457T
aauggaaauuguuuu

SEQ ID NO: 1950376 - RNA, 12 nt, Shigella flexneri 2a str. 2457T
aaugcuucacac

SEQ ID NO: 1950377 - RNA, 23 nt, Shigella flexneri 2a str. 2457T
aaugcggccuuuuuauuuauuca

SEQ ID NO: 1950378 - RNA, 22 nt, Shigella flexneri 2a str. 2457T
aaugcugucgguuuauggaaaa

SEQ ID NO: 1950379 - RNA, 19 nt, Shigella flexneri 2a str. 2457T
aaugcuguuccagaccaua

SEQ ID NO: 1950380 - RNA, 17 nt, Shigella flexneri 2a str. 2457T
aaugcgcggucagaaaa

SEQ ID NO: 1950381 - RNA, 18 nt, Shigella flexneri 2a str. 2457T
aaugcgcggucagaaaau

SEQ ID NO: 1950382 - RNA, 17 nt, Shigella flexneri 2a str. 2457T
aaugcgcaucaaagcca

SEQ ID NO: 1950383 - RNA, 18 nt, Shigella flexneri 2a str. 2457T
aaugcgcaucaaagccag

SEQ ID NO: 1950384 - RNA, 14 nt, Shigella flexneri 2a str. 2457T
aauggcaucugaua

SEQ ID NO: 1950385 - RNA, 18 nt, Shigella flexneri 2a str. 2457T
aauggagacgguuucugc

SEQ ID NO: 1950386 - RNA, 22 nt, Shigella flexneri 2a str. 2457T
aauggaaagcccgccccgcucg

SEQ ID NO: 1950387 - RNA, 23 nt, Shigella flexneri 2a str. 2457T
aauggaaucgcucucagagagaa

SEQ ID NO: 1950388 - RNA, 23 nt, Shigella flexneri 2a str. 2457T
aauggccggaacgcuuucuuugg

SEQ ID NO: 1950389 - RNA, 19 nt, Shigella flexneri 2a str. 2457T
aauggcgacauaaaauaac

SEQ ID NO: 1950390 - RNA, 20 nt, Shigella flexneri 2a str. 2457T
aauggcaucugauaagccca

SEQ ID NO: 1950391 - RNA, 17 nt, Shigella flexneri 2a str. 2457T
aauggcccaaaaggcag

SEQ ID NO: 1950392 - RNA, 19 nt, Shigella flexneri 2a str. 2457T
aauggcgcauccagccaac

SEQ ID NO: 1950393 - RNA, 18 nt, Shigella flexneri 2a str. 2457T
aaugguuucauuccagua

SEQ ID NO: 1950394 - RNA, 19 nt, Shigella flexneri 2a str. 2457T
aauguaauacgcucaucug

SEQ ID NO: 1950395 - RNA, 16 nt, Shigella flexneri 2a str. 2457T
aacagcaaccuccguc

SEQ ID NO: 1950396 - RNA, 20 nt, Shigella flexneri 2a str. 2457T
aacagcagaacgaccagcgc

SEQ ID NO: 1950397 - RNA, 15 nt, Shigella flexneri 2a str. 2457T
aacagcaccagcagg

SEQ ID NO: 1950398 - RNA, 13 nt, Shigella flexneri 2a str. 2457T
aacagcacaucag

SEQ ID NO: 1950399 - RNA, 16 nt, Shigella flexneri 2a str. 2457T
aacagcacaucagcca

SEQ ID NO: 1950400 - RNA, 14 nt, Shigella flexneri 2a str. 2457T
aacagcagggccug

SEQ ID NO: 1950401 - RNA, 15 nt, Shigella flexneri 2a str. 2457T
aacagcagggccuga

SEQ ID NO: 1950402 - RNA, 17 nt, Shigella flexneri 2a str. 2457T
aacagcaggcagaucca

SEQ ID NO: 1950403 - RNA, 17 nt, Shigella flexneri 2a str. 2457T
aacagccagcagcgaau

SEQ ID NO: 1950404 - RNA, 21 nt, Shigella flexneri 2a str. 2457T
aacagccagcgcugacgugau

SEQ ID NO: 1950405 - RNA, 11 nt, Shigella flexneri 2a str. 2457T
aacagcaguug

SEQ ID NO: 1950406 - RNA, 15 nt, Shigella flexneri 2a str. 2457T
aacagacaaaaagaa

SEQ ID NO: 1950407 - RNA, 22 nt, Shigella flexneri 2a str. 2457T
aacagaauuacuggcagauuau

SEQ ID NO: 1950408 - RNA, 13 nt, Shigella flexneri 2a str. 2457T
aacagacaaaaag

SEQ ID NO: 1950409 - RNA, 14 nt, Shigella flexneri 2a str. 2457T
aacagaagaaagca

SEQ ID NO: 1950410 - RNA, 23 nt, Shigella flexneri 2a str. 2457T
aacagaacgcgccuuaaaaacca

SEQ ID NO: 1950411 - RNA, 14 nt, Shigella flexneri 2a str. 2457T
aacagaacaauaau

SEQ ID NO: 1950412 - RNA, 20 nt, Shigella flexneri 2a str. 2457T
aacacuuugccgucagccac

SEQ ID NO: 1950413 - RNA, 17 nt, Shigella flexneri 2a str. 2457T
aacagaaacgccaucca

SEQ ID NO: 1950414 - RNA, 12 nt, Shigella flexneri 2a str. 2457T
aacagagauuac

SEQ ID NO: 1950415 - RNA, 19 nt, Shigella flexneri 2a str. 2457T
aacagaccacauuccaggc

SEQ ID NO: 1950416 - RNA, 13 nt, Shigella flexneri 2a str. 2457T
aacagaccagcac

SEQ ID NO: 1950417 - RNA, 13 nt, Shigella flexneri 2a str. 2457T
aacagaccauaac

SEQ ID NO: 1950418 - RNA, 16 nt, Shigella flexneri 2a str. 2457T
aacacucucugaagua

SEQ ID NO: 1950419 - RNA, 20 nt, Shigella flexneri 2a str. 2457T
aacacuguuaccgcugcugg

SEQ ID NO: 1950420 - RNA, 23 nt, Shigella flexneri 2a str. 2457T
aacacucuuccagucgccugcuu

SEQ ID NO: 1950421 - RNA, 19 nt, Shigella flexneri 2a str. 2457T
aacacgcgaccaaaggcga

SEQ ID NO: 1950422 - RNA, 22 nt, Shigella flexneri 2a str. 2457T
aacacgaucucacgcugaaaga

SEQ ID NO: 1950423 - RNA, 19 nt, Shigella flexneri 2a str. 2457T
aacacgggguuaaauugau

SEQ ID NO: 1950424 - RNA, 20 nt, Shigella flexneri 2a str. 2457T
aacacgacauacaccgcagc

SEQ ID NO: 1950425 - RNA, 18 nt, Shigella flexneri 2a str. 2457T
aacaccuguuccaguggc

SEQ ID NO: 1950426 - RNA, 18 nt, Shigella flexneri 2a str. 2457T
aacaccuucauccagcau

SEQ ID NO: 1950427 - RNA, 12 nt, Shigella flexneri 2a str. 2457T
aacaccuggcgc

SEQ ID NO: 1950428 - RNA, 14 nt, Shigella flexneri 2a str. 2457T
aacaccgaaccaga

SEQ ID NO: 1950429 - RNA, 21 nt, Shigella flexneri 2a str. 2457T
aacaccgauuuuguaaaagaa

SEQ ID NO: 1950430 - RNA, 22 nt, Shigella flexneri 2a str. 2457T
aacaccgauuuuguaaaagaag

SEQ ID NO: 1950431 - RNA, 21 nt, Shigella flexneri 2a str. 2457T
aacacccgaccaucaacuaaa

SEQ ID NO: 1950432 - RNA, 15 nt, Shigella flexneri 2a str. 2457T
aacaccgucgccuuc

SEQ ID NO: 1950433 - RNA, 23 nt, Shigella flexneri 2a str. 2457T
aacaccgugcauuucucacuuuu

SEQ ID NO: 1950434 - RNA, 19 nt, Shigella flexneri 2a str. 2457T
aacacauugugaaugauca

SEQ ID NO: 1950435 - RNA, 12 nt, Shigella flexneri 2a str. 2457T
aacaccaaaccc

SEQ ID NO: 1950436 - RNA, 14 nt, Shigella flexneri 2a str. 2457T
aacaccaaacccug

SEQ ID NO: 1950437 - RNA, 17 nt, Shigella flexneri 2a str. 2457T
aacaccaccugccagag

SEQ ID NO: 1950438 - RNA, 13 nt, Shigella flexneri 2a str. 2457T
aacaccagcagua

SEQ ID NO: 1950439 - RNA, 16 nt, Shigella flexneri 2a str. 2457T
aaaaagucagaucguu

SEQ ID NO: 1950440 - RNA, 23 nt, Shigella flexneri 2a str. 2457T
aaaaaguaagaauugauaaaaaa

SEQ ID NO: 1950441 - RNA, 18 nt, Shigella flexneri 2a str. 2457T
aacacauucaaacgauuu

SEQ ID NO: 1950442 - RNA, 16 nt, Shigella flexneri 2a str. 2457T
aacacauuauuaagaa

SEQ ID NO: 1950443 - RNA, 15 nt, Shigella flexneri 2a str. 2457T
aacacaauauucaua

SEQ ID NO: 1950444 - RNA, 14 nt, Shigella flexneri 2a str. 2457T
aacacacauuuauc

SEQ ID NO: 1950445 - RNA, 20 nt, Shigella flexneri 2a str. 2457T
aacacacguaggccggauaa

SEQ ID NO: 1950446 - RNA, 20 nt, Shigella flexneri 2a str. 2457T
aacacagauugauaaaaaua

SEQ ID NO: 1950447 - RNA, 22 nt, Shigella flexneri 2a str. 2457T
aacacagauugauaaaaauagu

SEQ ID NO: 1950448 - RNA, 22 nt, Shigella flexneri 2a str. 2457T
aacacacuuuccaguuccggca

SEQ ID NO: 1950449 - RNA, 13 nt, Shigella flexneri 2a str. 2457T
aacacacuuucca

SEQ ID NO: 1950450 - RNA, 20 nt, Shigella flexneri 2a str. 2457T
aacacauaaccguacaaucg

SEQ ID NO: 1950451 - RNA, 24 nt, Shigella flexneri 2a str. 2457T
aacacauauauuaauugccguuaa

SEQ ID NO: 1950452 - RNA, 17 nt, Shigella flexneri 2a str. 2457T
aacacaggauacgcaua

SEQ ID NO: 1950453 - RNA, 20 nt, Shigella flexneri 2a str. 2457T
aaaaaggcugacaaaucaga

SEQ ID NO: 1950454 - RNA, 23 nt, Shigella flexneri 2a str. 2457T
aaaaagguccuguaaugagaaua

SEQ ID NO: 1950455 - RNA, 19 nt, Shigella flexneri 2a str. 2457T
aacaaucacaauagaaaua

SEQ ID NO: 1950456 - RNA, 14 nt, Shigella flexneri 2a str. 2457T
aacaaucacaauag

SEQ ID NO: 1950457 - RNA, 18 nt, Shigella flexneri 2a str. 2457T
aacaaucacaauagaaau

SEQ ID NO: 1950458 - RNA, 19 nt, Shigella flexneri 2a str. 2457T
aacaaugccgauaaauaca

SEQ ID NO: 1950459 - RNA, 12 nt, Shigella flexneri 2a str. 2457T
aacaaugcguuu

SEQ ID NO: 1950460 - RNA, 15 nt, Shigella flexneri 2a str. 2457T
aacaaucucuuccag

SEQ ID NO: 1950461 - RNA, 19 nt, Shigella flexneri 2a str. 2457T
aacaauucguuguuuuugu

SEQ ID NO: 1950462 - RNA, 22 nt, Shigella flexneri 2a str. 2457T
aacaauucccgcagcuccagcc

SEQ ID NO: 1950463 - RNA, 16 nt, Shigella flexneri 2a str. 2457T
aacaauuucuucuggu

SEQ ID NO: 1950464 - RNA, 14 nt, Shigella flexneri 2a str. 2457T
aacaauauuaacuc

SEQ ID NO: 1950465 - RNA, 15 nt, Shigella flexneri 2a str. 2457T
aacaauacaaaugcc

SEQ ID NO: 1950466 - RNA, 14 nt, Shigella flexneri 2a str. 2457T
aaauucuggcacca

SEQ ID NO: 1950467 - RNA, 17 nt, Shigella flexneri 2a str. 2457T
aaauucuggcaccaccu

SEQ ID NO: 1950468 - RNA, 18 nt, Shigella flexneri 2a str. 2457T
aaauucuggcggcaauaa

SEQ ID NO: 1950469 - RNA, 18 nt, Shigella flexneri 2a str. 2457T
aaauucuccuuucuuucu

SEQ ID NO: 1950470 - RNA, 23 nt, Shigella flexneri 2a str. 2457T
aaauucuccuuucuuucuggaaa

SEQ ID NO: 1950471 - RNA, 20 nt, Shigella flexneri 2a str. 2457T
aaauucuucugaaugugccu

SEQ ID NO: 1950472 - RNA, 14 nt, Shigella flexneri 2a str. 2457T
aaauucuuaaugau

SEQ ID NO: 1950473 - RNA, 19 nt, Shigella flexneri 2a str. 2457T
aaauucuuacguaauuuau

SEQ ID NO: 1950474 - RNA, 23 nt, Shigella flexneri 2a str. 2457T
aaccacgccuaaaauccacaucg

SEQ ID NO: 1950475 - RNA, 17 nt, Shigella flexneri 2a str. 2457T
aaccacggaaaggcagu

SEQ ID NO: 1950476 - RNA, 22 nt, Shigella flexneri 2a str. 2457T
aaccacaaugucacaaauaaaa

SEQ ID NO: 1950477 - RNA, 18 nt, Shigella flexneri 2a str. 2457T
aaccacgacuuuuugucu

SEQ ID NO: 1950478 - RNA, 19 nt, Shigella flexneri 2a str. 2457T
aaccaugucgcauccgaca

SEQ ID NO: 1950479 - RNA, 23 nt, Shigella flexneri 2a str. 2457T
aacccgucugguuugggcaugau

SEQ ID NO: 1950480 - RNA, 22 nt, Shigella flexneri 2a str. 2457T
aacccguauguucccaccagcc

SEQ ID NO: 1950481 - RNA, 17 nt, Shigella flexneri 2a str. 2457T
aacccggcaccaacaaa

SEQ ID NO: 1950482 - RNA, 21 nt, Shigella flexneri 2a str. 2457T
aacccagcgauggacgcagac

SEQ ID NO: 1950483 - RNA, 21 nt, Shigella flexneri 2a str. 2457T
aaccauuuguucguguuaaca

SEQ ID NO: 1950484 - RNA, 14 nt, Shigella flexneri 2a str. 2457T
aacccacacauuuc

SEQ ID NO: 1950485 - RNA, 23 nt, Shigella flexneri 2a str. 2457T
aacccagaagaaagccggaugau

SEQ ID NO: 1950486 - RNA, 13 nt, Shigella flexneri 2a str. 2457T
aacccaccaugcc

SEQ ID NO: 1950487 - RNA, 14 nt, Shigella flexneri 2a str. 2457T
aaccgaugaacugg

SEQ ID NO: 1950488 - RNA, 15 nt, Shigella flexneri 2a str. 2457T
aaccgaugaacuggc

SEQ ID NO: 1950489 - RNA, 15 nt, Shigella flexneri 2a str. 2457T
aaccgcaaaugauua

SEQ ID NO: 1950490 - RNA, 21 nt, Shigella flexneri 2a str. 2457T
aaccgcaaaugauuagugcca

SEQ ID NO: 1950491 - RNA, 20 nt, Shigella flexneri 2a str. 2457T
aaccgcaucaacagugccaa

SEQ ID NO: 1950492 - RNA, 21 nt, Shigella flexneri 2a str. 2457T
aaccgcaucaacagugccaau

SEQ ID NO: 1950493 - RNA, 15 nt, Shigella flexneri 2a str. 2457T
aaccgcagugauuuc

SEQ ID NO: 1950494 - RNA, 18 nt, Shigella flexneri 2a str. 2457T
aaccgcaguguaguucug

SEQ ID NO: 1950495 - RNA, 19 nt, Shigella flexneri 2a str. 2457T
aaccgcuacauacuuaaau

SEQ ID NO: 1950496 - RNA, 15 nt, Shigella flexneri 2a str. 2457T
aaccgcugcaaaaaa

SEQ ID NO: 1950497 - RNA, 17 nt, Shigella flexneri 2a str. 2457T
aaccgcgaugaccaaaa

SEQ ID NO: 1950498 - RNA, 19 nt, Shigella flexneri 2a str. 2457T
aaccgccugcgaguuuuac

SEQ ID NO: 1950499 - RNA, 13 nt, Shigella flexneri 2a str. 2457T
aaccgccuggcgc

SEQ ID NO: 1950500 - RNA, 22 nt, Shigella flexneri 2a str. 2457T
aaccgcccagugccagcaccac

SEQ ID NO: 1950501 - RNA, 17 nt, Shigella flexneri 2a str. 2457T
aacccuaacccaacauu

SEQ ID NO: 1950502 - RNA, 22 nt, Shigella flexneri 2a str. 2457T
aacccugagugaauuguuuuau

SEQ ID NO: 1950503 - RNA, 14 nt, Shigella flexneri 2a str. 2457T
aacccuucuuccau

SEQ ID NO: 1950504 - RNA, 18 nt, Shigella flexneri 2a str. 2457T
aacccuugcguuucugac

SEQ ID NO: 1950505 - RNA, 18 nt, Shigella flexneri 2a str. 2457T
aaccgagguuaaugaucg

SEQ ID NO: 1950506 - RNA, 18 nt, Shigella flexneri 2a str. 2457T
aaccgaguuaguccacac

SEQ ID NO: 1950507 - RNA, 14 nt, Shigella flexneri 2a str. 2457T
aaccgaaggcacca

SEQ ID NO: 1950508 - RNA, 13 nt, Shigella flexneri 2a str. 2457T
aaccgacugccau

SEQ ID NO: 1950509 - RNA, 16 nt, Shigella flexneri 2a str. 2457T
aaccgaacccagcagg

SEQ ID NO: 1950510 - RNA, 19 nt, Shigella flexneri 2a str. 2457T
aacaucaaaaagcugucgu

SEQ ID NO: 1950511 - RNA, 20 nt, Shigella flexneri 2a str. 2457T
aacaucaugccggccagcgc

SEQ ID NO: 1950512 - RNA, 13 nt, Shigella flexneri 2a str. 2457T
aacauccagauca

SEQ ID NO: 1950513 - RNA, 13 nt, Shigella flexneri 2a str. 2457T
aacaucaucuccc

SEQ ID NO: 1950514 - RNA, 16 nt, Shigella flexneri 2a str. 2457T
aacaugaaacagaaaa

SEQ ID NO: 1950515 - RNA, 22 nt, Shigella flexneri 2a str. 2457T
aacaugacgcgcaucacgacaa

SEQ ID NO: 1950516 - RNA, 18 nt, Shigella flexneri 2a str. 2457T
aacaucccuguaaaacgc

SEQ ID NO: 1950517 - RNA, 17 nt, Shigella flexneri 2a str. 2457T
aacaucccgguaauaau

SEQ ID NO: 1950518 - RNA, 22 nt, Shigella flexneri 2a str. 2457T
aacagccugugccugagccgga

SEQ ID NO: 1950519 - RNA, 22 nt, Shigella flexneri 2a str. 2457T
aacagccuuaaacucaauauua

SEQ ID NO: 1950520 - RNA, 22 nt, Shigella flexneri 2a str. 2457T
aacagcgcaccagaaacaauaa

SEQ ID NO: 1950521 - RNA, 17 nt, Shigella flexneri 2a str. 2457T
aacauaaucaauaaaaa

SEQ ID NO: 1950522 - RNA, 16 nt, Shigella flexneri 2a str. 2457T
aacagccccugagcgu

SEQ ID NO: 1950523 - RNA, 22 nt, Shigella flexneri 2a str. 2457T
aacauacugcuccauaauugcc

SEQ ID NO: 1950524 - RNA, 22 nt, Shigella flexneri 2a str. 2457T
aacauacugcccgagcgccauu

SEQ ID NO: 1950525 - RNA, 13 nt, Shigella flexneri 2a str. 2457T
aacauacaaauag

SEQ ID NO: 1950526 - RNA, 12 nt, Shigella flexneri 2a str. 2457T
aacauaaugcaa

SEQ ID NO: 1950527 - RNA, 14 nt, Shigella flexneri 2a str. 2457T
aacauaaugcaacg

SEQ ID NO: 1950528 - RNA, 20 nt, Shigella flexneri 2a str. 2457T
aacauaccuaaaagcacgcc

SEQ ID NO: 1950529 - RNA, 19 nt, Shigella flexneri 2a str. 2457T
aacauacaaauagccaauu

SEQ ID NO: 1950530 - RNA, 20 nt, Shigella flexneri 2a str. 2457T
aacauacaaauagccaauuc

SEQ ID NO: 1950531 - RNA, 20 nt, Shigella flexneri 2a str. 2457T
aacaugagcgaauaaaaaaa

SEQ ID NO: 1950532 - RNA, 14 nt, Shigella flexneri 2a str. 2457T
aacauuacgugggc

SEQ ID NO: 1950533 - RNA, 23 nt, Shigella flexneri 2a str. 2457T
aacauggugggcggguggaguau

SEQ ID NO: 1950534 - RNA, 18 nt, Shigella flexneri 2a str. 2457T
aacauguuccugccaguc

SEQ ID NO: 1950535 - RNA, 14 nt, Shigella flexneri 2a str. 2457T
aacauuacuuuccg

SEQ ID NO: 1950536 - RNA, 17 nt, Shigella flexneri 2a str. 2457T
aacauuaggaauaaugu

SEQ ID NO: 1950537 - RNA, 21 nt, Shigella flexneri 2a str. 2457T
aacauucgccgcugugauuuc

SEQ ID NO: 1950538 - RNA, 19 nt, Shigella flexneri 2a str. 2457T
aacauucgccgcugugauu

SEQ ID NO: 1950539 - RNA, 19 nt, Shigella flexneri 2a str. 2457T
aaccaacaauugcccccca

SEQ ID NO: 1950540 - RNA, 13 nt, Shigella flexneri 2a str. 2457T
aaccaacaccugu

SEQ ID NO: 1950541 - RNA, 21 nt, Shigella flexneri 2a str. 2457T
aaccaacaccuguuccagugg

SEQ ID NO: 1950542 - RNA, 20 nt, Shigella flexneri 2a str. 2457T
aaccaacggcgagccagcgc

SEQ ID NO: 1950543 - RNA, 17 nt, Shigella flexneri 2a str. 2457T
aaccaacgccagcagca

SEQ ID NO: 1950544 - RNA, 14 nt, Shigella flexneri 2a str. 2457T
aaccaaauaaaaua

SEQ ID NO: 1950545 - RNA, 14 nt, Shigella flexneri 2a str. 2457T
aacauugcugccag

SEQ ID NO: 1950546 - RNA, 12 nt, Shigella flexneri 2a str. 2457T
aacauugcugcu

SEQ ID NO: 1950547 - RNA, 19 nt, Shigella flexneri 2a str. 2457T
aacauugcugcugaagcaa

SEQ ID NO: 1950548 - RNA, 13 nt, Shigella flexneri 2a str. 2457T
aaccaaugccacc

SEQ ID NO: 1950549 - RNA, 13 nt, Shigella flexneri 2a str. 2457T
aaccaaucuccca

SEQ ID NO: 1950550 - RNA, 16 nt, Shigella flexneri 2a str. 2457T
aagaauaucuucuguu

SEQ ID NO: 1950551 - RNA, 17 nt, Shigella flexneri 2a str. 2457T
aagaaucaugccaaaaa

SEQ ID NO: 1950552 - RNA, 20 nt, Shigella flexneri 2a str. 2457T
aagaauacagggaaagaagu

SEQ ID NO: 1950553 - RNA, 21 nt, Shigella flexneri 2a str. 2457T
aagaaguuccagggcagcagu

SEQ ID NO: 1950554 - RNA, 20 nt, Shigella flexneri 2a str. 2457T
aagaaguaaaacagucgcuc

SEQ ID NO: 1950555 - RNA, 23 nt, Shigella flexneri 2a str. 2457T
aagaagaucguggagaacaauau

SEQ ID NO: 1950556 - RNA, 19 nt, Shigella flexneri 2a str. 2457T
aagaagcggugaaaaaauu

SEQ ID NO: 1950557 - RNA, 18 nt, Shigella flexneri 2a str. 2457T
aagaagccgccagaccga

SEQ ID NO: 1950558 - RNA, 16 nt, Shigella flexneri 2a str. 2457T
aagaaacgcuuaaaac

SEQ ID NO: 1950559 - RNA, 13 nt, Shigella flexneri 2a str. 2457T
aagaaaaaagauu

SEQ ID NO: 1950560 - RNA, 19 nt, Shigella flexneri 2a str. 2457T
aacuuguagcuuucaacgc

SEQ ID NO: 1950561 - RNA, 11 nt, Shigella flexneri 2a str. 2457T
aagaaccaugc

SEQ ID NO: 1950562 - RNA, 23 nt, Shigella flexneri 2a str. 2457T
aagaacaccagagccugccaaug

SEQ ID NO: 1950563 - RNA, 19 nt, Shigella flexneri 2a str. 2457T
aagaaaguggcaggcucau

SEQ ID NO: 1950564 - RNA, 21 nt, Shigella flexneri 2a str. 2457T
aagaaagcaaugaaauucauu

SEQ ID NO: 1950565 - RNA, 17 nt, Shigella flexneri 2a str. 2457T
aagaaagcaaugaaauu

SEQ ID NO: 1950566 - RNA, 22 nt, Shigella flexneri 2a str. 2457T
aacuucacaucaccauagccua

SEQ ID NO: 1950567 - RNA, 18 nt, Shigella flexneri 2a str. 2457T
aacuugacucgccugaaa

SEQ ID NO: 1950568 - RNA, 12 nt, Shigella flexneri 2a str. 2457T
aacuugauacug

SEQ ID NO: 1950569 - RNA, 21 nt, Shigella flexneri 2a str. 2457T
aacuucuuuuucgacaaacac

SEQ ID NO: 1950570 - RNA, 16 nt, Shigella flexneri 2a str. 2457T
aacuucaccgguucau

SEQ ID NO: 1950571 - RNA, 21 nt, Shigella flexneri 2a str. 2457T
aacuucaccgguucaucacga

SEQ ID NO: 1950572 - RNA, 14 nt, Shigella flexneri 2a str. 2457T
aacuucaccagcac

SEQ ID NO: 1950573 - RNA, 17 nt, Shigella flexneri 2a str. 2457T
aacuucuucaguuuuuc

SEQ ID NO: 1950574 - RNA, 16 nt, Shigella flexneri 2a str. 2457T
aacugguguaagucgg

SEQ ID NO: 1950575 - RNA, 21 nt, Shigella flexneri 2a str. 2457T
aacuuacugauaguguuuuau

SEQ ID NO: 1950576 - RNA, 22 nt, Shigella flexneri 2a str. 2457T
aacuuaccgccgcuccagaauc

SEQ ID NO: 1950577 - RNA, 20 nt, Shigella flexneri 2a str. 2457T
aacuuacugacaucaaaccc

SEQ ID NO: 1950578 - RNA, 12 nt, Shigella flexneri 2a str. 2457T
aacuuaagucuc

SEQ ID NO: 1950579 - RNA, 15 nt, Shigella flexneri 2a str. 2457T
aacuuaagucuccau

SEQ ID NO: 1950580 - RNA, 14 nt, Shigella flexneri 2a str. 2457T
aacuuaaugucaua

SEQ ID NO: 1950581 - RNA, 20 nt, Shigella flexneri 2a str. 2457T
aacucaaaaauaaucaucuc

SEQ ID NO: 1950582 - RNA, 14 nt, Shigella flexneri 2a str. 2457T
aacucuuccuuaac

SEQ ID NO: 1950583 - RNA, 17 nt, Shigella flexneri 2a str. 2457T
aacucuuccuuaacauc

SEQ ID NO: 1950584 - RNA, 19 nt, Shigella flexneri 2a str. 2457T
aacucaaaaauaaucaucu

SEQ ID NO: 1950585 - RNA, 19 nt, Shigella flexneri 2a str. 2457T
aacugauuuagcaucagcg

SEQ ID NO: 1950586 - RNA, 19 nt, Shigella flexneri 2a str. 2457T
aacucuuuuuccugcugca

SEQ ID NO: 1950587 - RNA, 21 nt, Shigella flexneri 2a str. 2457T
aacugaaaggcgcucauuuuc

SEQ ID NO: 1950588 - RNA, 15 nt, Shigella flexneri 2a str. 2457T
aacugaauaauacac

SEQ ID NO: 1950589 - RNA, 23 nt, Shigella flexneri 2a str. 2457T
aacugaagauugaacagcagaac

SEQ ID NO: 1950590 - RNA, 11 nt, Shigella flexneri 2a str. 2457T
aacugaagcug

SEQ ID NO: 1950591 - RNA, 14 nt, Shigella flexneri 2a str. 2457T
aacuggaaaaauaa

SEQ ID NO: 1950592 - RNA, 17 nt, Shigella flexneri 2a str. 2457T
aacuggaaaaauaauuu

SEQ ID NO: 1950593 - RNA, 16 nt, Shigella flexneri 2a str. 2457T
aacugcuguuaauuca

SEQ ID NO: 1950594 - RNA, 11 nt, Shigella flexneri 2a str. 2457T
aacuggcaaca

SEQ ID NO: 1950595 - RNA, 15 nt, Shigella flexneri 2a str. 2457T
aacuggaugaaaaaa

SEQ ID NO: 1950596 - RNA, 13 nt, Shigella flexneri 2a str. 2457T
aacuggcaggaaa

SEQ ID NO: 1950597 - RNA, 20 nt, Shigella flexneri 2a str. 2457T
aacugcuauucaccagcaaa

SEQ ID NO: 1950598 - RNA, 14 nt, Shigella flexneri 2a str. 2457T
aacguaacaaaacu

SEQ ID NO: 1950599 - RNA, 18 nt, Shigella flexneri 2a str. 2457T
aacgucucuauuucaccc

SEQ ID NO: 1950600 - RNA, 22 nt, Shigella flexneri 2a str. 2457T
aacgucgcaagacgaaaaauga

SEQ ID NO: 1950601 - RNA, 13 nt, Shigella flexneri 2a str. 2457T
aacgucuugcuga

SEQ ID NO: 1950602 - RNA, 12 nt, Shigella flexneri 2a str. 2457T
aacgucuucccg

SEQ ID NO: 1950603 - RNA, 13 nt, Shigella flexneri 2a str. 2457T
aacguuccagcaa

SEQ ID NO: 1950604 - RNA, 17 nt, Shigella flexneri 2a str. 2457T
aacguugaauuucaggu

SEQ ID NO: 1950605 - RNA, 22 nt, Shigella flexneri 2a str. 2457T
aacguugcugcgccgagcaaua

SEQ ID NO: 1950606 - RNA, 21 nt, Shigella flexneri 2a str. 2457T
aacgugugcuuuguucaugcc

SEQ ID NO: 1950607 - RNA, 20 nt, Shigella flexneri 2a str. 2457T
aacgugcggggguuuucucu

SEQ ID NO: 1950608 - RNA, 15 nt, Shigella flexneri 2a str. 2457T
aacgugggccuggcg

SEQ ID NO: 1950609 - RNA, 16 nt, Shigella flexneri 2a str. 2457T
aacgugaucaaaucau

SEQ ID NO: 1950610 - RNA, 19 nt, Shigella flexneri 2a str. 2457T
aacgugcaaaaucaaacag

SEQ ID NO: 1950611 - RNA, 13 nt, Shigella flexneri 2a str. 2457T
aacguuuuuaaaa

SEQ ID NO: 1950612 - RNA, 22 nt, Shigella flexneri 2a str. 2457T
aacuaaaaacagcaucaauaau

SEQ ID NO: 1950613 - RNA, 13 nt, Shigella flexneri 2a str. 2457T
aacuaaaaacagc

SEQ ID NO: 1950614 - RNA, 16 nt, Shigella flexneri 2a str. 2457T
aacuaacugacuuccg

SEQ ID NO: 1950615 - RNA, 20 nt, Shigella flexneri 2a str. 2457T
aacuaccagcaguuugguaa

SEQ ID NO: 1950616 - RNA, 20 nt, Shigella flexneri 2a str. 2457T
aacggaccaauaaacgccag

SEQ ID NO: 1950617 - RNA, 23 nt, Shigella flexneri 2a str. 2457T
aacggggguuuuacuuuuuaacu

SEQ ID NO: 1950618 - RNA, 15 nt, Shigella flexneri 2a str. 2457T
aacggaacgaaaaaa

SEQ ID NO: 1950619 - RNA, 14 nt, Shigella flexneri 2a str. 2457T
aacgguaaggacaa

SEQ ID NO: 1950620 - RNA, 16 nt, Shigella flexneri 2a str. 2457T
aacggguuaaauccug

SEQ ID NO: 1950621 - RNA, 14 nt, Shigella flexneri 2a str. 2457T
aacgggugauuaaa

SEQ ID NO: 1950622 - RNA, 19 nt, Shigella flexneri 2a str. 2457T
aacgggugauuaaagaaaa

SEQ ID NO: 1950623 - RNA, 18 nt, Shigella flexneri 2a str. 2457T
aacggugcgaccaaacug

SEQ ID NO: 1950624 - RNA, 22 nt, Shigella flexneri 2a str. 2457T
aacgguucuuuggucaggcgcu

SEQ ID NO: 1950625 - RNA, 20 nt, Shigella flexneri 2a str. 2457T
aacgguuuauccccaaggau

SEQ ID NO: 1950626 - RNA, 15 nt, Shigella flexneri 2a str. 2457T
aacguaaacgcagca

SEQ ID NO: 1950627 - RNA, 14 nt, Shigella flexneri 2a str. 2457T
aacgguuaacaguu

SEQ ID NO: 1950628 - RNA, 13 nt, Shigella flexneri 2a str. 2457T
aacggucacggcu

SEQ ID NO: 1950629 - RNA, 22 nt, Shigella flexneri 2a str. 2457T
aacggucgccgcgcaaauccac

SEQ ID NO: 1950630 - RNA, 18 nt, Shigella flexneri 2a str. 2457T
aacggucgccgcgcaaau

SEQ ID NO: 1950631 - RNA, 22 nt, Shigella flexneri 2a str. 2457T
aacgcuucucccagccgcccug

SEQ ID NO: 1950632 - RNA, 14 nt, Shigella flexneri 2a str. 2457T
aacgcuuucuuugg

SEQ ID NO: 1950633 - RNA, 19 nt, Shigella flexneri 2a str. 2457T
aacgcuuucucaccaugac

SEQ ID NO: 1950634 - RNA, 22 nt, Shigella flexneri 2a str. 2457T
aacgcuuucucaccaugaccga

SEQ ID NO: 1950635 - RNA, 15 nt, Shigella flexneri 2a str. 2457T
aacgccggguaaaug

SEQ ID NO: 1950636 - RNA, 14 nt, Shigella flexneri 2a str. 2457T
aacgccgucaucac

SEQ ID NO: 1950637 - RNA, 16 nt, Shigella flexneri 2a str. 2457T
aacgccggagugaaaa

SEQ ID NO: 1950638 - RNA, 19 nt, Shigella flexneri 2a str. 2457T
aacgccggaugacacauca

SEQ ID NO: 1950639 - RNA, 18 nt, Shigella flexneri 2a str. 2457T
aacgcugacggugccagg

SEQ ID NO: 1950640 - RNA, 12 nt, Shigella flexneri 2a str. 2457T
aacgauggcgcg

SEQ ID NO: 1950641 - RNA, 20 nt, Shigella flexneri 2a str. 2457T
aacgauuuuuuuaauaauau

SEQ ID NO: 1950642 - RNA, 17 nt, Shigella flexneri 2a str. 2457T
aacgcaaacuguuucag

SEQ ID NO: 1950643 - RNA, 12 nt, Shigella flexneri 2a str. 2457T
aacgcaaaauuc

SEQ ID NO: 1950644 - RNA, 20 nt, Shigella flexneri 2a str. 2457T
aacgaugucgcccacuuuca

SEQ ID NO: 1950645 - RNA, 21 nt, Shigella flexneri 2a str. 2457T
aacgauucaaaagaugagaaa

SEQ ID NO: 1950646 - RNA, 15 nt, Shigella flexneri 2a str. 2457T
aaccggaaccagcgc

SEQ ID NO: 1950647 - RNA, 14 nt, Shigella flexneri 2a str. 2457T
aaccggauacccug

SEQ ID NO: 1950648 - RNA, 20 nt, Shigella flexneri 2a str. 2457T
aaccggauaucgaacaaaaa

SEQ ID NO: 1950649 - RNA, 15 nt, Shigella flexneri 2a str. 2457T
aaccggaucgccaau

SEQ ID NO: 1950650 - RNA, 17 nt, Shigella flexneri 2a str. 2457T
aaccggaucgcgaccug

SEQ ID NO: 1950651 - RNA, 23 nt, Shigella flexneri 2a str. 2457T
aaccggaucgcgaccuguucucc

SEQ ID NO: 1950652 - RNA, 19 nt, Shigella flexneri 2a str. 2457T
aaccggaccagcaacaaau

SEQ ID NO: 1950653 - RNA, 13 nt, Shigella flexneri 2a str. 2457T
aaccggcaagcaa

SEQ ID NO: 1950654 - RNA, 18 nt, Shigella flexneri 2a str. 2457T
aaccggauuuucaccauc

SEQ ID NO: 1950655 - RNA, 15 nt, Shigella flexneri 2a str. 2457T
aaccgggaagaucca

SEQ ID NO: 1950656 - RNA, 18 nt, Shigella flexneri 2a str. 2457T
aacgccccuucugccgca

SEQ ID NO: 1950657 - RNA, 15 nt, Shigella flexneri 2a str. 2457T
aacgccccaauccac

SEQ ID NO: 1950658 - RNA, 16 nt, Shigella flexneri 2a str. 2457T
aacgccgccagaccac

SEQ ID NO: 1950659 - RNA, 23 nt, Shigella flexneri 2a str. 2457T
aacgcaaagagagaagccagaua

SEQ ID NO: 1950660 - RNA, 16 nt, Shigella flexneri 2a str. 2457T
aacgcaaauacugacu

SEQ ID NO: 1950661 - RNA, 21 nt, Shigella flexneri 2a str. 2457T
aacgcaaagagagaagccaga

SEQ ID NO: 1950662 - RNA, 14 nt, Shigella flexneri 2a str. 2457T
aacgcaaagagaga

SEQ ID NO: 1950663 - RNA, 21 nt, Shigella flexneri 2a str. 2457T
aacgcaaucaaauaccaccag

SEQ ID NO: 1950664 - RNA, 13 nt, Shigella flexneri 2a str. 2457T
aacgcaccaauag

SEQ ID NO: 1950665 - RNA, 14 nt, Shigella flexneri 2a str. 2457T
aacgccagaucacc

SEQ ID NO: 1950666 - RNA, 13 nt, Shigella flexneri 2a str. 2457T
aacgccagcagca

SEQ ID NO: 1950667 - RNA, 13 nt, Shigella flexneri 2a str. 2457T
aaggauaaaaaag

SEQ ID NO: 1950668 - RNA, 20 nt, Shigella flexneri 2a str. 2457T
aagcugcaaguauucacucu

SEQ ID NO: 1950669 - RNA, 14 nt, Shigella flexneri 2a str. 2457T
aagcugcaggacca

SEQ ID NO: 1950670 - RNA, 20 nt, Shigella flexneri 2a str. 2457T
aagcugacaggcgcugauga

SEQ ID NO: 1950671 - RNA, 14 nt, Shigella flexneri 2a str. 2457T
aagcugagcacaaa

SEQ ID NO: 1950672 - RNA, 17 nt, Shigella flexneri 2a str. 2457T
aagcugucaccaaucag

SEQ ID NO: 1950673 - RNA, 16 nt, Shigella flexneri 2a str. 2457T
aagcugugccugaaua

SEQ ID NO: 1950674 - RNA, 14 nt, Shigella flexneri 2a str. 2457T
aagcuguucuuccc

SEQ ID NO: 1950675 - RNA, 14 nt, Shigella flexneri 2a str. 2457T
aagcuguagaggcg

SEQ ID NO: 1950676 - RNA, 16 nt, Shigella flexneri 2a str. 2457T
aagcucucuuccaguu

SEQ ID NO: 1950677 - RNA, 19 nt, Shigella flexneri 2a str. 2457T
aagcucuucaugcagcaug

SEQ ID NO: 1950678 - RNA, 13 nt, Shigella flexneri 2a str. 2457T
aagcugacaggcg

SEQ ID NO: 1950679 - RNA, 15 nt, Shigella flexneri 2a str. 2457T
aagcgugcaaauaua

SEQ ID NO: 1950680 - RNA, 16 nt, Shigella flexneri 2a str. 2457T
aagccggaauuuuccu

SEQ ID NO: 1950681 - RNA, 15 nt, Shigella flexneri 2a str. 2457T
aagcgcgucaccacc

SEQ ID NO: 1950682 - RNA, 17 nt, Shigella flexneri 2a str. 2457T
aagccgcgugcgcugga

SEQ ID NO: 1950683 - RNA, 18 nt, Shigella flexneri 2a str. 2457T
aagccgcuaacagcagca

SEQ ID NO: 1950684 - RNA, 20 nt, Shigella flexneri 2a str. 2457T
aagccgccgguagucaccgc

SEQ ID NO: 1950685 - RNA, 23 nt, Shigella flexneri 2a str. 2457T
aagccgccacgaccugcagaaaa

SEQ ID NO: 1950686 - RNA, 22 nt, Shigella flexneri 2a str. 2457T
aagccgccagaccgacauuaau

SEQ ID NO: 1950687 - RNA, 19 nt, Shigella flexneri 2a str. 2457T
aagccgccaucucuuccag

SEQ ID NO: 1950688 - RNA, 20 nt, Shigella flexneri 2a str. 2457T
aagcgcucccgcaggagcgc

SEQ ID NO: 1950689 - RNA, 15 nt, Shigella flexneri 2a str. 2457T
aagcgucagaaaaau

SEQ ID NO: 1950690 - RNA, 21 nt, Shigella flexneri 2a str. 2457T
aagcggcacugcucuuuaaca

SEQ ID NO: 1950691 - RNA, 17 nt, Shigella flexneri 2a str. 2457T
aagcguauccaucacua

SEQ ID NO: 1950692 - RNA, 15 nt, Shigella flexneri 2a str. 2457T
aagggucagggagaa

SEQ ID NO: 1950693 - RNA, 22 nt, Shigella flexneri 2a str. 2457T
aagggugucuguuaaucgcauu

SEQ ID NO: 1950694 - RNA, 21 nt, Shigella flexneri 2a str. 2457T
aaggguuuuugagucacauuu

SEQ ID NO: 1950695 - RNA, 14 nt, Shigella flexneri 2a str. 2457T
aaggcguucacgcc

SEQ ID NO: 1950696 - RNA, 15 nt, Shigella flexneri 2a str. 2457T
aaggccuuaguagaa

SEQ ID NO: 1950697 - RNA, 16 nt, Shigella flexneri 2a str. 2457T
aaggcgaaaggcuggc

SEQ ID NO: 1950698 - RNA, 13 nt, Shigella flexneri 2a str. 2457T
aaggcaagaaaau

SEQ ID NO: 1950699 - RNA, 12 nt, Shigella flexneri 2a str. 2457T
aaggcaaacugu

SEQ ID NO: 1950700 - RNA, 16 nt, Shigella flexneri 2a str. 2457T
aaggcgggaauaauuu

SEQ ID NO: 1950701 - RNA, 22 nt, Shigella flexneri 2a str. 2457T
aaggcgcucauuuucucuuuca

SEQ ID NO: 1950702 - RNA, 16 nt, Shigella flexneri 2a str. 2457T
aaggcgcgguuucugc

SEQ ID NO: 1950703 - RNA, 23 nt, Shigella flexneri 2a str. 2457T
aaggcgcauugcuggcugcggga

SEQ ID NO: 1950704 - RNA, 13 nt, Shigella flexneri 2a str. 2457T
aaggcgagcgcgg

SEQ ID NO: 1950705 - RNA, 20 nt, Shigella flexneri 2a str. 2457T
aagguaaugcgcgagccaua

SEQ ID NO: 1950706 - RNA, 20 nt, Shigella flexneri 2a str. 2457T
aagguagaauaaggcuuucg

SEQ ID NO: 1950707 - RNA, 23 nt, Shigella flexneri 2a str. 2457T
aaggucacucccggauaaaucuc

SEQ ID NO: 1950708 - RNA, 16 nt, Shigella flexneri 2a str. 2457T
aaggucaccaguucac

SEQ ID NO: 1950709 - RNA, 21 nt, Shigella flexneri 2a str. 2457T
aagguaucgcgaaaaaaagau

SEQ ID NO: 1950710 - RNA, 17 nt, Shigella flexneri 2a str. 2457T
aagguaucgcgaaaaaa

SEQ ID NO: 1950711 - RNA, 16 nt, Shigella flexneri 2a str. 2457T
aagguuaaaccgccag

SEQ ID NO: 1950712 - RNA, 22 nt, Shigella flexneri 2a str. 2457T
aagguggucagacggaacaucu

SEQ ID NO: 1950713 - RNA, 17 nt, Shigella flexneri 2a str. 2457T
aaggugauuuuugagac

SEQ ID NO: 1950714 - RNA, 15 nt, Shigella flexneri 2a str. 2457T
aagguuucaguaaca

SEQ ID NO: 1950715 - RNA, 22 nt, Shigella flexneri 2a str. 2457T
aagguuuaauacgcuuaaucug

SEQ ID NO: 1950716 - RNA, 17 nt, Shigella flexneri 2a str. 2457T
aagguucuuugcugccg

SEQ ID NO: 1950717 - RNA, 17 nt, Shigella flexneri 2a str. 2457T
aagcauucguaaugaau

SEQ ID NO: 1950718 - RNA, 21 nt, Shigella flexneri 2a str. 2457T
aagcaugaucgaggcaaagag

SEQ ID NO: 1950719 - RNA, 12 nt, Shigella flexneri 2a str. 2457T
aagcaugaugcg

SEQ ID NO: 1950720 - RNA, 15 nt, Shigella flexneri 2a str. 2457T
aagccaacagcagcc

SEQ ID NO: 1950721 - RNA, 18 nt, Shigella flexneri 2a str. 2457T
aagccaacagcagccaca

SEQ ID NO: 1950722 - RNA, 11 nt, Shigella flexneri 2a str. 2457T
aagcauuuaau

SEQ ID NO: 1950723 - RNA, 18 nt, Shigella flexneri 2a str. 2457T
aagcauuuuuucacaugu

SEQ ID NO: 1950724 - RNA, 20 nt, Shigella flexneri 2a str. 2457T
aagcauuuuuucacauguuc

SEQ ID NO: 1950725 - RNA, 15 nt, Shigella flexneri 2a str. 2457T
aagccagcauacagc

SEQ ID NO: 1950726 - RNA, 19 nt, Shigella flexneri 2a str. 2457T
aagccacugugcgcgccag

SEQ ID NO: 1950727 - RNA, 17 nt, Shigella flexneri 2a str. 2457T
aagccaaucacaaaaag

SEQ ID NO: 1950728 - RNA, 13 nt, Shigella flexneri 2a str. 2457T
aagccaccacgcc

SEQ ID NO: 1950729 - RNA, 20 nt, Shigella flexneri 2a str. 2457T
aagccaccgaacaaaacagc

SEQ ID NO: 1950730 - RNA, 20 nt, Shigella flexneri 2a str. 2457T
aagccauguuuaacuccuuc

SEQ ID NO: 1950731 - RNA, 20 nt, Shigella flexneri 2a str. 2457T
aagccaugcuuugcauccca

SEQ ID NO: 1950732 - RNA, 14 nt, Shigella flexneri 2a str. 2457T
aagccaucccugua

SEQ ID NO: 1950733 - RNA, 13 nt, Shigella flexneri 2a str. 2457T
aagccauccagca

SEQ ID NO: 1950734 - RNA, 18 nt, Shigella flexneri 2a str. 2457T
aagcccauaccacagcaa

SEQ ID NO: 1950735 - RNA, 18 nt, Shigella flexneri 2a str. 2457T
aagccgaagcugucagaa

SEQ ID NO: 1950736 - RNA, 19 nt, Shigella flexneri 2a str. 2457T
aagccccggaauucucaaa

SEQ ID NO: 1950737 - RNA, 15 nt, Shigella flexneri 2a str. 2457T
aagccccguagccau

SEQ ID NO: 1950738 - RNA, 17 nt, Shigella flexneri 2a str. 2457T
aagccccguagccauga

SEQ ID NO: 1950739 - RNA, 14 nt, Shigella flexneri 2a str. 2457T
aagcaucaauugcu

SEQ ID NO: 1950740 - RNA, 15 nt, Shigella flexneri 2a str. 2457T
aagcaggugccuuac

SEQ ID NO: 1950741 - RNA, 17 nt, Shigella flexneri 2a str. 2457T
aagcaggucggcucagc

SEQ ID NO: 1950742 - RNA, 15 nt, Shigella flexneri 2a str. 2457T
aagcaggcuucacgc

SEQ ID NO: 1950743 - RNA, 17 nt, Shigella flexneri 2a str. 2457T
aagcaguuucaccagca

SEQ ID NO: 1950744 - RNA, 18 nt, Shigella flexneri 2a str. 2457T
aagcaguuucaccagcag

SEQ ID NO: 1950745 - RNA, 21 nt, Shigella flexneri 2a str. 2457T
aagcacuacucuauacaggau

SEQ ID NO: 1950746 - RNA, 19 nt, Shigella flexneri 2a str. 2457T
aagcacucguaagaggcgu

SEQ ID NO: 1950747 - RNA, 20 nt, Shigella flexneri 2a str. 2457T
aagcacugcaucaaugccgg

SEQ ID NO: 1950748 - RNA, 20 nt, Shigella flexneri 2a str. 2457T
aagcacucugacggauagua

SEQ ID NO: 1950749 - RNA, 19 nt, Shigella flexneri 2a str. 2457T
aagcagacaacccacacau

SEQ ID NO: 1950750 - RNA, 21 nt, Shigella flexneri 2a str. 2457T
aagcagcgaugcuuugcgcuu

SEQ ID NO: 1950751 - RNA, 15 nt, Shigella flexneri 2a str. 2457T
aagcagcgaugcuuu

SEQ ID NO: 1950752 - RNA, 13 nt, Shigella flexneri 2a str. 2457T
aagcagccaucug

SEQ ID NO: 1950753 - RNA, 19 nt, Shigella flexneri 2a str. 2457T
aagcagcauguagaugccg

SEQ ID NO: 1950754 - RNA, 16 nt, Shigella flexneri 2a str. 2457T
aagcagagcagggaag

SEQ ID NO: 1950755 - RNA, 13 nt, Shigella flexneri 2a str. 2457T
aagcaaaaaaaca

SEQ ID NO: 1950756 - RNA, 14 nt, Shigella flexneri 2a str. 2457T
aagcaaaaauaaau

SEQ ID NO: 1950757 - RNA, 12 nt, Shigella flexneri 2a str. 2457T
aagcaacuccau

SEQ ID NO: 1950758 - RNA, 12 nt, Shigella flexneri 2a str. 2457T
aagcaacaaagu

SEQ ID NO: 1950759 - RNA, 15 nt, Shigella flexneri 2a str. 2457T
aagcaacaaaguuug

SEQ ID NO: 1950760 - RNA, 18 nt, Shigella flexneri 2a str. 2457T
aagauuguuggcaaaaaa

SEQ ID NO: 1950761 - RNA, 19 nt, Shigella flexneri 2a str. 2457T
aagauuguuggcaaaaaaa

SEQ ID NO: 1950762 - RNA, 15 nt, Shigella flexneri 2a str. 2457T
aagcacaugcugaca

SEQ ID NO: 1950763 - RNA, 15 nt, Shigella flexneri 2a str. 2457T
aagcaccacuccuca

SEQ ID NO: 1950764 - RNA, 16 nt, Shigella flexneri 2a str. 2457T
aagcaauaccgcgaau

SEQ ID NO: 1950765 - RNA, 14 nt, Shigella flexneri 2a str. 2457T
aagcaagaacagcc

SEQ ID NO: 1950766 - RNA, 19 nt, Shigella flexneri 2a str. 2457T
aagcaagcgucgccagcgc

SEQ ID NO: 1950767 - RNA, 15 nt, Shigella flexneri 2a str. 2457T
aagauuccagugccg

SEQ ID NO: 1950768 - RNA, 21 nt, Shigella flexneri 2a str. 2457T
aagauugccggggauaucccc

SEQ ID NO: 1950769 - RNA, 16 nt, Shigella flexneri 2a str. 2457T
aagauucguauuuaaa

SEQ ID NO: 1950770 - RNA, 14 nt, Shigella flexneri 2a str. 2457T
aagauuagccugaa

SEQ ID NO: 1950771 - RNA, 13 nt, Shigella flexneri 2a str. 2457T
aagauuacugaca

SEQ ID NO: 1950772 - RNA, 22 nt, Shigella flexneri 2a str. 2457T
aagauuacugacaauuugccca

SEQ ID NO: 1950773 - RNA, 15 nt, Shigella flexneri 2a str. 2457T
aagaugcauuuauau

SEQ ID NO: 1950774 - RNA, 14 nt, Shigella flexneri 2a str. 2457T
aagaugccugaugc

SEQ ID NO: 1950775 - RNA, 14 nt, Shigella flexneri 2a str. 2457T
aagaugcuacaaca

SEQ ID NO: 1950776 - RNA, 16 nt, Shigella flexneri 2a str. 2457T
aagaugcuacaacauc

SEQ ID NO: 1950777 - RNA, 19 nt, Shigella flexneri 2a str. 2457T
aagauguucuaucuuucag

SEQ ID NO: 1950778 - RNA, 21 nt, Shigella flexneri 2a str. 2457T
aagauguucuaucuuucagac

SEQ ID NO: 1950779 - RNA, 22 nt, Shigella flexneri 2a str. 2457T
aagaugugagcgauacccauuu

SEQ ID NO: 1950780 - RNA, 20 nt, Shigella flexneri 2a str. 2457T
aagaauguccauuauuucaa

SEQ ID NO: 1950781 - RNA, 21 nt, Shigella flexneri 2a str. 2457T
aagaauguccauuauuucaau

SEQ ID NO: 1950782 - RNA, 14 nt, Shigella flexneri 2a str. 2457T
aagaauuaaaauau

SEQ ID NO: 1950783 - RNA, 16 nt, Shigella flexneri 2a str. 2457T
aagaugaugucacagc

SEQ ID NO: 1950784 - RNA, 12 nt, Shigella flexneri 2a str. 2457T
aagaucuuugcg

SEQ ID NO: 1950785 - RNA, 19 nt, Shigella flexneri 2a str. 2457T
aagaugaaauaguugcauu

SEQ ID NO: 1950786 - RNA, 21 nt, Shigella flexneri 2a str. 2457T
aauacucgucccguccuucau

SEQ ID NO: 1950787 - RNA, 17 nt, Shigella flexneri 2a str. 2457T
aauacuccauaacuauu

SEQ ID NO: 1950788 - RNA, 12 nt, Shigella flexneri 2a str. 2457T
aauacuccccuu

SEQ ID NO: 1950789 - RNA, 22 nt, Shigella flexneri 2a str. 2457T
aauagagaaaguaaaccaccag

SEQ ID NO: 1950790 - RNA, 17 nt, Shigella flexneri 2a str. 2457T
aauagagaucucucuug

SEQ ID NO: 1950791 - RNA, 20 nt, Shigella flexneri 2a str. 2457T
aauagaaccuaagaaccaga

SEQ ID NO: 1950792 - RNA, 20 nt, Shigella flexneri 2a str. 2457T
aauagaacuauaauugcuuu

SEQ ID NO: 1950793 - RNA, 17 nt, Shigella flexneri 2a str. 2457T
aauacuuucacaaaaau

SEQ ID NO: 1950794 - RNA, 19 nt, Shigella flexneri 2a str. 2457T
aauacuuucacaaaaauaa

SEQ ID NO: 1950795 - RNA, 18 nt, Shigella flexneri 2a str. 2457T
aauaccgacuucggccag

SEQ ID NO: 1950796 - RNA, 23 nt, Shigella flexneri 2a str. 2457T
aauaccgaagaguaaccaaacgu

SEQ ID NO: 1950797 - RNA, 19 nt, Shigella flexneri 2a str. 2457T
aauaccgcccaccaccagc

SEQ ID NO: 1950798 - RNA, 19 nt, Shigella flexneri 2a str. 2457T
aauaccgccugcaaauaaa

SEQ ID NO: 1950799 - RNA, 15 nt, Shigella flexneri 2a str. 2457T
aauaccggaugccaa

SEQ ID NO: 1950800 - RNA, 16 nt, Shigella flexneri 2a str. 2457T
aauacauacgcaaaaa

SEQ ID NO: 1950801 - RNA, 20 nt, Shigella flexneri 2a str. 2457T
aauacauacgcaaaaaacau

SEQ ID NO: 1950802 - RNA, 11 nt, Shigella flexneri 2a str. 2457T
aauacauauau

SEQ ID NO: 1950803 - RNA, 19 nt, Shigella flexneri 2a str. 2457T
aauacauauauuacaacgu

SEQ ID NO: 1950804 - RNA, 23 nt, Shigella flexneri 2a str. 2457T
aauacaucaauuuucccuucuga

SEQ ID NO: 1950805 - RNA, 19 nt, Shigella flexneri 2a str. 2457T
aauacgauccugagcagcc

SEQ ID NO: 1950806 - RNA, 17 nt, Shigella flexneri 2a str. 2457T
aauacgcccaucauuca

SEQ ID NO: 1950807 - RNA, 22 nt, Shigella flexneri 2a str. 2457T
aauacgcaccgggcuuccggca

SEQ ID NO: 1950808 - RNA, 17 nt, Shigella flexneri 2a str. 2457T
aauacgauuaacgccag

SEQ ID NO: 1950809 - RNA, 20 nt, Shigella flexneri 2a str. 2457T
aauacgcucacgcgcugccu

SEQ ID NO: 1950810 - RNA, 15 nt, Shigella flexneri 2a str. 2457T
aauacgcucaucugg

SEQ ID NO: 1950811 - RNA, 18 nt, Shigella flexneri 2a str. 2457T
aauacgcucgaacagcug

SEQ ID NO: 1950812 - RNA, 18 nt, Shigella flexneri 2a str. 2457T
aauacgcuuaaucuguac

SEQ ID NO: 1950813 - RNA, 21 nt, Shigella flexneri 2a str. 2457T
aauacggauauucaucuccag

SEQ ID NO: 1950814 - RNA, 20 nt, Shigella flexneri 2a str. 2457T
aauacgcuggcgcgccgccu

SEQ ID NO: 1950815 - RNA, 21 nt, Shigella flexneri 2a str. 2457T
aauacggcaaguaauaauauc

SEQ ID NO: 1950816 - RNA, 14 nt, Shigella flexneri 2a str. 2457T
aaaaauaccgagca

SEQ ID NO: 1950817 - RNA, 14 nt, Shigella flexneri 2a str. 2457T
aauaauaucuuuuu

SEQ ID NO: 1950818 - RNA, 12 nt, Shigella flexneri 2a str. 2457T
aauaauaucuuu

SEQ ID NO: 1950819 - RNA, 15 nt, Shigella flexneri 2a str. 2457T
aauaauaucuccagc

SEQ ID NO: 1950820 - RNA, 14 nt, Shigella flexneri 2a str. 2457T
aauaaucaacgcga

SEQ ID NO: 1950821 - RNA, 23 nt, Shigella flexneri 2a str. 2457T
aauaaucaacgcgauauaauaaa

SEQ ID NO: 1950822 - RNA, 15 nt, Shigella flexneri 2a str. 2457T
aaaaaucaaaaaacu

SEQ ID NO: 1950823 - RNA, 22 nt, Shigella flexneri 2a str. 2457T
aauaauaccguucucuuuaaaa

SEQ ID NO: 1950824 - RNA, 20 nt, Shigella flexneri 2a str. 2457T
aaaaauacauacgcaaaaaa

SEQ ID NO: 1950825 - RNA, 16 nt, Shigella flexneri 2a str. 2457T
aaaaauaccgagcagc

SEQ ID NO: 1950826 - RNA, 20 nt, Shigella flexneri 2a str. 2457T
aauaacgccggagagaaaaa

SEQ ID NO: 1950827 - RNA, 16 nt, Shigella flexneri 2a str. 2457T
aauaaccucuucgaau

SEQ ID NO: 1950828 - RNA, 18 nt, Shigella flexneri 2a str. 2457T
aauaaccugcaaaauagu

SEQ ID NO: 1950829 - RNA, 20 nt, Shigella flexneri 2a str. 2457T
aauaacggcugauaacaaua

SEQ ID NO: 1950830 - RNA, 22 nt, Shigella flexneri 2a str. 2457T
aauacagccagccagcaccagg

SEQ ID NO: 1950831 - RNA, 23 nt, Shigella flexneri 2a str. 2457T
aauacagccagccagcaccaggc

SEQ ID NO: 1950832 - RNA, 15 nt, Shigella flexneri 2a str. 2457T
aauacagcauugucu

SEQ ID NO: 1950833 - RNA, 15 nt, Shigella flexneri 2a str. 2457T
aauacagggaaagaa

SEQ ID NO: 1950834 - RNA, 19 nt, Shigella flexneri 2a str. 2457T
aauacagggaaagaagucu

SEQ ID NO: 1950835 - RNA, 19 nt, Shigella flexneri 2a str. 2457T
aauacagcuuaaucaccag

SEQ ID NO: 1950836 - RNA, 21 nt, Shigella flexneri 2a str. 2457T
aauacaggcgacgaguugcuu

SEQ ID NO: 1950837 - RNA, 16 nt, Shigella flexneri 2a str. 2457T
aauacagcaauggaaa

SEQ ID NO: 1950838 - RNA, 19 nt, Shigella flexneri 2a str. 2457T
aauacagcaauggaaaaag

SEQ ID NO: 1950839 - RNA, 17 nt, Shigella flexneri 2a str. 2457T
aauacagcaauggaaaa

SEQ ID NO: 1950840 - RNA, 18 nt, Shigella flexneri 2a str. 2457T
aauacagcaauggaaaaa

SEQ ID NO: 1950841 - RNA, 18 nt, Shigella flexneri 2a str. 2457T
aauaaucgcaauuaccca

SEQ ID NO: 1950842 - RNA, 22 nt, Shigella flexneri 2a str. 2457T
aauaaucgaucgcguaauaaaa

SEQ ID NO: 1950843 - RNA, 20 nt, Shigella flexneri 2a str. 2457T
aauaaucaacgcggcaauaa

SEQ ID NO: 1950844 - RNA, 22 nt, Shigella flexneri 2a str. 2457T
aaaaauccagauuuauaaaaga

SEQ ID NO: 1950845 - RNA, 22 nt, Shigella flexneri 2a str. 2457T
aauaaucacauaauccagacac

SEQ ID NO: 1950846 - RNA, 11 nt, Shigella flexneri 2a str. 2457T
aauaaucagau

SEQ ID NO: 1950847 - RNA, 17 nt, Shigella flexneri 2a str. 2457T
aauaauuaucauuaaaa

SEQ ID NO: 1950848 - RNA, 21 nt, Shigella flexneri 2a str. 2457T
aaguuauccugguacucgacu

SEQ ID NO: 1950849 - RNA, 23 nt, Shigella flexneri 2a str. 2457T
aaguuccgauaaucggugcggca

SEQ ID NO: 1950850 - RNA, 22 nt, Shigella flexneri 2a str. 2457T
aaguuauaaauaaaaagagauu

SEQ ID NO: 1950851 - RNA, 18 nt, Shigella flexneri 2a str. 2457T
aagugugaugguauucau

SEQ ID NO: 1950852 - RNA, 15 nt, Shigella flexneri 2a str. 2457T
aaguuaucaaguauu

SEQ ID NO: 1950853 - RNA, 20 nt, Shigella flexneri 2a str. 2457T
aaguuugcaacuuucgcuuu

SEQ ID NO: 1950854 - RNA, 13 nt, Shigella flexneri 2a str. 2457T
aaguuggcaccaa

SEQ ID NO: 1950855 - RNA, 15 nt, Shigella flexneri 2a str. 2457T
aaguugcucaagcug

SEQ ID NO: 1950856 - RNA, 23 nt, Shigella flexneri 2a str. 2457T
aaguugcucaagcugaacauuuu

SEQ ID NO: 1950857 - RNA, 23 nt, Shigella flexneri 2a str. 2457T
aaguugcauuagcacaaacccag

SEQ ID NO: 1950858 - RNA, 23 nt, Shigella flexneri 2a str. 2457T
aaguaauagaacuauaauugcuu

SEQ ID NO: 1950859 - RNA, 13 nt, Shigella flexneri 2a str. 2457T
aaguaaucuauau

SEQ ID NO: 1950860 - RNA, 23 nt, Shigella flexneri 2a str. 2457T
aagucuuccggugcaucaacaua

SEQ ID NO: 1950861 - RNA, 19 nt, Shigella flexneri 2a str. 2457T
aaguaacaauagcgaacag

SEQ ID NO: 1950862 - RNA, 16 nt, Shigella flexneri 2a str. 2457T
aaguaagcaacauaag

SEQ ID NO: 1950863 - RNA, 19 nt, Shigella flexneri 2a str. 2457T
aaguaaggcgggaauaauu

SEQ ID NO: 1950864 - RNA, 18 nt, Shigella flexneri 2a str. 2457T
aagugaguugguuauuca

SEQ ID NO: 1950865 - RNA, 20 nt, Shigella flexneri 2a str. 2457T
aagugagguguacuggcaau

SEQ ID NO: 1950866 - RNA, 19 nt, Shigella flexneri 2a str. 2457T
aaguggacgaacaguucaa

SEQ ID NO: 1950867 - RNA, 16 nt, Shigella flexneri 2a str. 2457T
aagugcugggaaaccu

SEQ ID NO: 1950868 - RNA, 20 nt, Shigella flexneri 2a str. 2457T
aaguggggguuuuauuuaac

SEQ ID NO: 1950869 - RNA, 17 nt, Shigella flexneri 2a str. 2457T
aauaacacauauauuaa

SEQ ID NO: 1950870 - RNA, 16 nt, Shigella flexneri 2a str. 2457T
aauaacacauauauua

SEQ ID NO: 1950871 - RNA, 16 nt, Shigella flexneri 2a str. 2457T
aauaaccggcacuuca

SEQ ID NO: 1950872 - RNA, 12 nt, Shigella flexneri 2a str. 2457T
aauaaauagauc

SEQ ID NO: 1950873 - RNA, 22 nt, Shigella flexneri 2a str. 2457T
aauaaaccugccuuacauauca

SEQ ID NO: 1950874 - RNA, 21 nt, Shigella flexneri 2a str. 2457T
aauaaacaucagcuauucuua

SEQ ID NO: 1950875 - RNA, 13 nt, Shigella flexneri 2a str. 2457T
aauaaaauaucuu

SEQ ID NO: 1950876 - RNA, 22 nt, Shigella flexneri 2a str. 2457T
aauaaaaauacauacgcaaaaa

SEQ ID NO: 1950877 - RNA, 14 nt, Shigella flexneri 2a str. 2457T
aauaaaaucuauua

SEQ ID NO: 1950878 - RNA, 22 nt, Shigella flexneri 2a str. 2457T
aauaaacaaugagauauuuaaa

SEQ ID NO: 1950879 - RNA, 19 nt, Shigella flexneri 2a str. 2457T
aauaaaaaaggcugcauaa

SEQ ID NO: 1950880 - RNA, 16 nt, Shigella flexneri 2a str. 2457T
aaguuuuuaugaguuu

SEQ ID NO: 1950881 - RNA, 14 nt, Shigella flexneri 2a str. 2457T
cggauaaagcugcc

SEQ ID NO: 1950882 - RNA, 22 nt, Shigella flexneri 2a str. 2457T
cggaguugaccagcuccagcag

SEQ ID NO: 1950883 - RNA, 14 nt, Shigella flexneri 2a str. 2457T
cggaguuuaugagg

SEQ ID NO: 1950884 - RNA, 16 nt, Shigella flexneri 2a str. 2457T
cggaguugcagauuug

SEQ ID NO: 1950885 - RNA, 16 nt, Shigella flexneri 2a str. 2457T
cggaguuuaugaggca

SEQ ID NO: 1950886 - RNA, 23 nt, Shigella flexneri 2a str. 2457T
cggaguagucucucgccucaugg

SEQ ID NO: 1950887 - RNA, 18 nt, Shigella flexneri 2a str. 2457T
cggaguaaugccagucag

SEQ ID NO: 1950888 - RNA, 22 nt, Shigella flexneri 2a str. 2457T
cggagugaaaauucuccggcgu

SEQ ID NO: 1950889 - RNA, 13 nt, Shigella flexneri 2a str. 2457T
cggaggcccgccc

SEQ ID NO: 1950890 - RNA, 19 nt, Shigella flexneri 2a str. 2457T
cggagcuucacccgcagca

SEQ ID NO: 1950891 - RNA, 16 nt, Shigella flexneri 2a str. 2457T
cggagguuuuuuccuc

SEQ ID NO: 1950892 - RNA, 21 nt, Shigella flexneri 2a str. 2457T
cggauagauuuuuaaugcuuu

SEQ ID NO: 1950893 - RNA, 22 nt, Shigella flexneri 2a str. 2457T
cggauacgguuuuuugaacaga

SEQ ID NO: 1950894 - RNA, 16 nt, Shigella flexneri 2a str. 2457T
cggauaauucccaggc

SEQ ID NO: 1950895 - RNA, 16 nt, Shigella flexneri 2a str. 2457T
cggauaccaccagugc

SEQ ID NO: 1950896 - RNA, 20 nt, Shigella flexneri 2a str. 2457T
cggauaccaccagugccauu

SEQ ID NO: 1950897 - RNA, 21 nt, Shigella flexneri 2a str. 2457T
cggauaauggagccagaucug

SEQ ID NO: 1950898 - RNA, 16 nt, Shigella flexneri 2a str. 2457T
cggauaaucggcaaua

SEQ ID NO: 1950899 - RNA, 14 nt, Shigella flexneri 2a str. 2457T
cggauaaggcauuu

SEQ ID NO: 1950900 - RNA, 18 nt, Shigella flexneri 2a str. 2457T
cggauaucuuucgccaug

SEQ ID NO: 1950901 - RNA, 13 nt, Shigella flexneri 2a str. 2457T
cggaucaagaaag

SEQ ID NO: 1950902 - RNA, 21 nt, Shigella flexneri 2a str. 2457T
cggaucagcgucgccuggugu

SEQ ID NO: 1950903 - RNA, 23 nt, Shigella flexneri 2a str. 2457T
cggaucaugguagcgugauggcc

SEQ ID NO: 1950904 - RNA, 20 nt, Shigella flexneri 2a str. 2457T
cggaucaggcggcucaccug

SEQ ID NO: 1950905 - RNA, 20 nt, Shigella flexneri 2a str. 2457T
cggaucgauaccguucagac

SEQ ID NO: 1950906 - RNA, 15 nt, Shigella flexneri 2a str. 2457T
cggaucggaggcagc

SEQ ID NO: 1950907 - RNA, 19 nt, Shigella flexneri 2a str. 2457T
cggauccccugcgcggcga

SEQ ID NO: 1950908 - RNA, 17 nt, Shigella flexneri 2a str. 2457T
cggauccaugacgagga

SEQ ID NO: 1950909 - RNA, 15 nt, Shigella flexneri 2a str. 2457T
cggaugaguacagcg

SEQ ID NO: 1950910 - RNA, 16 nt, Shigella flexneri 2a str. 2457T
cggaugaucauccggc

SEQ ID NO: 1950911 - RNA, 18 nt, Shigella flexneri 2a str. 2457T
cggaugaguacagcgcau

SEQ ID NO: 1950912 - RNA, 11 nt, Shigella flexneri 2a str. 2457T
cggaugacaga

SEQ ID NO: 1950913 - RNA, 16 nt, Shigella flexneri 2a str. 2457T
cggaugacccagcgcg

SEQ ID NO: 1950914 - RNA, 15 nt, Shigella flexneri 2a str. 2457T
cggaucucagcucau

SEQ ID NO: 1950915 - RNA, 17 nt, Shigella flexneri 2a str. 2457T
cggaucucagcucauua

SEQ ID NO: 1950916 - RNA, 14 nt, Shigella flexneri 2a str. 2457T
cggaugcgccagca

SEQ ID NO: 1950917 - RNA, 14 nt, Shigella flexneri 2a str. 2457T
cggaugauucacau

SEQ ID NO: 1950918 - RNA, 24 nt, Shigella flexneri 2a str. 2457T
cggaugcagcaucaugucgcccac

SEQ ID NO: 1950919 - RNA, 16 nt, Shigella flexneri 2a str. 2457T
cggauugcuccugcuc

SEQ ID NO: 1950920 - RNA, 17 nt, Shigella flexneri 2a str. 2457T
cggauguagcaacggag

SEQ ID NO: 1950921 - RNA, 22 nt, Shigella flexneri 2a str. 2457T
cggauuaacaguccgccguucu

SEQ ID NO: 1950922 - RNA, 15 nt, Shigella flexneri 2a str. 2457T
cggcaaccagcaccg

SEQ ID NO: 1950923 - RNA, 13 nt, Shigella flexneri 2a str. 2457T
cggcaaccgcauc

SEQ ID NO: 1950924 - RNA, 17 nt, Shigella flexneri 2a str. 2457T
cggcaaccgcauccaga

SEQ ID NO: 1950925 - RNA, 21 nt, Shigella flexneri 2a str. 2457T
cggcaaauucauuaccaaccu

SEQ ID NO: 1950926 - RNA, 23 nt, Shigella flexneri 2a str. 2457T
cggcaaagugaauacagaacagu

SEQ ID NO: 1950927 - RNA, 14 nt, Shigella flexneri 2a str. 2457T
cggcaaacugcuga

SEQ ID NO: 1950928 - RNA, 22 nt, Shigella flexneri 2a str. 2457T
cggauuuggcaaaugcaucagu

SEQ ID NO: 1950929 - RNA, 16 nt, Shigella flexneri 2a str. 2457T
cggauuuggcugaaua

SEQ ID NO: 1950930 - RNA, 13 nt, Shigella flexneri 2a str. 2457T
cggcaaacgucgc

SEQ ID NO: 1950931 - RNA, 14 nt, Shigella flexneri 2a str. 2457T
cggcaaacgcaacc

SEQ ID NO: 1950932 - RNA, 15 nt, Shigella flexneri 2a str. 2457T
cggcaaaaaucggca

SEQ ID NO: 1950933 - RNA, 14 nt, Shigella flexneri 2a str. 2457T
cggcaaaaccguuc

SEQ ID NO: 1950934 - RNA, 16 nt, Shigella flexneri 2a str. 2457T
cggcaauaauccccgc

SEQ ID NO: 1950935 - RNA, 15 nt, Shigella flexneri 2a str. 2457T
cggcaaucuguuaug

SEQ ID NO: 1950936 - RNA, 17 nt, Shigella flexneri 2a str. 2457T
cggcaaucgcugcuaau

SEQ ID NO: 1950937 - RNA, 20 nt, Shigella flexneri 2a str. 2457T
cggcaaucauucccagaccu

SEQ ID NO: 1950938 - RNA, 22 nt, Shigella flexneri 2a str. 2457T
cggcaaucgccagaucagcuuc

SEQ ID NO: 1950939 - RNA, 22 nt, Shigella flexneri 2a str. 2457T
cggcaacgacugcgagcaaaau

SEQ ID NO: 1950940 - RNA, 19 nt, Shigella flexneri 2a str. 2457T
cggcaagaaauaccgaaga

SEQ ID NO: 1950941 - RNA, 18 nt, Shigella flexneri 2a str. 2457T
cggcaagauacugcauaa

SEQ ID NO: 1950942 - RNA, 23 nt, Shigella flexneri 2a str. 2457T
cggcaagaucgcgaugggucgcc

SEQ ID NO: 1950943 - RNA, 15 nt, Shigella flexneri 2a str. 2457T
cggcaagcaaaugaa

SEQ ID NO: 1950944 - RNA, 13 nt, Shigella flexneri 2a str. 2457T
cggcaagcaaaug

SEQ ID NO: 1950945 - RNA, 20 nt, Shigella flexneri 2a str. 2457T
cggcaagauggauuacaccu

SEQ ID NO: 1950946 - RNA, 12 nt, Shigella flexneri 2a str. 2457T
cggcaccaccaa

SEQ ID NO: 1950947 - RNA, 15 nt, Shigella flexneri 2a str. 2457T
cggcaccaccaaaaa

SEQ ID NO: 1950948 - RNA, 23 nt, Shigella flexneri 2a str. 2457T
cggcacccaauccaguacaugaa

SEQ ID NO: 1950949 - RNA, 13 nt, Shigella flexneri 2a str. 2457T
cggcacaagaaaa

SEQ ID NO: 1950950 - RNA, 13 nt, Shigella flexneri 2a str. 2457T
cggcaauuuuuac

SEQ ID NO: 1950951 - RNA, 20 nt, Shigella flexneri 2a str. 2457T
cggcaauuuuuaccggucag

SEQ ID NO: 1950952 - RNA, 17 nt, Shigella flexneri 2a str. 2457T
cggcaauucucucugau

SEQ ID NO: 1950953 - RNA, 17 nt, Shigella flexneri 2a str. 2457T
cggcaauucucugcucc

SEQ ID NO: 1950954 - RNA, 21 nt, Shigella flexneri 2a str. 2457T
cggcaauguuaccgaucgcca

SEQ ID NO: 1950955 - RNA, 13 nt, Shigella flexneri 2a str. 2457T
cggcaauggugaa

SEQ ID NO: 1950956 - RNA, 14 nt, Shigella flexneri 2a str. 2457T
cggcaauggcugcg

SEQ ID NO: 1950957 - RNA, 13 nt, Shigella flexneri 2a str. 2457T
cggcaccacaaac

SEQ ID NO: 1950958 - RNA, 22 nt, Shigella flexneri 2a str. 2457T
cggcaccuaauaacucuccucc

SEQ ID NO: 1950959 - RNA, 22 nt, Shigella flexneri 2a str. 2457T
cggcacguucgaugcggcucag

SEQ ID NO: 1950960 - RNA, 14 nt, Shigella flexneri 2a str. 2457T
cggcacuccucuuc

SEQ ID NO: 1950961 - RNA, 21 nt, Shigella flexneri 2a str. 2457T
cggacgcaccgcguauugcuc

SEQ ID NO: 1950962 - RNA, 17 nt, Shigella flexneri 2a str. 2457T
cggacgcccgccgacca

SEQ ID NO: 1950963 - RNA, 15 nt, Shigella flexneri 2a str. 2457T
cggaccgucuuuuuu

SEQ ID NO: 1950964 - RNA, 13 nt, Shigella flexneri 2a str. 2457T
cggaccagcaaca

SEQ ID NO: 1950965 - RNA, 23 nt, Shigella flexneri 2a str. 2457T
cggacauugaguuuacgcagcag

SEQ ID NO: 1950966 - RNA, 14 nt, Shigella flexneri 2a str. 2457T
cggacaguccccuc

SEQ ID NO: 1950967 - RNA, 15 nt, Shigella flexneri 2a str. 2457T
cggaauaucgcuggc

SEQ ID NO: 1950968 - RNA, 18 nt, Shigella flexneri 2a str. 2457T
cggacacuccuuccugaa

SEQ ID NO: 1950969 - RNA, 18 nt, Shigella flexneri 2a str. 2457T
cggacacugcuuacaggc

SEQ ID NO: 1950970 - RNA, 14 nt, Shigella flexneri 2a str. 2457T
cggacacacuucau

SEQ ID NO: 1950971 - RNA, 19 nt, Shigella flexneri 2a str. 2457T
cggacuuccagcggacgau

SEQ ID NO: 1950972 - RNA, 22 nt, Shigella flexneri 2a str. 2457T
cggagacgguuauauuuacaaa

SEQ ID NO: 1950973 - RNA, 20 nt, Shigella flexneri 2a str. 2457T
cggacugaaaguacuucaca

SEQ ID NO: 1950974 - RNA, 15 nt, Shigella flexneri 2a str. 2457T
cggacugaacgcggc

SEQ ID NO: 1950975 - RNA, 15 nt, Shigella flexneri 2a str. 2457T
cggacguuugccaug

SEQ ID NO: 1950976 - RNA, 22 nt, Shigella flexneri 2a str. 2457T
cggacguucgcccacuucuuuc

SEQ ID NO: 1950977 - RNA, 21 nt, Shigella flexneri 2a str. 2457T
cggacggucgacgggcccaua

SEQ ID NO: 1950978 - RNA, 17 nt, Shigella flexneri 2a str. 2457T
cggagcaaugaucucaa

SEQ ID NO: 1950979 - RNA, 20 nt, Shigella flexneri 2a str. 2457T
cggagccagccguugcccgu

SEQ ID NO: 1950980 - RNA, 20 nt, Shigella flexneri 2a str. 2457T
cggagcaccguauugacgcu

SEQ ID NO: 1950981 - RNA, 22 nt, Shigella flexneri 2a str. 2457T
cggagccauugcccgaugcgca

SEQ ID NO: 1950982 - RNA, 14 nt, Shigella flexneri 2a str. 2457T
cggagccauucccc

SEQ ID NO: 1950983 - RNA, 15 nt, Shigella flexneri 2a str. 2457T
cggaggaaagcaccu

SEQ ID NO: 1950984 - RNA, 20 nt, Shigella flexneri 2a str. 2457T
cggaaaguuuaauugccauu

SEQ ID NO: 1950985 - RNA, 23 nt, Shigella flexneri 2a str. 2457T
cggaaaucacgauugcugccgau

SEQ ID NO: 1950986 - RNA, 13 nt, Shigella flexneri 2a str. 2457T
cggaaaucuccag

SEQ ID NO: 1950987 - RNA, 18 nt, Shigella flexneri 2a str. 2457T
cggaaaucuccagauaau

SEQ ID NO: 1950988 - RNA, 15 nt, Shigella flexneri 2a str. 2457T
cggaaaucuccagau

SEQ ID NO: 1950989 - RNA, 14 nt, Shigella flexneri 2a str. 2457T
cggaaacagugcug

SEQ ID NO: 1950990 - RNA, 21 nt, Shigella flexneri 2a str. 2457T
cggaaaauuauuuuaaauuuc

SEQ ID NO: 1950991 - RNA, 17 nt, Shigella flexneri 2a str. 2457T
cggaaagcacaaaauca

SEQ ID NO: 1950992 - RNA, 23 nt, Shigella flexneri 2a str. 2457T
cggaacaucugccccauugcuga

SEQ ID NO: 1950993 - RNA, 23 nt, Shigella flexneri 2a str. 2457T
cggaaauuaccgcaccaccagca

SEQ ID NO: 1950994 - RNA, 20 nt, Shigella flexneri 2a str. 2457T
cggaaauuaccgcaccacca

SEQ ID NO: 1950995 - RNA, 12 nt, Shigella flexneri 2a str. 2457T
cggaacaggcag

SEQ ID NO: 1950996 - RNA, 16 nt, Shigella flexneri 2a str. 2457T
cggaacugugcugccg

SEQ ID NO: 1950997 - RNA, 14 nt, Shigella flexneri 2a str. 2457T
cggaagagacuauu

SEQ ID NO: 1950998 - RNA, 17 nt, Shigella flexneri 2a str. 2457T
cggaagagacuauuucu

SEQ ID NO: 1950999 - RNA, 13 nt, Shigella flexneri 2a str. 2457T
cggaagagauggu

SEQ ID NO: 1951000 - RNA, 15 nt, Shigella flexneri 2a str. 2457T
cggaacugugcugcc

SEQ ID NO: 1951001 - RNA, 13 nt, Shigella flexneri 2a str. 2457T
cggaacugaugau

SEQ ID NO: 1951002 - RNA, 20 nt, Shigella flexneri 2a str. 2457T
cggaaccggauuuucaccau

SEQ ID NO: 1951003 - RNA, 16 nt, Shigella flexneri 2a str. 2457T
cggaaguaccaauggc

SEQ ID NO: 1951004 - RNA, 20 nt, Shigella flexneri 2a str. 2457T
cgcuaaggucaccaguucac

SEQ ID NO: 1951005 - RNA, 21 nt, Shigella flexneri 2a str. 2457T
cgcuaaugcgacccaugcacc

SEQ ID NO: 1951006 - RNA, 17 nt, Shigella flexneri 2a str. 2457T
cgcuaagauaccccagc

SEQ ID NO: 1951007 - RNA, 17 nt, Shigella flexneri 2a str. 2457T
cgcuaaacaggaucugg

SEQ ID NO: 1951008 - RNA, 12 nt, Shigella flexneri 2a str. 2457T
cgcuaaauguuu

SEQ ID NO: 1951009 - RNA, 13 nt, Shigella flexneri 2a str. 2457T
cgcuaaaugccgc

SEQ ID NO: 1951010 - RNA, 22 nt, Shigella flexneri 2a str. 2457T
cgcuaacccgcagcuuaaugaa

SEQ ID NO: 1951011 - RNA, 13 nt, Shigella flexneri 2a str. 2457T
cgcuaacagcagc

SEQ ID NO: 1951012 - RNA, 14 nt, Shigella flexneri 2a str. 2457T
cgcuaacagcagca

SEQ ID NO: 1951013 - RNA, 14 nt, Shigella flexneri 2a str. 2457T
cgcuuuacguuccu

SEQ ID NO: 1951014 - RNA, 19 nt, Shigella flexneri 2a str. 2457T
cgcuuuacucaacuccccg

SEQ ID NO: 1951015 - RNA, 23 nt, Shigella flexneri 2a str. 2457T
cgcuugucaucgaugagaugacg

SEQ ID NO: 1951016 - RNA, 18 nt, Shigella flexneri 2a str. 2457T
cgcuaccaggaagcgacc

SEQ ID NO: 1951017 - RNA, 16 nt, Shigella flexneri 2a str. 2457T
cgcuuuaucgccgcug

SEQ ID NO: 1951018 - RNA, 21 nt, Shigella flexneri 2a str. 2457T
cgcuuucgcuacuucaaacaa

SEQ ID NO: 1951019 - RNA, 19 nt, Shigella flexneri 2a str. 2457T
cgcuuucacuauuucuuug

SEQ ID NO: 1951020 - RNA, 17 nt, Shigella flexneri 2a str. 2457T
cgcuuucgcuuucucuu

SEQ ID NO: 1951021 - RNA, 18 nt, Shigella flexneri 2a str. 2457T
cgcuuucucaccaugacc

SEQ ID NO: 1951022 - RNA, 16 nt, Shigella flexneri 2a str. 2457T
cgcuuucucuucggcu

SEQ ID NO: 1951023 - RNA, 20 nt, Shigella flexneri 2a str. 2457T
cgcuuugggcucaucaauac

SEQ ID NO: 1951024 - RNA, 17 nt, Shigella flexneri 2a str. 2457T
cgcuuuuuucagcgcca

SEQ ID NO: 1951025 - RNA, 19 nt, Shigella flexneri 2a str. 2457T
cggaaaauauuuaggucag

SEQ ID NO: 1951026 - RNA, 15 nt, Shigella flexneri 2a str. 2457T
cgcuuuuauaaaggg

SEQ ID NO: 1951027 - RNA, 16 nt, Shigella flexneri 2a str. 2457T
cggccgcacuuacagc

SEQ ID NO: 1951028 - RNA, 14 nt, Shigella flexneri 2a str. 2457T
cggcccggcuuucu

SEQ ID NO: 1951029 - RNA, 16 nt, Shigella flexneri 2a str. 2457T
cggcgaagagagcgcc

SEQ ID NO: 1951030 - RNA, 22 nt, Shigella flexneri 2a str. 2457T
cggccuacaaaagcaauaauuu

SEQ ID NO: 1951031 - RNA, 14 nt, Shigella flexneri 2a str. 2457T
cggccagcgcaccu

SEQ ID NO: 1951032 - RNA, 19 nt, Shigella flexneri 2a str. 2457T
cggccacucuuuggcaacc

SEQ ID NO: 1951033 - RNA, 19 nt, Shigella flexneri 2a str. 2457T
cggcagcaaucgaccaggc

SEQ ID NO: 1951034 - RNA, 18 nt, Shigella flexneri 2a str. 2457T
cggcauuuuuuucaccaa

SEQ ID NO: 1951035 - RNA, 23 nt, Shigella flexneri 2a str. 2457T
cggcauuuuuuucaccaacgcaa

SEQ ID NO: 1951036 - RNA, 22 nt, Shigella flexneri 2a str. 2457T
cggcauuuuucggcgucagaac

SEQ ID NO: 1951037 - RNA, 14 nt, Shigella flexneri 2a str. 2457T
cggccacagcgcca

SEQ ID NO: 1951038 - RNA, 23 nt, Shigella flexneri 2a str. 2457T
cggcauucagugcaaaugccaga

SEQ ID NO: 1951039 - RNA, 17 nt, Shigella flexneri 2a str. 2457T
cggcauucccagccccc

SEQ ID NO: 1951040 - RNA, 19 nt, Shigella flexneri 2a str. 2457T
cggcauuuccauaccuaaa

SEQ ID NO: 1951041 - RNA, 22 nt, Shigella flexneri 2a str. 2457T
cgagguuaaugaucgcgccgcc

SEQ ID NO: 1951042 - RNA, 18 nt, Shigella flexneri 2a str. 2457T
cgaggugucuucgcgcac

SEQ ID NO: 1951043 - RNA, 12 nt, Shigella flexneri 2a str. 2457T
cgaguaaaaaaa

SEQ ID NO: 1951044 - RNA, 16 nt, Shigella flexneri 2a str. 2457T
cgaggugcucuccacg

SEQ ID NO: 1951045 - RNA, 16 nt, Shigella flexneri 2a str. 2457T
cgaggguaaacaacau

SEQ ID NO: 1951046 - RNA, 19 nt, Shigella flexneri 2a str. 2457T
cgaguaaacaggggcugua

SEQ ID NO: 1951047 - RNA, 13 nt, Shigella flexneri 2a str. 2457T
cgaguaaucaggc

SEQ ID NO: 1951048 - RNA, 20 nt, Shigella flexneri 2a str. 2457T
cgaguccuguugucuuucca

SEQ ID NO: 1951049 - RNA, 15 nt, Shigella flexneri 2a str. 2457T
cgagucgcugagcgu

SEQ ID NO: 1951050 - RNA, 17 nt, Shigella flexneri 2a str. 2457T
cgagucgcugagcgugc

SEQ ID NO: 1951051 - RNA, 20 nt, Shigella flexneri 2a str. 2457T
cgagucgcugagcgugcccc

SEQ ID NO: 1951052 - RNA, 16 nt, Shigella flexneri 2a str. 2457T
cgagucgucaguucca

SEQ ID NO: 1951053 - RNA, 20 nt, Shigella flexneri 2a str. 2457T
cgauaaaggucgacagcagc

SEQ ID NO: 1951054 - RNA, 13 nt, Shigella flexneri 2a str. 2457T
cgauaaagcuggg

SEQ ID NO: 1951055 - RNA, 14 nt, Shigella flexneri 2a str. 2457T
cgauaaagcugggu

SEQ ID NO: 1951056 - RNA, 14 nt, Shigella flexneri 2a str. 2457T
cgauaaaccagcaa

SEQ ID NO: 1951057 - RNA, 21 nt, Shigella flexneri 2a str. 2457T
cgauaaauacagcguuaaaaa

SEQ ID NO: 1951058 - RNA, 14 nt, Shigella flexneri 2a str. 2457T
cgaguucagaucag

SEQ ID NO: 1951059 - RNA, 21 nt, Shigella flexneri 2a str. 2457T
cgauagcgcccgaacggaaac

SEQ ID NO: 1951060 - RNA, 14 nt, Shigella flexneri 2a str. 2457T
cgauagcgccgcca

SEQ ID NO: 1951061 - RNA, 15 nt, Shigella flexneri 2a str. 2457T
cgauaauuuaugccu

SEQ ID NO: 1951062 - RNA, 20 nt, Shigella flexneri 2a str. 2457T
cgauaauuuaugccugauac

SEQ ID NO: 1951063 - RNA, 17 nt, Shigella flexneri 2a str. 2457T
cgauaaccuucuucauu

SEQ ID NO: 1951064 - RNA, 18 nt, Shigella flexneri 2a str. 2457T
cgauaaccaucuucuuca

SEQ ID NO: 1951065 - RNA, 18 nt, Shigella flexneri 2a str. 2457T
cgauaaucucaauauccg

SEQ ID NO: 1951066 - RNA, 13 nt, Shigella flexneri 2a str. 2457T
cgagcguggaacu

SEQ ID NO: 1951067 - RNA, 14 nt, Shigella flexneri 2a str. 2457T
cgagcguggaacuu

SEQ ID NO: 1951068 - RNA, 11 nt, Shigella flexneri 2a str. 2457T
cgaggaaaaua

SEQ ID NO: 1951069 - RNA, 22 nt, Shigella flexneri 2a str. 2457T
cgagcuuauuuguugagcugga

SEQ ID NO: 1951070 - RNA, 23 nt, Shigella flexneri 2a str. 2457T
cgagcgguaaaccguuaucaccu

SEQ ID NO: 1951071 - RNA, 12 nt, Shigella flexneri 2a str. 2457T
aaacgcuggcag

SEQ ID NO: 1951072 - RNA, 22 nt, Shigella flexneri 2a str. 2457T
aaacgcuggcagcauuucucua

SEQ ID NO: 1951073 - RNA, 15 nt, Shigella flexneri 2a str. 2457T
aaacgcucucucagu

SEQ ID NO: 1951074 - RNA, 15 nt, Shigella flexneri 2a str. 2457T
aaacggauaaucaug

SEQ ID NO: 1951075 - RNA, 19 nt, Shigella flexneri 2a str. 2457T
cgagcgccuuauccugccu

SEQ ID NO: 1951076 - RNA, 16 nt, Shigella flexneri 2a str. 2457T
cgaggacagcaucguc

SEQ ID NO: 1951077 - RNA, 22 nt, Shigella flexneri 2a str. 2457T
cgaggaacaucugaguugccau

SEQ ID NO: 1951078 - RNA, 22 nt, Shigella flexneri 2a str. 2457T
cgaggaaucguucauaccacgc

SEQ ID NO: 1951079 - RNA, 19 nt, Shigella flexneri 2a str. 2457T
cgaggaagcuuucgcagua

SEQ ID NO: 1951080 - RNA, 20 nt, Shigella flexneri 2a str. 2457T
cgaggccaauuuggcugcca

SEQ ID NO: 1951081 - RNA, 14 nt, Shigella flexneri 2a str. 2457T
cgaggccaauuugg

SEQ ID NO: 1951082 - RNA, 13 nt, Shigella flexneri 2a str. 2457T
cgaggcacagcag

SEQ ID NO: 1951083 - RNA, 12 nt, Shigella flexneri 2a str. 2457T
cgaggcaaagag

SEQ ID NO: 1951084 - RNA, 16 nt, Shigella flexneri 2a str. 2457T
cgaggcaaccagcacg

SEQ ID NO: 1951085 - RNA, 18 nt, Shigella flexneri 2a str. 2457T
cgagggaaaauaaaaugu

SEQ ID NO: 1951086 - RNA, 16 nt, Shigella flexneri 2a str. 2457T
cgaggccuaacaccau

SEQ ID NO: 1951087 - RNA, 12 nt, Shigella flexneri 2a str. 2457T
cgaauagaaagc

SEQ ID NO: 1951088 - RNA, 12 nt, Shigella flexneri 2a str. 2457T
cgaauacacccu

SEQ ID NO: 1951089 - RNA, 22 nt, Shigella flexneri 2a str. 2457T
cgaauacggauauguuuacuuc

SEQ ID NO: 1951090 - RNA, 13 nt, Shigella flexneri 2a str. 2457T
cgacuacccgcgc

SEQ ID NO: 1951091 - RNA, 20 nt, Shigella flexneri 2a str. 2457T
cgacuacaggacaucuugaa

SEQ ID NO: 1951092 - RNA, 13 nt, Shigella flexneri 2a str. 2457T
cgacgugcgggcg

SEQ ID NO: 1951093 - RNA, 16 nt, Shigella flexneri 2a str. 2457T
cgacgugaccuuucag

SEQ ID NO: 1951094 - RNA, 14 nt, Shigella flexneri 2a str. 2457T
cgacuauuaugaau

SEQ ID NO: 1951095 - RNA, 15 nt, Shigella flexneri 2a str. 2457T
cgacugccgcucacc

SEQ ID NO: 1951096 - RNA, 17 nt, Shigella flexneri 2a str. 2457T
cgacugauaucugcccg

SEQ ID NO: 1951097 - RNA, 20 nt, Shigella flexneri 2a str. 2457T
cgacugcaaaccaugacgca

SEQ ID NO: 1951098 - RNA, 14 nt, Shigella flexneri 2a str. 2457T
cgagaaauuuuuau

SEQ ID NO: 1951099 - RNA, 21 nt, Shigella flexneri 2a str. 2457T
cgagaaacuucacaucaccau

SEQ ID NO: 1951100 - RNA, 19 nt, Shigella flexneri 2a str. 2457T
cgagaagcagcaacacaau

SEQ ID NO: 1951101 - RNA, 23 nt, Shigella flexneri 2a str. 2457T
cgacuuuucauaagcgucagaaa

SEQ ID NO: 1951102 - RNA, 17 nt, Shigella flexneri 2a str. 2457T
cgagaaaagccaaccug

SEQ ID NO: 1951103 - RNA, 13 nt, Shigella flexneri 2a str. 2457T
cgagaaaaugacg

SEQ ID NO: 1951104 - RNA, 13 nt, Shigella flexneri 2a str. 2457T
cgacuuuaugcgu

SEQ ID NO: 1951105 - RNA, 18 nt, Shigella flexneri 2a str. 2457T
cgacuuauucuucaacaa

SEQ ID NO: 1951106 - RNA, 15 nt, Shigella flexneri 2a str. 2457T
cgacuucaucgccaa

SEQ ID NO: 1951107 - RNA, 20 nt, Shigella flexneri 2a str. 2457T
cgagagacgcuugucaccgu

SEQ ID NO: 1951108 - RNA, 15 nt, Shigella flexneri 2a str. 2457T
cgagagagaaaauaa

SEQ ID NO: 1951109 - RNA, 14 nt, Shigella flexneri 2a str. 2457T
cgagaguaacacau

SEQ ID NO: 1951110 - RNA, 22 nt, Shigella flexneri 2a str. 2457T
cgagacgguuaaaaacagccag

SEQ ID NO: 1951111 - RNA, 23 nt, Shigella flexneri 2a str. 2457T
cgagacgguuaaaaacagccagc

SEQ ID NO: 1951112 - RNA, 21 nt, Shigella flexneri 2a str. 2457T
cgagaaucagcgagacaacaa

SEQ ID NO: 1951113 - RNA, 20 nt, Shigella flexneri 2a str. 2457T
cgagaaucagcgagacaaca

SEQ ID NO: 1951114 - RNA, 14 nt, Shigella flexneri 2a str. 2457T
cgagaauaaaacag

SEQ ID NO: 1951115 - RNA, 23 nt, Shigella flexneri 2a str. 2457T
cgagaauaaaacaggcagcugcc

SEQ ID NO: 1951116 - RNA, 15 nt, Shigella flexneri 2a str. 2457T
cgagcaggagaagca

SEQ ID NO: 1951117 - RNA, 14 nt, Shigella flexneri 2a str. 2457T
cgagcaguacagcc

SEQ ID NO: 1951118 - RNA, 23 nt, Shigella flexneri 2a str. 2457T
cgagauaaugguuuccagcaucg

SEQ ID NO: 1951119 - RNA, 13 nt, Shigella flexneri 2a str. 2457T
cgagauaauguuc

SEQ ID NO: 1951120 - RNA, 17 nt, Shigella flexneri 2a str. 2457T
cgagauaccuaacauuu

SEQ ID NO: 1951121 - RNA, 23 nt, Shigella flexneri 2a str. 2457T
cgagaucuuuaucaaucaccgcu

SEQ ID NO: 1951122 - RNA, 22 nt, Shigella flexneri 2a str. 2457T
cgagcaauaaaaacuccgccgc

SEQ ID NO: 1951123 - RNA, 21 nt, Shigella flexneri 2a str. 2457T
cgagcaaugagcuauguuuga

SEQ ID NO: 1951124 - RNA, 20 nt, Shigella flexneri 2a str. 2457T
cgagauuagacggcgcaaca

SEQ ID NO: 1951125 - RNA, 22 nt, Shigella flexneri 2a str. 2457T
cgagcaaaucgcggcaguggcu

SEQ ID NO: 1951126 - RNA, 11 nt, Shigella flexneri 2a str. 2457T
cgagcccuucg

SEQ ID NO: 1951127 - RNA, 23 nt, Shigella flexneri 2a str. 2457T
cgagccguuccuaacaugccacu

SEQ ID NO: 1951128 - RNA, 16 nt, Shigella flexneri 2a str. 2457T
aaacgcucccugccag

SEQ ID NO: 1951129 - RNA, 22 nt, Shigella flexneri 2a str. 2457T
aaacgcucccugccaguccugc

SEQ ID NO: 1951130 - RNA, 14 nt, Shigella flexneri 2a str. 2457T
aaacgcgccaggua

SEQ ID NO: 1951131 - RNA, 14 nt, Shigella flexneri 2a str. 2457T
aaacgcgaccgccg

SEQ ID NO: 1951132 - RNA, 20 nt, Shigella flexneri 2a str. 2457T
aaacgccuugcgcgcagugc

SEQ ID NO: 1951133 - RNA, 13 nt, Shigella flexneri 2a str. 2457T
cgccaccaccagc

SEQ ID NO: 1951134 - RNA, 13 nt, Shigella flexneri 2a str. 2457T
cgccaccacccug

SEQ ID NO: 1951135 - RNA, 13 nt, Shigella flexneri 2a str. 2457T
cgccaccacaaaa

SEQ ID NO: 1951136 - RNA, 15 nt, Shigella flexneri 2a str. 2457T
cgccaccacaacauu

SEQ ID NO: 1951137 - RNA, 21 nt, Shigella flexneri 2a str. 2457T
cgccaccggcuuucgcuucaa

SEQ ID NO: 1951138 - RNA, 22 nt, Shigella flexneri 2a str. 2457T
cgccacauaagaucaucggcca

SEQ ID NO: 1951139 - RNA, 18 nt, Shigella flexneri 2a str. 2457T
cgccacauaagaucaucg

SEQ ID NO: 1951140 - RNA, 18 nt, Shigella flexneri 2a str. 2457T
cgccacaccacugcgcau

SEQ ID NO: 1951141 - RNA, 23 nt, Shigella flexneri 2a str. 2457T
cgccacagcauucucggcccggc

SEQ ID NO: 1951142 - RNA, 19 nt, Shigella flexneri 2a str. 2457T
cgccacaauauuccggcau

SEQ ID NO: 1951143 - RNA, 17 nt, Shigella flexneri 2a str. 2457T
cgccacaacgcaauaaa

SEQ ID NO: 1951144 - RNA, 19 nt, Shigella flexneri 2a str. 2457T
cgccaauucguaaguacau

SEQ ID NO: 1951145 - RNA, 16 nt, Shigella flexneri 2a str. 2457T
cgccacaaacgccaga

SEQ ID NO: 1951146 - RNA, 15 nt, Shigella flexneri 2a str. 2457T
cgccacaaccagcgc

SEQ ID NO: 1951147 - RNA, 20 nt, Shigella flexneri 2a str. 2457T
cgccaaucagcgcagcaccc

SEQ ID NO: 1951148 - RNA, 21 nt, Shigella flexneri 2a str. 2457T
cgccaauaaccggcacuucaa

SEQ ID NO: 1951149 - RNA, 22 nt, Shigella flexneri 2a str. 2457T
cgccaauuaaugcaccaacaaa

SEQ ID NO: 1951150 - RNA, 16 nt, Shigella flexneri 2a str. 2457T
cgccaaccagcugacc

SEQ ID NO: 1951151 - RNA, 15 nt, Shigella flexneri 2a str. 2457T
cgccaacgcaccuga

SEQ ID NO: 1951152 - RNA, 15 nt, Shigella flexneri 2a str. 2457T
cgccaaccugcuggu

SEQ ID NO: 1951153 - RNA, 24 nt, Shigella flexneri 2a str. 2457T
cgccaaaccacuauuauggcgcag

SEQ ID NO: 1951154 - RNA, 21 nt, Shigella flexneri 2a str. 2457T
cgccaaaaggcaauucaauua

SEQ ID NO: 1951155 - RNA, 20 nt, Shigella flexneri 2a str. 2457T
cgccaaagaaaccgcgcgau

SEQ ID NO: 1951156 - RNA, 14 nt, Shigella flexneri 2a str. 2457T
cgccaaagcggcag

SEQ ID NO: 1951157 - RNA, 17 nt, Shigella flexneri 2a str. 2457T
cgccaaacggauacgaa

SEQ ID NO: 1951158 - RNA, 16 nt, Shigella flexneri 2a str. 2457T
cgccaaacccaccagc

SEQ ID NO: 1951159 - RNA, 13 nt, Shigella flexneri 2a str. 2457T
cgcauugcauuuc

SEQ ID NO: 1951160 - RNA, 15 nt, Shigella flexneri 2a str. 2457T
cgcauugccagagug

SEQ ID NO: 1951161 - RNA, 22 nt, Shigella flexneri 2a str. 2457T
cgcauuaugcagccuuuuuuau

SEQ ID NO: 1951162 - RNA, 23 nt, Shigella flexneri 2a str. 2457T
cgcauggccguuauccugaucaa

SEQ ID NO: 1951163 - RNA, 16 nt, Shigella flexneri 2a str. 2457T
cgcauggcauuuugca

SEQ ID NO: 1951164 - RNA, 23 nt, Shigella flexneri 2a str. 2457T
cgcauagcuaauccccuccagcg

SEQ ID NO: 1951165 - RNA, 15 nt, Shigella flexneri 2a str. 2457T
aaacggcacgaugag

SEQ ID NO: 1951166 - RNA, 19 nt, Shigella flexneri 2a str. 2457T
aaacggcacgguugccauu

SEQ ID NO: 1951167 - RNA, 22 nt, Shigella flexneri 2a str. 2457T
cgcagggacacucgcugacuga

SEQ ID NO: 1951168 - RNA, 17 nt, Shigella flexneri 2a str. 2457T
cgcagggcaugacacag

SEQ ID NO: 1951169 - RNA, 17 nt, Shigella flexneri 2a str. 2457T
cgcaucaggcaaucucu

SEQ ID NO: 1951170 - RNA, 14 nt, Shigella flexneri 2a str. 2457T
cgcaucaauauuaa

SEQ ID NO: 1951171 - RNA, 19 nt, Shigella flexneri 2a str. 2457T
cgcaucagggcgcuggcga

SEQ ID NO: 1951172 - RNA, 14 nt, Shigella flexneri 2a str. 2457T
cgcaucaggcaauu

SEQ ID NO: 1951173 - RNA, 21 nt, Shigella flexneri 2a str. 2457T
cgcaucgacauauucaccauu

SEQ ID NO: 1951174 - RNA, 23 nt, Shigella flexneri 2a str. 2457T
cgcaucuguuucgaucagcaauu

SEQ ID NO: 1951175 - RNA, 20 nt, Shigella flexneri 2a str. 2457T
cgcaucggucagacccaguu

SEQ ID NO: 1951176 - RNA, 16 nt, Shigella flexneri 2a str. 2457T
cgcaucgggggaagcu

SEQ ID NO: 1951177 - RNA, 17 nt, Shigella flexneri 2a str. 2457T
cgcagcucaucaacacg

SEQ ID NO: 1951178 - RNA, 13 nt, Shigella flexneri 2a str. 2457T
cgcagcgucagca

SEQ ID NO: 1951179 - RNA, 20 nt, Shigella flexneri 2a str. 2457T
cgcagcgucagcaccagaga

SEQ ID NO: 1951180 - RNA, 21 nt, Shigella flexneri 2a str. 2457T
cgcagauagagcgccugcaga

SEQ ID NO: 1951181 - RNA, 12 nt, Shigella flexneri 2a str. 2457T
cgcagauaaaua

SEQ ID NO: 1951182 - RNA, 19 nt, Shigella flexneri 2a str. 2457T
cgcagauaaauaucaaucc

SEQ ID NO: 1951183 - RNA, 18 nt, Shigella flexneri 2a str. 2457T
cgcagaugaagcuggcaa

SEQ ID NO: 1951184 - RNA, 19 nt, Shigella flexneri 2a str. 2457T
cgcagaugaagcuggcaaa

SEQ ID NO: 1951185 - RNA, 15 nt, Shigella flexneri 2a str. 2457T
cgcagauuucuucug

SEQ ID NO: 1951186 - RNA, 20 nt, Shigella flexneri 2a str. 2457T
cgcaggagcgccgaauggau

SEQ ID NO: 1951187 - RNA, 14 nt, Shigella flexneri 2a str. 2457T
cgcaggaugggcaa

SEQ ID NO: 1951188 - RNA, 13 nt, Shigella flexneri 2a str. 2457T
cgcaggccacgaa

SEQ ID NO: 1951189 - RNA, 14 nt, Shigella flexneri 2a str. 2457T
cgcaggcgcugaaa

SEQ ID NO: 1951190 - RNA, 12 nt, Shigella flexneri 2a str. 2457T
cgcaggcgcgcu

SEQ ID NO: 1951191 - RNA, 16 nt, Shigella flexneri 2a str. 2457T
cgcaggcgcaauggcg

SEQ ID NO: 1951192 - RNA, 19 nt, Shigella flexneri 2a str. 2457T
cgcaggcgcaauggcgcaa

SEQ ID NO: 1951193 - RNA, 16 nt, Shigella flexneri 2a str. 2457T
cgcaaccaacggccuu

SEQ ID NO: 1951194 - RNA, 21 nt, Shigella flexneri 2a str. 2457T
cgcaacagugaaauacaguua

SEQ ID NO: 1951195 - RNA, 23 nt, Shigella flexneri 2a str. 2457T
cgcaaccacaaaacacucuucaa

SEQ ID NO: 1951196 - RNA, 15 nt, Shigella flexneri 2a str. 2457T
cgcaaccagcgucag

SEQ ID NO: 1951197 - RNA, 13 nt, Shigella flexneri 2a str. 2457T
cgcaacaaauaaa

SEQ ID NO: 1951198 - RNA, 20 nt, Shigella flexneri 2a str. 2457T
cgcaaauauuucacccgcga

SEQ ID NO: 1951199 - RNA, 17 nt, Shigella flexneri 2a str. 2457T
cgcaaaggccagcaauc

SEQ ID NO: 1951200 - RNA, 16 nt, Shigella flexneri 2a str. 2457T
cgcaacuuccccucug

SEQ ID NO: 1951201 - RNA, 18 nt, Shigella flexneri 2a str. 2457T
cgcaacugguccagcccc

SEQ ID NO: 1951202 - RNA, 22 nt, Shigella flexneri 2a str. 2457T
cgcacaauggcggugaucccaa

SEQ ID NO: 1951203 - RNA, 20 nt, Shigella flexneri 2a str. 2457T
cgcacaggcaauccagcucg

SEQ ID NO: 1951204 - RNA, 14 nt, Shigella flexneri 2a str. 2457T
cgcacacaacagac

SEQ ID NO: 1951205 - RNA, 14 nt, Shigella flexneri 2a str. 2457T
cgcacaccccggcg

SEQ ID NO: 1951206 - RNA, 17 nt, Shigella flexneri 2a str. 2457T
cgcacaccgagauaaug

SEQ ID NO: 1951207 - RNA, 15 nt, Shigella flexneri 2a str. 2457T
cgcacacgccgugca

SEQ ID NO: 1951208 - RNA, 22 nt, Shigella flexneri 2a str. 2457T
cgcacgccuggcagucacggcg

SEQ ID NO: 1951209 - RNA, 22 nt, Shigella flexneri 2a str. 2457T
cgcacgcagggaguuaccgugu

SEQ ID NO: 1951210 - RNA, 17 nt, Shigella flexneri 2a str. 2457T
cgcacguugucagcaac

SEQ ID NO: 1951211 - RNA, 19 nt, Shigella flexneri 2a str. 2457T
cgcacgucagccucgcugg

SEQ ID NO: 1951212 - RNA, 14 nt, Shigella flexneri 2a str. 2457T
cgcacucgcccuga

SEQ ID NO: 1951213 - RNA, 12 nt, Shigella flexneri 2a str. 2457T
cgcacuugccag

SEQ ID NO: 1951214 - RNA, 18 nt, Shigella flexneri 2a str. 2457T
cgcacuuugccagaaauc

SEQ ID NO: 1951215 - RNA, 13 nt, Shigella flexneri 2a str. 2457T
cgcagaaagaggc

SEQ ID NO: 1951216 - RNA, 15 nt, Shigella flexneri 2a str. 2457T
cgcagaaccagaagc

SEQ ID NO: 1951217 - RNA, 16 nt, Shigella flexneri 2a str. 2457T
cgcagaaccagaagcg

SEQ ID NO: 1951218 - RNA, 12 nt, Shigella flexneri 2a str. 2457T
cgcaccagcagg

SEQ ID NO: 1951219 - RNA, 17 nt, Shigella flexneri 2a str. 2457T
cgcaccagaaacaauaa

SEQ ID NO: 1951220 - RNA, 20 nt, Shigella flexneri 2a str. 2457T
cgcaccaacuccacuucacc

SEQ ID NO: 1951221 - RNA, 13 nt, Shigella flexneri 2a str. 2457T
cgcaccaacucca

SEQ ID NO: 1951222 - RNA, 11 nt, Shigella flexneri 2a str. 2457T
cgcaccaccag

SEQ ID NO: 1951223 - RNA, 22 nt, Shigella flexneri 2a str. 2457T
cgcaccagcggaaugcagucac

SEQ ID NO: 1951224 - RNA, 13 nt, Shigella flexneri 2a str. 2457T
cgcaccugccagc

SEQ ID NO: 1951225 - RNA, 16 nt, Shigella flexneri 2a str. 2457T
cgcaccugccagcgcc

SEQ ID NO: 1951226 - RNA, 16 nt, Shigella flexneri 2a str. 2457T
cgcaccugaguaauua

SEQ ID NO: 1951227 - RNA, 12 nt, Shigella flexneri 2a str. 2457T
cgcaccuuuacc

SEQ ID NO: 1951228 - RNA, 19 nt, Shigella flexneri 2a str. 2457T
cgaugcuuugaccucccgc

SEQ ID NO: 1951229 - RNA, 18 nt, Shigella flexneri 2a str. 2457T
cgauggucagcuucaccu

SEQ ID NO: 1951230 - RNA, 15 nt, Shigella flexneri 2a str. 2457T
cgauggucagcuuca

SEQ ID NO: 1951231 - RNA, 16 nt, Shigella flexneri 2a str. 2457T
cgaugaucaacagcau

SEQ ID NO: 1951232 - RNA, 16 nt, Shigella flexneri 2a str. 2457T
cgauauucuucaguau

SEQ ID NO: 1951233 - RNA, 16 nt, Shigella flexneri 2a str. 2457T
cgauauucauuuugcu

SEQ ID NO: 1951234 - RNA, 15 nt, Shigella flexneri 2a str. 2457T
cgauaugccggcauc

SEQ ID NO: 1951235 - RNA, 23 nt, Shigella flexneri 2a str. 2457T
cgaugcgaucauuaacaccacgc

SEQ ID NO: 1951236 - RNA, 12 nt, Shigella flexneri 2a str. 2457T
cgauuuucaaaa

SEQ ID NO: 1951237 - RNA, 13 nt, Shigella flexneri 2a str. 2457T
cgauuuuguaaaa

SEQ ID NO: 1951238 - RNA, 16 nt, Shigella flexneri 2a str. 2457T
cgauuuuguaaaagaa

SEQ ID NO: 1951239 - RNA, 13 nt, Shigella flexneri 2a str. 2457T
cgcaaaaaacauu

SEQ ID NO: 1951240 - RNA, 18 nt, Shigella flexneri 2a str. 2457T
cgcaaaacguggccucca

SEQ ID NO: 1951241 - RNA, 19 nt, Shigella flexneri 2a str. 2457T
cgcaaaccuggcaacaauc

SEQ ID NO: 1951242 - RNA, 16 nt, Shigella flexneri 2a str. 2457T
cgcaaacgcccgucca

SEQ ID NO: 1951243 - RNA, 23 nt, Shigella flexneri 2a str. 2457T
cgcaaacgcccguccaucaacaa

SEQ ID NO: 1951244 - RNA, 20 nt, Shigella flexneri 2a str. 2457T
cgcaaacaguacaucuucca

SEQ ID NO: 1951245 - RNA, 18 nt, Shigella flexneri 2a str. 2457T
cgcaaaauaccagcaauu

SEQ ID NO: 1951246 - RNA, 13 nt, Shigella flexneri 2a str. 2457T
cgcaaacaccagc

SEQ ID NO: 1951247 - RNA, 23 nt, Shigella flexneri 2a str. 2457T
cgcaaacaucggcuuauucauau

SEQ ID NO: 1951248 - RNA, 19 nt, Shigella flexneri 2a str. 2457T
cgaugugaacccugauuuc

SEQ ID NO: 1951249 - RNA, 15 nt, Shigella flexneri 2a str. 2457T
cgauuucuuuauccg

SEQ ID NO: 1951250 - RNA, 17 nt, Shigella flexneri 2a str. 2457T
cgauugucagcuggugg

SEQ ID NO: 1951251 - RNA, 17 nt, Shigella flexneri 2a str. 2457T
cgauuuggccgaagagg

SEQ ID NO: 1951252 - RNA, 18 nt, Shigella flexneri 2a str. 2457T
cgauuuggccgaagagga

SEQ ID NO: 1951253 - RNA, 19 nt, Shigella flexneri 2a str. 2457T
cgauuuggccgaagaggaa

SEQ ID NO: 1951254 - RNA, 15 nt, Shigella flexneri 2a str. 2457T
cgauugcucaacgcc

SEQ ID NO: 1951255 - RNA, 20 nt, Shigella flexneri 2a str. 2457T
cgccgcguuugcgcagccag

SEQ ID NO: 1951256 - RNA, 23 nt, Shigella flexneri 2a str. 2457T
cgccgcuauuauaucgcucucuu

SEQ ID NO: 1951257 - RNA, 20 nt, Shigella flexneri 2a str. 2457T
cgccggaaucaacggcaaca

SEQ ID NO: 1951258 - RNA, 17 nt, Shigella flexneri 2a str. 2457T
cgccgcuugcuggcgcu

SEQ ID NO: 1951259 - RNA, 15 nt, Shigella flexneri 2a str. 2457T
cgccgcggacaauaa

SEQ ID NO: 1951260 - RNA, 14 nt, Shigella flexneri 2a str. 2457T
aaacgugcggcugu

SEQ ID NO: 1951261 - RNA, 13 nt, Shigella flexneri 2a str. 2457T
aaacguuuaaaaa

SEQ ID NO: 1951262 - RNA, 15 nt, Shigella flexneri 2a str. 2457T
aaacguuuaaaaacu

SEQ ID NO: 1951263 - RNA, 14 nt, Shigella flexneri 2a str. 2457T
cgccguaacgcccu

SEQ ID NO: 1951264 - RNA, 15 nt, Shigella flexneri 2a str. 2457T
cgccgguaugggcaa

SEQ ID NO: 1951265 - RNA, 14 nt, Shigella flexneri 2a str. 2457T
cgccggucacgccc

SEQ ID NO: 1951266 - RNA, 18 nt, Shigella flexneri 2a str. 2457T
cgccgggaaauuuuuccg

SEQ ID NO: 1951267 - RNA, 18 nt, Shigella flexneri 2a str. 2457T
cgccgggaugcuggggcc

SEQ ID NO: 1951268 - RNA, 18 nt, Shigella flexneri 2a str. 2457T
cgccggaugacacaucac

SEQ ID NO: 1951269 - RNA, 23 nt, Shigella flexneri 2a str. 2457T
cgccggaugacacaucaccucca

SEQ ID NO: 1951270 - RNA, 19 nt, Shigella flexneri 2a str. 2457T
cgccgaagugcgcgcagcu

SEQ ID NO: 1951271 - RNA, 17 nt, Shigella flexneri 2a str. 2457T
cgccgaauaacgcgcag

SEQ ID NO: 1951272 - RNA, 20 nt, Shigella flexneri 2a str. 2457T
cgcccugaaaacgcaguucc

SEQ ID NO: 1951273 - RNA, 15 nt, Shigella flexneri 2a str. 2457T
cgcccugaaccgacg

SEQ ID NO: 1951274 - RNA, 13 nt, Shigella flexneri 2a str. 2457T
cgcccgcuugcga

SEQ ID NO: 1951275 - RNA, 14 nt, Shigella flexneri 2a str. 2457T
cgcccggauuacag

SEQ ID NO: 1951276 - RNA, 16 nt, Shigella flexneri 2a str. 2457T
cgccgagcaaugagcu

SEQ ID NO: 1951277 - RNA, 16 nt, Shigella flexneri 2a str. 2457T
cgccgagcaaaccaca

SEQ ID NO: 1951278 - RNA, 15 nt, Shigella flexneri 2a str. 2457T
cgccgagcaccacgu

SEQ ID NO: 1951279 - RNA, 15 nt, Shigella flexneri 2a str. 2457T
cgccgcauccggcau

SEQ ID NO: 1951280 - RNA, 14 nt, Shigella flexneri 2a str. 2457T
cgccgcaucuuccc

SEQ ID NO: 1951281 - RNA, 15 nt, Shigella flexneri 2a str. 2457T
cgccgcauccaacau

SEQ ID NO: 1951282 - RNA, 18 nt, Shigella flexneri 2a str. 2457T
cgccgcauaguaagccgg

SEQ ID NO: 1951283 - RNA, 19 nt, Shigella flexneri 2a str. 2457T
cgccgcacuuucuccuccc

SEQ ID NO: 1951284 - RNA, 13 nt, Shigella flexneri 2a str. 2457T
cgccgcccagaga

SEQ ID NO: 1951285 - RNA, 15 nt, Shigella flexneri 2a str. 2457T
cgccgcccagccagc

SEQ ID NO: 1951286 - RNA, 20 nt, Shigella flexneri 2a str. 2457T
cgccgcccagccagccgagg

SEQ ID NO: 1951287 - RNA, 19 nt, Shigella flexneri 2a str. 2457T
cgcccacgccagccugcuu

SEQ ID NO: 1951288 - RNA, 15 nt, Shigella flexneri 2a str. 2457T
cgcccaccaccagcg

SEQ ID NO: 1951289 - RNA, 19 nt, Shigella flexneri 2a str. 2457T
cgccaugcuugaagggcug

SEQ ID NO: 1951290 - RNA, 23 nt, Shigella flexneri 2a str. 2457T
cgccaugaacgcgaaggccagaa

SEQ ID NO: 1951291 - RNA, 18 nt, Shigella flexneri 2a str. 2457T
cgccaugagcggacugaa

SEQ ID NO: 1951292 - RNA, 14 nt, Shigella flexneri 2a str. 2457T
cgccaugaagaugg

SEQ ID NO: 1951293 - RNA, 19 nt, Shigella flexneri 2a str. 2457T
cgccacgcucacucaucac

SEQ ID NO: 1951294 - RNA, 14 nt, Shigella flexneri 2a str. 2457T
cgcccauuccagua

SEQ ID NO: 1951295 - RNA, 12 nt, Shigella flexneri 2a str. 2457T
cgcccagugcgg

SEQ ID NO: 1951296 - RNA, 17 nt, Shigella flexneri 2a str. 2457T
cgcccaguggaugcgcc

SEQ ID NO: 1951297 - RNA, 13 nt, Shigella flexneri 2a str. 2457T
cgccccaacacaa

SEQ ID NO: 1951298 - RNA, 19 nt, Shigella flexneri 2a str. 2457T
cgccccacagacccaggua

SEQ ID NO: 1951299 - RNA, 22 nt, Shigella flexneri 2a str. 2457T
cgcccgaaugcgaaaauccuca

SEQ ID NO: 1951300 - RNA, 20 nt, Shigella flexneri 2a str. 2457T
cgcccgaccaucgccagcuc

SEQ ID NO: 1951301 - RNA, 21 nt, Shigella flexneri 2a str. 2457T
cgcccgaauugaagccaaauc

SEQ ID NO: 1951302 - RNA, 18 nt, Shigella flexneri 2a str. 2457T
cgcccgccguccggcgcu

SEQ ID NO: 1951303 - RNA, 22 nt, Shigella flexneri 2a str. 2457T
cgcccgaugcauaauccgccgc

SEQ ID NO: 1951304 - RNA, 20 nt, Shigella flexneri 2a str. 2457T
cgcgcuuaucgccagcgcca

SEQ ID NO: 1951305 - RNA, 19 nt, Shigella flexneri 2a str. 2457T
cgcgcuuaucgccagcgcc

SEQ ID NO: 1951306 - RNA, 13 nt, Shigella flexneri 2a str. 2457T
cgcggagcgccug

SEQ ID NO: 1951307 - RNA, 20 nt, Shigella flexneri 2a str. 2457T
cgcggcauuaccggcaaugu

SEQ ID NO: 1951308 - RNA, 20 nt, Shigella flexneri 2a str. 2457T
cgcggcauuuuuacugcgcg

SEQ ID NO: 1951309 - RNA, 21 nt, Shigella flexneri 2a str. 2457T
cgcggcagccaccgccagcgg

SEQ ID NO: 1951310 - RNA, 20 nt, Shigella flexneri 2a str. 2457T
cgcggguaaguacgccauca

SEQ ID NO: 1951311 - RNA, 20 nt, Shigella flexneri 2a str. 2457T
cgcggcuuugucauaaccaa

SEQ ID NO: 1951312 - RNA, 19 nt, Shigella flexneri 2a str. 2457T
cgcgucggcgucagcgcca

SEQ ID NO: 1951313 - RNA, 18 nt, Shigella flexneri 2a str. 2457T
cgcgucuuaucuggccua

SEQ ID NO: 1951314 - RNA, 16 nt, Shigella flexneri 2a str. 2457T
cgcgucuuaucuggcc

SEQ ID NO: 1951315 - RNA, 13 nt, Shigella flexneri 2a str. 2457T
cgcguucacugcc

SEQ ID NO: 1951316 - RNA, 14 nt, Shigella flexneri 2a str. 2457T
cgcguucacugccg

SEQ ID NO: 1951317 - RNA, 15 nt, Shigella flexneri 2a str. 2457T
cgcguuucugcgcuu

SEQ ID NO: 1951318 - RNA, 19 nt, Shigella flexneri 2a str. 2457T
cgcguucgauggcgcgcca

SEQ ID NO: 1951319 - RNA, 15 nt, Shigella flexneri 2a str. 2457T
cgcguguuccagaga

SEQ ID NO: 1951320 - RNA, 20 nt, Shigella flexneri 2a str. 2457T
cgcguaaccgguaccugccg

SEQ ID NO: 1951321 - RNA, 16 nt, Shigella flexneri 2a str. 2457T
cgcguaacugaagcau

SEQ ID NO: 1951322 - RNA, 13 nt, Shigella flexneri 2a str. 2457T
cgcguaacugcug

SEQ ID NO: 1951323 - RNA, 20 nt, Shigella flexneri 2a str. 2457T
cgcguagagaauccagugcu

SEQ ID NO: 1951324 - RNA, 16 nt, Shigella flexneri 2a str. 2457T
cgcguacacuuuccug

SEQ ID NO: 1951325 - RNA, 19 nt, Shigella flexneri 2a str. 2457T
cgcguccggcgucgcuucu

SEQ ID NO: 1951326 - RNA, 24 nt, Shigella flexneri 2a str. 2457T
cgcguaugguuuuuccagccgagc

SEQ ID NO: 1951327 - RNA, 19 nt, Shigella flexneri 2a str. 2457T
cgcguaugguuuuuccagc

SEQ ID NO: 1951328 - RNA, 17 nt, Shigella flexneri 2a str. 2457T
cgcggucagcugcuguu

SEQ ID NO: 1951329 - RNA, 19 nt, Shigella flexneri 2a str. 2457T
cgcgguaucaccacccagc

SEQ ID NO: 1951330 - RNA, 17 nt, Shigella flexneri 2a str. 2457T
cgcgguaaagcgcggca

SEQ ID NO: 1951331 - RNA, 18 nt, Shigella flexneri 2a str. 2457T
cgcgguagcgggcaguaa

SEQ ID NO: 1951332 - RNA, 14 nt, Shigella flexneri 2a str. 2457T
cgcgguaucaccac

SEQ ID NO: 1951333 - RNA, 12 nt, Shigella flexneri 2a str. 2457T
cgcgguagcacg

SEQ ID NO: 1951334 - RNA, 17 nt, Shigella flexneri 2a str. 2457T
cgcgguaaacugcauga

SEQ ID NO: 1951335 - RNA, 21 nt, Shigella flexneri 2a str. 2457T
cgcggucgccgucaggcaagc

SEQ ID NO: 1951336 - RNA, 20 nt, Shigella flexneri 2a str. 2457T
cgcgguguugauacaggcgc

SEQ ID NO: 1951337 - RNA, 19 nt, Shigella flexneri 2a str. 2457T
cgcgaucgcugagcuccug

SEQ ID NO: 1951338 - RNA, 13 nt, Shigella flexneri 2a str. 2457T
cgcgaucgcgcca

SEQ ID NO: 1951339 - RNA, 15 nt, Shigella flexneri 2a str. 2457T
cgcgcaaauccacgu

SEQ ID NO: 1951340 - RNA, 16 nt, Shigella flexneri 2a str. 2457T
cgcgcaaaaaaucgcc

SEQ ID NO: 1951341 - RNA, 18 nt, Shigella flexneri 2a str. 2457T
cgcgcaaccaacggccuu

SEQ ID NO: 1951342 - RNA, 20 nt, Shigella flexneri 2a str. 2457T
cgcgcaaccaacggccuugc

SEQ ID NO: 1951343 - RNA, 21 nt, Shigella flexneri 2a str. 2457T
cgcgauucugauugccgcuuu

SEQ ID NO: 1951344 - RNA, 13 nt, Shigella flexneri 2a str. 2457T
cgcgcagcuucac

SEQ ID NO: 1951345 - RNA, 22 nt, Shigella flexneri 2a str. 2457T
cgcgcacguacaucccgcgaac

SEQ ID NO: 1951346 - RNA, 20 nt, Shigella flexneri 2a str. 2457T
cgcgcacucgcccugaccug

SEQ ID NO: 1951347 - RNA, 18 nt, Shigella flexneri 2a str. 2457T
cgcgcacgucagccucgc

SEQ ID NO: 1951348 - RNA, 22 nt, Shigella flexneri 2a str. 2457T
cgcgcagugccgguggaagggc

SEQ ID NO: 1951349 - RNA, 22 nt, Shigella flexneri 2a str. 2457T
cgcgcaggcggauugcuucugc

SEQ ID NO: 1951350 - RNA, 22 nt, Shigella flexneri 2a str. 2457T
cgcgcagggugcagaaucaauc

SEQ ID NO: 1951351 - RNA, 21 nt, Shigella flexneri 2a str. 2457T
cgcgcaggaucgacugcaaac

SEQ ID NO: 1951352 - RNA, 18 nt, Shigella flexneri 2a str. 2457T
cgcgcccauacggcucag

SEQ ID NO: 1951353 - RNA, 22 nt, Shigella flexneri 2a str. 2457T
cgcgccauuucggcgugcuguc

SEQ ID NO: 1951354 - RNA, 22 nt, Shigella flexneri 2a str. 2457T
cgcgccaaucagcgcagcaccc

SEQ ID NO: 1951355 - RNA, 21 nt, Shigella flexneri 2a str. 2457T
cgcgccaaucagcgcagcacc

SEQ ID NO: 1951356 - RNA, 17 nt, Shigella flexneri 2a str. 2457T
cgcgccaaucagcgcag

SEQ ID NO: 1951357 - RNA, 18 nt, Shigella flexneri 2a str. 2457T
cgcgccaagauagaacca

SEQ ID NO: 1951358 - RNA, 14 nt, Shigella flexneri 2a str. 2457T
cgcgcccgcgcagc

SEQ ID NO: 1951359 - RNA, 13 nt, Shigella flexneri 2a str. 2457T
cgcgcccuccugc

SEQ ID NO: 1951360 - RNA, 21 nt, Shigella flexneri 2a str. 2457T
cgcgccccacggauugccgcu

SEQ ID NO: 1951361 - RNA, 21 nt, Shigella flexneri 2a str. 2457T
cgcgccgcgcugcuguagcag

SEQ ID NO: 1951362 - RNA, 21 nt, Shigella flexneri 2a str. 2457T
cgcgccgcgguacagcucggu

SEQ ID NO: 1951363 - RNA, 13 nt, Shigella flexneri 2a str. 2457T
cgcgccgccgccc

SEQ ID NO: 1951364 - RNA, 16 nt, Shigella flexneri 2a str. 2457T
cgcgccgccucccuuc

SEQ ID NO: 1951365 - RNA, 17 nt, Shigella flexneri 2a str. 2457T
cgccuucugcgccgccu

SEQ ID NO: 1951366 - RNA, 22 nt, Shigella flexneri 2a str. 2457T
cgccuguuuaccgcucaccgga

SEQ ID NO: 1951367 - RNA, 15 nt, Shigella flexneri 2a str. 2457T
cgccuugcgcgcagu

SEQ ID NO: 1951368 - RNA, 19 nt, Shigella flexneri 2a str. 2457T
cgccuugcggaaauuccag

SEQ ID NO: 1951369 - RNA, 16 nt, Shigella flexneri 2a str. 2457T
cgccuuuaccgcgcau

SEQ ID NO: 1951370 - RNA, 14 nt, Shigella flexneri 2a str. 2457T
cgccuuucuuaaac

SEQ ID NO: 1951371 - RNA, 19 nt, Shigella flexneri 2a str. 2457T
cgccuuucuuaaacuucac

SEQ ID NO: 1951372 - RNA, 17 nt, Shigella flexneri 2a str. 2457T
cgccuuguuccugcuug

SEQ ID NO: 1951373 - RNA, 15 nt, Shigella flexneri 2a str. 2457T
cgccuuuuacgcauu

SEQ ID NO: 1951374 - RNA, 23 nt, Shigella flexneri 2a str. 2457T
cgccugcuccucggugaucucaa

SEQ ID NO: 1951375 - RNA, 16 nt, Shigella flexneri 2a str. 2457T
cgccuguguccuguug

SEQ ID NO: 1951376 - RNA, 17 nt, Shigella flexneri 2a str. 2457T
cgccuguucccuucuca

SEQ ID NO: 1951377 - RNA, 14 nt, Shigella flexneri 2a str. 2457T
cgccugcggccagc

SEQ ID NO: 1951378 - RNA, 16 nt, Shigella flexneri 2a str. 2457T
cgccugcggccagcag

SEQ ID NO: 1951379 - RNA, 19 nt, Shigella flexneri 2a str. 2457T
cgcgaaaguuaccgcgcca

SEQ ID NO: 1951380 - RNA, 22 nt, Shigella flexneri 2a str. 2457T
cgccuuuucuuuauaaauuccu

SEQ ID NO: 1951381 - RNA, 21 nt, Shigella flexneri 2a str. 2457T
cgccuuuugauacucugucug

SEQ ID NO: 1951382 - RNA, 19 nt, Shigella flexneri 2a str. 2457T
cgccuuuuuucgccgcagc

SEQ ID NO: 1951383 - RNA, 15 nt, Shigella flexneri 2a str. 2457T
cgcgaaagaggcgca

SEQ ID NO: 1951384 - RNA, 15 nt, Shigella flexneri 2a str. 2457T
cgcgauagccgcuuu

SEQ ID NO: 1951385 - RNA, 14 nt, Shigella flexneri 2a str. 2457T
cgcgauauugcugc

SEQ ID NO: 1951386 - RNA, 22 nt, Shigella flexneri 2a str. 2457T
cgcgacuuuaaucaccugccag

SEQ ID NO: 1951387 - RNA, 15 nt, Shigella flexneri 2a str. 2457T
cgcgaccuguucucc

SEQ ID NO: 1951388 - RNA, 23 nt, Shigella flexneri 2a str. 2457T
ccgucaucgacaaaaacccugcc

SEQ ID NO: 1951389 - RNA, 21 nt, Shigella flexneri 2a str. 2457T
ccgucaguuuuucacccgcaa

SEQ ID NO: 1951390 - RNA, 16 nt, Shigella flexneri 2a str. 2457T
ccgucagcgcaugauu

SEQ ID NO: 1951391 - RNA, 15 nt, Shigella flexneri 2a str. 2457T
ccgucagccgcccgc

SEQ ID NO: 1951392 - RNA, 19 nt, Shigella flexneri 2a str. 2457T
ccgucagcggcaauucuuu

SEQ ID NO: 1951393 - RNA, 22 nt, Shigella flexneri 2a str. 2457T
ccgucagucacaccgcgcgucc

SEQ ID NO: 1951394 - RNA, 11 nt, Shigella flexneri 2a str. 2457T
ccgucagccgc

SEQ ID NO: 1951395 - RNA, 23 nt, Shigella flexneri 2a str. 2457T
ccgucacgcguugcuaugcugaa

SEQ ID NO: 1951396 - RNA, 18 nt, Shigella flexneri 2a str. 2457T
ccgucaccggaauaauga

SEQ ID NO: 1951397 - RNA, 20 nt, Shigella flexneri 2a str. 2457T
aaaccuuagguugugaucau

SEQ ID NO: 1951398 - RNA, 22 nt, Shigella flexneri 2a str. 2457T
aaaccuuagguugugaucaucc

SEQ ID NO: 1951399 - RNA, 16 nt, Shigella flexneri 2a str. 2457T
aaacgaaucugcaaau

SEQ ID NO: 1951400 - RNA, 16 nt, Shigella flexneri 2a str. 2457T
ccgucgggucagcucc

SEQ ID NO: 1951401 - RNA, 14 nt, Shigella flexneri 2a str. 2457T
ccgugaauuacugc

SEQ ID NO: 1951402 - RNA, 17 nt, Shigella flexneri 2a str. 2457T
ccgucuucccgcagcca

SEQ ID NO: 1951403 - RNA, 16 nt, Shigella flexneri 2a str. 2457T
ccgucuucccgcagcc

SEQ ID NO: 1951404 - RNA, 12 nt, Shigella flexneri 2a str. 2457T
ccgucgcauggg

SEQ ID NO: 1951405 - RNA, 16 nt, Shigella flexneri 2a str. 2457T
ccgucccuaccgguaa

SEQ ID NO: 1951406 - RNA, 23 nt, Shigella flexneri 2a str. 2457T
ccguacugaaugaucacuuguuc

SEQ ID NO: 1951407 - RNA, 21 nt, Shigella flexneri 2a str. 2457T
ccguacugacggcguucuuua

SEQ ID NO: 1951408 - RNA, 14 nt, Shigella flexneri 2a str. 2457T
ccguacugcauaau

SEQ ID NO: 1951409 - RNA, 21 nt, Shigella flexneri 2a str. 2457T
ccguacaaagugccgccagcu

SEQ ID NO: 1951410 - RNA, 19 nt, Shigella flexneri 2a str. 2457T
ccguaauccguggucuguu

SEQ ID NO: 1951411 - RNA, 17 nt, Shigella flexneri 2a str. 2457T
ccguaagcaacgccaaa

SEQ ID NO: 1951412 - RNA, 16 nt, Shigella flexneri 2a str. 2457T
ccgguuuugguuuucu

SEQ ID NO: 1951413 - RNA, 18 nt, Shigella flexneri 2a str. 2457T
ccgguuuuacuuugccuu

SEQ ID NO: 1951414 - RNA, 20 nt, Shigella flexneri 2a str. 2457T
ccgguuugcgccgugcgaau

SEQ ID NO: 1951415 - RNA, 19 nt, Shigella flexneri 2a str. 2457T
ccguaacgcccuucaggug

SEQ ID NO: 1951416 - RNA, 16 nt, Shigella flexneri 2a str. 2457T
ccguaagcgccccgag

SEQ ID NO: 1951417 - RNA, 21 nt, Shigella flexneri 2a str. 2457T
ccguaaguaagauaaaagcaa

SEQ ID NO: 1951418 - RNA, 12 nt, Shigella flexneri 2a str. 2457T
ccgguuuuucaa

SEQ ID NO: 1951419 - RNA, 16 nt, Shigella flexneri 2a str. 2457T
ccguauaauaucuuuu

SEQ ID NO: 1951420 - RNA, 14 nt, Shigella flexneri 2a str. 2457T
ccguaguuccacau

SEQ ID NO: 1951421 - RNA, 17 nt, Shigella flexneri 2a str. 2457T
ccguaguauuuucuuug

SEQ ID NO: 1951422 - RNA, 13 nt, Shigella flexneri 2a str. 2457T
ccguaguggccac

SEQ ID NO: 1951423 - RNA, 20 nt, Shigella flexneri 2a str. 2457T
ccguauguucccaccagcca

SEQ ID NO: 1951424 - RNA, 22 nt, Shigella flexneri 2a str. 2457T
ccguauguucccaccagccacg

SEQ ID NO: 1951425 - RNA, 17 nt, Shigella flexneri 2a str. 2457T
ccguauuacugagaugg

SEQ ID NO: 1951426 - RNA, 21 nt, Shigella flexneri 2a str. 2457T
ccgucaaucuucacgcgcaga

SEQ ID NO: 1951427 - RNA, 14 nt, Shigella flexneri 2a str. 2457T
ccgguccuggcgau

SEQ ID NO: 1951428 - RNA, 16 nt, Shigella flexneri 2a str. 2457T
ccggugcgccagaccu

SEQ ID NO: 1951429 - RNA, 13 nt, Shigella flexneri 2a str. 2457T
ccggugucgaugu

SEQ ID NO: 1951430 - RNA, 16 nt, Shigella flexneri 2a str. 2457T
ccggugaccaucagca

SEQ ID NO: 1951431 - RNA, 22 nt, Shigella flexneri 2a str. 2457T
ccggauaaagcguucacgccgc

SEQ ID NO: 1951432 - RNA, 14 nt, Shigella flexneri 2a str. 2457T
ccggccauuccagc

SEQ ID NO: 1951433 - RNA, 16 nt, Shigella flexneri 2a str. 2457T
ccggccagcgccacca

SEQ ID NO: 1951434 - RNA, 19 nt, Shigella flexneri 2a str. 2457T
ccggccuaccguucaggca

SEQ ID NO: 1951435 - RNA, 19 nt, Shigella flexneri 2a str. 2457T
ccggcgacacaucuaaugc

SEQ ID NO: 1951436 - RNA, 22 nt, Shigella flexneri 2a str. 2457T
ccggccugcacugcaggccgga

SEQ ID NO: 1951437 - RNA, 17 nt, Shigella flexneri 2a str. 2457T
ccggcgcggugcuggau

SEQ ID NO: 1951438 - RNA, 16 nt, Shigella flexneri 2a str. 2457T
ccggcuuaccgcuccg

SEQ ID NO: 1951439 - RNA, 22 nt, Shigella flexneri 2a str. 2457T
ccggcugaggcguuucaacucc

SEQ ID NO: 1951440 - RNA, 19 nt, Shigella flexneri 2a str. 2457T
ccgggaaauccucaaccgg

SEQ ID NO: 1951441 - RNA, 14 nt, Shigella flexneri 2a str. 2457T
ccgggagaaggccu

SEQ ID NO: 1951442 - RNA, 18 nt, Shigella flexneri 2a str. 2457T
aaaccgggcaauuuaaac

SEQ ID NO: 1951443 - RNA, 21 nt, Shigella flexneri 2a str. 2457T
ccggggagauauuccccagac

SEQ ID NO: 1951444 - RNA, 17 nt, Shigella flexneri 2a str. 2457T
aaaccugacaacaaaac

SEQ ID NO: 1951445 - RNA, 14 nt, Shigella flexneri 2a str. 2457T
aaaccucuuccagc

SEQ ID NO: 1951446 - RNA, 18 nt, Shigella flexneri 2a str. 2457T
aaaccucuuccagcagau

SEQ ID NO: 1951447 - RNA, 22 nt, Shigella flexneri 2a str. 2457T
ccgggaucaccgaaccagggcg

SEQ ID NO: 1951448 - RNA, 15 nt, Shigella flexneri 2a str. 2457T
ccgggccuccccuga

SEQ ID NO: 1951449 - RNA, 16 nt, Shigella flexneri 2a str. 2457T
aaaccugauuacgcac

SEQ ID NO: 1951450 - RNA, 17 nt, Shigella flexneri 2a str. 2457T
aaaccugauuacgcacc

SEQ ID NO: 1951451 - RNA, 16 nt, Shigella flexneri 2a str. 2457T
ccgcuggcgucugggc

SEQ ID NO: 1951452 - RNA, 20 nt, Shigella flexneri 2a str. 2457T
ccgcuggccauuucugccag

SEQ ID NO: 1951453 - RNA, 14 nt, Shigella flexneri 2a str. 2457T
ccgcugagacgcgc

SEQ ID NO: 1951454 - RNA, 11 nt, Shigella flexneri 2a str. 2457T
ccgcugauuca

SEQ ID NO: 1951455 - RNA, 22 nt, Shigella flexneri 2a str. 2457T
ccgcucucaaucucuuuuucca

SEQ ID NO: 1951456 - RNA, 21 nt, Shigella flexneri 2a str. 2457T
ccgcucuucauacgcggcaga

SEQ ID NO: 1951457 - RNA, 22 nt, Shigella flexneri 2a str. 2457T
ccgcucugcgaucugcgcguca

SEQ ID NO: 1951458 - RNA, 13 nt, Shigella flexneri 2a str. 2457T
ccggaauaaugau

SEQ ID NO: 1951459 - RNA, 17 nt, Shigella flexneri 2a str. 2457T
ccggaacgggaaacgau

SEQ ID NO: 1951460 - RNA, 22 nt, Shigella flexneri 2a str. 2457T
ccggaacgggagaaacccggcc

SEQ ID NO: 1951461 - RNA, 17 nt, Shigella flexneri 2a str. 2457T
ccggaagccaccacgcc

SEQ ID NO: 1951462 - RNA, 19 nt, Shigella flexneri 2a str. 2457T
ccggacguaaugauguaaa

SEQ ID NO: 1951463 - RNA, 21 nt, Shigella flexneri 2a str. 2457T
ccggaauuucuuucagcaguu

SEQ ID NO: 1951464 - RNA, 23 nt, Shigella flexneri 2a str. 2457T
ccggagaguauuaucugcaauua

SEQ ID NO: 1951465 - RNA, 13 nt, Shigella flexneri 2a str. 2457T
ccggagccagccg

SEQ ID NO: 1951466 - RNA, 13 nt, Shigella flexneri 2a str. 2457T
ccggacuggagca

SEQ ID NO: 1951467 - RNA, 15 nt, Shigella flexneri 2a str. 2457T
ccggacugaaaguac

SEQ ID NO: 1951468 - RNA, 15 nt, Shigella flexneri 2a str. 2457T
ccggacuccgcaccg

SEQ ID NO: 1951469 - RNA, 21 nt, Shigella flexneri 2a str. 2457T
ccgcuugggcagaauauuuga

SEQ ID NO: 1951470 - RNA, 18 nt, Shigella flexneri 2a str. 2457T
ccggaacaggcagggcca

SEQ ID NO: 1951471 - RNA, 19 nt, Shigella flexneri 2a str. 2457T
ccgcuguaaaugcugcucc

SEQ ID NO: 1951472 - RNA, 15 nt, Shigella flexneri 2a str. 2457T
ccgcugggccgucag

SEQ ID NO: 1951473 - RNA, 14 nt, Shigella flexneri 2a str. 2457T
ccgcuucugcagcu

SEQ ID NO: 1951474 - RNA, 16 nt, Shigella flexneri 2a str. 2457T
ccgcuucugcagcuuu

SEQ ID NO: 1951475 - RNA, 11 nt, Shigella flexneri 2a str. 2457T
ccgcucccugg

SEQ ID NO: 1951476 - RNA, 12 nt, Shigella flexneri 2a str. 2457T
ccgcucccagca

SEQ ID NO: 1951477 - RNA, 12 nt, Shigella flexneri 2a str. 2457T
ccgcucagcucc

SEQ ID NO: 1951478 - RNA, 13 nt, Shigella flexneri 2a str. 2457T
ccgcuacuggcaa

SEQ ID NO: 1951479 - RNA, 15 nt, Shigella flexneri 2a str. 2457T
ccgcuaccgcccuga

SEQ ID NO: 1951480 - RNA, 21 nt, Shigella flexneri 2a str. 2457T
ccgcuaucgaggcucugauug

SEQ ID NO: 1951481 - RNA, 15 nt, Shigella flexneri 2a str. 2457T
ccgcuaucaguucag

SEQ ID NO: 1951482 - RNA, 16 nt, Shigella flexneri 2a str. 2457T
ccgcguugcagcauau

SEQ ID NO: 1951483 - RNA, 16 nt, Shigella flexneri 2a str. 2457T
ccgcguggacggucaa

SEQ ID NO: 1951484 - RNA, 16 nt, Shigella flexneri 2a str. 2457T
ccgcgugcgcggcagc

SEQ ID NO: 1951485 - RNA, 17 nt, Shigella flexneri 2a str. 2457T
ccgcggcucaggcgcac

SEQ ID NO: 1951486 - RNA, 22 nt, Shigella flexneri 2a str. 2457T
ccgcgggcgaauuaucggcagc

SEQ ID NO: 1951487 - RNA, 14 nt, Shigella flexneri 2a str. 2457T
ccgcgugacgcugg

SEQ ID NO: 1951488 - RNA, 18 nt, Shigella flexneri 2a str. 2457T
ccgcgucauugacgcugg

SEQ ID NO: 1951489 - RNA, 21 nt, Shigella flexneri 2a str. 2457T
ccgcguaaacgugcggcugug

SEQ ID NO: 1951490 - RNA, 23 nt, Shigella flexneri 2a str. 2457T
ccgcguaaacgugcggcugugcg

SEQ ID NO: 1951491 - RNA, 16 nt, Shigella flexneri 2a str. 2457T
ccgcgcuuucuucuuc

SEQ ID NO: 1951492 - RNA, 22 nt, Shigella flexneri 2a str. 2457T
ccgcgcugcuguagcaguucca

SEQ ID NO: 1951493 - RNA, 15 nt, Shigella flexneri 2a str. 2457T
ccgcgcuugccgccg

SEQ ID NO: 1951494 - RNA, 13 nt, Shigella flexneri 2a str. 2457T
aaaccgaaggcac

SEQ ID NO: 1951495 - RNA, 20 nt, Shigella flexneri 2a str. 2457T
aaaccgacuuacuuauuucu

SEQ ID NO: 1951496 - RNA, 23 nt, Shigella flexneri 2a str. 2457T
aaaccgcaccguauugcgccggu

SEQ ID NO: 1951497 - RNA, 23 nt, Shigella flexneri 2a str. 2457T
ccgcgcggguggugcguaccagg

SEQ ID NO: 1951498 - RNA, 20 nt, Shigella flexneri 2a str. 2457T
ccgcgccuucgugcggcugc

SEQ ID NO: 1951499 - RNA, 17 nt, Shigella flexneri 2a str. 2457T
ccgcgcggcgcaggcgc

SEQ ID NO: 1951500 - RNA, 13 nt, Shigella flexneri 2a str. 2457T
aaacccugcgcac

SEQ ID NO: 1951501 - RNA, 19 nt, Shigella flexneri 2a str. 2457T
aaacccugccgucugggca

SEQ ID NO: 1951502 - RNA, 11 nt, Shigella flexneri 2a str. 2457T
ccgcgccgcgg

SEQ ID NO: 1951503 - RNA, 22 nt, Shigella flexneri 2a str. 2457T
ccgcgccgugcaacugcggcgc

SEQ ID NO: 1951504 - RNA, 15 nt, Shigella flexneri 2a str. 2457T
ccgcgccgcagccgg

SEQ ID NO: 1951505 - RNA, 13 nt, Shigella flexneri 2a str. 2457T
ccgccuguugccc

SEQ ID NO: 1951506 - RNA, 19 nt, Shigella flexneri 2a str. 2457T
ccgccuuguuguaaugaca

SEQ ID NO: 1951507 - RNA, 16 nt, Shigella flexneri 2a str. 2457T
ccgccuuucacgccgg

SEQ ID NO: 1951508 - RNA, 17 nt, Shigella flexneri 2a str. 2457T
ccgcgaaccggaccagc

SEQ ID NO: 1951509 - RNA, 19 nt, Shigella flexneri 2a str. 2457T
ccgcgaaccggaccagcaa

SEQ ID NO: 1951510 - RNA, 19 nt, Shigella flexneri 2a str. 2457T
ccgcagcauugcucaccgc

SEQ ID NO: 1951511 - RNA, 13 nt, Shigella flexneri 2a str. 2457T
ccgcagccaucac

SEQ ID NO: 1951512 - RNA, 15 nt, Shigella flexneri 2a str. 2457T
ccgcagccaucacca

SEQ ID NO: 1951513 - RNA, 20 nt, Shigella flexneri 2a str. 2457T
ccgcagccgccagaaauggc

SEQ ID NO: 1951514 - RNA, 15 nt, Shigella flexneri 2a str. 2457T
ccgcagccgccagaa

SEQ ID NO: 1951515 - RNA, 13 nt, Shigella flexneri 2a str. 2457T
ccgcagccgccac

SEQ ID NO: 1951516 - RNA, 18 nt, Shigella flexneri 2a str. 2457T
ccgcgaauuaugcagccu

SEQ ID NO: 1951517 - RNA, 16 nt, Shigella flexneri 2a str. 2457T
ccgcgacgacgacagg

SEQ ID NO: 1951518 - RNA, 18 nt, Shigella flexneri 2a str. 2457T
ccgcgacguacugggaaa

SEQ ID NO: 1951519 - RNA, 15 nt, Shigella flexneri 2a str. 2457T
ccgcgaguaaucaca

SEQ ID NO: 1951520 - RNA, 15 nt, Shigella flexneri 2a str. 2457T
ccgcgaucuuccacg

SEQ ID NO: 1951521 - RNA, 18 nt, Shigella flexneri 2a str. 2457T
ccgcgcacgucagccucg

SEQ ID NO: 1951522 - RNA, 21 nt, Shigella flexneri 2a str. 2457T
ccgcgcaguaccacuucaucc

SEQ ID NO: 1951523 - RNA, 12 nt, Shigella flexneri 2a str. 2457T
ccgcgccagcgg

SEQ ID NO: 1951524 - RNA, 18 nt, Shigella flexneri 2a str. 2457T
ccucuaacagaucaucca

SEQ ID NO: 1951525 - RNA, 17 nt, Shigella flexneri 2a str. 2457T
ccucuaacucuucugaa

SEQ ID NO: 1951526 - RNA, 18 nt, Shigella flexneri 2a str. 2457T
ccucguuuugccgccauc

SEQ ID NO: 1951527 - RNA, 22 nt, Shigella flexneri 2a str. 2457T
ccucguuaccccuucauccaca

SEQ ID NO: 1951528 - RNA, 14 nt, Shigella flexneri 2a str. 2457T
ccucguucuucccu

SEQ ID NO: 1951529 - RNA, 23 nt, Shigella flexneri 2a str. 2457T
ccucgugcucagagcuacaaaga

SEQ ID NO: 1951530 - RNA, 16 nt, Shigella flexneri 2a str. 2457T
ccucgucccaaaagcu

SEQ ID NO: 1951531 - RNA, 20 nt, Shigella flexneri 2a str. 2457T
ccucgucggcgguuuucauc

SEQ ID NO: 1951532 - RNA, 23 nt, Shigella flexneri 2a str. 2457T
ccucucaugagcagaccaauaac

SEQ ID NO: 1951533 - RNA, 15 nt, Shigella flexneri 2a str. 2457T
ccucucagaaagggg

SEQ ID NO: 1951534 - RNA, 18 nt, Shigella flexneri 2a str. 2457T
ccucuaucuguuugccag

SEQ ID NO: 1951535 - RNA, 15 nt, Shigella flexneri 2a str. 2457T
ccucuccccagcgga

SEQ ID NO: 1951536 - RNA, 12 nt, Shigella flexneri 2a str. 2457T
ccucucuucgcu

SEQ ID NO: 1951537 - RNA, 18 nt, Shigella flexneri 2a str. 2457T
ccucucuggccgcuucca

SEQ ID NO: 1951538 - RNA, 18 nt, Shigella flexneri 2a str. 2457T
ccucugcgacucucagcc

SEQ ID NO: 1951539 - RNA, 17 nt, Shigella flexneri 2a str. 2457T
ccucugcgcccagcaac

SEQ ID NO: 1951540 - RNA, 14 nt, Shigella flexneri 2a str. 2457T
ccucgcuacgccag

SEQ ID NO: 1951541 - RNA, 18 nt, Shigella flexneri 2a str. 2457T
ccucgcccauuuuucaug

SEQ ID NO: 1951542 - RNA, 14 nt, Shigella flexneri 2a str. 2457T
ccucgcccgcagaa

SEQ ID NO: 1951543 - RNA, 17 nt, Shigella flexneri 2a str. 2457T
ccucgccccuccgggga

SEQ ID NO: 1951544 - RNA, 12 nt, Shigella flexneri 2a str. 2457T
ccuccugcagcg

SEQ ID NO: 1951545 - RNA, 13 nt, Shigella flexneri 2a str. 2457T
ccuccugcagcgu

SEQ ID NO: 1951546 - RNA, 17 nt, Shigella flexneri 2a str. 2457T
aaacgcagucuucccag

SEQ ID NO: 1951547 - RNA, 18 nt, Shigella flexneri 2a str. 2457T
aaacgccaccuguuucuu

SEQ ID NO: 1951548 - RNA, 13 nt, Shigella flexneri 2a str. 2457T
aaacgccagcagc

SEQ ID NO: 1951549 - RNA, 17 nt, Shigella flexneri 2a str. 2457T
aaacgccguucuucagc

SEQ ID NO: 1951550 - RNA, 15 nt, Shigella flexneri 2a str. 2457T
ccucauucaccaguu

SEQ ID NO: 1951551 - RNA, 22 nt, Shigella flexneri 2a str. 2457T
ccuccagcgagcuggcgcugau

SEQ ID NO: 1951552 - RNA, 22 nt, Shigella flexneri 2a str. 2457T
ccuccagcuccucgaguccuuc

SEQ ID NO: 1951553 - RNA, 16 nt, Shigella flexneri 2a str. 2457T
ccucccguuucccugu

SEQ ID NO: 1951554 - RNA, 12 nt, Shigella flexneri 2a str. 2457T
ccgugauucacg

SEQ ID NO: 1951555 - RNA, 20 nt, Shigella flexneri 2a str. 2457T
ccucaguacccgcguucugg

SEQ ID NO: 1951556 - RNA, 22 nt, Shigella flexneri 2a str. 2457T
ccucacgaucacagcaguccag

SEQ ID NO: 1951557 - RNA, 17 nt, Shigella flexneri 2a str. 2457T
ccucaaccccuuccuga

SEQ ID NO: 1951558 - RNA, 16 nt, Shigella flexneri 2a str. 2457T
ccucaaccccuuccug

SEQ ID NO: 1951559 - RNA, 23 nt, Shigella flexneri 2a str. 2457T
ccucaaacgagggguuuuuuguu

SEQ ID NO: 1951560 - RNA, 16 nt, Shigella flexneri 2a str. 2457T
ccucaacauacaaaua

SEQ ID NO: 1951561 - RNA, 22 nt, Shigella flexneri 2a str. 2457T
ccugcaugcgaaugcagggccg

SEQ ID NO: 1951562 - RNA, 20 nt, Shigella flexneri 2a str. 2457T
ccugcauucgagccaagcgg

SEQ ID NO: 1951563 - RNA, 11 nt, Shigella flexneri 2a str. 2457T
ccugcauaucg

SEQ ID NO: 1951564 - RNA, 16 nt, Shigella flexneri 2a str. 2457T
ccugcagcuggucgcc

SEQ ID NO: 1951565 - RNA, 12 nt, Shigella flexneri 2a str. 2457T
ccugcagcuuca

SEQ ID NO: 1951566 - RNA, 12 nt, Shigella flexneri 2a str. 2457T
ccugcagcugcu

SEQ ID NO: 1951567 - RNA, 17 nt, Shigella flexneri 2a str. 2457T
ccugcgccugcaccauu

SEQ ID NO: 1951568 - RNA, 17 nt, Shigella flexneri 2a str. 2457T
ccugcgauggugguugc

SEQ ID NO: 1951569 - RNA, 13 nt, Shigella flexneri 2a str. 2457T
ccugcgcaggcau

SEQ ID NO: 1951570 - RNA, 14 nt, Shigella flexneri 2a str. 2457T
ccugcggugcagcc

SEQ ID NO: 1951571 - RNA, 14 nt, Shigella flexneri 2a str. 2457T
ccugcgcuuccagc

SEQ ID NO: 1951572 - RNA, 15 nt, Shigella flexneri 2a str. 2457T
ccugcggacagucac

SEQ ID NO: 1951573 - RNA, 18 nt, Shigella flexneri 2a str. 2457T
ccugauuuuauuucggaa

SEQ ID NO: 1951574 - RNA, 15 nt, Shigella flexneri 2a str. 2457T
ccugcaaauaaauac

SEQ ID NO: 1951575 - RNA, 22 nt, Shigella flexneri 2a str. 2457T
ccugcaacgagugcaucuggua

SEQ ID NO: 1951576 - RNA, 22 nt, Shigella flexneri 2a str. 2457T
ccugcaacgguugauggcaguc

SEQ ID NO: 1951577 - RNA, 23 nt, Shigella flexneri 2a str. 2457T
ccugcacaaauagccagcagagc

SEQ ID NO: 1951578 - RNA, 19 nt, Shigella flexneri 2a str. 2457T
ccugcacaaauagccagca

SEQ ID NO: 1951579 - RNA, 13 nt, Shigella flexneri 2a str. 2457T
ccugcaauuccug

SEQ ID NO: 1951580 - RNA, 22 nt, Shigella flexneri 2a str. 2457T
ccugauagcccgcacaaagcac

SEQ ID NO: 1951581 - RNA, 17 nt, Shigella flexneri 2a str. 2457T
ccugauacucucgcucc

SEQ ID NO: 1951582 - RNA, 15 nt, Shigella flexneri 2a str. 2457T
ccugaucgacgcgcu

SEQ ID NO: 1951583 - RNA, 20 nt, Shigella flexneri 2a str. 2457T
ccugaugugaaagauaaaac

SEQ ID NO: 1951584 - RNA, 19 nt, Shigella flexneri 2a str. 2457T
ccugaugcgaugcuugacg

SEQ ID NO: 1951585 - RNA, 17 nt, Shigella flexneri 2a str. 2457T
ccugaugcgcugcgcuu

SEQ ID NO: 1951586 - RNA, 12 nt, Shigella flexneri 2a str. 2457T
ccugaugcguug

SEQ ID NO: 1951587 - RNA, 17 nt, Shigella flexneri 2a str. 2457T
ccugaugcguugcgcuu

SEQ ID NO: 1951588 - RNA, 21 nt, Shigella flexneri 2a str. 2457T
ccugaugcagcguaaaccccu

SEQ ID NO: 1951589 - RNA, 19 nt, Shigella flexneri 2a str. 2457T
ccugaugcaucagucacga

SEQ ID NO: 1951590 - RNA, 19 nt, Shigella flexneri 2a str. 2457T
ccugaagguguuugacugu

SEQ ID NO: 1951591 - RNA, 13 nt, Shigella flexneri 2a str. 2457T
ccugaaggaccuu

SEQ ID NO: 1951592 - RNA, 22 nt, Shigella flexneri 2a str. 2457T
ccugaagcaguuucaccagcag

SEQ ID NO: 1951593 - RNA, 12 nt, Shigella flexneri 2a str. 2457T
ccugaauaacac

SEQ ID NO: 1951594 - RNA, 19 nt, Shigella flexneri 2a str. 2457T
ccugaauaacaccagccag

SEQ ID NO: 1951595 - RNA, 11 nt, Shigella flexneri 2a str. 2457T
ccugaauaauc

SEQ ID NO: 1951596 - RNA, 20 nt, Shigella flexneri 2a str. 2457T
ccugaauaaucguaaucagc

SEQ ID NO: 1951597 - RNA, 22 nt, Shigella flexneri 2a str. 2457T
ccugaauaacaccagccagaau

SEQ ID NO: 1951598 - RNA, 23 nt, Shigella flexneri 2a str. 2457T
ccugaauaaugucccccgggcgg

SEQ ID NO: 1951599 - RNA, 15 nt, Shigella flexneri 2a str. 2457T
ccucuuuuuucaaca

SEQ ID NO: 1951600 - RNA, 19 nt, Shigella flexneri 2a str. 2457T
ccugaaaguauuugacugu

SEQ ID NO: 1951601 - RNA, 22 nt, Shigella flexneri 2a str. 2457T
ccugaaacggaaucgcccgcug

SEQ ID NO: 1951602 - RNA, 20 nt, Shigella flexneri 2a str. 2457T
ccugaaauguuugcaauaaa

SEQ ID NO: 1951603 - RNA, 21 nt, Shigella flexneri 2a str. 2457T
ccucuuccauuucaucgccag

SEQ ID NO: 1951604 - RNA, 15 nt, Shigella flexneri 2a str. 2457T
ccucuucccagaccc

SEQ ID NO: 1951605 - RNA, 16 nt, Shigella flexneri 2a str. 2457T
ccucuuccauuucauc

SEQ ID NO: 1951606 - RNA, 16 nt, Shigella flexneri 2a str. 2457T
ccucuuccacauuuuc

SEQ ID NO: 1951607 - RNA, 22 nt, Shigella flexneri 2a str. 2457T
ccucuuacgcgaauaguuuccg

SEQ ID NO: 1951608 - RNA, 18 nt, Shigella flexneri 2a str. 2457T
ccucuuaaugcaggcagc

SEQ ID NO: 1951609 - RNA, 21 nt, Shigella flexneri 2a str. 2457T
ccucuucagcguccauccaca

SEQ ID NO: 1951610 - RNA, 15 nt, Shigella flexneri 2a str. 2457T
ccucuucaauuaaca

SEQ ID NO: 1951611 - RNA, 16 nt, Shigella flexneri 2a str. 2457T
ccucuucuuuuagcuc

SEQ ID NO: 1951612 - RNA, 11 nt, Shigella flexneri 2a str. 2457T
ccucuucuuuu

SEQ ID NO: 1951613 - RNA, 17 nt, Shigella flexneri 2a str. 2457T
ccucuucuaccacauga

SEQ ID NO: 1951614 - RNA, 19 nt, Shigella flexneri 2a str. 2457T
ccugagacagacagccuca

SEQ ID NO: 1951615 - RNA, 22 nt, Shigella flexneri 2a str. 2457T
ccugagaauuccgacagagaaa

SEQ ID NO: 1951616 - RNA, 23 nt, Shigella flexneri 2a str. 2457T
ccugagcuggcagaccugcuuug

SEQ ID NO: 1951617 - RNA, 21 nt, Shigella flexneri 2a str. 2457T
ccugauaagacgcgacaagcg

SEQ ID NO: 1951618 - RNA, 21 nt, Shigella flexneri 2a str. 2457T
ccugauaaaaaccauucaggc

SEQ ID NO: 1951619 - RNA, 22 nt, Shigella flexneri 2a str. 2457T
ccugagugaauauuuaaccuga

SEQ ID NO: 1951620 - RNA, 17 nt, Shigella flexneri 2a str. 2457T
ccugagucagaaacugu

SEQ ID NO: 1951621 - RNA, 14 nt, Shigella flexneri 2a str. 2457T
ccugagucaucaac

SEQ ID NO: 1951622 - RNA, 12 nt, Shigella flexneri 2a str. 2457T
ccugaguaauua

SEQ ID NO: 1951623 - RNA, 16 nt, Shigella flexneri 2a str. 2457T
ccugagucagaaacug

SEQ ID NO: 1951624 - RNA, 15 nt, Shigella flexneri 2a str. 2457T
ccugaccuugcuuug

SEQ ID NO: 1951625 - RNA, 19 nt, Shigella flexneri 2a str. 2457T
ccugaccauuaucaaacag

SEQ ID NO: 1951626 - RNA, 19 nt, Shigella flexneri 2a str. 2457T
ccugacguaacgaccacca

SEQ ID NO: 1951627 - RNA, 18 nt, Shigella flexneri 2a str. 2457T
ccugacggaaaucaucca

SEQ ID NO: 1951628 - RNA, 18 nt, Shigella flexneri 2a str. 2457T
ccugacgcccguuuucac

SEQ ID NO: 1951629 - RNA, 16 nt, Shigella flexneri 2a str. 2457T
ccugacgcaauaacac

SEQ ID NO: 1951630 - RNA, 24 nt, Shigella flexneri 2a str. 2457T
ccugacgcccguuaccaauaccaa

SEQ ID NO: 1951631 - RNA, 15 nt, Shigella flexneri 2a str. 2457T
ccugacaacaaaacg

SEQ ID NO: 1951632 - RNA, 21 nt, Shigella flexneri 2a str. 2457T
ccugacaacaaaacgggggcu

SEQ ID NO: 1951633 - RNA, 17 nt, Shigella flexneri 2a str. 2457T
ccugaauggugaccugc

SEQ ID NO: 1951634 - RNA, 22 nt, Shigella flexneri 2a str. 2457T
ccugacauugcguugauaugca

SEQ ID NO: 1951635 - RNA, 22 nt, Shigella flexneri 2a str. 2457T
ccugacaggcgggaagaacggc

SEQ ID NO: 1951636 - RNA, 13 nt, Shigella flexneri 2a str. 2457T
ccugacaaaucau

SEQ ID NO: 1951637 - RNA, 16 nt, Shigella flexneri 2a str. 2457T
cgaacggcuguugaug

SEQ ID NO: 1951638 - RNA, 16 nt, Shigella flexneri 2a str. 2457T
cgaacgcuaugacgcc

SEQ ID NO: 1951639 - RNA, 16 nt, Shigella flexneri 2a str. 2457T
cgaagagagcgccaga

SEQ ID NO: 1951640 - RNA, 22 nt, Shigella flexneri 2a str. 2457T
cgaagacaucgcagggaucauc

SEQ ID NO: 1951641 - RNA, 11 nt, Shigella flexneri 2a str. 2457T
cgaagaggggg

SEQ ID NO: 1951642 - RNA, 14 nt, Shigella flexneri 2a str. 2457T
cgaagcgcgcagcg

SEQ ID NO: 1951643 - RNA, 16 nt, Shigella flexneri 2a str. 2457T
cgaagccggacugggc

SEQ ID NO: 1951644 - RNA, 20 nt, Shigella flexneri 2a str. 2457T
cgaaguauggaaaucaccca

SEQ ID NO: 1951645 - RNA, 20 nt, Shigella flexneri 2a str. 2457T
cgaaggugccugcccagccg

SEQ ID NO: 1951646 - RNA, 15 nt, Shigella flexneri 2a str. 2457T
cgaauaagcugcgug

SEQ ID NO: 1951647 - RNA, 18 nt, Shigella flexneri 2a str. 2457T
cgaagucguucagaucuu

SEQ ID NO: 1951648 - RNA, 13 nt, Shigella flexneri 2a str. 2457T
cgaagcggcugcg

SEQ ID NO: 1951649 - RNA, 14 nt, Shigella flexneri 2a str. 2457T
cgaacagaccaaac

SEQ ID NO: 1951650 - RNA, 12 nt, Shigella flexneri 2a str. 2457T
cgaacaaaacca

SEQ ID NO: 1951651 - RNA, 14 nt, Shigella flexneri 2a str. 2457T
cgaacaugcggguc

SEQ ID NO: 1951652 - RNA, 16 nt, Shigella flexneri 2a str. 2457T
cgaaccaggaagaugu

SEQ ID NO: 1951653 - RNA, 13 nt, Shigella flexneri 2a str. 2457T
cgaacccagcagg

SEQ ID NO: 1951654 - RNA, 13 nt, Shigella flexneri 2a str. 2457T
cgaaccagugcuc

SEQ ID NO: 1951655 - RNA, 17 nt, Shigella flexneri 2a str. 2457T
cgaaccagugcuccacc

SEQ ID NO: 1951656 - RNA, 18 nt, Shigella flexneri 2a str. 2457T
cgaacgccuucgccaucu

SEQ ID NO: 1951657 - RNA, 16 nt, Shigella flexneri 2a str. 2457T
cgaaauaacugcuauu

SEQ ID NO: 1951658 - RNA, 12 nt, Shigella flexneri 2a str. 2457T
cgaaaguaccau

SEQ ID NO: 1951659 - RNA, 17 nt, Shigella flexneri 2a str. 2457T
cgaaagcgucagcuuuc

SEQ ID NO: 1951660 - RNA, 13 nt, Shigella flexneri 2a str. 2457T
cgaaagccccagc

SEQ ID NO: 1951661 - RNA, 16 nt, Shigella flexneri 2a str. 2457T
cgaaagcagggcggca

SEQ ID NO: 1951662 - RNA, 19 nt, Shigella flexneri 2a str. 2457T
cgaaaucaccgccaccagc

SEQ ID NO: 1951663 - RNA, 13 nt, Shigella flexneri 2a str. 2457T
cgaaaucgccauu

SEQ ID NO: 1951664 - RNA, 23 nt, Shigella flexneri 2a str. 2457T
cgaaauggugugcaugguguuca

SEQ ID NO: 1951665 - RNA, 20 nt, Shigella flexneri 2a str. 2457T
cgaaauggcugccaaugaua

SEQ ID NO: 1951666 - RNA, 21 nt, Shigella flexneri 2a str. 2457T
cgaaacgggcugauuucaccc

SEQ ID NO: 1951667 - RNA, 18 nt, Shigella flexneri 2a str. 2457T
cgaaaccguggcggaaau

SEQ ID NO: 1951668 - RNA, 16 nt, Shigella flexneri 2a str. 2457T
cgaaaccgacugccau

SEQ ID NO: 1951669 - RNA, 17 nt, Shigella flexneri 2a str. 2457T
cgaaagaggcgcagaug

SEQ ID NO: 1951670 - RNA, 11 nt, Shigella flexneri 2a str. 2457T
cgaaagaaaag

SEQ ID NO: 1951671 - RNA, 13 nt, Shigella flexneri 2a str. 2457T
cgaaaccacugca

SEQ ID NO: 1951672 - RNA, 21 nt, Shigella flexneri 2a str. 2457T
cgaaaacgccaccgcgccggg

SEQ ID NO: 1951673 - RNA, 14 nt, Shigella flexneri 2a str. 2457T
cgaaaaaaauuacu

SEQ ID NO: 1951674 - RNA, 17 nt, Shigella flexneri 2a str. 2457T
cgaaaaaaauuacucau

SEQ ID NO: 1951675 - RNA, 20 nt, Shigella flexneri 2a str. 2457T
cgaaaaagucccuucccagc

SEQ ID NO: 1951676 - RNA, 18 nt, Shigella flexneri 2a str. 2457T
ccuuuuucucugguccaa

SEQ ID NO: 1951677 - RNA, 15 nt, Shigella flexneri 2a str. 2457T
ccuuuuuuaaacauu

SEQ ID NO: 1951678 - RNA, 12 nt, Shigella flexneri 2a str. 2457T
cgaaaaaaagau

SEQ ID NO: 1951679 - RNA, 23 nt, Shigella flexneri 2a str. 2457T
ccuuuucaguuggcugacaaagu

SEQ ID NO: 1951680 - RNA, 16 nt, Shigella flexneri 2a str. 2457T
ccuuugaacaaccaga

SEQ ID NO: 1951681 - RNA, 17 nt, Shigella flexneri 2a str. 2457T
ccuuucuuucuggaaau

SEQ ID NO: 1951682 - RNA, 21 nt, Shigella flexneri 2a str. 2457T
ccuuucuguuccauaaucgcc

SEQ ID NO: 1951683 - RNA, 18 nt, Shigella flexneri 2a str. 2457T
ccuuucuggacacagcgu

SEQ ID NO: 1951684 - RNA, 21 nt, Shigella flexneri 2a str. 2457T
ccuuucugaugcauaaaaaaa

SEQ ID NO: 1951685 - RNA, 21 nt, Shigella flexneri 2a str. 2457T
ccuuucugcauccguucuucg

SEQ ID NO: 1951686 - RNA, 15 nt, Shigella flexneri 2a str. 2457T
ccuuucugagaggaa

SEQ ID NO: 1951687 - RNA, 23 nt, Shigella flexneri 2a str. 2457T
ccuuggucgaagcuucucauccu

SEQ ID NO: 1951688 - RNA, 17 nt, Shigella flexneri 2a str. 2457T
ccuuacucauaaauacu

SEQ ID NO: 1951689 - RNA, 16 nt, Shigella flexneri 2a str. 2457T
ccuuagcaacaggcca

SEQ ID NO: 1951690 - RNA, 12 nt, Shigella flexneri 2a str. 2457T
ccuuagguauuc

SEQ ID NO: 1951691 - RNA, 18 nt, Shigella flexneri 2a str. 2457T
ccuuaacgguaucuuucc

SEQ ID NO: 1951692 - RNA, 16 nt, Shigella flexneri 2a str. 2457T
ccuuaacgcaaaaucu

SEQ ID NO: 1951693 - RNA, 22 nt, Shigella flexneri 2a str. 2457T
ccuucaucacgcagcgucagca

SEQ ID NO: 1951694 - RNA, 13 nt, Shigella flexneri 2a str. 2457T
ccuucauccagca

SEQ ID NO: 1951695 - RNA, 14 nt, Shigella flexneri 2a str. 2457T
ccuuauccagcaga

SEQ ID NO: 1951696 - RNA, 20 nt, Shigella flexneri 2a str. 2457T
ccuucaucuucaacugccau

SEQ ID NO: 1951697 - RNA, 23 nt, Shigella flexneri 2a str. 2457T
ccuucggggcggcuaucccaaag

SEQ ID NO: 1951698 - RNA, 13 nt, Shigella flexneri 2a str. 2457T
ccuucuaaagcaa

SEQ ID NO: 1951699 - RNA, 22 nt, Shigella flexneri 2a str. 2457T
ccuucgguagcagcuuucagca

SEQ ID NO: 1951700 - RNA, 13 nt, Shigella flexneri 2a str. 2457T
ccuucucagcggu

SEQ ID NO: 1951701 - RNA, 17 nt, Shigella flexneri 2a str. 2457T
ccuuccccguucugcca

SEQ ID NO: 1951702 - RNA, 15 nt, Shigella flexneri 2a str. 2457T
ccuuccacaccacuu

SEQ ID NO: 1951703 - RNA, 18 nt, Shigella flexneri 2a str. 2457T
ccuuccagcgcguucugu

SEQ ID NO: 1951704 - RNA, 22 nt, Shigella flexneri 2a str. 2457T
ccuugcgauuacgcucggcaaa

SEQ ID NO: 1951705 - RNA, 17 nt, Shigella flexneri 2a str. 2457T
ccuugcggaaauuccag

SEQ ID NO: 1951706 - RNA, 20 nt, Shigella flexneri 2a str. 2457T
ccuugcggaaauuccagcgg

SEQ ID NO: 1951707 - RNA, 16 nt, Shigella flexneri 2a str. 2457T
ccuugcggaaauucca

SEQ ID NO: 1951708 - RNA, 18 nt, Shigella flexneri 2a str. 2457T
ccuugauuauuucccucg

SEQ ID NO: 1951709 - RNA, 14 nt, Shigella flexneri 2a str. 2457T
ccuucugagaucaa

SEQ ID NO: 1951710 - RNA, 15 nt, Shigella flexneri 2a str. 2457T
ccuucuggcgacccg

SEQ ID NO: 1951711 - RNA, 17 nt, Shigella flexneri 2a str. 2457T
ccuugaguuuuucaucc

SEQ ID NO: 1951712 - RNA, 23 nt, Shigella flexneri 2a str. 2457T
ccuguucaucgacagaacggaua

SEQ ID NO: 1951713 - RNA, 17 nt, Shigella flexneri 2a str. 2457T
ccuguugaaaaaccaga

SEQ ID NO: 1951714 - RNA, 21 nt, Shigella flexneri 2a str. 2457T
ccuguugauggggguccugag

SEQ ID NO: 1951715 - RNA, 13 nt, Shigella flexneri 2a str. 2457T
ccuguugcccuuu

SEQ ID NO: 1951716 - RNA, 21 nt, Shigella flexneri 2a str. 2457T
ccuguuugguugccagccaca

SEQ ID NO: 1951717 - RNA, 23 nt, Shigella flexneri 2a str. 2457T
ccuguuuugucuuuuuaaugacu

SEQ ID NO: 1951718 - RNA, 16 nt, Shigella flexneri 2a str. 2457T
ccuguugucuuuccag

SEQ ID NO: 1951719 - RNA, 21 nt, Shigella flexneri 2a str. 2457T
ccuguugucuuuccagacuca

SEQ ID NO: 1951720 - RNA, 18 nt, Shigella flexneri 2a str. 2457T
ccuguggacgcagcucau

SEQ ID NO: 1951721 - RNA, 18 nt, Shigella flexneri 2a str. 2457T
ccugugggccgauggcua

SEQ ID NO: 1951722 - RNA, 19 nt, Shigella flexneri 2a str. 2457T
ccuguggauaaagcaguuu

SEQ ID NO: 1951723 - RNA, 14 nt, Shigella flexneri 2a str. 2457T
ccuguuaaucagcu

SEQ ID NO: 1951724 - RNA, 23 nt, Shigella flexneri 2a str. 2457T
ccuguuaaucagcuaauggcugc

SEQ ID NO: 1951725 - RNA, 13 nt, Shigella flexneri 2a str. 2457T
ccugugcgcccug

SEQ ID NO: 1951726 - RNA, 18 nt, Shigella flexneri 2a str. 2457T
ccugugcgcccuguucug

SEQ ID NO: 1951727 - RNA, 12 nt, Shigella flexneri 2a str. 2457T
ccugugcagcga

SEQ ID NO: 1951728 - RNA, 13 nt, Shigella flexneri 2a str. 2457T
ccugugccagcca

SEQ ID NO: 1951729 - RNA, 22 nt, Shigella flexneri 2a str. 2457T
ccugugccagcucgugcagaac

SEQ ID NO: 1951730 - RNA, 16 nt, Shigella flexneri 2a str. 2457T
ccugugcaaccuuuuc

SEQ ID NO: 1951731 - RNA, 22 nt, Shigella flexneri 2a str. 2457T
ccugucucucagcacaccauaa

SEQ ID NO: 1951732 - RNA, 14 nt, Shigella flexneri 2a str. 2457T
ccugucuucccugc

SEQ ID NO: 1951733 - RNA, 15 nt, Shigella flexneri 2a str. 2457T
ccugugacagcagcg

SEQ ID NO: 1951734 - RNA, 18 nt, Shigella flexneri 2a str. 2457T
ccugguuauuucacuuca

SEQ ID NO: 1951735 - RNA, 19 nt, Shigella flexneri 2a str. 2457T
ccugguuauuucacuucaa

SEQ ID NO: 1951736 - RNA, 20 nt, Shigella flexneri 2a str. 2457T
ccugguaucuuuacagcgcu

SEQ ID NO: 1951737 - RNA, 15 nt, Shigella flexneri 2a str. 2457T
ccugguaccagcacc

SEQ ID NO: 1951738 - RNA, 16 nt, Shigella flexneri 2a str. 2457T
ccugcugcacgcccug

SEQ ID NO: 1951739 - RNA, 18 nt, Shigella flexneri 2a str. 2457T
ccugcugcacgucauacu

SEQ ID NO: 1951740 - RNA, 16 nt, Shigella flexneri 2a str. 2457T
ccugcugaauccccuu

SEQ ID NO: 1951741 - RNA, 22 nt, Shigella flexneri 2a str. 2457T
ccugcucgucggcaaagcgggc

SEQ ID NO: 1951742 - RNA, 18 nt, Shigella flexneri 2a str. 2457T
ccugcucgucauccgcca

SEQ ID NO: 1951743 - RNA, 19 nt, Shigella flexneri 2a str. 2457T
ccugcucgucauccgccag

SEQ ID NO: 1951744 - RNA, 15 nt, Shigella flexneri 2a str. 2457T
ccuguaaacgaaaac

SEQ ID NO: 1951745 - RNA, 18 nt, Shigella flexneri 2a str. 2457T
ccugguuucuggucauug

SEQ ID NO: 1951746 - RNA, 17 nt, Shigella flexneri 2a str. 2457T
ccuguaguguguugcaa

SEQ ID NO: 1951747 - RNA, 18 nt, Shigella flexneri 2a str. 2457T
ccugucgcuuugacugcu

SEQ ID NO: 1951748 - RNA, 19 nt, Shigella flexneri 2a str. 2457T
ccuguaucccaguucgauu

SEQ ID NO: 1951749 - RNA, 21 nt, Shigella flexneri 2a str. 2457T
ccuguauuguuccacucuuuc

SEQ ID NO: 1951750 - RNA, 15 nt, Shigella flexneri 2a str. 2457T
ccuguauaaacuauc

SEQ ID NO: 1951751 - RNA, 17 nt, Shigella flexneri 2a str. 2457T
ccugucagacuuaagcc

SEQ ID NO: 1951752 - RNA, 17 nt, Shigella flexneri 2a str. 2457T
ccgacaaugccacaaac

SEQ ID NO: 1951753 - RNA, 13 nt, Shigella flexneri 2a str. 2457T
ccgaauucaaauc

SEQ ID NO: 1951754 - RNA, 19 nt, Shigella flexneri 2a str. 2457T
ccgaaugaccgccccugcg

SEQ ID NO: 1951755 - RNA, 14 nt, Shigella flexneri 2a str. 2457T
ccgaaggcaccauu

SEQ ID NO: 1951756 - RNA, 18 nt, Shigella flexneri 2a str. 2457T
ccgaagaagaaguuuauu

SEQ ID NO: 1951757 - RNA, 12 nt, Shigella flexneri 2a str. 2457T
aaacauuuuugc

SEQ ID NO: 1951758 - RNA, 19 nt, Shigella flexneri 2a str. 2457T
aaaccacagaccggacuga

SEQ ID NO: 1951759 - RNA, 15 nt, Shigella flexneri 2a str. 2457T
aaacaguucugcagc

SEQ ID NO: 1951760 - RNA, 21 nt, Shigella flexneri 2a str. 2457T
aaacagugcccauacccgaug

SEQ ID NO: 1951761 - RNA, 16 nt, Shigella flexneri 2a str. 2457T
aaacagucuggagcaa

SEQ ID NO: 1951762 - RNA, 22 nt, Shigella flexneri 2a str. 2457T
aaacagucacuuucgagcaauu

SEQ ID NO: 1951763 - RNA, 16 nt, Shigella flexneri 2a str. 2457T
ccgaaccagugcucca

SEQ ID NO: 1951764 - RNA, 19 nt, Shigella flexneri 2a str. 2457T
aaacaucgcugauuucacc

SEQ ID NO: 1951765 - RNA, 23 nt, Shigella flexneri 2a str. 2457T
aaacaucgcugauuucaccaucu

SEQ ID NO: 1951766 - RNA, 22 nt, Shigella flexneri 2a str. 2457T
aaacaucggcuuauucauauca

SEQ ID NO: 1951767 - RNA, 23 nt, Shigella flexneri 2a str. 2457T
aaacaucggcuuauucauaucaa

SEQ ID NO: 1951768 - RNA, 14 nt, Shigella flexneri 2a str. 2457T
aaacaugccaacaa

SEQ ID NO: 1951769 - RNA, 20 nt, Shigella flexneri 2a str. 2457T
aaacaugccaacaaaaucuu

SEQ ID NO: 1951770 - RNA, 19 nt, Shigella flexneri 2a str. 2457T
aaacaugagcgaauaaaaa

SEQ ID NO: 1951771 - RNA, 14 nt, Shigella flexneri 2a str. 2457T
ccgaacagaucacg

SEQ ID NO: 1951772 - RNA, 17 nt, Shigella flexneri 2a str. 2457T
cccuuucucuucaaacc

SEQ ID NO: 1951773 - RNA, 13 nt, Shigella flexneri 2a str. 2457T
cccuuucugcauc

SEQ ID NO: 1951774 - RNA, 23 nt, Shigella flexneri 2a str. 2457T
cccuuccuugcuaagcccucuca

SEQ ID NO: 1951775 - RNA, 23 nt, Shigella flexneri 2a str. 2457T
cccuucccgggucgcgacugcca

SEQ ID NO: 1951776 - RNA, 15 nt, Shigella flexneri 2a str. 2457T
cccuucauucaggug

SEQ ID NO: 1951777 - RNA, 12 nt, Shigella flexneri 2a str. 2457T
cccuuccagcuu

SEQ ID NO: 1951778 - RNA, 19 nt, Shigella flexneri 2a str. 2457T
cccugugcgccaccgcgga

SEQ ID NO: 1951779 - RNA, 19 nt, Shigella flexneri 2a str. 2457T
cccuucaucgcuccugccg

SEQ ID NO: 1951780 - RNA, 16 nt, Shigella flexneri 2a str. 2457T
cccuguaauugccuga

SEQ ID NO: 1951781 - RNA, 16 nt, Shigella flexneri 2a str. 2457T
cccuucucgcucuugu

SEQ ID NO: 1951782 - RNA, 12 nt, Shigella flexneri 2a str. 2457T
cccuucuucaau

SEQ ID NO: 1951783 - RNA, 24 nt, Shigella flexneri 2a str. 2457T
cccuucucaaucccuuucucuuca

SEQ ID NO: 1951784 - RNA, 16 nt, Shigella flexneri 2a str. 2457T
cccuucuuucacuuca

SEQ ID NO: 1951785 - RNA, 18 nt, Shigella flexneri 2a str. 2457T
cccuucgguagcagcuuu

SEQ ID NO: 1951786 - RNA, 10 nt, Shigella flexneri 2a str. 2457T
cccuucuucc

SEQ ID NO: 1951787 - RNA, 19 nt, Shigella flexneri 2a str. 2457T
cccuucuuuugucgugccc

SEQ ID NO: 1951788 - RNA, 20 nt, Shigella flexneri 2a str. 2457T
cccugcgcuaaacaggaucu

SEQ ID NO: 1951789 - RNA, 22 nt, Shigella flexneri 2a str. 2457T
cccugcgcuaaacaggaucugg

SEQ ID NO: 1951790 - RNA, 19 nt, Shigella flexneri 2a str. 2457T
cccugcgcggcgacuucca

SEQ ID NO: 1951791 - RNA, 21 nt, Shigella flexneri 2a str. 2457T
cccuggcgaugcccccagcag

SEQ ID NO: 1951792 - RNA, 16 nt, Shigella flexneri 2a str. 2457T
cccuggcucugcacua

SEQ ID NO: 1951793 - RNA, 19 nt, Shigella flexneri 2a str. 2457T
cccuggcaacccgggcucc

SEQ ID NO: 1951794 - RNA, 20 nt, Shigella flexneri 2a str. 2457T
cccuggcaauagcgcacgcc

SEQ ID NO: 1951795 - RNA, 22 nt, Shigella flexneri 2a str. 2457T
cccugcacuuaacaggaucugg

SEQ ID NO: 1951796 - RNA, 19 nt, Shigella flexneri 2a str. 2457T
cccugcaccggugcaucca

SEQ ID NO: 1951797 - RNA, 20 nt, Shigella flexneri 2a str. 2457T
cccugcacuuaacaggaucu

SEQ ID NO: 1951798 - RNA, 22 nt, Shigella flexneri 2a str. 2457T
cccugcagucaccugcccuccg

SEQ ID NO: 1951799 - RNA, 14 nt, Shigella flexneri 2a str. 2457T
cccugcagucaccu

SEQ ID NO: 1951800 - RNA, 15 nt, Shigella flexneri 2a str. 2457T
cccugcgauugugac

SEQ ID NO: 1951801 - RNA, 16 nt, Shigella flexneri 2a str. 2457T
cccugcaauccagggg

SEQ ID NO: 1951802 - RNA, 14 nt, Shigella flexneri 2a str. 2457T
cccugcaauuauua

SEQ ID NO: 1951803 - RNA, 18 nt, Shigella flexneri 2a str. 2457T
aaacacugggaugaaagu

SEQ ID NO: 1951804 - RNA, 14 nt, Shigella flexneri 2a str. 2457T
aaacacuugcggca

SEQ ID NO: 1951805 - RNA, 12 nt, Shigella flexneri 2a str. 2457T
ccgacugccugc

SEQ ID NO: 1951806 - RNA, 17 nt, Shigella flexneri 2a str. 2457T
ccgacugcgccaauacc

SEQ ID NO: 1951807 - RNA, 18 nt, Shigella flexneri 2a str. 2457T
aaaccacccaccagcgcc

SEQ ID NO: 1951808 - RNA, 15 nt, Shigella flexneri 2a str. 2457T
ccgagccgguugccu

SEQ ID NO: 1951809 - RNA, 22 nt, Shigella flexneri 2a str. 2457T
ccgauaaaggucgacagcagcc

SEQ ID NO: 1951810 - RNA, 18 nt, Shigella flexneri 2a str. 2457T
ccgauaaaggucgacagc

SEQ ID NO: 1951811 - RNA, 21 nt, Shigella flexneri 2a str. 2457T
ccgauaaaggucgacagcagc

SEQ ID NO: 1951812 - RNA, 23 nt, Shigella flexneri 2a str. 2457T
ccgauaaaacgguuuauccccaa

SEQ ID NO: 1951813 - RNA, 20 nt, Shigella flexneri 2a str. 2457T
ccgaguuguugagguucgga

SEQ ID NO: 1951814 - RNA, 20 nt, Shigella flexneri 2a str. 2457T
ccgaguggcauuucgccaaa

SEQ ID NO: 1951815 - RNA, 23 nt, Shigella flexneri 2a str. 2457T
ccgaggcgcuggcagaaggccgc

SEQ ID NO: 1951816 - RNA, 17 nt, Shigella flexneri 2a str. 2457T
ccgaggcauucagccag

SEQ ID NO: 1951817 - RNA, 15 nt, Shigella flexneri 2a str. 2457T
ccgaggccaaaacca

SEQ ID NO: 1951818 - RNA, 18 nt, Shigella flexneri 2a str. 2457T
ccgauggucacggacagg

SEQ ID NO: 1951819 - RNA, 17 nt, Shigella flexneri 2a str. 2457T
ccgauggucagcuucac

SEQ ID NO: 1951820 - RNA, 14 nt, Shigella flexneri 2a str. 2457T
ccgcaacuaccagc

SEQ ID NO: 1951821 - RNA, 22 nt, Shigella flexneri 2a str. 2457T
ccgcaacaaugccgauaaauac

SEQ ID NO: 1951822 - RNA, 23 nt, Shigella flexneri 2a str. 2457T
ccgcaacauacugcccgagcgcc

SEQ ID NO: 1951823 - RNA, 21 nt, Shigella flexneri 2a str. 2457T
ccgcacguuagaaacaaaaaa

SEQ ID NO: 1951824 - RNA, 17 nt, Shigella flexneri 2a str. 2457T
ccgcacucaucuuauug

SEQ ID NO: 1951825 - RNA, 12 nt, Shigella flexneri 2a str. 2457T
ccgcaccgccgu

SEQ ID NO: 1951826 - RNA, 18 nt, Shigella flexneri 2a str. 2457T
ccgauccuagaucgggca

SEQ ID NO: 1951827 - RNA, 20 nt, Shigella flexneri 2a str. 2457T
ccgaucggcuggcauuuuua

SEQ ID NO: 1951828 - RNA, 21 nt, Shigella flexneri 2a str. 2457T
ccgaugaucaacagcaucauc

SEQ ID NO: 1951829 - RNA, 14 nt, Shigella flexneri 2a str. 2457T
ccgauccggcacca

SEQ ID NO: 1951830 - RNA, 16 nt, Shigella flexneri 2a str. 2457T
ccgaucaauuucacag

SEQ ID NO: 1951831 - RNA, 19 nt, Shigella flexneri 2a str. 2457T
ccgaucauacgaacgccug

SEQ ID NO: 1951832 - RNA, 20 nt, Shigella flexneri 2a str. 2457T
ccgauaaucaacaaaccaaa

SEQ ID NO: 1951833 - RNA, 21 nt, Shigella flexneri 2a str. 2457T
ccgauaaucaacgcgccgcca

SEQ ID NO: 1951834 - RNA, 14 nt, Shigella flexneri 2a str. 2457T
ccgauacggacagu

SEQ ID NO: 1951835 - RNA, 20 nt, Shigella flexneri 2a str. 2457T
cccggcggcgcgccaggcgc

SEQ ID NO: 1951836 - RNA, 16 nt, Shigella flexneri 2a str. 2457T
cccggcgguauaccau

SEQ ID NO: 1951837 - RNA, 19 nt, Shigella flexneri 2a str. 2457T
cccggggugauaacgccug

SEQ ID NO: 1951838 - RNA, 14 nt, Shigella flexneri 2a str. 2457T
aaacacgcagccgg

SEQ ID NO: 1951839 - RNA, 19 nt, Shigella flexneri 2a str. 2457T
aaacacugcgcucuucugg

SEQ ID NO: 1951840 - RNA, 16 nt, Shigella flexneri 2a str. 2457T
cccguacuucugacca

SEQ ID NO: 1951841 - RNA, 21 nt, Shigella flexneri 2a str. 2457T
cccguaccgucaaucuucacg

SEQ ID NO: 1951842 - RNA, 13 nt, Shigella flexneri 2a str. 2457T
cccggucccuuca

SEQ ID NO: 1951843 - RNA, 19 nt, Shigella flexneri 2a str. 2457T
cccgguguucccgcgccag

SEQ ID NO: 1951844 - RNA, 15 nt, Shigella flexneri 2a str. 2457T
cccggcgcagcgcgc

SEQ ID NO: 1951845 - RNA, 17 nt, Shigella flexneri 2a str. 2457T
cccggcgcagcgcgcga

SEQ ID NO: 1951846 - RNA, 20 nt, Shigella flexneri 2a str. 2457T
cccggcgcauggccgggguu

SEQ ID NO: 1951847 - RNA, 18 nt, Shigella flexneri 2a str. 2457T
cccgcgucguucaucgca

SEQ ID NO: 1951848 - RNA, 18 nt, Shigella flexneri 2a str. 2457T
cccgcguuaagacacacu

SEQ ID NO: 1951849 - RNA, 19 nt, Shigella flexneri 2a str. 2457T
cccgcguuaagacacacua

SEQ ID NO: 1951850 - RNA, 21 nt, Shigella flexneri 2a str. 2457T
cccgcgcgguaucaccaccca

SEQ ID NO: 1951851 - RNA, 17 nt, Shigella flexneri 2a str. 2457T
cccgcgccauauaauac

SEQ ID NO: 1951852 - RNA, 13 nt, Shigella flexneri 2a str. 2457T
cccgcgaccacca

SEQ ID NO: 1951853 - RNA, 15 nt, Shigella flexneri 2a str. 2457T
cccgcgaccaccagc

SEQ ID NO: 1951854 - RNA, 20 nt, Shigella flexneri 2a str. 2457T
cccgcgaacggggcugccag

SEQ ID NO: 1951855 - RNA, 16 nt, Shigella flexneri 2a str. 2457T
cccggaucguucacau

SEQ ID NO: 1951856 - RNA, 12 nt, Shigella flexneri 2a str. 2457T
cccggaagccac

SEQ ID NO: 1951857 - RNA, 16 nt, Shigella flexneri 2a str. 2457T
cccggcaccaaucacc

SEQ ID NO: 1951858 - RNA, 21 nt, Shigella flexneri 2a str. 2457T
cccggcaccaaucaccgccag

SEQ ID NO: 1951859 - RNA, 15 nt, Shigella flexneri 2a str. 2457T
cccggcagagaaaau

SEQ ID NO: 1951860 - RNA, 12 nt, Shigella flexneri 2a str. 2457T
cccggcagagaa

SEQ ID NO: 1951861 - RNA, 18 nt, Shigella flexneri 2a str. 2457T
cccggcaaucaccgccag

SEQ ID NO: 1951862 - RNA, 21 nt, Shigella flexneri 2a str. 2457T
cccggcaagaaauaccgaaga

SEQ ID NO: 1951863 - RNA, 20 nt, Shigella flexneri 2a str. 2457T
cccggcaacaaauucacgcc

SEQ ID NO: 1951864 - RNA, 23 nt, Shigella flexneri 2a str. 2457T
cccggcaaaauagaguguuccuc

SEQ ID NO: 1951865 - RNA, 13 nt, Shigella flexneri 2a str. 2457T
cccgcugaaaagc

SEQ ID NO: 1951866 - RNA, 20 nt, Shigella flexneri 2a str. 2457T
cccgcucgaaguuuuccuca

SEQ ID NO: 1951867 - RNA, 21 nt, Shigella flexneri 2a str. 2457T
cccgcuguuuguucaagcgca

SEQ ID NO: 1951868 - RNA, 12 nt, Shigella flexneri 2a str. 2457T
cccgcuucgccc

SEQ ID NO: 1951869 - RNA, 17 nt, Shigella flexneri 2a str. 2457T
cccgcuguaaaugcugc

SEQ ID NO: 1951870 - RNA, 15 nt, Shigella flexneri 2a str. 2457T
cccgcuucgcccgcc

SEQ ID NO: 1951871 - RNA, 16 nt, Shigella flexneri 2a str. 2457T
cccgcuucgcccgcca

SEQ ID NO: 1951872 - RNA, 20 nt, Shigella flexneri 2a str. 2457T
cccgcuuuuuugucaccuuu

SEQ ID NO: 1951873 - RNA, 17 nt, Shigella flexneri 2a str. 2457T
cccggaacuugccgggc

SEQ ID NO: 1951874 - RNA, 17 nt, Shigella flexneri 2a str. 2457T
cccggaagcaucaaacg

SEQ ID NO: 1951875 - RNA, 17 nt, Shigella flexneri 2a str. 2457T
ccccgggccuccccuga

SEQ ID NO: 1951876 - RNA, 18 nt, Shigella flexneri 2a str. 2457T
cccccgcucuuccaggca

SEQ ID NO: 1951877 - RNA, 23 nt, Shigella flexneri 2a str. 2457T
cccccuuugaccagccagucagu

SEQ ID NO: 1951878 - RNA, 12 nt, Shigella flexneri 2a str. 2457T
ccccauuugcca

SEQ ID NO: 1951879 - RNA, 23 nt, Shigella flexneri 2a str. 2457T
ccccauuaccugacagcagagca

SEQ ID NO: 1951880 - RNA, 12 nt, Shigella flexneri 2a str. 2457T
cccccacagcuc

SEQ ID NO: 1951881 - RNA, 15 nt, Shigella flexneri 2a str. 2457T
ccccaauccacgcgg

SEQ ID NO: 1951882 - RNA, 22 nt, Shigella flexneri 2a str. 2457T
ccccaaggcgaggggaccgccc

SEQ ID NO: 1951883 - RNA, 15 nt, Shigella flexneri 2a str. 2457T
ccccaauguagccgc

SEQ ID NO: 1951884 - RNA, 13 nt, Shigella flexneri 2a str. 2457T
ccccaauguucgu

SEQ ID NO: 1951885 - RNA, 20 nt, Shigella flexneri 2a str. 2457T
ccccaaggaucgucgcccga

SEQ ID NO: 1951886 - RNA, 16 nt, Shigella flexneri 2a str. 2457T
cccagcauggcaauaa

SEQ ID NO: 1951887 - RNA, 23 nt, Shigella flexneri 2a str. 2457T
cccagccagccgagguagaaccc

SEQ ID NO: 1951888 - RNA, 17 nt, Shigella flexneri 2a str. 2457T
cccauugccccauguug

SEQ ID NO: 1951889 - RNA, 15 nt, Shigella flexneri 2a str. 2457T
cccauuccucaugga

SEQ ID NO: 1951890 - RNA, 14 nt, Shigella flexneri 2a str. 2457T
ccccagguuccccc

SEQ ID NO: 1951891 - RNA, 12 nt, Shigella flexneri 2a str. 2457T
ccccaguaauuc

SEQ ID NO: 1951892 - RNA, 21 nt, Shigella flexneri 2a str. 2457T
ccccaucuuccgucacaggca

SEQ ID NO: 1951893 - RNA, 16 nt, Shigella flexneri 2a str. 2457T
ccccagcggaaaauau

SEQ ID NO: 1951894 - RNA, 21 nt, Shigella flexneri 2a str. 2457T
ccccaggccagcagcagagca

SEQ ID NO: 1951895 - RNA, 22 nt, Shigella flexneri 2a str. 2457T
ccccacucgccccgagaaaaau

SEQ ID NO: 1951896 - RNA, 20 nt, Shigella flexneri 2a str. 2457T
ccccacaaucagccagaaca

SEQ ID NO: 1951897 - RNA, 21 nt, Shigella flexneri 2a str. 2457T
ccccacaaacccgccagacca

SEQ ID NO: 1951898 - RNA, 20 nt, Shigella flexneri 2a str. 2457T
ccccagaagcuuuccaucgg

SEQ ID NO: 1951899 - RNA, 13 nt, Shigella flexneri 2a str. 2457T
cccgaugaccuug

SEQ ID NO: 1951900 - RNA, 14 nt, Shigella flexneri 2a str. 2457T
cccgaucgcucaua

SEQ ID NO: 1951901 - RNA, 18 nt, Shigella flexneri 2a str. 2457T
cccgauucggucauggua

SEQ ID NO: 1951902 - RNA, 11 nt, Shigella flexneri 2a str. 2457T
cccgauggcuu

SEQ ID NO: 1951903 - RNA, 20 nt, Shigella flexneri 2a str. 2457T
cccgauggucagcuucaccu

SEQ ID NO: 1951904 - RNA, 15 nt, Shigella flexneri 2a str. 2457T
cccgcagcuccagcc

SEQ ID NO: 1951905 - RNA, 15 nt, Shigella flexneri 2a str. 2457T
cccgccccugacagg

SEQ ID NO: 1951906 - RNA, 22 nt, Shigella flexneri 2a str. 2457T
cccgccgcugguuaccaccugc

SEQ ID NO: 1951907 - RNA, 15 nt, Shigella flexneri 2a str. 2457T
cccgccugauagacc

SEQ ID NO: 1951908 - RNA, 11 nt, Shigella flexneri 2a str. 2457T
ccccugcgguu

SEQ ID NO: 1951909 - RNA, 21 nt, Shigella flexneri 2a str. 2457T
ccccucacccuaacccucucc

SEQ ID NO: 1951910 - RNA, 15 nt, Shigella flexneri 2a str. 2457T
ccccuccacauucag

SEQ ID NO: 1951911 - RNA, 12 nt, Shigella flexneri 2a str. 2457T
ccccuguugcaa

SEQ ID NO: 1951912 - RNA, 19 nt, Shigella flexneri 2a str. 2457T
ccccuguugugccagacca

SEQ ID NO: 1951913 - RNA, 18 nt, Shigella flexneri 2a str. 2457T
ccccgggcggccucuuca

SEQ ID NO: 1951914 - RNA, 21 nt, Shigella flexneri 2a str. 2457T
ccccgugaugaacugcgguaa

SEQ ID NO: 1951915 - RNA, 14 nt, Shigella flexneri 2a str. 2457T
ccccguucugccag

SEQ ID NO: 1951916 - RNA, 18 nt, Shigella flexneri 2a str. 2457T
ccccggucagcagcacca

SEQ ID NO: 1951917 - RNA, 13 nt, Shigella flexneri 2a str. 2457T
cccgagaaaaaua

SEQ ID NO: 1951918 - RNA, 14 nt, Shigella flexneri 2a str. 2457T
cccgagcacaugca

SEQ ID NO: 1951919 - RNA, 16 nt, Shigella flexneri 2a str. 2457T
cccgacuccagcagug

SEQ ID NO: 1951920 - RNA, 17 nt, Shigella flexneri 2a str. 2457T
cccgacuccagcagugc

SEQ ID NO: 1951921 - RNA, 14 nt, Shigella flexneri 2a str. 2457T
cccgaaugaccgcc

SEQ ID NO: 1951922 - RNA, 15 nt, Shigella flexneri 2a str. 2457T
cccgaaugaccgccc

SEQ ID NO: 1951923 - RNA, 19 nt, Shigella flexneri 2a str. 2457T
cccgaagggcgaagcgcgc

SEQ ID NO: 1951924 - RNA, 13 nt, Shigella flexneri 2a str. 2457T
ccaugcggcaucu

SEQ ID NO: 1951925 - RNA, 17 nt, Shigella flexneri 2a str. 2457T
ccaugcggcgaggaauc

SEQ ID NO: 1951926 - RNA, 18 nt, Shigella flexneri 2a str. 2457T
ccaugcuaauagcugcgc

SEQ ID NO: 1951927 - RNA, 19 nt, Shigella flexneri 2a str. 2457T
ccaugcguuuuaccgccuc

SEQ ID NO: 1951928 - RNA, 14 nt, Shigella flexneri 2a str. 2457T
ccaugcugagcuuc

SEQ ID NO: 1951929 - RNA, 13 nt, Shigella flexneri 2a str. 2457T
ccauuauuucaau

SEQ ID NO: 1951930 - RNA, 17 nt, Shigella flexneri 2a str. 2457T
ccaugcuugaagggcug

SEQ ID NO: 1951931 - RNA, 13 nt, Shigella flexneri 2a str. 2457T
ccauucaaucuuc

SEQ ID NO: 1951932 - RNA, 22 nt, Shigella flexneri 2a str. 2457T
ccauucacacuccagucccagu

SEQ ID NO: 1951933 - RNA, 22 nt, Shigella flexneri 2a str. 2457T
ccauugagaaagcccuggcgca

SEQ ID NO: 1951934 - RNA, 21 nt, Shigella flexneri 2a str. 2457T
ccauugacgcaucgcccgguu

SEQ ID NO: 1951935 - RNA, 16 nt, Shigella flexneri 2a str. 2457T
ccauugacguuccuuu

SEQ ID NO: 1951936 - RNA, 23 nt, Shigella flexneri 2a str. 2457T
ccauugacagaauauacggaaug

SEQ ID NO: 1951937 - RNA, 23 nt, Shigella flexneri 2a str. 2457T
ccauuguuguuggauccccugcc

SEQ ID NO: 1951938 - RNA, 18 nt, Shigella flexneri 2a str. 2457T
ccauuuaacguuaucuga

SEQ ID NO: 1951939 - RNA, 11 nt, Shigella flexneri 2a str. 2457T
cccaaugaccu

SEQ ID NO: 1951940 - RNA, 13 nt, Shigella flexneri 2a str. 2457T
cccaaugaccuuu

SEQ ID NO: 1951941 - RNA, 22 nt, Shigella flexneri 2a str. 2457T
cccaauguagccgcacgcuggc

SEQ ID NO: 1951942 - RNA, 16 nt, Shigella flexneri 2a str. 2457T
cccaauguucguccau

SEQ ID NO: 1951943 - RNA, 13 nt, Shigella flexneri 2a str. 2457T
cccaaaaggcagc

SEQ ID NO: 1951944 - RNA, 23 nt, Shigella flexneri 2a str. 2457T
cccaaaaaaucaacgacaaaaau

SEQ ID NO: 1951945 - RNA, 20 nt, Shigella flexneri 2a str. 2457T
cccacgucagaccaaaacgc

SEQ ID NO: 1951946 - RNA, 21 nt, Shigella flexneri 2a str. 2457T
cccacggcggugucgccagaa

SEQ ID NO: 1951947 - RNA, 13 nt, Shigella flexneri 2a str. 2457T
cccacggcgguaa

SEQ ID NO: 1951948 - RNA, 23 nt, Shigella flexneri 2a str. 2457T
cccacguuaguguggccaguucc

SEQ ID NO: 1951949 - RNA, 12 nt, Shigella flexneri 2a str. 2457T
cccacgccgccc

SEQ ID NO: 1951950 - RNA, 19 nt, Shigella flexneri 2a str. 2457T
cccacgauguauccggcaa

SEQ ID NO: 1951951 - RNA, 18 nt, Shigella flexneri 2a str. 2457T
cccacugugggauugcuu

SEQ ID NO: 1951952 - RNA, 13 nt, Shigella flexneri 2a str. 2457T
cccacugcucaau

SEQ ID NO: 1951953 - RNA, 14 nt, Shigella flexneri 2a str. 2457T
cccagacgagagug

SEQ ID NO: 1951954 - RNA, 22 nt, Shigella flexneri 2a str. 2457T
cccagaccuaacuuggcaaagc

SEQ ID NO: 1951955 - RNA, 15 nt, Shigella flexneri 2a str. 2457T
cccagagccugaagg

SEQ ID NO: 1951956 - RNA, 22 nt, Shigella flexneri 2a str. 2457T
cccagcaucacgcccgcuuuuu

SEQ ID NO: 1951957 - RNA, 12 nt, Shigella flexneri 2a str. 2457T
cccaccaccagc

SEQ ID NO: 1951958 - RNA, 14 nt, Shigella flexneri 2a str. 2457T
cccaccagcaaaua

SEQ ID NO: 1951959 - RNA, 13 nt, Shigella flexneri 2a str. 2457T
cccaccagccacg

SEQ ID NO: 1951960 - RNA, 21 nt, Shigella flexneri 2a str. 2457T
cccacauguugcgcuucacca

SEQ ID NO: 1951961 - RNA, 13 nt, Shigella flexneri 2a str. 2457T
cccacagcucugc

SEQ ID NO: 1951962 - RNA, 20 nt, Shigella flexneri 2a str. 2457T
cccacagacccagguagaca

SEQ ID NO: 1951963 - RNA, 14 nt, Shigella flexneri 2a str. 2457T
cccaccugcggcac

SEQ ID NO: 1951964 - RNA, 14 nt, Shigella flexneri 2a str. 2457T
cccaccagcugaug

SEQ ID NO: 1951965 - RNA, 13 nt, Shigella flexneri 2a str. 2457T
cccaccagcgccg

SEQ ID NO: 1951966 - RNA, 13 nt, Shigella flexneri 2a str. 2457T
cccaccccagcag

SEQ ID NO: 1951967 - RNA, 16 nt, Shigella flexneri 2a str. 2457T
aaacaagguuugaaaa

SEQ ID NO: 1951968 - RNA, 13 nt, Shigella flexneri 2a str. 2457T
ccaucaucaccag

SEQ ID NO: 1951969 - RNA, 19 nt, Shigella flexneri 2a str. 2457T
ccaucauaugcgccagcgg

SEQ ID NO: 1951970 - RNA, 21 nt, Shigella flexneri 2a str. 2457T
aaacaauaagggcugacaguu

SEQ ID NO: 1951971 - RNA, 22 nt, Shigella flexneri 2a str. 2457T
ccaucaugcacacuaucgcuua

SEQ ID NO: 1951972 - RNA, 15 nt, Shigella flexneri 2a str. 2457T
ccaucaugcgccagg

SEQ ID NO: 1951973 - RNA, 16 nt, Shigella flexneri 2a str. 2457T
ccaucaucgcuuucag

SEQ ID NO: 1951974 - RNA, 16 nt, Shigella flexneri 2a str. 2457T
ccaucaucggcaaaca

SEQ ID NO: 1951975 - RNA, 15 nt, Shigella flexneri 2a str. 2457T
ccauccauuuuucac

SEQ ID NO: 1951976 - RNA, 12 nt, Shigella flexneri 2a str. 2457T
ccaucagcagcg

SEQ ID NO: 1951977 - RNA, 14 nt, Shigella flexneri 2a str. 2457T
ccaucaccucuuca

SEQ ID NO: 1951978 - RNA, 20 nt, Shigella flexneri 2a str. 2457T
ccaucaccucuucagcgucc

SEQ ID NO: 1951979 - RNA, 19 nt, Shigella flexneri 2a str. 2457T
ccaucagacuuugcgccau

SEQ ID NO: 1951980 - RNA, 15 nt, Shigella flexneri 2a str. 2457T
ccaucacuuucaaaa

SEQ ID NO: 1951981 - RNA, 18 nt, Shigella flexneri 2a str. 2457T
ccaucacuuucaaaagcc

SEQ ID NO: 1951982 - RNA, 20 nt, Shigella flexneri 2a str. 2457T
ccaucacuuucaaaagcccc

SEQ ID NO: 1951983 - RNA, 16 nt, Shigella flexneri 2a str. 2457T
ccaucucuuccagcga

SEQ ID NO: 1951984 - RNA, 19 nt, Shigella flexneri 2a str. 2457T
ccaucugaugauauuuuuc

SEQ ID NO: 1951985 - RNA, 15 nt, Shigella flexneri 2a str. 2457T
ccaucuguucugccg

SEQ ID NO: 1951986 - RNA, 16 nt, Shigella flexneri 2a str. 2457T
ccaugauccugcaaua

SEQ ID NO: 1951987 - RNA, 17 nt, Shigella flexneri 2a str. 2457T
ccaugauaguguccauu

SEQ ID NO: 1951988 - RNA, 16 nt, Shigella flexneri 2a str. 2457T
ccaugccuuguuugau

SEQ ID NO: 1951989 - RNA, 21 nt, Shigella flexneri 2a str. 2457T
ccaugccuuguuugaucaucg

SEQ ID NO: 1951990 - RNA, 23 nt, Shigella flexneri 2a str. 2457T
ccaugauuucguagacugcagcg

SEQ ID NO: 1951991 - RNA, 22 nt, Shigella flexneri 2a str. 2457T
ccaugauccugcaauaccgccg

SEQ ID NO: 1951992 - RNA, 14 nt, Shigella flexneri 2a str. 2457T
ccaugaugacaaca

SEQ ID NO: 1951993 - RNA, 17 nt, Shigella flexneri 2a str. 2457T
ccaugaugacaacauag

SEQ ID NO: 1951994 - RNA, 12 nt, Shigella flexneri 2a str. 2457T
ccaucuccagcu

SEQ ID NO: 1951995 - RNA, 19 nt, Shigella flexneri 2a str. 2457T
ccaucuccuuacugccccc

SEQ ID NO: 1951996 - RNA, 18 nt, Shigella flexneri 2a str. 2457T
ccaucuccgcauguuucg

SEQ ID NO: 1951997 - RNA, 14 nt, Shigella flexneri 2a str. 2457T
ccaucgauaaucac

SEQ ID NO: 1951998 - RNA, 23 nt, Shigella flexneri 2a str. 2457T
ccaucgcaaacaguacaucuucc

SEQ ID NO: 1951999 - RNA, 21 nt, Shigella flexneri 2a str. 2457T
ccaucgauuuugcaauaaugg

SEQ ID NO: 1952000 - RNA, 16 nt, Shigella flexneri 2a str. 2457T
ccaucgacgaaauggu

SEQ ID NO: 1952001 - RNA, 17 nt, Shigella flexneri 2a str. 2457T
ccauccgaauucacuua

SEQ ID NO: 1952002 - RNA, 13 nt, Shigella flexneri 2a str. 2457T
ccauccgaguugu

SEQ ID NO: 1952003 - RNA, 18 nt, Shigella flexneri 2a str. 2457T
ccaucgaaccaucggcuu

SEQ ID NO: 1952004 - RNA, 16 nt, Shigella flexneri 2a str. 2457T
ccaggugaaaaauaaa

SEQ ID NO: 1952005 - RNA, 19 nt, Shigella flexneri 2a str. 2457T
ccaguggaugcgccauacc

SEQ ID NO: 1952006 - RNA, 17 nt, Shigella flexneri 2a str. 2457T
ccagugcguacccagcg

SEQ ID NO: 1952007 - RNA, 17 nt, Shigella flexneri 2a str. 2457T
ccaguuuguucagcugc

SEQ ID NO: 1952008 - RNA, 13 nt, Shigella flexneri 2a str. 2457T
ccaguuucacagg

SEQ ID NO: 1952009 - RNA, 15 nt, Shigella flexneri 2a str. 2457T
ccaguuugccuucac

SEQ ID NO: 1952010 - RNA, 14 nt, Shigella flexneri 2a str. 2457T
ccaguuucggacgc

SEQ ID NO: 1952011 - RNA, 22 nt, Shigella flexneri 2a str. 2457T
ccauaaauugcuguaaauucuc

SEQ ID NO: 1952012 - RNA, 13 nt, Shigella flexneri 2a str. 2457T
ccaguucuacaau

SEQ ID NO: 1952013 - RNA, 15 nt, Shigella flexneri 2a str. 2457T
ccaguucguuguagu

SEQ ID NO: 1952014 - RNA, 20 nt, Shigella flexneri 2a str. 2457T
ccaguugugucagugcgcga

SEQ ID NO: 1952015 - RNA, 16 nt, Shigella flexneri 2a str. 2457T
ccaguuuacugucugc

SEQ ID NO: 1952016 - RNA, 18 nt, Shigella flexneri 2a str. 2457T
ccauaguuaucggugugu

SEQ ID NO: 1952017 - RNA, 20 nt, Shigella flexneri 2a str. 2457T
ccauagcaucccaauacccg

SEQ ID NO: 1952018 - RNA, 13 nt, Shigella flexneri 2a str. 2457T
ccauaauaaucau

SEQ ID NO: 1952019 - RNA, 14 nt, Shigella flexneri 2a str. 2457T
ccauaauaaucauc

SEQ ID NO: 1952020 - RNA, 21 nt, Shigella flexneri 2a str. 2457T
ccauaaucacucuuccccgcu

SEQ ID NO: 1952021 - RNA, 14 nt, Shigella flexneri 2a str. 2457T
ccauaauaagcgcc

SEQ ID NO: 1952022 - RNA, 21 nt, Shigella flexneri 2a str. 2457T
ccauaagcccagaacaaauaa

SEQ ID NO: 1952023 - RNA, 13 nt, Shigella flexneri 2a str. 2457T
ccauauagcgcac

SEQ ID NO: 1952024 - RNA, 18 nt, Shigella flexneri 2a str. 2457T
ccaucaaagaagcucuuu

SEQ ID NO: 1952025 - RNA, 20 nt, Shigella flexneri 2a str. 2457T
ccaucaacgccaucgccagg

SEQ ID NO: 1952026 - RNA, 12 nt, Shigella flexneri 2a str. 2457T
ccaucaaaucug

SEQ ID NO: 1952027 - RNA, 17 nt, Shigella flexneri 2a str. 2457T
ccaucacauccugauag

SEQ ID NO: 1952028 - RNA, 15 nt, Shigella flexneri 2a str. 2457T
ccaucacaaaguggg

SEQ ID NO: 1952029 - RNA, 18 nt, Shigella flexneri 2a str. 2457T
ccagcggguugcugagau

SEQ ID NO: 1952030 - RNA, 23 nt, Shigella flexneri 2a str. 2457T
ccagcgguggugacugguuuuuc

SEQ ID NO: 1952031 - RNA, 18 nt, Shigella flexneri 2a str. 2457T
ccagcggcgggauuuuuu

SEQ ID NO: 1952032 - RNA, 16 nt, Shigella flexneri 2a str. 2457T
ccagcggcggcacagc

SEQ ID NO: 1952033 - RNA, 14 nt, Shigella flexneri 2a str. 2457T
ccagcggcagcucg

SEQ ID NO: 1952034 - RNA, 13 nt, Shigella flexneri 2a str. 2457T
ccagcggcagcuc

SEQ ID NO: 1952035 - RNA, 22 nt, Shigella flexneri 2a str. 2457T
ccagcggaauucccgcuucuuc

SEQ ID NO: 1952036 - RNA, 22 nt, Shigella flexneri 2a str. 2457T
ccagcgcguuauguaacaacug

SEQ ID NO: 1952037 - RNA, 18 nt, Shigella flexneri 2a str. 2457T
ccagcgcgaugcaggcca

SEQ ID NO: 1952038 - RNA, 18 nt, Shigella flexneri 2a str. 2457T
ccagcgcguaaauaccuu

SEQ ID NO: 1952039 - RNA, 21 nt, Shigella flexneri 2a str. 2457T
ccagcguuuccagcaccaguu

SEQ ID NO: 1952040 - RNA, 17 nt, Shigella flexneri 2a str. 2457T
ccagcguuuccagcacc

SEQ ID NO: 1952041 - RNA, 19 nt, Shigella flexneri 2a str. 2457T
ccagcguuuccagcaccag

SEQ ID NO: 1952042 - RNA, 22 nt, Shigella flexneri 2a str. 2457T
ccagcguugauguuccuccucg

SEQ ID NO: 1952043 - RNA, 12 nt, Shigella flexneri 2a str. 2457T
ccagcucaaacg

SEQ ID NO: 1952044 - RNA, 14 nt, Shigella flexneri 2a str. 2457T
ccagcucaaacgaa

SEQ ID NO: 1952045 - RNA, 16 nt, Shigella flexneri 2a str. 2457T
ccagcuccauccacca

SEQ ID NO: 1952046 - RNA, 16 nt, Shigella flexneri 2a str. 2457T
ccagcuccagcagacc

SEQ ID NO: 1952047 - RNA, 17 nt, Shigella flexneri 2a str. 2457T
ccagcuccguccagcca

SEQ ID NO: 1952048 - RNA, 18 nt, Shigella flexneri 2a str. 2457T
ccagcuccguccagccac

SEQ ID NO: 1952049 - RNA, 15 nt, Shigella flexneri 2a str. 2457T
ccagcguaaauccug

SEQ ID NO: 1952050 - RNA, 20 nt, Shigella flexneri 2a str. 2457T
ccagcguacguaacuucuua

SEQ ID NO: 1952051 - RNA, 13 nt, Shigella flexneri 2a str. 2457T
ccagcgucagcau

SEQ ID NO: 1952052 - RNA, 22 nt, Shigella flexneri 2a str. 2457T
ccagcgucaucauagacuuccc

SEQ ID NO: 1952053 - RNA, 23 nt, Shigella flexneri 2a str. 2457T
ccagcgucaucauagacuucccu

SEQ ID NO: 1952054 - RNA, 18 nt, Shigella flexneri 2a str. 2457T
ccagcgucgcaucaggca

SEQ ID NO: 1952055 - RNA, 15 nt, Shigella flexneri 2a str. 2457T
ccagcguggcaugac

SEQ ID NO: 1952056 - RNA, 14 nt, Shigella flexneri 2a str. 2457T
ccagcguguugccg

SEQ ID NO: 1952057 - RNA, 17 nt, Shigella flexneri 2a str. 2457T
ccagcguguugccgcuu

SEQ ID NO: 1952058 - RNA, 15 nt, Shigella flexneri 2a str. 2457T
ccagcguuaccggcu

SEQ ID NO: 1952059 - RNA, 20 nt, Shigella flexneri 2a str. 2457T
ccagcgaaccguugaggaug

SEQ ID NO: 1952060 - RNA, 21 nt, Shigella flexneri 2a str. 2457T
ccagccuucuucauccagcgc

SEQ ID NO: 1952061 - RNA, 16 nt, Shigella flexneri 2a str. 2457T
ccagccuuuuucucug

SEQ ID NO: 1952062 - RNA, 14 nt, Shigella flexneri 2a str. 2457T
ccacucugaccuga

SEQ ID NO: 1952063 - RNA, 12 nt, Shigella flexneri 2a str. 2457T
ccacugcaauga

SEQ ID NO: 1952064 - RNA, 15 nt, Shigella flexneri 2a str. 2457T
ccacugcaaaucacc

SEQ ID NO: 1952065 - RNA, 17 nt, Shigella flexneri 2a str. 2457T
ccacugcaacagcuguu

SEQ ID NO: 1952066 - RNA, 23 nt, Shigella flexneri 2a str. 2457T
ccacugacgggaaacucugcugg

SEQ ID NO: 1952067 - RNA, 16 nt, Shigella flexneri 2a str. 2457T
ccagcgccaguaauuc

SEQ ID NO: 1952068 - RNA, 19 nt, Shigella flexneri 2a str. 2457T
ccagcgccgacagcagccc

SEQ ID NO: 1952069 - RNA, 18 nt, Shigella flexneri 2a str. 2457T
ccagcgccgacagcagcc

SEQ ID NO: 1952070 - RNA, 21 nt, Shigella flexneri 2a str. 2457T
ccagcgccgccuccucagaaa

SEQ ID NO: 1952071 - RNA, 18 nt, Shigella flexneri 2a str. 2457T
ccagcgccgccagaauca

SEQ ID NO: 1952072 - RNA, 14 nt, Shigella flexneri 2a str. 2457T
ccagcgccugcgcg

SEQ ID NO: 1952073 - RNA, 13 nt, Shigella flexneri 2a str. 2457T
ccagcgacuccag

SEQ ID NO: 1952074 - RNA, 22 nt, Shigella flexneri 2a str. 2457T
ccagcgaugacuguacagaucc

SEQ ID NO: 1952075 - RNA, 18 nt, Shigella flexneri 2a str. 2457T
ccagcgccaccaccagca

SEQ ID NO: 1952076 - RNA, 20 nt, Shigella flexneri 2a str. 2457T
ccagcgcacaguuauaaaau

SEQ ID NO: 1952077 - RNA, 16 nt, Shigella flexneri 2a str. 2457T
ccagcgcagacggcgc

SEQ ID NO: 1952078 - RNA, 17 nt, Shigella flexneri 2a str. 2457T
ccagcgcagacaccaga

SEQ ID NO: 1952079 - RNA, 15 nt, Shigella flexneri 2a str. 2457T
ccagcgcaucaggca

SEQ ID NO: 1952080 - RNA, 19 nt, Shigella flexneri 2a str. 2457T
ccaggcugcaaagucuggg

SEQ ID NO: 1952081 - RNA, 16 nt, Shigella flexneri 2a str. 2457T
ccaggcucgccgccgc

SEQ ID NO: 1952082 - RNA, 20 nt, Shigella flexneri 2a str. 2457T
ccaggucagagagccagccc

SEQ ID NO: 1952083 - RNA, 19 nt, Shigella flexneri 2a str. 2457T
ccagggcuuacaaaaccug

SEQ ID NO: 1952084 - RNA, 16 nt, Shigella flexneri 2a str. 2457T
ccagggcuuuauucac

SEQ ID NO: 1952085 - RNA, 14 nt, Shigella flexneri 2a str. 2457T
ccagggccucuccu

SEQ ID NO: 1952086 - RNA, 16 nt, Shigella flexneri 2a str. 2457T
ccaggcgcgaauggaa

SEQ ID NO: 1952087 - RNA, 14 nt, Shigella flexneri 2a str. 2457T
ccaggcguucugcc

SEQ ID NO: 1952088 - RNA, 17 nt, Shigella flexneri 2a str. 2457T
ccaggcguucugccugg

SEQ ID NO: 1952089 - RNA, 21 nt, Shigella flexneri 2a str. 2457T
ccaggaucuuuugucaugacu

SEQ ID NO: 1952090 - RNA, 20 nt, Shigella flexneri 2a str. 2457T
ccaggauugauagaaauauc

SEQ ID NO: 1952091 - RNA, 18 nt, Shigella flexneri 2a str. 2457T
ccaggagcguauucagca

SEQ ID NO: 1952092 - RNA, 16 nt, Shigella flexneri 2a str. 2457T
ccaggagcuccagguc

SEQ ID NO: 1952093 - RNA, 16 nt, Shigella flexneri 2a str. 2457T
ccaggacgcaguccag

SEQ ID NO: 1952094 - RNA, 17 nt, Shigella flexneri 2a str. 2457T
ccaggcauuaaauccug

SEQ ID NO: 1952095 - RNA, 20 nt, Shigella flexneri 2a str. 2457T
ccaggcaguuuauccagcca

SEQ ID NO: 1952096 - RNA, 12 nt, Shigella flexneri 2a str. 2457T
ccaggccagcgc

SEQ ID NO: 1952097 - RNA, 20 nt, Shigella flexneri 2a str. 2457T
ccaggccaaauccuuccagc

SEQ ID NO: 1952098 - RNA, 16 nt, Shigella flexneri 2a str. 2457T
ccaggccagcgcaacu

SEQ ID NO: 1952099 - RNA, 13 nt, Shigella flexneri 2a str. 2457T
ccaggccagcagc

SEQ ID NO: 1952100 - RNA, 19 nt, Shigella flexneri 2a str. 2457T
ccaggcagauuuuuuaacu

SEQ ID NO: 1952101 - RNA, 22 nt, Shigella flexneri 2a str. 2457T
ccaggcaacgaaaggugaagug

SEQ ID NO: 1952102 - RNA, 14 nt, Shigella flexneri 2a str. 2457T
ccaggcaaaccagu

SEQ ID NO: 1952103 - RNA, 18 nt, Shigella flexneri 2a str. 2457T
ccagcuggcuaccgccgc

SEQ ID NO: 1952104 - RNA, 12 nt, Shigella flexneri 2a str. 2457T
ccagcugucaaa

SEQ ID NO: 1952105 - RNA, 17 nt, Shigella flexneri 2a str. 2457T
ccagcugccgacgccag

SEQ ID NO: 1952106 - RNA, 17 nt, Shigella flexneri 2a str. 2457T
ccagcugccguccccau

SEQ ID NO: 1952107 - RNA, 21 nt, Shigella flexneri 2a str. 2457T
ccagcugcuguggauucagca

SEQ ID NO: 1952108 - RNA, 19 nt, Shigella flexneri 2a str. 2457T
ccagcucuucuucacucuc

SEQ ID NO: 1952109 - RNA, 18 nt, Shigella flexneri 2a str. 2457T
ccagcucuucuucacucu

SEQ ID NO: 1952110 - RNA, 13 nt, Shigella flexneri 2a str. 2457T
ccaggaaacccaa

SEQ ID NO: 1952111 - RNA, 23 nt, Shigella flexneri 2a str. 2457T
ccaggaaccugugacagcagcgg

SEQ ID NO: 1952112 - RNA, 18 nt, Shigella flexneri 2a str. 2457T
ccaggaacuccagaucca

SEQ ID NO: 1952113 - RNA, 23 nt, Shigella flexneri 2a str. 2457T
ccaggaacuccagauccauaagg

SEQ ID NO: 1952114 - RNA, 17 nt, Shigella flexneri 2a str. 2457T
ccaggaaggccagcagg

SEQ ID NO: 1952115 - RNA, 19 nt, Shigella flexneri 2a str. 2457T
ccagcuugucauacggauu

SEQ ID NO: 1952116 - RNA, 22 nt, Shigella flexneri 2a str. 2457T
ccagcuugaaggguuuuauaau

SEQ ID NO: 1952117 - RNA, 17 nt, Shigella flexneri 2a str. 2457T
ccagcuugcgacaugcg

SEQ ID NO: 1952118 - RNA, 14 nt, Shigella flexneri 2a str. 2457T
cauuucgaagaaac

SEQ ID NO: 1952119 - RNA, 23 nt, Shigella flexneri 2a str. 2457T
cauuucgugcggguaaccagcca

SEQ ID NO: 1952120 - RNA, 16 nt, Shigella flexneri 2a str. 2457T
cauuucccggaauaau

SEQ ID NO: 1952121 - RNA, 15 nt, Shigella flexneri 2a str. 2457T
cauuucccagcaaga

SEQ ID NO: 1952122 - RNA, 19 nt, Shigella flexneri 2a str. 2457T
cauuucccagcaagaacca

SEQ ID NO: 1952123 - RNA, 16 nt, Shigella flexneri 2a str. 2457T
cauuucccccuuccug

SEQ ID NO: 1952124 - RNA, 15 nt, Shigella flexneri 2a str. 2457T
cauuuccauaaauug

SEQ ID NO: 1952125 - RNA, 19 nt, Shigella flexneri 2a str. 2457T
cauuucauauucaaaaucc

SEQ ID NO: 1952126 - RNA, 17 nt, Shigella flexneri 2a str. 2457T
cauuucaucggcuagua

SEQ ID NO: 1952127 - RNA, 17 nt, Shigella flexneri 2a str. 2457T
cauuuaugccauguuca

SEQ ID NO: 1952128 - RNA, 23 nt, Shigella flexneri 2a str. 2457T
cauuuauguucagccgucaucca

SEQ ID NO: 1952129 - RNA, 20 nt, Shigella flexneri 2a str. 2457T
cauuuagcgccggguuuuuu

SEQ ID NO: 1952130 - RNA, 22 nt, Shigella flexneri 2a str. 2457T
cauuuagcgccggguuuuuuau

SEQ ID NO: 1952131 - RNA, 23 nt, Shigella flexneri 2a str. 2457T
cauuucaaucaucucucgcauca

SEQ ID NO: 1952132 - RNA, 22 nt, Shigella flexneri 2a str. 2457T
cauuucaccgucaucgacaaaa

SEQ ID NO: 1952133 - RNA, 20 nt, Shigella flexneri 2a str. 2457T
cauuucagaaaguauauaaa

SEQ ID NO: 1952134 - RNA, 21 nt, Shigella flexneri 2a str. 2457T
cauuucagaaaguauauaaaa

SEQ ID NO: 1952135 - RNA, 19 nt, Shigella flexneri 2a str. 2457T
cauuuuacguugcauuucc

SEQ ID NO: 1952136 - RNA, 13 nt, Shigella flexneri 2a str. 2457T
cauuuguucuuuu

SEQ ID NO: 1952137 - RNA, 16 nt, Shigella flexneri 2a str. 2457T
cauuugugcauagcac

SEQ ID NO: 1952138 - RNA, 16 nt, Shigella flexneri 2a str. 2457T
cauuugcuccagacgc

SEQ ID NO: 1952139 - RNA, 21 nt, Shigella flexneri 2a str. 2457T
cauuuggauugauaauuguua

SEQ ID NO: 1952140 - RNA, 19 nt, Shigella flexneri 2a str. 2457T
cauuugacacgaacuuuau

SEQ ID NO: 1952141 - RNA, 20 nt, Shigella flexneri 2a str. 2457T
cauuugagcaggaugccuga

SEQ ID NO: 1952142 - RNA, 16 nt, Shigella flexneri 2a str. 2457T
cauuugcacaagaugc

SEQ ID NO: 1952143 - RNA, 14 nt, Shigella flexneri 2a str. 2457T
cauuugcaccgauu

SEQ ID NO: 1952144 - RNA, 14 nt, Shigella flexneri 2a str. 2457T
cauuugaaacguua

SEQ ID NO: 1952145 - RNA, 19 nt, Shigella flexneri 2a str. 2457T
cauuucuggcgucaaagcu

SEQ ID NO: 1952146 - RNA, 16 nt, Shigella flexneri 2a str. 2457T
cauuucuggugucaca

SEQ ID NO: 1952147 - RNA, 18 nt, Shigella flexneri 2a str. 2457T
cauuucuggugucacagu

SEQ ID NO: 1952148 - RNA, 22 nt, Shigella flexneri 2a str. 2457T
cauuucuggugucacagugaau

SEQ ID NO: 1952149 - RNA, 16 nt, Shigella flexneri 2a str. 2457T
cauuucugccauucca

SEQ ID NO: 1952150 - RNA, 14 nt, Shigella flexneri 2a str. 2457T
cauuucuggcguca

SEQ ID NO: 1952151 - RNA, 19 nt, Shigella flexneri 2a str. 2457T
cauuucuccagcaguucua

SEQ ID NO: 1952152 - RNA, 18 nt, Shigella flexneri 2a str. 2457T
cauuggagaguugaaagc

SEQ ID NO: 1952153 - RNA, 22 nt, Shigella flexneri 2a str. 2457T
cauuggccggaauaccacuuuc

SEQ ID NO: 1952154 - RNA, 21 nt, Shigella flexneri 2a str. 2457T
cauugguugcuggaaagagaa

SEQ ID NO: 1952155 - RNA, 13 nt, Shigella flexneri 2a str. 2457T
cauuuacagaaac

SEQ ID NO: 1952156 - RNA, 15 nt, Shigella flexneri 2a str. 2457T
cauuuaaaaagaaaa

SEQ ID NO: 1952157 - RNA, 14 nt, Shigella flexneri 2a str. 2457T
cauugugugaaauc

SEQ ID NO: 1952158 - RNA, 23 nt, Shigella flexneri 2a str. 2457T
cauugugaccuuugacucagcgu

SEQ ID NO: 1952159 - RNA, 19 nt, Shigella flexneri 2a str. 2457T
cauucggcgcagguuuaau

SEQ ID NO: 1952160 - RNA, 22 nt, Shigella flexneri 2a str. 2457T
cauucgcuguguaaacccagcc

SEQ ID NO: 1952161 - RNA, 15 nt, Shigella flexneri 2a str. 2457T
cauucgucuccuggc

SEQ ID NO: 1952162 - RNA, 17 nt, Shigella flexneri 2a str. 2457T
cauucgguuuucaaucg

SEQ ID NO: 1952163 - RNA, 20 nt, Shigella flexneri 2a str. 2457T
cauugcccgcccgacaaagc

SEQ ID NO: 1952164 - RNA, 20 nt, Shigella flexneri 2a str. 2457T
cauugccagagugaaaaugc

SEQ ID NO: 1952165 - RNA, 20 nt, Shigella flexneri 2a str. 2457T
cauugccggugauugcaaag

SEQ ID NO: 1952166 - RNA, 17 nt, Shigella flexneri 2a str. 2457T
cauugccugaugcgcua

SEQ ID NO: 1952167 - RNA, 17 nt, Shigella flexneri 2a str. 2457T
cauugcggcaacaaugc

SEQ ID NO: 1952168 - RNA, 16 nt, Shigella flexneri 2a str. 2457T
cauugcucucuucucc

SEQ ID NO: 1952169 - RNA, 17 nt, Shigella flexneri 2a str. 2457T
cauugcucuggcaaacu

SEQ ID NO: 1952170 - RNA, 21 nt, Shigella flexneri 2a str. 2457T
cauugcugcugaagcaacagu

SEQ ID NO: 1952171 - RNA, 15 nt, Shigella flexneri 2a str. 2457T
cauugcucacuuccu

SEQ ID NO: 1952172 - RNA, 20 nt, Shigella flexneri 2a str. 2457T
cauugcucacuuccuuuuuu

SEQ ID NO: 1952173 - RNA, 16 nt, Shigella flexneri 2a str. 2457T
cauucgacaacugcug

SEQ ID NO: 1952174 - RNA, 18 nt, Shigella flexneri 2a str. 2457T
cauucgagaagcccauac

SEQ ID NO: 1952175 - RNA, 20 nt, Shigella flexneri 2a str. 2457T
cauucgccgguuccagcuuc

SEQ ID NO: 1952176 - RNA, 16 nt, Shigella flexneri 2a str. 2457T
cauucaucgccuucuu

SEQ ID NO: 1952177 - RNA, 22 nt, Shigella flexneri 2a str. 2457T
cauuccggaguuuaugaggcac

SEQ ID NO: 1952178 - RNA, 20 nt, Shigella flexneri 2a str. 2457T
cauuccgggaaacgaaccau

SEQ ID NO: 1952179 - RNA, 20 nt, Shigella flexneri 2a str. 2457T
cauucagugcaaaugccaga

SEQ ID NO: 1952180 - RNA, 11 nt, Shigella flexneri 2a str. 2457T
cauuagcccaa

SEQ ID NO: 1952181 - RNA, 22 nt, Shigella flexneri 2a str. 2457T
cauuaggaauaaugucuuuaau

SEQ ID NO: 1952182 - RNA, 20 nt, Shigella flexneri 2a str. 2457T
cauuauaaauucuggccacu

SEQ ID NO: 1952183 - RNA, 16 nt, Shigella flexneri 2a str. 2457T
cauucagccaguucuu

SEQ ID NO: 1952184 - RNA, 19 nt, Shigella flexneri 2a str. 2457T
cauucaacuuaagucucca

SEQ ID NO: 1952185 - RNA, 17 nt, Shigella flexneri 2a str. 2457T
cauuaaggucauaucuu

SEQ ID NO: 1952186 - RNA, 19 nt, Shigella flexneri 2a str. 2457T
cauuaagggugaucagccc

SEQ ID NO: 1952187 - RNA, 17 nt, Shigella flexneri 2a str. 2457T
cauuaaggcaagaaaau

SEQ ID NO: 1952188 - RNA, 14 nt, Shigella flexneri 2a str. 2457T
cauuacucguccuu

SEQ ID NO: 1952189 - RNA, 20 nt, Shigella flexneri 2a str. 2457T
cauuacguccaucacaauca

SEQ ID NO: 1952190 - RNA, 15 nt, Shigella flexneri 2a str. 2457T
cauuagauaaaaaug

SEQ ID NO: 1952191 - RNA, 14 nt, Shigella flexneri 2a str. 2457T
cauuaccacgauuu

SEQ ID NO: 1952192 - RNA, 18 nt, Shigella flexneri 2a str. 2457T
cauuaccacgauuuugac

SEQ ID NO: 1952193 - RNA, 14 nt, Shigella flexneri 2a str. 2457T
cauuaccugacagc

SEQ ID NO: 1952194 - RNA, 19 nt, Shigella flexneri 2a str. 2457T
cauuaccuucaacacuggc

SEQ ID NO: 1952195 - RNA, 13 nt, Shigella flexneri 2a str. 2457T
caucuucacuuca

SEQ ID NO: 1952196 - RNA, 20 nt, Shigella flexneri 2a str. 2457T
caucuucacuguccgccaga

SEQ ID NO: 1952197 - RNA, 18 nt, Shigella flexneri 2a str. 2457T
caucuucacuguccgcca

SEQ ID NO: 1952198 - RNA, 14 nt, Shigella flexneri 2a str. 2457T
caucuucaucaucc

SEQ ID NO: 1952199 - RNA, 20 nt, Shigella flexneri 2a str. 2457T
caucuuccaguugcacgcca

SEQ ID NO: 1952200 - RNA, 21 nt, Shigella flexneri 2a str. 2457T
caucuuccaguugcacgccac

SEQ ID NO: 1952201 - RNA, 15 nt, Shigella flexneri 2a str. 2457T
caucuuccaguugca

SEQ ID NO: 1952202 - RNA, 14 nt, Shigella flexneri 2a str. 2457T
cauggcaagaauaa

SEQ ID NO: 1952203 - RNA, 16 nt, Shigella flexneri 2a str. 2457T
cauggagaacgccugu

SEQ ID NO: 1952204 - RNA, 22 nt, Shigella flexneri 2a str. 2457T
cauggagaacgccuguguccug

SEQ ID NO: 1952205 - RNA, 18 nt, Shigella flexneri 2a str. 2457T
cauggaagaaaaauauaa

SEQ ID NO: 1952206 - RNA, 14 nt, Shigella flexneri 2a str. 2457T
caugcuggcugcgc

SEQ ID NO: 1952207 - RNA, 12 nt, Shigella flexneri 2a str. 2457T
caugcuucugca

SEQ ID NO: 1952208 - RNA, 13 nt, Shigella flexneri 2a str. 2457T
caugcuuagcaca

SEQ ID NO: 1952209 - RNA, 20 nt, Shigella flexneri 2a str. 2457T
caugguaaaaccgacuuaaa

SEQ ID NO: 1952210 - RNA, 20 nt, Shigella flexneri 2a str. 2457T
caugguaacgccccacaaac

SEQ ID NO: 1952211 - RNA, 12 nt, Shigella flexneri 2a str. 2457T
cauggcguccgu

SEQ ID NO: 1952212 - RNA, 21 nt, Shigella flexneri 2a str. 2457T
cauggcugacugucgcagcca

SEQ ID NO: 1952213 - RNA, 13 nt, Shigella flexneri 2a str. 2457T
cauggcauuuucu

SEQ ID NO: 1952214 - RNA, 13 nt, Shigella flexneri 2a str. 2457T
cauggugcacauu

SEQ ID NO: 1952215 - RNA, 14 nt, Shigella flexneri 2a str. 2457T
cauguaacgaugca

SEQ ID NO: 1952216 - RNA, 17 nt, Shigella flexneri 2a str. 2457T
cauguaacgaugcauga

SEQ ID NO: 1952217 - RNA, 11 nt, Shigella flexneri 2a str. 2457T
caugucaucaa

SEQ ID NO: 1952218 - RNA, 20 nt, Shigella flexneri 2a str. 2457T
cauguacgcguucaaucaaa

SEQ ID NO: 1952219 - RNA, 22 nt, Shigella flexneri 2a str. 2457T
caugucgguuguacaaaaaaug

SEQ ID NO: 1952220 - RNA, 17 nt, Shigella flexneri 2a str. 2457T
cauguccuucuucugcc

SEQ ID NO: 1952221 - RNA, 17 nt, Shigella flexneri 2a str. 2457T
ccacggaagcaguucgc

SEQ ID NO: 1952222 - RNA, 16 nt, Shigella flexneri 2a str. 2457T
ccacggcaugaaagcg

SEQ ID NO: 1952223 - RNA, 15 nt, Shigella flexneri 2a str. 2457T
ccacggcaugaaagc

SEQ ID NO: 1952224 - RNA, 15 nt, Shigella flexneri 2a str. 2457T
ccacggccacagcca

SEQ ID NO: 1952225 - RNA, 17 nt, Shigella flexneri 2a str. 2457T
ccacgcuguagccgccg

SEQ ID NO: 1952226 - RNA, 22 nt, Shigella flexneri 2a str. 2457T
ccacgcugcaucgccaaucugc

SEQ ID NO: 1952227 - RNA, 15 nt, Shigella flexneri 2a str. 2457T
ccacgcugccgcgca

SEQ ID NO: 1952228 - RNA, 16 nt, Shigella flexneri 2a str. 2457T
ccacgcugagagaagc

SEQ ID NO: 1952229 - RNA, 19 nt, Shigella flexneri 2a str. 2457T
ccacgcugagagaagcacg

SEQ ID NO: 1952230 - RNA, 15 nt, Shigella flexneri 2a str. 2457T
ccacgcuccaucaug

SEQ ID NO: 1952231 - RNA, 21 nt, Shigella flexneri 2a str. 2457T
ccacgccuuaugccacgugag

SEQ ID NO: 1952232 - RNA, 20 nt, Shigella flexneri 2a str. 2457T
ccacgccguuuuuacccagc

SEQ ID NO: 1952233 - RNA, 18 nt, Shigella flexneri 2a str. 2457T
ccacgccugccgccagca

SEQ ID NO: 1952234 - RNA, 17 nt, Shigella flexneri 2a str. 2457T
ccacgcgauacuuuuuc

SEQ ID NO: 1952235 - RNA, 16 nt, Shigella flexneri 2a str. 2457T
ccacgcgauacuuuuu

SEQ ID NO: 1952236 - RNA, 24 nt, Shigella flexneri 2a str. 2457T
ccacgccgauaaucaacgcgccgc

SEQ ID NO: 1952237 - RNA, 16 nt, Shigella flexneri 2a str. 2457T
ccacguuccccagaug

SEQ ID NO: 1952238 - RNA, 14 nt, Shigella flexneri 2a str. 2457T
ccacguuccccaga

SEQ ID NO: 1952239 - RNA, 19 nt, Shigella flexneri 2a str. 2457T
ccacguuaguguggccagu

SEQ ID NO: 1952240 - RNA, 23 nt, Shigella flexneri 2a str. 2457T
ccacguucugaucuuucuucagc

SEQ ID NO: 1952241 - RNA, 17 nt, Shigella flexneri 2a str. 2457T
ccacguugacaaacugc

SEQ ID NO: 1952242 - RNA, 14 nt, Shigella flexneri 2a str. 2457T
ccacucaccgccgu

SEQ ID NO: 1952243 - RNA, 21 nt, Shigella flexneri 2a str. 2457T
ccacucaccgccguuaccuuc

SEQ ID NO: 1952244 - RNA, 18 nt, Shigella flexneri 2a str. 2457T
ccacuauuauggcgcagg

SEQ ID NO: 1952245 - RNA, 21 nt, Shigella flexneri 2a str. 2457T
ccacuacaucaagucauugau

SEQ ID NO: 1952246 - RNA, 23 nt, Shigella flexneri 2a str. 2457T
ccacuacgugaucgucuucaacc

SEQ ID NO: 1952247 - RNA, 21 nt, Shigella flexneri 2a str. 2457T
ccacgguucuccacucugcca

SEQ ID NO: 1952248 - RNA, 19 nt, Shigella flexneri 2a str. 2457T
ccacgguugguuuuaucca

SEQ ID NO: 1952249 - RNA, 15 nt, Shigella flexneri 2a str. 2457T
ccacgguauuugcca

SEQ ID NO: 1952250 - RNA, 13 nt, Shigella flexneri 2a str. 2457T
ccacggcuccagc

SEQ ID NO: 1952251 - RNA, 21 nt, Shigella flexneri 2a str. 2457T
ccacgguacgccagaguggau

SEQ ID NO: 1952252 - RNA, 18 nt, Shigella flexneri 2a str. 2457T
ccacggcggugucgccag

SEQ ID NO: 1952253 - RNA, 13 nt, Shigella flexneri 2a str. 2457T
ccaccacgccaag

SEQ ID NO: 1952254 - RNA, 18 nt, Shigella flexneri 2a str. 2457T
ccaccaccgcaaaauagg

SEQ ID NO: 1952255 - RNA, 16 nt, Shigella flexneri 2a str. 2457T
ccacaggccggagcca

SEQ ID NO: 1952256 - RNA, 17 nt, Shigella flexneri 2a str. 2457T
ccacaggaccacguucc

SEQ ID NO: 1952257 - RNA, 13 nt, Shigella flexneri 2a str. 2457T
ccaccagauggcu

SEQ ID NO: 1952258 - RNA, 17 nt, Shigella flexneri 2a str. 2457T
ccaccagaaucgccagc

SEQ ID NO: 1952259 - RNA, 15 nt, Shigella flexneri 2a str. 2457T
ccaccaggccacggc

SEQ ID NO: 1952260 - RNA, 13 nt, Shigella flexneri 2a str. 2457T
ccaccacgcugua

SEQ ID NO: 1952261 - RNA, 13 nt, Shigella flexneri 2a str. 2457T
ccaccacugcaau

SEQ ID NO: 1952262 - RNA, 19 nt, Shigella flexneri 2a str. 2457T
ccaccaguaccucuucgcu

SEQ ID NO: 1952263 - RNA, 20 nt, Shigella flexneri 2a str. 2457T
ccaccagggauaaagccccc

SEQ ID NO: 1952264 - RNA, 12 nt, Shigella flexneri 2a str. 2457T
ccaccagugcca

SEQ ID NO: 1952265 - RNA, 18 nt, Shigella flexneri 2a str. 2457T
ccaccauguucacugccg

SEQ ID NO: 1952266 - RNA, 21 nt, Shigella flexneri 2a str. 2457T
ccaccauuuuacguccgcgca

SEQ ID NO: 1952267 - RNA, 14 nt, Shigella flexneri 2a str. 2457T
ccacccgucgggca

SEQ ID NO: 1952268 - RNA, 13 nt, Shigella flexneri 2a str. 2457T
ccacccuggcaac

SEQ ID NO: 1952269 - RNA, 22 nt, Shigella flexneri 2a str. 2457T
ccacccuggcaacccgggcucc

SEQ ID NO: 1952270 - RNA, 21 nt, Shigella flexneri 2a str. 2457T
ccacgauagagagcagucagg

SEQ ID NO: 1952271 - RNA, 19 nt, Shigella flexneri 2a str. 2457T
ccacgauauguucaggaua

SEQ ID NO: 1952272 - RNA, 15 nt, Shigella flexneri 2a str. 2457T
ccacgcaacagacca

SEQ ID NO: 1952273 - RNA, 23 nt, Shigella flexneri 2a str. 2457T
ccacgaccucaaaggccgacagc

SEQ ID NO: 1952274 - RNA, 12 nt, Shigella flexneri 2a str. 2457T
ccacgaccgcag

SEQ ID NO: 1952275 - RNA, 23 nt, Shigella flexneri 2a str. 2457T
ccaccugaaauggucgccccgga

SEQ ID NO: 1952276 - RNA, 13 nt, Shigella flexneri 2a str. 2457T
ccaccgaagcuuu

SEQ ID NO: 1952277 - RNA, 16 nt, Shigella flexneri 2a str. 2457T
ccaccgcccagagaau

SEQ ID NO: 1952278 - RNA, 20 nt, Shigella flexneri 2a str. 2457T
ccaccuccacgcccagcgca

SEQ ID NO: 1952279 - RNA, 15 nt, Shigella flexneri 2a str. 2457T
ccacagcucugcugu

SEQ ID NO: 1952280 - RNA, 13 nt, Shigella flexneri 2a str. 2457T
ccacagccagcca

SEQ ID NO: 1952281 - RNA, 22 nt, Shigella flexneri 2a str. 2457T
ccacagcauucucggcccggcc

SEQ ID NO: 1952282 - RNA, 14 nt, Shigella flexneri 2a str. 2457T
ccacagccaacaca

SEQ ID NO: 1952283 - RNA, 19 nt, Shigella flexneri 2a str. 2457T
ccacagcagccuucgccac

SEQ ID NO: 1952284 - RNA, 16 nt, Shigella flexneri 2a str. 2457T
ccacaccaaucaacaa

SEQ ID NO: 1952285 - RNA, 16 nt, Shigella flexneri 2a str. 2457T
ccacaccaccaugcua

SEQ ID NO: 1952286 - RNA, 19 nt, Shigella flexneri 2a str. 2457T
ccacaccaccguuuucccg

SEQ ID NO: 1952287 - RNA, 22 nt, Shigella flexneri 2a str. 2457T
ccacagacaaaauccugccagc

SEQ ID NO: 1952288 - RNA, 19 nt, Shigella flexneri 2a str. 2457T
ccacagacaaacagcucga

SEQ ID NO: 1952289 - RNA, 15 nt, Shigella flexneri 2a str. 2457T
ccacacccacaucaa

SEQ ID NO: 1952290 - RNA, 15 nt, Shigella flexneri 2a str. 2457T
ccaaucucccagccg

SEQ ID NO: 1952291 - RNA, 15 nt, Shigella flexneri 2a str. 2457T
ccaaucugugccgcu

SEQ ID NO: 1952292 - RNA, 19 nt, Shigella flexneri 2a str. 2457T
ccaauggcaauaaagacau

SEQ ID NO: 1952293 - RNA, 23 nt, Shigella flexneri 2a str. 2457T
ccaauguagccgcacgcuggcgu

SEQ ID NO: 1952294 - RNA, 22 nt, Shigella flexneri 2a str. 2457T
ccaauguaauacgcucaucugg

SEQ ID NO: 1952295 - RNA, 11 nt, Shigella flexneri 2a str. 2457T
ccaauugcugu

SEQ ID NO: 1952296 - RNA, 18 nt, Shigella flexneri 2a str. 2457T
ccaauugcacauauuuuu

SEQ ID NO: 1952297 - RNA, 15 nt, Shigella flexneri 2a str. 2457T
ccaauccgccagcca

SEQ ID NO: 1952298 - RNA, 20 nt, Shigella flexneri 2a str. 2457T
ccaaucauucccauuuauuu

SEQ ID NO: 1952299 - RNA, 22 nt, Shigella flexneri 2a str. 2457T
ccaauccagaacaccauaauga

SEQ ID NO: 1952300 - RNA, 14 nt, Shigella flexneri 2a str. 2457T
ccaaucccgccaua

SEQ ID NO: 1952301 - RNA, 19 nt, Shigella flexneri 2a str. 2457T
ccaauauagacaaaguaac

SEQ ID NO: 1952302 - RNA, 23 nt, Shigella flexneri 2a str. 2457T
ccaaucaaauacccuugcagaua

SEQ ID NO: 1952303 - RNA, 19 nt, Shigella flexneri 2a str. 2457T
ccaaucaccgccagcaagg

SEQ ID NO: 1952304 - RNA, 16 nt, Shigella flexneri 2a str. 2457T
ccaaucagcaauaaac

SEQ ID NO: 1952305 - RNA, 14 nt, Shigella flexneri 2a str. 2457T
ccaaucagcacaca

SEQ ID NO: 1952306 - RNA, 17 nt, Shigella flexneri 2a str. 2457T
ccaaucagcacacauaa

SEQ ID NO: 1952307 - RNA, 17 nt, Shigella flexneri 2a str. 2457T
ccaaucagcaauaaacg

SEQ ID NO: 1952308 - RNA, 22 nt, Shigella flexneri 2a str. 2457T
ccaaucacacaaccaugcagga

SEQ ID NO: 1952309 - RNA, 22 nt, Shigella flexneri 2a str. 2457T
ccaauaccgcccaccaccagcg

SEQ ID NO: 1952310 - RNA, 14 nt, Shigella flexneri 2a str. 2457T
ccaauaucaaauaa

SEQ ID NO: 1952311 - RNA, 21 nt, Shigella flexneri 2a str. 2457T
ccaauauaauuccauucacca

SEQ ID NO: 1952312 - RNA, 14 nt, Shigella flexneri 2a str. 2457T
ccaauagccgcgcc

SEQ ID NO: 1952313 - RNA, 22 nt, Shigella flexneri 2a str. 2457T
ccaaggcgaggggaccgccccu

SEQ ID NO: 1952314 - RNA, 19 nt, Shigella flexneri 2a str. 2457T
ccaaguucgaacgccgcca

SEQ ID NO: 1952315 - RNA, 16 nt, Shigella flexneri 2a str. 2457T
ccaauacaaaauuuaa

SEQ ID NO: 1952316 - RNA, 23 nt, Shigella flexneri 2a str. 2457T
ccaacuuaccgccggugcaugau

SEQ ID NO: 1952317 - RNA, 13 nt, Shigella flexneri 2a str. 2457T
ccaacuucaugac

SEQ ID NO: 1952318 - RNA, 15 nt, Shigella flexneri 2a str. 2457T
ccaacugccugaugc

SEQ ID NO: 1952319 - RNA, 23 nt, Shigella flexneri 2a str. 2457T
ccaacuggcaaaagauaaagcca

SEQ ID NO: 1952320 - RNA, 18 nt, Shigella flexneri 2a str. 2457T
ccaacugauuuucaucuu

SEQ ID NO: 1952321 - RNA, 14 nt, Shigella flexneri 2a str. 2457T
ccaacuguaccagc

SEQ ID NO: 1952322 - RNA, 20 nt, Shigella flexneri 2a str. 2457T
ccaagauuaaaggcaccaau

SEQ ID NO: 1952323 - RNA, 13 nt, Shigella flexneri 2a str. 2457T
ccaacggcgagcc

SEQ ID NO: 1952324 - RNA, 15 nt, Shigella flexneri 2a str. 2457T
ccaacggccuugcgg

SEQ ID NO: 1952325 - RNA, 19 nt, Shigella flexneri 2a str. 2457T
ccaacgcgccaccgaccag

SEQ ID NO: 1952326 - RNA, 19 nt, Shigella flexneri 2a str. 2457T
ccaacgauaauucagcaau

SEQ ID NO: 1952327 - RNA, 17 nt, Shigella flexneri 2a str. 2457T
ccaacgauaauucagca

SEQ ID NO: 1952328 - RNA, 15 nt, Shigella flexneri 2a str. 2457T
ccaaagucaucaauc

SEQ ID NO: 1952329 - RNA, 12 nt, Shigella flexneri 2a str. 2457T
ccaaauauuucu

SEQ ID NO: 1952330 - RNA, 20 nt, Shigella flexneri 2a str. 2457T
ccaaaucauccagaccgcuc

SEQ ID NO: 1952331 - RNA, 22 nt, Shigella flexneri 2a str. 2457T
ccaaaggcgaguucaaucaacu

SEQ ID NO: 1952332 - RNA, 13 nt, Shigella flexneri 2a str. 2457T
ccaacagguuuug

SEQ ID NO: 1952333 - RNA, 17 nt, Shigella flexneri 2a str. 2457T
ccaacaaugcaaaauag

SEQ ID NO: 1952334 - RNA, 15 nt, Shigella flexneri 2a str. 2457T
ccaacaaucucuucc

SEQ ID NO: 1952335 - RNA, 16 nt, Shigella flexneri 2a str. 2457T
ccaacaaucucuucca

SEQ ID NO: 1952336 - RNA, 14 nt, Shigella flexneri 2a str. 2457T
ccaacaaauagaga

SEQ ID NO: 1952337 - RNA, 14 nt, Shigella flexneri 2a str. 2457T
ccaacaacagcgcg

SEQ ID NO: 1952338 - RNA, 13 nt, Shigella flexneri 2a str. 2457T
ccaacaaacagua

SEQ ID NO: 1952339 - RNA, 18 nt, Shigella flexneri 2a str. 2457T
ccaaaucugauuaauauu

SEQ ID NO: 1952340 - RNA, 15 nt, Shigella flexneri 2a str. 2457T
ccaaauccagcgcca

SEQ ID NO: 1952341 - RNA, 19 nt, Shigella flexneri 2a str. 2457T
ccaaauccuuccagcucca

SEQ ID NO: 1952342 - RNA, 23 nt, Shigella flexneri 2a str. 2457T
ccaaaucgcccagcaaauacgua

SEQ ID NO: 1952343 - RNA, 20 nt, Shigella flexneri 2a str. 2457T
caucugcguggcgcgcguca

SEQ ID NO: 1952344 - RNA, 17 nt, Shigella flexneri 2a str. 2457T
caucugcguggcgcgcg

SEQ ID NO: 1952345 - RNA, 13 nt, Shigella flexneri 2a str. 2457T
caucugcuuuuug

SEQ ID NO: 1952346 - RNA, 15 nt, Shigella flexneri 2a str. 2457T
caucuggcauucaga

SEQ ID NO: 1952347 - RNA, 20 nt, Shigella flexneri 2a str. 2457T
caucuggaaagucugaauga

SEQ ID NO: 1952348 - RNA, 19 nt, Shigella flexneri 2a str. 2457T
caucuuaacuucgcagcuu

SEQ ID NO: 1952349 - RNA, 15 nt, Shigella flexneri 2a str. 2457T
caucuucaacugcca

SEQ ID NO: 1952350 - RNA, 23 nt, Shigella flexneri 2a str. 2457T
caucugucaguggacgauaagca

SEQ ID NO: 1952351 - RNA, 22 nt, Shigella flexneri 2a str. 2457T
caucucugcaacgucuucccga

SEQ ID NO: 1952352 - RNA, 23 nt, Shigella flexneri 2a str. 2457T
caucuccugcaacagguugcgcu

SEQ ID NO: 1952353 - RNA, 16 nt, Shigella flexneri 2a str. 2457T
caucuccuuacugccc

SEQ ID NO: 1952354 - RNA, 23 nt, Shigella flexneri 2a str. 2457T
caucuccuuacugcccccggcgu

SEQ ID NO: 1952355 - RNA, 19 nt, Shigella flexneri 2a str. 2457T
caucucgcucaaaaaucca

SEQ ID NO: 1952356 - RNA, 20 nt, Shigella flexneri 2a str. 2457T
caucucgcgcucuucuucgc

SEQ ID NO: 1952357 - RNA, 18 nt, Shigella flexneri 2a str. 2457T
caucucgcgcucuucuuc

SEQ ID NO: 1952358 - RNA, 17 nt, Shigella flexneri 2a str. 2457T
caucucgcgcucuucuu

SEQ ID NO: 1952359 - RNA, 20 nt, Shigella flexneri 2a str. 2457T
caucugagcaugaugccuga

SEQ ID NO: 1952360 - RNA, 23 nt, Shigella flexneri 2a str. 2457T
caucugaguugccaucaucacca

SEQ ID NO: 1952361 - RNA, 21 nt, Shigella flexneri 2a str. 2457T
caucugaccacggccacagcc

SEQ ID NO: 1952362 - RNA, 13 nt, Shigella flexneri 2a str. 2457T
caucugaccagau

SEQ ID NO: 1952363 - RNA, 20 nt, Shigella flexneri 2a str. 2457T
caucugaccacggccacagc

SEQ ID NO: 1952364 - RNA, 13 nt, Shigella flexneri 2a str. 2457T
caucucuucuucc

SEQ ID NO: 1952365 - RNA, 17 nt, Shigella flexneri 2a str. 2457T
caucucuucacgcuuug

SEQ ID NO: 1952366 - RNA, 19 nt, Shigella flexneri 2a str. 2457T
caucucuuccggcaccaca

SEQ ID NO: 1952367 - RNA, 17 nt, Shigella flexneri 2a str. 2457T
caucugccggaaccagc

SEQ ID NO: 1952368 - RNA, 11 nt, Shigella flexneri 2a str. 2457T
caucugcccca

SEQ ID NO: 1952369 - RNA, 14 nt, Shigella flexneri 2a str. 2457T
caucugccagccau

SEQ ID NO: 1952370 - RNA, 14 nt, Shigella flexneri 2a str. 2457T
caucugccacuucu

SEQ ID NO: 1952371 - RNA, 19 nt, Shigella flexneri 2a str. 2457T
caucugcauucaacuggau

SEQ ID NO: 1952372 - RNA, 23 nt, Shigella flexneri 2a str. 2457T
caucugcauucaacuggauaaaa

SEQ ID NO: 1952373 - RNA, 14 nt, Shigella flexneri 2a str. 2457T
caucgcuccacgcc

SEQ ID NO: 1952374 - RNA, 21 nt, Shigella flexneri 2a str. 2457T
caucgcuccacgccauaugug

SEQ ID NO: 1952375 - RNA, 14 nt, Shigella flexneri 2a str. 2457T
caucgcuacaccaa

SEQ ID NO: 1952376 - RNA, 20 nt, Shigella flexneri 2a str. 2457T
caucgcuacaccaaucguca

SEQ ID NO: 1952377 - RNA, 20 nt, Shigella flexneri 2a str. 2457T
caucguugacauuugcuuuu

SEQ ID NO: 1952378 - RNA, 22 nt, Shigella flexneri 2a str. 2457T
caucuauagugaggcuauucca

SEQ ID NO: 1952379 - RNA, 13 nt, Shigella flexneri 2a str. 2457T
caucucaaacacg

SEQ ID NO: 1952380 - RNA, 20 nt, Shigella flexneri 2a str. 2457T
caucucaacuuucuuggcac

SEQ ID NO: 1952381 - RNA, 15 nt, Shigella flexneri 2a str. 2457T
caucucauccaucaa

SEQ ID NO: 1952382 - RNA, 22 nt, Shigella flexneri 2a str. 2457T
caucucaggcaguacgcggcgg

SEQ ID NO: 1952383 - RNA, 14 nt, Shigella flexneri 2a str. 2457T
caucuccacaguca

SEQ ID NO: 1952384 - RNA, 19 nt, Shigella flexneri 2a str. 2457T
caucuccacagucaggcug

SEQ ID NO: 1952385 - RNA, 17 nt, Shigella flexneri 2a str. 2457T
cauccucuucugccugc

SEQ ID NO: 1952386 - RNA, 14 nt, Shigella flexneri 2a str. 2457T
cauccucuuuacgc

SEQ ID NO: 1952387 - RNA, 16 nt, Shigella flexneri 2a str. 2457T
cauccugauaggauuu

SEQ ID NO: 1952388 - RNA, 17 nt, Shigella flexneri 2a str. 2457T
cauccguuucccuguuc

SEQ ID NO: 1952389 - RNA, 22 nt, Shigella flexneri 2a str. 2457T
cauccguuucccuguucagccu

SEQ ID NO: 1952390 - RNA, 22 nt, Shigella flexneri 2a str. 2457T
cauccguuucucuguucagccu

SEQ ID NO: 1952391 - RNA, 20 nt, Shigella flexneri 2a str. 2457T
cauccguggcgacagaggug

SEQ ID NO: 1952392 - RNA, 23 nt, Shigella flexneri 2a str. 2457T
cauccgugaauaaugcaaaaagg

SEQ ID NO: 1952393 - RNA, 22 nt, Shigella flexneri 2a str. 2457T
cauccgguuaucgucugcgcca

SEQ ID NO: 1952394 - RNA, 19 nt, Shigella flexneri 2a str. 2457T
cauccggcaauucucugcu

SEQ ID NO: 1952395 - RNA, 21 nt, Shigella flexneri 2a str. 2457T
cauccggcaauuaaaaaagcg

SEQ ID NO: 1952396 - RNA, 14 nt, Shigella flexneri 2a str. 2457T
cauccgcucccugg

SEQ ID NO: 1952397 - RNA, 15 nt, Shigella flexneri 2a str. 2457T
cauccggcaaaaaag

SEQ ID NO: 1952398 - RNA, 16 nt, Shigella flexneri 2a str. 2457T
cauccggcaaaaacaa

SEQ ID NO: 1952399 - RNA, 15 nt, Shigella flexneri 2a str. 2457T
cauccgacaucaacc

SEQ ID NO: 1952400 - RNA, 15 nt, Shigella flexneri 2a str. 2457T
cauccgacacuggca

SEQ ID NO: 1952401 - RNA, 18 nt, Shigella flexneri 2a str. 2457T
cauccgacaaggcaucag

SEQ ID NO: 1952402 - RNA, 14 nt, Shigella flexneri 2a str. 2457T
cauccgaagaacca

SEQ ID NO: 1952403 - RNA, 14 nt, Shigella flexneri 2a str. 2457T
caucauucccgccc

SEQ ID NO: 1952404 - RNA, 17 nt, Shigella flexneri 2a str. 2457T
caucauuuaaaaagaaa

SEQ ID NO: 1952405 - RNA, 16 nt, Shigella flexneri 2a str. 2457T
caucccggcauaaccg

SEQ ID NO: 1952406 - RNA, 18 nt, Shigella flexneri 2a str. 2457T
caucccugucguccagac

SEQ ID NO: 1952407 - RNA, 22 nt, Shigella flexneri 2a str. 2457T
caucgaugguugcccugcuggu

SEQ ID NO: 1952408 - RNA, 15 nt, Shigella flexneri 2a str. 2457T
caucgaugagaugac

SEQ ID NO: 1952409 - RNA, 16 nt, Shigella flexneri 2a str. 2457T
caucgauaucaaccag

SEQ ID NO: 1952410 - RNA, 16 nt, Shigella flexneri 2a str. 2457T
caucgauaaucaccga

SEQ ID NO: 1952411 - RNA, 17 nt, Shigella flexneri 2a str. 2457T
cauccuucacacugccu

SEQ ID NO: 1952412 - RNA, 19 nt, Shigella flexneri 2a str. 2457T
cauccuguacgacaaaaga

SEQ ID NO: 1952413 - RNA, 21 nt, Shigella flexneri 2a str. 2457T
cauccugguaguccaggaugu

SEQ ID NO: 1952414 - RNA, 21 nt, Shigella flexneri 2a str. 2457T
cauccugcggcagcuccagca

SEQ ID NO: 1952415 - RNA, 12 nt, Shigella flexneri 2a str. 2457T
cauccugccaug

SEQ ID NO: 1952416 - RNA, 15 nt, Shigella flexneri 2a str. 2457T
caucgccuuccagcg

SEQ ID NO: 1952417 - RNA, 16 nt, Shigella flexneri 2a str. 2457T
caucgcgcccaaacca

SEQ ID NO: 1952418 - RNA, 18 nt, Shigella flexneri 2a str. 2457T
caucgcgcccgccgccau

SEQ ID NO: 1952419 - RNA, 19 nt, Shigella flexneri 2a str. 2457T
caucgccugaucgcgcagu

SEQ ID NO: 1952420 - RNA, 23 nt, Shigella flexneri 2a str. 2457T
caucgccgguaaaaaugcgcagu

SEQ ID NO: 1952421 - RNA, 16 nt, Shigella flexneri 2a str. 2457T
caucgcauacaaaaac

SEQ ID NO: 1952422 - RNA, 16 nt, Shigella flexneri 2a str. 2457T
caucgauuuugcaaua

SEQ ID NO: 1952423 - RNA, 18 nt, Shigella flexneri 2a str. 2457T
caucauaaccugcucugc

SEQ ID NO: 1952424 - RNA, 13 nt, Shigella flexneri 2a str. 2457T
caucauaagacuu

SEQ ID NO: 1952425 - RNA, 12 nt, Shigella flexneri 2a str. 2457T
caucaguuucaa

SEQ ID NO: 1952426 - RNA, 22 nt, Shigella flexneri 2a str. 2457T
caucaguugcaccugauccagc

SEQ ID NO: 1952427 - RNA, 14 nt, Shigella flexneri 2a str. 2457T
caucagugccagua

SEQ ID NO: 1952428 - RNA, 20 nt, Shigella flexneri 2a str. 2457T
caucagucucaaaccggcuc

SEQ ID NO: 1952429 - RNA, 17 nt, Shigella flexneri 2a str. 2457T
caucaggccuacaaaau

SEQ ID NO: 1952430 - RNA, 12 nt, Shigella flexneri 2a str. 2457T
caucagggcgcu

SEQ ID NO: 1952431 - RNA, 12 nt, Shigella flexneri 2a str. 2457T
caucaggggcag

SEQ ID NO: 1952432 - RNA, 13 nt, Shigella flexneri 2a str. 2457T
caucaucagauuc

SEQ ID NO: 1952433 - RNA, 19 nt, Shigella flexneri 2a str. 2457T
caucauccccguaucuuca

SEQ ID NO: 1952434 - RNA, 22 nt, Shigella flexneri 2a str. 2457T
caucaucagaaaugccaguaac

SEQ ID NO: 1952435 - RNA, 16 nt, Shigella flexneri 2a str. 2457T
caucaucagaaaugcc

SEQ ID NO: 1952436 - RNA, 17 nt, Shigella flexneri 2a str. 2457T
caucaugaauauauaau

SEQ ID NO: 1952437 - RNA, 13 nt, Shigella flexneri 2a str. 2457T
caucaucucccac

SEQ ID NO: 1952438 - RNA, 15 nt, Shigella flexneri 2a str. 2457T
caucaucgcagauuu

SEQ ID NO: 1952439 - RNA, 15 nt, Shigella flexneri 2a str. 2457T
caucaucgauaccaa

SEQ ID NO: 1952440 - RNA, 17 nt, Shigella flexneri 2a str. 2457T
caucaucgcaaugauuu

SEQ ID NO: 1952441 - RNA, 21 nt, Shigella flexneri 2a str. 2457T
caucagaccuucgcuaucaaa

SEQ ID NO: 1952442 - RNA, 14 nt, Shigella flexneri 2a str. 2457T
caucagacauuauu

SEQ ID NO: 1952443 - RNA, 21 nt, Shigella flexneri 2a str. 2457T
caucagaagauggugaauggu

SEQ ID NO: 1952444 - RNA, 23 nt, Shigella flexneri 2a str. 2457T
caucacgguugagggcaaacacc

SEQ ID NO: 1952445 - RNA, 19 nt, Shigella flexneri 2a str. 2457T
caucagaaacacacuuucc

SEQ ID NO: 1952446 - RNA, 13 nt, Shigella flexneri 2a str. 2457T
caucacgucccgu

SEQ ID NO: 1952447 - RNA, 14 nt, Shigella flexneri 2a str. 2457T
caucacgucggcgu

SEQ ID NO: 1952448 - RNA, 15 nt, Shigella flexneri 2a str. 2457T
caucacgcccgcuuu

SEQ ID NO: 1952449 - RNA, 20 nt, Shigella flexneri 2a str. 2457T
caucacgcgguuacgcaccg

SEQ ID NO: 1952450 - RNA, 22 nt, Shigella flexneri 2a str. 2457T
caucaauggcugcaaagcauuu

SEQ ID NO: 1952451 - RNA, 14 nt, Shigella flexneri 2a str. 2457T
caucaaugaccuga

SEQ ID NO: 1952452 - RNA, 16 nt, Shigella flexneri 2a str. 2457T
caucaaugaccuuuuu

SEQ ID NO: 1952453 - RNA, 21 nt, Shigella flexneri 2a str. 2457T
caucaaucccuucgacuuuca

SEQ ID NO: 1952454 - RNA, 13 nt, Shigella flexneri 2a str. 2457T
caucaaucauuuu

SEQ ID NO: 1952455 - RNA, 22 nt, Shigella flexneri 2a str. 2457T
caucaggcaaucucugguuugu

SEQ ID NO: 1952456 - RNA, 21 nt, Shigella flexneri 2a str. 2457T
caucaggcaaugggcaaacgc

SEQ ID NO: 1952457 - RNA, 21 nt, Shigella flexneri 2a str. 2457T
caucaggcagauacaaccaau

SEQ ID NO: 1952458 - RNA, 21 nt, Shigella flexneri 2a str. 2457T
caucaggcaucgugcaccaau

SEQ ID NO: 1952459 - RNA, 20 nt, Shigella flexneri 2a str. 2457T
caucaggaugacaaacuuga

SEQ ID NO: 1952460 - RNA, 17 nt, Shigella flexneri 2a str. 2457T
caucaggaaacccgcca

SEQ ID NO: 1952461 - RNA, 11 nt, Shigella flexneri 2a str. 2457T
caucaggaaac

SEQ ID NO: 1952462 - RNA, 15 nt, Shigella flexneri 2a str. 2457T
caucagcgucgguuu

SEQ ID NO: 1952463 - RNA, 12 nt, Shigella flexneri 2a str. 2457T
caucagcugcca

SEQ ID NO: 1952464 - RNA, 19 nt, Shigella flexneri 2a str. 2457T
caucagcggcgaagccuaa

SEQ ID NO: 1952465 - RNA, 17 nt, Shigella flexneri 2a str. 2457T
caucagauaaucgccau

SEQ ID NO: 1952466 - RNA, 18 nt, Shigella flexneri 2a str. 2457T
caucagcgccaccagcgc

SEQ ID NO: 1952467 - RNA, 14 nt, Shigella flexneri 2a str. 2457T
caucagcgccuuac

SEQ ID NO: 1952468 - RNA, 20 nt, Shigella flexneri 2a str. 2457T
caucagcgauucauugagua

SEQ ID NO: 1952469 - RNA, 17 nt, Shigella flexneri 2a str. 2457T
cauaguagccagccaga

SEQ ID NO: 1952470 - RNA, 19 nt, Shigella flexneri 2a str. 2457T
cauaguagccagccagaau

SEQ ID NO: 1952471 - RNA, 20 nt, Shigella flexneri 2a str. 2457T
cauagucacuaccuguuuaa

SEQ ID NO: 1952472 - RNA, 22 nt, Shigella flexneri 2a str. 2457T
cauaguauuuauccauaauuug

SEQ ID NO: 1952473 - RNA, 15 nt, Shigella flexneri 2a str. 2457T
cauacguuucaccag

SEQ ID NO: 1952474 - RNA, 16 nt, Shigella flexneri 2a str. 2457T
cauacguacaaacgcu

SEQ ID NO: 1952475 - RNA, 21 nt, Shigella flexneri 2a str. 2457T
cauacguacaaacgcuuuacu

SEQ ID NO: 1952476 - RNA, 22 nt, Shigella flexneri 2a str. 2457T
cauacguacaaacgcuuuacuc

SEQ ID NO: 1952477 - RNA, 19 nt, Shigella flexneri 2a str. 2457T
cauacgcguaaaacagcca

SEQ ID NO: 1952478 - RNA, 18 nt, Shigella flexneri 2a str. 2457T
cauauaccgcaucagcau

SEQ ID NO: 1952479 - RNA, 10 nt, Shigella flexneri 2a str. 2457T
cauauaccuc

SEQ ID NO: 1952480 - RNA, 19 nt, Shigella flexneri 2a str. 2457T
cauaguguguuccucugcu

SEQ ID NO: 1952481 - RNA, 20 nt, Shigella flexneri 2a str. 2457T
cauaguguguuccucugcuc

SEQ ID NO: 1952482 - RNA, 18 nt, Shigella flexneri 2a str. 2457T
cauaugagcgucgaagaa

SEQ ID NO: 1952483 - RNA, 16 nt, Shigella flexneri 2a str. 2457T
cauaucuucaacgcac

SEQ ID NO: 1952484 - RNA, 17 nt, Shigella flexneri 2a str. 2457T
cauaucucccaguaagc

SEQ ID NO: 1952485 - RNA, 20 nt, Shigella flexneri 2a str. 2457T
cauauccccgggcggccucu

SEQ ID NO: 1952486 - RNA, 20 nt, Shigella flexneri 2a str. 2457T
cauauagccgccuuguugua

SEQ ID NO: 1952487 - RNA, 23 nt, Shigella flexneri 2a str. 2457T
cauauagccgccuuguuguaaug

SEQ ID NO: 1952488 - RNA, 18 nt, Shigella flexneri 2a str. 2457T
cauaucaccguucacugc

SEQ ID NO: 1952489 - RNA, 15 nt, Shigella flexneri 2a str. 2457T
cauaucagcaacucu

SEQ ID NO: 1952490 - RNA, 17 nt, Shigella flexneri 2a str. 2457T
cauauggaagaaacgcu

SEQ ID NO: 1952491 - RNA, 14 nt, Shigella flexneri 2a str. 2457T
cauaugcaucagau

SEQ ID NO: 1952492 - RNA, 14 nt, Shigella flexneri 2a str. 2457T
cauaugcagcaucc

SEQ ID NO: 1952493 - RNA, 22 nt, Shigella flexneri 2a str. 2457T
cauauguguuugugcugugaca

SEQ ID NO: 1952494 - RNA, 15 nt, Shigella flexneri 2a str. 2457T
cauauguugaaaagc

SEQ ID NO: 1952495 - RNA, 23 nt, Shigella flexneri 2a str. 2457T
cauauucaccacgaaaccgacug

SEQ ID NO: 1952496 - RNA, 14 nt, Shigella flexneri 2a str. 2457T
cauauuuaaagaag

SEQ ID NO: 1952497 - RNA, 19 nt, Shigella flexneri 2a str. 2457T
cauauuuaaucaguucuac

SEQ ID NO: 1952498 - RNA, 12 nt, Shigella flexneri 2a str. 2457T
cauauucaccac

SEQ ID NO: 1952499 - RNA, 13 nt, Shigella flexneri 2a str. 2457T
cauauucagcagc

SEQ ID NO: 1952500 - RNA, 14 nt, Shigella flexneri 2a str. 2457T
cauauucagcagca

SEQ ID NO: 1952501 - RNA, 20 nt, Shigella flexneri 2a str. 2457T
cauauuuccuuccuuggaua

SEQ ID NO: 1952502 - RNA, 20 nt, Shigella flexneri 2a str. 2457T
cauauuuauaggguaaauua

SEQ ID NO: 1952503 - RNA, 15 nt, Shigella flexneri 2a str. 2457T
caucaaaaaaugaaa

SEQ ID NO: 1952504 - RNA, 14 nt, Shigella flexneri 2a str. 2457T
caucaaacccuucc

SEQ ID NO: 1952505 - RNA, 13 nt, Shigella flexneri 2a str. 2457T
caucaauauuaag

SEQ ID NO: 1952506 - RNA, 13 nt, Shigella flexneri 2a str. 2457T
caucaacucaguu

SEQ ID NO: 1952507 - RNA, 12 nt, Shigella flexneri 2a str. 2457T
caucaaccagca

SEQ ID NO: 1952508 - RNA, 14 nt, Shigella flexneri 2a str. 2457T
caucaaccaacacc

SEQ ID NO: 1952509 - RNA, 21 nt, Shigella flexneri 2a str. 2457T
caucaaccaacaccuguucca

SEQ ID NO: 1952510 - RNA, 20 nt, Shigella flexneri 2a str. 2457T
caucaacccgcccagugccg

SEQ ID NO: 1952511 - RNA, 17 nt, Shigella flexneri 2a str. 2457T
caucaaccagcacaaag

SEQ ID NO: 1952512 - RNA, 15 nt, Shigella flexneri 2a str. 2457T
cauaaccugcucugc

SEQ ID NO: 1952513 - RNA, 18 nt, Shigella flexneri 2a str. 2457T
cauaaccacucaccgccg

SEQ ID NO: 1952514 - RNA, 13 nt, Shigella flexneri 2a str. 2457T
cauaaccagucca

SEQ ID NO: 1952515 - RNA, 21 nt, Shigella flexneri 2a str. 2457T
cauaacgccaauucauuccuu

SEQ ID NO: 1952516 - RNA, 19 nt, Shigella flexneri 2a str. 2457T
cauaacgcugauauuucgg

SEQ ID NO: 1952517 - RNA, 22 nt, Shigella flexneri 2a str. 2457T
cauaacgcaucggcuaaaccau

SEQ ID NO: 1952518 - RNA, 13 nt, Shigella flexneri 2a str. 2457T
cauaaccacucac

SEQ ID NO: 1952519 - RNA, 11 nt, Shigella flexneri 2a str. 2457T
cauaacagaau

SEQ ID NO: 1952520 - RNA, 18 nt, Shigella flexneri 2a str. 2457T
cauaacagaggccacccu

SEQ ID NO: 1952521 - RNA, 21 nt, Shigella flexneri 2a str. 2457T
cauaacacaauaccuucugcg

SEQ ID NO: 1952522 - RNA, 20 nt, Shigella flexneri 2a str. 2457T
cauaaauuucacgucacgcu

SEQ ID NO: 1952523 - RNA, 13 nt, Shigella flexneri 2a str. 2457T
cauaacugccgga

SEQ ID NO: 1952524 - RNA, 17 nt, Shigella flexneri 2a str. 2457T
cauaacuggucaucaaa

SEQ ID NO: 1952525 - RNA, 18 nt, Shigella flexneri 2a str. 2457T
cauaacuggucaucaaau

SEQ ID NO: 1952526 - RNA, 13 nt, Shigella flexneri 2a str. 2457T
cauaacucaccau

SEQ ID NO: 1952527 - RNA, 15 nt, Shigella flexneri 2a str. 2457T
cauaacucaccauca

SEQ ID NO: 1952528 - RNA, 19 nt, Shigella flexneri 2a str. 2457T
cauaagcccagaacaaaua

SEQ ID NO: 1952529 - RNA, 19 nt, Shigella flexneri 2a str. 2457T
cauaagguccuccagcucc

SEQ ID NO: 1952530 - RNA, 18 nt, Shigella flexneri 2a str. 2457T
cauaaagcgguuuucaaa

SEQ ID NO: 1952531 - RNA, 22 nt, Shigella flexneri 2a str. 2457T
cauaaagccugcuucaaacgcu

SEQ ID NO: 1952532 - RNA, 15 nt, Shigella flexneri 2a str. 2457T
cauaaauacagagca

SEQ ID NO: 1952533 - RNA, 15 nt, Shigella flexneri 2a str. 2457T
cauaaauugcagcga

SEQ ID NO: 1952534 - RNA, 16 nt, Shigella flexneri 2a str. 2457T
cauaaaucagaucgac

SEQ ID NO: 1952535 - RNA, 22 nt, Shigella flexneri 2a str. 2457T
cauaaaucucagcccgaugaua

SEQ ID NO: 1952536 - RNA, 22 nt, Shigella flexneri 2a str. 2457T
cauaaaaaugcccgauaagcaa

SEQ ID NO: 1952537 - RNA, 21 nt, Shigella flexneri 2a str. 2457T
cauaaaaaagaagccuccguu

SEQ ID NO: 1952538 - RNA, 15 nt, Shigella flexneri 2a str. 2457T
cauaaacaccagcaa

SEQ ID NO: 1952539 - RNA, 13 nt, Shigella flexneri 2a str. 2457T
cauaaacagcagg

SEQ ID NO: 1952540 - RNA, 14 nt, Shigella flexneri 2a str. 2457T
cauaaaaucacagg

SEQ ID NO: 1952541 - RNA, 20 nt, Shigella flexneri 2a str. 2457T
cauaaaauaaccaaauaaaa

SEQ ID NO: 1952542 - RNA, 14 nt, Shigella flexneri 2a str. 2457T
cauaaggugggagg

SEQ ID NO: 1952543 - RNA, 15 nt, Shigella flexneri 2a str. 2457T
cauaauaugaccuga

SEQ ID NO: 1952544 - RNA, 20 nt, Shigella flexneri 2a str. 2457T
cauaauauucauuacaccaa

SEQ ID NO: 1952545 - RNA, 23 nt, Shigella flexneri 2a str. 2457T
cauaauauucauuacaccaauac

SEQ ID NO: 1952546 - RNA, 14 nt, Shigella flexneri 2a str. 2457T
cauaaucagacgac

SEQ ID NO: 1952547 - RNA, 13 nt, Shigella flexneri 2a str. 2457T
cauaaucaauaaa

SEQ ID NO: 1952548 - RNA, 18 nt, Shigella flexneri 2a str. 2457T
cauaaucaauaaaaauac

SEQ ID NO: 1952549 - RNA, 16 nt, Shigella flexneri 2a str. 2457T
cauaauccacuuucuu

SEQ ID NO: 1952550 - RNA, 20 nt, Shigella flexneri 2a str. 2457T
cauaaucauuacaaccgcug

SEQ ID NO: 1952551 - RNA, 13 nt, Shigella flexneri 2a str. 2457T
cauaauccagguu

SEQ ID NO: 1952552 - RNA, 15 nt, Shigella flexneri 2a str. 2457T
cauaaugugcgcaca

SEQ ID NO: 1952553 - RNA, 20 nt, Shigella flexneri 2a str. 2457T
cauaauguccugcggacagu

SEQ ID NO: 1952554 - RNA, 22 nt, Shigella flexneri 2a str. 2457T
cauaauuaaacgcgcgcuggaa

SEQ ID NO: 1952555 - RNA, 18 nt, Shigella flexneri 2a str. 2457T
cauaauguugcugccuug

SEQ ID NO: 1952556 - RNA, 12 nt, Shigella flexneri 2a str. 2457T
cauacaaauaag

SEQ ID NO: 1952557 - RNA, 22 nt, Shigella flexneri 2a str. 2457T
cauaaugauggggucacagguu

SEQ ID NO: 1952558 - RNA, 13 nt, Shigella flexneri 2a str. 2457T
cauaaugcagcca

SEQ ID NO: 1952559 - RNA, 16 nt, Shigella flexneri 2a str. 2457T
cauaaugcccagcguu

SEQ ID NO: 1952560 - RNA, 15 nt, Shigella flexneri 2a str. 2457T
cauaaugcugacaaa

SEQ ID NO: 1952561 - RNA, 16 nt, Shigella flexneri 2a str. 2457T
cauaaucggcgcggcg

SEQ ID NO: 1952562 - RNA, 17 nt, Shigella flexneri 2a str. 2457T
cauaaucuguuucaucu

SEQ ID NO: 1952563 - RNA, 15 nt, Shigella flexneri 2a str. 2457T
cauacauccucucuu

SEQ ID NO: 1952564 - RNA, 20 nt, Shigella flexneri 2a str. 2457T
cauacagcuuuuacagccaa

SEQ ID NO: 1952565 - RNA, 14 nt, Shigella flexneri 2a str. 2457T
cauaccacagcaaa

SEQ ID NO: 1952566 - RNA, 22 nt, Shigella flexneri 2a str. 2457T
cauacaugguuugaucgcuaag

SEQ ID NO: 1952567 - RNA, 20 nt, Shigella flexneri 2a str. 2457T
cauacaugguuugaucgcua

SEQ ID NO: 1952568 - RNA, 14 nt, Shigella flexneri 2a str. 2457T
cauacaaaaacaca

SEQ ID NO: 1952569 - RNA, 13 nt, Shigella flexneri 2a str. 2457T
cauacaacgccau

SEQ ID NO: 1952570 - RNA, 22 nt, Shigella flexneri 2a str. 2457T
cauacagaucgugcaucuccug

SEQ ID NO: 1952571 - RNA, 16 nt, Shigella flexneri 2a str. 2457T
cauacgcaaaaaacau

SEQ ID NO: 1952572 - RNA, 20 nt, Shigella flexneri 2a str. 2457T
cauacgcggcagaaugguuu

SEQ ID NO: 1952573 - RNA, 17 nt, Shigella flexneri 2a str. 2457T
cauaccugaguggcaau

SEQ ID NO: 1952574 - RNA, 22 nt, Shigella flexneri 2a str. 2457T
cauaccuuccacuuucacgccc

SEQ ID NO: 1952575 - RNA, 20 nt, Shigella flexneri 2a str. 2457T
cauaccgugguacguuaaag

SEQ ID NO: 1952576 - RNA, 16 nt, Shigella flexneri 2a str. 2457T
cauaccuaaaaaaucc

SEQ ID NO: 1952577 - RNA, 14 nt, Shigella flexneri 2a str. 2457T
cauaccuaaaagca

SEQ ID NO: 1952578 - RNA, 15 nt, Shigella flexneri 2a str. 2457T
cauaccuaaaaaauc

SEQ ID NO: 1952579 - RNA, 21 nt, Shigella flexneri 2a str. 2457T
cauaccuaaaagcacgccaga

SEQ ID NO: 1952580 - RNA, 21 nt, Shigella flexneri 2a str. 2457T
cauacccaacguaacaaaacu

SEQ ID NO: 1952581 - RNA, 12 nt, Shigella flexneri 2a str. 2457T
caguuugccaug

SEQ ID NO: 1952582 - RNA, 18 nt, Shigella flexneri 2a str. 2457T
caguuucugauacugcuc

SEQ ID NO: 1952583 - RNA, 14 nt, Shigella flexneri 2a str. 2457T
caguuucugcagcu

SEQ ID NO: 1952584 - RNA, 21 nt, Shigella flexneri 2a str. 2457T
caguuucuuaccuacuugcuc

SEQ ID NO: 1952585 - RNA, 21 nt, Shigella flexneri 2a str. 2457T
caguuuucauauaccgcauca

SEQ ID NO: 1952586 - RNA, 20 nt, Shigella flexneri 2a str. 2457T
caguuugcgcgugcugggau

SEQ ID NO: 1952587 - RNA, 22 nt, Shigella flexneri 2a str. 2457T
caguuuggucuggcaaaaauaa

SEQ ID NO: 1952588 - RNA, 16 nt, Shigella flexneri 2a str. 2457T
caguuugucuucaaug

SEQ ID NO: 1952589 - RNA, 12 nt, Shigella flexneri 2a str. 2457T
cauaaaaaaacg

SEQ ID NO: 1952590 - RNA, 24 nt, Shigella flexneri 2a str. 2457T
caguuuucgcaccgcguuuagcgu

SEQ ID NO: 1952591 - RNA, 14 nt, Shigella flexneri 2a str. 2457T
caguuuugucuucg

SEQ ID NO: 1952592 - RNA, 17 nt, Shigella flexneri 2a str. 2457T
caguuuuuaauuuucgu

SEQ ID NO: 1952593 - RNA, 22 nt, Shigella flexneri 2a str. 2457T
caguuuugucuucggccauuga

SEQ ID NO: 1952594 - RNA, 13 nt, Shigella flexneri 2a str. 2457T
caguuuauuuucu

SEQ ID NO: 1952595 - RNA, 15 nt, Shigella flexneri 2a str. 2457T
caguuuauccagcca

SEQ ID NO: 1952596 - RNA, 13 nt, Shigella flexneri 2a str. 2457T
caguuuauacagc

SEQ ID NO: 1952597 - RNA, 14 nt, Shigella flexneri 2a str. 2457T
caguuucgccaggg

SEQ ID NO: 1952598 - RNA, 18 nt, Shigella flexneri 2a str. 2457T
caguuucggaccagccgc

SEQ ID NO: 1952599 - RNA, 13 nt, Shigella flexneri 2a str. 2457T
caguuucauagug

SEQ ID NO: 1952600 - RNA, 17 nt, Shigella flexneri 2a str. 2457T
caguuucagccccauca

SEQ ID NO: 1952601 - RNA, 14 nt, Shigella flexneri 2a str. 2457T
caguuucacagggu

SEQ ID NO: 1952602 - RNA, 15 nt, Shigella flexneri 2a str. 2457T
caguuucaccugcug

SEQ ID NO: 1952603 - RNA, 20 nt, Shigella flexneri 2a str. 2457T
caguugguuagagcacauca

SEQ ID NO: 1952604 - RNA, 20 nt, Shigella flexneri 2a str. 2457T
caguugucagcccuuuuuca

SEQ ID NO: 1952605 - RNA, 15 nt, Shigella flexneri 2a str. 2457T
caguuggggaaaagu

SEQ ID NO: 1952606 - RNA, 20 nt, Shigella flexneri 2a str. 2457T
caguugguagguccagccgc

SEQ ID NO: 1952607 - RNA, 14 nt, Shigella flexneri 2a str. 2457T
caguuccugcaacu

SEQ ID NO: 1952608 - RNA, 16 nt, Shigella flexneri 2a str. 2457T
caguucgauauccagu

SEQ ID NO: 1952609 - RNA, 16 nt, Shigella flexneri 2a str. 2457T
caguucgauuucccag

SEQ ID NO: 1952610 - RNA, 18 nt, Shigella flexneri 2a str. 2457T
caguucauuuuucucaac

SEQ ID NO: 1952611 - RNA, 15 nt, Shigella flexneri 2a str. 2457T
caguucccccugcca

SEQ ID NO: 1952612 - RNA, 18 nt, Shigella flexneri 2a str. 2457T
caguucccagggcuuucg

SEQ ID NO: 1952613 - RNA, 17 nt, Shigella flexneri 2a str. 2457T
caguuccgcugcaaguu

SEQ ID NO: 1952614 - RNA, 19 nt, Shigella flexneri 2a str. 2457T
caguuccggcaucgacagu

SEQ ID NO: 1952615 - RNA, 24 nt, Shigella flexneri 2a str. 2457T
caguucgcccgcuucaucgugcuc

SEQ ID NO: 1952616 - RNA, 22 nt, Shigella flexneri 2a str. 2457T
caguucgcgauccugauacaga

SEQ ID NO: 1952617 - RNA, 16 nt, Shigella flexneri 2a str. 2457T
caguucggcaucaucg

SEQ ID NO: 1952618 - RNA, 16 nt, Shigella flexneri 2a str. 2457T
caguucgguugggauc

SEQ ID NO: 1952619 - RNA, 20 nt, Shigella flexneri 2a str. 2457T
caguucuaccaucaauggcu

SEQ ID NO: 1952620 - RNA, 21 nt, Shigella flexneri 2a str. 2457T
caguugaccugcgaccggcgu

SEQ ID NO: 1952621 - RNA, 19 nt, Shigella flexneri 2a str. 2457T
caguugauacaggaacagc

SEQ ID NO: 1952622 - RNA, 16 nt, Shigella flexneri 2a str. 2457T
caguugaucagccagg

SEQ ID NO: 1952623 - RNA, 16 nt, Shigella flexneri 2a str. 2457T
caguucuuccaguucc

SEQ ID NO: 1952624 - RNA, 13 nt, Shigella flexneri 2a str. 2457T
caguucugcagcg

SEQ ID NO: 1952625 - RNA, 15 nt, Shigella flexneri 2a str. 2457T
caguucuucaaaaau

SEQ ID NO: 1952626 - RNA, 20 nt, Shigella flexneri 2a str. 2457T
caguucuggcaccggacgcu

SEQ ID NO: 1952627 - RNA, 22 nt, Shigella flexneri 2a str. 2457T
caguucuggcaccggacgcuug

SEQ ID NO: 1952628 - RNA, 18 nt, Shigella flexneri 2a str. 2457T
caguugcauaauuucuuc

SEQ ID NO: 1952629 - RNA, 19 nt, Shigella flexneri 2a str. 2457T
caguugcaacucgacugga

SEQ ID NO: 1952630 - RNA, 21 nt, Shigella flexneri 2a str. 2457T
caguugcggcuuauucauuac

SEQ ID NO: 1952631 - RNA, 14 nt, Shigella flexneri 2a str. 2457T
caguuggcugacaa

SEQ ID NO: 1952632 - RNA, 15 nt, Shigella flexneri 2a str. 2457T
caguuggcugacaaa

SEQ ID NO: 1952633 - RNA, 13 nt, Shigella flexneri 2a str. 2457T
caguuggcugugg

SEQ ID NO: 1952634 - RNA, 22 nt, Shigella flexneri 2a str. 2457T
caguucagcgauauccagcgau

SEQ ID NO: 1952635 - RNA, 19 nt, Shigella flexneri 2a str. 2457T
caguucagucagcaguguc

SEQ ID NO: 1952636 - RNA, 21 nt, Shigella flexneri 2a str. 2457T
caguucaucaacgcccauaaa

SEQ ID NO: 1952637 - RNA, 17 nt, Shigella flexneri 2a str. 2457T
caguucauuugaacugg

SEQ ID NO: 1952638 - RNA, 13 nt, Shigella flexneri 2a str. 2457T
caguuccagcagc

SEQ ID NO: 1952639 - RNA, 19 nt, Shigella flexneri 2a str. 2457T
caguuaucaaauucauugc

SEQ ID NO: 1952640 - RNA, 17 nt, Shigella flexneri 2a str. 2457T
caguuauagcgcagacg

SEQ ID NO: 1952641 - RNA, 12 nt, Shigella flexneri 2a str. 2457T
caguucagaagc

SEQ ID NO: 1952642 - RNA, 18 nt, Shigella flexneri 2a str. 2457T
caguucaccgccgaggcg

SEQ ID NO: 1952643 - RNA, 16 nt, Shigella flexneri 2a str. 2457T
caguucacgaauauuu

SEQ ID NO: 1952644 - RNA, 12 nt, Shigella flexneri 2a str. 2457T
caguuauaaaau

SEQ ID NO: 1952645 - RNA, 15 nt, Shigella flexneri 2a str. 2457T
caguucaaaguugca

SEQ ID NO: 1952646 - RNA, 21 nt, Shigella flexneri 2a str. 2457T
caguucaaauucauugucggg

SEQ ID NO: 1952647 - RNA, 22 nt, Shigella flexneri 2a str. 2457T
caguucacccucauucaccagu

SEQ ID NO: 1952648 - RNA, 23 nt, Shigella flexneri 2a str. 2457T
caguucaagugcuacccacuucc

SEQ ID NO: 1952649 - RNA, 16 nt, Shigella flexneri 2a str. 2457T
caguucacaccagcca

SEQ ID NO: 1952650 - RNA, 20 nt, Shigella flexneri 2a str. 2457T
caguguacuuaucuuuuaca

SEQ ID NO: 1952651 - RNA, 16 nt, Shigella flexneri 2a str. 2457T
caguguccagcggcau

SEQ ID NO: 1952652 - RNA, 15 nt, Shigella flexneri 2a str. 2457T
caguuaaguuaauuc

SEQ ID NO: 1952653 - RNA, 18 nt, Shigella flexneri 2a str. 2457T
caguuaaccugcuccuca

SEQ ID NO: 1952654 - RNA, 17 nt, Shigella flexneri 2a str. 2457T
caguuacugccaccauc

SEQ ID NO: 1952655 - RNA, 18 nt, Shigella flexneri 2a str. 2457T
caguuacugccaccaucc

SEQ ID NO: 1952656 - RNA, 15 nt, Shigella flexneri 2a str. 2457T
caguguaaaacagca

SEQ ID NO: 1952657 - RNA, 15 nt, Shigella flexneri 2a str. 2457T
caguguaucggcggc

SEQ ID NO: 1952658 - RNA, 14 nt, Shigella flexneri 2a str. 2457T
cagugggauuaaaa

SEQ ID NO: 1952659 - RNA, 14 nt, Shigella flexneri 2a str. 2457T
cagugggcgcugcu

SEQ ID NO: 1952660 - RNA, 21 nt, Shigella flexneri 2a str. 2457T
caguggaugcgccauaccaug

SEQ ID NO: 1952661 - RNA, 21 nt, Shigella flexneri 2a str. 2457T
caguggauaauacacuaacag

SEQ ID NO: 1952662 - RNA, 17 nt, Shigella flexneri 2a str. 2457T
caguggacgauaagcac

SEQ ID NO: 1952663 - RNA, 15 nt, Shigella flexneri 2a str. 2457T
cagugcuucgcggac

SEQ ID NO: 1952664 - RNA, 12 nt, Shigella flexneri 2a str. 2457T
cagugcuuuauc

SEQ ID NO: 1952665 - RNA, 14 nt, Shigella flexneri 2a str. 2457T
cagugccccgagcg

SEQ ID NO: 1952666 - RNA, 19 nt, Shigella flexneri 2a str. 2457T
cagguauaccggaccaaua

SEQ ID NO: 1952667 - RNA, 20 nt, Shigella flexneri 2a str. 2457T
cagguauaccgaaaucgcca

SEQ ID NO: 1952668 - RNA, 16 nt, Shigella flexneri 2a str. 2457T
cagugccguuccagcc

SEQ ID NO: 1952669 - RNA, 20 nt, Shigella flexneri 2a str. 2457T
cagugccugcgccaccguuu

SEQ ID NO: 1952670 - RNA, 18 nt, Shigella flexneri 2a str. 2457T
cagugccgcccaccacuc

SEQ ID NO: 1952671 - RNA, 12 nt, Shigella flexneri 2a str. 2457T
cagugccgcgcc

SEQ ID NO: 1952672 - RNA, 18 nt, Shigella flexneri 2a str. 2457T
cagugccggaugauucac

SEQ ID NO: 1952673 - RNA, 19 nt, Shigella flexneri 2a str. 2457T
cagugcggauaccaccagu

SEQ ID NO: 1952674 - RNA, 16 nt, Shigella flexneri 2a str. 2457T
cagcaacuuaaucauc

SEQ ID NO: 1952675 - RNA, 17 nt, Shigella flexneri 2a str. 2457T
cagcaacugacugacuu

SEQ ID NO: 1952676 - RNA, 17 nt, Shigella flexneri 2a str. 2457T
cagcaacucugguggac

SEQ ID NO: 1952677 - RNA, 16 nt, Shigella flexneri 2a str. 2457T
cagcaagagcaaauaa

SEQ ID NO: 1952678 - RNA, 21 nt, Shigella flexneri 2a str. 2457T
cagcaacgggcugaagaagua

SEQ ID NO: 1952679 - RNA, 16 nt, Shigella flexneri 2a str. 2457T
aaaaugccgcacauca

SEQ ID NO: 1952680 - RNA, 21 nt, Shigella flexneri 2a str. 2457T
aaaaugcaucggcauaaucau

SEQ ID NO: 1952681 - RNA, 20 nt, Shigella flexneri 2a str. 2457T
aaaaugccuuuaccgacaua

SEQ ID NO: 1952682 - RNA, 22 nt, Shigella flexneri 2a str. 2457T
cagcaacaagccaguccagaaa

SEQ ID NO: 1952683 - RNA, 22 nt, Shigella flexneri 2a str. 2457T
cagcaacaaauaaccgccugau

SEQ ID NO: 1952684 - RNA, 21 nt, Shigella flexneri 2a str. 2457T
cagcaacacaaucagacgcag

SEQ ID NO: 1952685 - RNA, 16 nt, Shigella flexneri 2a str. 2457T
cagcaaauagccgagc

SEQ ID NO: 1952686 - RNA, 17 nt, Shigella flexneri 2a str. 2457T
cagcaaauccaucauau

SEQ ID NO: 1952687 - RNA, 11 nt, Shigella flexneri 2a str. 2457T
cagcaaaggaa

SEQ ID NO: 1952688 - RNA, 21 nt, Shigella flexneri 2a str. 2457T
aaaaugauguagaccugauac

SEQ ID NO: 1952689 - RNA, 17 nt, Shigella flexneri 2a str. 2457T
cagaucagccacuuccu

SEQ ID NO: 1952690 - RNA, 13 nt, Shigella flexneri 2a str. 2457T
cagaucauccugc

SEQ ID NO: 1952691 - RNA, 14 nt, Shigella flexneri 2a str. 2457T
cagauccagcaccu

SEQ ID NO: 1952692 - RNA, 14 nt, Shigella flexneri 2a str. 2457T
cagauccagugcuc

SEQ ID NO: 1952693 - RNA, 14 nt, Shigella flexneri 2a str. 2457T
cagaucauccaucg

SEQ ID NO: 1952694 - RNA, 21 nt, Shigella flexneri 2a str. 2457T
cagauccaaaccgacugccug

SEQ ID NO: 1952695 - RNA, 23 nt, Shigella flexneri 2a str. 2457T
cagauccauaagguccuccagcu

SEQ ID NO: 1952696 - RNA, 22 nt, Shigella flexneri 2a str. 2457T
cagauccgccaguuuguagcca

SEQ ID NO: 1952697 - RNA, 13 nt, Shigella flexneri 2a str. 2457T
cagauccgccauu

SEQ ID NO: 1952698 - RNA, 23 nt, Shigella flexneri 2a str. 2457T
aaaaucgugaaaaaucaauauau

SEQ ID NO: 1952699 - RNA, 14 nt, Shigella flexneri 2a str. 2457T
aaaaucucaaugua

SEQ ID NO: 1952700 - RNA, 21 nt, Shigella flexneri 2a str. 2457T
aaaaucuauugcaacauguug

SEQ ID NO: 1952701 - RNA, 14 nt, Shigella flexneri 2a str. 2457T
cagauucagcagcg

SEQ ID NO: 1952702 - RNA, 16 nt, Shigella flexneri 2a str. 2457T
cagauucagccacauu

SEQ ID NO: 1952703 - RNA, 14 nt, Shigella flexneri 2a str. 2457T
aaaaucuuaaagau

SEQ ID NO: 1952704 - RNA, 21 nt, Shigella flexneri 2a str. 2457T
aaaaucuucguuaucccaggc

SEQ ID NO: 1952705 - RNA, 14 nt, Shigella flexneri 2a str. 2457T
cagcaaacaggugc

SEQ ID NO: 1952706 - RNA, 15 nt, Shigella flexneri 2a str. 2457T
cagcaaaaugcauaa

SEQ ID NO: 1952707 - RNA, 15 nt, Shigella flexneri 2a str. 2457T
cagcaaaaucaccau

SEQ ID NO: 1952708 - RNA, 16 nt, Shigella flexneri 2a str. 2457T
cagcaaaaucaccauc

SEQ ID NO: 1952709 - RNA, 20 nt, Shigella flexneri 2a str. 2457T
cagauucaggcgcagcaagu

SEQ ID NO: 1952710 - RNA, 18 nt, Shigella flexneri 2a str. 2457T
cagauuccucucauuuaa

SEQ ID NO: 1952711 - RNA, 15 nt, Shigella flexneri 2a str. 2457T
cagauugauaaaaau

SEQ ID NO: 1952712 - RNA, 14 nt, Shigella flexneri 2a str. 2457T
cagauugccacagg

SEQ ID NO: 1952713 - RNA, 14 nt, Shigella flexneri 2a str. 2457T
cagcagcagcaaga

SEQ ID NO: 1952714 - RNA, 14 nt, Shigella flexneri 2a str. 2457T
cagcagcagacagc

SEQ ID NO: 1952715 - RNA, 23 nt, Shigella flexneri 2a str. 2457T
cagcagcagacagccuaccagac

SEQ ID NO: 1952716 - RNA, 17 nt, Shigella flexneri 2a str. 2457T
cagcagauuaaccgcuu

SEQ ID NO: 1952717 - RNA, 20 nt, Shigella flexneri 2a str. 2457T
aaaaugugcccggacagucc

SEQ ID NO: 1952718 - RNA, 14 nt, Shigella flexneri 2a str. 2457T
cagcagcaagauau

SEQ ID NO: 1952719 - RNA, 15 nt, Shigella flexneri 2a str. 2457T
cagcagcaccaccgc

SEQ ID NO: 1952720 - RNA, 15 nt, Shigella flexneri 2a str. 2457T
cagcacguugaacug

SEQ ID NO: 1952721 - RNA, 15 nt, Shigella flexneri 2a str. 2457T
cagcacuaugacugc

SEQ ID NO: 1952722 - RNA, 22 nt, Shigella flexneri 2a str. 2457T
cagcacggugaagaagcggaaa

SEQ ID NO: 1952723 - RNA, 22 nt, Shigella flexneri 2a str. 2457T
cagcagauauugccccacaccg

SEQ ID NO: 1952724 - RNA, 23 nt, Shigella flexneri 2a str. 2457T
cagcacugauuuuuuccaacagg

SEQ ID NO: 1952725 - RNA, 18 nt, Shigella flexneri 2a str. 2457T
cagcacugauuuuuucca

SEQ ID NO: 1952726 - RNA, 14 nt, Shigella flexneri 2a str. 2457T
cagcacugauaauc

SEQ ID NO: 1952727 - RNA, 21 nt, Shigella flexneri 2a str. 2457T
cagcagauauugccccacacc

SEQ ID NO: 1952728 - RNA, 19 nt, Shigella flexneri 2a str. 2457T
aaaauggucagccagcggc

SEQ ID NO: 1952729 - RNA, 19 nt, Shigella flexneri 2a str. 2457T
aaaaugguuccuggaacug

SEQ ID NO: 1952730 - RNA, 17 nt, Shigella flexneri 2a str. 2457T
aaaaugguggagauaaa

SEQ ID NO: 1952731 - RNA, 18 nt, Shigella flexneri 2a str. 2457T
cagcaccagcuccggcac

SEQ ID NO: 1952732 - RNA, 23 nt, Shigella flexneri 2a str. 2457T
cagcaccaguucacccucauuca

SEQ ID NO: 1952733 - RNA, 12 nt, Shigella flexneri 2a str. 2457T
cagcaccaucau

SEQ ID NO: 1952734 - RNA, 19 nt, Shigella flexneri 2a str. 2457T
cagcaccagcgauuguuca

SEQ ID NO: 1952735 - RNA, 19 nt, Shigella flexneri 2a str. 2457T
cagcaccacuuccggcaac

SEQ ID NO: 1952736 - RNA, 12 nt, Shigella flexneri 2a str. 2457T
cagcaccagaga

SEQ ID NO: 1952737 - RNA, 13 nt, Shigella flexneri 2a str. 2457T
cagcaccagcaac

SEQ ID NO: 1952738 - RNA, 18 nt, Shigella flexneri 2a str. 2457T
cagcaauacguuucauau

SEQ ID NO: 1952739 - RNA, 22 nt, Shigella flexneri 2a str. 2457T
cagcaauaaucagauggcggcu

SEQ ID NO: 1952740 - RNA, 16 nt, Shigella flexneri 2a str. 2457T
cagcaaucacugccag

SEQ ID NO: 1952741 - RNA, 13 nt, Shigella flexneri 2a str. 2457T
cagcaaucacugc

SEQ ID NO: 1952742 - RNA, 16 nt, Shigella flexneri 2a str. 2457T
cagcaccaccgcccgu

SEQ ID NO: 1952743 - RNA, 19 nt, Shigella flexneri 2a str. 2457T
cagcaccuuaugcgggcca

SEQ ID NO: 1952744 - RNA, 14 nt, Shigella flexneri 2a str. 2457T
cagcacgcugaagg

SEQ ID NO: 1952745 - RNA, 21 nt, Shigella flexneri 2a str. 2457T
cagcaccgcacagaccaucaa

SEQ ID NO: 1952746 - RNA, 15 nt, Shigella flexneri 2a str. 2457T
cagcaccgcagagau

SEQ ID NO: 1952747 - RNA, 18 nt, Shigella flexneri 2a str. 2457T
cagcaccgcgacaaucag

SEQ ID NO: 1952748 - RNA, 16 nt, Shigella flexneri 2a str. 2457T
cagauaguugauuaau

SEQ ID NO: 1952749 - RNA, 21 nt, Shigella flexneri 2a str. 2457T
cagauaucccgccagcaccag

SEQ ID NO: 1952750 - RNA, 13 nt, Shigella flexneri 2a str. 2457T
cagaucagaccaa

SEQ ID NO: 1952751 - RNA, 21 nt, Shigella flexneri 2a str. 2457T
aaaaucccggcaacaaauuca

SEQ ID NO: 1952752 - RNA, 16 nt, Shigella flexneri 2a str. 2457T
aaaaucgacagcagga

SEQ ID NO: 1952753 - RNA, 15 nt, Shigella flexneri 2a str. 2457T
aaaaucgcaagaucu

SEQ ID NO: 1952754 - RNA, 13 nt, Shigella flexneri 2a str. 2457T
aaaaucgcuucag

SEQ ID NO: 1952755 - RNA, 14 nt, Shigella flexneri 2a str. 2457T
aaaaucgcuucagc

SEQ ID NO: 1952756 - RNA, 20 nt, Shigella flexneri 2a str. 2457T
cagauacaguuuuugcgcuu

SEQ ID NO: 1952757 - RNA, 14 nt, Shigella flexneri 2a str. 2457T
cagauaccacauca

SEQ ID NO: 1952758 - RNA, 21 nt, Shigella flexneri 2a str. 2457T
cagauaaugcccgaugaccuu

SEQ ID NO: 1952759 - RNA, 14 nt, Shigella flexneri 2a str. 2457T
cagauaaugagaaa

SEQ ID NO: 1952760 - RNA, 15 nt, Shigella flexneri 2a str. 2457T
cagauagcaacagca

SEQ ID NO: 1952761 - RNA, 22 nt, Shigella flexneri 2a str. 2457T
cagauacugaugaacgcgcagg

SEQ ID NO: 1952762 - RNA, 20 nt, Shigella flexneri 2a str. 2457T
cagauaggcaucagcaauug

SEQ ID NO: 1952763 - RNA, 19 nt, Shigella flexneri 2a str. 2457T
aaaauccagauuuauaaaa

SEQ ID NO: 1952764 - RNA, 22 nt, Shigella flexneri 2a str. 2457T
aaaauccagauuuauaaaagaa

SEQ ID NO: 1952765 - RNA, 22 nt, Shigella flexneri 2a str. 2457T
aaaauccauuuucuauuuugca

SEQ ID NO: 1952766 - RNA, 11 nt, Shigella flexneri 2a str. 2457T
cagauaaaaua

SEQ ID NO: 1952767 - RNA, 22 nt, Shigella flexneri 2a str. 2457T
cagauaaaauacacuuuaaugc

SEQ ID NO: 1952768 - RNA, 16 nt, Shigella flexneri 2a str. 2457T
cagagcgaucaaccca

SEQ ID NO: 1952769 - RNA, 15 nt, Shigella flexneri 2a str. 2457T
cagagccugaauaaa

SEQ ID NO: 1952770 - RNA, 14 nt, Shigella flexneri 2a str. 2457T
cagacuguagauga

SEQ ID NO: 1952771 - RNA, 17 nt, Shigella flexneri 2a str. 2457T
aaaaucacauaaauucu

SEQ ID NO: 1952772 - RNA, 14 nt, Shigella flexneri 2a str. 2457T
aaaaucaccaucac

SEQ ID NO: 1952773 - RNA, 22 nt, Shigella flexneri 2a str. 2457T
cagacuuuuugcggcagcaaug

SEQ ID NO: 1952774 - RNA, 22 nt, Shigella flexneri 2a str. 2457T
cagagauggccgguuuguuauc

SEQ ID NO: 1952775 - RNA, 13 nt, Shigella flexneri 2a str. 2457T
cagagauucuuuu

SEQ ID NO: 1952776 - RNA, 15 nt, Shigella flexneri 2a str. 2457T
cagagauagaacugc

SEQ ID NO: 1952777 - RNA, 20 nt, Shigella flexneri 2a str. 2457T
cagagauagaacugcauugu

SEQ ID NO: 1952778 - RNA, 16 nt, Shigella flexneri 2a str. 2457T
cagagauucgguaacc

SEQ ID NO: 1952779 - RNA, 17 nt, Shigella flexneri 2a str. 2457T
cagagauuugcuccagc

SEQ ID NO: 1952780 - RNA, 18 nt, Shigella flexneri 2a str. 2457T
cagagauuugcuccagcg

SEQ ID NO: 1952781 - RNA, 21 nt, Shigella flexneri 2a str. 2457T
cagagcaaaaaucgacagcag

SEQ ID NO: 1952782 - RNA, 19 nt, Shigella flexneri 2a str. 2457T
cagaaugcgggcgaaaaca

SEQ ID NO: 1952783 - RNA, 20 nt, Shigella flexneri 2a str. 2457T
cagaaugcgggcgaaaacau

SEQ ID NO: 1952784 - RNA, 14 nt, Shigella flexneri 2a str. 2457T
cagaaugccccauu

SEQ ID NO: 1952785 - RNA, 17 nt, Shigella flexneri 2a str. 2457T
cagaauuugaggaagcu

SEQ ID NO: 1952786 - RNA, 14 nt, Shigella flexneri 2a str. 2457T
cagaauuugaggaa

SEQ ID NO: 1952787 - RNA, 15 nt, Shigella flexneri 2a str. 2457T
cagaauuugaggaag

SEQ ID NO: 1952788 - RNA, 14 nt, Shigella flexneri 2a str. 2457T
cagaaugaugccgc

SEQ ID NO: 1952789 - RNA, 17 nt, Shigella flexneri 2a str. 2457T
cagaaucuucuucucag

SEQ ID NO: 1952790 - RNA, 19 nt, Shigella flexneri 2a str. 2457T
cagaaucuucuucucagcc

SEQ ID NO: 1952791 - RNA, 13 nt, Shigella flexneri 2a str. 2457T
cagacaacuuccc

SEQ ID NO: 1952792 - RNA, 15 nt, Shigella flexneri 2a str. 2457T
cagacaucaccagua

SEQ ID NO: 1952793 - RNA, 23 nt, Shigella flexneri 2a str. 2457T
cagacauuauaaauucuggccac

SEQ ID NO: 1952794 - RNA, 12 nt, Shigella flexneri 2a str. 2457T
cagacaacauga

SEQ ID NO: 1952795 - RNA, 20 nt, Shigella flexneri 2a str. 2457T
cagacaaccauauuuaugca

SEQ ID NO: 1952796 - RNA, 15 nt, Shigella flexneri 2a str. 2457T
cagacaacccacaca

SEQ ID NO: 1952797 - RNA, 15 nt, Shigella flexneri 2a str. 2457T
cagacaacaugagaa

SEQ ID NO: 1952798 - RNA, 14 nt, Shigella flexneri 2a str. 2457T
cagacaaaugaaca

SEQ ID NO: 1952799 - RNA, 19 nt, Shigella flexneri 2a str. 2457T
cagacaaaugaacaccaaa

SEQ ID NO: 1952800 - RNA, 19 nt, Shigella flexneri 2a str. 2457T
cagacaaaugucacugcuu

SEQ ID NO: 1952801 - RNA, 22 nt, Shigella flexneri 2a str. 2457T
cagaauuuuucgcuaaaaaaug

SEQ ID NO: 1952802 - RNA, 20 nt, Shigella flexneri 2a str. 2457T
cagacaaaaagaauacgcaa

SEQ ID NO: 1952803 - RNA, 15 nt, Shigella flexneri 2a str. 2457T
cagaauacgcugaaa

SEQ ID NO: 1952804 - RNA, 20 nt, Shigella flexneri 2a str. 2457T
cagaaguugcucaagcugaa

SEQ ID NO: 1952805 - RNA, 23 nt, Shigella flexneri 2a str. 2457T
cagaauaucguucaagagacugc

SEQ ID NO: 1952806 - RNA, 14 nt, Shigella flexneri 2a str. 2457T
cagaauauuugauu

SEQ ID NO: 1952807 - RNA, 15 nt, Shigella flexneri 2a str. 2457T
cagaauagacaaaaa

SEQ ID NO: 1952808 - RNA, 19 nt, Shigella flexneri 2a str. 2457T
cagaauagacaaaaauucu

SEQ ID NO: 1952809 - RNA, 17 nt, Shigella flexneri 2a str. 2457T
cagaauagcgccgccaa

SEQ ID NO: 1952810 - RNA, 19 nt, Shigella flexneri 2a str. 2457T
cagaauauauaaagauuca

SEQ ID NO: 1952811 - RNA, 22 nt, Shigella flexneri 2a str. 2457T
cagaaucagguugaugcgagua

SEQ ID NO: 1952812 - RNA, 12 nt, Shigella flexneri 2a str. 2457T
cagaauccagga

SEQ ID NO: 1952813 - RNA, 14 nt, Shigella flexneri 2a str. 2457T
cagaauccaggaaa

SEQ ID NO: 1952814 - RNA, 20 nt, Shigella flexneri 2a str. 2457T
cagaaucaccucuuuuucca

SEQ ID NO: 1952815 - RNA, 19 nt, Shigella flexneri 2a str. 2457T
cagaaucaggccauuacua

SEQ ID NO: 1952816 - RNA, 14 nt, Shigella flexneri 2a str. 2457T
cagaaucgccagca

SEQ ID NO: 1952817 - RNA, 15 nt, Shigella flexneri 2a str. 2457T
cagaaucgccagcau

SEQ ID NO: 1952818 - RNA, 20 nt, Shigella flexneri 2a str. 2457T
cagaaucgccagcaucggca

SEQ ID NO: 1952819 - RNA, 17 nt, Shigella flexneri 2a str. 2457T
cagaaucgggcugagau

SEQ ID NO: 1952820 - RNA, 23 nt, Shigella flexneri 2a str. 2457T
cagaaucuaagaucccugccauu

SEQ ID NO: 1952821 - RNA, 21 nt, Shigella flexneri 2a str. 2457T
cagacugaucaucgcccaguu

SEQ ID NO: 1952822 - RNA, 16 nt, Shigella flexneri 2a str. 2457T
cagacugaauacgcuc

SEQ ID NO: 1952823 - RNA, 20 nt, Shigella flexneri 2a str. 2457T
cagacggcugucauccagca

SEQ ID NO: 1952824 - RNA, 16 nt, Shigella flexneri 2a str. 2457T
cagacggcugucuucc

SEQ ID NO: 1952825 - RNA, 17 nt, Shigella flexneri 2a str. 2457T
cagacggcugucuuccu

SEQ ID NO: 1952826 - RNA, 20 nt, Shigella flexneri 2a str. 2457T
cagacgguaaccccucuuca

SEQ ID NO: 1952827 - RNA, 16 nt, Shigella flexneri 2a str. 2457T
cagacggucagcgaga

SEQ ID NO: 1952828 - RNA, 13 nt, Shigella flexneri 2a str. 2457T
cagaccuuuuaau

SEQ ID NO: 1952829 - RNA, 19 nt, Shigella flexneri 2a str. 2457T
cagacgaauaaaacagaaa

SEQ ID NO: 1952830 - RNA, 21 nt, Shigella flexneri 2a str. 2457T
cagaccuucgcuaucaaacug

SEQ ID NO: 1952831 - RNA, 12 nt, Shigella flexneri 2a str. 2457T
cagaccugaauu

SEQ ID NO: 1952832 - RNA, 16 nt, Shigella flexneri 2a str. 2457T
cagaccugcgucacca

SEQ ID NO: 1952833 - RNA, 17 nt, Shigella flexneri 2a str. 2457T
cagaccugcgucaccac

SEQ ID NO: 1952834 - RNA, 18 nt, Shigella flexneri 2a str. 2457T
cagacgagggaaaauaaa

SEQ ID NO: 1952835 - RNA, 11 nt, Shigella flexneri 2a str. 2457T
cagacccaguu

SEQ ID NO: 1952836 - RNA, 18 nt, Shigella flexneri 2a str. 2457T
cagacccauaaucagacg

SEQ ID NO: 1952837 - RNA, 21 nt, Shigella flexneri 2a str. 2457T
cagacccauaaucagacgacg

SEQ ID NO: 1952838 - RNA, 23 nt, Shigella flexneri 2a str. 2457T
cagacccugcucuuucagcaccg

SEQ ID NO: 1952839 - RNA, 18 nt, Shigella flexneri 2a str. 2457T
cagaccaaucccgccaua

SEQ ID NO: 1952840 - RNA, 11 nt, Shigella flexneri 2a str. 2457T
cagaccaauag

SEQ ID NO: 1952841 - RNA, 15 nt, Shigella flexneri 2a str. 2457T
cagaccaaucaccac

SEQ ID NO: 1952842 - RNA, 19 nt, Shigella flexneri 2a str. 2457T
cagacccacggauagauuu

SEQ ID NO: 1952843 - RNA, 21 nt, Shigella flexneri 2a str. 2457T
cagacccagguagacaccaag

SEQ ID NO: 1952844 - RNA, 20 nt, Shigella flexneri 2a str. 2457T
cagaccuacaaaaccugcac

SEQ ID NO: 1952845 - RNA, 16 nt, Shigella flexneri 2a str. 2457T
cagaccuaccaucucc

SEQ ID NO: 1952846 - RNA, 16 nt, Shigella flexneri 2a str. 2457T
cagaccgcacaccgag

SEQ ID NO: 1952847 - RNA, 14 nt, Shigella flexneri 2a str. 2457T
cagaaguugcucaa

SEQ ID NO: 1952848 - RNA, 16 nt, Shigella flexneri 2a str. 2457T
cagaaguugcacccag

SEQ ID NO: 1952849 - RNA, 19 nt, Shigella flexneri 2a str. 2457T
cagaaguccggaaagccau

SEQ ID NO: 1952850 - RNA, 22 nt, Shigella flexneri 2a str. 2457T
cagaaggccgcaguaaagcgca

SEQ ID NO: 1952851 - RNA, 23 nt, Shigella flexneri 2a str. 2457T
cagaaggagcuaauaaugagcag

SEQ ID NO: 1952852 - RNA, 22 nt, Shigella flexneri 2a str. 2457T
cagaagguaaauuguuggcgua

SEQ ID NO: 1952853 - RNA, 23 nt, Shigella flexneri 2a str. 2457T
cagaacuucugguaacagcggac

SEQ ID NO: 1952854 - RNA, 13 nt, Shigella flexneri 2a str. 2457T
cagaacuucgcua

SEQ ID NO: 1952855 - RNA, 22 nt, Shigella flexneri 2a str. 2457T
cagaacuucgcuaacaaucuca

SEQ ID NO: 1952856 - RNA, 13 nt, Shigella flexneri 2a str. 2457T
cagaaggccagga

SEQ ID NO: 1952857 - RNA, 18 nt, Shigella flexneri 2a str. 2457T
cagaagcugcaggaccau

SEQ ID NO: 1952858 - RNA, 20 nt, Shigella flexneri 2a str. 2457T
cagaagcugcaggaccauac

SEQ ID NO: 1952859 - RNA, 20 nt, Shigella flexneri 2a str. 2457T
cagaaccacggaauaaccag

SEQ ID NO: 1952860 - RNA, 14 nt, Shigella flexneri 2a str. 2457T
cagaacagcuacag

SEQ ID NO: 1952861 - RNA, 19 nt, Shigella flexneri 2a str. 2457T
cagaaagugaguuuugcau

SEQ ID NO: 1952862 - RNA, 21 nt, Shigella flexneri 2a str. 2457T
cagaaaguuuuucaacaccau

SEQ ID NO: 1952863 - RNA, 23 nt, Shigella flexneri 2a str. 2457T
cagaaaguuuuucaacaccauga

SEQ ID NO: 1952864 - RNA, 20 nt, Shigella flexneri 2a str. 2457T
cagaaagucauggcaaacug

SEQ ID NO: 1952865 - RNA, 17 nt, Shigella flexneri 2a str. 2457T
cagaacuaaaagauggc

SEQ ID NO: 1952866 - RNA, 21 nt, Shigella flexneri 2a str. 2457T
cagaacgguucuugaaaauca

SEQ ID NO: 1952867 - RNA, 23 nt, Shigella flexneri 2a str. 2457T
cagaacgguucuugaaaaucaac

SEQ ID NO: 1952868 - RNA, 17 nt, Shigella flexneri 2a str. 2457T
cagaacgaccaguucac

SEQ ID NO: 1952869 - RNA, 21 nt, Shigella flexneri 2a str. 2457T
cagaacgcgccuuaaaaacca

SEQ ID NO: 1952870 - RNA, 15 nt, Shigella flexneri 2a str. 2457T
cagaaccgcuucuuc

SEQ ID NO: 1952871 - RNA, 15 nt, Shigella flexneri 2a str. 2457T
cacuuuugaaaucaa

SEQ ID NO: 1952872 - RNA, 22 nt, Shigella flexneri 2a str. 2457T
cacuuuuauuaacucagcauua

SEQ ID NO: 1952873 - RNA, 17 nt, Shigella flexneri 2a str. 2457T
cacuuugccagaaaucc

SEQ ID NO: 1952874 - RNA, 13 nt, Shigella flexneri 2a str. 2457T
cacuuugugucag

SEQ ID NO: 1952875 - RNA, 17 nt, Shigella flexneri 2a str. 2457T
cacuuugugucagcgcc

SEQ ID NO: 1952876 - RNA, 23 nt, Shigella flexneri 2a str. 2457T
cagaaaauuacggauuacaugga

SEQ ID NO: 1952877 - RNA, 13 nt, Shigella flexneri 2a str. 2457T
cagaaaagaaccu

SEQ ID NO: 1952878 - RNA, 17 nt, Shigella flexneri 2a str. 2457T
cagaaaagagacgcuga

SEQ ID NO: 1952879 - RNA, 18 nt, Shigella flexneri 2a str. 2457T
cagaaaauggcacaaugg

SEQ ID NO: 1952880 - RNA, 20 nt, Shigella flexneri 2a str. 2457T
aaaauauccguagugaaaaa

SEQ ID NO: 1952881 - RNA, 20 nt, Shigella flexneri 2a str. 2457T
aaaauaucguaggccugcuc

SEQ ID NO: 1952882 - RNA, 17 nt, Shigella flexneri 2a str. 2457T
cacuuguucagcgaugu

SEQ ID NO: 1952883 - RNA, 18 nt, Shigella flexneri 2a str. 2457T
cacuucgcuuacgccugc

SEQ ID NO: 1952884 - RNA, 23 nt, Shigella flexneri 2a str. 2457T
cacuucgcgcaaccaguccuccg

SEQ ID NO: 1952885 - RNA, 19 nt, Shigella flexneri 2a str. 2457T
cacuucauccggauacagc

SEQ ID NO: 1952886 - RNA, 19 nt, Shigella flexneri 2a str. 2457T
cacuucauuaaccacgauc

SEQ ID NO: 1952887 - RNA, 12 nt, Shigella flexneri 2a str. 2457T
cacuucaucaag

SEQ ID NO: 1952888 - RNA, 17 nt, Shigella flexneri 2a str. 2457T
cacuucaaccacauuca

SEQ ID NO: 1952889 - RNA, 21 nt, Shigella flexneri 2a str. 2457T
cacuucaccgcgaauauaagc

SEQ ID NO: 1952890 - RNA, 17 nt, Shigella flexneri 2a str. 2457T
cacuucacggcugcuaa

SEQ ID NO: 1952891 - RNA, 19 nt, Shigella flexneri 2a str. 2457T
cacuucguucuguuugcag

SEQ ID NO: 1952892 - RNA, 16 nt, Shigella flexneri 2a str. 2457T
cacuucgucagaaaug

SEQ ID NO: 1952893 - RNA, 23 nt, Shigella flexneri 2a str. 2457T
cacuucugaguucggcauggggu

SEQ ID NO: 1952894 - RNA, 19 nt, Shigella flexneri 2a str. 2457T
cacuucuguuacuccagcg

SEQ ID NO: 1952895 - RNA, 17 nt, Shigella flexneri 2a str. 2457T
cacuucuucagccaguu

SEQ ID NO: 1952896 - RNA, 16 nt, Shigella flexneri 2a str. 2457T
cacuugcgcauaauaa

SEQ ID NO: 1952897 - RNA, 19 nt, Shigella flexneri 2a str. 2457T
cacugguucccaacaacag

SEQ ID NO: 1952898 - RNA, 21 nt, Shigella flexneri 2a str. 2457T
cacugguuccgguuuauccau

SEQ ID NO: 1952899 - RNA, 15 nt, Shigella flexneri 2a str. 2457T
cacugguucaaagua

SEQ ID NO: 1952900 - RNA, 22 nt, Shigella flexneri 2a str. 2457T
cacuggguucaaaaacuaauuc

SEQ ID NO: 1952901 - RNA, 23 nt, Shigella flexneri 2a str. 2457T
cacuggguuggguucacuuuccc

SEQ ID NO: 1952902 - RNA, 15 nt, Shigella flexneri 2a str. 2457T
cacuggucgcccugg

SEQ ID NO: 1952903 - RNA, 17 nt, Shigella flexneri 2a str. 2457T
cacuggucugacgcuga

SEQ ID NO: 1952904 - RNA, 20 nt, Shigella flexneri 2a str. 2457T
cacuggucugacgcugaaua

SEQ ID NO: 1952905 - RNA, 18 nt, Shigella flexneri 2a str. 2457T
cacugucgagaucgcggc

SEQ ID NO: 1952906 - RNA, 18 nt, Shigella flexneri 2a str. 2457T
cacuguaugaaacaacgu

SEQ ID NO: 1952907 - RNA, 21 nt, Shigella flexneri 2a str. 2457T
cacuggcccaacaacggcuuu

SEQ ID NO: 1952908 - RNA, 19 nt, Shigella flexneri 2a str. 2457T
cacuggcgcgaauagcuuc

SEQ ID NO: 1952909 - RNA, 18 nt, Shigella flexneri 2a str. 2457T
cacugggagaacgcugcu

SEQ ID NO: 1952910 - RNA, 13 nt, Shigella flexneri 2a str. 2457T
cacuuacuuuccu

SEQ ID NO: 1952911 - RNA, 13 nt, Shigella flexneri 2a str. 2457T
cacuuaaugaauc

SEQ ID NO: 1952912 - RNA, 21 nt, Shigella flexneri 2a str. 2457T
cacuuaucuggaguuauagcu

SEQ ID NO: 1952913 - RNA, 20 nt, Shigella flexneri 2a str. 2457T
cacugugggauugcuucagu

SEQ ID NO: 1952914 - RNA, 19 nt, Shigella flexneri 2a str. 2457T
cacuguuggcgaaaauccu

SEQ ID NO: 1952915 - RNA, 15 nt, Shigella flexneri 2a str. 2457T
cacuguucacuuuug

SEQ ID NO: 1952916 - RNA, 21 nt, Shigella flexneri 2a str. 2457T
cacuuaacccauuacaagccc

SEQ ID NO: 1952917 - RNA, 21 nt, Shigella flexneri 2a str. 2457T
cacucaucuuauugaucaucc

SEQ ID NO: 1952918 - RNA, 22 nt, Shigella flexneri 2a str. 2457T
cacucaugauccuggauuuccu

SEQ ID NO: 1952919 - RNA, 11 nt, Shigella flexneri 2a str. 2457T
cacucaccgca

SEQ ID NO: 1952920 - RNA, 21 nt, Shigella flexneri 2a str. 2457T
cacucacgauagugacucauu

SEQ ID NO: 1952921 - RNA, 10 nt, Shigella flexneri 2a str. 2457T
cacuauuucu

SEQ ID NO: 1952922 - RNA, 14 nt, Shigella flexneri 2a str. 2457T
cacuacgugaucgu

SEQ ID NO: 1952923 - RNA, 16 nt, Shigella flexneri 2a str. 2457T
cacuacggucacgcca

SEQ ID NO: 1952924 - RNA, 15 nt, Shigella flexneri 2a str. 2457T
cacuacucugaccca

SEQ ID NO: 1952925 - RNA, 22 nt, Shigella flexneri 2a str. 2457T
cacuaucccaacaacucuuccu

SEQ ID NO: 1952926 - RNA, 20 nt, Shigella flexneri 2a str. 2457T
cacuauacaaccagauaacc

SEQ ID NO: 1952927 - RNA, 12 nt, Shigella flexneri 2a str. 2457T
cacuaucgcuga

SEQ ID NO: 1952928 - RNA, 21 nt, Shigella flexneri 2a str. 2457T
cacguucaaaacggugaucaa

SEQ ID NO: 1952929 - RNA, 16 nt, Shigella flexneri 2a str. 2457T
cacguuuaacacgcuc

SEQ ID NO: 1952930 - RNA, 23 nt, Shigella flexneri 2a str. 2457T
cacguuccguauaccgucaggau

SEQ ID NO: 1952931 - RNA, 23 nt, Shigella flexneri 2a str. 2457T
cacguuccuggaaccagugaaua

SEQ ID NO: 1952932 - RNA, 17 nt, Shigella flexneri 2a str. 2457T
cacguuccccagaugcg

SEQ ID NO: 1952933 - RNA, 17 nt, Shigella flexneri 2a str. 2457T
cacguucaucccacucu

SEQ ID NO: 1952934 - RNA, 21 nt, Shigella flexneri 2a str. 2457T
cacuaccauuuguucuuuuuu

SEQ ID NO: 1952935 - RNA, 20 nt, Shigella flexneri 2a str. 2457T
cacuaccauaaaaaaacaca

SEQ ID NO: 1952936 - RNA, 16 nt, Shigella flexneri 2a str. 2457T
cacuaccguaauagug

SEQ ID NO: 1952937 - RNA, 20 nt, Shigella flexneri 2a str. 2457T
cacuacgcagggauauuuca

SEQ ID NO: 1952938 - RNA, 15 nt, Shigella flexneri 2a str. 2457T
cacuaccuucuuccc

SEQ ID NO: 1952939 - RNA, 16 nt, Shigella flexneri 2a str. 2457T
cacuaacagaacaaua

SEQ ID NO: 1952940 - RNA, 19 nt, Shigella flexneri 2a str. 2457T
cacuaacagaacaauaaua

SEQ ID NO: 1952941 - RNA, 20 nt, Shigella flexneri 2a str. 2457T
cacuaacgcgucuuaucugg

SEQ ID NO: 1952942 - RNA, 16 nt, Shigella flexneri 2a str. 2457T
cacuaaagccugcuuu

SEQ ID NO: 1952943 - RNA, 20 nt, Shigella flexneri 2a str. 2457T
cacuaaacccgaccacuucc

SEQ ID NO: 1952944 - RNA, 18 nt, Shigella flexneri 2a str. 2457T
cacuaaggguaaaacgac

SEQ ID NO: 1952945 - RNA, 21 nt, Shigella flexneri 2a str. 2457T
cacuccauccagcaacaacag

SEQ ID NO: 1952946 - RNA, 17 nt, Shigella flexneri 2a str. 2457T
cacuccccgcaacagug

SEQ ID NO: 1952947 - RNA, 23 nt, Shigella flexneri 2a str. 2457T
cacucccggauaaaucuccauuu

SEQ ID NO: 1952948 - RNA, 20 nt, Shigella flexneri 2a str. 2457T
cacucccuuucugccacgcc

SEQ ID NO: 1952949 - RNA, 21 nt, Shigella flexneri 2a str. 2457T
cacuccgguaauaucgcgcag

SEQ ID NO: 1952950 - RNA, 15 nt, Shigella flexneri 2a str. 2457T
cacucgcauccucuu

SEQ ID NO: 1952951 - RNA, 16 nt, Shigella flexneri 2a str. 2457T
cacucgccccgagaaa

SEQ ID NO: 1952952 - RNA, 14 nt, Shigella flexneri 2a str. 2457T
cacucgacagcacc

SEQ ID NO: 1952953 - RNA, 15 nt, Shigella flexneri 2a str. 2457T
cacucggugucguua

SEQ ID NO: 1952954 - RNA, 14 nt, Shigella flexneri 2a str. 2457T
cacucucaccacgc

SEQ ID NO: 1952955 - RNA, 22 nt, Shigella flexneri 2a str. 2457T
cacucucaccacgcuccaucau

SEQ ID NO: 1952956 - RNA, 21 nt, Shigella flexneri 2a str. 2457T
cacucucgggaaggcccuucc

SEQ ID NO: 1952957 - RNA, 12 nt, Shigella flexneri 2a str. 2457T
cacucugacgga

SEQ ID NO: 1952958 - RNA, 21 nt, Shigella flexneri 2a str. 2457T
cacucucaaucgucaaacgca

SEQ ID NO: 1952959 - RNA, 22 nt, Shigella flexneri 2a str. 2457T
cacucugccguaccaucgccag

SEQ ID NO: 1952960 - RNA, 19 nt, Shigella flexneri 2a str. 2457T
cacucugcugccacauucc

SEQ ID NO: 1952961 - RNA, 12 nt, Shigella flexneri 2a str. 2457T
cacucuucaaca

SEQ ID NO: 1952962 - RNA, 21 nt, Shigella flexneri 2a str. 2457T
cacugaauagugccacaccag

SEQ ID NO: 1952963 - RNA, 14 nt, Shigella flexneri 2a str. 2457T
cacugaaaaucacc

SEQ ID NO: 1952964 - RNA, 17 nt, Shigella flexneri 2a str. 2457T
cacugaaaaucaccuca

SEQ ID NO: 1952965 - RNA, 21 nt, Shigella flexneri 2a str. 2457T
cacugaccaccaccaccugca

SEQ ID NO: 1952966 - RNA, 14 nt, Shigella flexneri 2a str. 2457T
cacugacaccagca

SEQ ID NO: 1952967 - RNA, 18 nt, Shigella flexneri 2a str. 2457T
cacugacacggaacaacg

SEQ ID NO: 1952968 - RNA, 15 nt, Shigella flexneri 2a str. 2457T
cacugagucagccca

SEQ ID NO: 1952969 - RNA, 20 nt, Shigella flexneri 2a str. 2457T
cacugagucagcccaacaaa

SEQ ID NO: 1952970 - RNA, 18 nt, Shigella flexneri 2a str. 2457T
cacugacgcgucuuaucu

SEQ ID NO: 1952971 - RNA, 16 nt, Shigella flexneri 2a str. 2457T
cacugacgggaaacuc

SEQ ID NO: 1952972 - RNA, 13 nt, Shigella flexneri 2a str. 2457T
cacugcaaaacag

SEQ ID NO: 1952973 - RNA, 16 nt, Shigella flexneri 2a str. 2457T
cacugcaaaucaccac

SEQ ID NO: 1952974 - RNA, 15 nt, Shigella flexneri 2a str. 2457T
cacugcaacagcugu

SEQ ID NO: 1952975 - RNA, 20 nt, Shigella flexneri 2a str. 2457T
cacugccagaauagccgcag

SEQ ID NO: 1952976 - RNA, 20 nt, Shigella flexneri 2a str. 2457T
cacugccagauucuccaaca

SEQ ID NO: 1952977 - RNA, 14 nt, Shigella flexneri 2a str. 2457T
cacugcgcucuucu

SEQ ID NO: 1952978 - RNA, 16 nt, Shigella flexneri 2a str. 2457T
cacugcgcccgccagc

SEQ ID NO: 1952979 - RNA, 19 nt, Shigella flexneri 2a str. 2457T
cacugcgcauaauccacuu

SEQ ID NO: 1952980 - RNA, 17 nt, Shigella flexneri 2a str. 2457T
cacugcgcccgccagca

SEQ ID NO: 1952981 - RNA, 19 nt, Shigella flexneri 2a str. 2457T
cacugcugauuuggaaagu

SEQ ID NO: 1952982 - RNA, 14 nt, Shigella flexneri 2a str. 2457T
cacugcucaccgaa

SEQ ID NO: 1952983 - RNA, 17 nt, Shigella flexneri 2a str. 2457T
cacugcucaaucaucac

SEQ ID NO: 1952984 - RNA, 22 nt, Shigella flexneri 2a str. 2457T
cacugcuuuggcucuucgcucc

SEQ ID NO: 1952985 - RNA, 16 nt, Shigella flexneri 2a str. 2457T
cacugccguacaggca

SEQ ID NO: 1952986 - RNA, 13 nt, Shigella flexneri 2a str. 2457T
cacugcgcccgcc

SEQ ID NO: 1952987 - RNA, 18 nt, Shigella flexneri 2a str. 2457T
cacugcgagaaaaagccu

SEQ ID NO: 1952988 - RNA, 13 nt, Shigella flexneri 2a str. 2457T
cacugcgagaaaa

SEQ ID NO: 1952989 - RNA, 15 nt, Shigella flexneri 2a str. 2457T
cacugcgagaaaaag

SEQ ID NO: 1952990 - RNA, 16 nt, Shigella flexneri 2a str. 2457T
cacugcccgagaacag

SEQ ID NO: 1952991 - RNA, 17 nt, Shigella flexneri 2a str. 2457T
cacugccggaagagagc

SEQ ID NO: 1952992 - RNA, 17 nt, Shigella flexneri 2a str. 2457T
cacugccguacagacag

SEQ ID NO: 1952993 - RNA, 18 nt, Shigella flexneri 2a str. 2457T
cagcgucgcaucaggcau

SEQ ID NO: 1952994 - RNA, 15 nt, Shigella flexneri 2a str. 2457T
cagcgucgcaucugg

SEQ ID NO: 1952995 - RNA, 17 nt, Shigella flexneri 2a str. 2457T
cagcgucgcaucuggca

SEQ ID NO: 1952996 - RNA, 16 nt, Shigella flexneri 2a str. 2457T
cagcguccagcccucc

SEQ ID NO: 1952997 - RNA, 14 nt, Shigella flexneri 2a str. 2457T
cagcgucgucagca

SEQ ID NO: 1952998 - RNA, 15 nt, Shigella flexneri 2a str. 2457T
cagcguguugaggaa

SEQ ID NO: 1952999 - RNA, 18 nt, Shigella flexneri 2a str. 2457T
cagcguucgccaaaccca

SEQ ID NO: 1953000 - RNA, 22 nt, Shigella flexneri 2a str. 2457T
cagcguucauaaauacagagca

SEQ ID NO: 1953001 - RNA, 13 nt, Shigella flexneri 2a str. 2457T
aaaauucaucaaa

SEQ ID NO: 1953002 - RNA, 19 nt, Shigella flexneri 2a str. 2457T
cagcguugcccccugaagc

SEQ ID NO: 1953003 - RNA, 22 nt, Shigella flexneri 2a str. 2457T
aaaauucauucaauuaauaaca

SEQ ID NO: 1953004 - RNA, 20 nt, Shigella flexneri 2a str. 2457T
aaaauucuggguaaugacuc

SEQ ID NO: 1953005 - RNA, 15 nt, Shigella flexneri 2a str. 2457T
cagcgguugagagaa

SEQ ID NO: 1953006 - RNA, 17 nt, Shigella flexneri 2a str. 2457T
cagcgguuuacccugcu

SEQ ID NO: 1953007 - RNA, 12 nt, Shigella flexneri 2a str. 2457T
cagcggguuaau

SEQ ID NO: 1953008 - RNA, 12 nt, Shigella flexneri 2a str. 2457T
cagcgguuuugc

SEQ ID NO: 1953009 - RNA, 21 nt, Shigella flexneri 2a str. 2457T
cagcguaaauccugacgcugg

SEQ ID NO: 1953010 - RNA, 18 nt, Shigella flexneri 2a str. 2457T
cagcguaaaggcggcaga

SEQ ID NO: 1953011 - RNA, 22 nt, Shigella flexneri 2a str. 2457T
cagcguaaaggcggcagaacag

SEQ ID NO: 1953012 - RNA, 22 nt, Shigella flexneri 2a str. 2457T
cagcguaaaggucaauuccuuc

SEQ ID NO: 1953013 - RNA, 21 nt, Shigella flexneri 2a str. 2457T
cagcguaauaaccaacggcga

SEQ ID NO: 1953014 - RNA, 17 nt, Shigella flexneri 2a str. 2457T
cagcgucagcauaaaaa

SEQ ID NO: 1953015 - RNA, 23 nt, Shigella flexneri 2a str. 2457T
cagcgucagcaucauaccuccgc

SEQ ID NO: 1953016 - RNA, 22 nt, Shigella flexneri 2a str. 2457T
cagcgggaucggcguacuggca

SEQ ID NO: 1953017 - RNA, 21 nt, Shigella flexneri 2a str. 2457T
cagcgggcgaaucaacuccag

SEQ ID NO: 1953018 - RNA, 22 nt, Shigella flexneri 2a str. 2457T
aaaauuacucccgugccagagc

SEQ ID NO: 1953019 - RNA, 13 nt, Shigella flexneri 2a str. 2457T
aaaauucaagaca

SEQ ID NO: 1953020 - RNA, 14 nt, Shigella flexneri 2a str. 2457T
cagcgcaucagaca

SEQ ID NO: 1953021 - RNA, 14 nt, Shigella flexneri 2a str. 2457T
cagcgccugcugca

SEQ ID NO: 1953022 - RNA, 15 nt, Shigella flexneri 2a str. 2457T
cagcgccugcugcac

SEQ ID NO: 1953023 - RNA, 14 nt, Shigella flexneri 2a str. 2457T
cagcgccaacgcac

SEQ ID NO: 1953024 - RNA, 19 nt, Shigella flexneri 2a str. 2457T
cagcgccuggcugcauggc

SEQ ID NO: 1953025 - RNA, 23 nt, Shigella flexneri 2a str. 2457T
cagcggaaauuaccgcaccacca

SEQ ID NO: 1953026 - RNA, 23 nt, Shigella flexneri 2a str. 2457T
cagcggaaugcagucacgccagu

SEQ ID NO: 1953027 - RNA, 23 nt, Shigella flexneri 2a str. 2457T
cagcggaaccgcuguugucugaa

SEQ ID NO: 1953028 - RNA, 14 nt, Shigella flexneri 2a str. 2457T
cagcggacagccau

SEQ ID NO: 1953029 - RNA, 18 nt, Shigella flexneri 2a str. 2457T
cagcgcguucugguaaac

SEQ ID NO: 1953030 - RNA, 15 nt, Shigella flexneri 2a str. 2457T
cagcggcggcaaaau

SEQ ID NO: 1953031 - RNA, 15 nt, Shigella flexneri 2a str. 2457T
cagcggcggcacagc

SEQ ID NO: 1953032 - RNA, 16 nt, Shigella flexneri 2a str. 2457T
cagcggcuuccaccgc

SEQ ID NO: 1953033 - RNA, 23 nt, Shigella flexneri 2a str. 2457T
aaaauuacaaaaagugcuuucug

SEQ ID NO: 1953034 - RNA, 21 nt, Shigella flexneri 2a str. 2457T
cagcggcgaauguuccaucac

SEQ ID NO: 1953035 - RNA, 14 nt, Shigella flexneri 2a str. 2457T
cagcggccagccau

SEQ ID NO: 1953036 - RNA, 16 nt, Shigella flexneri 2a str. 2457T
cagcggcaguaaauau

SEQ ID NO: 1953037 - RNA, 18 nt, Shigella flexneri 2a str. 2457T
cagcccagcccugaacca

SEQ ID NO: 1953038 - RNA, 18 nt, Shigella flexneri 2a str. 2457T
cagccauacguugcauaa

SEQ ID NO: 1953039 - RNA, 23 nt, Shigella flexneri 2a str. 2457T
cagccauugugaccuuugacuca

SEQ ID NO: 1953040 - RNA, 15 nt, Shigella flexneri 2a str. 2457T
cagcccaaagcagag

SEQ ID NO: 1953041 - RNA, 16 nt, Shigella flexneri 2a str. 2457T
cagccccagagccuga

SEQ ID NO: 1953042 - RNA, 13 nt, Shigella flexneri 2a str. 2457T
cagccccagcacu

SEQ ID NO: 1953043 - RNA, 16 nt, Shigella flexneri 2a str. 2457T
cagccccagcgucagc

SEQ ID NO: 1953044 - RNA, 16 nt, Shigella flexneri 2a str. 2457T
cagccccaggauugau

SEQ ID NO: 1953045 - RNA, 15 nt, Shigella flexneri 2a str. 2457T
cagcccgagguuauu

SEQ ID NO: 1953046 - RNA, 16 nt, Shigella flexneri 2a str. 2457T
cagccccugcgccagc

SEQ ID NO: 1953047 - RNA, 17 nt, Shigella flexneri 2a str. 2457T
cagccccugcgccagcg

SEQ ID NO: 1953048 - RNA, 14 nt, Shigella flexneri 2a str. 2457T
cagccccgguuuuu

SEQ ID NO: 1953049 - RNA, 14 nt, Shigella flexneri 2a str. 2457T
cagcccgccgccau

SEQ ID NO: 1953050 - RNA, 18 nt, Shigella flexneri 2a str. 2457T
cagcccgaucggcuggca

SEQ ID NO: 1953051 - RNA, 17 nt, Shigella flexneri 2a str. 2457T
cagccacucggacaccu

SEQ ID NO: 1953052 - RNA, 21 nt, Shigella flexneri 2a str. 2457T
cagccaaaucccgugaugcgg

SEQ ID NO: 1953053 - RNA, 23 nt, Shigella flexneri 2a str. 2457T
cagcagccacaccaaucaacaau

SEQ ID NO: 1953054 - RNA, 22 nt, Shigella flexneri 2a str. 2457T
cagcagcccugccggaacgugc

SEQ ID NO: 1953055 - RNA, 15 nt, Shigella flexneri 2a str. 2457T
cagccagagccacca

SEQ ID NO: 1953056 - RNA, 23 nt, Shigella flexneri 2a str. 2457T
cagccagacgccagccacaggcu

SEQ ID NO: 1953057 - RNA, 14 nt, Shigella flexneri 2a str. 2457T
cagccagaugccuu

SEQ ID NO: 1953058 - RNA, 15 nt, Shigella flexneri 2a str. 2457T
cagccacuucuucca

SEQ ID NO: 1953059 - RNA, 12 nt, Shigella flexneri 2a str. 2457T
cagccacuuccu

SEQ ID NO: 1953060 - RNA, 22 nt, Shigella flexneri 2a str. 2457T
cagccacuuccugcucgguaaa

SEQ ID NO: 1953061 - RNA, 16 nt, Shigella flexneri 2a str. 2457T
cagccagaaugucccc

SEQ ID NO: 1953062 - RNA, 16 nt, Shigella flexneri 2a str. 2457T
cagccagaauuacccc

SEQ ID NO: 1953063 - RNA, 17 nt, Shigella flexneri 2a str. 2457T
cagccagaaagaaccgu

SEQ ID NO: 1953064 - RNA, 14 nt, Shigella flexneri 2a str. 2457T
cagccaguugaucu

SEQ ID NO: 1953065 - RNA, 22 nt, Shigella flexneri 2a str. 2457T
cagccauaaagaaaucaccugc

SEQ ID NO: 1953066 - RNA, 21 nt, Shigella flexneri 2a str. 2457T
cagccaguuuuucagcgccag

SEQ ID NO: 1953067 - RNA, 21 nt, Shigella flexneri 2a str. 2457T
cagccauaaucacucuucccc

SEQ ID NO: 1953068 - RNA, 23 nt, Shigella flexneri 2a str. 2457T
cagccauaaagaaaucaccugcc

SEQ ID NO: 1953069 - RNA, 14 nt, Shigella flexneri 2a str. 2457T
cagccagguuuugu

SEQ ID NO: 1953070 - RNA, 12 nt, Shigella flexneri 2a str. 2457T
cagccagcagcg

SEQ ID NO: 1953071 - RNA, 15 nt, Shigella flexneri 2a str. 2457T
cagccagcagaggga

SEQ ID NO: 1953072 - RNA, 17 nt, Shigella flexneri 2a str. 2457T
cagcgaguucaggcgcu

SEQ ID NO: 1953073 - RNA, 21 nt, Shigella flexneri 2a str. 2457T
cagcgauaaugaaugaugcgg

SEQ ID NO: 1953074 - RNA, 13 nt, Shigella flexneri 2a str. 2457T
cagcgauaaaaau

SEQ ID NO: 1953075 - RNA, 20 nt, Shigella flexneri 2a str. 2457T
cagcgaguuuuucaguccac

SEQ ID NO: 1953076 - RNA, 21 nt, Shigella flexneri 2a str. 2457T
cagcgauucaacaguagccuc

SEQ ID NO: 1953077 - RNA, 20 nt, Shigella flexneri 2a str. 2457T
cagcgauuacuguacagauc

SEQ ID NO: 1953078 - RNA, 20 nt, Shigella flexneri 2a str. 2457T
cagcgaugacuguacagauc

SEQ ID NO: 1953079 - RNA, 16 nt, Shigella flexneri 2a str. 2457T
cagcgauuuaucggca

SEQ ID NO: 1953080 - RNA, 15 nt, Shigella flexneri 2a str. 2457T
cagcgauuugcggaa

SEQ ID NO: 1953081 - RNA, 18 nt, Shigella flexneri 2a str. 2457T
cagcgagauaacgcugau

SEQ ID NO: 1953082 - RNA, 17 nt, Shigella flexneri 2a str. 2457T
cagcgagcuggcgcuga

SEQ ID NO: 1953083 - RNA, 22 nt, Shigella flexneri 2a str. 2457T
cagcgagcuggcgcugauaaau

SEQ ID NO: 1953084 - RNA, 13 nt, Shigella flexneri 2a str. 2457T
cagccuuucucag

SEQ ID NO: 1953085 - RNA, 18 nt, Shigella flexneri 2a str. 2457T
cagcgacaggaacgccgc

SEQ ID NO: 1953086 - RNA, 16 nt, Shigella flexneri 2a str. 2457T
cagcgacagggccagg

SEQ ID NO: 1953087 - RNA, 15 nt, Shigella flexneri 2a str. 2457T
cagccuuaccggaga

SEQ ID NO: 1953088 - RNA, 14 nt, Shigella flexneri 2a str. 2457T
cagcccgucucagc

SEQ ID NO: 1953089 - RNA, 23 nt, Shigella flexneri 2a str. 2457T
cagccgcgcgcuucugguuauau

SEQ ID NO: 1953090 - RNA, 13 nt, Shigella flexneri 2a str. 2457T
cagccgugcccaa

SEQ ID NO: 1953091 - RNA, 15 nt, Shigella flexneri 2a str. 2457T
cagccuacaaaaacu

SEQ ID NO: 1953092 - RNA, 20 nt, Shigella flexneri 2a str. 2457T
cagccucaagcacccgccgc

SEQ ID NO: 1953093 - RNA, 14 nt, Shigella flexneri 2a str. 2457T
cagccuacagaagu

SEQ ID NO: 1953094 - RNA, 22 nt, Shigella flexneri 2a str. 2457T
caggguuagccgaucaggcuuu

SEQ ID NO: 1953095 - RNA, 13 nt, Shigella flexneri 2a str. 2457T
cagguaaagacca

SEQ ID NO: 1953096 - RNA, 16 nt, Shigella flexneri 2a str. 2457T
caggguuuugcccagc

SEQ ID NO: 1953097 - RNA, 22 nt, Shigella flexneri 2a str. 2457T
cagggugacaaauuugugcucu

SEQ ID NO: 1953098 - RNA, 18 nt, Shigella flexneri 2a str. 2457T
cagggugaucaccaguaa

SEQ ID NO: 1953099 - RNA, 21 nt, Shigella flexneri 2a str. 2457T
cagguaauuaacauucauuuu

SEQ ID NO: 1953100 - RNA, 20 nt, Shigella flexneri 2a str. 2457T
cagguaauuugaucaaauac

SEQ ID NO: 1953101 - RNA, 18 nt, Shigella flexneri 2a str. 2457T
cagguaagaguuucaaca

SEQ ID NO: 1953102 - RNA, 15 nt, Shigella flexneri 2a str. 2457T
cagguaaucugccau

SEQ ID NO: 1953103 - RNA, 14 nt, Shigella flexneri 2a str. 2457T
cagguaaucugcca

SEQ ID NO: 1953104 - RNA, 16 nt, Shigella flexneri 2a str. 2457T
cagguagguuggugaa

SEQ ID NO: 1953105 - RNA, 18 nt, Shigella flexneri 2a str. 2457T
cagguagcgcauaagcca

SEQ ID NO: 1953106 - RNA, 20 nt, Shigella flexneri 2a str. 2457T
cagguagcgcauaagccacc

SEQ ID NO: 1953107 - RNA, 20 nt, Shigella flexneri 2a str. 2457T
cagggccucuccuuuaccac

SEQ ID NO: 1953108 - RNA, 14 nt, Shigella flexneri 2a str. 2457T
cagggccugaagga

SEQ ID NO: 1953109 - RNA, 18 nt, Shigella flexneri 2a str. 2457T
cagggaucaacauucaga

SEQ ID NO: 1953110 - RNA, 16 nt, Shigella flexneri 2a str. 2457T
cagggaucaacauuca

SEQ ID NO: 1953111 - RNA, 15 nt, Shigella flexneri 2a str. 2457T
cagggaugaagugaa

SEQ ID NO: 1953112 - RNA, 15 nt, Shigella flexneri 2a str. 2457T
cagggauggcuuuua

SEQ ID NO: 1953113 - RNA, 19 nt, Shigella flexneri 2a str. 2457T
cagggaugaagugaagaug

SEQ ID NO: 1953114 - RNA, 21 nt, Shigella flexneri 2a str. 2457T
caggguauggaucccucuuuc

SEQ ID NO: 1953115 - RNA, 18 nt, Shigella flexneri 2a str. 2457T
caggguaccgauagauuu

SEQ ID NO: 1953116 - RNA, 20 nt, Shigella flexneri 2a str. 2457T
caggguagacuuggcuuucu

SEQ ID NO: 1953117 - RNA, 12 nt, Shigella flexneri 2a str. 2457T
cagggcuuacaa

SEQ ID NO: 1953118 - RNA, 19 nt, Shigella flexneri 2a str. 2457T
cagggcgcgggcaacagaa

SEQ ID NO: 1953119 - RNA, 21 nt, Shigella flexneri 2a str. 2457T
cagggcgcgggcaacagaauu

SEQ ID NO: 1953120 - RNA, 17 nt, Shigella flexneri 2a str. 2457T
caggggcagcaccauca

SEQ ID NO: 1953121 - RNA, 13 nt, Shigella flexneri 2a str. 2457T
caggcgcuuggcu

SEQ ID NO: 1953122 - RNA, 16 nt, Shigella flexneri 2a str. 2457T
caggcgcuguaugccu

SEQ ID NO: 1953123 - RNA, 22 nt, Shigella flexneri 2a str. 2457T
caggcguuuguaacccaccaug

SEQ ID NO: 1953124 - RNA, 16 nt, Shigella flexneri 2a str. 2457T
caggcggcuucgcauc

SEQ ID NO: 1953125 - RNA, 14 nt, Shigella flexneri 2a str. 2457T
caggcuacucccag

SEQ ID NO: 1953126 - RNA, 22 nt, Shigella flexneri 2a str. 2457T
caggcuaccgcagugaaauuuc

SEQ ID NO: 1953127 - RNA, 14 nt, Shigella flexneri 2a str. 2457T
caggcuacuuuucc

SEQ ID NO: 1953128 - RNA, 17 nt, Shigella flexneri 2a str. 2457T
caggcuaucgaacaugc

SEQ ID NO: 1953129 - RNA, 15 nt, Shigella flexneri 2a str. 2457T
caggcucgccgccgc

SEQ ID NO: 1953130 - RNA, 14 nt, Shigella flexneri 2a str. 2457T
caggcucugguguu

SEQ ID NO: 1953131 - RNA, 17 nt, Shigella flexneri 2a str. 2457T
caggcucgccgccgcug

SEQ ID NO: 1953132 - RNA, 18 nt, Shigella flexneri 2a str. 2457T
caggcugcaaagucuggg

SEQ ID NO: 1953133 - RNA, 19 nt, Shigella flexneri 2a str. 2457T
caggcugcaaagucugggc

SEQ ID NO: 1953134 - RNA, 23 nt, Shigella flexneri 2a str. 2457T
caggcugaacaacaguuuuaucu

SEQ ID NO: 1953135 - RNA, 20 nt, Shigella flexneri 2a str. 2457T
caggcuuuauucugacgcca

SEQ ID NO: 1953136 - RNA, 23 nt, Shigella flexneri 2a str. 2457T
caggcuuuauucugacgccacca

SEQ ID NO: 1953137 - RNA, 18 nt, Shigella flexneri 2a str. 2457T
cagggaaaaaagccccgu

SEQ ID NO: 1953138 - RNA, 17 nt, Shigella flexneri 2a str. 2457T
caggcuuuuaacaccug

SEQ ID NO: 1953139 - RNA, 23 nt, Shigella flexneri 2a str. 2457T
cagggaaaugacggucaucaccu

SEQ ID NO: 1953140 - RNA, 17 nt, Shigella flexneri 2a str. 2457T
cagggagucuugcugga

SEQ ID NO: 1953141 - RNA, 16 nt, Shigella flexneri 2a str. 2457T
caggcgaaggccucuc

SEQ ID NO: 1953142 - RNA, 23 nt, Shigella flexneri 2a str. 2457T
caggccuacagcauauaaugcaa

SEQ ID NO: 1953143 - RNA, 16 nt, Shigella flexneri 2a str. 2457T
caggccuacauuuucu

SEQ ID NO: 1953144 - RNA, 19 nt, Shigella flexneri 2a str. 2457T
caggccuacaauguuucug

SEQ ID NO: 1953145 - RNA, 17 nt, Shigella flexneri 2a str. 2457T
caggccuacaaguccgu

SEQ ID NO: 1953146 - RNA, 18 nt, Shigella flexneri 2a str. 2457T
caggccuacgugaggcau

SEQ ID NO: 1953147 - RNA, 16 nt, Shigella flexneri 2a str. 2457T
caggccuaacacaugc

SEQ ID NO: 1953148 - RNA, 14 nt, Shigella flexneri 2a str. 2457T
caggccguggauca

SEQ ID NO: 1953149 - RNA, 20 nt, Shigella flexneri 2a str. 2457T
caggccaaaaaacagccccu

SEQ ID NO: 1953150 - RNA, 15 nt, Shigella flexneri 2a str. 2457T
caggcgcgugaaugc

SEQ ID NO: 1953151 - RNA, 22 nt, Shigella flexneri 2a str. 2457T
caggcgcgaauggaaagcccgc

SEQ ID NO: 1953152 - RNA, 18 nt, Shigella flexneri 2a str. 2457T
caggcgagucgagauccc

SEQ ID NO: 1953153 - RNA, 16 nt, Shigella flexneri 2a str. 2457T
caggcagcacugcuua

SEQ ID NO: 1953154 - RNA, 18 nt, Shigella flexneri 2a str. 2457T
caggcagauccaguuacc

SEQ ID NO: 1953155 - RNA, 15 nt, Shigella flexneri 2a str. 2457T
caggcaggucuuuca

SEQ ID NO: 1953156 - RNA, 18 nt, Shigella flexneri 2a str. 2457T
caggcauuugcuccagac

SEQ ID NO: 1953157 - RNA, 18 nt, Shigella flexneri 2a str. 2457T
caggcaguuuauccagcc

SEQ ID NO: 1953158 - RNA, 14 nt, Shigella flexneri 2a str. 2457T
caggcaaaccagua

SEQ ID NO: 1953159 - RNA, 15 nt, Shigella flexneri 2a str. 2457T
caggcaaaccaguac

SEQ ID NO: 1953160 - RNA, 22 nt, Shigella flexneri 2a str. 2457T
caggcaaacuucacgcauuuac

SEQ ID NO: 1953161 - RNA, 23 nt, Shigella flexneri 2a str. 2457T
caggcaacaacaaccgaugaacu

SEQ ID NO: 1953162 - RNA, 16 nt, Shigella flexneri 2a str. 2457T
caggcaacagggaaau

SEQ ID NO: 1953163 - RNA, 19 nt, Shigella flexneri 2a str. 2457T
caggauuuccagcucaaag

SEQ ID NO: 1953164 - RNA, 21 nt, Shigella flexneri 2a str. 2457T
caggauucacaauauuaauac

SEQ ID NO: 1953165 - RNA, 20 nt, Shigella flexneri 2a str. 2457T
caggcaaguagcgccauacu

SEQ ID NO: 1953166 - RNA, 21 nt, Shigella flexneri 2a str. 2457T
caggcaagccgcuaacagcag

SEQ ID NO: 1953167 - RNA, 17 nt, Shigella flexneri 2a str. 2457T
caggcacaccgccgccg

SEQ ID NO: 1953168 - RNA, 17 nt, Shigella flexneri 2a str. 2457T
caggcaccagccccugg

SEQ ID NO: 1953169 - RNA, 14 nt, Shigella flexneri 2a str. 2457T
caggcaccagcccc

SEQ ID NO: 1953170 - RNA, 12 nt, Shigella flexneri 2a str. 2457T
caggagcuggau

SEQ ID NO: 1953171 - RNA, 20 nt, Shigella flexneri 2a str. 2457T
caggagcuggaugcccaaca

SEQ ID NO: 1953172 - RNA, 15 nt, Shigella flexneri 2a str. 2457T
caggagucaugucau

SEQ ID NO: 1953173 - RNA, 16 nt, Shigella flexneri 2a str. 2457T
caggaguagcucuggg

SEQ ID NO: 1953174 - RNA, 17 nt, Shigella flexneri 2a str. 2457T
caggaguagcucugggu

SEQ ID NO: 1953175 - RNA, 20 nt, Shigella flexneri 2a str. 2457T
aaaauuucccccacagcucu

SEQ ID NO: 1953176 - RNA, 15 nt, Shigella flexneri 2a str. 2457T
caggacgaaaaauca

SEQ ID NO: 1953177 - RNA, 16 nt, Shigella flexneri 2a str. 2457T
caggacgaaaaaucac

SEQ ID NO: 1953178 - RNA, 15 nt, Shigella flexneri 2a str. 2457T
caggaccguucgcua

SEQ ID NO: 1953179 - RNA, 13 nt, Shigella flexneri 2a str. 2457T
caggaucagcucc

SEQ ID NO: 1953180 - RNA, 14 nt, Shigella flexneri 2a str. 2457T
caggaucagacaca

SEQ ID NO: 1953181 - RNA, 17 nt, Shigella flexneri 2a str. 2457T
caggaucuccagcuccc

SEQ ID NO: 1953182 - RNA, 16 nt, Shigella flexneri 2a str. 2457T
caggaugcggcuaauu

SEQ ID NO: 1953183 - RNA, 16 nt, Shigella flexneri 2a str. 2457T
caggaugggcaacgcg

SEQ ID NO: 1953184 - RNA, 21 nt, Shigella flexneri 2a str. 2457T
caggauggcuggccgugcaga

SEQ ID NO: 1953185 - RNA, 21 nt, Shigella flexneri 2a str. 2457T
cagcuucgcuucccaacgcag

SEQ ID NO: 1953186 - RNA, 22 nt, Shigella flexneri 2a str. 2457T
cagcuugucuacgccuuguuuc

SEQ ID NO: 1953187 - RNA, 16 nt, Shigella flexneri 2a str. 2457T
cagcuuucaccugcgc

SEQ ID NO: 1953188 - RNA, 19 nt, Shigella flexneri 2a str. 2457T
caggaaaacuacacacugg

SEQ ID NO: 1953189 - RNA, 23 nt, Shigella flexneri 2a str. 2457T
caggaaaacuacacacuggaucu

SEQ ID NO: 1953190 - RNA, 19 nt, Shigella flexneri 2a str. 2457T
cagcuuucagcagcggcuc

SEQ ID NO: 1953191 - RNA, 13 nt, Shigella flexneri 2a str. 2457T
caggaaaugggug

SEQ ID NO: 1953192 - RNA, 17 nt, Shigella flexneri 2a str. 2457T
caggaaaucgucgaggg

SEQ ID NO: 1953193 - RNA, 14 nt, Shigella flexneri 2a str. 2457T
caggaacugcucau

SEQ ID NO: 1953194 - RNA, 15 nt, Shigella flexneri 2a str. 2457T
caggaauggcgaagg

SEQ ID NO: 1953195 - RNA, 12 nt, Shigella flexneri 2a str. 2457T
caggaaggccag

SEQ ID NO: 1953196 - RNA, 14 nt, Shigella flexneri 2a str. 2457T
caggaaggccagca

SEQ ID NO: 1953197 - RNA, 14 nt, Shigella flexneri 2a str. 2457T
caggaagccccagc

SEQ ID NO: 1953198 - RNA, 15 nt, Shigella flexneri 2a str. 2457T
caggaagccccagcu

SEQ ID NO: 1953199 - RNA, 17 nt, Shigella flexneri 2a str. 2457T
cagcugcucauuacagu

SEQ ID NO: 1953200 - RNA, 16 nt, Shigella flexneri 2a str. 2457T
cagcugcgcguuaucu

SEQ ID NO: 1953201 - RNA, 12 nt, Shigella flexneri 2a str. 2457T
cagcugcgugcc

SEQ ID NO: 1953202 - RNA, 18 nt, Shigella flexneri 2a str. 2457T
cagcugccgaaccacuga

SEQ ID NO: 1953203 - RNA, 23 nt, Shigella flexneri 2a str. 2457T
cagcugcgcaucaugccacccag

SEQ ID NO: 1953204 - RNA, 17 nt, Shigella flexneri 2a str. 2457T
cagcugauccuucuguu

SEQ ID NO: 1953205 - RNA, 22 nt, Shigella flexneri 2a str. 2457T
aaaauucuuacguaauuuauaa

SEQ ID NO: 1953206 - RNA, 20 nt, Shigella flexneri 2a str. 2457T
cagcguuuccagcaccaguu

SEQ ID NO: 1953207 - RNA, 17 nt, Shigella flexneri 2a str. 2457T
cagcguuuccagcacca

SEQ ID NO: 1953208 - RNA, 19 nt, Human
gccuucggccuccauccug

SEQ ID NO: 1953209 - RNA, 16 nt, Human
uauccuucagccugaa

SEQ ID NO: 1953210 - RNA, 16 nt, Human
uggagcucguggaaca

SEQ ID NO: 1953211 - RNA, 16 nt, Human
uggagcucgugggaca

SEQ ID NO: 1953212 - RNA, 18 nt, Human
ugggagaaucacuugaac

SEQ ID NO: 1953213 - RNA, 12 nt, Human
uguugacauggg

SEQ ID NO: 1953214 - RNA, 23 nt, Human
uguuggagaagaacugaaaucau

SEQ ID NO: 1953215 - RNA, 22 nt, Human
ugaacccauauuuguacaccaa

SEQ ID NO: 1953216 - RNA, 14 nt, Human
ucaccaaggcugau

SEQ ID NO: 1953217 - RNA, 22 nt, Human
ugauaaauggcuuccuggcaau

SEQ ID NO: 1953218 - RNA, 15 nt, Human
ugaauggcuaagcaa

SEQ ID NO: 1953219 - RNA, 19 nt, Human
ugagagacacacugaagaa

SEQ ID NO: 1953220 - RNA, 15 nt, Human
gcagugagccgagau

SEQ ID NO: 1953221 - RNA, 20 nt, Human
gagcucguggaacaguuacc

SEQ ID NO: 1953222 - RNA, 22 nt, Human
gaauaauccuaaacauaugaau

SEQ ID NO: 1953223 - RNA, 22 nt, Human
gaauuaguuuuauaugcuucug

SEQ ID NO: 1953224 - RNA, 13 nt, Human
cuuuuuauggcac

SEQ ID NO: 1953225 - RNA, 19 nt, Human
cuuuccacagaagcuccag

SEQ ID NO: 1953226 - RNA, 23 nt, Human
gaaaacuuuaugcuaagugaaau

SEQ ID NO: 1953227 - RNA, 17 nt, Human
gacgcucucuggccuuc

SEQ ID NO: 1953228 - RNA, 15 nt, Human
gacgcucucuggccu

SEQ ID NO: 1953229 - RNA, 15 nt, Human
gacauuugcucaugg

SEQ ID NO: 1953230 - RNA, 15 nt, Human
cugagcuugcagaga

SEQ ID NO: 1953231 - RNA, 14 nt, Human
cugcaaagcccagc

SEQ ID NO: 1953232 - RNA, 14 nt, Human
cucuggcuccagcu

SEQ ID NO: 1953233 - RNA, 13 nt, Human
cucuggccuucgg

SEQ ID NO: 1953234 - RNA, 17 nt, Human
cuaugucauuugcugga

SEQ ID NO: 1953235 - RNA, 17 nt, Human
cuaugcagagguccaca

SEQ ID NO: 1953236 - RNA, 13 nt, Human
cuaucuuugagcg

SEQ ID NO: 1953237 - RNA, 16 nt, Human
cgcccacuagacccac

SEQ ID NO: 1953238 - RNA, 13 nt, Human
cgcucucuggccu

SEQ ID NO: 1953239 - RNA, 17 nt, Human
cguaaucguguccccua

SEQ ID NO: 1953240 - RNA, 17 nt, Human
aaaagcaucacaugaac

SEQ ID NO: 1953241 - RNA, 13 nt, Human
aaauugucacagg

SEQ ID NO: 1953242 - RNA, 15 nt, Human
aacucccuuucaaca

SEQ ID NO: 1953243 - RNA, 19 nt, Human
aagugacaagcucacagac

SEQ ID NO: 1953244 - RNA, 19 nt, Human
acucguuaauuuguagugu

SEQ ID NO: 1953245 - RNA, 13 nt, Human
acugccuucucaa

SEQ ID NO: 1953246 - RNA, 17 nt, Human
acgcucucuggccuucg

SEQ ID NO: 1953247 - RNA, 20 nt, Human
aagacccaaaaggcagaagc

SEQ ID NO: 1953248 - RNA, 15 nt, Human
agaagaacugaaauc

SEQ ID NO: 1953249 - RNA, 15 nt, Human
agggaggacgcucuc

SEQ ID NO: 1953250 - RNA, 17 nt, Human
cgagaaaacaauaacga

SEQ ID NO: 1953251 - RNA, 13 nt, Human
cgagauacagaau

SEQ ID NO: 1953252 - RNA, 21 nt, Human
cgaaguauccuucagccugaa

SEQ ID NO: 1953253 - RNA, 14 nt, Human
cgagcguugcuggg

SEQ ID NO: 1953254 - RNA, 12 nt, Human
ccugcaaagccc

SEQ ID NO: 1953255 - RNA, 23 nt, Human
ccaccagucugacuguuuccauc

SEQ ID NO: 1953256 - RNA, 23 nt, Human
cccacagcuguaugauucccagc

SEQ ID NO: 1953257 - RNA, 22 nt, Human
augugcuaguaauuggaaaggc

SEQ ID NO: 1953258 - RNA, 18 nt, Human
auguuuaauucugaaagc

SEQ ID NO: 1953259 - RNA, 21 nt, Human
augggacauuugcucauggaa

SEQ ID NO: 1953260 - RNA, 20 nt, Human
caagccagauuuuccugaaa

SEQ ID NO: 1953261 - RNA, 14 nt, Human
caagaaaugaaagc

SEQ ID NO: 1953262 - RNA, 19 nt, Human
caacacacagauuugagcu

SEQ ID NO: 1953263 - RNA, 13 nt, Human
cagauccuggaaa

SEQ ID NO: 1953264 - RNA, 18 nt, Human
cagccucuuagaugcagu

SEQ ID NO: 1953265 - RNA, 22 nt, Human
ccaaauguucaucaaugaauga

SEQ ID NO: 1953266 - RNA, 16 nt, Human
ggaacaguuaccucug

SEQ ID NO: 1953267 - RNA, 19 nt, Human
gagcucgugggacagucac

SEQ ID NO: 1953268 - RNA, 20 nt, Human
gaggacgcucucuggccuuc

SEQ ID NO: 1953269 - RNA, 18 nt, Human
gaucaccugcccugcuga

SEQ ID NO: 1953270 - RNA, 21 nt, Human
gaucagcuuauugucuaguga

SEQ ID NO: 1953271 - RNA, 21 nt, Human
cugcucaauaaaguacaagag

SEQ ID NO: 1953272 - RNA, 19 nt, Human
cuagaguuuagcuggaaaa

SEQ ID NO: 1953273 - RNA, 22 nt, Human
gaauugaggacacugauauggg

SEQ ID NO: 1953274 - RNA, 14 nt, Human
gaauuacauuugua

SEQ ID NO: 1953275 - RNA, 23 nt, Human
cuucggccuccauccugaggcuc

SEQ ID NO: 1953276 - RNA, 20 nt, Human
uccauccugaggcuccacuu

SEQ ID NO: 1953277 - RNA, 13 nt, Human
uaagaagugaaaa

SEQ ID NO: 1953278 - RNA, 20 nt, Human
ggacgcucucuggccuucgg

SEQ ID NO: 1953279 - RNA, 16 nt, Human
ggacgcucucuggccu

SEQ ID NO: 1953280 - RNA, 16 nt, Human
uaaaagacagugaaag

SEQ ID NO: 1953281 - RNA, 13 nt, Human
uccuggaaaucag

SEQ ID NO: 1953282 - RNA, 20 nt, Human
uccaucaaggguacacugcc

SEQ ID NO: 1953283 - RNA, 19 nt, Human
ugaaagcagggacuugaac

SEQ ID NO: 1953284 - RNA, 16 nt, Human
ugagcagucaggaaag

SEQ ID NO: 1953285 - RNA, 15 nt, Human
ugccuguaaucacag

SEQ ID NO: 1953286 - RNA, 21 nt, Human
ugggacagucaccucauggaa

SEQ ID NO: 1953287 - RNA, 12 nt, Human
ugggaggcugag

SEQ ID NO: 1953288 - RNA, 17 nt, Human
uucucuucacagucaca

SEQ ID NO: 1953289 - RNA, 19 nt, Human
uguuaaaacugggacaggg

SEQ ID NO: 1953290 - RNA, 22 nt, Human
uuggucugugagaugcuagaac

SEQ ID NO: 1953291 - RNA, 17 nt, Human
uaaucaccaaggcugau

SEQ ID NO: 1953292 - RNA, 22 nt, Human
gugccccugcacuccagccuga

SEQ ID NO: 1953293 - RNA, 12 nt, Human
gugagaugcuag

SEQ ID NO: 1953294 - RNA, 18 nt, Human
uccauccugaggcuccac

SEQ ID NO: 1953295 - RNA, 16 nt, Human
uccauccugaggcucc

SEQ ID NO: 1953296 - RNA, 15 nt, Human
uccauccugaggcuc

SEQ ID NO: 1953297 - RNA, 23 nt, Human
ucaauaaaauccauacauuugug

SEQ ID NO: 1953298 - RNA, 13 nt, Human
ggaggacgcucuc

SEQ ID NO: 1953299 - RNA, 15 nt, Human
guagauaggccaugg

SEQ ID NO: 1953300 - RNA, 22 nt, Human
aaagcuccauuuuuagugaaau

SEQ ID NO: 1953301 - RNA, 20 nt, Human
acacagauuugagcucagcc

SEQ ID NO: 1953302 - RNA, 15 nt, Human
acgcucucuggccuu

SEQ ID NO: 1953303 - RNA, 14 nt, Human
accacugcagaaga

SEQ ID NO: 1953304 - RNA, 13 nt, Human
acccuugccaugu

SEQ ID NO: 1953305 - RNA, 17 nt, Human
agaacucccuuucaaca

SEQ ID NO: 1953306 - RNA, 15 nt, Human
aauaucacuugucaa

SEQ ID NO: 1953307 - RNA, 14 nt, Human
auaccacaggaacc

SEQ ID NO: 1953308 - RNA, 15 nt, Human
auuauguuaaaacug

SEQ ID NO: 1953309 - RNA, 16 nt, Human
auuccacagcugcuca

SEQ ID NO: 1953310 - RNA, 13 nt, Human
auuugaaauauug

SEQ ID NO: 1953311 - RNA, 23 nt, Human
auuuuggcaagcucuaucaccaa

SEQ ID NO: 1953312 - RNA, 12 nt, Human
caaauuuacaga

SEQ ID NO: 1953313 - RNA, 16 nt, Human
agcucguggaacaguu

SEQ ID NO: 1953314 - RNA, 15 nt, Human
agcucgugggacagu

SEQ ID NO: 1953315 - RNA, 14 nt, Human
agccugaucaccug

SEQ ID NO: 1953316 - RNA, 16 nt, Human
acagauccccaagccu

SEQ ID NO: 1953317 - RNA, 16 nt, Human
aguuuuugugaaaagc

SEQ ID NO: 1953318 - RNA, 13 nt, Human
aguguuugaaagc

SEQ ID NO: 1953319 - RNA, 14 nt, Human
aggaauugacccac

SEQ ID NO: 1953320 - RNA, 14 nt, Human
cagauccuggaaau

SEQ ID NO: 1953321 - RNA, 17 nt, Human
caagcauuuagauguau

SEQ ID NO: 1953322 - RNA, 14 nt, Human
auuuuaaucaccaa

SEQ ID NO: 1953323 - RNA, 16 nt, Human
caaaaggauaaugaau

SEQ ID NO: 1953324 - RNA, 17 nt, Human
auugucacaggacagcc

SEQ ID NO: 1953325 - RNA, 18 nt, Human
auuccacagcugcucaau

SEQ ID NO: 1953326 - RNA, 14 nt, Human
caggcuagauguau

SEQ ID NO: 1953327 - RNA, 17 nt, Human
cauccugaggcuccacu

SEQ ID NO: 1953328 - RNA, 17 nt, Human
caucccuuaccugggaa

SEQ ID NO: 1953329 - RNA, 13 nt, Human
cauccuacaagac

SEQ ID NO: 1953330 - RNA, 14 nt, Human
cagugauuaccagg

SEQ ID NO: 1953331 - RNA, 12 nt, Human
caugauccugca

SEQ ID NO: 1953332 - RNA, 15 nt, Human
ccagccagcacagcc

SEQ ID NO: 1953333 - RNA, 18 nt, Human
auguuuacagauccccaa

SEQ ID NO: 1953334 - RNA, 18 nt, Human
auguugacaugggacauu

SEQ ID NO: 1953335 - RNA, 16 nt, Human
auguuaaaacugggac

SEQ ID NO: 1953336 - RNA, 14 nt, Human
auccuucagccuga

SEQ ID NO: 1953337 - RNA, 16 nt, Human
augcaguucugaagaa

SEQ ID NO: 1953338 - RNA, 19 nt, Human
aucaccugcccugcugagu

SEQ ID NO: 1953339 - RNA, 14 nt, Human
agcucuaucaccaa

SEQ ID NO: 1953340 - RNA, 18 nt, Human
ucacauuccaagccucau

SEQ ID NO: 1953341 - RNA, 14 nt, Human
ugauaacuggaaac

SEQ ID NO: 1953342 - RNA, 12 nt, Human
ugauccugcaau

SEQ ID NO: 1953343 - RNA, 16 nt, Human
ugcacuccagccugag

SEQ ID NO: 1953344 - RNA, 14 nt, Human
ucuggagggaagcc

SEQ ID NO: 1953345 - RNA, 16 nt, Human
ugagcgacagugagac

SEQ ID NO: 1953346 - RNA, 16 nt, Human
ggugagugccuguaau

SEQ ID NO: 1953347 - RNA, 19 nt, Human
gggacagggaggacgcucu

SEQ ID NO: 1953348 - RNA, 19 nt, Human
gugauaguuguaccgcaau

SEQ ID NO: 1953349 - RNA, 20 nt, Human
gguuuuaauuagugaacugc

SEQ ID NO: 1953350 - RNA, 22 nt, Human
guguaaguagauaggccauggg

SEQ ID NO: 1953351 - RNA, 11 nt, Human
gaaaauaacga

SEQ ID NO: 1953352 - RNA, 16 nt, Human
cuuuucccaacuccag

SEQ ID NO: 1953353 - RNA, 17 nt, Human
cuuggggcugaugcagu

SEQ ID NO: 1953354 - RNA, 14 nt, Human
cugcccauccugcc

SEQ ID NO: 1953355 - RNA, 16 nt, Human
agccagacaucaacag

SEQ ID NO: 1953356 - RNA, 15 nt, Human
gaaaucauacuucuu

SEQ ID NO: 1953357 - RNA, 21 nt, Human
cucagcccuggugggcagaga

SEQ ID NO: 1953358 - RNA, 23 nt, Human
agcagcuuauucacaagacccaa

SEQ ID NO: 1953359 - RNA, 23 nt, Human
agaugcuagaacucccuuucaac

SEQ ID NO: 1953360 - RNA, 17 nt, Human
cugcacuccagccugag

SEQ ID NO: 1953361 - RNA, 14 nt, Human
uugccaugugcuag

SEQ ID NO: 1953362 - RNA, 22 nt, Human
gucacaggaaguagaggaggcc

SEQ ID NO: 1953363 - RNA, 23 nt, Human
acgaggauugggaaaaaguaauu

SEQ ID NO: 1953364 - RNA, 14 nt, Human
uugggaaaaaguaa

SEQ ID NO: 1953365 - RNA, 15 nt, Human
ugggacagggaggac

SEQ ID NO: 1953366 - RNA, 14 nt, Human
aucaccaaggcuga

SEQ ID NO: 1953367 - RNA, 23 nt, Human
ugaaaaucuuauaauuuaaaaua

SEQ ID NO: 1953368 - RNA, 18 nt, Human
aaaguaacccuacaaaac

SEQ ID NO: 1953369 - RNA, 13 nt, Human
gagacagcucugc

SEQ ID NO: 1953370 - RNA, 22 nt, Human
agacucugucucaguccaugaa

SEQ ID NO: 1953371 - RNA, 14 nt, Human
gccucagucucccu

SEQ ID NO: 1953372 - RNA, 16 nt, Human
uggcaagcucuaucac

SEQ ID NO: 1953373 - RNA, 13 nt, Human
auuuuaaaagaau

SEQ ID NO: 1953374 - RNA, 19 nt, Human
acaauaacgauaaaagaca

SEQ ID NO: 1953375 - RNA, 17 nt, Human
cugcacuccagccugag

SEQ ID NO: 1953376 - RNA, 19 nt, Human
uggaaauguuuacagaucc

SEQ ID NO: 1953377 - RNA, 19 nt, Human
gcuuguauuccuuuuucuc

SEQ ID NO: 1953378 - RNA, 18 nt, Human
uuuuauaucaauuuaaaa

SEQ ID NO: 1953379 - RNA, 20 nt, Human
uguaagaaaauaucacuugu

SEQ ID NO: 1953380 - RNA, 11 nt, Human
ugcagugagcc

SEQ ID NO: 1953381 - RNA, 16 nt, Human
ggaugccccguccccc

SEQ ID NO: 1953382 - RNA, 12 nt, Human
uauaauuuaaaa

SEQ ID NO: 1953383 - RNA, 14 nt, Human
cagagguugcagug

SEQ ID NO: 1953384 - RNA, 19 nt, Human
augcagagguccacaacac

SEQ ID NO: 1953385 - RNA, 15 nt, Human
ugcagauaaacagua

SEQ ID NO: 1953386 - RNA, 23 nt, Human
augucaauucuugccaaauauaa

SEQ ID NO: 1953387 - RNA, 17 nt, Human
acacuaagagagaauga

SEQ ID NO: 1953388 - RNA, 19 nt, Human
gcacuaguauuucuaugaa

SEQ ID NO: 1953389 - RNA, 19 nt, Human
auuuacagagacagaaagc

SEQ ID NO: 1953390 - RNA, 21 nt, Human
aauuuacagagacagaaagca

SEQ ID NO: 1953391 - RNA, 12 nt, Human
guagacacacau

SEQ ID NO: 1953392 - RNA, 14 nt, Human
cuggccgggagccu

SEQ ID NO: 1953393 - RNA, 16 nt, Human
aauuucuucaacuccc

SEQ ID NO: 1953394 - RNA, 13 nt, Human
ucuauaauuuaaa

SEQ ID NO: 1953395 - RNA, 14 nt, Human
ugagcucagcccug

SEQ ID NO: 1953396 - RNA, 14 nt, Human
ugacacuuaaaaau

SEQ ID NO: 1953397 - RNA, 16 nt, Human
auacauguuacaacac

SEQ ID NO: 1953398 - RNA, 20 nt, Human
gacauuugcucauggaauug

SEQ ID NO: 1953399 - RNA, 17 nt, Human
gccuccuuuuaaaguaa

SEQ ID NO: 1953400 - RNA, 16 nt, Human
aaaagcaucacaugaa

SEQ ID NO: 1953401 - RNA, 13 nt, Human
acaagagcuuaac

SEQ ID NO: 1953402 - RNA, 21 nt, Human
ucaagucuuucacauuuaaau

SEQ ID NO: 1953403 - RNA, 15 nt, Human
auuucauucaauauc

SEQ ID NO: 1953404 - RNA, 16 nt, Human
aaaaauuccaagugau

SEQ ID NO: 1953405 - RNA, 15 nt, Human
cuguaaaauaauaac

SEQ ID NO: 1953406 - RNA, 13 nt, Human
gguccacaacaca

SEQ ID NO: 1953407 - RNA, 23 nt, Human
cucagucucccucccuuggggcc

SEQ ID NO: 1953408 - RNA, 15 nt, Human
uucacuguaaaauaa

SEQ ID NO: 1953409 - RNA, 21 nt, Human
gccaaauauaaauaaaaauaa

SEQ ID NO: 1953410 - RNA, 22 nt, Human
ggcauuuaggccaugggacagg

SEQ ID NO: 1953411 - RNA, 23 nt, Human
cccacuggacucaccucccccau

SEQ ID NO: 1953412 - RNA, 20 nt, Human
aaggagccaaacauccuaca

SEQ ID NO: 1953413 - RNA, 14 nt, Human
uauguauauuuuau

SEQ ID NO: 1953414 - RNA, 12 nt, Human
acacuuaaaaau

SEQ ID NO: 1953415 - RNA, 19 nt, Human
ggagccugaucaccugccc

SEQ ID NO: 1953416 - RNA, 13 nt, Human
cacaacuauauug

SEQ ID NO: 1953417 - RNA, 14 nt, Human
aauggcuaagcaaa

SEQ ID NO: 1953418 - RNA, 16 nt, Human
ccuaugcagaggucca

SEQ ID NO: 1953419 - RNA, 14 nt, Human
aguuuuuuuuuaaa

SEQ ID NO: 1953420 - RNA, 13 nt, Human
gaagaacugaaau

SEQ ID NO: 1953421 - RNA, 20 nt, Human
acaugagguacugagaguga

SEQ ID NO: 1953422 - RNA, 18 nt, Human
guauuauuuuuuaaaaaa

SEQ ID NO: 1953423 - RNA, 15 nt, Human
gucaaugcagccccc

SEQ ID NO: 1953424 - RNA, 20 nt, Human
cccugcacuccagccugagc

SEQ ID NO: 1953425 - RNA, 14 nt, Human
cagauccuggaaau

SEQ ID NO: 1953426 - RNA, 13 nt, Human
cccuccuuaucaa

SEQ ID NO: 1953427 - RNA, 18 nt, Human
uuuauguuuaauucugaa

SEQ ID NO: 1953428 - RNA, 18 nt, Human
ucaaggguacacugccuu

SEQ ID NO: 1953429 - RNA, 17 nt, Human
aggguguguaaguagau

SEQ ID NO: 1953430 - RNA, 18 nt, Human
aaauaacgauaaaagaca

SEQ ID NO: 1953431 - RNA, 17 nt, Human
agugagacagcucugca

SEQ ID NO: 1953432 - RNA, 11 nt, Human
cauaugaaaag

SEQ ID NO: 1953433 - RNA, 22 nt, Human
uagacacacaugaaguccaagc

SEQ ID NO: 1953434 - RNA, 23 nt, Human
uuuccaucaaggguacacugccu

SEQ ID NO: 1953435 - RNA, 17 nt, Human
agacacacugaagaagc

SEQ ID NO: 1953436 - RNA, 19 nt, Human
augaaagcagggacuugaa

SEQ ID NO: 1953437 - RNA, 14 nt, Human
ggccuucggccucc

SEQ ID NO: 1953438 - RNA, 21 nt, Human
acaugagguacugagagugaa

SEQ ID NO: 1953439 - RNA, 17 nt, Human
uauauuguagauaauac

SEQ ID NO: 1953440 - RNA, 19 nt, Human
aauuuuuauauuugaaaua

SEQ ID NO: 1953441 - RNA, 20 nt, Human
aacaaugcuguauuuuaaaa

SEQ ID NO: 1953442 - RNA, 20 nt, Human
uagaugcaguucugaagaag

SEQ ID NO: 1953443 - RNA, 18 nt, Human
guuaguauuguccagguc

SEQ ID NO: 1953444 - RNA, 21 nt, Human
aaacaauaacgauaaaagaca

SEQ ID NO: 1953445 - RNA, 18 nt, Human
gaauaauccuaaacauau

SEQ ID NO: 1953446 - RNA, 20 nt, Human
aguuuuuuuuuaaaaaagaa

SEQ ID NO: 1953447 - RNA, 15 nt, Human
aguucugaagaagau

SEQ ID NO: 1953448 - RNA, 14 nt, Human
guaacugauuugua

SEQ ID NO: 1953449 - RNA, 17 nt, Human
uacaaaugcauuucuaa

SEQ ID NO: 1953450 - RNA, 16 nt, Human
aauugacccacaagaa

SEQ ID NO: 1953451 - RNA, 21 nt, Human
cuaccaaaaaucucaauauuu

SEQ ID NO: 1953452 - RNA, 14 nt, Human
gaaugauuaugaau

SEQ ID NO: 1953453 - RNA, 22 nt, Human
aaccuacacgagauacagaauu

SEQ ID NO: 1953454 - RNA, 21 nt, Human
aaaagguauuuuaaucaccaa

SEQ ID NO: 1953455 - RNA, 22 nt, Human
ccccuuccuaauuccacagcug

SEQ ID NO: 1953456 - RNA, 14 nt, Human
uccagauccuggaa

SEQ ID NO: 1953457 - RNA, 14 nt, Human
auccaaugaaauga

SEQ ID NO: 1953458 - RNA, 15 nt, Human
acaagacccaaaagg

SEQ ID NO: 1953459 - RNA, 17 nt, Human
gaagaccucauuuugaa

SEQ ID NO: 1953460 - RNA, 13 nt, Human
aaaaauccuacuu

SEQ ID NO: 1953461 - RNA, 23 nt, Human
ggucucagugucaaugcagcccc

SEQ ID NO: 1953462 - RNA, 13 nt, Human
gcuggagcucugc

SEQ ID NO: 1953463 - RNA, 13 nt, Human
auuggacaguaaa

SEQ ID NO: 1953464 - RNA, 20 nt, Human
uggaauaauccuaaacauau

SEQ ID NO: 1953465 - RNA, 12 nt, Human
acacugaagaag

SEQ ID NO: 1953466 - RNA, 14 nt, Human
ugcuguauuuuaaa

SEQ ID NO: 1953467 - RNA, 21 nt, Human
ccaaauauaaauaaaaauaau

SEQ ID NO: 1953468 - RNA, 14 nt, Human
cugaggcuccacuu

SEQ ID NO: 1953469 - RNA, 16 nt, Human
gcuucacuguaaaaua

SEQ ID NO: 1953470 - RNA, 17 nt, Human
aaagcagggacuugaac

SEQ ID NO: 1953471 - RNA, 20 nt, Human
ggguuccuuccucugagccu

SEQ ID NO: 1953472 - RNA, 20 nt, Human
ugagucccaggcugagccuc

SEQ ID NO: 1953473 - RNA, 21 nt, Human
uuauguuuaauucugaaagca

SEQ ID NO: 1953474 - RNA, 19 nt, Human
cagcuacuugggaggcuga

SEQ ID NO: 1953475 - RNA, 15 nt, Human
aagaagugaaaaucu

SEQ ID NO: 1953476 - RNA, 15 nt, Human
agacaaggaaaaaau

SEQ ID NO: 1953477 - RNA, 19 nt, Human
cccauggcacucuauguuc

SEQ ID NO: 1953478 - RNA, 11 nt, Human
auuuuugaagc

SEQ ID NO: 1953479 - RNA, 18 nt, Human
agaagcaacccaaauguu

SEQ ID NO: 1953480 - RNA, 14 nt, Human
ccacuggacucacc

SEQ ID NO: 1953481 - RNA, 18 nt, Human
aggaaaaaauaacaauga

SEQ ID NO: 1953482 - RNA, 16 nt, Human
agagguccacaacaca

SEQ ID NO: 1953483 - RNA, 19 nt, Human
auagcuacuaauuuuaaaa

SEQ ID NO: 1953484 - RNA, 19 nt, Human
cuuccagauccuggaaauc

SEQ ID NO: 1953485 - RNA, 17 nt, Human
uaauuuuuauauuugaa

SEQ ID NO: 1953486 - RNA, 20 nt, Human
uccagccugagcgacaguga

SEQ ID NO: 1953487 - RNA, 15 nt, Human
ugauuucauucaaua

SEQ ID NO: 1953488 - RNA, 13 nt, Human
uggcuccagcugg

SEQ ID NO: 1953489 - RNA, 21 nt, Human
auauaugcuaagucuuauaua

SEQ ID NO: 1953490 - RNA, 15 nt, Human
aaauauuuauuuuaa

SEQ ID NO: 1953491 - RNA, 19 nt, Human
gccugaucaccugcccugc

SEQ ID NO: 1953492 - RNA, 19 nt, Human
caacucccugccccccagc

SEQ ID NO: 1953493 - RNA, 21 nt, Human
auuuuuucucuaggaaauauu

SEQ ID NO: 1953494 - RNA, 17 nt, Human
caagacccaaaaggcag

SEQ ID NO: 1953495 - RNA, 23 nt, Human
cuucaacucccugccccccagcc

SEQ ID NO: 1953496 - RNA, 22 nt, Human
gcuaaaacaagcacuaaacaaa

SEQ ID NO: 1953497 - RNA, 13 nt, Human
ccccagcccuccu

SEQ ID NO: 1953498 - RNA, 14 nt, Human
acgagaaaacaaua

SEQ ID NO: 1953499 - RNA, 14 nt, Human
agacaucaacagau

SEQ ID NO: 1953500 - RNA, 17 nt, Human
auguugacaugggacau

SEQ ID NO: 1953501 - RNA, 13 nt, Human
acagcccuucuuu

SEQ ID NO: 1953502 - RNA, 20 nt, Human
cuacuuccccuuccuaauuc

SEQ ID NO: 1953503 - RNA, 21 nt, Human
aaauaauuuuuauauuugaaa

SEQ ID NO: 1953504 - RNA, 16 nt, Human
aaaauaacaauaaaag

SEQ ID NO: 1953505 - RNA, 16 nt, Human
gucuaucuuugagcgc

SEQ ID NO: 1953506 - RNA, 22 nt, Human
cuuguaaaggaauuuaaaaauc

SEQ ID NO: 1953507 - RNA, 22 nt, Human
uuuuauagcuacuaauuuuaaa

SEQ ID NO: 1953508 - RNA, 22 nt, Human
agaagcaccaaucaugaauuag

SEQ ID NO: 1953509 - RNA, 15 nt, Human
cacuuggucugugag

SEQ ID NO: 1953510 - RNA, 21 nt, Human
cccuauccuacuuccccuucc

SEQ ID NO: 1953511 - RNA, 23 nt, Human
aaauuuacagagacagaaagcag

SEQ ID NO: 1953512 - RNA, 19 nt, Human
ucaguccaugaagauguag

SEQ ID NO: 1953513 - RNA, 15 nt, Human
ccagcacagccucuu

SEQ ID NO: 1953514 - RNA, 12 nt, Human
cagugaaagaaa

SEQ ID NO: 1953515 - RNA, 20 nt, Human
agcuuauugucuagugaaac

SEQ ID NO: 1953516 - RNA, 12 nt, Human
agacagugaaag

SEQ ID NO: 1953517 - RNA, 23 nt, Human
cuuaagaagacugcauuauauuu

SEQ ID NO: 1953518 - RNA, 20 nt, Human
caagccuccuuuuaaaguaa

SEQ ID NO: 1953519 - RNA, 21 nt, Human
augcuacaggauuugaaauug

SEQ ID NO: 1953520 - RNA, 20 nt, Human
uauacugugugcuaaaacaa

SEQ ID NO: 1953521 - RNA, 13 nt, Human
gauuguaaaaugg

SEQ ID NO: 1953522 - RNA, 15 nt, Human
aaauauaaauaaaaa

SEQ ID NO: 1953523 - RNA, 12 nt, Human
cucccugccccc

SEQ ID NO: 1953524 - RNA, 15 nt, Human
uacaaaugcauuucu

SEQ ID NO: 1953525 - RNA, 18 nt, Human
cagggaggacgcucucug

SEQ ID NO: 1953526 - RNA, 20 nt, Human
agaagaacugaaaucauacu

SEQ ID NO: 1953527 - RNA, 19 nt, Human
aauauuauguuaaaacugg

SEQ ID NO: 1953528 - RNA, 21 nt, Human
caccagucugacuguuuccau

SEQ ID NO: 1953529 - RNA, 19 nt, Human
cagauccccaagccuggca

SEQ ID NO: 1953530 - RNA, 18 nt, Human
auuuguauaaaauaauuu

SEQ ID NO: 1953531 - RNA, 21 nt, Human
uguauaaaauaauuuuuauau

SEQ ID NO: 1953532 - RNA, 22 nt, Human
uguauacugugugcuaaaacaa

SEQ ID NO: 1953533 - RNA, 22 nt, Human
aaauaacaaugaaaguugauaa

SEQ ID NO: 1953534 - RNA, 15 nt, Human
cagucucccucccuu

SEQ ID NO: 1953535 - RNA, 16 nt, Human
cugagcuugcagagau

SEQ ID NO: 1953536 - RNA, 20 nt, Human
augucgucaaagcugaaaug

SEQ ID NO: 1953537 - RNA, 15 nt, Human
accucccccaucucu

SEQ ID NO: 1953538 - RNA, 13 nt, Human
acggggugaaacc

SEQ ID NO: 1953539 - RNA, 16 nt, Human
ugacuuaaugccacua

SEQ ID NO: 1953540 - RNA, 14 nt, Human
caaaugcauuucua

SEQ ID NO: 1953541 - RNA, 15 nt, Human
cagugaaagaaaaua

SEQ ID NO: 1953542 - RNA, 13 nt, Human
uauuucuaugaaa

SEQ ID NO: 1953543 - RNA, 22 nt, Human
aaaaaaccugagccccaaaagg

SEQ ID NO: 1953544 - RNA, 20 nt, Human
cacuagacccacuggacuca

SEQ ID NO: 1953545 - RNA, 18 nt, Human
caguuguugcccacagcu

SEQ ID NO: 1953546 - RNA, 18 nt, Human
cccaagccuggcaaggga

SEQ ID NO: 1953547 - RNA, 22 nt, Human
aauaauccuaaacauaugaauu

SEQ ID NO: 1953548 - RNA, 18 nt, Human
cagccucuuagaugcagu

SEQ ID NO: 1953549 - RNA, 20 nt, Human
caggcugagccucagucucc

SEQ ID NO: 1953550 - RNA, 17 nt, Human
caagccuccuuuuaaag

SEQ ID NO: 1953551 - RNA, 17 nt, Human
gacagugaaagaaaaua

SEQ ID NO: 1953552 - RNA, 17 nt, Human
ugaaauauuauuuuaua

SEQ ID NO: 1953553 - RNA, 13 nt, Human
aucuacacuccag

SEQ ID NO: 1953554 - RNA, 23 nt, Human
uaacgauaaaagacagugaaaga

SEQ ID NO: 1953555 - RNA, 21 nt, Human
ugcucaauaaaguacaagagc

SEQ ID NO: 1953556 - RNA, 18 nt, Human
acauuugcucauggaauu

SEQ ID NO: 1953557 - RNA, 22 nt, Human
cugaggcuccacuuggucugug

SEQ ID NO: 1953558 - RNA, 16 nt, Human
uauaugucacuuugcu

SEQ ID NO: 1953559 - RNA, 15 nt, Human
agagacagaaagcag

SEQ ID NO: 1953560 - RNA, 18 nt, Human
cuccagccugagcgacag

SEQ ID NO: 1953561 - RNA, 13 nt, Human
aacaagccuccuu

SEQ ID NO: 1953562 - RNA, 17 nt, Human
agagacagaaagcagaa

SEQ ID NO: 1953563 - RNA, 22 nt, Human
ggacagcccuucuuuccacaga

SEQ ID NO: 1953564 - RNA, 18 nt, Human
uguauuauuuuuuaaaaa

SEQ ID NO: 1953565 - RNA, 21 nt, Human
cccccucuggcuccagcuggc

SEQ ID NO: 1953566 - RNA, 16 nt, Human
aaauauuuauuuuaau

SEQ ID NO: 1953567 - RNA, 17 nt, Human
aauaugcucuaaacaug

SEQ ID NO: 1953568 - RNA, 19 nt, Human
auuguaguccuguaaugga

SEQ ID NO: 1953569 - RNA, 11 nt, Human
gagguaaaagc

SEQ ID NO: 1953570 - RNA, 15 nt, Human
aagugaaaaucuaca

SEQ ID NO: 1953571 - RNA, 14 nt, Human
auuuucuauaauuu

SEQ ID NO: 1953572 - RNA, 14 nt, Human
aagcaucacaugaa

SEQ ID NO: 1953573 - RNA, 13 nt, Human
uuuucuuuucauu

SEQ ID NO: 1953574 - RNA, 23 nt, Human
cagagguugcagugagccgagau

SEQ ID NO: 1953575 - RNA, 15 nt, Human
ggcaagcucuaucac

SEQ ID NO: 1953576 - RNA, 14 nt, Human
cuaagcauuccaac

SEQ ID NO: 1953577 - RNA, 20 nt, Human
auauuuuauaucaauuuaaa

SEQ ID NO: 1953578 - RNA, 18 nt, Human
ccauccugccccugagcc

SEQ ID NO: 1953579 - RNA, 17 nt, Human
cugccucagaaaacaag

SEQ ID NO: 1953580 - RNA, 18 nt, Human
uuuuagugaaauauuauu

SEQ ID NO: 1953581 - RNA, 14 nt, Human
cuaaacauaugaau

SEQ ID NO: 1953582 - RNA, 18 nt, Human
acagagacagaaagcaga

SEQ ID NO: 1953583 - RNA, 20 nt, Human
uuccacagaagcuccaggua

SEQ ID NO: 1953584 - RNA, 12 nt, Human
caggacagcccu

SEQ ID NO: 1953585 - RNA, 14 nt, Human
uaaaggaauuuaaa

SEQ ID NO: 1953586 - RNA, 24 nt, Human
cauucuggaauaauccuaaacaua

SEQ ID NO: 1953587 - RNA, 21 nt, Human
uaaaagacagugaaagaaaau

SEQ ID NO: 1953588 - RNA, 17 nt, Human
gacaaggaaaaaauaac

SEQ ID NO: 1953589 - RNA, 16 nt, Human
cucagcccuggugggc

SEQ ID NO: 1953590 - RNA, 14 nt, Human
aauauuuauuuuaa

SEQ ID NO: 1953591 - RNA, 15 nt, Human
ucauaauaaguugca

SEQ ID NO: 1953592 - RNA, 20 nt, Human
uuaaguuuuuuuuuaaaaaa

SEQ ID NO: 1953593 - RNA, 14 nt, Human
aaagaggaaugaag

SEQ ID NO: 1953594 - RNA, 23 nt, Human
gccccugcacuccagccugagcg

SEQ ID NO: 1953595 - RNA, 15 nt, Human
aaggguacacugccu

SEQ ID NO: 1953596 - RNA, 12 nt, Human
cagaacagugau

SEQ ID NO: 1953597 - RNA, 15 nt, Human
ccucauguccacugg

SEQ ID NO: 1953598 - RNA, 22 nt, Human
cuaagcuucacuguaaaauaau

SEQ ID NO: 1953599 - RNA, 14 nt, Human
gagagugaacaaau

SEQ ID NO: 1953600 - RNA, 18 nt, Human
guuucaaacauauauaac

SEQ ID NO: 1953601 - RNA, 18 nt, Human
gaccccugagcuugcaga

SEQ ID NO: 1953602 - RNA, 14 nt, Human
ugcuggagcucugc

SEQ ID NO: 1953603 - RNA, 16 nt, Human
augccccgucccccuc

SEQ ID NO: 1953604 - RNA, 16 nt, Human
uauaucaauuuaaaaa

SEQ ID NO: 1953605 - RNA, 20 nt, Human
caagcucuaucaccaaggag

SEQ ID NO: 1953606 - RNA, 17 nt, Human
auggcuaguaucaaaag

SEQ ID NO: 1953607 - RNA, 14 nt, Human
agagacagaaagca

SEQ ID NO: 1953608 - RNA, 17 nt, Human
auaaaguacaagagcuu

SEQ ID NO: 1953609 - RNA, 23 nt, Human
uggaaauguuuacagauccccaa

SEQ ID NO: 1953610 - RNA, 22 nt, Human
ccucccuuggggccuaugcaga

SEQ ID NO: 1953611 - RNA, 22 nt, Human
gaauuucuucaacucccugccc

SEQ ID NO: 1953612 - RNA, 14 nt, Human
gcaaagcccagcuu

SEQ ID NO: 1953613 - RNA, 14 nt, Human
aaauauaaauaaaa

SEQ ID NO: 1953614 - RNA, 14 nt, Human
auaaauaaaaauaa

SEQ ID NO: 1953615 - RNA, 13 nt, Human
caacucccugccc

SEQ ID NO: 1953616 - RNA, 20 nt, Human
acuagaguuuagcuggaaaa

SEQ ID NO: 1953617 - RNA, 19 nt, Human
acuaucucauuuccaagca

SEQ ID NO: 1953618 - RNA, 20 nt, Human
uguaauaggcguaacuaauu

SEQ ID NO: 1953619 - RNA, 16 nt, Human
cuagaacucccuuuca

SEQ ID NO: 1953620 - RNA, 22 nt, Human
auauaugcuaagucuuauauau

SEQ ID NO: 1953621 - RNA, 15 nt, Human
cagccagcacagccu

SEQ ID NO: 1953622 - RNA, 12 nt, Human
aauuuuaaaaug

SEQ ID NO: 1953623 - RNA, 14 nt, Human
uauuugaaauauug

SEQ ID NO: 1953624 - RNA, 22 nt, Human
cccccugcaaagcccagcuuga

SEQ ID NO: 1953625 - RNA, 21 nt, Human
uauacugugugcuaaaacaag

SEQ ID NO: 1953626 - RNA, 19 nt, Human
acauuuguauaaaauaauu

SEQ ID NO: 1953627 - RNA, 23 nt, Human
ucuagcaugucgucaaagcugaa

SEQ ID NO: 1953628 - RNA, 12 nt, Human
gcugaugcaguu

SEQ ID NO: 1953629 - RNA, 19 nt, Human
ugaacaaauuuacagagac

SEQ ID NO: 1953630 - RNA, 15 nt, Human
aauaacgauaaaaga

SEQ ID NO: 1953631 - RNA, 17 nt, Human
ucucuggccuucggccu

SEQ ID NO: 1953632 - RNA, 22 nt, Human
uggacgagaaaacaauaacgau

SEQ ID NO: 1953633 - RNA, 17 nt, Human
cgauaaaagacagugaa

SEQ ID NO: 1953634 - RNA, 12 nt, Human
gauaaaagacag

SEQ ID NO: 1953635 - RNA, 21 nt, Human
cgaaguauccuucagccugaa

SEQ ID NO: 1953636 - RNA, 22 nt, Human
agcacagccucuuagaugcagu

SEQ ID NO: 1953637 - RNA, 19 nt, Human
cucaccucccccaucucuu

SEQ ID NO: 1953638 - RNA, 13 nt, Human
ucuaagaagugaa

SEQ ID NO: 1953639 - RNA, 19 nt, Human
ugagucccaggcugagccu

SEQ ID NO: 1953640 - RNA, 15 nt, Human
uaggaaauauuuauu

SEQ ID NO: 1953641 - RNA, 15 nt, Human
ccugccccccagccc

SEQ ID NO: 1953642 - RNA, 19 nt, Human
ucaccaaggcugauuaaac

SEQ ID NO: 1953643 - RNA, 14 nt, Human
ugcucauggaauug

SEQ ID NO: 1953644 - RNA, 18 nt, Human
ccaagccuggcaagggaa

SEQ ID NO: 1953645 - RNA, 22 nt, Human
uguugcccacagcuguaugauu

SEQ ID NO: 1953646 - RNA, 22 nt, Human
accaaucaugaauuaguuuuau

SEQ ID NO: 1953647 - RNA, 21 nt, Human
auaguuguaccgcaaugugac

SEQ ID NO: 1953648 - RNA, 15 nt, Human
ccacaggaaccacaa

SEQ ID NO: 1953649 - RNA, 21 nt, Human
aaacgaggauugggaaaaagu

SEQ ID NO: 1953650 - RNA, 22 nt, Human
gucucuacuaaaaauacaaaaa

SEQ ID NO: 1953651 - RNA, 22 nt, Human
uauuucagauaaucacaauaca

SEQ ID NO: 1953652 - RNA, 19 nt, Human
agugaggagcuuugaaacg

SEQ ID NO: 1953653 - RNA, 17 nt, Human
cucguggaacaguuacc

SEQ ID NO: 1953654 - RNA, 16 nt, Human
uaaauaaaaauaaucc

SEQ ID NO: 1953655 - RNA, 23 nt, Human
agcaugucgucaaagcugaaaug

SEQ ID NO: 1953656 - RNA, 19 nt, Human
cucuguucugcacacagca

SEQ ID NO: 1953657 - RNA, 13 nt, Human
agaaaugaaagca

SEQ ID NO: 1953658 - RNA, 23 nt, Human
aguaauuggaaaggcagcucuaa

SEQ ID NO: 1953659 - RNA, 21 nt, Human
auaugcucuaaacauguuuau

SEQ ID NO: 1953660 - RNA, 18 nt, Human
gaaacaaaaggauaauga

SEQ ID NO: 1953661 - RNA, 13 nt, Human
acuguaaaauaau

SEQ ID NO: 1953662 - RNA, 17 nt, Human
uaugcuaagugaaauaa

SEQ ID NO: 1953663 - RNA, 20 nt, Human
cagccugagcgacagugaga

SEQ ID NO: 1953664 - RNA, 20 nt, Human
ccugccuaagugcagccccg

SEQ ID NO: 1953665 - RNA, 11 nt, Human
auaauuuaaau

SEQ ID NO: 1953666 - RNA, 16 nt, Human
cuagaaccaccugccu

SEQ ID NO: 1953667 - RNA, 20 nt, Human
cacuguggguagacacacau

SEQ ID NO: 1953668 - RNA, 19 nt, Human
ugcacacagcacgggggcc

SEQ ID NO: 1953669 - RNA, 18 nt, Human
aucuuauaauuuaaaaua

SEQ ID NO: 1953670 - RNA, 14 nt, Human
aaagagaacuucca

SEQ ID NO: 1953671 - RNA, 19 nt, Human
cuuccuaauuccacagcug

SEQ ID NO: 1953672 - RNA, 14 nt, Human
ccugccccccagcc

SEQ ID NO: 1953673 - RNA, 20 nt, Human
cuggccuucggccuccaucc

SEQ ID NO: 1953674 - RNA, 15 nt, Human
ucuggcuccagcugg

SEQ ID NO: 1953675 - RNA, 15 nt, Human
caaauccaaugaaau

SEQ ID NO: 1953676 - RNA, 21 nt, Human
ugaugcuacaggauuugaaau

SEQ ID NO: 1953677 - RNA, 19 nt, Human
guuguauuauuuuuuaaaa

SEQ ID NO: 1953678 - RNA, 13 nt, Human
aaaugaaagcagg

SEQ ID NO: 1953679 - RNA, 20 nt, Human
uccaagccucauguccacug

SEQ ID NO: 1953680 - RNA, 16 nt, Human
cuacacuccagugaga

SEQ ID NO: 1953681 - RNA, 21 nt, Human
gaaagcagggacuugaaccca

SEQ ID NO: 1953682 - RNA, 11 nt, Human
aauuuaaauau

SEQ ID NO: 1953683 - RNA, 14 nt, Human
cagauccccaagcc

SEQ ID NO: 1953684 - RNA, 19 nt, Human
uuuccugaaaacccuugcc

SEQ ID NO: 1953685 - RNA, 13 nt, Human
ccaaaagguauuu

SEQ ID NO: 1953686 - RNA, 16 nt, Human
cuggccuucggccucc

SEQ ID NO: 1953687 - RNA, 22 nt, Human
ucuagcaugucgucaaagcuga

SEQ ID NO: 1953688 - RNA, 22 nt, Human
gugccucaccccuugccauaau

SEQ ID NO: 1953689 - RNA, 13 nt, Human
cugccuucucaac

SEQ ID NO: 1953690 - RNA, 19 nt, Human
uguuggacgagaaaacaau

SEQ ID NO: 1953691 - RNA, 15 nt, Human
caaggaaaaaauaac

SEQ ID NO: 1953692 - RNA, 19 nt, Human
cucauggaauuggagcucg

SEQ ID NO: 1953693 - RNA, 17 nt, Human
uucacuguaaaauaaua

SEQ ID NO: 1953694 - RNA, 15 nt, Human
uccuacaagacacag

SEQ ID NO: 1953695 - RNA, 22 nt, Human
uuuaauaauguuucaaacauau

SEQ ID NO: 1953696 - RNA, 17 nt, Human
cuuccuaauuccacagc

SEQ ID NO: 1953697 - RNA, 22 nt, Human
aguauguuagugcaaauuguca

SEQ ID NO: 1953698 - RNA, 23 nt, Human
uacaaaugggaaacaaaaggaua

SEQ ID NO: 1953699 - RNA, 14 nt, Human
auuguccaggucua

SEQ ID NO: 1953700 - RNA, 12 nt, Human
aagagcuuaaca

SEQ ID NO: 1953701 - RNA, 16 nt, Human
gagcucgugggacagu

SEQ ID NO: 1953702 - RNA, 14 nt, Human
ggaaguagaggagg

SEQ ID NO: 1953703 - RNA, 22 nt, Human
caaauuuacagagacagaaagc

SEQ ID NO: 1953704 - RNA, 14 nt, Human
agauguagaggaga

SEQ ID NO: 1953705 - RNA, 14 nt, Human
aacgauaaaagaca

SEQ ID NO: 1953706 - RNA, 19 nt, Human
gugacuuaaugccacuaaa

SEQ ID NO: 1953707 - RNA, 22 nt, Human
aauaugccccauucaacaucua

SEQ ID NO: 1953708 - RNA, 13 nt, Human
aaacauccuacaa

SEQ ID NO: 1953709 - RNA, 16 nt, Human
caggcugagccucagu

SEQ ID NO: 1953710 - RNA, 22 nt, Human
ugaagcaaaauuuuuucucuag

SEQ ID NO: 1953711 - RNA, 22 nt, Human
cacuaguauuucuaugaaauau

SEQ ID NO: 1953712 - RNA, 18 nt, Human
auucuugccaaauauaaa

SEQ ID NO: 1953713 - RNA, 15 nt, Human
aaaaaauaacaauga

SEQ ID NO: 1953714 - RNA, 17 nt, Human
cucgugggacagucacc

SEQ ID NO: 1953715 - RNA, 20 nt, Human
cagugaaagaaaauaacgau

SEQ ID NO: 1953716 - RNA, 18 nt, Human
uguggucacaggaaguag

SEQ ID NO: 1953717 - RNA, 18 nt, Human
aaguugauaugccuuuuc

SEQ ID NO: 1953718 - RNA, 20 nt, Human
uguuggugaacuugguuuua

SEQ ID NO: 1953719 - RNA, 17 nt, Human
gucaaagcugaaaugga

SEQ ID NO: 1953720 - RNA, 23 nt, Human
cccagcccuccuuaucaaaggac

SEQ ID NO: 1953721 - RNA, 14 nt, Human
uaguuucccuugca

SEQ ID NO: 1953722 - RNA, 23 nt, Human
ugcauagguuuaauaauuuuuaa

SEQ ID NO: 1953723 - RNA, 14 nt, Human
uuuuaaaaaagaaa

SEQ ID NO: 1953724 - RNA, 13 nt, Human
aacucccugcccc

SEQ ID NO: 1953725 - RNA, 15 nt, Human
aauauaaauaaaaau

SEQ ID NO: 1953726 - RNA, 15 nt, Human
uauaaauaaaaauaa

SEQ ID NO: 1953727 - RNA, 16 nt, Human
cugagcgacagugaga

SEQ ID NO: 1953728 - RNA, 23 nt, Human
auuauauggcuugaguuuaaauu

SEQ ID NO: 1953729 - RNA, 13 nt, Human
uauuuauuuuaau

SEQ ID NO: 1953730 - RNA, 12 nt, Human
cccccagcccuc

SEQ ID NO: 1953731 - RNA, 23 nt, Human
ucuccauguacuggcaagaccug

SEQ ID NO: 1953732 - RNA, 21 nt, Human
caaagcccagcuugaaaccuu

SEQ ID NO: 1953733 - RNA, 13 nt, Human
acacacaugaagu

SEQ ID NO: 1953734 - RNA, 22 nt, Human
uuuauggcacuaguauuucuau

SEQ ID NO: 1953735 - RNA, 14 nt, Human
gcuggagcucugcc

SEQ ID NO: 1953736 - RNA, 18 nt, Human
cuggaaacuucagcgguu

SEQ ID NO: 1953737 - RNA, 22 nt, Human
uaaaauaauuuuuauauuugaa

SEQ ID NO: 1953738 - RNA, 17 nt, Human
ccugccccccagcccuc

SEQ ID NO: 1953739 - RNA, 17 nt, Human
gccugagcgacagugag

SEQ ID NO: 1953740 - RNA, 12 nt, Human
aagaaaauaacg

SEQ ID NO: 1953741 - RNA, 18 nt, Human
caugaagauguagaggag

SEQ ID NO: 1953742 - RNA, 22 nt, Human
aagacccaaaaggcagaagcaa

SEQ ID NO: 1953743 - RNA, 18 nt, Human
cuuuccacagaagcucca

SEQ ID NO: 1953744 - RNA, 14 nt, Human
uucagccugaaaga

SEQ ID NO: 1953745 - RNA, 14 nt, Human
uuuguauaaaauaa

SEQ ID NO: 1953746 - RNA, 13 nt, Human
caccaaggagcca

SEQ ID NO: 1953747 - RNA, 22 nt, Human
ugggcacuguggguagacacac

SEQ ID NO: 1953748 - RNA, 15 nt, Human
agugacaagcucaca

SEQ ID NO: 1953749 - RNA, 13 nt, Human
uguauauuuuaua

SEQ ID NO: 1953750 - RNA, 18 nt, Human
gaaaauaacaauaaaaga

SEQ ID NO: 1953751 - RNA, 14 nt, Human
auuuguauaaaaua

SEQ ID NO: 1953752 - RNA, 18 nt, Human
gaaaauaucacuugucaa

SEQ ID NO: 1953753 - RNA, 15 nt, Human
aagccuggcaaggga

SEQ ID NO: 1953754 - RNA, 22 nt, Human
aaacauguuuaucguauuugau

SEQ ID NO: 1953755 - RNA, 13 nt, Human
uuuaaaaaagaaa

SEQ ID NO: 1953756 - RNA, 17 nt, Human
cauuuguauaaaauaau

SEQ ID NO: 1953757 - RNA, 14 nt, Human
auuucuaugaaaua

SEQ ID NO: 1953758 - RNA, 19 nt, Human
uuggcaagcucuaucacca

SEQ ID NO: 1953759 - RNA, 22 nt, Human
caagcucuaucaccaaggagcc

SEQ ID NO: 1953760 - RNA, 15 nt, Human
guucugcagauaaac

SEQ ID NO: 1953761 - RNA, 14 nt, Human
gauaaaagacagug

SEQ ID NO: 1953762 - RNA, 23 nt, Human
cucuacuaaaaauacaaaaaaaa

SEQ ID NO: 1953763 - RNA, 17 nt, Human
ugaaaaucuuauaauuu

SEQ ID NO: 1953764 - RNA, 15 nt, Human
ucaguuuuugugaaa

SEQ ID NO: 1953765 - RNA, 16 nt, Human
guucugcacacagcac

SEQ ID NO: 1953766 - RNA, 19 nt, Human
cugagccucagucucccuc

SEQ ID NO: 1953767 - RNA, 18 nt, Human
uguaaaggaauuuaaaaa

SEQ ID NO: 1953768 - RNA, 17 nt, Human
agaacucccuuucaaca

SEQ ID NO: 1953769 - RNA, 13 nt, Human
agcgacagugaga

SEQ ID NO: 1953770 - RNA, 17 nt, Human
aagacagugaaagaaaa

SEQ ID NO: 1953771 - RNA, 21 nt, Human
cucaguccaugaagauguaga

SEQ ID NO: 1953772 - RNA, 14 nt, Human
ccaugggacaggga

SEQ ID NO: 1953773 - RNA, 15 nt, Human
cuaagugcagccccg

SEQ ID NO: 1953774 - RNA, 15 nt, Human
gccuugggaccccug

SEQ ID NO: 1953775 - RNA, 15 nt, Human
gcuguauuuuaaaag

SEQ ID NO: 1953776 - RNA, 20 nt, Human
uaagugaaauaagccagaca

SEQ ID NO: 1953777 - RNA, 20 nt, Human
cugauauuggacaguaaaau

SEQ ID NO: 1953778 - RNA, 18 nt, Human
cagagacagaaagcagaa

SEQ ID NO: 1953779 - RNA, 23 nt, Human
aacuuguaaaggaauuuaaaaau

SEQ ID NO: 1953780 - RNA, 17 nt, Human
ccaaaagguauuuuaau

SEQ ID NO: 1953781 - RNA, 14 nt, Human
ggcuccagcuggcc

SEQ ID NO: 1953782 - RNA, 17 nt, Human
gaaaaucaggcuggcca

SEQ ID NO: 1953783 - RNA, 21 nt, Human
auccccaagccuggcaaggga

SEQ ID NO: 1953784 - RNA, 17 nt, Human
augauuaaguaaugaua

SEQ ID NO: 1953785 - RNA, 13 nt, Human
acaagaaaugaaa

SEQ ID NO: 1953786 - RNA, 16 nt, Human
cugcacuccagccuga

SEQ ID NO: 1953787 - RNA, 16 nt, Human
uuuauauuugaaauau

SEQ ID NO: 1953788 - RNA, 16 nt, Human
gacauagaauuaacac

SEQ ID NO: 1953789 - RNA, 21 nt, Human
aacuuguaaaggaauuuaaaa

SEQ ID NO: 1953790 - RNA, 14 nt, Human
caguucugaagaag

SEQ ID NO: 1953791 - RNA, 19 nt, Human
agacucgggauuaguacac

SEQ ID NO: 1953792 - RNA, 16 nt, Human
aagacugcacaucaaa

SEQ ID NO: 1953793 - RNA, 22 nt, Human
uauuucuaugaaauauuauguu

SEQ ID NO: 1953794 - RNA, 13 nt, Human
ccucccccaucuc

SEQ ID NO: 1953795 - RNA, 20 nt, Human
uuugcaagccagauuuuccu

SEQ ID NO: 1953796 - RNA, 22 nt, Human
ggacaguaaaauccacagacca

SEQ ID NO: 1953797 - RNA, 20 nt, Human
gccgggcgugguggugagug

SEQ ID NO: 1953798 - RNA, 14 nt, Human
uauuuauuuuaaua

SEQ ID NO: 1953799 - RNA, 16 nt, Human
cauuucuaaagccauu

SEQ ID NO: 1953800 - RNA, 15 nt, Human
aaugauuaugaauua

SEQ ID NO: 1953801 - RNA, 14 nt, Human
uugugauugauuau

SEQ ID NO: 1953802 - RNA, 18 nt, Human
acaaaugcauuucuaaag

SEQ ID NO: 1953803 - RNA, 21 nt, Human
ucuuaggguuaugauuaagua

SEQ ID NO: 1953804 - RNA, 12 nt, Human
ucuuaagaagac

SEQ ID NO: 1953805 - RNA, 13 nt, Human
aagacaaggaaaa

SEQ ID NO: 1953806 - RNA, 17 nt, Human
auguuuacagaucccca

SEQ ID NO: 1953807 - RNA, 15 nt, Human
uagauaggccauggg

SEQ ID NO: 1953808 - RNA, 18 nt, Human
gcuccauuuuuagugaaa

SEQ ID NO: 1953809 - RNA, 17 nt, Human
uccagcuggccgggagc

SEQ ID NO: 1953810 - RNA, 16 nt, Human
cuccauccugaggcuc

SEQ ID NO: 1953811 - RNA, 20 nt, Human
gaaacauuugguaaggggaa

SEQ ID NO: 1953812 - RNA, 16 nt, Human
cuuuaugcuaagugaa

SEQ ID NO: 1953813 - RNA, 22 nt, Human
caugaguaacugauuuguaaca

SEQ ID NO: 1953814 - RNA, 18 nt, Human
cagucucccucccuuggg

SEQ ID NO: 1953815 - RNA, 17 nt, Human
acaaaugggaaacaaaa

SEQ ID NO: 1953816 - RNA, 14 nt, Human
agcucuaucaccaa

SEQ ID NO: 1953817 - RNA, 18 nt, Human
uuuugugaagcaaaauuu

SEQ ID NO: 1953818 - RNA, 15 nt, Human
guuuuucuuuucauu

SEQ ID NO: 1953819 - RNA, 21 nt, Human
uaguauuucuaugaaauauua

SEQ ID NO: 1953820 - RNA, 21 nt, Human
augaauacuuuauaaaggauu

SEQ ID NO: 1953821 - RNA, 19 nt, Human
agcucugcccauccugccc

SEQ ID NO: 1953822 - RNA, 15 nt, Human
ugccccgucccccuc

SEQ ID NO: 1953823 - RNA, 22 nt, Human
agcccuccuuaucaaaggacac

SEQ ID NO: 1953824 - RNA, 17 nt, Human
uuccaagugauugaaac

SEQ ID NO: 1953825 - RNA, 22 nt, Human
ggcagcuuuccucaaaacuuca

SEQ ID NO: 1953826 - RNA, 16 nt, Human
uguccccuauccuacu

SEQ ID NO: 1953827 - RNA, 20 nt, Human
auuuugugauugauuauaug

SEQ ID NO: 1953828 - RNA, 22 nt, Human
uggguuccuuccucugagccuu

SEQ ID NO: 1953829 - RNA, 19 nt, Human
caucaaggguacacugccu

SEQ ID NO: 1953830 - RNA, 16 nt, Human
auuccaccuacaugag

SEQ ID NO: 1953831 - RNA, 13 nt, Human
ugggaggcugaga

SEQ ID NO: 1953832 - RNA, 22 nt, Human
cucugagccuugggaccccuga

SEQ ID NO: 1953833 - RNA, 17 nt, Human
cugaucaccugcccugc

SEQ ID NO: 1953834 - RNA, 17 nt, Human
cagacaucaacagauaa

SEQ ID NO: 1953835 - RNA, 22 nt, Human
gacucaccucccccaucucuuc

SEQ ID NO: 1953836 - RNA, 21 nt, Human
aaaugucuugcuugauuguau

SEQ ID NO: 1953837 - RNA, 17 nt, Human
aggccaugggacaggga

SEQ ID NO: 1953838 - RNA, 16 nt, Human
uccuguaauggaagca

SEQ ID NO: 1953839 - RNA, 20 nt, Human
cuaaaugucaaucagccuag

SEQ ID NO: 1953840 - RNA, 16 nt, Human
ccucaaaacuucagac

SEQ ID NO: 1953841 - RNA, 20 nt, Human
ucuucuggguuccuuccucu

SEQ ID NO: 1953842 - RNA, 19 nt, Human
agucaaauugugugaaagg

SEQ ID NO: 1953843 - RNA, 19 nt, Human
cauggaauuggagcucgug

SEQ ID NO: 1953844 - RNA, 23 nt, Human
gucucccucccuuggggccuaug

SEQ ID NO: 1953845 - RNA, 20 nt, Human
aaugaauacuuuauaaagga

SEQ ID NO: 1953846 - RNA, 15 nt, Human
uaacgauaaaagaca

SEQ ID NO: 1953847 - RNA, 18 nt, Human
uacauuuguauaaaauaa

SEQ ID NO: 1953848 - RNA, 14 nt, Human
ccuugaugaagaag

SEQ ID NO: 1953849 - RNA, 14 nt, Human
augauguuuagaaa

SEQ ID NO: 1953850 - RNA, 20 nt, Human
uguaaaggaauuuaaaaauc

SEQ ID NO: 1953851 - RNA, 20 nt, Human
guucugcagauaaacaguag

SEQ ID NO: 1953852 - RNA, 17 nt, Human
ccuacuuccccuuccua

SEQ ID NO: 1953853 - RNA, 15 nt, Human
ccugcaaagcccagc

SEQ ID NO: 1953854 - RNA, 17 nt, Human
auaucaauuuaaaaaaa

SEQ ID NO: 1953855 - RNA, 19 nt, Human
cccccucuggcuccagcug

SEQ ID NO: 1953856 - RNA, 14 nt, Human
auuuaaauauaugc

SEQ ID NO: 1953857 - RNA, 14 nt, Human
auugucuagugaaa

SEQ ID NO: 1953858 - RNA, 17 nt, Human
ucuauaauuuaaauaua

SEQ ID NO: 1953859 - RNA, 12 nt, Human
gcucagcccugg

SEQ ID NO: 1953860 - RNA, 21 nt, Human
augucauuugcuggagcucug

SEQ ID NO: 1953861 - RNA, 20 nt, Human
aaacuuuaugcuaagugaaa

SEQ ID NO: 1953862 - RNA, 12 nt, Human
aagaaaauaaca

SEQ ID NO: 1953863 - RNA, 16 nt, Human
ccugagcuugcagaga

SEQ ID NO: 1953864 - RNA, 20 nt, Human
agcuucacuguaaaauaaua

SEQ ID NO: 1953865 - RNA, 18 nt, Human
uauagcuacuaauuuuaa

SEQ ID NO: 1953866 - RNA, 19 nt, Human
gaggcagagguugcaguga

SEQ ID NO: 1953867 - RNA, 21 nt, Human
uuuucaggcuagauguaugua

SEQ ID NO: 1953868 - RNA, 13 nt, Human
aggauuugaaauu

SEQ ID NO: 1953869 - RNA, 12 nt, Human
ccaggcugagcc

SEQ ID NO: 1953870 - RNA, 22 nt, Human
cucagcccuggugggcagagag

SEQ ID NO: 1953871 - RNA, 17 nt, Human
acucaccucccccaucu

SEQ ID NO: 1953872 - RNA, 13 nt, Human
aaauccuugaaga

SEQ ID NO: 1953873 - RNA, 17 nt, Human
aauaacgauaaaagaca

SEQ ID NO: 1953874 - RNA, 15 nt, Human
augggacagggagga

SEQ ID NO: 1953875 - RNA, 15 nt, Human
auauugacuuuuuau

SEQ ID NO: 1953876 - RNA, 17 nt, Human
cuccuuaucaaaggaca

SEQ ID NO: 1953877 - RNA, 20 nt, Human
ucauucacucaacaaacaua

SEQ ID NO: 1953878 - RNA, 20 nt, Human
ggccaugggacagggaggac

SEQ ID NO: 1953879 - RNA, 14 nt, Human
uaugaauuacauuu

SEQ ID NO: 1953880 - RNA, 18 nt, Human
ugggcacaggguuuaugu

SEQ ID NO: 1953881 - RNA, 15 nt, Human
uccauccugaggcuc

SEQ ID NO: 1953882 - RNA, 18 nt, Human
gcccuggugggcagagag

SEQ ID NO: 1953883 - RNA, 16 nt, Human
cagauccccaagccug

SEQ ID NO: 1953884 - RNA, 15 nt, Human
gccuaagugcagccc

SEQ ID NO: 1953885 - RNA, 20 nt, Human
accucugccucagaaaacaa

SEQ ID NO: 1953886 - RNA, 15 nt, Human
uuuaauaauuuuuaa

SEQ ID NO: 1953887 - RNA, 24 nt, Human
ccccugagcuugcagagaugaggc

SEQ ID NO: 1953888 - RNA, 23 nt, Human
ggaugguucccuugaugaagaag

SEQ ID NO: 1953889 - RNA, 17 nt, Human
guauuauuuuuuaaaaa

SEQ ID NO: 1953890 - RNA, 14 nt, Human
uaacuaauuuuaac

SEQ ID NO: 1953891 - RNA, 22 nt, Human
ugguuguauuauuuuuuaaaaa

SEQ ID NO: 1953892 - RNA, 16 nt, Human
uaaaauccauacauuu

SEQ ID NO: 1953893 - RNA, 13 nt, Human
ugaaagaaaauaa

SEQ ID NO: 1953894 - RNA, 16 nt, Human
ccugccccccagcccu

SEQ ID NO: 1953895 - RNA, 19 nt, Human
cagagaugaggccgccaug

SEQ ID NO: 1953896 - RNA, 15 nt, Human
gccccauucaacauc

SEQ ID NO: 1953897 - RNA, 14 nt, Human
auccuugaagauuu

SEQ ID NO: 1953898 - RNA, 21 nt, Human
cuucucacauuuauauuuuug

SEQ ID NO: 1953899 - RNA, 13 nt, Human
acaaggaaaaaau

SEQ ID NO: 1953900 - RNA, 23 nt, Human
ggcuaagcuucacuguaaaauaa

SEQ ID NO: 1953901 - RNA, 20 nt, Human
guccccuauccuacuucccc

SEQ ID NO: 1953902 - RNA, 13 nt, Human
cuucucaacucca

SEQ ID NO: 1953903 - RNA, 23 nt, Human
gaggcauuuaggccaugggacag

SEQ ID NO: 1953904 - RNA, 15 nt, Human
uucacauuuaaauaa

SEQ ID NO: 1953905 - RNA, 23 nt, Human
augaauuaaguuuuuuuuuaaaa

SEQ ID NO: 1953906 - RNA, 14 nt, Human
cugagucccaggcu

SEQ ID NO: 1953907 - RNA, 19 nt, Human
aagcuuguauuccuuuuuc

SEQ ID NO: 1953908 - RNA, 19 nt, Human
gcucauggaauuggagcuc

SEQ ID NO: 1953909 - RNA, 21 nt, Human
agcccuucuuuccacagaagc

SEQ ID NO: 1953910 - RNA, 17 nt, Human
ccaaggaugccccgucc

SEQ ID NO: 1953911 - RNA, 17 nt, Human
auaauuuaaauauaugc

SEQ ID NO: 1953912 - RNA, 17 nt, Human
uuauuacuguaagaaaa

SEQ ID NO: 1953913 - RNA, 18 nt, Human
auaaaguguuugaaagcu

SEQ ID NO: 1953914 - RNA, 22 nt, Human
cccaugauguuuagaaacacaa

SEQ ID NO: 1953915 - RNA, 22 nt, Human
ugauaguuguaccgcaauguga

SEQ ID NO: 1953916 - RNA, 14 nt, Human
gcugauuaaaccaa

SEQ ID NO: 1953917 - RNA, 21 nt, Human
aaagaaaauaacgauaaaaga

SEQ ID NO: 1953918 - RNA, 16 nt, Human
agguugcagugagccg

SEQ ID NO: 1953919 - RNA, 19 nt, Human
ggaauuucuucaacucccu

SEQ ID NO: 1953920 - RNA, 19 nt, Human
agcuacuaauuuuaaaaug

SEQ ID NO: 1953921 - RNA, 23 nt, Human
auaauguguucauucuggaauaa

SEQ ID NO: 1953922 - RNA, 15 nt, Human
ggcaauagucaaauu

SEQ ID NO: 1953923 - RNA, 21 nt, Human
cuauguucuaagaagugaaaa

SEQ ID NO: 1953924 - RNA, 13 nt, Human
cucaccuccccca

SEQ ID NO: 1953925 - RNA, 20 nt, Human
acaagacacagugaccauac

SEQ ID NO: 1953926 - RNA, 17 nt, Human
ucauacuucuuaggguu

SEQ ID NO: 1953927 - RNA, 12 nt, Human
aaaagaaagaaa

SEQ ID NO: 1953928 - RNA, 20 nt, Human
cugcacuccagccugagcga

SEQ ID NO: 1953929 - RNA, 18 nt, Human
uaagcuucacuguaaaau

SEQ ID NO: 1953930 - RNA, 18 nt, Human
acaagccuccuuuuaaag

SEQ ID NO: 1953931 - RNA, 19 nt, Human
cccacuggacucaccuccc

SEQ ID NO: 1953932 - RNA, 18 nt, Human
uuuucucuccucucccca

SEQ ID NO: 1953933 - RNA, 23 nt, Human
uuuuauagcuacuaauuuuaaaa

SEQ ID NO: 1953934 - RNA, 14 nt, Human
cucagucucccucc

SEQ ID NO: 1953935 - RNA, 15 nt, Human
cuucaacucccugcc

SEQ ID NO: 1953936 - RNA, 16 nt, Human
cauagaaguaaaaaca

SEQ ID NO: 1953937 - RNA, 23 nt, Human
caccaaggagccaaacauccuac

SEQ ID NO: 1953938 - RNA, 21 nt, Human
uccauccugaggcuccacuug

SEQ ID NO: 1953939 - RNA, 22 nt, Human
gagucccaggcugagccucagu

SEQ ID NO: 1953940 - RNA, 23 nt, Human
acucuauguucuaagaagugaaa

SEQ ID NO: 1953941 - RNA, 18 nt, Human
uaauaauguuucaaacau

SEQ ID NO: 1953942 - RNA, 19 nt, Human
aaaaucuuauaauuuaaaa

SEQ ID NO: 1953943 - RNA, 16 nt, Human
aauaaaguguuugaaa

SEQ ID NO: 1953944 - RNA, 23 nt, Human
agcucugcccauccugccccuga

SEQ ID NO: 1953945 - RNA, 23 nt, Human
aauaauccucaguuuuugugaaa

SEQ ID NO: 1953946 - RNA, 14 nt, Human
cuggagcucugccc

SEQ ID NO: 1953947 - RNA, 21 nt, Human
ugaacaaauuuacagagacag

SEQ ID NO: 1953948 - RNA, 14 nt, Human
agcucguggaacag

SEQ ID NO: 1953949 - RNA, 21 nt, Human
aggcucuuuugggauuuuuga

SEQ ID NO: 1953950 - RNA, 21 nt, Human
aggguuaugauuaaguaauga

SEQ ID NO: 1953951 - RNA, 19 nt, Human
uauuuuaauaauguuucaa

SEQ ID NO: 1953952 - RNA, 22 nt, Human
auaucuuuuuuuuaauaaacca

SEQ ID NO: 1953953 - RNA, 18 nt, Human
ccaaccuggaguugaaaa

SEQ ID NO: 1953954 - RNA, 15 nt, Human
gacagggaggacgcu

SEQ ID NO: 1953955 - RNA, 15 nt, Human
cccccagcccuccuu

SEQ ID NO: 1953956 - RNA, 14 nt, Human
cagucucccucccu

SEQ ID NO: 1953957 - RNA, 14 nt, Human
cuucucuucacagu

SEQ ID NO: 1953958 - RNA, 16 nt, Human
ccccaucucuucuggg

SEQ ID NO: 1953959 - RNA, 15 nt, Human
ccaaggagccaaaca

SEQ ID NO: 1953960 - RNA, 21 nt, Human
gacagucaccucauggaauug

SEQ ID NO: 1953961 - RNA, 20 nt, Human
uuuaaauaaaguguuugaaa

SEQ ID NO: 1953962 - RNA, 20 nt, Human
aagacagugaaagaaaauaa

SEQ ID NO: 1953963 - RNA, 20 nt, Human
caaauguucaucaaugaaug

SEQ ID NO: 1953964 - RNA, 12 nt, Human
gguauuuuaauc

SEQ ID NO: 1953965 - RNA, 22 nt, Human
augguuguauuauuuuuuaaaa

SEQ ID NO: 1953966 - RNA, 16 nt, Human
gacaaggaaaaaauaa

SEQ ID NO: 1953967 - RNA, 17 nt, Human
uugccaaauauaaauaa

SEQ ID NO: 1953968 - RNA, 19 nt, Human
uagugagcagucaggaaag

SEQ ID NO: 1953969 - RNA, 18 nt, Human
cccucuggcuccagcugg

SEQ ID NO: 1953970 - RNA, 12 nt, Human
caugggaaguga

SEQ ID NO: 1953971 - RNA, 19 nt, Human
auccuacaagacacaguga

SEQ ID NO: 1953972 - RNA, 23 nt, Human
gauauuaaccaggggccaugaau

SEQ ID NO: 1953973 - RNA, 18 nt, Human
cugagucccaggcugagc

SEQ ID NO: 1953974 - RNA, 18 nt, Human
cugagggcauagaaguaa

SEQ ID NO: 1953975 - RNA, 15 nt, Human
uuaauucugaaagca

SEQ ID NO: 1953976 - RNA, 18 nt, Human
agguccacaacacacaga

SEQ ID NO: 1953977 - RNA, 12 nt, Human
aaaauaacaaua

SEQ ID NO: 1953978 - RNA, 15 nt, Human
agacagcucugcaua

SEQ ID NO: 1953979 - RNA, 15 nt, Human
gaaagaaaauaacga

SEQ ID NO: 1953980 - RNA, 18 nt, Human
auccuucagccugaaaga

SEQ ID NO: 1953981 - RNA, 17 nt, Human
aaauguucaucaaugaa

SEQ ID NO: 1953982 - RNA, 18 nt, Human
acuuuaugcuaagugaaa

SEQ ID NO: 1953983 - RNA, 19 nt, Human
ucaguuauuauauuuacaa

SEQ ID NO: 1953984 - RNA, 15 nt, Human
uauuuauuuuaauaa

SEQ ID NO: 1953985 - RNA, 23 nt, Human
ugaaaugaguuuuucuuuucauu

SEQ ID NO: 1953986 - RNA, 17 nt, Human
aagcuuuuuuugaauca

SEQ ID NO: 1953987 - RNA, 17 nt, Human
auuauuuuuuaaaaaaa

SEQ ID NO: 1953988 - RNA, 20 nt, Human
accuacacgagauacagaau

SEQ ID NO: 1953989 - RNA, 23 nt, Human
ucggccuccauccugaggcucca

SEQ ID NO: 1953990 - RNA, 11 nt, Human
caacucccugc

SEQ ID NO: 1953991 - RNA, 12 nt, Human
auauaaauaaaa

SEQ ID NO: 1953992 - RNA, 17 nt, Human
aaauccuacuuucauaa

SEQ ID NO: 1953993 - RNA, 18 nt, Human
cucuggccuucggccucc

SEQ ID NO: 1953994 - RNA, 10 nt, Human
auguuuucag

SEQ ID NO: 1953995 - RNA, 12 nt, Human
gaagaccucauu

SEQ ID NO: 1953996 - RNA, 23 nt, Human
uccaacuaucucauuuccaagca

SEQ ID NO: 1953997 - RNA, 19 nt, Human
accauuuuggcaagcucua

SEQ ID NO: 1953998 - RNA, 20 nt, Human
gaaacgaggauugggaaaaa

SEQ ID NO: 1953999 - RNA, 19 nt, Human
guuauuauauuuacaaaug

SEQ ID NO: 1954000 - RNA, 18 nt, Human
agauccccaagccuggca

SEQ ID NO: 1954001 - RNA, 18 nt, Human
gccuucggccuccauccu

SEQ ID NO: 1954002 - RNA, 22 nt, Human
agugagcagucaggaaagagaa

SEQ ID NO: 1954003 - RNA, 23 nt, Human
uagacacacaugaaguccaagca

SEQ ID NO: 1954004 - RNA, 18 nt, Human
auagucaaauugugugaa

SEQ ID NO: 1954005 - RNA, 22 nt, Human
cagcacgggggccaaggaugcc

SEQ ID NO: 1954006 - RNA, 15 nt, Human
ccuggugggcagaga

SEQ ID NO: 1954007 - RNA, 20 nt, Human
aaaagacagugaaagaaaau

SEQ ID NO: 1954008 - RNA, 17 nt, Human
aaaaauccuacuuucau

SEQ ID NO: 1954009 - RNA, 14 nt, Human
augggccauaugaa

SEQ ID NO: 1954010 - RNA, 14 nt, Human
cuggaaaucagggu

SEQ ID NO: 1954011 - RNA, 15 nt, Human
cuugaaaacuuuaug

SEQ ID NO: 1954012 - RNA, 16 nt, Human
cagcuuuccucaaaac

SEQ ID NO: 1954013 - RNA, 13 nt, Human
uuuuaaaaaagaa

SEQ ID NO: 1954014 - RNA, 22 nt, Human
auuacuguaagaaaauaucacu

SEQ ID NO: 1954015 - RNA, 20 nt, Human
uaaaacaagcacuaaacaaa

SEQ ID NO: 1954016 - RNA, 18 nt, Human
uaaaagacaaggaaaaaa

SEQ ID NO: 1954017 - RNA, 17 nt, Human
uccugccccugagccca

SEQ ID NO: 1954018 - RNA, 21 nt, Human
ccuggugccucaccccuugcc

SEQ ID NO: 1954019 - RNA, 22 nt, Human
gugugaccacugcagaagacag

SEQ ID NO: 1954020 - RNA, 14 nt, Human
aaaauacaaaaaaa

SEQ ID NO: 1954021 - RNA, 13 nt, Human
ccugagcuugcag

SEQ ID NO: 1954022 - RNA, 21 nt, Human
cuaagcuucacuguaaaauaa

SEQ ID NO: 1954023 - RNA, 17 nt, Human
gaaugagagacacacug

SEQ ID NO: 1954024 - RNA, 16 nt, Human
auaucaauuuaaaaaa

SEQ ID NO: 1954025 - RNA, 21 nt, Human
cucuucuggguuccuuccucu

SEQ ID NO: 1954026 - RNA, 16 nt, Human
agccucagucucccuc

SEQ ID NO: 1954027 - RNA, 21 nt, Human
gccuuuucccaacuccagaaa

SEQ ID NO: 1954028 - RNA, 16 nt, Human
ugaaguccaagcauuu

SEQ ID NO: 1954029 - RNA, 17 nt, Human
cuuccucugagccuugg

SEQ ID NO: 1954030 - RNA, 14 nt, Human
auauuuauuuuaau

SEQ ID NO: 1954031 - RNA, 21 nt, Human
uuacauuuguauaaaauaauu

SEQ ID NO: 1954032 - RNA, 21 nt, Human
ugcccauccugccccugagcc

SEQ ID NO: 1954033 - RNA, 15 nt, Human
caagcucacagaccu

SEQ ID NO: 1954034 - RNA, 23 nt, Human
gggagccugaucaccugcccugc

SEQ ID NO: 1954035 - RNA, 16 nt, Human
aagcuucacuguaaaa

SEQ ID NO: 1954036 - RNA, 22 nt, Human
acagauuugagcucagcccugg

SEQ ID NO: 1954037 - RNA, 16 nt, Human
ggcagagagguaggga

SEQ ID NO: 1954038 - RNA, 17 nt, Human
uuacagagacagaaagc

SEQ ID NO: 1954039 - RNA, 22 nt, Human
gaaauaagccagacaucaacag

SEQ ID NO: 1954040 - RNA, 23 nt, Human
aggaugguucccuugaugaagaa

SEQ ID NO: 1954041 - RNA, 18 nt, Human
gaagcaaaauuuuuucuc

SEQ ID NO: 1954042 - RNA, 17 nt, Human
uugugaagcaaaauuuu

SEQ ID NO: 1954043 - RNA, 16 nt, Human
cacuuaaaaaugguuu

SEQ ID NO: 1954044 - RNA, 16 nt, Human
ccauuuuuagugaaau

SEQ ID NO: 1954045 - RNA, 14 nt, Human
aagagugaaggauu

SEQ ID NO: 1954046 - RNA, 13 nt, Human
uuuugaaucauca

SEQ ID NO: 1954047 - RNA, 23 nt, Human
ugaauuacauuuguauaaaauaa

SEQ ID NO: 1954048 - RNA, 17 nt, Human
aaagacaaggaaaaaau

SEQ ID NO: 1954049 - RNA, 22 nt, Human
aggcuccacuuggucugugaga

SEQ ID NO: 1954050 - RNA, 21 nt, Human
cuaaauugacacuuaaaaaug

SEQ ID NO: 1954051 - RNA, 22 nt, Human
uaaaacaagcacuaaacaaaga

SEQ ID NO: 1954052 - RNA, 21 nt, Human
cuggccuucggccuccauccu

SEQ ID NO: 1954053 - RNA, 19 nt, Human
gacagucaccucauggaau

SEQ ID NO: 1954054 - RNA, 13 nt, Human
aagugcagccccg

SEQ ID NO: 1954055 - RNA, 14 nt, Human
uacuaauuuuaaaa

SEQ ID NO: 1954056 - RNA, 18 nt, Human
auaauccuaaacauauga

SEQ ID NO: 1954057 - RNA, 19 nt, Human
aaucuacacuccagugaga

SEQ ID NO: 1954058 - RNA, 17 nt, Human
uaauuccacagcugcuc

SEQ ID NO: 1954059 - RNA, 19 nt, Human
gagccugaucaccugcccu

SEQ ID NO: 1954060 - RNA, 14 nt, Human
ccuuaucaaaggac

SEQ ID NO: 1954061 - RNA, 15 nt, Human
ccucagucucccucc

SEQ ID NO: 1954062 - RNA, 18 nt, Human
cuuugagcgcccacuaga

SEQ ID NO: 1954063 - RNA, 11 nt, Human
gccaugggaca

SEQ ID NO: 1954064 - RNA, 14 nt, Human
cucuggcuccagcu

SEQ ID NO: 1954065 - RNA, 21 nt, Human
uuauuuucuauaauuuaaaua

SEQ ID NO: 1954066 - RNA, 18 nt, Human
acuggacucaccuccccc

SEQ ID NO: 1954067 - RNA, 17 nt, Human
aaauaacaauaaaagac

SEQ ID NO: 1954068 - RNA, 23 nt, Human
auucaauaucuuuuuuuuaauaa

SEQ ID NO: 1954069 - RNA, 19 nt, Human
cucacauuuauauuuuugu

SEQ ID NO: 1954070 - RNA, 16 nt, Human
ggcugagccucagucu

SEQ ID NO: 1954071 - RNA, 23 nt, Human
caaagcugaaauggacuuuugua

SEQ ID NO: 1954072 - RNA, 15 nt, Human
uacuaauuuuaaaau

SEQ ID NO: 1954073 - RNA, 17 nt, Human
cuggagggaagccuugg

SEQ ID NO: 1954074 - RNA, 15 nt, Human
ucugcagauaaacag

SEQ ID NO: 1954075 - RNA, 23 nt, Human
cuaguaauuggaaaggcagcucu

SEQ ID NO: 1954076 - RNA, 23 nt, Human
cucauguccacugguucuucuug

SEQ ID NO: 1954077 - RNA, 16 nt, Human
ccuaagugcagccccg

SEQ ID NO: 1954078 - RNA, 15 nt, Human
acucaccucccccau

SEQ ID NO: 1954079 - RNA, 13 nt, Human
uaaacauguuuau

SEQ ID NO: 1954080 - RNA, 22 nt, Human
cacuuccaagagccuuuuuuug

SEQ ID NO: 1954081 - RNA, 14 nt, Human
ggcaauagucaaau

SEQ ID NO: 1954082 - RNA, 13 nt, Human
agacagcucugca

SEQ ID NO: 1954083 - RNA, 16 nt, Human
ugcuaagucuuauaua

SEQ ID NO: 1954084 - RNA, 23 nt, Human
acugucuuguuggacgagaaaac

SEQ ID NO: 1954085 - RNA, 19 nt, Human
agcagcuuauucacaagac

SEQ ID NO: 1954086 - RNA, 22 nt, Human
aggaugccccgucccccucugg

SEQ ID NO: 1954087 - RNA, 19 nt, Human
cuggccuucggccuccauc

SEQ ID NO: 1954088 - RNA, 20 nt, Human
caagagccuuuuuuugaaaa

SEQ ID NO: 1954089 - RNA, 12 nt, Human
auucugaaagca

SEQ ID NO: 1954090 - RNA, 22 nt, Human
aaacauccuacaagacacagug

SEQ ID NO: 1954091 - RNA, 18 nt, Human
auuuuuagugaaauauua

SEQ ID NO: 1954092 - RNA, 19 nt, Human
ugaaauggacuuuuguaca

SEQ ID NO: 1954093 - RNA, 15 nt, Human
uucugcacacagcac

SEQ ID NO: 1954094 - RNA, 15 nt, Human
auagaaguaaaaaca

SEQ ID NO: 1954095 - RNA, 11 nt, Human
ggucacaggaa

SEQ ID NO: 1954096 - RNA, 19 nt, Human
auuuucaguuauuauauuu

SEQ ID NO: 1954097 - RNA, 14 nt, Human
cucugccucagaaa

SEQ ID NO: 1954098 - RNA, 15 nt, Human
ugagcucagcccugg

SEQ ID NO: 1954099 - RNA, 16 nt, Human
uuucuauaauuuaaau

SEQ ID NO: 1954100 - RNA, 21 nt, Human
gaaaaguauguuagugcaaau

SEQ ID NO: 1954101 - RNA, 21 nt, Human
aaucaccaaggcugauuaaac

SEQ ID NO: 1954102 - RNA, 18 nt, Human
ucuaugaaauauuauguu

SEQ ID NO: 1954103 - RNA, 16 nt, Human
ugcauagguuuaauaa

SEQ ID NO: 1954104 - RNA, 15 nt, Human
gacaguauggcagcu

SEQ ID NO: 1954105 - RNA, 22 nt, Human
agucuuucacauuuaaauaaag

SEQ ID NO: 1954106 - RNA, 13 nt, Human
agccucagucucc

SEQ ID NO: 1954107 - RNA, 23 nt, Human
uaaguuuuuuuuuaaaaaagaaa

SEQ ID NO: 1954108 - RNA, 17 nt, Human
agucccaggcugagccu

SEQ ID NO: 1954109 - RNA, 14 nt, Human
ccccugagcuugca

SEQ ID NO: 1954110 - RNA, 18 nt, Human
acaaaugggaaacaaaag

SEQ ID NO: 1954111 - RNA, 14 nt, Human
ugcuucuguuuuau

SEQ ID NO: 1954112 - RNA, 19 nt, Human
aagucuuucacauuuaaau

SEQ ID NO: 1954113 - RNA, 21 nt, Human
aagcuccauuuuuagugaaau

SEQ ID NO: 1954114 - RNA, 23 nt, Human
ggucuaucuuugagcgcccacua

SEQ ID NO: 1954115 - RNA, 15 nt, Human
uauaauuuaaauaua

SEQ ID NO: 1954116 - RNA, 20 nt, Human
aacaagccuccuuuuaaagu

SEQ ID NO: 1954117 - RNA, 22 nt, Human
uauccuacuuccccuuccuaau

SEQ ID NO: 1954118 - RNA, 14 nt, Human
agagguccacaaca

SEQ ID NO: 1954119 - RNA, 21 nt, Human
ugaaauggacuuuuguacaua

SEQ ID NO: 1954120 - RNA, 17 nt, Human
gauaaaagacagugaaa

SEQ ID NO: 1954121 - RNA, 13 nt, Human
aguguuugaaagc

SEQ ID NO: 1954122 - RNA, 19 nt, Human
uaguuuaugauuccaccua

SEQ ID NO: 1954123 - RNA, 17 nt, Human
cccacuagacccacugg

SEQ ID NO: 1954124 - RNA, 16 nt, Human
cacuggacucaccucc

SEQ ID NO: 1954125 - RNA, 19 nt, Human
aguauuucuaugaaauauu

SEQ ID NO: 1954126 - RNA, 18 nt, Human
aagucuuucacauuuaaa

SEQ ID NO: 1954127 - RNA, 17 nt, Human
agaaucacuugaacccg

SEQ ID NO: 1954128 - RNA, 16 nt, Human
aauuccacagcugcuc

SEQ ID NO: 1954129 - RNA, 15 nt, Human
auauuuuuuguuaaa

SEQ ID NO: 1954130 - RNA, 21 nt, Human
agccucuuagaugcaguucug

SEQ ID NO: 1954131 - RNA, 23 nt, Human
aaaauaucacuugucaauaaaau

SEQ ID NO: 1954132 - RNA, 18 nt, Human
aagaccucauuuugaagg

SEQ ID NO: 1954133 - RNA, 15 nt, Human
ucacaggacagcccu

SEQ ID NO: 1954134 - RNA, 20 nt, Human
aauuaaguuuuuuuuuaaaa

SEQ ID NO: 1954135 - RNA, 13 nt, Human
cucagaaaacaag

SEQ ID NO: 1954136 - RNA, 19 nt, Human
uggcaagcucuaucaccaa

SEQ ID NO: 1954137 - RNA, 13 nt, Human
cucugagccuugg

SEQ ID NO: 1954138 - RNA, 14 nt, Human
aaaagaaacauuug

SEQ ID NO: 1954139 - RNA, 12 nt, Human
gcaaagcccagc

SEQ ID NO: 1954140 - RNA, 14 nt, Human
aaauauuauuuuau

SEQ ID NO: 1954141 - RNA, 13 nt, Human
cacaacacacaga

SEQ ID NO: 1954142 - RNA, 14 nt, Human
uaaauaguuuauga

SEQ ID NO: 1954143 - RNA, 16 nt, Human
ugaaauuguauuacaa

SEQ ID NO: 1954144 - RNA, 20 nt, Human
caaauauaaauaaaaauaau

SEQ ID NO: 1954145 - RNA, 14 nt, Human
uugcuggagcucug

SEQ ID NO: 1954146 - RNA, 21 nt, Human
uauuauuuuauagcuacuaau

SEQ ID NO: 1954147 - RNA, 13 nt, Human
aagacagugaaag

SEQ ID NO: 1954148 - RNA, 11 nt, Human
accauuuuuac

SEQ ID NO: 1954149 - RNA, 13 nt, Human
uggacgagaaaac

SEQ ID NO: 1954150 - RNA, 12 nt, Human
acaagaaaugaa

SEQ ID NO: 1954151 - RNA, 14 nt, Human
agguugcagugagc

SEQ ID NO: 1954152 - RNA, 14 nt, Human
aauaguuuaugauu

SEQ ID NO: 1954153 - RNA, 13 nt, Human
ucucccucccuug

SEQ ID NO: 1954154 - RNA, 16 nt, Human
ugacaagcucacagac

SEQ ID NO: 1954155 - RNA, 15 nt, Human
agaauaccacaggaa

SEQ ID NO: 1954156 - RNA, 14 nt, Human
auuauuuuuuaaaa

SEQ ID NO: 1954157 - RNA, 14 nt, Human
uauaauuuaaaaua

SEQ ID NO: 1954158 - RNA, 22 nt, Human
aggacaccauuuuggcaagcuc

SEQ ID NO: 1954159 - RNA, 14 nt, Human
acccgggaggcaga

SEQ ID NO: 1954160 - RNA, 23 nt, Human
gaaaaucuuauaauuuaaaauau

SEQ ID NO: 1954161 - RNA, 15 nt, Human
acauccuacaagaca

SEQ ID NO: 1954162 - RNA, 14 nt, Human
acuggacucaccuc

SEQ ID NO: 1954163 - RNA, 19 nt, Human
uuugccaaguucuccacua

SEQ ID NO: 1954164 - RNA, 23 nt, Human
ggaggcagagguugcagugagcc

SEQ ID NO: 1954165 - RNA, 15 nt, Human
augauaacuggaaac

SEQ ID NO: 1954166 - RNA, 19 nt, Human
accccugagcuugcagaga

SEQ ID NO: 1954167 - RNA, 12 nt, Human
auuuuaaaagaa

SEQ ID NO: 1954168 - RNA, 15 nt, Human
uuuagugaaauauua

SEQ ID NO: 1954169 - RNA, 16 nt, Human
uacauuuguauaaaau

SEQ ID NO: 1954170 - RNA, 14 nt, Human
auuugaaauuguau

SEQ ID NO: 1954171 - RNA, 18 nt, Human
auguuaaaacugggacag

SEQ ID NO: 1954172 - RNA, 20 nt, Human
aauucuugccaaauauaaau

SEQ ID NO: 1954173 - RNA, 16 nt, Human
ccacuuauaggaauug

SEQ ID NO: 1954174 - RNA, 15 nt, Human
cuggguuccuuccuc

SEQ ID NO: 1954175 - RNA, 14 nt, Human
cauagaaguaaaaa

SEQ ID NO: 1954176 - RNA, 19 nt, Human
aaaauaacgauaaaagaca

SEQ ID NO: 1954177 - RNA, 13 nt, Human
uuauucacaagac

SEQ ID NO: 1954178 - RNA, 16 nt, Human
ugugagaugcuagaac

SEQ ID NO: 1954179 - RNA, 20 nt, Human
ugccccccagcccuccuuau

SEQ ID NO: 1954180 - RNA, 16 nt, Human
agguacuucaaauccu

SEQ ID NO: 1954181 - RNA, 19 nt, Human
gucuuucacauuuaaauaa

SEQ ID NO: 1954182 - RNA, 16 nt, Human
ucuuggucucaguguc

SEQ ID NO: 1954183 - RNA, 16 nt, Human
ugcaaauugucacagg

SEQ ID NO: 1954184 - RNA, 22 nt, Human
ccauuucuugagguaaaagcau

SEQ ID NO: 1954185 - RNA, 17 nt, Human
gacagucaccucaugga

SEQ ID NO: 1954186 - RNA, 15 nt, Human
gcacagccucuuaga

SEQ ID NO: 1954187 - RNA, 17 nt, Human
aaucuuucacaggggac

SEQ ID NO: 1954188 - RNA, 19 nt, Human
ugaaauuguauuacaaauc

SEQ ID NO: 1954189 - RNA, 23 nt, Human
aaguauccuucagccugaaagag

SEQ ID NO: 1954190 - RNA, 14 nt, Human
uauaaauaaaaaua

SEQ ID NO: 1954191 - RNA, 18 nt, Human
uucugauauuggacagua

SEQ ID NO: 1954192 - RNA, 23 nt, Human
cugaaaucauacuucuuaggguu

SEQ ID NO: 1954193 - RNA, 20 nt, Human
auaagccagacaucaacaga

SEQ ID NO: 1954194 - RNA, 20 nt, Human
uuucuucaacucccugcccc

SEQ ID NO: 1954195 - RNA, 14 nt, Human
gagcccauggcacu

SEQ ID NO: 1954196 - RNA, 21 nt, Human
agggugauauuaaccaggggc

SEQ ID NO: 1954197 - RNA, 18 nt, Human
uuggggccuaugcagagg

SEQ ID NO: 1954198 - RNA, 17 nt, Human
uccucugagccuuggga

SEQ ID NO: 1954199 - RNA, 19 nt, Human
cccugcaaagcccagcuug

SEQ ID NO: 1954200 - RNA, 17 nt, Human
ccucagucucccucccu

SEQ ID NO: 1954201 - RNA, 18 nt, Human
uaaauugacacuuaaaaa

SEQ ID NO: 1954202 - RNA, 14 nt, Human
cugccccccagccc

SEQ ID NO: 1954203 - RNA, 14 nt, Human
uugacccacaagaa

SEQ ID NO: 1954204 - RNA, 12 nt, Human
aucguguccccu

SEQ ID NO: 1954205 - RNA, 15 nt, Human
aaaauaacaaugaaa

SEQ ID NO: 1954206 - RNA, 22 nt, Human
ucaacuccaaacugacucuuaa

SEQ ID NO: 1954207 - RNA, 16 nt, Human
uggucugugagaugcu

SEQ ID NO: 1954208 - RNA, 15 nt, Human
ugcuucuguuuuaua

SEQ ID NO: 1954209 - RNA, 20 nt, Human
acagcccuucuuuccacaga

SEQ ID NO: 1954210 - RNA, 19 nt, Human
augaauuacauuuguauaa

SEQ ID NO: 1954211 - RNA, 16 nt, Human
caugguuuagaaagcu

SEQ ID NO: 1954212 - RNA, 13 nt, Human
auaacgauaaaag

SEQ ID NO: 1954213 - RNA, 19 nt, Human
auuaaguuuuuuuuuaaaa

SEQ ID NO: 1954214 - RNA, 20 nt, Human
cacagcacgggggccaagga

SEQ ID NO: 1954215 - RNA, 16 nt, Human
agugaaauauuauuuu

SEQ ID NO: 1954216 - RNA, 18 nt, Human
cagugaaagaaaauaaca

SEQ ID NO: 1954217 - RNA, 16 nt, Human
uauguucuaagaagug

SEQ ID NO: 1954218 - RNA, 23 nt, Human
uuuauaugcuucuguuuuauaau

SEQ ID NO: 1954219 - RNA, 17 nt, Human
agcgacagugagacucu

SEQ ID NO: 1954220 - RNA, 17 nt, Human
accugagccccaaaagg

SEQ ID NO: 1954221 - RNA, 14 nt, Human
cuugagguaaaagc

SEQ ID NO: 1954222 - RNA, 15 nt, Human
aaaaaagaaacauuu

SEQ ID NO: 1954223 - RNA, 22 nt, Human
caaugcuguauuuuaaaagaau

SEQ ID NO: 1954224 - RNA, 16 nt, Human
uuucacauuuaaauaa

SEQ ID NO: 1954225 - RNA, 19 nt, Human
augaaguacucauacaugu

SEQ ID NO: 1954226 - RNA, 19 nt, Human
cugcaaagcccagcuugaa

SEQ ID NO: 1954227 - RNA, 10 nt, Human
accugagccc

SEQ ID NO: 1954228 - RNA, 15 nt, Human
gccucuuagaugcag

SEQ ID NO: 1954229 - RNA, 16 nt, Human
gccucagucucccucc

SEQ ID NO: 1954230 - RNA, 11 nt, Human
ccugagcccca

SEQ ID NO: 1954231 - RNA, 22 nt, Human
gaugcaguuguugcccacagcu

SEQ ID NO: 1954232 - RNA, 11 nt, Human
caucuagugag

SEQ ID NO: 1954233 - RNA, 17 nt, Human
uaucuuuuuuuuaauaa

SEQ ID NO: 1954234 - RNA, 13 nt, Human
guaacuaauuuua

SEQ ID NO: 1954235 - RNA, 17 nt, Human
acuugaacccauauuug

SEQ ID NO: 1954236 - RNA, 13 nt, Human
ccaggcugagccu

SEQ ID NO: 1954237 - RNA, 14 nt, Human
uucuggaauaaucc

SEQ ID NO: 1954238 - RNA, 19 nt, Human
cagcacgggggccaaggau

SEQ ID NO: 1954239 - RNA, 17 nt, Human
uucugagcauuuaauau

SEQ ID NO: 1954240 - RNA, 15 nt, Human
ucccccaucucuucu

SEQ ID NO: 1954241 - RNA, 18 nt, Human
uggucaauuuuguuaugu

SEQ ID NO: 1954242 - RNA, 14 nt, Human
ugagcuugcagaga

SEQ ID NO: 1954243 - RNA, 16 nt, Human
acuaguuucccuugca

SEQ ID NO: 1954244 - RNA, 13 nt, Human
aacucuauaaugu

SEQ ID NO: 1954245 - RNA, 17 nt, Human
cuucacuguaaaauaau

SEQ ID NO: 1954246 - RNA, 22 nt, Human
accuaacgaaguauccuucagc

SEQ ID NO: 1954247 - RNA, 20 nt, Human
ucaauaaaauccauacauuu

SEQ ID NO: 1954248 - RNA, 17 nt, Human
ggagcucguggaacagu

SEQ ID NO: 1954249 - RNA, 18 nt, Human
uaaaagacagugaaagaa

SEQ ID NO: 1954250 - RNA, 22 nt, Human
aauuuuuucucuaggaaauauu

SEQ ID NO: 1954251 - RNA, 12 nt, Human
uucucuaggaaa

SEQ ID NO: 1954252 - RNA, 15 nt, Human
aagcacuaaacaaag

SEQ ID NO: 1954253 - RNA, 20 nt, Human
gagccucagucucccucccu

SEQ ID NO: 1954254 - RNA, 21 nt, Human
cauuucuugagguaaaagcau

SEQ ID NO: 1954255 - RNA, 14 nt, Human
aucaaaagaaagaa

SEQ ID NO: 1954256 - RNA, 13 nt, Human
ugaaauuguauua

SEQ ID NO: 1954257 - RNA, 14 nt, Human
gaaaaaauaacaau

SEQ ID NO: 1954258 - RNA, 21 nt, Human
caacacacagauuugagcuca

SEQ ID NO: 1954259 - RNA, 17 nt, Human
aaagcuccauuuuuagu

SEQ ID NO: 1954260 - RNA, 12 nt, Human
acaugagguacu

SEQ ID NO: 1954261 - RNA, 12 nt, Human
ggcugaugcagu

SEQ ID NO: 1954262 - RNA, 14 nt, Human
uccacuuggucugu

SEQ ID NO: 1954263 - RNA, 15 nt, Human
gugaccacugcagaa

SEQ ID NO: 1954264 - RNA, 16 nt, Human
ucagucucccucccuu

SEQ ID NO: 1954265 - RNA, 19 nt, Human
auugaggacacugauaugg

SEQ ID NO: 1954266 - RNA, 14 nt, Human
cuuggucugugaga

SEQ ID NO: 1954267 - RNA, 14 nt, Human
ugcuagaacucccu

SEQ ID NO: 1954268 - RNA, 16 nt, Human
uucacauuuaaauaaa

SEQ ID NO: 1954269 - RNA, 15 nt, Human
ugaaauuguauuaca

SEQ ID NO: 1954270 - RNA, 15 nt, Human
ucuaugaaauauuau

SEQ ID NO: 1954271 - RNA, 19 nt, Human
gcacacagcacgggggcca

SEQ ID NO: 1954272 - RNA, 20 nt, Human
uaauaaguugcauagguuua

SEQ ID NO: 1954273 - RNA, 14 nt, Human
cguguccccuaucc

SEQ ID NO: 1954274 - RNA, 20 nt, Human
auuacuguaagaaaauauca

SEQ ID NO: 1954275 - RNA, 21 nt, Human
ccaaggaugccccgucccccu

SEQ ID NO: 1954276 - RNA, 19 nt, Human
auaaaagacagugaaagaa

SEQ ID NO: 1954277 - RNA, 14 nt, Human
uaguaucaaaagaa

SEQ ID NO: 1954278 - RNA, 22 nt, Human
aucaucaagucuuucacauuua

SEQ ID NO: 1954279 - RNA, 14 nt, Human
aauauuauuuuaua

SEQ ID NO: 1954280 - RNA, 16 nt, Human
agaugcuagaacuccc

SEQ ID NO: 1954281 - RNA, 18 nt, Human
uuacaaaugggaaacaaa

SEQ ID NO: 1954282 - RNA, 15 nt, Human
uccagauccuggaaa

SEQ ID NO: 1954283 - RNA, 21 nt, Human
gaaaugaguuuuucuuuucau

SEQ ID NO: 1954284 - RNA, 14 nt, Human
auuuauuuuaauaa

SEQ ID NO: 1954285 - RNA, 14 nt, Human
acaagagcuuaaca

SEQ ID NO: 1954286 - RNA, 16 nt, Human
cuucuggguuccuucc

SEQ ID NO: 1954287 - RNA, 18 nt, Human
uccuaauuccacagcugc

SEQ ID NO: 1954288 - RNA, 20 nt, Human
aagaugguaccaccagucug

SEQ ID NO: 1954289 - RNA, 18 nt, Human
ugaacuugguuuuaauua

SEQ ID NO: 1954290 - RNA, 14 nt, Human
accauuuuuacuug

SEQ ID NO: 1954291 - RNA, 20 nt, Human
aaagagugaaggauuuaugu

SEQ ID NO: 1954292 - RNA, 16 nt, Human
gaagauguagaggaga

SEQ ID NO: 1954293 - RNA, 19 nt, Human
cuuggggccuaugcagagg

SEQ ID NO: 1954294 - RNA, 21 nt, Human
ccuuuuuuugaaaaaaagcuu

SEQ ID NO: 1954295 - RNA, 22 nt, Human
gaugcaguucugaagaagaugg

SEQ ID NO: 1954296 - RNA, 22 nt, Human
cuccugccuaagugcagccccg

SEQ ID NO: 1954297 - RNA, 20 nt, Human
gagccugaucaccugcccug

SEQ ID NO: 1954298 - RNA, 22 nt, Human
ugaauggcuaagcaaaauguga

SEQ ID NO: 1954299 - RNA, 12 nt, Human
acaagacacagu

SEQ ID NO: 1954300 - RNA, 18 nt, Human
uuguaaaggaauuuaaaa

SEQ ID NO: 1954301 - RNA, 13 nt, Human
auuuuuuaaaaaa

SEQ ID NO: 1954302 - RNA, 14 nt, Human
aaugauuaugaauu

SEQ ID NO: 1954303 - RNA, 22 nt, Human
uuccccuuccuaauuccacagc

SEQ ID NO: 1954304 - RNA, 22 nt, Human
ugaaaaaguucugcagauaaac

SEQ ID NO: 1954305 - RNA, 13 nt, Human
agcccagcuugaa

SEQ ID NO: 1954306 - RNA, 17 nt, Human
cucagucucccucccuu

SEQ ID NO: 1954307 - RNA, 19 nt, Human
cugccccccagcccuccuu

SEQ ID NO: 1954308 - RNA, 20 nt, Human
uaggaauugacccacaagaa

SEQ ID NO: 1954309 - RNA, 19 nt, Human
uguauacugugugcuaaaa

SEQ ID NO: 1954310 - RNA, 16 nt, Human
ucaguuuuugugaaaa

SEQ ID NO: 1954311 - RNA, 22 nt, Human
cuccagccugagcgacagugag

SEQ ID NO: 1954312 - RNA, 16 nt, Human
auuugaugcuacagga

SEQ ID NO: 1954313 - RNA, 13 nt, Human
aaaauaacaauga

SEQ ID NO: 1954314 - RNA, 15 nt, Human
guaaggggaauugag

SEQ ID NO: 1954315 - RNA, 15 nt, Human
uugcucauggaauug

SEQ ID NO: 1954316 - RNA, 21 nt, Human
uccuucagccugaaagaggaa

SEQ ID NO: 1954317 - RNA, 17 nt, Human
aaaguacaagagcuuaa

SEQ ID NO: 1954318 - RNA, 20 nt, Human
uauaugcuaagucuuauaua

SEQ ID NO: 1954319 - RNA, 21 nt, Human
guccccuauccuacuuccccu

SEQ ID NO: 1954320 - RNA, 18 nt, Human
ccuucggccuccauccug

SEQ ID NO: 1954321 - RNA, 21 nt, Human
uacaugagguacugagaguga

SEQ ID NO: 1954322 - RNA, 16 nt, Human
aaauaacaaugaaagu

SEQ ID NO: 1954323 - RNA, 16 nt, Human
ugcaugguuuagaaag

SEQ ID NO: 1954324 - RNA, 21 nt, Human
uccuacaagacacagugacca

SEQ ID NO: 1954325 - RNA, 23 nt, Human
uuagaugcaguucugaagaagau

SEQ ID NO: 1954326 - RNA, 22 nt, Human
caguauggcagcuuuccucaaa

SEQ ID NO: 1954327 - RNA, 15 nt, Human
auaauuuugugaagc

SEQ ID NO: 1954328 - RNA, 19 nt, Human
agaugcuagaacucccuuu

SEQ ID NO: 1954329 - RNA, 19 nt, Human
auaaaagacaaggaaaaaa

SEQ ID NO: 1954330 - RNA, 20 nt, Human
cucccugccccccagcccuc

SEQ ID NO: 1954331 - RNA, 13 nt, Human
cacauuuaaauaa

SEQ ID NO: 1954332 - RNA, 18 nt, Human
cauggaauuggagcucgu

SEQ ID NO: 1954333 - RNA, 18 nt, Human
ugaaaaaguucugcagau

SEQ ID NO: 1954334 - RNA, 13 nt, Human
augauuccaccua

SEQ ID NO: 1954335 - RNA, 18 nt, Human
aaaaguucugcagauaaa

SEQ ID NO: 1954336 - RNA, 19 nt, Human
agccugaucaccugcccug

SEQ ID NO: 1954337 - RNA, 21 nt, Human
ucacaugaacuuguaaaggaa

SEQ ID NO: 1954338 - RNA, 14 nt, Human
cucccugcccccca

SEQ ID NO: 1954339 - RNA, 13 nt, Human
agacacagugacc

SEQ ID NO: 1954340 - RNA, 14 nt, Human
acaaauccaaugaa

SEQ ID NO: 1954341 - RNA, 16 nt, Human
ucaucaaugaaugaau

SEQ ID NO: 1954342 - RNA, 17 nt, Human
aaauaacgauaaaagac

SEQ ID NO: 1954343 - RNA, 22 nt, Human
gugaacaaauuuacagagacag

SEQ ID NO: 1954344 - RNA, 21 nt, Human
accaaggagccaaacauccua

SEQ ID NO: 1954345 - RNA, 23 nt, Human
uuguaacaagccuccuuuuaaag

SEQ ID NO: 1954346 - RNA, 17 nt, Human
ugaacuugguuuuaauu

SEQ ID NO: 1954347 - RNA, 16 nt, Human
aagcauuuagauguau

SEQ ID NO: 1954348 - RNA, 16 nt, Human
uuauaauuuaaaauau

SEQ ID NO: 1954349 - RNA, 12 nt, Human
gacagugaaaga

SEQ ID NO: 1954350 - RNA, 20 nt, Human
ucaagucuuucacauuuaaa

SEQ ID NO: 1954351 - RNA, 12 nt, Human
agggauggggcu

SEQ ID NO: 1954352 - RNA, 13 nt, Human
ccucuggcuccag

SEQ ID NO: 1954353 - RNA, 15 nt, Human
ugagcgcccacuaga

SEQ ID NO: 1954354 - RNA, 18 nt, Human
acugugugcuaaaacaag

SEQ ID NO: 1954355 - RNA, 22 nt, Human
caccagucugacuguuuccauc

SEQ ID NO: 1954356 - RNA, 18 nt, Human
aaggaugccccguccccc

SEQ ID NO: 1954357 - RNA, 19 nt, Human
agaaaauaacgauaaaaga

SEQ ID NO: 1954358 - RNA, 18 nt, Human
aaauauuuauuuuaauaa

SEQ ID NO: 1954359 - RNA, 12 nt, Human
cuucaacucccu

SEQ ID NO: 1954360 - RNA, 22 nt, Human
cuuccuaauuccacagcugcuc

SEQ ID NO: 1954361 - RNA, 15 nt, Human
gcagagguugcagug

SEQ ID NO: 1954362 - RNA, 16 nt, Human
uagcuacuaauuuuaa

SEQ ID NO: 1954363 - RNA, 11 nt, Human
aauuccacagc

SEQ ID NO: 1954364 - RNA, 21 nt, Human
uuuauauaagcuuguauuccu

SEQ ID NO: 1954365 - RNA, 13 nt, Human
acaauaaaagaca

SEQ ID NO: 1954366 - RNA, 13 nt, Human
cgggaggcagagg

SEQ ID NO: 1954367 - RNA, 12 nt, Human
cuaagaagugaa

SEQ ID NO: 1954368 - RNA, 12 nt, Human
acugaaaucaua

SEQ ID NO: 1954369 - RNA, 12 nt, Human
acucccugcccc

SEQ ID NO: 1954370 - RNA, 12 nt, Human
cuacaagacaca

SEQ ID NO: 1954371 - RNA, 18 nt, Human
agccugaucaccugcccu

SEQ ID NO: 1954372 - RNA, 16 nt, Human
acauccuacaagacac

SEQ ID NO: 1954373 - RNA, 12 nt, Human
uuuuuuuuaaaa

SEQ ID NO: 1954374 - RNA, 17 nt, Human
cagugaaagaaaauaac

SEQ ID NO: 1954375 - RNA, 17 nt, Human
agguccacaacacacag

SEQ ID NO: 1954376 - RNA, 17 nt, Human
ccccaguuguuucuacu

SEQ ID NO: 1954377 - RNA, 20 nt, Human
agcuacuaauuuuaaaaugu

SEQ ID NO: 1954378 - RNA, 19 nt, Human
uggugaacuugguuuuaau

SEQ ID NO: 1954379 - RNA, 17 nt, Human
aaacauccuacaagaca

SEQ ID NO: 1954380 - RNA, 23 nt, Human
auuuuauagcuacuaauuuuaaa

SEQ ID NO: 1954381 - RNA, 19 nt, Human
ccgggcgugguggugagug

SEQ ID NO: 1954382 - RNA, 12 nt, Human
cauuauauuuau

SEQ ID NO: 1954383 - RNA, 17 nt, Human
cuacacuccagugagac

SEQ ID NO: 1954384 - RNA, 20 nt, Human
agaugcaguucugaagaaga

SEQ ID NO: 1954385 - RNA, 13 nt, Human
caacaucuaguga

SEQ ID NO: 1954386 - RNA, 13 nt, Human
gcagaacagugau

SEQ ID NO: 1954387 - RNA, 12 nt, Human
ccccuugccaua

SEQ ID NO: 1954388 - RNA, 17 nt, Human
cccacuggacucaccuc

SEQ ID NO: 1954389 - RNA, 16 nt, Human
uaucaaaagaaagaaa

SEQ ID NO: 1954390 - RNA, 19 nt, Human
ugaucaccugcccugcuga

SEQ ID NO: 1954391 - RNA, 16 nt, Human
ccuacaugagguacug

SEQ ID NO: 1954392 - RNA, 19 nt, Human
acuggacucaccuccccca

SEQ ID NO: 1954393 - RNA, 22 nt, Human
gauaaaagacagugaaagaaaa

SEQ ID NO: 1954394 - RNA, 22 nt, Human
aauuacauuuguauaaaauaau

SEQ ID NO: 1954395 - RNA, 19 nt, Human
uugugccccugcacuccag

SEQ ID NO: 1954396 - RNA, 21 nt, Human
ccucuguucugcacacagcac

SEQ ID NO: 1954397 - RNA, 23 nt, Human
caauaacgauaaaagacagugaa

SEQ ID NO: 1954398 - RNA, 21 nt, Human
uuuguauaaaauaauuuuuau

SEQ ID NO: 1954399 - RNA, 22 nt, Human
auauaaauaaaaauaauccuca

SEQ ID NO: 1954400 - RNA, 23 nt, Human
uccagguagaggguguguaagua

SEQ ID NO: 1954401 - RNA, 16 nt, Human
cugcucucaguucacu

SEQ ID NO: 1954402 - RNA, 15 nt, Human
aauugacccacaaga

SEQ ID NO: 1954403 - RNA, 22 nt, Human
caccucccccaucucuucuggg

SEQ ID NO: 1954404 - RNA, 16 nt, Human
uauuuuugugauuuug

SEQ ID NO: 1954405 - RNA, 18 nt, Human
uaguaucaaaagaaagaa

SEQ ID NO: 1954406 - RNA, 13 nt, Human
uaugaaauauuau

SEQ ID NO: 1954407 - RNA, 14 nt, Human
aagaagugaaaauc

SEQ ID NO: 1954408 - RNA, 18 nt, Human
ggaggacgcucucuggcc

SEQ ID NO: 1954409 - RNA, 17 nt, Human
ccuauccuacuuccccu

SEQ ID NO: 1954410 - RNA, 18 nt, Human
acagaaagcagaacagug

SEQ ID NO: 1954411 - RNA, 22 nt, Human
agaauuuuaugcggcauuuucu

SEQ ID NO: 1954412 - RNA, 18 nt, Human
agugucaaugcagccccc

SEQ ID NO: 1954413 - RNA, 19 nt, Human
guccaggucuaccaaaaau

SEQ ID NO: 1954414 - RNA, 13 nt, Human
gcucucuggccuu

SEQ ID NO: 1954415 - RNA, 14 nt, Human
ugguauguuuucag

SEQ ID NO: 1954416 - RNA, 16 nt, Human
uguucuaagaagugaa

SEQ ID NO: 1954417 - RNA, 16 nt, Human
ucuuauaauuuaaaau

SEQ ID NO: 1954418 - RNA, 16 nt, Human
cuucaacucccugccc

SEQ ID NO: 1954419 - RNA, 14 nt, Human
acagaauuuuaugc

SEQ ID NO: 1954420 - RNA, 17 nt, Human
ccacuggacucaccucc

SEQ ID NO: 1954421 - RNA, 15 nt, Human
ccacaagaaaugaaa

SEQ ID NO: 1954422 - RNA, 13 nt, Human
ugagcgacaguga

SEQ ID NO: 1954423 - RNA, 14 nt, Human
acuuggucugugag

SEQ ID NO: 1954424 - RNA, 16 nt, Human
uaacaauaaaagacaa

SEQ ID NO: 1954425 - RNA, 23 nt, Human
aucacagcuacuugggaggcuga

SEQ ID NO: 1954426 - RNA, 17 nt, Human
caaacauauauaacaau

SEQ ID NO: 1954427 - RNA, 23 nt, Human
cuacacgagauacagaauuuuau

SEQ ID NO: 1954428 - RNA, 21 nt, Human
uauuacuguaagaaaauauca

SEQ ID NO: 1954429 - RNA, 13 nt, Human
uuaugcuaaguga

SEQ ID NO: 1954430 - RNA, 14 nt, Human
cucaacaaacauaa

SEQ ID NO: 1954431 - RNA, 15 nt, Human
uggacgagaaaacaa

SEQ ID NO: 1954432 - RNA, 13 nt, Human
uaauuuuuauauu

SEQ ID NO: 1954433 - RNA, 16 nt, Human
uucccaacuccagaaa

SEQ ID NO: 1954434 - RNA, 16 nt, Human
uaggauguugaaaaag

SEQ ID NO: 1954435 - RNA, 21 nt, Human
auuccuuuuucucuccucucc

SEQ ID NO: 1954436 - RNA, 15 nt, Human
cuuuucccaacucca

SEQ ID NO: 1954437 - RNA, 19 nt, Human
auucccagccagcacagcc

SEQ ID NO: 1954438 - RNA, 17 nt, Human
caagaaaugaaagcagg

SEQ ID NO: 1954439 - RNA, 16 nt, Human
gccaaggaugccccgu

SEQ ID NO: 1954440 - RNA, 23 nt, Human
auauaacaaugcuguauuuuaaa

SEQ ID NO: 1954441 - RNA, 14 nt, Human
cuguaaucacagcu

SEQ ID NO: 1954442 - RNA, 22 nt, Human
cucuggccuucggccuccaucc

SEQ ID NO: 1954443 - RNA, 13 nt, Human
cccaaaaggcaga

SEQ ID NO: 1954444 - RNA, 18 nt, Human
gccugagcgacagugaga

SEQ ID NO: 1954445 - RNA, 15 nt, Human
auuugguaaggggaa

SEQ ID NO: 1954446 - RNA, 15 nt, Human
acaaaugggaaacaa

SEQ ID NO: 1954447 - RNA, 20 nt, Human
cucuguucugcacacagcac

SEQ ID NO: 1954448 - RNA, 19 nt, Human
gccccccagcccuccuuau

SEQ ID NO: 1954449 - RNA, 16 nt, Human
ccuggugggcagagag

SEQ ID NO: 1954450 - RNA, 14 nt, Human
agaaaauaacaaua

SEQ ID NO: 1954451 - RNA, 22 nt, Human
guguccccuauccuacuucccc

SEQ ID NO: 1954452 - RNA, 17 nt, Human
acccacuggacucaccu

SEQ ID NO: 1954453 - RNA, 21 nt, Human
caagacugcacaucaaaauau

SEQ ID NO: 1954454 - RNA, 22 nt, Human
gaagugaaaaucuacacuccag

SEQ ID NO: 1954455 - RNA, 15 nt, Human
auaaaguguuugaaa

SEQ ID NO: 1954456 - RNA, 12 nt, Human
ucaccccuugcc

SEQ ID NO: 1954457 - RNA, 20 nt, Human
ccauuguggucacaggaagu

SEQ ID NO: 1954458 - RNA, 16 nt, Human
agugagacagcucugc

SEQ ID NO: 1954459 - RNA, 18 nt, Human
acaaaaggauaaugaaua

SEQ ID NO: 1954460 - RNA, 22 nt, Human
uucaauaucuuuuuuuuaauaa

SEQ ID NO: 1954461 - RNA, 13 nt, Human
uuuaaaaaaaaac

SEQ ID NO: 1954462 - RNA, 16 nt, Human
gccaugugcuaguaau

SEQ ID NO: 1954463 - RNA, 19 nt, Human
gucaaucagccuaguugau

SEQ ID NO: 1954464 - RNA, 18 nt, Human
cucuauguucuaagaagu

SEQ ID NO: 1954465 - RNA, 16 nt, Human
cagggacuugaaccca

SEQ ID NO: 1954466 - RNA, 23 nt, Human
ucuuagaugcaguucugaagaag

SEQ ID NO: 1954467 - RNA, 17 nt, Human
cguaaucguguccccua

SEQ ID NO: 1954468 - RNA, 14 nt, Human
guaacuaauuuuaa

SEQ ID NO: 1954469 - RNA, 22 nt, Human
uuuauagcuacuaauuuuaaaa

SEQ ID NO: 1954470 - RNA, 21 nt, Human
ccauccugccccugagcccau

SEQ ID NO: 1954471 - RNA, 11 nt, Human
ucaccugcccu

SEQ ID NO: 1954472 - RNA, 16 nt, Human
agugucaaugcagccc

SEQ ID NO: 1954473 - RNA, 20 nt, Human
acggacgaaccuugaaaacu

SEQ ID NO: 1954474 - RNA, 22 nt, Human
uuguaacaagccuccuuuuaaa

SEQ ID NO: 1954475 - RNA, 22 nt, Human
uggaaaguuuaugguuguauua

SEQ ID NO: 1954476 - RNA, 19 nt, Human
agaaaauaacaauaaaaga

SEQ ID NO: 1954477 - RNA, 20 nt, Human
aauaauuuuuauauuugaaa

SEQ ID NO: 1954478 - RNA, 19 nt, Human
acucugucucaguccauga

SEQ ID NO: 1954479 - RNA, 18 nt, Human
gcaaagcccagcuugaaa

SEQ ID NO: 1954480 - RNA, 21 nt, Human
caagacccaaaaggcagaagc

SEQ ID NO: 1954481 - RNA, 23 nt, Human
caacggggugaaacccugucucu

SEQ ID NO: 1954482 - RNA, 22 nt, Human
agacucgggauuaguacacacu

SEQ ID NO: 1954483 - RNA, 20 nt, Human
ugguuguauuauuuuuuaaa

SEQ ID NO: 1954484 - RNA, 14 nt, Human
uucacauuuaaaua

SEQ ID NO: 1954485 - RNA, 14 nt, Human
aaaacuucagacau

SEQ ID NO: 1954486 - RNA, 18 nt, Human
ugagcucagcccuggugg

SEQ ID NO: 1954487 - RNA, 17 nt, Human
gcaaauugucacaggac

SEQ ID NO: 1954488 - RNA, 11 nt, Human
ucaccuccccc

SEQ ID NO: 1954489 - RNA, 21 nt, Human
gaaaacaauaacgauaaaaga

SEQ ID NO: 1954490 - RNA, 16 nt, Human
cuucggccuccauccu

SEQ ID NO: 1954491 - RNA, 15 nt, Human
agaaaacaauaacga

SEQ ID NO: 1954492 - RNA, 21 nt, Human
gaagugaaaaucuacacucca

SEQ ID NO: 1954493 - RNA, 15 nt, Human
cucccugccccccag

SEQ ID NO: 1954494 - RNA, 23 nt, Human
gauagauaggucagugcaaauac

SEQ ID NO: 1954495 - RNA, 13 nt, Human
uaacaauaaaaga

SEQ ID NO: 1954496 - RNA, 15 nt, Human
aaacauaugaauuau

SEQ ID NO: 1954497 - RNA, 12 nt, Human
gaauuggagcuc

SEQ ID NO: 1954498 - RNA, 22 nt, Human
cugcucaauaaaguacaagagc

SEQ ID NO: 1954499 - RNA, 15 nt, Human
gaaaugaaagcaggg

SEQ ID NO: 1954500 - RNA, 23 nt, Human
uguugcccacagcuguaugauuc

SEQ ID NO: 1954501 - RNA, 12 nt, Human
agaaaacaauaa

SEQ ID NO: 1954502 - RNA, 12 nt, Human
uaagaagacugc

SEQ ID NO: 1954503 - RNA, 16 nt, Human
cacgggggccaaggau

SEQ ID NO: 1954504 - RNA, 16 nt, Human
gacauuugcucaugga

SEQ ID NO: 1954505 - RNA, 16 nt, Human
aggguguguaaguaga

SEQ ID NO: 1954506 - RNA, 16 nt, Human
aaugaaagcagggacu

SEQ ID NO: 1954507 - RNA, 18 nt, Human
gagucccaggcugagccu

SEQ ID NO: 1954508 - RNA, 15 nt, Human
ucuuauaauuuaaaa

SEQ ID NO: 1954509 - RNA, 18 nt, Human
auagcuacuaauuuuaaa

SEQ ID NO: 1954510 - RNA, 21 nt, Human
aauuuuuauauuugaaauauu

SEQ ID NO: 1954511 - RNA, 13 nt, Human
ugaaaaucuuaua

SEQ ID NO: 1954512 - RNA, 19 nt, Human
aaauaugccccauucaaca

SEQ ID NO: 1954513 - RNA, 16 nt, Human
uuaaauuguaauaggc

SEQ ID NO: 1954514 - RNA, 15 nt, Human
acaaggaaaaaauaa

SEQ ID NO: 1954515 - RNA, 13 nt, Human
aggaaaaaauaac

SEQ ID NO: 1954516 - RNA, 21 nt, Human
ugccuguaaucacagcuacuu

SEQ ID NO: 1954517 - RNA, 16 nt, Human
gccuaagugcagcccc

SEQ ID NO: 1954518 - RNA, 15 nt, Human
acaggguuuauguuu

SEQ ID NO: 1954519 - RNA, 16 nt, Human
augcuguauuuuaaaa

SEQ ID NO: 1954520 - RNA, 15 nt, Human
agccugaaagaggaa

SEQ ID NO: 1954521 - RNA, 22 nt, Human
gaggggagcaugggaagugacg

SEQ ID NO: 1954522 - RNA, 23 nt, Human
cuggccgggagccugaucaccug

SEQ ID NO: 1954523 - RNA, 21 nt, Human
aaaauuuuuucucuaggaaau

SEQ ID NO: 1954524 - RNA, 18 nt, Human
uuacuguaagaaaauauc

SEQ ID NO: 1954525 - RNA, 15 nt, Human
ucaaaggacaccauu

SEQ ID NO: 1954526 - RNA, 14 nt, Human
ucccuugaugaaga

SEQ ID NO: 1954527 - RNA, 15 nt, Human
uugacccacaagaaa

SEQ ID NO: 1954528 - RNA, 20 nt, Human
auaauccuaaacauaugaau

SEQ ID NO: 1954529 - RNA, 22 nt, Human
uuugaaacgaggauugggaaaa

SEQ ID NO: 1954530 - RNA, 20 nt, Human
ggccuaugcagagguccaca

SEQ ID NO: 1954531 - RNA, 13 nt, Human
uuggacgagaaaa

SEQ ID NO: 1954532 - RNA, 20 nt, Human
aaggaugccccgucccccuc

SEQ ID NO: 1954533 - RNA, 12 nt, Human
uuaauaaaccau

SEQ ID NO: 1954534 - RNA, 22 nt, Human
aaacaaggaugaauuaaguuuu

SEQ ID NO: 1954535 - RNA, 15 nt, Human
ggccuccauccugag

SEQ ID NO: 1954536 - RNA, 18 nt, Human
ucucuaggaaauauuuau

SEQ ID NO: 1954537 - RNA, 16 nt, Human
ccugagcgacagugag

SEQ ID NO: 1954538 - RNA, 14 nt, Human
aaccugagccccaa

SEQ ID NO: 1954539 - RNA, 21 nt, Human
auuuacaaaugggaaacaaaa

SEQ ID NO: 1954540 - RNA, 17 nt, Human
aaccuagggugauauua

SEQ ID NO: 1954541 - RNA, 15 nt, Human
cuacuaauuuuaaaa

SEQ ID NO: 1954542 - RNA, 12 nt, Human
aauuuaaauaua

SEQ ID NO: 1954543 - RNA, 21 nt, Human
uaauaggcguaacuaauuuua

SEQ ID NO: 1954544 - RNA, 16 nt, Human
ccacuuggucugugag

SEQ ID NO: 1954545 - RNA, 15 nt, Human
acuuuauaaaggauu

SEQ ID NO: 1954546 - RNA, 19 nt, Human
cgcccacuagacccacugg

SEQ ID NO: 1954547 - RNA, 20 nt, Human
aaauccuugaagauuuacca

SEQ ID NO: 1954548 - RNA, 20 nt, Human
aggcugagaugggagaauca

SEQ ID NO: 1954549 - RNA, 17 nt, Human
uaaaagacaaggaaaaa

SEQ ID NO: 1954550 - RNA, 23 nt, Human
ggaacaguuaccucugccucaga

SEQ ID NO: 1954551 - RNA, 21 nt, Human
cccacuggacucaccuccccc

SEQ ID NO: 1954552 - RNA, 21 nt, Human
acaguuaccucugccucagaa

SEQ ID NO: 1954553 - RNA, 17 nt, Human
gcaagcucuaucaccaa

SEQ ID NO: 1954554 - RNA, 20 nt, Human
aaagacagugaaagaaaaua

SEQ ID NO: 1954555 - RNA, 21 nt, Human
cacuugaacccgggaggcaga

SEQ ID NO: 1954556 - RNA, 20 nt, Human
ucacaugaacuuguaaagga

SEQ ID NO: 1954557 - RNA, 15 nt, Human
ggacucaccuccccc

SEQ ID NO: 1954558 - RNA, 14 nt, Human
cacuaaacaaagag

SEQ ID NO: 1954559 - RNA, 12 nt, Human
uauucacaagac

SEQ ID NO: 1954560 - RNA, 21 nt, Human
cugcccugcugagucccaggc

SEQ ID NO: 1954561 - RNA, 20 nt, Human
ccagugagacagcucugcau

SEQ ID NO: 1954562 - RNA, 17 nt, Human
augcagagguccacaac

SEQ ID NO: 1954563 - RNA, 21 nt, Human
auucauagcagcuuauucaca

SEQ ID NO: 1954564 - RNA, 15 nt, Human
aacgauaaaagacag

SEQ ID NO: 1954565 - RNA, 14 nt, Human
agaugcuagaacuc

SEQ ID NO: 1954566 - RNA, 22 nt, Human
caaaugggaaacaaaaggauaa

SEQ ID NO: 1954567 - RNA, 21 nt, Human
aaugaauggcuaagcaaaaug

SEQ ID NO: 1954568 - RNA, 21 nt, Human
gggagccugaucaccugcccu

SEQ ID NO: 1954569 - RNA, 18 nt, Human
aaaagacaaggaaaaaau

SEQ ID NO: 1954570 - RNA, 22 nt, Human
caaggaugccccgucccccucu

SEQ ID NO: 1954571 - RNA, 22 nt, Human
ggguuccuuccucugagccuug

SEQ ID NO: 1954572 - RNA, 15 nt, Human
auuauuuuuuaaaaa

SEQ ID NO: 1954573 - RNA, 20 nt, Human
uauuuauuacuguaagaaaa

SEQ ID NO: 1954574 - RNA, 15 nt, Human
cuaagcaaaauguga

SEQ ID NO: 1954575 - RNA, 18 nt, Human
auuuaggccaugggacag

SEQ ID NO: 1954576 - RNA, 22 nt, Human
cuggguuccuuccucugagccu

SEQ ID NO: 1954577 - RNA, 22 nt, Human
ugaccauacuaauuauaccccc

SEQ ID NO: 1954578 - RNA, 16 nt, Human
agugaaggauuuaugu

SEQ ID NO: 1954579 - RNA, 15 nt, Human
cucguggaacaguua

SEQ ID NO: 1954580 - RNA, 20 nt, Human
aauaucuuuuuuuuaauaaa

SEQ ID NO: 1954581 - RNA, 19 nt, Human
gagccucagucucccuccc

SEQ ID NO: 1954582 - RNA, 17 nt, Human
acuuccagauccuggaa

SEQ ID NO: 1954583 - RNA, 17 nt, Human
agcuacuaauuuuaaaa

SEQ ID NO: 1954584 - RNA, 11 nt, Human
cuguuuuauaa

SEQ ID NO: 1954585 - RNA, 23 nt, Human
aauauuuauuuuaauaauguuuc

SEQ ID NO: 1954586 - RNA, 11 nt, Human
caauaaaagac

SEQ ID NO: 1954587 - RNA, 16 nt, Human
cagggcucacagaauu

SEQ ID NO: 1954588 - RNA, 22 nt, Human
guacacugccuucucaacucca

SEQ ID NO: 1954589 - RNA, 23 nt, Human
auguuaaaacugggacaggggag

SEQ ID NO: 1954590 - RNA, 15 nt, Human
acaucaacagauaaa

SEQ ID NO: 1954591 - RNA, 15 nt, Human
ugaaacccugucucu

SEQ ID NO: 1954592 - RNA, 15 nt, Human
uugacacuuaaaaau

SEQ ID NO: 1954593 - RNA, 17 nt, Human
aguugauaaguacauga

SEQ ID NO: 1954594 - RNA, 21 nt, Human
auuauauggcuugaguuuaaa

SEQ ID NO: 1954595 - RNA, 14 nt, Human
ugugaaaagcucca

SEQ ID NO: 1954596 - RNA, 22 nt, Human
uucauucacucaacaaacauaa

SEQ ID NO: 1954597 - RNA, 21 nt, Human
accaccugccuauauuuuuug

SEQ ID NO: 1954598 - RNA, 17 nt, Human
gaagcaccaaucaugaa

SEQ ID NO: 1954599 - RNA, 12 nt, Human
cuggcuccagcu

SEQ ID NO: 1954600 - RNA, 16 nt, Human
ugaaguacucauacau

SEQ ID NO: 1954601 - RNA, 15 nt, Human
uacaggauuugaaau

SEQ ID NO: 1954602 - RNA, 14 nt, Human
acauagugaggagc

SEQ ID NO: 1954603 - RNA, 18 nt, Human
cagcuuauugucuaguga

SEQ ID NO: 1954604 - RNA, 15 nt, Human
aaggaauuuaaaaau

SEQ ID NO: 1954605 - RNA, 22 nt, Human
aaaucaggguuaguauugucca

SEQ ID NO: 1954606 - RNA, 14 nt, Human
uaauccuaaacaua

SEQ ID NO: 1954607 - RNA, 13 nt, Human
uaagugcagcccc

SEQ ID NO: 1954608 - RNA, 17 nt, Human
auuuucuauaauuuaaa

SEQ ID NO: 1954609 - RNA, 15 nt, Human
ugccccccagcccuc

SEQ ID NO: 1954610 - RNA, 22 nt, Human
cccuauccuacuuccccuuccu

SEQ ID NO: 1954611 - RNA, 13 nt, Human
ccuccuuuuaaag

SEQ ID NO: 1954612 - RNA, 17 nt, Human
aaauauaaauaaaaaua

SEQ ID NO: 1954613 - RNA, 14 nt, Human
gaaaacaauaacga

SEQ ID NO: 1954614 - RNA, 15 nt, Human
gucccaggcugagcc

SEQ ID NO: 1954615 - RNA, 13 nt, Human
aacacaacuauau

SEQ ID NO: 1954616 - RNA, 16 nt, Human
acauuugcucauggaa

SEQ ID NO: 1954617 - RNA, 14 nt, Human
aauuguauuacaaa

SEQ ID NO: 1954618 - RNA, 18 nt, Human
gaaaugaaagcagggacu

SEQ ID NO: 1954619 - RNA, 20 nt, Human
cagcuggccgggagccugau

SEQ ID NO: 1954620 - RNA, 12 nt, Human
gguuuauauaag

SEQ ID NO: 1954621 - RNA, 21 nt, Human
ugaaacgaggauugggaaaaa

SEQ ID NO: 1954622 - RNA, 18 nt, Human
acauguuacaacacggac

SEQ ID NO: 1954623 - RNA, 18 nt, Human
auuuuaacucuauaaugu

SEQ ID NO: 1954624 - RNA, 18 nt, Human
aguucuccacuagcuaug

SEQ ID NO: 1954625 - RNA, 12 nt, Human
aauacuuuauaa

SEQ ID NO: 1954626 - RNA, 12 nt, Human
uguuugaaagcu

SEQ ID NO: 1954627 - RNA, 18 nt, Human
uaaugaauacuuuauaaa

SEQ ID NO: 1954628 - RNA, 19 nt, Human
aaacaauaacgauaaaaga

SEQ ID NO: 1954629 - RNA, 21 nt, Human
acagugaaagaaaauaacaau

SEQ ID NO: 1954630 - RNA, 17 nt, Human
uguaaaggaauuuaaaa

SEQ ID NO: 1954631 - RNA, 21 nt, Human
ugagcucagcccuggugggca

SEQ ID NO: 1954632 - RNA, 17 nt, Human
augccccgucccccucu

SEQ ID NO: 1954633 - RNA, 16 nt, Human
gacaagcucacagacc

SEQ ID NO: 1954634 - RNA, 15 nt, Human
uuuaugguuguauua

SEQ ID NO: 1954635 - RNA, 16 nt, Human
ucuucaacucccugcc

SEQ ID NO: 1954636 - RNA, 16 nt, Human
uccugcaauuccacuu

SEQ ID NO: 1954637 - RNA, 23 nt, Human
agaaugauuaugaauuacauuug

SEQ ID NO: 1954638 - RNA, 16 nt, Human
ccuccuuaucaaagga

SEQ ID NO: 1954639 - RNA, 17 nt, Human
uaacugauuuguaacaa

SEQ ID NO: 1954640 - RNA, 17 nt, Human
cuaucucauuuccaagc

SEQ ID NO: 1954641 - RNA, 12 nt, Human
ucccccucuggc

SEQ ID NO: 1954642 - RNA, 13 nt, Human
cugcacuccagcc

SEQ ID NO: 1954643 - RNA, 17 nt, Human
agaugggagaaucacuu

SEQ ID NO: 1954644 - RNA, 20 nt, Human
acuccagugagacagcucug

SEQ ID NO: 1954645 - RNA, 23 nt, Human
gcccuggugccucaccccuugcc

SEQ ID NO: 1954646 - RNA, 20 nt, Human
ugagagugaacaaauuuaca

SEQ ID NO: 1954647 - RNA, 19 nt, Human
aauguuuacagauccccaa

SEQ ID NO: 1954648 - RNA, 16 nt, Human
cccccagcccuccuua

SEQ ID NO: 1954649 - RNA, 23 nt, Human
gcuuuggucuaucuuugagcgcc

SEQ ID NO: 1954650 - RNA, 14 nt, Human
cucaccccuugcca

SEQ ID NO: 1954651 - RNA, 21 nt, Human
ugaccauacuaauuauacccc

SEQ ID NO: 1954652 - RNA, 19 nt, Human
cuaagcuucacuguaaaau

SEQ ID NO: 1954653 - RNA, 14 nt, Human
aauauuauguuaaa

SEQ ID NO: 1954654 - RNA, 23 nt, Human
aguacucauacauguuacaacac

SEQ ID NO: 1954655 - RNA, 18 nt, Human
ccugccuaagugcagccc

SEQ ID NO: 1954656 - RNA, 13 nt, Human
ccaaggaugcccc

SEQ ID NO: 1954657 - RNA, 11 nt, Human
acugggacagg

SEQ ID NO: 1954658 - RNA, 15 nt, Human
ccgucccccucuggc

SEQ ID NO: 1954659 - RNA, 14 nt, Human
agucucccucccuu

SEQ ID NO: 1954660 - RNA, 18 nt, Human
uguacuuuauuuucuaua

SEQ ID NO: 1954661 - RNA, 22 nt, Human
auuuucuucucacauuuauauu

SEQ ID NO: 1954662 - RNA, 16 nt, Human
cauuuguauaaaauaa

SEQ ID NO: 1954663 - RNA, 20 nt, Human
augguuuagaaagcuugccc

SEQ ID NO: 1954664 - RNA, 13 nt, Human
uacagagacagaa

SEQ ID NO: 1954665 - RNA, 16 nt, Human
uugccauaauuacuau

SEQ ID NO: 1954666 - RNA, 20 nt, Human
uaaaagacagugaaagaaaa

SEQ ID NO: 1954667 - RNA, 16 nt, Human
gaaaaaauaacaauga

SEQ ID NO: 1954668 - RNA, 20 nt, Human
caaacauccuacaagacaca

SEQ ID NO: 1954669 - RNA, 16 nt, Human
aagaaaauaacaauaa

SEQ ID NO: 1954670 - RNA, 14 nt, Human
cuaagucuuauaua

SEQ ID NO: 1954671 - RNA, 23 nt, Human
uccaaacugacucuuaagaagac

SEQ ID NO: 1954672 - RNA, 18 nt, Human
cagaaagcagaacaguga

SEQ ID NO: 1954673 - RNA, 20 nt, Human
aaaaaccugagccccaaaag

SEQ ID NO: 1954674 - RNA, 18 nt, Human
gccuuggggcugaugcag

SEQ ID NO: 1954675 - RNA, 18 nt, Human
agagaaugagagacacac

SEQ ID NO: 1954676 - RNA, 19 nt, Human
aagcauuccaacuaucuca

SEQ ID NO: 1954677 - RNA, 16 nt, Human
aauuuuuaauuauaug

SEQ ID NO: 1954678 - RNA, 16 nt, Human
acauuuauauuuuugu

SEQ ID NO: 1954679 - RNA, 23 nt, Human
cucagcccuggugggcagagagg

SEQ ID NO: 1954680 - RNA, 17 nt, Human
ucuuucacauuuaaaua

SEQ ID NO: 1954681 - RNA, 20 nt, Human
cccugccccccagcccuccu

SEQ ID NO: 1954682 - RNA, 18 nt, Human
agcaaaauuuuuucucua

SEQ ID NO: 1954683 - RNA, 22 nt, Human
ccgggagccugaucaccugccc

SEQ ID NO: 1954684 - RNA, 19 nt, Human
cccugccccccagcccucc

SEQ ID NO: 1954685 - RNA, 16 nt, Human
augaauacuuuauaaa

SEQ ID NO: 1954686 - RNA, 15 nt, Human
cauuccaagccucau

SEQ ID NO: 1954687 - RNA, 19 nt, Human
uauauuuuuuguuaaauga

SEQ ID NO: 1954688 - RNA, 16 nt, Human
cugagccucagucucc

SEQ ID NO: 1954689 - RNA, 13 nt, Human
ugcauuucuaaag

SEQ ID NO: 1954690 - RNA, 16 nt, Human
auuuuuagugaaauau

SEQ ID NO: 1954691 - RNA, 14 nt, Human
uuaugauuaaguaa

SEQ ID NO: 1954692 - RNA, 17 nt, Human
uuucacauuuaaauaaa

SEQ ID NO: 1954693 - RNA, 18 nt, Human
uaaguuuuuuuuuaaaaa

SEQ ID NO: 1954694 - RNA, 17 nt, Human
gacgagaaaacaauaac

SEQ ID NO: 1954695 - RNA, 14 nt, Human
gagcucagcccugg

SEQ ID NO: 1954696 - RNA, 14 nt, Human
cgucccccucuggc

SEQ ID NO: 1954697 - RNA, 16 nt, Human
aaaguguuugaaagcu

SEQ ID NO: 1954698 - RNA, 19 nt, Human
aaugaauggcuaagcaaaa

SEQ ID NO: 1954699 - RNA, 22 nt, Human
uauuccuuuuucucuccucucc

SEQ ID NO: 1954700 - RNA, 23 nt, Human
gaaugagagacacacugaagaag

SEQ ID NO: 1954701 - RNA, 17 nt, Human
agcucugcccauccugc

SEQ ID NO: 1954702 - RNA, 18 nt, Human
acaugaacuuguaaagga

SEQ ID NO: 1954703 - RNA, 23 nt, Human
cauuguggucacaggaaguagag

SEQ ID NO: 1954704 - RNA, 14 nt, Human
aaucucaauauuuc

SEQ ID NO: 1954705 - RNA, 18 nt, Human
cccacuggacucaccucc

SEQ ID NO: 1954706 - RNA, 22 nt, Human
ugaguuuuucuuuucauuuacc

SEQ ID NO: 1954707 - RNA, 14 nt, Human
uaaauaaaaauaau

SEQ ID NO: 1954708 - RNA, 23 nt, Human
uguagguagaucuggucuuuaga

SEQ ID NO: 1954709 - RNA, 22 nt, Human
caucgcaauguaagacucggga

SEQ ID NO: 1954710 - RNA, 19 nt, Human
ggacucaccucccccaucu

SEQ ID NO: 1954711 - RNA, 20 nt, Human
gcuugcagagaugaggccgc

SEQ ID NO: 1954712 - RNA, 22 nt, Human
agaaagugacaagcucacagac

SEQ ID NO: 1954713 - RNA, 17 nt, Human
acaaaugcauuucuaaa

SEQ ID NO: 1954714 - RNA, 15 nt, Human
cucgugggacaguca

SEQ ID NO: 1954715 - RNA, 21 nt, Human
cccccauuguggucacaggaa

SEQ ID NO: 1954716 - RNA, 19 nt, Human
ccaccugccuauauuuuuu

SEQ ID NO: 1954717 - RNA, 14 nt, Human
uauaauuuaaauau

SEQ ID NO: 1954718 - RNA, 21 nt, Human
aaguuuaugguuguauuauuu

SEQ ID NO: 1954719 - RNA, 20 nt, Human
aguuguuucuacuacaugga

SEQ ID NO: 1954720 - RNA, 22 nt, Human
cuucagccugaaagaggaauga

SEQ ID NO: 1954721 - RNA, 13 nt, Human
aacaauaaaagac

SEQ ID NO: 1954722 - RNA, 18 nt, Human
gacccacuggacucaccu

SEQ ID NO: 1954723 - RNA, 16 nt, Human
ucuugagguaaaagca

SEQ ID NO: 1954724 - RNA, 19 nt, Human
uuuauaucaauuuaaaaaa

SEQ ID NO: 1954725 - RNA, 13 nt, Human
aucaggcuggcca

SEQ ID NO: 1954726 - RNA, 18 nt, Human
uucaauaucuuuuuuuua

SEQ ID NO: 1954727 - RNA, 13 nt, Human
uuaaaaaagaaac

SEQ ID NO: 1954728 - RNA, 14 nt, Human
uggcuugaguuuaa

SEQ ID NO: 1954729 - RNA, 15 nt, Human
caggaaguagaggag

SEQ ID NO: 1954730 - RNA, 13 nt, Human
aaauaaaaauaau

SEQ ID NO: 1954731 - RNA, 18 nt, Human
gacauuugcucauggaau

SEQ ID NO: 1954732 - RNA, 16 nt, Human
ugagaugcuagaacuc

SEQ ID NO: 1954733 - RNA, 16 nt, Human
aaaaugugauauguac

SEQ ID NO: 1954734 - RNA, 21 nt, Human
gcccugcugagucccaggcug

SEQ ID NO: 1954735 - RNA, 12 nt, Human
cagauuuuccug

SEQ ID NO: 1954736 - RNA, 18 nt, Human
gagccucagucucccucc

SEQ ID NO: 1954737 - RNA, 16 nt, Human
agcuugaaaccuucac

SEQ ID NO: 1954738 - RNA, 17 nt, Human
ucgggauuaguacacac

SEQ ID NO: 1954739 - RNA, 18 nt, Human
aaaaucuuauaauuuaaa

SEQ ID NO: 1954740 - RNA, 16 nt, Human
uggggauagugaggca

SEQ ID NO: 1954741 - RNA, 19 nt, Human
ucaauucuugccaaauaua

SEQ ID NO: 1954742 - RNA, 21 nt, Human
cuaguaucaaaagaaagaaaa

SEQ ID NO: 1954743 - RNA, 15 nt, Human
acugaagaagcacca

SEQ ID NO: 1954744 - RNA, 19 nt, Human
cucugcauacucauuagga

SEQ ID NO: 1954745 - RNA, 19 nt, Human
auuggagcucgugggacag

SEQ ID NO: 1954746 - RNA, 17 nt, Human
ugguucccuugaugaag

SEQ ID NO: 1954747 - RNA, 21 nt, Human
aucuuuuuuuuaauaaaccau

SEQ ID NO: 1954748 - RNA, 20 nt, Human
cuuauucacaagacccaaaa

SEQ ID NO: 1954749 - RNA, 20 nt, Human
aagucuuucacauuuaaaua

SEQ ID NO: 1954750 - RNA, 16 nt, Human
gagaaacuggaacucu

SEQ ID NO: 1954751 - RNA, 19 nt, Human
auagugaggagcuuugaaa

SEQ ID NO: 1954752 - RNA, 22 nt, Human
aauuuaaaaaaaaaccugagcc

SEQ ID NO: 1954753 - RNA, 18 nt, Human
gccccugcacuccagccu

SEQ ID NO: 1954754 - RNA, 23 nt, Human
caccucauggaauuggagcucgu

SEQ ID NO: 1954755 - RNA, 19 nt, Human
gguuccuuccucugagccu

SEQ ID NO: 1954756 - RNA, 19 nt, Human
uccagaaagugacaagcuc

SEQ ID NO: 1954757 - RNA, 14 nt, Human
ggacucaccucccc

SEQ ID NO: 1954758 - RNA, 16 nt, Human
auuuguauaaaauaau

SEQ ID NO: 1954759 - RNA, 23 nt, Human
gggccuaugcagagguccacaac

SEQ ID NO: 1954760 - RNA, 13 nt, Human
aucaaugaaugaa

SEQ ID NO: 1954761 - RNA, 14 nt, Human
agucugacuguuuc

SEQ ID NO: 1954762 - RNA, 22 nt, Human
cacagauuugagcucagcccug

SEQ ID NO: 1954763 - RNA, 19 nt, Human
cuucuggguuccuuccucu

SEQ ID NO: 1954764 - RNA, 14 nt, Human
uucuaugaaauauu

SEQ ID NO: 1954765 - RNA, 19 nt, Human
aaaagacagugaaagaaaa

SEQ ID NO: 1954766 - RNA, 16 nt, Human
ucccugccccccagcc

SEQ ID NO: 1954767 - RNA, 11 nt, Human
auuuaaaaauc

SEQ ID NO: 1954768 - RNA, 16 nt, Human
aaauauaaauaaaaau

SEQ ID NO: 1954769 - RNA, 15 nt, Human
uuacagagacagaaa

SEQ ID NO: 1954770 - RNA, 23 nt, Human
aaagcccagcuugaaaccuucac

SEQ ID NO: 1954771 - RNA, 15 nt, Human
uguuaaaugauuuca

SEQ ID NO: 1954772 - RNA, 15 nt, Human
uagggugauauuaac

SEQ ID NO: 1954773 - RNA, 17 nt, Human
uaaaagacagugaaaga

SEQ ID NO: 1954774 - RNA, 14 nt, Human
cacaagaaaugaaa

SEQ ID NO: 1954775 - RNA, 13 nt, Human
ucacuguaaaaua

SEQ ID NO: 1954776 - RNA, 15 nt, Human
gugaacuugguuuua

SEQ ID NO: 1954777 - RNA, 19 nt, Human
guacaagagcuuaacagug

SEQ ID NO: 1954778 - RNA, 15 nt, Human
cgggagccugaucac

SEQ ID NO: 1954779 - RNA, 18 nt, Human
ucuucaacucccugcccc

SEQ ID NO: 1954780 - RNA, 14 nt, Human
ucuauaauuuaaau

SEQ ID NO: 1954781 - RNA, 17 nt, Human
ucuauaauguguucauu

SEQ ID NO: 1954782 - RNA, 19 nt, Human
acagucaccucauggaauu

SEQ ID NO: 1954783 - RNA, 21 nt, Human
auuuuccugaaaacccuugcc

SEQ ID NO: 1954784 - RNA, 14 nt, Human
acccaaaaggcaga

SEQ ID NO: 1954785 - RNA, 19 nt, Human
gaaaauaacgauaaaagac

SEQ ID NO: 1954786 - RNA, 13 nt, Human
ucuuauaauuuaa

SEQ ID NO: 1954787 - RNA, 21 nt, Human
ucuucaacucccugcccccca

SEQ ID NO: 1954788 - RNA, 19 nt, Human
gagguacugagagugaaca

SEQ ID NO: 1954789 - RNA, 23 nt, Human
uagauguauagguugaugguggu

SEQ ID NO: 1954790 - RNA, 20 nt, Human
ugaggcuccacuuggucugu

SEQ ID NO: 1954791 - RNA, 21 nt, Human
cagagguccacaacacacaga

SEQ ID NO: 1954792 - RNA, 14 nt, Human
aagcaacccaaaug

SEQ ID NO: 1954793 - RNA, 16 nt, Human
aucaauuuaaaaaaaa

SEQ ID NO: 1954794 - RNA, 15 nt, Human
gcccacuagacccac

SEQ ID NO: 1954795 - RNA, 16 nt, Human
aaauaguuuaugauuc

SEQ ID NO: 1954796 - RNA, 17 nt, Human
caauaacgauaaaagac

SEQ ID NO: 1954797 - RNA, 19 nt, Human
uauauuuuugugauuuugu

SEQ ID NO: 1954798 - RNA, 16 nt, Human
ugacacuuaaaaaugg

SEQ ID NO: 1954799 - RNA, 16 nt, Human
auuauacccccugcaa

SEQ ID NO: 1954800 - RNA, 13 nt, Human
aggcuagauguau

SEQ ID NO: 1954801 - RNA, 18 nt, Human
gaugccccgucccccucu

SEQ ID NO: 1954802 - RNA, 15 nt, Human
acgagauacagaauu

SEQ ID NO: 1954803 - RNA, 19 nt, Human
cuggacucaccucccccau

SEQ ID NO: 1954804 - RNA, 18 nt, Human
acauuuauauuuuuguga

SEQ ID NO: 1954805 - RNA, 18 nt, Human
auuugcuggagcucugcc

SEQ ID NO: 1954806 - RNA, 22 nt, Human
acaugagguacugagagugaac

SEQ ID NO: 1954807 - RNA, 19 nt, Human
guaguccuguaauggaagc

SEQ ID NO: 1954808 - RNA, 17 nt, Human
uccuacaagacacagug

SEQ ID NO: 1954809 - RNA, 15 nt, Human
aucaaaggacaccau

SEQ ID NO: 1954810 - RNA, 16 nt, Human
auuuuaauaauguuuc

SEQ ID NO: 1954811 - RNA, 21 nt, Human
ccccugcaaagcccagcuuga

SEQ ID NO: 1954812 - RNA, 20 nt, Human
gaauucauucacucaacaaa

SEQ ID NO: 1954813 - RNA, 23 nt, Human
auuucugagcauuuaauauggau

SEQ ID NO: 1954814 - RNA, 13 nt, Human
auccugaggcucc

SEQ ID NO: 1954815 - RNA, 18 nt, Human
acaaauccaaugaaauga

SEQ ID NO: 1954816 - RNA, 22 nt, Human
gcagagagguagggauggggcu

SEQ ID NO: 1954817 - RNA, 17 nt, Human
caaauccaaugaaauga

SEQ ID NO: 1954818 - RNA, 19 nt, Human
uaucacuugucaauaaaau

SEQ ID NO: 1954819 - RNA, 20 nt, Human
ugauuucugagcauuuaaua

SEQ ID NO: 1954820 - RNA, 18 nt, Human
caugaauuaguuuuauau

SEQ ID NO: 1954821 - RNA, 23 nt, Human
gggaaacaaaaggauaaugaaua

SEQ ID NO: 1954822 - RNA, 15 nt, Human
auccugccccugagc

SEQ ID NO: 1954823 - RNA, 16 nt, Human
acaaauccaaugaaau

SEQ ID NO: 1954824 - RNA, 20 nt, Human
ccauacuaauuauacccccu

SEQ ID NO: 1954825 - RNA, 16 nt, Human
uaaugaauacuuuaua

SEQ ID NO: 1954826 - RNA, 18 nt, Human
uuuuaaaaaagaaacauu

SEQ ID NO: 1954827 - RNA, 15 nt, Human
uuaauuuguaguguu

SEQ ID NO: 1954828 - RNA, 14 nt, Human
ucaaugcagccccc

SEQ ID NO: 1954829 - RNA, 18 nt, Human
caaggcuagaaccaccug

SEQ ID NO: 1954830 - RNA, 15 nt, Human
auaauccuaaacaua

SEQ ID NO: 1954831 - RNA, 22 nt, Human
uacaugagguacugagagugaa

SEQ ID NO: 1954832 - RNA, 23 nt, Human
aucucuucuggguuccuuccucu

SEQ ID NO: 1954833 - RNA, 14 nt, Human
ucuuuuuuuuaaua

SEQ ID NO: 1954834 - RNA, 13 nt, Human
uucuauaauuuaa

SEQ ID NO: 1954835 - RNA, 19 nt, Human
ucagugucaaugcagcccc

SEQ ID NO: 1954836 - RNA, 22 nt, Human
cuuuccacagaagcuccaggua

SEQ ID NO: 1954837 - RNA, 18 nt, Human
acucuuaagaagacugca

SEQ ID NO: 1954838 - RNA, 16 nt, Human
cacuaguauuucuaug

SEQ ID NO: 1954839 - RNA, 12 nt, Human
aauaauuuuuaa

SEQ ID NO: 1954840 - RNA, 20 nt, Human
gcagagaugaggccgccaug

SEQ ID NO: 1954841 - RNA, 17 nt, Human
auauuugaaauauugac

SEQ ID NO: 1954842 - RNA, 15 nt, Human
aaagaaagaaaauca

SEQ ID NO: 1954843 - RNA, 20 nt, Human
ccagcuggccgggagccuga

SEQ ID NO: 1954844 - RNA, 12 nt, Human
uuuuauauuuga

SEQ ID NO: 1954845 - RNA, 20 nt, Human
gaccauacuaauuauacccc

SEQ ID NO: 1954846 - RNA, 19 nt, Human
acuucagcgguuuauauaa

SEQ ID NO: 1954847 - RNA, 20 nt, Human
agagacacacugaagaagca

SEQ ID NO: 1954848 - RNA, 13 nt, Human
ccagcccuccuua

SEQ ID NO: 1954849 - RNA, 19 nt, Human
uccauccugaggcuccacu

SEQ ID NO: 1954850 - RNA, 20 nt, Human
uacaucccuuaccugggaaa

SEQ ID NO: 1954851 - RNA, 14 nt, Human
agaauucauucacu

SEQ ID NO: 1954852 - RNA, 21 nt, Human
uauaaaauaauuuuuauauuu

SEQ ID NO: 1954853 - RNA, 20 nt, Human
uaugcuucuguuuuauaauu

SEQ ID NO: 1954854 - RNA, 19 nt, Human
aaaauaacaauaaaagaca

SEQ ID NO: 1954855 - RNA, 10 nt, Human
caacucccug

SEQ ID NO: 1954856 - RNA, 14 nt, Human
ugaucaccugcccu

SEQ ID NO: 1954857 - RNA, 16 nt, Human
uguaguccuguaaugg

SEQ ID NO: 1954858 - RNA, 21 nt, Human
ccucccuuggggccuaugcag

SEQ ID NO: 1954859 - RNA, 14 nt, Human
cuccagugagacag

SEQ ID NO: 1954860 - RNA, 14 nt, Human
uccacaacacacag

SEQ ID NO: 1954861 - RNA, 17 nt, Human
ggaaauauuuauuuuaa

SEQ ID NO: 1954862 - RNA, 13 nt, Human
acuaauuuuaaaa

SEQ ID NO: 1954863 - RNA, 20 nt, Human
cuucaacucccugcccccca

SEQ ID NO: 1954864 - RNA, 13 nt, Human
cacuguaaaauaa

SEQ ID NO: 1954865 - RNA, 18 nt, Human
ccacuuggucugugagau

SEQ ID NO: 1954866 - RNA, 20 nt, Human
auuacauuuguauaaaauaa

SEQ ID NO: 1954867 - RNA, 19 nt, Human
agaguuuagcuggaaaagu

SEQ ID NO: 1954868 - RNA, 15 nt, Human
auaucaauuuaaaaa

SEQ ID NO: 1954869 - RNA, 19 nt, Human
aaacaaaaggauaaugaau

SEQ ID NO: 1954870 - RNA, 19 nt, Human
ccccugcaaagcccagcuu

SEQ ID NO: 1954871 - RNA, 15 nt, Human
cacaggacagcccuu

SEQ ID NO: 1954872 - RNA, 19 nt, Human
gguuuaauaauuuuuaauu

SEQ ID NO: 1954873 - RNA, 22 nt, Human
caauaaaagacaaggaaaaaau

SEQ ID NO: 1954874 - RNA, 15 nt, Human
gagaugcuagaacuc

SEQ ID NO: 1954875 - RNA, 20 nt, Human
uuacaaauccaaugaaauga

SEQ ID NO: 1954876 - RNA, 17 nt, Human
gccaugggacagggagg

SEQ ID NO: 1954877 - RNA, 22 nt, Human
uuugaugcuacaggauuugaaa

SEQ ID NO: 1954878 - RNA, 13 nt, Human
cccugcacuccag

SEQ ID NO: 1954879 - RNA, 22 nt, Human
aggauggcuaguaucaaaagaa

SEQ ID NO: 1954880 - RNA, 16 nt, Human
ccucagucucccuccc

SEQ ID NO: 1954881 - RNA, 18 nt, Human
aucuacacuccagugaga

SEQ ID NO: 1954882 - RNA, 22 nt, Human
auauuuacaaaugggaaacaaa

SEQ ID NO: 1954883 - RNA, 21 nt, Human
gcugagucccaggcugagccu

SEQ ID NO: 1954884 - RNA, 13 nt, Human
agcucugcccauc

SEQ ID NO: 1954885 - RNA, 16 nt, Human
auccuugaagauuuac

SEQ ID NO: 1954886 - RNA, 14 nt, Human
agaaaugaaagcag

SEQ ID NO: 1954887 - RNA, 12 nt, Human
cauagaaguaaa

SEQ ID NO: 1954888 - RNA, 23 nt, Human
gaaaacaauaacgauaaaagaca

SEQ ID NO: 1954889 - RNA, 13 nt, Human
cauuuguauaaaa

SEQ ID NO: 1954890 - RNA, 15 nt, Human
auauaaauaaaaaua

SEQ ID NO: 1954891 - RNA, 23 nt, Human
caucaacagauaaauaguuuaug

SEQ ID NO: 1954892 - RNA, 15 nt, Human
uaaaagacaaggaaa

SEQ ID NO: 1954893 - RNA, 14 nt, Human
aaaagaaagaaaau

SEQ ID NO: 1954894 - RNA, 22 nt, Human
ggcuaagcuucacuguaaaaua

SEQ ID NO: 1954895 - RNA, 16 nt, Human
ugagcucagcccuggu

SEQ ID NO: 1954896 - RNA, 14 nt, Human
uaaaagacaaggaa

SEQ ID NO: 1954897 - RNA, 16 nt, Human
ggccuccauccugagg

SEQ ID NO: 1954898 - RNA, 14 nt, Human
caaggaaaaaauaa

SEQ ID NO: 1954899 - RNA, 15 nt, Human
aagccagauuuuccu

SEQ ID NO: 1954900 - RNA, 20 nt, Human
acuuuauuuucuauaauuua

SEQ ID NO: 1954901 - RNA, 18 nt, Human
uuuguuaaaugauuucau

SEQ ID NO: 1954902 - RNA, 22 nt, Human
ugucucuacuaaaaauacaaaa

SEQ ID NO: 1954903 - RNA, 12 nt, Human
cuccauuuuuag

SEQ ID NO: 1954904 - RNA, 11 nt, Human
gcaugguuuag

SEQ ID NO: 1954905 - RNA, 14 nt, Human
uuauuauauuuaca

SEQ ID NO: 1954906 - RNA, 13 nt, Human
auaaauaaaaaua

SEQ ID NO: 1954907 - RNA, 12 nt, Human
ggaggcugagau

SEQ ID NO: 1954908 - RNA, 16 nt, Human
ccccugcacuccagcc

SEQ ID NO: 1954909 - RNA, 16 nt, Human
uucaguuauuauauuu

SEQ ID NO: 1954910 - RNA, 14 nt, Human
gaaagcagaacagu

SEQ ID NO: 1954911 - RNA, 18 nt, Human
ucuucuggguuccuuccu

SEQ ID NO: 1954912 - RNA, 15 nt, Human
uaucaauuuaaaaaa

SEQ ID NO: 1954913 - RNA, 18 nt, Human
cagauuugagcucagccc

SEQ ID NO: 1954914 - RNA, 13 nt, Human
auaacuggaaacu

SEQ ID NO: 1954915 - RNA, 12 nt, Human
uauuauuuuuua

SEQ ID NO: 1954916 - RNA, 20 nt, Human
gggaggcagagguugcagug

SEQ ID NO: 1954917 - RNA, 19 nt, Human
cuagaguuuagcuggaaaa

SEQ ID NO: 1954918 - RNA, 20 nt, Human
acaagacccaaaaggcagaa

SEQ ID NO: 1954919 - RNA, 18 nt, Human
aaaucuuauaauuuaaaa

SEQ ID NO: 1954920 - RNA, 17 nt, Human
gccuaagugcagccccg

SEQ ID NO: 1954921 - RNA, 13 nt, Human
aucucaauauuuc

SEQ ID NO: 1954922 - RNA, 22 nt, Human
agaaugagagacacacugaaga

SEQ ID NO: 1954923 - RNA, 18 nt, Human
gcacuccagccugagcga

SEQ ID NO: 1954924 - RNA, 16 nt, Human
ccuccuuuuaaaguaa

SEQ ID NO: 1954925 - RNA, 20 nt, Human
uaacaagccuccuuuuaaag

SEQ ID NO: 1954926 - RNA, 18 nt, Human
uaucaaaagaaagaaaau

SEQ ID NO: 1954927 - RNA, 21 nt, Human
auguuuacagauccccaagcc

SEQ ID NO: 1954928 - RNA, 21 nt, Human
auggcagcuuuccucaaaacu

SEQ ID NO: 1954929 - RNA, 17 nt, Human
ugaaauaagccagacau

SEQ ID NO: 1954930 - RNA, 22 nt, Human
aucucuucuggguuccuuccuc

SEQ ID NO: 1954931 - RNA, 21 nt, Human
gcccauccugccccugagccc

SEQ ID NO: 1954932 - RNA, 19 nt, Human
gugaacuugguuuuaauua

SEQ ID NO: 1954933 - RNA, 13 nt, Human
aaaauaacgauaa

SEQ ID NO: 1954934 - RNA, 15 nt, Human
gaagauguagaggag

SEQ ID NO: 1954935 - RNA, 12 nt, Human
uucagccugaaa

SEQ ID NO: 1954936 - RNA, 14 nt, Human
uggacucaccuccc

SEQ ID NO: 1954937 - RNA, 13 nt, Human
uuuagugaaauau

SEQ ID NO: 1954938 - RNA, 14 nt, Human
uaaaauccauacau

SEQ ID NO: 1954939 - RNA, 16 nt, Human
aacuugguuuuaauua

SEQ ID NO: 1954940 - RNA, 16 nt, Human
uacaaaugggaaacaa

SEQ ID NO: 1954941 - RNA, 16 nt, Human
aaaauccauacauuug

SEQ ID NO: 1954942 - RNA, 21 nt, Human
uguaaaauggugugaccacug

SEQ ID NO: 1954943 - RNA, 17 nt, Human
ugaucaccugcccugcu

SEQ ID NO: 1954944 - RNA, 17 nt, Human
ccaaaaaucucaauauu

SEQ ID NO: 1954945 - RNA, 20 nt, Human
uuaacacaugauccugcaau

SEQ ID NO: 1954946 - RNA, 16 nt, Human
auaauccuaaacauau

SEQ ID NO: 1954947 - RNA, 24 nt, Human
uggccgggagccugaucaccugcc

SEQ ID NO: 1954948 - RNA, 17 nt, Human
uuaauaauuuuuaauua

SEQ ID NO: 1954949 - RNA, 19 nt, Human
uguaguguuggagaagaac

SEQ ID NO: 1954950 - RNA, 14 nt, Human
cugcugagucccag

SEQ ID NO: 1954951 - RNA, 18 nt, Human
cugcucaauaaaguacaa

SEQ ID NO: 1954952 - RNA, 17 nt, Human
aagacaaggaaaaaaua

SEQ ID NO: 1954953 - RNA, 14 nt, Human
cagauuugagcuca

SEQ ID NO: 1954954 - RNA, 21 nt, Human
gcaaaauuuuuucucuaggaa

SEQ ID NO: 1954955 - RNA, 14 nt, Human
acauauauaacaau

SEQ ID NO: 1954956 - RNA, 18 nt, Human
caagccucauguccacug

SEQ ID NO: 1954957 - RNA, 16 nt, Human
aucaaaagaaagaaaa

SEQ ID NO: 1954958 - RNA, 12 nt, Human
uaguacacacuu

SEQ ID NO: 1954959 - RNA, 23 nt, Human
agaguuuagcuggaaaaguaugu

SEQ ID NO: 1954960 - RNA, 15 nt, Human
gaccacugcagaaga

SEQ ID NO: 1954961 - RNA, 22 nt, Human
cuucaacucccugccccccagc

SEQ ID NO: 1954962 - RNA, 16 nt, Human
agugaaagaaaauaac

SEQ ID NO: 1954963 - RNA, 18 nt, Human
gaggcuccacuuggucug

SEQ ID NO: 1954964 - RNA, 22 nt, Human
acaccuuguacuuuauuuucua

SEQ ID NO: 1954965 - RNA, 18 nt, Human
cugagccuugggaccccu

SEQ ID NO: 1954966 - RNA, 21 nt, Human
cucagugucaaugcagccccc

SEQ ID NO: 1954967 - RNA, 16 nt, Human
auaaugaauacuuuau

SEQ ID NO: 1954968 - RNA, 18 nt, Human
cuucucacauuuauauuu

SEQ ID NO: 1954969 - RNA, 21 nt, Human
acagcccuucuuuccacagaa

SEQ ID NO: 1954970 - RNA, 16 nt, Human
ccaggcugagccucag

SEQ ID NO: 1954971 - RNA, 22 nt, Human
aagagccuuuuuuugaaaaaaa

SEQ ID NO: 1954972 - RNA, 19 nt, Human
auuuucuauaauuuaaaua

SEQ ID NO: 1954973 - RNA, 15 nt, Human
aucuuauaauuuaaa

SEQ ID NO: 1954974 - RNA, 15 nt, Human
auaaauaaaaauaau

SEQ ID NO: 1954975 - RNA, 13 nt, Human
auugauuauaugu

SEQ ID NO: 1954976 - RNA, 22 nt, Human
gaauuaaguuuuuuuuuaaaaa

SEQ ID NO: 1954977 - RNA, 17 nt, Human
gcaugguuuagaaagcu

SEQ ID NO: 1954978 - RNA, 18 nt, Human
cagcugcucaauaaagua

SEQ ID NO: 1954979 - RNA, 14 nt, Human
ccucagucucccuc

SEQ ID NO: 1954980 - RNA, 22 nt, Human
ccauacuaauuauacccccugc

SEQ ID NO: 1954981 - RNA, 20 nt, Human
cugagccucagucucccucc

SEQ ID NO: 1954982 - RNA, 17 nt, Human
uuuuuaauuauauggcu

SEQ ID NO: 1954983 - RNA, 19 nt, Human
auacuaauuauacccccug

SEQ ID NO: 1954984 - RNA, 13 nt, Human
gacaaggaaaaaa

SEQ ID NO: 1954985 - RNA, 20 nt, Human
aaagacaaggaaaaaauaac

SEQ ID NO: 1954986 - RNA, 14 nt, Human
ccaaugaaaugagu

SEQ ID NO: 1954987 - RNA, 15 nt, Human
agccucagucucccu

SEQ ID NO: 1954988 - RNA, 19 nt, Human
caugaguaacugauuugua

SEQ ID NO: 1954989 - RNA, 20 nt, Human
ugaaaaucuuauaauuuaaa

SEQ ID NO: 1954990 - RNA, 22 nt, Human
cagcccuggugggcagagaggu

SEQ ID NO: 1954991 - RNA, 15 nt, Human
agggcucacagaauu

SEQ ID NO: 1954992 - RNA, 17 nt, Human
aaucuuauaauuuaaaa

SEQ ID NO: 1954993 - RNA, 22 nt, Human
cauuuaaauaaaguguuugaaa

SEQ ID NO: 1954994 - RNA, 13 nt, Human
agaaguaaaaaca

SEQ ID NO: 1954995 - RNA, 17 nt, Human
uaacgauaaaagacagu

SEQ ID NO: 1954996 - RNA, 17 nt, Human
uguucuaagaagugaaa

SEQ ID NO: 1954997 - RNA, 16 nt, Human
ugccucaccccuugcc

SEQ ID NO: 1954998 - RNA, 16 nt, Human
caaaaggauaaugaau

SEQ ID NO: 1954999 - RNA, 21 nt, Human
agucucccucccuuggggccu

SEQ ID NO: 1955000 - RNA, 19 nt, Human
guacugagagugaacaaau

SEQ ID NO: 1955001 - RNA, 17 nt, Human
caccucccccaucucuu

SEQ ID NO: 1955002 - RNA, 17 nt, Human
guuuaauaauuuuuaau

SEQ ID NO: 1955003 - RNA, 12 nt, Human
accccugagcuu

SEQ ID NO: 1955004 - RNA, 17 nt, Human
acaagaaaugaaagcag

SEQ ID NO: 1955005 - RNA, 22 nt, Human
ucuggguuccuuccucugagcc

SEQ ID NO: 1955006 - RNA, 14 nt, Human
ugcuaagucuuaua

SEQ ID NO: 1955007 - RNA, 17 nt, Human
uuauaaucuuucacagg

SEQ ID NO: 1955008 - RNA, 17 nt, Human
aguauuucuaugaaaua

SEQ ID NO: 1955009 - RNA, 13 nt, Human
ccucauggaauug

SEQ ID NO: 1955010 - RNA, 16 nt, Human
auugucuagugaaacu

SEQ ID NO: 1955011 - RNA, 17 nt, Human
ucugugagaugcuagaa

SEQ ID NO: 1955012 - RNA, 12 nt, Human
aauaaaguacaa

SEQ ID NO: 1955013 - RNA, 16 nt, Human
acaugaaguccaagca

SEQ ID NO: 1955014 - RNA, 20 nt, Human
auucccagccagcacagccu

SEQ ID NO: 1955015 - RNA, 18 nt, Human
aaagaaaaucaggcuggc

SEQ ID NO: 1955016 - RNA, 18 nt, Human
ccugaaagaggaaugaag

SEQ ID NO: 1955017 - RNA, 14 nt, Human
cagugaaagaaaau

SEQ ID NO: 1955018 - RNA, 22 nt, Human
gagccucagucucccucccuug

SEQ ID NO: 1955019 - RNA, 16 nt, Human
uugucaauaaaaucca

SEQ ID NO: 1955020 - RNA, 12 nt, Human
gacgagaaaaca

SEQ ID NO: 1955021 - RNA, 14 nt, Human
aauauaaauaaaaa

SEQ ID NO: 1955022 - RNA, 12 nt, Human
cacaacacacag

SEQ ID NO: 1955023 - RNA, 18 nt, Human
auggcuugaguuuaaauu

SEQ ID NO: 1955024 - RNA, 22 nt, Human
aaagacagugaaagaaaauaac

SEQ ID NO: 1955025 - RNA, 22 nt, Human
uacugagagugaacaaauuuac

SEQ ID NO: 1955026 - RNA, 17 nt, Human
uucucuaggaaauauuu

SEQ ID NO: 1955027 - RNA, 17 nt, Human
auaaguacaugauaagc

SEQ ID NO: 1955028 - RNA, 16 nt, Human
acuaaacaaagaguga

SEQ ID NO: 1955029 - RNA, 23 nt, Human
ggaugaauuaaguuuuuuuuuaa

SEQ ID NO: 1955030 - RNA, 15 nt, Human
auuuuaaaagaauga

SEQ ID NO: 1955031 - RNA, 18 nt, Human
auuauuuuuuaaaaaaau

SEQ ID NO: 1955032 - RNA, 15 nt, Human
cugacucuuaagaag

SEQ ID NO: 1955033 - RNA, 21 nt, Human
cuuguuggacgagaaaacaau

SEQ ID NO: 1955034 - RNA, 19 nt, Human
uucccuugaugaagaaguu

SEQ ID NO: 1955035 - RNA, 23 nt, Human
gaccccugagcuugcagagauga

SEQ ID NO: 1955036 - RNA, 17 nt, Human
gugccuguaaucacagc

SEQ ID NO: 1955037 - RNA, 19 nt, Human
uggugagugccuguaauca

SEQ ID NO: 1955038 - RNA, 15 nt, Human
agucaccucauggaa

SEQ ID NO: 1955039 - RNA, 16 nt, Human
ugcacaucaaaauaug

SEQ ID NO: 1955040 - RNA, 17 nt, Human
ccucuggcuccagcugg

SEQ ID NO: 1955041 - RNA, 21 nt, Human
cugauauuggacaguaaaauc

SEQ ID NO: 1955042 - RNA, 20 nt, Human
auacugugugcuaaaacaag

SEQ ID NO: 1955043 - RNA, 19 nt, Human
auuuugugaagcaaaauuu

SEQ ID NO: 1955044 - RNA, 23 nt, Human
ucuaccaaaaaucucaauauuuc

SEQ ID NO: 1955045 - RNA, 20 nt, Human
augcuucuguuuuauaauuu

SEQ ID NO: 1955046 - RNA, 17 nt, Human
aauucuugccaaauaua

SEQ ID NO: 1955047 - RNA, 21 nt, Human
cucaaaacuucagacauagaa

SEQ ID NO: 1955048 - RNA, 20 nt, Human
acuucuuaggguuaugauua

SEQ ID NO: 1955049 - RNA, 19 nt, Human
gaaagaaaauaacaauaaa

SEQ ID NO: 1955050 - RNA, 22 nt, Human
gcacagccucuuagaugcaguu

SEQ ID NO: 1955051 - RNA, 23 nt, Human
guaauuccguagguuauuuucag

SEQ ID NO: 1955052 - RNA, 15 nt, Human
aucaauuuaaaaaaa

SEQ ID NO: 1955053 - RNA, 19 nt, Human
augaguaacugauuuguaa

SEQ ID NO: 1955054 - RNA, 12 nt, Human
ccuucagccuga

SEQ ID NO: 1955055 - RNA, 13 nt, Human
uuaaauuguaaua

SEQ ID NO: 1955056 - RNA, 14 nt, Human
ugagaugcuagaac

SEQ ID NO: 1955057 - RNA, 18 nt, Human
cuccauccugaggcucca

SEQ ID NO: 1955058 - RNA, 20 nt, Human
acuaaauugacacuuaaaaa

SEQ ID NO: 1955059 - RNA, 20 nt, Human
gaaaauaacaauaaaagaca

SEQ ID NO: 1955060 - RNA, 12 nt, Human
gucccaggcuga

SEQ ID NO: 1955061 - RNA, 17 nt, Human
cugagcgacagugagac

SEQ ID NO: 1955062 - RNA, 22 nt, Human
ccacagcuguaugauucccagc

SEQ ID NO: 1955063 - RNA, 15 nt, Human
aauucugaaagcaac

SEQ ID NO: 1955064 - RNA, 22 nt, Human
aucaccaaggcugauuaaacca

SEQ ID NO: 1955065 - RNA, 18 nt, Human
caaggcugauuaaaccaa

SEQ ID NO: 1955066 - RNA, 17 nt, Human
guuuaauucugaaagca

SEQ ID NO: 1955067 - RNA, 12 nt, Human
aaaugaaagcag

SEQ ID NO: 1955068 - RNA, 16 nt, Human
acaaggaugaauuaag

SEQ ID NO: 1955069 - RNA, 14 nt, Human
cugcaaagcccagc

SEQ ID NO: 1955070 - RNA, 12 nt, Human
aaggaugccccg

SEQ ID NO: 1955071 - RNA, 21 nt, Human
cagugagacagcucugcauac

SEQ ID NO: 1955072 - RNA, 22 nt, Human
aaagagugaaggauuuauguuu

SEQ ID NO: 1955073 - RNA, 17 nt, Human
guugcugggggggauug

SEQ ID NO: 1955074 - RNA, 18 nt, Human
auagaauuaacacaugau

SEQ ID NO: 1955075 - RNA, 16 nt, Human
ccugaucaccugcccu

SEQ ID NO: 1955076 - RNA, 14 nt, Human
guauuuuaaaagaa

SEQ ID NO: 1955077 - RNA, 14 nt, Human
cugucucaguccau

SEQ ID NO: 1955078 - RNA, 21 nt, Human
acagugauuaccagggacuga

SEQ ID NO: 1955079 - RNA, 13 nt, Human
ccagcacagccuc

SEQ ID NO: 1955080 - RNA, 19 nt, Human
uacuucuuaggguuaugau

SEQ ID NO: 1955081 - RNA, 17 nt, Human
aacaguuaccucugccu

SEQ ID NO: 1955082 - RNA, 21 nt, Human
uuuuauggcacuaguauuucu

SEQ ID NO: 1955083 - RNA, 18 nt, Human
cuucacuguaaaauaaua

SEQ ID NO: 1955084 - RNA, 19 nt, Human
ccuccauccugaggcucca

SEQ ID NO: 1955085 - RNA, 16 nt, Human
gaauggcuaagcaaaa

SEQ ID NO: 1955086 - RNA, 24 nt, Human
cauaugaaaaggcuaagcuucacu

SEQ ID NO: 1955087 - RNA, 19 nt, Human
ccccugagcuugcagagau

SEQ ID NO: 1955088 - RNA, 20 nt, Human
ugagagacacacugaagaag

SEQ ID NO: 1955089 - RNA, 18 nt, Human
uacuuuauuuucuauaau

SEQ ID NO: 1955090 - RNA, 20 nt, Human
augcaguuguugcccacagc

SEQ ID NO: 1955091 - RNA, 14 nt, Human
ccugccccugagcc

SEQ ID NO: 1955092 - RNA, 17 nt, Human
agacagugaaagaaaau

SEQ ID NO: 1955093 - RNA, 21 nt, Human
aaugugacuuaaugccacuaa

SEQ ID NO: 1955094 - RNA, 17 nt, Human
agcuucacuguaaaaua

SEQ ID NO: 1955095 - RNA, 20 nt, Human
accugauuucugagcauuua

SEQ ID NO: 1955096 - RNA, 22 nt, Human
agaaaacaauaacgauaaaaga

SEQ ID NO: 1955097 - RNA, 13 nt, Human
uacuuuauuuucu

SEQ ID NO: 1955098 - RNA, 22 nt, Human
uuaccucugccucagaaaacaa

SEQ ID NO: 1955099 - RNA, 15 nt, Human
aauacuuuauaaagg

SEQ ID NO: 1955100 - RNA, 16 nt, Human
acagagacagaaagca

SEQ ID NO: 1955101 - RNA, 19 nt, Human
ugggacaggggagaaccua

SEQ ID NO: 1955102 - RNA, 22 nt, Human
uugacccacaagaaaugaaagc

SEQ ID NO: 1955103 - RNA, 18 nt, Human
aacaaugcuguauuuuaa

SEQ ID NO: 1955104 - RNA, 13 nt, Human
aauuuuuauauuu

SEQ ID NO: 1955105 - RNA, 11 nt, Human
uuauauuuauu

SEQ ID NO: 1955106 - RNA, 20 nt, Human
uugauaaguacaugauaagc

SEQ ID NO: 1955107 - RNA, 14 nt, Human
gauuaguacacacu

SEQ ID NO: 1955108 - RNA, 14 nt, Human
aagcucuaucacca

SEQ ID NO: 1955109 - RNA, 12 nt, Human
gccccugagccc

SEQ ID NO: 1955110 - RNA, 18 nt, Human
gccccgucccccucuggc

SEQ ID NO: 1955111 - RNA, 17 nt, Human
aucaaggguacacugcc

SEQ ID NO: 1955112 - RNA, 17 nt, Human
uggcuaagcaaaaugug

SEQ ID NO: 1955113 - RNA, 17 nt, Human
cccccugcaaagcccag

SEQ ID NO: 1955114 - RNA, 11 nt, Human
aaccugagccc

SEQ ID NO: 1955115 - RNA, 12 nt, Human
cuuccucugagc

SEQ ID NO: 1955116 - RNA, 16 nt, Human
uucuauaauuuaaaua

SEQ ID NO: 1955117 - RNA, 18 nt, Human
cacuccagugagacagcu

SEQ ID NO: 1955118 - RNA, 16 nt, Human
auccuacaagacacag

SEQ ID NO: 1955119 - RNA, 15 nt, Human
agcucuaucaccaag

SEQ ID NO: 1955120 - RNA, 21 nt, Human
ugggaggcugagaugggagaa

SEQ ID NO: 1955121 - RNA, 15 nt, Human
augaauuaaguuuuu

SEQ ID NO: 1955122 - RNA, 16 nt, Human
acaugaacuuguaaag

SEQ ID NO: 1955123 - RNA, 23 nt, Human
cuagacccacuggacucaccucc

SEQ ID NO: 1955124 - RNA, 23 nt, Human
ggccuccauccugaggcuccacu

SEQ ID NO: 1955125 - RNA, 15 nt, Human
cccugcaaagcccag

SEQ ID NO: 1955126 - RNA, 23 nt, Human
aucaccaaggcugauuaaaccaa

SEQ ID NO: 1955127 - RNA, 12 nt, Human
cuugguuuuaau

SEQ ID NO: 1955128 - RNA, 13 nt, Human
uuauguuuaauuc

SEQ ID NO: 1955129 - RNA, 22 nt, Human
ucuacuaaaaauacaaaaaaaa

SEQ ID NO: 1955130 - RNA, 21 nt, Human
aaaauaugccccauucaacau

SEQ ID NO: 1955131 - RNA, 15 nt, Human
acagugaaagaaaau

SEQ ID NO: 1955132 - RNA, 21 nt, Human
caaggaaaaaauaacaaugaa

SEQ ID NO: 1955133 - RNA, 16 nt, Human
ucaaaagaaagaaaau

SEQ ID NO: 1955134 - RNA, 14 nt, Human
gugagcuacaaaug

SEQ ID NO: 1955135 - RNA, 13 nt, Human
aaaugggaaacaa

SEQ ID NO: 1955136 - RNA, 22 nt, Human
agcuuguauuccuuuuucucuc

SEQ ID NO: 1955137 - RNA, 18 nt, Human
uaaaauccauacauuugu

SEQ ID NO: 1955138 - RNA, 15 nt, Human
uccaagccucauguc

SEQ ID NO: 1955139 - RNA, 18 nt, Human
cucccuuggggccuaugc

SEQ ID NO: 1955140 - RNA, 19 nt, Human
cucugccucagaaaacaag

SEQ ID NO: 1955141 - RNA, 23 nt, Human
uggcuugaguuuaaauuguaaua

SEQ ID NO: 1955142 - RNA, 22 nt, Human
aaauguugacaugggacauuug

SEQ ID NO: 1955143 - RNA, 22 nt, Human
uugaaaaucuuauaauuuaaaa

SEQ ID NO: 1955144 - RNA, 22 nt, Human
cugggacaggggagaaccuagg

SEQ ID NO: 1955145 - RNA, 13 nt, Human
caguuauuauauu

SEQ ID NO: 1955146 - RNA, 15 nt, Human
aagccuccuuuuaaa

SEQ ID NO: 1955147 - RNA, 15 nt, Human
aaugaauggcuaagc

SEQ ID NO: 1955148 - RNA, 20 nt, Human
aaaaucuuauaauuuaaaau

SEQ ID NO: 1955149 - RNA, 12 nt, Human
aguguuugaaag

SEQ ID NO: 1955150 - RNA, 11 nt, Human
augggacaggg

SEQ ID NO: 1955151 - RNA, 18 nt, Human
ccucuggcuccagcuggc

SEQ ID NO: 1955152 - RNA, 12 nt, Human
ugagagacacac

SEQ ID NO: 1955153 - RNA, 23 nt, Human
uauguuaaaacugggacagggga

SEQ ID NO: 1955154 - RNA, 15 nt, Human
ggccuucggccucca

SEQ ID NO: 1955155 - RNA, 19 nt, Human
cggccuccauccugaggcu

SEQ ID NO: 1955156 - RNA, 16 nt, Human
cugaucaccugcccug

SEQ ID NO: 1955157 - RNA, 19 nt, Human
ccugccuaagugcagcccc

SEQ ID NO: 1955158 - RNA, 19 nt, Human
aaagacagugaaagaaaau

SEQ ID NO: 1955159 - RNA, 21 nt, Human
cacaugaacuuguaaaggaau

SEQ ID NO: 1955160 - RNA, 21 nt, Human
caucuagcaugucgucaaagc

SEQ ID NO: 1955161 - RNA, 23 nt, Human
caugcugucuacacuaagagaga

SEQ ID NO: 1955162 - RNA, 16 nt, Human
ccugcaaagcccagcu

SEQ ID NO: 1955163 - RNA, 16 nt, Human
uuaauaauuuuuaauu

SEQ ID NO: 1955164 - RNA, 17 nt, Human
agugauuaccagggacu

SEQ ID NO: 1955165 - RNA, 21 nt, Human
auuauauuuauuacuguaaga

SEQ ID NO: 1955166 - RNA, 12 nt, Human
gaaaauaacaau

SEQ ID NO: 1955167 - RNA, 15 nt, Human
gccucagucucccuc

SEQ ID NO: 1955168 - RNA, 18 nt, Human
uuuauggcacuaguauuu

SEQ ID NO: 1955169 - RNA, 18 nt, Human
ugcauagguuuaauaauu

SEQ ID NO: 1955170 - RNA, 13 nt, Human
uaacgauaaaaga

SEQ ID NO: 1955171 - RNA, 23 nt, Human
ugaauuauguuugcauguucacu

SEQ ID NO: 1955172 - RNA, 15 nt, Human
cucccuuggggccua

SEQ ID NO: 1955173 - RNA, 16 nt, Human
aaaagcuccauuuuua

SEQ ID NO: 1955174 - RNA, 16 nt, Human
agggaggacgcucucu

SEQ ID NO: 1955175 - RNA, 17 nt, Human
ugaaggauuuauguuua

SEQ ID NO: 1955176 - RNA, 23 nt, Human
uaggauggcuaguaucaaaagaa

SEQ ID NO: 1955177 - RNA, 15 nt, Human
aaucucaauauuuca

SEQ ID NO: 1955178 - RNA, 23 nt, Human
uuuguauaaaauaauuuuuauau

SEQ ID NO: 1955179 - RNA, 15 nt, Human
aagaaaauaacaaua

SEQ ID NO: 1955180 - RNA, 13 nt, Human
ccaccugccuaua

SEQ ID NO: 1955181 - RNA, 13 nt, Human
aagaaaauaacga

SEQ ID NO: 1955182 - RNA, 22 nt, Human
auaacaaugcuguauuuuaaaa

SEQ ID NO: 1955183 - RNA, 15 nt, Human
cccugccccccagcc

SEQ ID NO: 1955184 - RNA, 21 nt, Human
gucucagugucaaugcagccc

SEQ ID NO: 1955185 - RNA, 22 nt, Human
ccaaacauccuacaagacacag

SEQ ID NO: 1955186 - RNA, 19 nt, Human
acagugauuaccagggacu

SEQ ID NO: 1955187 - RNA, 20 nt, Human
ugagcgcccacuagacccac

SEQ ID NO: 1955188 - RNA, 15 nt, Human
auuucuaugaaauau

SEQ ID NO: 1955189 - RNA, 15 nt, Human
ugguuuagaaagcuu

SEQ ID NO: 1955190 - RNA, 15 nt, Human
aaauaauuuuuauau

SEQ ID NO: 1955191 - RNA, 15 nt, Human
cuuaagaagacugca

SEQ ID NO: 1955192 - RNA, 21 nt, Human
cugagccucagucucccuccc

SEQ ID NO: 1955193 - RNA, 18 nt, Human
aagggaauuucuucaacu

SEQ ID NO: 1955194 - RNA, 13 nt, Human
cuuaucaaaggac

SEQ ID NO: 1955195 - RNA, 17 nt, Human
cuaagcuucacuguaaa

SEQ ID NO: 1955196 - RNA, 19 nt, Human
agacagugaaagaaaauaa

SEQ ID NO: 1955197 - RNA, 23 nt, Human
uaaaagacagugaaagaaaauaa

SEQ ID NO: 1955198 - RNA, 13 nt, Human
aaaguguuugaaa

SEQ ID NO: 1955199 - RNA, 22 nt, Human
gcuugcagagaugaggccgcca

SEQ ID NO: 1955200 - RNA, 18 nt, Human
gaagcaccaaucaugaau

SEQ ID NO: 1955201 - RNA, 16 nt, Human
gugagacagcucugca

SEQ ID NO: 1955202 - RNA, 22 nt, Human
uuuccaagcaaguauuagaaua

SEQ ID NO: 1955203 - RNA, 18 nt, Human
acugacucuuaagaagac

SEQ ID NO: 1955204 - RNA, 16 nt, Human
uauccuacuuccccuu

SEQ ID NO: 1955205 - RNA, 19 nt, Human
caaggaugccccguccccc

SEQ ID NO: 1955206 - RNA, 17 nt, Human
ccacugcagaagacagu

SEQ ID NO: 1955207 - RNA, 20 nt, Human
guuccuuccucugagccuug

SEQ ID NO: 1955208 - RNA, 20 nt, Human
cccuuccuaauuccacagcu

SEQ ID NO: 1955209 - RNA, 18 nt, Human
ccugcaaagcccagcuug

SEQ ID NO: 1955210 - RNA, 17 nt, Human
agggcauagaaguaaaa

SEQ ID NO: 1955211 - RNA, 14 nt, Human
caugaacuuguaaa

SEQ ID NO: 1955212 - RNA, 20 nt, Human
ccccuauccuacuuccccuu

SEQ ID NO: 1955213 - RNA, 16 nt, Human
cugcugagucccaggc

SEQ ID NO: 1955214 - RNA, 13 nt, Human
ugauuauauguca

SEQ ID NO: 1955215 - RNA, 13 nt, Human
uccuacuuccccu

SEQ ID NO: 1955216 - RNA, 22 nt, Human
caucucuucuggguuccuuccu

SEQ ID NO: 1955217 - RNA, 22 nt, Human
aacucccugccccccagcccuc

SEQ ID NO: 1955218 - RNA, 19 nt, Human
ccccuauccuacuuccccu

SEQ ID NO: 1955219 - RNA, 14 nt, Human
uuucuaugaaauau

SEQ ID NO: 1955220 - RNA, 19 nt, Human
cuccagcuggccgggagcc

SEQ ID NO: 1955221 - RNA, 14 nt, Human
cuacaagacacagu

SEQ ID NO: 1955222 - RNA, 16 nt, Human
cucaauaaaguacaag

SEQ ID NO: 1955223 - RNA, 17 nt, Human
auuuuaauaauguuuca

SEQ ID NO: 1955224 - RNA, 23 nt, Human
uuauagcuacuaauuuuaaaaug

SEQ ID NO: 1955225 - RNA, 15 nt, Human
aaaauacaaaaaaaa

SEQ ID NO: 1955226 - RNA, 23 nt, Human
ccccucuggcuccagcuggccgg

SEQ ID NO: 1955227 - RNA, 16 nt, Human
auaacuggaaacuuca

SEQ ID NO: 1955228 - RNA, 17 nt, Human
uaucaauuuaaaaaaaa

SEQ ID NO: 1955229 - RNA, 15 nt, Human
cuucucuucacaguc

SEQ ID NO: 1955230 - RNA, 23 nt, Human
ugcagagguccacaacacacaga

SEQ ID NO: 1955231 - RNA, 20 nt, Human
aaaacaagcacuaaacaaag

SEQ ID NO: 1955232 - RNA, 18 nt, Human
uucucuaggaaauauuua

SEQ ID NO: 1955233 - RNA, 23 nt, Human
gaaaaaguucugcagauaaacag

SEQ ID NO: 1955234 - RNA, 14 nt, Human
agcaaguauuagaa

SEQ ID NO: 1955235 - RNA, 22 nt, Human
ccgggaggcagagguugcagug

SEQ ID NO: 1955236 - RNA, 18 nt, Human
uaauuuuaacucuauaau

SEQ ID NO: 1955237 - RNA, 23 nt, Human
cacuggacucaccucccccaucu

SEQ ID NO: 1955238 - RNA, 20 nt, Human
ccaaauguucaucaaugaau

SEQ ID NO: 1955239 - RNA, 15 nt, Human
gauccugcaauucca

SEQ ID NO: 1955240 - RNA, 19 nt, Human
auaauuuuuauauuugaaa

SEQ ID NO: 1955241 - RNA, 14 nt, Human
auacaaaaaaaaaa

SEQ ID NO: 1955242 - RNA, 16 nt, Human
caugggacagggagga

SEQ ID NO: 1955243 - RNA, 19 nt, Human
uuauggcacuaguauuucu

SEQ ID NO: 1955244 - RNA, 17 nt, Human
gacucaccucccccauc

SEQ ID NO: 1955245 - RNA, 15 nt, Human
uggacucaccucccc

SEQ ID NO: 1955246 - RNA, 20 nt, Human
ccagcuugaaaccuucacuu

SEQ ID NO: 1955247 - RNA, 20 nt, Human
uugaacccgggaggcagagg

SEQ ID NO: 1955248 - RNA, 13 nt, Human
ccacaacacacag

SEQ ID NO: 1955249 - RNA, 17 nt, Human
cucuuuugggauuuuug

SEQ ID NO: 1955250 - RNA, 21 nt, Human
acgcucucuggccuucggccu

SEQ ID NO: 1955251 - RNA, 13 nt, Human
cugagagugaaca

SEQ ID NO: 1955252 - RNA, 22 nt, Human
gaaaaucuuauaauuuaaaaua

SEQ ID NO: 1955253 - RNA, 21 nt, Human
ccugaucaccugcccugcuga

SEQ ID NO: 1955254 - RNA, 15 nt, Human
cugaaagaggaauga

SEQ ID NO: 1955255 - RNA, 15 nt, Human
augguuguauuauuu

SEQ ID NO: 1955256 - RNA, 12 nt, Human
uaauuccacagc

SEQ ID NO: 1955257 - RNA, 16 nt, Human
cuuauaauuuaaaaua

SEQ ID NO: 1955258 - RNA, 20 nt, Human
aauuuuuucucuaggaaaua

SEQ ID NO: 1955259 - RNA, 17 nt, Human
uuccaagccucaugucc

SEQ ID NO: 1955260 - RNA, 18 nt, Human
uauuuucuauaauuuaaa

SEQ ID NO: 1955261 - RNA, 22 nt, Human
cauaaauguugacaugggacau

SEQ ID NO: 1955262 - RNA, 19 nt, Human
caauucuugccaaauauaa

SEQ ID NO: 1955263 - RNA, 17 nt, Human
ccugagcuugcagagau

SEQ ID NO: 1955264 - RNA, 14 nt, Human
ucuaggaaauauuu

SEQ ID NO: 1955265 - RNA, 15 nt, Human
ugcuguauuuuaaaa

SEQ ID NO: 1955266 - RNA, 23 nt, Human
ugucaauucuugccaaauauaaa

SEQ ID NO: 1955267 - RNA, 15 nt, Human
cuaguaauuggaaag

SEQ ID NO: 1955268 - RNA, 18 nt, Human
ugugaccacugcagaaga

SEQ ID NO: 1955269 - RNA, 17 nt, Human
aggcuagaaccaccugc

SEQ ID NO: 1955270 - RNA, 19 nt, Human
aaguugcauagguuuaaua

SEQ ID NO: 1955271 - RNA, 22 nt, Human
accauuucuugagguaaaagca

SEQ ID NO: 1955272 - RNA, 15 nt, Human
gccccugcacuccag

SEQ ID NO: 1955273 - RNA, 12 nt, Human
ucuacacuccag

SEQ ID NO: 1955274 - RNA, 14 nt, Human
cucccuuggggccu

SEQ ID NO: 1955275 - RNA, 16 nt, Human
augcuaagugaaauaa

SEQ ID NO: 1955276 - RNA, 17 nt, Human
ggccaugggacagggag

SEQ ID NO: 1955277 - RNA, 17 nt, Human
gccccccagcccuccuu

SEQ ID NO: 1955278 - RNA, 21 nt, Human
cuccagcuggccgggagccug

SEQ ID NO: 1955279 - RNA, 24 nt, Human
uaauuuaaaauaugcucuaaacau

SEQ ID NO: 1955280 - RNA, 15 nt, Human
ccccugagcuugcag

SEQ ID NO: 1955281 - RNA, 13 nt, Human
augcuagaacucc

SEQ ID NO: 1955282 - RNA, 20 nt, Human
aagggcuguuauaaucuuuc

SEQ ID NO: 1955283 - RNA, 21 nt, Human
guauacugugugcuaaaacaa

SEQ ID NO: 1955284 - RNA, 20 nt, Human
uaacgauaaaagacagugaa

SEQ ID NO: 1955285 - RNA, 19 nt, Human
agauuugagcucagcccug

SEQ ID NO: 1955286 - RNA, 16 nt, Human
uaaaagacaaggaaaa

SEQ ID NO: 1955287 - RNA, 16 nt, Human
ugaauuaguuuuauau

SEQ ID NO: 1955288 - RNA, 18 nt, Human
ugccauaauuacuauguc

SEQ ID NO: 1955289 - RNA, 13 nt, Human
ggaaguagaggag

SEQ ID NO: 1955290 - RNA, 17 nt, Human
ucagacauagaauuaac

SEQ ID NO: 1955291 - RNA, 20 nt, Human
guauuauuuuuuaaaaaaau

SEQ ID NO: 1955292 - RNA, 17 nt, Human
cccaggcugagccucag

SEQ ID NO: 1955293 - RNA, 16 nt, Human
uuuuagugaaauauua

SEQ ID NO: 1955294 - RNA, 19 nt, Human
auuauuuuuuaaaaaaauu

SEQ ID NO: 1955295 - RNA, 22 nt, Human
augcagagguccacaacacaca

SEQ ID NO: 1955296 - RNA, 21 nt, Human
uuauagcuacuaauuuuaaaa

SEQ ID NO: 1955297 - RNA, 19 nt, Human
uaucucauuuccaagcaag

SEQ ID NO: 1955298 - RNA, 12 nt, Human
caacccaaaugu

SEQ ID NO: 1955299 - RNA, 17 nt, Human
uuauaucaauuuaaaaa

SEQ ID NO: 1955300 - RNA, 13 nt, Human
uuccucugagccu

SEQ ID NO: 1955301 - RNA, 18 nt, Human
uccagcuggccgggagcc

SEQ ID NO: 1955302 - RNA, 20 nt, Human
accucauggaauuggagcuc

SEQ ID NO: 1955303 - RNA, 18 nt, Human
uggagggaagccuugggg

SEQ ID NO: 1955304 - RNA, 12 nt, Human
acagagacagaa

SEQ ID NO: 1955305 - RNA, 20 nt, Human
agaggagaaacuggaacucu

SEQ ID NO: 1955306 - RNA, 15 nt, Human
cuaucuuugagcgcc

SEQ ID NO: 1955307 - RNA, 20 nt, Human
auaaauggcuuccuggcaau

SEQ ID NO: 1955308 - RNA, 23 nt, Human
cuugauaaauggcuuccuggcaa

SEQ ID NO: 1955309 - RNA, 14 nt, Human
uugaaauuguauua

SEQ ID NO: 1955310 - RNA, 16 nt, Human
gaaucacuugaacccg

SEQ ID NO: 1955311 - RNA, 11 nt, Human
cgauaaaagac

SEQ ID NO: 1955312 - RNA, 16 nt, Human
aaauauuauguuaaaa

SEQ ID NO: 1955313 - RNA, 18 nt, Human
cccaggcugagccucagu

SEQ ID NO: 1955314 - RNA, 19 nt, Human
ucugagcauuuaauaugga

SEQ ID NO: 1955315 - RNA, 12 nt, Human
agugcagccccg

SEQ ID NO: 1955316 - RNA, 16 nt, Human
guuuuuuuuuaaaaaa

SEQ ID NO: 1955317 - RNA, 20 nt, Human
auaacaaugcuguauuuuaa

SEQ ID NO: 1955318 - RNA, 20 nt, Human
agccuuggggcugaugcagu

SEQ ID NO: 1955319 - RNA, 16 nt, Human
aacaauaaaagacaag

SEQ ID NO: 1955320 - RNA, 15 nt, Human
aaggaaaaaauaaca

SEQ ID NO: 1955321 - RNA, 15 nt, Human
cugcacuccagccug

SEQ ID NO: 1955322 - RNA, 20 nt, Human
ggagccugaucaccugcccu

SEQ ID NO: 1955323 - RNA, 18 nt, Human
cuccauuuuuagugaaau

SEQ ID NO: 1955324 - RNA, 13 nt, Human
agagguccacaac

SEQ ID NO: 1955325 - RNA, 17 nt, Human
uuauauuugaaauauug

SEQ ID NO: 1955326 - RNA, 17 nt, Human
cuggacucaccuccccc

SEQ ID NO: 1955327 - RNA, 15 nt, Human
uuauagcuacuaauu

SEQ ID NO: 1955328 - RNA, 20 nt, Human
aagcuucacuguaaaauaau

SEQ ID NO: 1955329 - RNA, 21 nt, Human
ucauucacucaacaaacauaa

SEQ ID NO: 1955330 - RNA, 18 nt, Human
uuauuacuguaagaaaau

SEQ ID NO: 1955331 - RNA, 16 nt, Human
cagucucccucccuug

SEQ ID NO: 1955332 - RNA, 20 nt, Human
gauugugccccugcacucca

SEQ ID NO: 1955333 - RNA, 18 nt, Human
cauagguuuaauaauuuu

SEQ ID NO: 1955334 - RNA, 19 nt, Human
ggaaaaaauaacaaugaaa

SEQ ID NO: 1955335 - RNA, 23 nt, Human
agcccuccuuaucaaaggacacc

SEQ ID NO: 1955336 - RNA, 21 nt, Human
uagggugauauuaaccagggg

SEQ ID NO: 1955337 - RNA, 17 nt, Human
uuaaauggucaauuuug

SEQ ID NO: 1955338 - RNA, 21 nt, Human
auguuuaauucugaaagcaac

SEQ ID NO: 1955339 - RNA, 21 nt, Human
uuccuaauuccacagcugcuc

SEQ ID NO: 1955340 - RNA, 19 nt, Human
ccccucuggcuccagcugg

SEQ ID NO: 1955341 - RNA, 18 nt, Human
uagugaaauauuauuuua

SEQ ID NO: 1955342 - RNA, 16 nt, Human
caauaacgauaaaaga

SEQ ID NO: 1955343 - RNA, 20 nt, Human
uuaaugccacuaaauugaca

SEQ ID NO: 1955344 - RNA, 13 nt, Human
aagcauuccaacu

SEQ ID NO: 1955345 - RNA, 21 nt, Human
aaaaaguucugcagauaaaca

SEQ ID NO: 1955346 - RNA, 19 nt, Human
acaaauuuacagagacaga

SEQ ID NO: 1955347 - RNA, 16 nt, Human
cugagcauuuaauaug

SEQ ID NO: 1955348 - RNA, 14 nt, Human
cucccucccuuggg

SEQ ID NO: 1955349 - RNA, 17 nt, Human
cugagaugggagaauca

SEQ ID NO: 1955350 - RNA, 15 nt, Human
gacucaccuccccca

SEQ ID NO: 1955351 - RNA, 18 nt, Human
acugccuucucaacucca

SEQ ID NO: 1955352 - RNA, 16 nt, Human
uuguaaaggaauuuaa

SEQ ID NO: 1955353 - RNA, 22 nt, Human
aaugggcacaggguuuauguuu

SEQ ID NO: 1955354 - RNA, 15 nt, Human
cucaacaaacauaau

SEQ ID NO: 1955355 - RNA, 12 nt, Human
cucauggaauug

SEQ ID NO: 1955356 - RNA, 22 nt, Human
gaaaacaauaacgauaaaagac

SEQ ID NO: 1955357 - RNA, 20 nt, Human
ucaaaacuucagacauagaa

SEQ ID NO: 1955358 - RNA, 15 nt, Human
ccuugccaugugcua

SEQ ID NO: 1955359 - RNA, 18 nt, Human
aaagagugaaggauuuau

SEQ ID NO: 1955360 - RNA, 18 nt, Human
cuuccucugagccuuggg

SEQ ID NO: 1955361 - RNA, 16 nt, Human
ugcuguauuuuaaaag

SEQ ID NO: 1955362 - RNA, 20 nt, Human
agcccuggugggcagagagg

SEQ ID NO: 1955363 - RNA, 19 nt, Human
auguuuacagauccccaag

SEQ ID NO: 1955364 - RNA, 19 nt, Human
uuccucccuucucuucaca

SEQ ID NO: 1955365 - RNA, 19 nt, Human
uccccuauccuacuucccc

SEQ ID NO: 1955366 - RNA, 17 nt, Human
agucugacuguuuccau

SEQ ID NO: 1955367 - RNA, 18 nt, Human
gaaaauaacgauaaaaga

SEQ ID NO: 1955368 - RNA, 17 nt, Human
uccacaacacacagauu

SEQ ID NO: 1955369 - RNA, 18 nt, Human
uauaacaaugcuguauuu

SEQ ID NO: 1955370 - RNA, 19 nt, Human
aauuuuguuauguauauuu

SEQ ID NO: 1955371 - RNA, 21 nt, Human
aguuguugcccacagcuguau

SEQ ID NO: 1955372 - RNA, 20 nt, Human
uaaaagacaaggaaaaaaua

SEQ ID NO: 1955373 - RNA, 16 nt, Human
uuuucucuaggaaaua

SEQ ID NO: 1955374 - RNA, 16 nt, Human
uucucuaggaaauauu

SEQ ID NO: 1955375 - RNA, 22 nt, Human
aauugacccacaagaaaugaaa

SEQ ID NO: 1955376 - RNA, 11 nt, Human
uucacagggga

SEQ ID NO: 1955377 - RNA, 14 nt, Human
acuaauuuuaaaau

SEQ ID NO: 1955378 - RNA, 15 nt, Human
ugucaauaaaaucca

SEQ ID NO: 1955379 - RNA, 23 nt, Human
caucucuucuggguuccuuccuc

SEQ ID NO: 1955380 - RNA, 18 nt, Human
auccccaagccuggcaag

SEQ ID NO: 1955381 - RNA, 16 nt, Human
auccaaugaaaugagu

SEQ ID NO: 1955382 - RNA, 20 nt, Human
ccuccugccuaagugcagcc

SEQ ID NO: 1955383 - RNA, 22 nt, Human
uaauaggcguaacuaauuuuaa

SEQ ID NO: 1955384 - RNA, 14 nt, Human
ucagucucccuccc

SEQ ID NO: 1955385 - RNA, 13 nt, Human
aaaaaugguuuaa

SEQ ID NO: 1955386 - RNA, 14 nt, Human
cacaacacacagau

SEQ ID NO: 1955387 - RNA, 20 nt, Human
agccuuuuuuugaaaaaaag

SEQ ID NO: 1955388 - RNA, 14 nt, Human
ugagacucugucuc

SEQ ID NO: 1955389 - RNA, 19 nt, Human
cacaggaaccacaagacug

SEQ ID NO: 1955390 - RNA, 21 nt, Human
gauaaaagacagugaaagaaa

SEQ ID NO: 1955391 - RNA, 15 nt, Human
uguauuuuaaaagaa

SEQ ID NO: 1955392 - RNA, 19 nt, Human
ugagcgcccacuagaccca

SEQ ID NO: 1955393 - RNA, 18 nt, Human
cuuucacauuuaaauaaa

SEQ ID NO: 1955394 - RNA, 17 nt, Human
aauaaaguguuugaaag

SEQ ID NO: 1955395 - RNA, 18 nt, Human
ccuuccuaauuccacagc

SEQ ID NO: 1955396 - RNA, 12 nt, Human
ucugcacacagc

SEQ ID NO: 1955397 - RNA, 21 nt, Human
auaauuuuuauauuugaaaua

SEQ ID NO: 1955398 - RNA, 16 nt, Human
cuucacuguaaaauaa

SEQ ID NO: 1955399 - RNA, 18 nt, Human
guuuaugguuguauuauu

SEQ ID NO: 1955400 - RNA, 18 nt, Human
aaauauaaauaaaaauaa

SEQ ID NO: 1955401 - RNA, 20 nt, Human
guaucaaaagaaagaaaauc

SEQ ID NO: 1955402 - RNA, 23 nt, Human
cacaagaaaugaaagcagggacu

SEQ ID NO: 1955403 - RNA, 22 nt, Human
auggaaauguuuacagaucccc

SEQ ID NO: 1955404 - RNA, 17 nt, Human
uccauccugaggcucca

SEQ ID NO: 1955405 - RNA, 12 nt, Human
auaacuggaaac

SEQ ID NO: 1955406 - RNA, 21 nt, Human
aggacagcccuucuuuccaca

SEQ ID NO: 1955407 - RNA, 18 nt, Human
accaccugccuauauuuu

SEQ ID NO: 1955408 - RNA, 15 nt, Human
gaaaacaaggaugaa

SEQ ID NO: 1955409 - RNA, 13 nt, Human
cuaugaaauauua

SEQ ID NO: 1955410 - RNA, 17 nt, Human
aaagaaacauuugguaa

SEQ ID NO: 1955411 - RNA, 16 nt, Human
accucugccucagaaa

SEQ ID NO: 1955412 - RNA, 20 nt, Human
aauuuugugaagcaaaauuu

SEQ ID NO: 1955413 - RNA, 22 nt, Human
agacccacuggacucaccuccc

SEQ ID NO: 1955414 - RNA, 19 nt, Human
uauacugugugcuaaaaca

SEQ ID NO: 1955415 - RNA, 21 nt, Human
gaaaaaaagcuuuuuuugaau

SEQ ID NO: 1955416 - RNA, 14 nt, Human
caaggcuagaacca

SEQ ID NO: 1955417 - RNA, 20 nt, Human
uaugaaaaggcuaagcuuca

SEQ ID NO: 1955418 - RNA, 19 nt, Human
ccauccugccccugagccc

SEQ ID NO: 1955419 - RNA, 13 nt, Human
aguuaccucugcc

SEQ ID NO: 1955420 - RNA, 21 nt, Human
aauuaaguuuuuuuuuaaaaa

SEQ ID NO: 1955421 - RNA, 21 nt, Human
gacagugaaagaaaauaacaa

SEQ ID NO: 1955422 - RNA, 18 nt, Human
uauuuucaguuauuauau

SEQ ID NO: 1955423 - RNA, 23 nt, Human
uaauuuguaguguuggagaagaa

SEQ ID NO: 1955424 - RNA, 14 nt, Human
ccagcuggccggga

SEQ ID NO: 1955425 - RNA, 21 nt, Human
gaaauguuuacagauccccaa

SEQ ID NO: 1955426 - RNA, 20 nt, Human
aauaagccagacaucaacag

SEQ ID NO: 1955427 - RNA, 16 nt, Human
aaagacaaggaaaaaa

SEQ ID NO: 1955428 - RNA, 19 nt, Human
cuaguaucaaaagaaagaa

SEQ ID NO: 1955429 - RNA, 13 nt, Human
uuuaaaaauccua

SEQ ID NO: 1955430 - RNA, 17 nt, Human
guguccccuauccuacu

SEQ ID NO: 1955431 - RNA, 15 nt, Human
uaacaauaaaagaca

SEQ ID NO: 1955432 - RNA, 20 nt, Human
aaauaauuuuuauauuugaa

SEQ ID NO: 1955433 - RNA, 21 nt, Human
aauucauucacucaacaaaca

SEQ ID NO: 1955434 - RNA, 22 nt, Human
accccugagcuugcagagauga

SEQ ID NO: 1955435 - RNA, 14 nt, Human
gucccaggcugagc

SEQ ID NO: 1955436 - RNA, 15 nt, Human
gcaagcucuaucacc

SEQ ID NO: 1955437 - RNA, 15 nt, Human
cuggacucaccuccc

SEQ ID NO: 1955438 - RNA, 22 nt, Human
uguucugauauuggacaguaaa

SEQ ID NO: 1955439 - RNA, 13 nt, Human
cacacugaagaag

SEQ ID NO: 1955440 - RNA, 20 nt, Human
cugcacacagcacgggggcc

SEQ ID NO: 1955441 - RNA, 22 nt, Human
agccaaacauccuacaagacac

SEQ ID NO: 1955442 - RNA, 23 nt, Human
acguaaucguguccccuauccua

SEQ ID NO: 1955443 - RNA, 19 nt, Human
agagccuuuuuuugaaaaa

SEQ ID NO: 1955444 - RNA, 18 nt, Human
cuuuucccaacuccagaa

SEQ ID NO: 1955445 - RNA, 16 nt, Human
aggccaugggacaggg

SEQ ID NO: 1955446 - RNA, 16 nt, Human
aaaauaauccucaguu

SEQ ID NO: 1955447 - RNA, 17 nt, Human
ucuuauaauuuaaaaua

SEQ ID NO: 1955448 - RNA, 14 nt, Human
auauuugaaauauu

SEQ ID NO: 1955449 - RNA, 22 nt, Human
caagcacuaaacaaagagugaa

SEQ ID NO: 1955450 - RNA, 10 nt, Human
ccugagcccc

SEQ ID NO: 1955451 - RNA, 21 nt, Human
aaagcugaaauggacuuuugu

SEQ ID NO: 1955452 - RNA, 20 nt, Human
aaucuuucacaggggacagg

SEQ ID NO: 1955453 - RNA, 14 nt, Human
auaaaauaauuuuu

SEQ ID NO: 1955454 - RNA, 23 nt, Human
agccuugggaccccugagcuugc

SEQ ID NO: 1955455 - RNA, 16 nt, Human
caggaaguagaggagg

SEQ ID NO: 1955456 - RNA, 17 nt, Human
cuauccuacuuccccuu

SEQ ID NO: 1955457 - RNA, 15 nt, Human
gcaacccaaauguuc

SEQ ID NO: 1955458 - RNA, 16 nt, Human
guuccuuccucugagc

SEQ ID NO: 1955459 - RNA, 17 nt, Human
aauaacaauaaaagaca

SEQ ID NO: 1955460 - RNA, 14 nt, Human
aaaggaauuuaaaa

SEQ ID NO: 1955461 - RNA, 13 nt, Human
gaaccuaggguga

SEQ ID NO: 1955462 - RNA, 21 nt, Human
caauuuuguuauguauauuuu

SEQ ID NO: 1955463 - RNA, 16 nt, Human
aauauaaauaaaaaua

SEQ ID NO: 1955464 - RNA, 18 nt, Human
gagcgacagugagacucu

SEQ ID NO: 1955465 - RNA, 23 nt, Human
ucaauaucuuuuuuuuaauaaac

SEQ ID NO: 1955466 - RNA, 14 nt, Human
cccugccccccagc

SEQ ID NO: 1955467 - RNA, 14 nt, Human
aaaagacagugaaa

SEQ ID NO: 1955468 - RNA, 18 nt, Human
auuaaguuuuuuuuuaaa

SEQ ID NO: 1955469 - RNA, 15 nt, Human
aaaaauaacaaugaa

SEQ ID NO: 1955470 - RNA, 15 nt, Human
uuagugaaauauuau

SEQ ID NO: 1955471 - RNA, 18 nt, Human
cccacuagacccacugga

SEQ ID NO: 1955472 - RNA, 20 nt, Human
auuuucaguuauuauauuua

SEQ ID NO: 1955473 - RNA, 13 nt, Human
acacuuaaaaaug

SEQ ID NO: 1955474 - RNA, 16 nt, Human
cccuauccuacuuccc

SEQ ID NO: 1955475 - RNA, 21 nt, Human
gacagaaagcagaacagugau

SEQ ID NO: 1955476 - RNA, 15 nt, Human
ccagauccuggaaau

SEQ ID NO: 1955477 - RNA, 15 nt, Human
cauguccacugguuc

SEQ ID NO: 1955478 - RNA, 15 nt, Human
cugcagauaaacagu

SEQ ID NO: 1955479 - RNA, 16 nt, Human
aaaugggaaacaaaag

SEQ ID NO: 1955480 - RNA, 17 nt, Human
agaaaugaaagcaggga

SEQ ID NO: 1955481 - RNA, 22 nt, Human
ugagacucugucucaguccaug

SEQ ID NO: 1955482 - RNA, 13 nt, Human
ccugccccccagc

SEQ ID NO: 1955483 - RNA, 15 nt, Human
ucagucucccucccu

SEQ ID NO: 1955484 - RNA, 19 nt, Human
gucaaauugugugaaaggu

SEQ ID NO: 1955485 - RNA, 17 nt, Human
ugaccacugcagaagac

SEQ ID NO: 1955486 - RNA, 12 nt, Human
aaugcagccccc

SEQ ID NO: 1955487 - RNA, 22 nt, Human
gaugguucccuugaugaagaag

SEQ ID NO: 1955488 - RNA, 16 nt, Human
uaaaggaauuuaaaaa

SEQ ID NO: 1955489 - RNA, 19 nt, Human
uggaacaguuaccucugcc

SEQ ID NO: 1955490 - RNA, 21 nt, Human
aagucuuucacauuuaaauaa

SEQ ID NO: 1955491 - RNA, 21 nt, Human
aauaauguuucaaacauauau

SEQ ID NO: 1955492 - RNA, 20 nt, Human
gcccauccugccccugagcc

SEQ ID NO: 1955493 - RNA, 15 nt, Human
ucugucucaguccau

SEQ ID NO: 1955494 - RNA, 21 nt, Human
gccugaucaccugcccugcug

SEQ ID NO: 1955495 - RNA, 15 nt, Human
uucggccuccauccu

SEQ ID NO: 1955496 - RNA, 16 nt, Human
ucucuaggaaauauuu

SEQ ID NO: 1955497 - RNA, 18 nt, Human
gaugcaguucugaagaag

SEQ ID NO: 1955498 - RNA, 17 nt, Human
caaauauaaauaaaaau

SEQ ID NO: 1955499 - RNA, 22 nt, Human
acauccuacaagacacagugac

SEQ ID NO: 1955500 - RNA, 22 nt, Human
auauauaacaaugcuguauuuu

SEQ ID NO: 1955501 - RNA, 15 nt, Human
accaaggcugauuaa

SEQ ID NO: 1955502 - RNA, 16 nt, Human
ucugcagauaaacagu

SEQ ID NO: 1955503 - RNA, 18 nt, Human
auuuauuacuguaagaaa

SEQ ID NO: 1955504 - RNA, 21 nt, Human
gcacuguggguagacacacau

SEQ ID NO: 1955505 - RNA, 15 nt, Human
cuacaagacacagug

SEQ ID NO: 1955506 - RNA, 19 nt, Human
cagaaagcagaacagugau

SEQ ID NO: 1955507 - RNA, 17 nt, Human
ugcacaucaaaauaugc

SEQ ID NO: 1955508 - RNA, 23 nt, Human
cacagauuugagcucagcccugg

SEQ ID NO: 1955509 - RNA, 20 nt, Human
agccuaguugaucagcuuau

SEQ ID NO: 1955510 - RNA, 20 nt, Human
gaaaauaacgauaaaagaca

SEQ ID NO: 1955511 - RNA, 14 nt, Human
accacaagacugca

SEQ ID NO: 1955512 - RNA, 14 nt, Human
acacugaagaagca

SEQ ID NO: 1955513 - RNA, 21 nt, Human
auuuguauaaaauaauuuuua

SEQ ID NO: 1955514 - RNA, 13 nt, Human
auugucuagugaa

SEQ ID NO: 1955515 - RNA, 16 nt, Human
cagaagcaacccaaau

SEQ ID NO: 1955516 - RNA, 14 nt, Human
cuuucauaauaagu

SEQ ID NO: 1955517 - RNA, 19 nt, Human
uacaaaaaaaaaaaaaaau

SEQ ID NO: 1955518 - RNA, 23 nt, Human
aagagccuuuuuuugaaaaaaag

SEQ ID NO: 1955519 - RNA, 21 nt, Human
aagacucgggauuaguacaca

SEQ ID NO: 1955520 - RNA, 22 nt, Human
cccagcccuccuuaucaaagga

SEQ ID NO: 1955521 - RNA, 20 nt, Human
ugauuauaugucacuuugcu

SEQ ID NO: 1955522 - RNA, 14 nt, Human
cacuuauaggaauu

SEQ ID NO: 1955523 - RNA, 14 nt, Human
ugaagauguagagg

SEQ ID NO: 1955524 - RNA, 16 nt, Human
cccacuggacucaccu

SEQ ID NO: 1955525 - RNA, 15 nt, Human
cagaauucauucacu

SEQ ID NO: 1955526 - RNA, 21 nt, Human
aauaauccucaguuuuuguga

SEQ ID NO: 1955527 - RNA, 19 nt, Human
aggucuaccaaaaaucuca

SEQ ID NO: 1955528 - RNA, 21 nt, Human
cauuuucuucucacauuuaua

SEQ ID NO: 1955529 - RNA, 21 nt, Human
cgacagugagacucugucuca

SEQ ID NO: 1955530 - RNA, 14 nt, Human
ggccgggagccuga

SEQ ID NO: 1955531 - RNA, 20 nt, Human
uuaaauggucaauuuuguua

SEQ ID NO: 1955532 - RNA, 15 nt, Human
ugcaauuccacuuau

SEQ ID NO: 1955533 - RNA, 20 nt, Human
gaacguaaucguguccccua

SEQ ID NO: 1955534 - RNA, 19 nt, Human
auuucuucaacucccugcc

SEQ ID NO: 1955535 - RNA, 20 nt, Human
cuugccauaauuacuauguc

SEQ ID NO: 1955536 - RNA, 23 nt, Human
uagauaggucagugcaaauacuc

SEQ ID NO: 1955537 - RNA, 15 nt, Human
acucaacaaacauaa

SEQ ID NO: 1955538 - RNA, 18 nt, Human
ccuugggaccccugagcu

SEQ ID NO: 1955539 - RNA, 18 nt, Human
agcugcucaauaaaguac

SEQ ID NO: 1955540 - RNA, 16 nt, Human
aauuacauuuguauaa

SEQ ID NO: 1955541 - RNA, 13 nt, Human
ucuacuaaaaaua

SEQ ID NO: 1955542 - RNA, 23 nt, Human
auaucuuuuuuuuaauaaaccau

SEQ ID NO: 1955543 - RNA, 15 nt, Human
aaaagacaaggaaaa

SEQ ID NO: 1955544 - RNA, 14 nt, Human
auuuauguuuaauu

SEQ ID NO: 1955545 - RNA, 14 nt, Human
ccaaauauaaauaa

SEQ ID NO: 1955546 - RNA, 22 nt, Human
agcagcauaaauguugacaugg

SEQ ID NO: 1955547 - RNA, 13 nt, Shigella flexneri 2a str. 301
uuuuuugcauuac

SEQ ID NO: 1955548 - RNA, 16 nt, Shigella flexneri 2a str. 301
uuuuugacgcuuuuac

SEQ ID NO: 1955549 - RNA, 17 nt, Shigella flexneri 2a str. 301
uuuucacuccgaaguaa

SEQ ID NO: 1955550 - RNA, 22 nt, Shigella flexneri 2a str. 301
uuuucuaugcgcucccguaauu

SEQ ID NO: 1955551 - RNA, 11 nt, Shigella flexneri 2a str. 301
uuuucaccagu

SEQ ID NO: 1955552 - RNA, 14 nt, Shigella flexneri 2a str. 301
uuuuaucugugaac

SEQ ID NO: 1955553 - RNA, 15 nt, Shigella flexneri 2a str. 301
uuuguaucugcagau

SEQ ID NO: 1955554 - RNA, 17 nt, Shigella flexneri 2a str. 301
uuuuacuaucuugccga

SEQ ID NO: 1955555 - RNA, 13 nt, Shigella flexneri 2a str. 301
uuugcauccagcu

SEQ ID NO: 1955556 - RNA, 21 nt, Shigella flexneri 2a str. 301
uuugccagucuggcuucgcug

SEQ ID NO: 1955557 - RNA, 13 nt, Shigella flexneri 2a str. 301
uuugcaucgccau

SEQ ID NO: 1955558 - RNA, 17 nt, Shigella flexneri 2a str. 301
uuugccagccgcagcuc

SEQ ID NO: 1955559 - RNA, 15 nt, Shigella flexneri 2a str. 301
uuugcccacagagcu

SEQ ID NO: 1955560 - RNA, 12 nt, Shigella flexneri 2a str. 301
uuugcacauucc

SEQ ID NO: 1955561 - RNA, 11 nt, Shigella flexneri 2a str. 301
uuucgucgcua

SEQ ID NO: 1955562 - RNA, 14 nt, Shigella flexneri 2a str. 301
uuucgccagcaccg

SEQ ID NO: 1955563 - RNA, 18 nt, Shigella flexneri 2a str. 301
uuucgccgcauccggcaa

SEQ ID NO: 1955564 - RNA, 10 nt, Shigella flexneri 2a str. 301
uuucgccagc

SEQ ID NO: 1955565 - RNA, 16 nt, Shigella flexneri 2a str. 301
uuuccugacucagcau

SEQ ID NO: 1955566 - RNA, 17 nt, Shigella flexneri 2a str. 301
uuucaguuuuacucuuu

SEQ ID NO: 1955567 - RNA, 13 nt, Shigella flexneri 2a str. 301
uuucaaccuaaag

SEQ ID NO: 1955568 - RNA, 17 nt, Shigella flexneri 2a str. 301
uuuauagcguugcccga

SEQ ID NO: 1955569 - RNA, 16 nt, Shigella flexneri 2a str. 301
uuucaaaacggucacg

SEQ ID NO: 1955570 - RNA, 22 nt, Shigella flexneri 2a str. 301
uuuaacggacacuccuuccuga

SEQ ID NO: 1955571 - RNA, 12 nt, Shigella flexneri 2a str. 301
uugguucaucgu

SEQ ID NO: 1955572 - RNA, 17 nt, Shigella flexneri 2a str. 301
uuggucagcucaaagcg

SEQ ID NO: 1955573 - RNA, 15 nt, Shigella flexneri 2a str. 301
uugguaaugacucca

SEQ ID NO: 1955574 - RNA, 18 nt, Shigella flexneri 2a str. 301
uuguauuacaacgugcuc

SEQ ID NO: 1955575 - RNA, 19 nt, Shigella flexneri 2a str. 301
uuguauuuuaucugaggca

SEQ ID NO: 1955576 - RNA, 16 nt, Shigella flexneri 2a str. 301
uugugagcauaacgua

SEQ ID NO: 1955577 - RNA, 22 nt, Shigella flexneri 2a str. 301
uuguuuuuugagcgguacacca

SEQ ID NO: 1955578 - RNA, 18 nt, Shigella flexneri 2a str. 301
uugcgcguaacgaucgcc

SEQ ID NO: 1955579 - RNA, 23 nt, Shigella flexneri 2a str. 301
uugcgccugauaaucugcugaac

SEQ ID NO: 1955580 - RNA, 17 nt, Shigella flexneri 2a str. 301
uugcgaucgaccugcgc

SEQ ID NO: 1955581 - RNA, 13 nt, Shigella flexneri 2a str. 301
uugcgauaucaac

SEQ ID NO: 1955582 - RNA, 23 nt, Shigella flexneri 2a str. 301
uugcgcaccggguaaugacucca

SEQ ID NO: 1955583 - RNA, 16 nt, Shigella flexneri 2a str. 301
uugcgcauccagcgcu

SEQ ID NO: 1955584 - RNA, 18 nt, Shigella flexneri 2a str. 301
uugcggcggcgcaaagcg

SEQ ID NO: 1955585 - RNA, 18 nt, Shigella flexneri 2a str. 301
uugcggcguauccggcuc

SEQ ID NO: 1955586 - RNA, 13 nt, Shigella flexneri 2a str. 301
uugcgcugaagua

SEQ ID NO: 1955587 - RNA, 13 nt, Shigella flexneri 2a str. 301
uugcggaugcagc

SEQ ID NO: 1955588 - RNA, 13 nt, Shigella flexneri 2a str. 301
uugcgucgccagu

SEQ ID NO: 1955589 - RNA, 13 nt, Shigella flexneri 2a str. 301
uugcgucaaugcc

SEQ ID NO: 1955590 - RNA, 14 nt, Shigella flexneri 2a str. 301
uugcguaucgacca

SEQ ID NO: 1955591 - RNA, 13 nt, Shigella flexneri 2a str. 301
uugccgccaccuu

SEQ ID NO: 1955592 - RNA, 11 nt, Shigella flexneri 2a str. 301
uugccgccagc

SEQ ID NO: 1955593 - RNA, 16 nt, Shigella flexneri 2a str. 301
uugccugaugcgcuac

SEQ ID NO: 1955594 - RNA, 17 nt, Shigella flexneri 2a str. 301
uugcuucaccagcagcg

SEQ ID NO: 1955595 - RNA, 13 nt, Shigella flexneri 2a str. 301
uugcuuuuacauu

SEQ ID NO: 1955596 - RNA, 17 nt, Shigella flexneri 2a str. 301
uugcugcugauccagcu

SEQ ID NO: 1955597 - RNA, 22 nt, Shigella flexneri 2a str. 301
uugcuggacuugaaccagcgac

SEQ ID NO: 1955598 - RNA, 21 nt, Shigella flexneri 2a str. 301
uugcuguaauuucacaccauc

SEQ ID NO: 1955599 - RNA, 16 nt, Shigella flexneri 2a str. 301
uugcucugcagcagcc

SEQ ID NO: 1955600 - RNA, 19 nt, Shigella flexneri 2a str. 301
uugcucagaaucacgccaa

SEQ ID NO: 1955601 - RNA, 15 nt, Shigella flexneri 2a str. 301
uugcucaagcugaac

SEQ ID NO: 1955602 - RNA, 18 nt, Shigella flexneri 2a str. 301
uugcguucaucaguucca

SEQ ID NO: 1955603 - RNA, 21 nt, Shigella flexneri 2a str. 301
uugcguuccaucagauucagc

SEQ ID NO: 1955604 - RNA, 22 nt, Shigella flexneri 2a str. 301
uuggagacugaugacaaacgca

SEQ ID NO: 1955605 - RNA, 17 nt, Shigella flexneri 2a str. 301
uugcccccugaagcagu

SEQ ID NO: 1955606 - RNA, 14 nt, Shigella flexneri 2a str. 301
uugcccaucgccac

SEQ ID NO: 1955607 - RNA, 22 nt, Shigella flexneri 2a str. 301
uugcaggggagcgaauacuccc

SEQ ID NO: 1955608 - RNA, 20 nt, Shigella flexneri 2a str. 301
uugcaggccagauaaggcgu

SEQ ID NO: 1955609 - RNA, 18 nt, Shigella flexneri 2a str. 301
uugcacugaaugccggau

SEQ ID NO: 1955610 - RNA, 18 nt, Shigella flexneri 2a str. 301
uugcaccgauugccggau

SEQ ID NO: 1955611 - RNA, 17 nt, Shigella flexneri 2a str. 301
uugcaaccacacaggca

SEQ ID NO: 1955612 - RNA, 13 nt, Shigella flexneri 2a str. 301
uugcaacgcccau

SEQ ID NO: 1955613 - RNA, 21 nt, Shigella flexneri 2a str. 301
uugaugccaguaauccggcuu

SEQ ID NO: 1955614 - RNA, 18 nt, Shigella flexneri 2a str. 301
uugaguuggcaugcguau

SEQ ID NO: 1955615 - RNA, 13 nt, Shigella flexneri 2a str. 301
uugacguccagcc

SEQ ID NO: 1955616 - RNA, 17 nt, Shigella flexneri 2a str. 301
uugaggaugcuaaggcu

SEQ ID NO: 1955617 - RNA, 16 nt, Shigella flexneri 2a str. 301
uugagcguauccagca

SEQ ID NO: 1955618 - RNA, 15 nt, Shigella flexneri 2a str. 301
uugagcaaucgacgc

SEQ ID NO: 1955619 - RNA, 19 nt, Shigella flexneri 2a str. 301
uugagcaggagcagcaggu

SEQ ID NO: 1955620 - RNA, 22 nt, Shigella flexneri 2a str. 301
uuccucaaccacuuuaucgaga

SEQ ID NO: 1955621 - RNA, 18 nt, Shigella flexneri 2a str. 301
uugaaggcagcauucgcc

SEQ ID NO: 1955622 - RNA, 18 nt, Shigella flexneri 2a str. 301
ugggugccgcgcagcgug

SEQ ID NO: 1955623 - RNA, 15 nt, Shigella flexneri 2a str. 301
ugggcgcaccugaau

SEQ ID NO: 1955624 - RNA, 21 nt, Shigella flexneri 2a str. 301
ugggcgaagagaaagaacgag

SEQ ID NO: 1955625 - RNA, 21 nt, Shigella flexneri 2a str. 301
ugggcaucggcaaucacauca

SEQ ID NO: 1955626 - RNA, 17 nt, Shigella flexneri 2a str. 301
ugggcaggaaaaucagc

SEQ ID NO: 1955627 - RNA, 20 nt, Shigella flexneri 2a str. 301
uggcugaacgacaaauucag

SEQ ID NO: 1955628 - RNA, 22 nt, Shigella flexneri 2a str. 301
uggcugagcaaacaguucugca

SEQ ID NO: 1955629 - RNA, 19 nt, Shigella flexneri 2a str. 301
uggcugacauaaacaccag

SEQ ID NO: 1955630 - RNA, 20 nt, Shigella flexneri 2a str. 301
uggcgucaggguguuacgcu

SEQ ID NO: 1955631 - RNA, 19 nt, Shigella flexneri 2a str. 301
uggcgucacgccgaccaga

SEQ ID NO: 1955632 - RNA, 21 nt, Shigella flexneri 2a str. 301
uggcgcauaacucaccaucaa

SEQ ID NO: 1955633 - RNA, 16 nt, Shigella flexneri 2a str. 301
uggcgcaucggucaga

SEQ ID NO: 1955634 - RNA, 15 nt, Shigella flexneri 2a str. 301
uggcgaaaucgcugc

SEQ ID NO: 1955635 - RNA, 19 nt, Shigella flexneri 2a str. 301
uggcgcaaugccauccagc

SEQ ID NO: 1955636 - RNA, 22 nt, Shigella flexneri 2a str. 301
uggcggacgggugaguaauguc

SEQ ID NO: 1955637 - RNA, 23 nt, Shigella flexneri 2a str. 301
uggcgcuucacuggcgacaugca

SEQ ID NO: 1955638 - RNA, 14 nt, Shigella flexneri 2a str. 301
uggcgcuuauagcg

SEQ ID NO: 1955639 - RNA, 24 nt, Shigella flexneri 2a str. 301
uggcgcuuauagcgaccauacagc

SEQ ID NO: 1955640 - RNA, 19 nt, Shigella flexneri 2a str. 301
uggcgcgaaccaucaccuc

SEQ ID NO: 1955641 - RNA, 18 nt, Shigella flexneri 2a str. 301
uggcgcgaacagcacauc

SEQ ID NO: 1955642 - RNA, 21 nt, Shigella flexneri 2a str. 301
uggccgcacgcaguuaacgcg

SEQ ID NO: 1955643 - RNA, 16 nt, Shigella flexneri 2a str. 301
uggccgagaggcugaa

SEQ ID NO: 1955644 - RNA, 23 nt, Shigella flexneri 2a str. 301
uggccgauccggacaugcugcac

SEQ ID NO: 1955645 - RNA, 20 nt, Shigella flexneri 2a str. 301
uggaagccacaaucgcagcg

SEQ ID NO: 1955646 - RNA, 13 nt, Shigella flexneri 2a str. 301
uggacaucaugcu

SEQ ID NO: 1955647 - RNA, 17 nt, Shigella flexneri 2a str. 301
uggagagugacaguuca

SEQ ID NO: 1955648 - RNA, 13 nt, Shigella flexneri 2a str. 301
uggagcaggaacu

SEQ ID NO: 1955649 - RNA, 15 nt, Shigella flexneri 2a str. 301
uggagacugaugaca

SEQ ID NO: 1955650 - RNA, 21 nt, Shigella flexneri 2a str. 301
uggaucaaggauugcagcacu

SEQ ID NO: 1955651 - RNA, 22 nt, Shigella flexneri 2a str. 301
uggauaaugaagucugccguug

SEQ ID NO: 1955652 - RNA, 21 nt, Shigella flexneri 2a str. 301
uggaugcggcaugaacaccuu

SEQ ID NO: 1955653 - RNA, 20 nt, Shigella flexneri 2a str. 301
uggaugacauugaugcgcca

SEQ ID NO: 1955654 - RNA, 21 nt, Shigella flexneri 2a str. 301
uggaugaacuucgcagccgug

SEQ ID NO: 1955655 - RNA, 21 nt, Shigella flexneri 2a str. 301
uggcaaaagacaccaucgcgc

SEQ ID NO: 1955656 - RNA, 17 nt, Shigella flexneri 2a str. 301
uggcaccgcagaucaga

SEQ ID NO: 1955657 - RNA, 18 nt, Shigella flexneri 2a str. 301
uggcagcaagugcggcgc

SEQ ID NO: 1955658 - RNA, 20 nt, Shigella flexneri 2a str. 301
uggcagcagucgcaacggcu

SEQ ID NO: 1955659 - RNA, 19 nt, Shigella flexneri 2a str. 301
uggcaucugauaagcccag

SEQ ID NO: 1955660 - RNA, 17 nt, Shigella flexneri 2a str. 301
uggcauccgugguggca

SEQ ID NO: 1955661 - RNA, 18 nt, Shigella flexneri 2a str. 301
uggcaguacgcugggcga

SEQ ID NO: 1955662 - RNA, 17 nt, Shigella flexneri 2a str. 301
uggcauuggcagagcga

SEQ ID NO: 1955663 - RNA, 21 nt, Shigella flexneri 2a str. 301
uggccagagugcguucaccga

SEQ ID NO: 1955664 - RNA, 14 nt, Shigella flexneri 2a str. 301
uggcccaucgccag

SEQ ID NO: 1955665 - RNA, 15 nt, Shigella flexneri 2a str. 301
uggcccaucgccagu

SEQ ID NO: 1955666 - RNA, 23 nt, Shigella flexneri 2a str. 301
ugucgauaaacaguuucgccagg

SEQ ID NO: 1955667 - RNA, 14 nt, Shigella flexneri 2a str. 301
ugugagcauaacgu

SEQ ID NO: 1955668 - RNA, 16 nt, Shigella flexneri 2a str. 301
ugugacuggaaaucaa

SEQ ID NO: 1955669 - RNA, 17 nt, Shigella flexneri 2a str. 301
ugugaagugaguugguu

SEQ ID NO: 1955670 - RNA, 15 nt, Shigella flexneri 2a str. 301
ugucgcuguuucugg

SEQ ID NO: 1955671 - RNA, 12 nt, Shigella flexneri 2a str. 301
ugugucgccagc

SEQ ID NO: 1955672 - RNA, 13 nt, Shigella flexneri 2a str. 301
uguguauacggca

SEQ ID NO: 1955673 - RNA, 23 nt, Shigella flexneri 2a str. 301
uguguuggcaccaucccuaugca

SEQ ID NO: 1955674 - RNA, 22 nt, Shigella flexneri 2a str. 301
ugugcagguggaauauccguca

SEQ ID NO: 1955675 - RNA, 18 nt, Shigella flexneri 2a str. 301
uguggcugcacaccuucu

SEQ ID NO: 1955676 - RNA, 15 nt, Shigella flexneri 2a str. 301
uguucagcgggcagg

SEQ ID NO: 1955677 - RNA, 11 nt, Shigella flexneri 2a str. 301
uguucacugcc

SEQ ID NO: 1955678 - RNA, 18 nt, Shigella flexneri 2a str. 301
uguucagccugaccgcac

SEQ ID NO: 1955679 - RNA, 15 nt, Shigella flexneri 2a str. 301
uguucacgaaaacag

SEQ ID NO: 1955680 - RNA, 14 nt, Shigella flexneri 2a str. 301
uguuauccaccgaa

SEQ ID NO: 1955681 - RNA, 20 nt, Shigella flexneri 2a str. 301
uguugcccagcgcaucaggc

SEQ ID NO: 1955682 - RNA, 19 nt, Shigella flexneri 2a str. 301
uguucuggucacucucgac

SEQ ID NO: 1955683 - RNA, 18 nt, Shigella flexneri 2a str. 301
uguugaaaagccggaaug

SEQ ID NO: 1955684 - RNA, 20 nt, Shigella flexneri 2a str. 301
ugucaucggucagaucggca

SEQ ID NO: 1955685 - RNA, 18 nt, Shigella flexneri 2a str. 301
ugucaucagucuagcccg

SEQ ID NO: 1955686 - RNA, 15 nt, Shigella flexneri 2a str. 301
ugucaucaacgacgg

SEQ ID NO: 1955687 - RNA, 21 nt, Shigella flexneri 2a str. 301
ugucauguauauuauccauca

SEQ ID NO: 1955688 - RNA, 15 nt, Shigella flexneri 2a str. 301
ugucagaugcggcgu

SEQ ID NO: 1955689 - RNA, 13 nt, Shigella flexneri 2a str. 301
ugucagcaacugu

SEQ ID NO: 1955690 - RNA, 19 nt, Shigella flexneri 2a str. 301
uguaggccggauaaggcau

SEQ ID NO: 1955691 - RNA, 20 nt, Shigella flexneri 2a str. 301
uguaggccggauaaggcgcu

SEQ ID NO: 1955692 - RNA, 23 nt, Shigella flexneri 2a str. 301
uguaggccagauaagacguucac

SEQ ID NO: 1955693 - RNA, 19 nt, Shigella flexneri 2a str. 301
uguaggccggauaaggcgu

SEQ ID NO: 1955694 - RNA, 19 nt, Shigella flexneri 2a str. 301
uguacuggcaauagcggac

SEQ ID NO: 1955695 - RNA, 15 nt, Shigella flexneri 2a str. 301
uguacuccagcagac

SEQ ID NO: 1955696 - RNA, 23 nt, Shigella flexneri 2a str. 301
uguagaucuccauacuuccacua

SEQ ID NO: 1955697 - RNA, 14 nt, Shigella flexneri 2a str. 301
uguaauccucuuug

SEQ ID NO: 1955698 - RNA, 15 nt, Shigella flexneri 2a str. 301
uguacaaaaaaugug

SEQ ID NO: 1955699 - RNA, 21 nt, Shigella flexneri 2a str. 301
uguaccaccagaaucgccagc

SEQ ID NO: 1955700 - RNA, 20 nt, Shigella flexneri 2a str. 301
uguaccaccagaaucgccag

SEQ ID NO: 1955701 - RNA, 15 nt, Shigella flexneri 2a str. 301
uguacggcagugaac

SEQ ID NO: 1955702 - RNA, 20 nt, Shigella flexneri 2a str. 301
uguaccuucacgcgcuccag

SEQ ID NO: 1955703 - RNA, 18 nt, Shigella flexneri 2a str. 301
ugguguagggcaggcgug

SEQ ID NO: 1955704 - RNA, 20 nt, Shigella flexneri 2a str. 301
uggugguuuguucgcucuau

SEQ ID NO: 1955705 - RNA, 12 nt, Shigella flexneri 2a str. 301
ugguuggccauc

SEQ ID NO: 1955706 - RNA, 16 nt, Shigella flexneri 2a str. 301
ugguuucaguaauccu

SEQ ID NO: 1955707 - RNA, 17 nt, Shigella flexneri 2a str. 301
uggugcgugcggcaaau

SEQ ID NO: 1955708 - RNA, 18 nt, Shigella flexneri 2a str. 301
ugguaagaggaauugauu

SEQ ID NO: 1955709 - RNA, 15 nt, Shigella flexneri 2a str. 301
uggguuuccggaucg

SEQ ID NO: 1955710 - RNA, 15 nt, Shigella flexneri 2a str. 301
ugguggcccggauuc

SEQ ID NO: 1955711 - RNA, 13 nt, Shigella flexneri 2a str. 301
uuacagcaacgcc

SEQ ID NO: 1955712 - RNA, 20 nt, Shigella flexneri 2a str. 301
uuacagcuggaguacggccu

SEQ ID NO: 1955713 - RNA, 16 nt, Shigella flexneri 2a str. 301
uuacccaaucccccac

SEQ ID NO: 1955714 - RNA, 21 nt, Shigella flexneri 2a str. 301
uuaccaguccugugacucaau

SEQ ID NO: 1955715 - RNA, 15 nt, Shigella flexneri 2a str. 301
uuacagucugcuccc

SEQ ID NO: 1955716 - RNA, 20 nt, Shigella flexneri 2a str. 301
uuacuuucggugacuucaaa

SEQ ID NO: 1955717 - RNA, 23 nt, Shigella flexneri 2a str. 301
uuaccgccacagcagccuucgcc

SEQ ID NO: 1955718 - RNA, 14 nt, Shigella flexneri 2a str. 301
uuaccgccauggcc

SEQ ID NO: 1955719 - RNA, 21 nt, Shigella flexneri 2a str. 301
uuacuuacgaaaaaagggcau

SEQ ID NO: 1955720 - RNA, 21 nt, Shigella flexneri 2a str. 301
uuagucgcccauuuugccacc

SEQ ID NO: 1955721 - RNA, 19 nt, Shigella flexneri 2a str. 301
uuaucuccauccgggauca

SEQ ID NO: 1955722 - RNA, 20 nt, Shigella flexneri 2a str. 301
uuaucuggccuacaaagggc

SEQ ID NO: 1955723 - RNA, 16 nt, Shigella flexneri 2a str. 301
uuaucaacuaucagau

SEQ ID NO: 1955724 - RNA, 15 nt, Shigella flexneri 2a str. 301
uuaucacagcagaac

SEQ ID NO: 1955725 - RNA, 22 nt, Shigella flexneri 2a str. 301
uguuugaaccagauaucgcgga

SEQ ID NO: 1955726 - RNA, 16 nt, Shigella flexneri 2a str. 301
uuaacaucaugucggc

SEQ ID NO: 1955727 - RNA, 15 nt, Shigella flexneri 2a str. 301
uuaacaaucacaaua

SEQ ID NO: 1955728 - RNA, 15 nt, Shigella flexneri 2a str. 301
uguuugacaacucau

SEQ ID NO: 1955729 - RNA, 12 nt, Shigella flexneri 2a str. 301
uguugcgucucg

SEQ ID NO: 1955730 - RNA, 15 nt, Shigella flexneri 2a str. 301
uuaagcgcaaaggcc

SEQ ID NO: 1955731 - RNA, 17 nt, Shigella flexneri 2a str. 301
uuaaccaccuccacgcc

SEQ ID NO: 1955732 - RNA, 18 nt, Shigella flexneri 2a str. 301
uuaacaccugcaacgguu

SEQ ID NO: 1955733 - RNA, 19 nt, Shigella flexneri 2a str. 301
uuaaccagcacguugaacu

SEQ ID NO: 1955734 - RNA, 23 nt, Shigella flexneri 2a str. 301
uuaacgcgccggaaauugccacu

SEQ ID NO: 1955735 - RNA, 11 nt, Shigella flexneri 2a str. 301
uuaaucaucaa

SEQ ID NO: 1955736 - RNA, 23 nt, Shigella flexneri 2a str. 301
uuccagcguagugaaggcaaacu

SEQ ID NO: 1955737 - RNA, 18 nt, Shigella flexneri 2a str. 301
uuccaggcccgcguggau

SEQ ID NO: 1955738 - RNA, 15 nt, Shigella flexneri 2a str. 301
uuccggcaagcaaau

SEQ ID NO: 1955739 - RNA, 17 nt, Shigella flexneri 2a str. 301
uuccggcaccacaaacu

SEQ ID NO: 1955740 - RNA, 17 nt, Shigella flexneri 2a str. 301
uuccgcuaucaguucag

SEQ ID NO: 1955741 - RNA, 14 nt, Shigella flexneri 2a str. 301
uuccggcgacguau

SEQ ID NO: 1955742 - RNA, 16 nt, Shigella flexneri 2a str. 301
uuccacgcaucaagca

SEQ ID NO: 1955743 - RNA, 22 nt, Shigella flexneri 2a str. 301
uuccacgcggguaaguacgcca

SEQ ID NO: 1955744 - RNA, 23 nt, Shigella flexneri 2a str. 301
uuccacgggcaauaucgacgcca

SEQ ID NO: 1955745 - RNA, 21 nt, Shigella flexneri 2a str. 301
uuccacgccugcauccgccau

SEQ ID NO: 1955746 - RNA, 21 nt, Shigella flexneri 2a str. 301
uuccacgcagauuaugccgcu

SEQ ID NO: 1955747 - RNA, 13 nt, Shigella flexneri 2a str. 301
uuccaccgcuauu

SEQ ID NO: 1955748 - RNA, 16 nt, Shigella flexneri 2a str. 301
uuccaccaucacgcca

SEQ ID NO: 1955749 - RNA, 20 nt, Shigella flexneri 2a str. 301
uuccagcaaaucuucgucgu

SEQ ID NO: 1955750 - RNA, 21 nt, Shigella flexneri 2a str. 301
uuccagcaaaucuucgucgug

SEQ ID NO: 1955751 - RNA, 17 nt, Shigella flexneri 2a str. 301
uuccagacucaacaggc

SEQ ID NO: 1955752 - RNA, 14 nt, Shigella flexneri 2a str. 301
uucauaucugccag

SEQ ID NO: 1955753 - RNA, 20 nt, Shigella flexneri 2a str. 301
uucauauuuuacauccggca

SEQ ID NO: 1955754 - RNA, 20 nt, Shigella flexneri 2a str. 301
uucauacagcggccagccau

SEQ ID NO: 1955755 - RNA, 13 nt, Shigella flexneri 2a str. 301
uucauccagcagu

SEQ ID NO: 1955756 - RNA, 16 nt, Shigella flexneri 2a str. 301
uucaacagauuucgaa

SEQ ID NO: 1955757 - RNA, 17 nt, Shigella flexneri 2a str. 301
uucaaccauucgcgcac

SEQ ID NO: 1955758 - RNA, 15 nt, Shigella flexneri 2a str. 301
uucaaccgucaccag

SEQ ID NO: 1955759 - RNA, 17 nt, Shigella flexneri 2a str. 301
uucacaaucagcgcgau

SEQ ID NO: 1955760 - RNA, 20 nt, Shigella flexneri 2a str. 301
uuaugguagugccgucagca

SEQ ID NO: 1955761 - RNA, 21 nt, Shigella flexneri 2a str. 301
uuaugccauguucaucaagcu

SEQ ID NO: 1955762 - RNA, 22 nt, Shigella flexneri 2a str. 301
uuaucugauuugauaaugccag

SEQ ID NO: 1955763 - RNA, 21 nt, Shigella flexneri 2a str. 301
uucaccaaucagaaaggcguu

SEQ ID NO: 1955764 - RNA, 13 nt, Shigella flexneri 2a str. 301
uucacaucaucau

SEQ ID NO: 1955765 - RNA, 23 nt, Shigella flexneri 2a str. 301
uucaccaguuguaaaucgcccac

SEQ ID NO: 1955766 - RNA, 21 nt, Shigella flexneri 2a str. 301
uucaccaguugguagguccag

SEQ ID NO: 1955767 - RNA, 17 nt, Shigella flexneri 2a str. 301
uucaccagcgcgaggau

SEQ ID NO: 1955768 - RNA, 23 nt, Shigella flexneri 2a str. 301
uucacuaaucaauuuuucaucgg

SEQ ID NO: 1955769 - RNA, 13 nt, Shigella flexneri 2a str. 301
uucacggcaccag

SEQ ID NO: 1955770 - RNA, 16 nt, Shigella flexneri 2a str. 301
uucacccaucgccaga

SEQ ID NO: 1955771 - RNA, 20 nt, Shigella flexneri 2a str. 301
uucacgguauuauucaucgc

SEQ ID NO: 1955772 - RNA, 20 nt, Shigella flexneri 2a str. 301
uucagguuacgcccuucacc

SEQ ID NO: 1955773 - RNA, 16 nt, Shigella flexneri 2a str. 301
uucaggcgugauucau

SEQ ID NO: 1955774 - RNA, 21 nt, Shigella flexneri 2a str. 301
uucaggcuuuuuuccagcugu

SEQ ID NO: 1955775 - RNA, 13 nt, Shigella flexneri 2a str. 301
uucagaaagcgcc

SEQ ID NO: 1955776 - RNA, 13 nt, Shigella flexneri 2a str. 301
ucggcuuucagcg

SEQ ID NO: 1955777 - RNA, 19 nt, Shigella flexneri 2a str. 301
ucggcgucuuguugaacag

SEQ ID NO: 1955778 - RNA, 16 nt, Shigella flexneri 2a str. 301
ucggcugaacgugcuc

SEQ ID NO: 1955779 - RNA, 21 nt, Shigella flexneri 2a str. 301
ucggccuuccauaaugcugac

SEQ ID NO: 1955780 - RNA, 14 nt, Shigella flexneri 2a str. 301
ucgcugccagcacu

SEQ ID NO: 1955781 - RNA, 17 nt, Shigella flexneri 2a str. 301
ucgcugauucuggcguu

SEQ ID NO: 1955782 - RNA, 11 nt, Shigella flexneri 2a str. 301
ucgcugccagc

SEQ ID NO: 1955783 - RNA, 22 nt, Shigella flexneri 2a str. 301
ucgcucauaugacguaucaccg

SEQ ID NO: 1955784 - RNA, 17 nt, Shigella flexneri 2a str. 301
ucgcgcuuaucgccagc

SEQ ID NO: 1955785 - RNA, 21 nt, Shigella flexneri 2a str. 301
ucgcgcuugcggaagcaaccg

SEQ ID NO: 1955786 - RNA, 14 nt, Shigella flexneri 2a str. 301
ucgcuacugauaau

SEQ ID NO: 1955787 - RNA, 16 nt, Shigella flexneri 2a str. 301
ucggaaugccggaauc

SEQ ID NO: 1955788 - RNA, 15 nt, Shigella flexneri 2a str. 301
ucgcugcugcggcga

SEQ ID NO: 1955789 - RNA, 15 nt, Shigella flexneri 2a str. 301
ucgcugccgcgcagg

SEQ ID NO: 1955790 - RNA, 13 nt, Shigella flexneri 2a str. 301
ucggcauaaucau

SEQ ID NO: 1955791 - RNA, 15 nt, Shigella flexneri 2a str. 301
ucguagugaugccau

SEQ ID NO: 1955792 - RNA, 20 nt, Shigella flexneri 2a str. 301
ucguaucuggcaagcaggac

SEQ ID NO: 1955793 - RNA, 16 nt, Shigella flexneri 2a str. 301
ucgguuucaucacaua

SEQ ID NO: 1955794 - RNA, 19 nt, Shigella flexneri 2a str. 301
ucgguugcacagacuuaau

SEQ ID NO: 1955795 - RNA, 15 nt, Shigella flexneri 2a str. 301
ucguagacugcagcg

SEQ ID NO: 1955796 - RNA, 20 nt, Shigella flexneri 2a str. 301
ucguaggccagauaagacgc

SEQ ID NO: 1955797 - RNA, 20 nt, Shigella flexneri 2a str. 301
ucguaggccggauaaggcgu

SEQ ID NO: 1955798 - RNA, 15 nt, Shigella flexneri 2a str. 301
ucgguccaccacgua

SEQ ID NO: 1955799 - RNA, 21 nt, Shigella flexneri 2a str. 301
ucgugacaauaauacccagca

SEQ ID NO: 1955800 - RNA, 21 nt, Shigella flexneri 2a str. 301
ucgugaaaggaaaaaauacag

SEQ ID NO: 1955801 - RNA, 22 nt, Shigella flexneri 2a str. 301
ucgucguuaagccuuucgcaaa

SEQ ID NO: 1955802 - RNA, 21 nt, Shigella flexneri 2a str. 301
ucgucgugaagcagagcagac

SEQ ID NO: 1955803 - RNA, 20 nt, Shigella flexneri 2a str. 301
ucgugcgucgcauccggcaa

SEQ ID NO: 1955804 - RNA, 15 nt, Shigella flexneri 2a str. 301
ucgugcaucauggaa

SEQ ID NO: 1955805 - RNA, 21 nt, Shigella flexneri 2a str. 301
ucgugggcaggaaaaucagca

SEQ ID NO: 1955806 - RNA, 21 nt, Shigella flexneri 2a str. 301
ucguuucaugccauccgcauc

SEQ ID NO: 1955807 - RNA, 20 nt, Shigella flexneri 2a str. 301
ucguuugugggaauaaccau

SEQ ID NO: 1955808 - RNA, 16 nt, Shigella flexneri 2a str. 301
ucuaaaaaugugcccg

SEQ ID NO: 1955809 - RNA, 15 nt, Shigella flexneri 2a str. 301
ucguuuuggcagaaa

SEQ ID NO: 1955810 - RNA, 22 nt, Shigella flexneri 2a str. 301
ucucaucaguuaacggcaggau

SEQ ID NO: 1955811 - RNA, 12 nt, Shigella flexneri 2a str. 301
ucucauccauca

SEQ ID NO: 1955812 - RNA, 15 nt, Shigella flexneri 2a str. 301
ucgccuuccagcgau

SEQ ID NO: 1955813 - RNA, 16 nt, Shigella flexneri 2a str. 301
ucgccugccagaugca

SEQ ID NO: 1955814 - RNA, 17 nt, Shigella flexneri 2a str. 301
ucgccugcaucaccauc

SEQ ID NO: 1955815 - RNA, 12 nt, Shigella flexneri 2a str. 301
ucgccugccaga

SEQ ID NO: 1955816 - RNA, 13 nt, Shigella flexneri 2a str. 301
ucgccugcggcgc

SEQ ID NO: 1955817 - RNA, 17 nt, Shigella flexneri 2a str. 301
ucgccugguacuggauu

SEQ ID NO: 1955818 - RNA, 22 nt, Shigella flexneri 2a str. 301
ucgccuuccacuucugcgucga

SEQ ID NO: 1955819 - RNA, 15 nt, Shigella flexneri 2a str. 301
ucgcgcucaucagcg

SEQ ID NO: 1955820 - RNA, 18 nt, Shigella flexneri 2a str. 301
ucgcgcuaauuccagucg

SEQ ID NO: 1955821 - RNA, 16 nt, Shigella flexneri 2a str. 301
ucgccugcaucaccau

SEQ ID NO: 1955822 - RNA, 19 nt, Shigella flexneri 2a str. 301
ucgccauaauaagcgccau

SEQ ID NO: 1955823 - RNA, 20 nt, Shigella flexneri 2a str. 301
ucgccagccucccagccauu

SEQ ID NO: 1955824 - RNA, 19 nt, Shigella flexneri 2a str. 301
ucgccagccucccagccau

SEQ ID NO: 1955825 - RNA, 13 nt, Shigella flexneri 2a str. 301
ucgccagcucaag

SEQ ID NO: 1955826 - RNA, 15 nt, Shigella flexneri 2a str. 301
ucgccgcacgcucaa

SEQ ID NO: 1955827 - RNA, 17 nt, Shigella flexneri 2a str. 301
ucgccgaggcgcuggca

SEQ ID NO: 1955828 - RNA, 14 nt, Shigella flexneri 2a str. 301
ucgcagucgccagc

SEQ ID NO: 1955829 - RNA, 16 nt, Shigella flexneri 2a str. 301
ucgcauaacagagcga

SEQ ID NO: 1955830 - RNA, 22 nt, Shigella flexneri 2a str. 301
ucgcaucccgguaucaaagcgc

SEQ ID NO: 1955831 - RNA, 13 nt, Shigella flexneri 2a str. 301
ucgccaaguucga

SEQ ID NO: 1955832 - RNA, 22 nt, Shigella flexneri 2a str. 301
ucgccaaaugucaccagccgau

SEQ ID NO: 1955833 - RNA, 14 nt, Shigella flexneri 2a str. 301
ucgccagcagccau

SEQ ID NO: 1955834 - RNA, 20 nt, Shigella flexneri 2a str. 301
ucgccacggcaugaaagcga

SEQ ID NO: 1955835 - RNA, 19 nt, Shigella flexneri 2a str. 301
ucgccaccguuauccugau

SEQ ID NO: 1955836 - RNA, 19 nt, Shigella flexneri 2a str. 301
ucgagacgggcgaggaaau

SEQ ID NO: 1955837 - RNA, 13 nt, Shigella flexneri 2a str. 301
ucgacuuaacgcg

SEQ ID NO: 1955838 - RNA, 19 nt, Shigella flexneri 2a str. 301
ucgacgcgccagcaccgca

SEQ ID NO: 1955839 - RNA, 18 nt, Shigella flexneri 2a str. 301
ucgagguacgcuccagca

SEQ ID NO: 1955840 - RNA, 15 nt, Shigella flexneri 2a str. 301
ucgaggcucugauug

SEQ ID NO: 1955841 - RNA, 16 nt, Shigella flexneri 2a str. 301
ucgagcgcgagcaggc

SEQ ID NO: 1955842 - RNA, 17 nt, Shigella flexneri 2a str. 301
ucgagugcaauaacguu

SEQ ID NO: 1955843 - RNA, 22 nt, Shigella flexneri 2a str. 301
ucgauaaauggcgcauccagcc

SEQ ID NO: 1955844 - RNA, 13 nt, Shigella flexneri 2a str. 301
ucgauaaccaucc

SEQ ID NO: 1955845 - RNA, 12 nt, Shigella flexneri 2a str. 301
ucgauaaaccau

SEQ ID NO: 1955846 - RNA, 14 nt, Shigella flexneri 2a str. 301
ucgaugaaagcgcc

SEQ ID NO: 1955847 - RNA, 12 nt, Shigella flexneri 2a str. 301
ucgcacuaucga

SEQ ID NO: 1955848 - RNA, 18 nt, Shigella flexneri 2a str. 301
ucgcacguauaaacaucu

SEQ ID NO: 1955849 - RNA, 14 nt, Shigella flexneri 2a str. 301
ucgcaaaccuggca

SEQ ID NO: 1955850 - RNA, 18 nt, Shigella flexneri 2a str. 301
ucgauuuuuuccagcgca

SEQ ID NO: 1955851 - RNA, 18 nt, Shigella flexneri 2a str. 301
ucgauuuuuaaugaacgg

SEQ ID NO: 1955852 - RNA, 20 nt, Shigella flexneri 2a str. 301
ucgauuucauucagcguauc

SEQ ID NO: 1955853 - RNA, 12 nt, Shigella flexneri 2a str. 301
ucgauuucugac

SEQ ID NO: 1955854 - RNA, 20 nt, Shigella flexneri 2a str. 301
ucgcaaucggguuaccggaa

SEQ ID NO: 1955855 - RNA, 20 nt, Shigella flexneri 2a str. 301
ucgcacaaaaucaugagguu

SEQ ID NO: 1955856 - RNA, 19 nt, Shigella flexneri 2a str. 301
ucgcaaauccauucaucgc

SEQ ID NO: 1955857 - RNA, 23 nt, Shigella flexneri 2a str. 301
ugccggaugcgaugcugacgcau

SEQ ID NO: 1955858 - RNA, 13 nt, Shigella flexneri 2a str. 301
ugccggaugcggc

SEQ ID NO: 1955859 - RNA, 15 nt, Shigella flexneri 2a str. 301
ugccggaugcggcgu

SEQ ID NO: 1955860 - RNA, 18 nt, Shigella flexneri 2a str. 301
ugccggaugcggcgugaa

SEQ ID NO: 1955861 - RNA, 22 nt, Shigella flexneri 2a str. 301
ugccggauguguugcauccggc

SEQ ID NO: 1955862 - RNA, 21 nt, Shigella flexneri 2a str. 301
ugccggauguuuccauccggc

SEQ ID NO: 1955863 - RNA, 14 nt, Shigella flexneri 2a str. 301
ugccggaacgugca

SEQ ID NO: 1955864 - RNA, 19 nt, Shigella flexneri 2a str. 301
ugccgcuuuaugugcuucu

SEQ ID NO: 1955865 - RNA, 19 nt, Shigella flexneri 2a str. 301
ugccgcuucauugaccuuu

SEQ ID NO: 1955866 - RNA, 23 nt, Shigella flexneri 2a str. 301
ugccgcuuuaugugcuucuacca

SEQ ID NO: 1955867 - RNA, 18 nt, Shigella flexneri 2a str. 301
ugccgcguuggcaauguc

SEQ ID NO: 1955868 - RNA, 15 nt, Shigella flexneri 2a str. 301
ugccgcaauggccgu

SEQ ID NO: 1955869 - RNA, 15 nt, Shigella flexneri 2a str. 301
ugccgcacauuuccc

SEQ ID NO: 1955870 - RNA, 17 nt, Shigella flexneri 2a str. 301
ugccgauuacguaauuc

SEQ ID NO: 1955871 - RNA, 23 nt, Shigella flexneri 2a str. 301
ugccgcccagaagcacugccaga

SEQ ID NO: 1955872 - RNA, 20 nt, Shigella flexneri 2a str. 301
ugcccggagcagcagucagg

SEQ ID NO: 1955873 - RNA, 20 nt, Shigella flexneri 2a str. 301
ugcaucccgccguaccggca

SEQ ID NO: 1955874 - RNA, 15 nt, Shigella flexneri 2a str. 301
ugcauauaaucgauc

SEQ ID NO: 1955875 - RNA, 23 nt, Shigella flexneri 2a str. 301
ugcaucggggaauugugcuuuca

SEQ ID NO: 1955876 - RNA, 18 nt, Shigella flexneri 2a str. 301
ugcauaauccgccgcugu

SEQ ID NO: 1955877 - RNA, 18 nt, Shigella flexneri 2a str. 301
ugcccaccgguuuccggg

SEQ ID NO: 1955878 - RNA, 16 nt, Shigella flexneri 2a str. 301
ugcccacucaacgguu

SEQ ID NO: 1955879 - RNA, 22 nt, Shigella flexneri 2a str. 301
ugccagccgccgcuaucggcaa

SEQ ID NO: 1955880 - RNA, 13 nt, Shigella flexneri 2a str. 301
ugccagccaggau

SEQ ID NO: 1955881 - RNA, 18 nt, Shigella flexneri 2a str. 301
ugccagcauaaucaccau

SEQ ID NO: 1955882 - RNA, 12 nt, Shigella flexneri 2a str. 301
ugcgcuaucagg

SEQ ID NO: 1955883 - RNA, 14 nt, Shigella flexneri 2a str. 301
ugcgcuauccagcg

SEQ ID NO: 1955884 - RNA, 17 nt, Shigella flexneri 2a str. 301
ugcgcuauccagcgcau

SEQ ID NO: 1955885 - RNA, 18 nt, Shigella flexneri 2a str. 301
ugcgcuacgcuuaucagg

SEQ ID NO: 1955886 - RNA, 17 nt, Shigella flexneri 2a str. 301
ugcggauuccggagcaa

SEQ ID NO: 1955887 - RNA, 18 nt, Shigella flexneri 2a str. 301
ugcggauugucauagcga

SEQ ID NO: 1955888 - RNA, 17 nt, Shigella flexneri 2a str. 301
ugcggcgugaacgccuu

SEQ ID NO: 1955889 - RNA, 19 nt, Shigella flexneri 2a str. 301
ugcggcgucauaauccggc

SEQ ID NO: 1955890 - RNA, 15 nt, Shigella flexneri 2a str. 301
ugcggcguuaacgcc

SEQ ID NO: 1955891 - RNA, 15 nt, Shigella flexneri 2a str. 301
ugcggcguauccggc

SEQ ID NO: 1955892 - RNA, 14 nt, Shigella flexneri 2a str. 301
ugcgccugcuaaac

SEQ ID NO: 1955893 - RNA, 22 nt, Shigella flexneri 2a str. 301
ugcgccugauaaucugcugaac

SEQ ID NO: 1955894 - RNA, 19 nt, Shigella flexneri 2a str. 301
ugcgcggauccacaccuga

SEQ ID NO: 1955895 - RNA, 22 nt, Shigella flexneri 2a str. 301
ugcgcggauggccucugccagc

SEQ ID NO: 1955896 - RNA, 18 nt, Shigella flexneri 2a str. 301
ugcgcgguaaagcgcggc

SEQ ID NO: 1955897 - RNA, 13 nt, Shigella flexneri 2a str. 301
ugccuccagcgac

SEQ ID NO: 1955898 - RNA, 17 nt, Shigella flexneri 2a str. 301
ugccugacggaaaucau

SEQ ID NO: 1955899 - RNA, 17 nt, Shigella flexneri 2a str. 301
ugccugaugcgacgcug

SEQ ID NO: 1955900 - RNA, 18 nt, Shigella flexneri 2a str. 301
ugcgcauaacugccggau

SEQ ID NO: 1955901 - RNA, 16 nt, Shigella flexneri 2a str. 301
ugcgcaucggcgucgu

SEQ ID NO: 1955902 - RNA, 21 nt, Shigella flexneri 2a str. 301
ugcgauggugguugcgccgua

SEQ ID NO: 1955903 - RNA, 21 nt, Shigella flexneri 2a str. 301
ugcgaucucgcguccgccgau

SEQ ID NO: 1955904 - RNA, 14 nt, Shigella flexneri 2a str. 301
ugcgagcaaagcgc

SEQ ID NO: 1955905 - RNA, 19 nt, Shigella flexneri 2a str. 301
ugcgacgcaacgcgcguga

SEQ ID NO: 1955906 - RNA, 16 nt, Shigella flexneri 2a str. 301
ugcgacgcuuaacgcg

SEQ ID NO: 1955907 - RNA, 22 nt, Shigella flexneri 2a str. 301
ugccuguacggcagugaacgcg

SEQ ID NO: 1955908 - RNA, 13 nt, Shigella flexneri 2a str. 301
ugccuguacggca

SEQ ID NO: 1955909 - RNA, 21 nt, Shigella flexneri 2a str. 301
ugcgacaaacauugcugccag

SEQ ID NO: 1955910 - RNA, 18 nt, Shigella flexneri 2a str. 301
ugcgacagagauauucag

SEQ ID NO: 1955911 - RNA, 19 nt, Shigella flexneri 2a str. 301
ugaggcgcuacgcuaucag

SEQ ID NO: 1955912 - RNA, 19 nt, Shigella flexneri 2a str. 301
ugacugcuuugcacaggca

SEQ ID NO: 1955913 - RNA, 14 nt, Shigella flexneri 2a str. 301
ugacugacuucaac

SEQ ID NO: 1955914 - RNA, 16 nt, Shigella flexneri 2a str. 301
ugacugccccaguucc

SEQ ID NO: 1955915 - RNA, 14 nt, Shigella flexneri 2a str. 301
ugacguaucaccga

SEQ ID NO: 1955916 - RNA, 21 nt, Shigella flexneri 2a str. 301
ugacguagcagcuccgccagc

SEQ ID NO: 1955917 - RNA, 11 nt, Shigella flexneri 2a str. 301
ugagcgcaaau

SEQ ID NO: 1955918 - RNA, 17 nt, Shigella flexneri 2a str. 301
ugagcgauuaucgccau

SEQ ID NO: 1955919 - RNA, 18 nt, Shigella flexneri 2a str. 301
ugagccaaaaugccugau

SEQ ID NO: 1955920 - RNA, 20 nt, Shigella flexneri 2a str. 301
ugacgcgucuuaucaggccu

SEQ ID NO: 1955921 - RNA, 23 nt, Shigella flexneri 2a str. 301
ugacgcgucuuaucaggccuaca

SEQ ID NO: 1955922 - RNA, 15 nt, Shigella flexneri 2a str. 301
ugacgcgggcagcag

SEQ ID NO: 1955923 - RNA, 16 nt, Shigella flexneri 2a str. 301
ugacgcgggcagcaga

SEQ ID NO: 1955924 - RNA, 21 nt, Shigella flexneri 2a str. 301
ugacgaugcuccacuccugcc

SEQ ID NO: 1955925 - RNA, 16 nt, Shigella flexneri 2a str. 301
ugacgccaccagcggu

SEQ ID NO: 1955926 - RNA, 21 nt, Shigella flexneri 2a str. 301
ugacgcgucuuaucuggccua

SEQ ID NO: 1955927 - RNA, 17 nt, Shigella flexneri 2a str. 301
ugacggacgcccgccga

SEQ ID NO: 1955928 - RNA, 16 nt, Shigella flexneri 2a str. 301
ugauuccgaauccaac

SEQ ID NO: 1955929 - RNA, 19 nt, Shigella flexneri 2a str. 301
ugauuuuccuccagcagca

SEQ ID NO: 1955930 - RNA, 16 nt, Shigella flexneri 2a str. 301
ugcaaaauauggggca

SEQ ID NO: 1955931 - RNA, 20 nt, Shigella flexneri 2a str. 301
ugauuuugcugaucggcaag

SEQ ID NO: 1955932 - RNA, 23 nt, Shigella flexneri 2a str. 301
ugcaaacgcuggugaguaacgcg

SEQ ID NO: 1955933 - RNA, 15 nt, Shigella flexneri 2a str. 301
ugcaacugcgcggca

SEQ ID NO: 1955934 - RNA, 22 nt, Shigella flexneri 2a str. 301
ugauuagggcggacaaccagcu

SEQ ID NO: 1955935 - RNA, 12 nt, Shigella flexneri 2a str. 301
ugaugcguaccu

SEQ ID NO: 1955936 - RNA, 22 nt, Shigella flexneri 2a str. 301
ugaugcgcugcgcuuaucaggc

SEQ ID NO: 1955937 - RNA, 21 nt, Shigella flexneri 2a str. 301
ugcaagcgggguaaaugccau

SEQ ID NO: 1955938 - RNA, 15 nt, Shigella flexneri 2a str. 301
ugcaagaucgcucau

SEQ ID NO: 1955939 - RNA, 12 nt, Shigella flexneri 2a str. 301
ugcaaucaucuu

SEQ ID NO: 1955940 - RNA, 22 nt, Shigella flexneri 2a str. 301
ugcaauuuguggugaagccacc

SEQ ID NO: 1955941 - RNA, 17 nt, Shigella flexneri 2a str. 301
ugcacaagaugccugau

SEQ ID NO: 1955942 - RNA, 16 nt, Shigella flexneri 2a str. 301
ugcacaauugccggau

SEQ ID NO: 1955943 - RNA, 22 nt, Shigella flexneri 2a str. 301
ugcacaauuuaccggcagguga

SEQ ID NO: 1955944 - RNA, 22 nt, Shigella flexneri 2a str. 301
ugcaccccaauuaauugccagc

SEQ ID NO: 1955945 - RNA, 17 nt, Shigella flexneri 2a str. 301
ugcaccgauugccggau

SEQ ID NO: 1955946 - RNA, 22 nt, Shigella flexneri 2a str. 301
ugaguucccggcagggaagcuc

SEQ ID NO: 1955947 - RNA, 17 nt, Shigella flexneri 2a str. 301
ugauccgccgcgcggug

SEQ ID NO: 1955948 - RNA, 13 nt, Shigella flexneri 2a str. 301
ugaucauccgccu

SEQ ID NO: 1955949 - RNA, 22 nt, Shigella flexneri 2a str. 301
ugaucauccgccucuaacagau

SEQ ID NO: 1955950 - RNA, 14 nt, Shigella flexneri 2a str. 301
ugaucggcgagaua

SEQ ID NO: 1955951 - RNA, 16 nt, Shigella flexneri 2a str. 301
ugaucgaggcaaagag

SEQ ID NO: 1955952 - RNA, 17 nt, Shigella flexneri 2a str. 301
ugaucgccagcggaaua

SEQ ID NO: 1955953 - RNA, 22 nt, Shigella flexneri 2a str. 301
ugaugcgcuacgcucaucaggc

SEQ ID NO: 1955954 - RNA, 18 nt, Shigella flexneri 2a str. 301
ugaucuauaccaccgcuc

SEQ ID NO: 1955955 - RNA, 13 nt, Shigella flexneri 2a str. 301
ugaucgucacgau

SEQ ID NO: 1955956 - RNA, 16 nt, Shigella flexneri 2a str. 301
ugaccgcuccgccauc

SEQ ID NO: 1955957 - RNA, 20 nt, Shigella flexneri 2a str. 301
ugaccgcgaguaaucacauc

SEQ ID NO: 1955958 - RNA, 14 nt, Shigella flexneri 2a str. 301
ugaccugccgcaga

SEQ ID NO: 1955959 - RNA, 16 nt, Shigella flexneri 2a str. 301
ugaccugcggcaccag

SEQ ID NO: 1955960 - RNA, 21 nt, Shigella flexneri 2a str. 301
ugacauucaccucacgacgua

SEQ ID NO: 1955961 - RNA, 19 nt, Shigella flexneri 2a str. 301
ugacagcgcccgacaagau

SEQ ID NO: 1955962 - RNA, 20 nt, Shigella flexneri 2a str. 301
ugacagccagcaagucuuca

SEQ ID NO: 1955963 - RNA, 17 nt, Shigella flexneri 2a str. 301
ugacagaguuccggccc

SEQ ID NO: 1955964 - RNA, 14 nt, Shigella flexneri 2a str. 301
ugacaguagccuuu

SEQ ID NO: 1955965 - RNA, 23 nt, Shigella flexneri 2a str. 301
ugacaggcgggaagaacggcaac

SEQ ID NO: 1955966 - RNA, 20 nt, Shigella flexneri 2a str. 301
ugacagcgcgcgccgccaau

SEQ ID NO: 1955967 - RNA, 20 nt, Shigella flexneri 2a str. 301
ugaccauaacccgcuuccag

SEQ ID NO: 1955968 - RNA, 12 nt, Shigella flexneri 2a str. 301
ugaccagucaga

SEQ ID NO: 1955969 - RNA, 21 nt, Shigella flexneri 2a str. 301
ugacccgguugaccggccagu

SEQ ID NO: 1955970 - RNA, 22 nt, Shigella flexneri 2a str. 301
ugaccaugcucaacaaaccguu

SEQ ID NO: 1955971 - RNA, 17 nt, Shigella flexneri 2a str. 301
ugaccaucuuccagcau

SEQ ID NO: 1955972 - RNA, 12 nt, Shigella flexneri 2a str. 301
ugacccaguaga

SEQ ID NO: 1955973 - RNA, 13 nt, Shigella flexneri 2a str. 301
ugaaaugcggcga

SEQ ID NO: 1955974 - RNA, 14 nt, Shigella flexneri 2a str. 301
ugaaaucacgcauc

SEQ ID NO: 1955975 - RNA, 13 nt, Shigella flexneri 2a str. 301
ugaaauugcuggu

SEQ ID NO: 1955976 - RNA, 19 nt, Shigella flexneri 2a str. 301
ugaacugacagccaaaggg

SEQ ID NO: 1955977 - RNA, 16 nt, Shigella flexneri 2a str. 301
ugaacugauugccacc

SEQ ID NO: 1955978 - RNA, 17 nt, Shigella flexneri 2a str. 301
ugaacuguacaaagccg

SEQ ID NO: 1955979 - RNA, 15 nt, Shigella flexneri 2a str. 301
ucucccagccgcccu

SEQ ID NO: 1955980 - RNA, 12 nt, Shigella flexneri 2a str. 301
ucucccguuccu

SEQ ID NO: 1955981 - RNA, 22 nt, Shigella flexneri 2a str. 301
ucuuucacuucagcaacgugcu

SEQ ID NO: 1955982 - RNA, 18 nt, Shigella flexneri 2a str. 301
ucuuugccugaucgguga

SEQ ID NO: 1955983 - RNA, 15 nt, Shigella flexneri 2a str. 301
ucuuugcuuccugag

SEQ ID NO: 1955984 - RNA, 21 nt, Shigella flexneri 2a str. 301
ugaaacggaaucgcccgcugu

SEQ ID NO: 1955985 - RNA, 12 nt, Shigella flexneri 2a str. 301
ugaaacgcuggu

SEQ ID NO: 1955986 - RNA, 23 nt, Shigella flexneri 2a str. 301
ugaaaggcgcgguuucugcuugu

SEQ ID NO: 1955987 - RNA, 19 nt, Shigella flexneri 2a str. 301
ugaaucgucggaauggcau

SEQ ID NO: 1955988 - RNA, 23 nt, Shigella flexneri 2a str. 301
ugaaucgggaucaccuguucguc

SEQ ID NO: 1955989 - RNA, 15 nt, Shigella flexneri 2a str. 301
ugaaugccgcuaccg

SEQ ID NO: 1955990 - RNA, 13 nt, Shigella flexneri 2a str. 301
ugaaugaucggau

SEQ ID NO: 1955991 - RNA, 22 nt, Shigella flexneri 2a str. 301
ugaaucccugcgaacugcgcag

SEQ ID NO: 1955992 - RNA, 22 nt, Shigella flexneri 2a str. 301
ugaaucgucagacgaugcgucu

SEQ ID NO: 1955993 - RNA, 18 nt, Shigella flexneri 2a str. 301
ugacaaagugcgcguugu

SEQ ID NO: 1955994 - RNA, 23 nt, Shigella flexneri 2a str. 301
ugacaaacgcaacauugccugau

SEQ ID NO: 1955995 - RNA, 15 nt, Shigella flexneri 2a str. 301
ugaaggcggcgcauc

SEQ ID NO: 1955996 - RNA, 20 nt, Shigella flexneri 2a str. 301
ugaagucgcgcucaucagcg

SEQ ID NO: 1955997 - RNA, 21 nt, Shigella flexneri 2a str. 301
ugaagguuucugcauuaucca

SEQ ID NO: 1955998 - RNA, 17 nt, Shigella flexneri 2a str. 301
ugaaguuauaaggcguu

SEQ ID NO: 1955999 - RNA, 23 nt, Shigella flexneri 2a str. 301
ugaagcucacuucgcuuacgccu

SEQ ID NO: 1956000 - RNA, 19 nt, Shigella flexneri 2a str. 301
ugaagaacuggaacgcgua

SEQ ID NO: 1956001 - RNA, 19 nt, Shigella flexneri 2a str. 301
uaugcagugcauccagcag

SEQ ID NO: 1956002 - RNA, 22 nt, Shigella flexneri 2a str. 301
uaugcccuggcucguggcugag

SEQ ID NO: 1956003 - RNA, 16 nt, Shigella flexneri 2a str. 301
uaugccugauuacggu

SEQ ID NO: 1956004 - RNA, 15 nt, Shigella flexneri 2a str. 301
uaugccucaacccuu

SEQ ID NO: 1956005 - RNA, 22 nt, Shigella flexneri 2a str. 301
uaucuccauucugagugacgcg

SEQ ID NO: 1956006 - RNA, 19 nt, Shigella flexneri 2a str. 301
uaucgcguugaugauuugu

SEQ ID NO: 1956007 - RNA, 19 nt, Shigella flexneri 2a str. 301
uaucgcccugcuccagcaa

SEQ ID NO: 1956008 - RNA, 16 nt, Shigella flexneri 2a str. 301
uaucgcgauacaccag

SEQ ID NO: 1956009 - RNA, 22 nt, Shigella flexneri 2a str. 301
uaucgcggauaugcagcagcca

SEQ ID NO: 1956010 - RNA, 17 nt, Shigella flexneri 2a str. 301
uaucgauaaauggcgca

SEQ ID NO: 1956011 - RNA, 17 nt, Shigella flexneri 2a str. 301
uaucgacagacgccagc

SEQ ID NO: 1956012 - RNA, 13 nt, Shigella flexneri 2a str. 301
uaucgacgccagu

SEQ ID NO: 1956013 - RNA, 19 nt, Shigella flexneri 2a str. 301
uaucgauuucuacacccag

SEQ ID NO: 1956014 - RNA, 20 nt, Shigella flexneri 2a str. 301
uaucgcacagaugcgacggc

SEQ ID NO: 1956015 - RNA, 20 nt, Shigella flexneri 2a str. 301
uaucgcagccuuaccggaga

SEQ ID NO: 1956016 - RNA, 14 nt, Shigella flexneri 2a str. 301
uaucgaacguccag

SEQ ID NO: 1956017 - RNA, 15 nt, Shigella flexneri 2a str. 301
uagcggcucuggcuc

SEQ ID NO: 1956018 - RNA, 18 nt, Shigella flexneri 2a str. 301
uauugccgaagaccagau

SEQ ID NO: 1956019 - RNA, 22 nt, Shigella flexneri 2a str. 301
uauugaauuuacgggccggaua

SEQ ID NO: 1956020 - RNA, 13 nt, Shigella flexneri 2a str. 301
uaugcgcauugcc

SEQ ID NO: 1956021 - RNA, 14 nt, Shigella flexneri 2a str. 301
uaugccuggcauuu

SEQ ID NO: 1956022 - RNA, 15 nt, Shigella flexneri 2a str. 301
uaugcugcgccaguu

SEQ ID NO: 1956023 - RNA, 13 nt, Shigella flexneri 2a str. 301
uaugcugauucgu

SEQ ID NO: 1956024 - RNA, 19 nt, Shigella flexneri 2a str. 301
ucaaaacggucacggcugu

SEQ ID NO: 1956025 - RNA, 16 nt, Shigella flexneri 2a str. 301
ucaaaaucaucaucuu

SEQ ID NO: 1956026 - RNA, 18 nt, Shigella flexneri 2a str. 301
uauuuugcuuccggcaag

SEQ ID NO: 1956027 - RNA, 14 nt, Shigella flexneri 2a str. 301
uauuucacuucaac

SEQ ID NO: 1956028 - RNA, 17 nt, Shigella flexneri 2a str. 301
ucaacgccaucgccagg

SEQ ID NO: 1956029 - RNA, 22 nt, Shigella flexneri 2a str. 301
ucaacgacccagccagacgcca

SEQ ID NO: 1956030 - RNA, 22 nt, Shigella flexneri 2a str. 301
ucaacgaucagcguggcaucgg

SEQ ID NO: 1956031 - RNA, 13 nt, Shigella flexneri 2a str. 301
ucaacccauuucg

SEQ ID NO: 1956032 - RNA, 22 nt, Shigella flexneri 2a str. 301
ucaaccacucaccgcuggcgua

SEQ ID NO: 1956033 - RNA, 18 nt, Shigella flexneri 2a str. 301
ucaaccacuuuaucgaga

SEQ ID NO: 1956034 - RNA, 21 nt, Shigella flexneri 2a str. 301
ucaacauucccugcaccggug

SEQ ID NO: 1956035 - RNA, 13 nt, Shigella flexneri 2a str. 301
ucaacaucgcguu

SEQ ID NO: 1956036 - RNA, 12 nt, Shigella flexneri 2a str. 301
ucaacaccgguu

SEQ ID NO: 1956037 - RNA, 13 nt, Shigella flexneri 2a str. 301
ucaacaacacucu

SEQ ID NO: 1956038 - RNA, 13 nt, Shigella flexneri 2a str. 301
ucaacacauccag

SEQ ID NO: 1956039 - RNA, 16 nt, Shigella flexneri 2a str. 301
ucaaauggcgcuucgu

SEQ ID NO: 1956040 - RNA, 12 nt, Shigella flexneri 2a str. 301
ucaaauacccuu

SEQ ID NO: 1956041 - RNA, 23 nt, Shigella flexneri 2a str. 301
ucaaaucaccauauucagcagca

SEQ ID NO: 1956042 - RNA, 16 nt, Shigella flexneri 2a str. 301
ucaaaggccgacagca

SEQ ID NO: 1956043 - RNA, 18 nt, Shigella flexneri 2a str. 301
ucaaaggccgacagcagg

SEQ ID NO: 1956044 - RNA, 13 nt, Shigella flexneri 2a str. 301
ucaaaguaaucaa

SEQ ID NO: 1956045 - RNA, 15 nt, Shigella flexneri 2a str. 301
ucaaacuucgucaca

SEQ ID NO: 1956046 - RNA, 21 nt, Shigella flexneri 2a str. 301
ucaaagaugaugucacagccg

SEQ ID NO: 1956047 - RNA, 13 nt, Shigella flexneri 2a str. 301
ucaagcgccgcca

SEQ ID NO: 1956048 - RNA, 15 nt, Shigella flexneri 2a str. 301
ucaagcgccgccagu

SEQ ID NO: 1956049 - RNA, 17 nt, Shigella flexneri 2a str. 301
ucaagcgucgcaucagg

SEQ ID NO: 1956050 - RNA, 17 nt, Shigella flexneri 2a str. 301
ucaagcacaaucacguc

SEQ ID NO: 1956051 - RNA, 17 nt, Shigella flexneri 2a str. 301
ucaagcaccauccuguu

SEQ ID NO: 1956052 - RNA, 15 nt, Shigella flexneri 2a str. 301
ucaagaaugacgcca

SEQ ID NO: 1956053 - RNA, 22 nt, Shigella flexneri 2a str. 301
ucaacggccugaccaugcucaa

SEQ ID NO: 1956054 - RNA, 17 nt, Shigella flexneri 2a str. 301
ucaacgucuuccggcgu

SEQ ID NO: 1956055 - RNA, 15 nt, Shigella flexneri 2a str. 301
ucaacggugucgaua

SEQ ID NO: 1956056 - RNA, 14 nt, Shigella flexneri 2a str. 301
ucaaggcgguaaau

SEQ ID NO: 1956057 - RNA, 13 nt, Shigella flexneri 2a str. 301
ucaagucgaaccu

SEQ ID NO: 1956058 - RNA, 18 nt, Shigella flexneri 2a str. 301
ucaaucaucucucgcauc

SEQ ID NO: 1956059 - RNA, 13 nt, Shigella flexneri 2a str. 301
ucaauccacgguu

SEQ ID NO: 1956060 - RNA, 17 nt, Shigella flexneri 2a str. 301
ucaaucuucacgcgcag

SEQ ID NO: 1956061 - RNA, 13 nt, Shigella flexneri 2a str. 301
ucaaugaaugcuu

SEQ ID NO: 1956062 - RNA, 17 nt, Shigella flexneri 2a str. 301
ucaauaucauuacgcca

SEQ ID NO: 1956063 - RNA, 21 nt, Shigella flexneri 2a str. 301
ucagauaaaugcaaacgcauc

SEQ ID NO: 1956064 - RNA, 23 nt, Shigella flexneri 2a str. 301
ucagaguuaaccugaaaccggaa

SEQ ID NO: 1956065 - RNA, 16 nt, Shigella flexneri 2a str. 301
ucagagugccgaagaa

SEQ ID NO: 1956066 - RNA, 17 nt, Shigella flexneri 2a str. 301
ucagaggcgaaccgcug

SEQ ID NO: 1956067 - RNA, 20 nt, Shigella flexneri 2a str. 301
ucagaaugcccacgccgcau

SEQ ID NO: 1956068 - RNA, 21 nt, Shigella flexneri 2a str. 301
ucagaucgccccggucaucaa

SEQ ID NO: 1956069 - RNA, 22 nt, Shigella flexneri 2a str. 301
ucagcacuucacccaucgccag

SEQ ID NO: 1956070 - RNA, 23 nt, Shigella flexneri 2a str. 301
ucagcauccguuaacuuucugcg

SEQ ID NO: 1956071 - RNA, 17 nt, Shigella flexneri 2a str. 301
ucagcaucaagauaaac

SEQ ID NO: 1956072 - RNA, 19 nt, Shigella flexneri 2a str. 301
ucagcagcguggugcugau

SEQ ID NO: 1956073 - RNA, 16 nt, Shigella flexneri 2a str. 301
ucagccaaauccagcg

SEQ ID NO: 1956074 - RNA, 22 nt, Shigella flexneri 2a str. 301
ucacuacaaccgggaucaccga

SEQ ID NO: 1956075 - RNA, 12 nt, Shigella flexneri 2a str. 301
ucacuuucugaa

SEQ ID NO: 1956076 - RNA, 21 nt, Shigella flexneri 2a str. 301
ucacuauuucuuuguagauga

SEQ ID NO: 1956077 - RNA, 12 nt, Shigella flexneri 2a str. 301
ucacucaccgca

SEQ ID NO: 1956078 - RNA, 16 nt, Shigella flexneri 2a str. 301
ucacuauguaauccug

SEQ ID NO: 1956079 - RNA, 20 nt, Shigella flexneri 2a str. 301
ucagaaaugccaguaacuca

SEQ ID NO: 1956080 - RNA, 21 nt, Shigella flexneri 2a str. 301
ucagaaagcccgaaucaguaa

SEQ ID NO: 1956081 - RNA, 19 nt, Shigella flexneri 2a str. 301
ucacuuuugccagacgaau

SEQ ID NO: 1956082 - RNA, 22 nt, Shigella flexneri 2a str. 301
ucagaauagaaaguugccagau

SEQ ID NO: 1956083 - RNA, 19 nt, Shigella flexneri 2a str. 301
ucacgccgcauccggcaua

SEQ ID NO: 1956084 - RNA, 20 nt, Shigella flexneri 2a str. 301
ucaccugcacaccaaccgcu

SEQ ID NO: 1956085 - RNA, 12 nt, Shigella flexneri 2a str. 301
ucaccugccagg

SEQ ID NO: 1956086 - RNA, 18 nt, Shigella flexneri 2a str. 301
ucacgccgcauccggcaa

SEQ ID NO: 1956087 - RNA, 19 nt, Shigella flexneri 2a str. 301
ucacgccugcggcuuccag

SEQ ID NO: 1956088 - RNA, 21 nt, Shigella flexneri 2a str. 301
ucacgcggguugccaccggua

SEQ ID NO: 1956089 - RNA, 15 nt, Shigella flexneri 2a str. 301
ucacauccggccagu

SEQ ID NO: 1956090 - RNA, 20 nt, Shigella flexneri 2a str. 301
ucacaucaccauagccuaau

SEQ ID NO: 1956091 - RNA, 17 nt, Shigella flexneri 2a str. 301
ucacaucgcuaccgcgc

SEQ ID NO: 1956092 - RNA, 21 nt, Shigella flexneri 2a str. 301
ucacacuccagucccaguuca

SEQ ID NO: 1956093 - RNA, 23 nt, Shigella flexneri 2a str. 301
ucaauucccgagcugcucgucag

SEQ ID NO: 1956094 - RNA, 19 nt, Shigella flexneri 2a str. 301
ucaaugcggcggcgcaccg

SEQ ID NO: 1956095 - RNA, 12 nt, Shigella flexneri 2a str. 301
ucaaugccugau

SEQ ID NO: 1956096 - RNA, 14 nt, Shigella flexneri 2a str. 301
ucacacuaaccguu

SEQ ID NO: 1956097 - RNA, 17 nt, Shigella flexneri 2a str. 301
ucacacccuugccagau

SEQ ID NO: 1956098 - RNA, 19 nt, Shigella flexneri 2a str. 301
ucaccagcaguaaaccgcu

SEQ ID NO: 1956099 - RNA, 22 nt, Shigella flexneri 2a str. 301
ucaccagcaaauccagcgguug

SEQ ID NO: 1956100 - RNA, 12 nt, Shigella flexneri 2a str. 301
ucaccagcagcg

SEQ ID NO: 1956101 - RNA, 14 nt, Shigella flexneri 2a str. 301
ucaccagacaucaa

SEQ ID NO: 1956102 - RNA, 14 nt, Shigella flexneri 2a str. 301
ucaccagcgcauug

SEQ ID NO: 1956103 - RNA, 22 nt, Shigella flexneri 2a str. 301
ucacccacguuacgcgaucguc

SEQ ID NO: 1956104 - RNA, 15 nt, Shigella flexneri 2a str. 301
ucacccacuaaucgu

SEQ ID NO: 1956105 - RNA, 18 nt, Shigella flexneri 2a str. 301
ucacccgcaaucaucgau

SEQ ID NO: 1956106 - RNA, 12 nt, Shigella flexneri 2a str. 301
ucaccggucaga

SEQ ID NO: 1956107 - RNA, 16 nt, Shigella flexneri 2a str. 301
ucauagguaaacauca

SEQ ID NO: 1956108 - RNA, 23 nt, Shigella flexneri 2a str. 301
ucauagcgcccuuucagcgccuu

SEQ ID NO: 1956109 - RNA, 13 nt, Shigella flexneri 2a str. 301
ucauacccugaau

SEQ ID NO: 1956110 - RNA, 22 nt, Shigella flexneri 2a str. 301
ucauagcaggcauccugaucgu

SEQ ID NO: 1956111 - RNA, 14 nt, Shigella flexneri 2a str. 301
ucaguagcgcaauc

SEQ ID NO: 1956112 - RNA, 14 nt, Shigella flexneri 2a str. 301
ucagccugacagca

SEQ ID NO: 1956113 - RNA, 23 nt, Shigella flexneri 2a str. 301
ucaggcgcugcauaucucccagu

SEQ ID NO: 1956114 - RNA, 20 nt, Shigella flexneri 2a str. 301
ucaggcuguguuuaagacgc

SEQ ID NO: 1956115 - RNA, 19 nt, Shigella flexneri 2a str. 301
ucaugccgcaauugucugu

SEQ ID NO: 1956116 - RNA, 15 nt, Shigella flexneri 2a str. 301
ucaucugcaccgauu

SEQ ID NO: 1956117 - RNA, 15 nt, Shigella flexneri 2a str. 301
ucaucuggcguacca

SEQ ID NO: 1956118 - RNA, 13 nt, Shigella flexneri 2a str. 301
ucaucugucauaa

SEQ ID NO: 1956119 - RNA, 24 nt, Shigella flexneri 2a str. 301
ucaugcugcuggguguagcgcauc

SEQ ID NO: 1956120 - RNA, 22 nt, Shigella flexneri 2a str. 301
ucaugcugcggcuguccggcac

SEQ ID NO: 1956121 - RNA, 15 nt, Shigella flexneri 2a str. 301
ucauuacaaccgcug

SEQ ID NO: 1956122 - RNA, 15 nt, Shigella flexneri 2a str. 301
ucauuaccgcgaaga

SEQ ID NO: 1956123 - RNA, 16 nt, Shigella flexneri 2a str. 301
ucauuaagaacuccug

SEQ ID NO: 1956124 - RNA, 22 nt, Shigella flexneri 2a str. 301
ucaucguugaucuguaacgcac

SEQ ID NO: 1956125 - RNA, 13 nt, Shigella flexneri 2a str. 301
ucaucgccgccaa

SEQ ID NO: 1956126 - RNA, 23 nt, Shigella flexneri 2a str. 301
ucaucgccgguaaaaaugcgcag

SEQ ID NO: 1956127 - RNA, 17 nt, Shigella flexneri 2a str. 301
ucaucgcauccagugcg

SEQ ID NO: 1956128 - RNA, 14 nt, Shigella flexneri 2a str. 301
ucaucgaccccagg

SEQ ID NO: 1956129 - RNA, 20 nt, Shigella flexneri 2a str. 301
ucauccuucauuauccuucg

SEQ ID NO: 1956130 - RNA, 14 nt, Shigella flexneri 2a str. 301
ucaucaaacgucuu

SEQ ID NO: 1956131 - RNA, 19 nt, Shigella flexneri 2a str. 301
ucauccggcacgcuaccau

SEQ ID NO: 1956132 - RNA, 17 nt, Shigella flexneri 2a str. 301
uccagauaauaaucaac

SEQ ID NO: 1956133 - RNA, 18 nt, Shigella flexneri 2a str. 301
uccagacggagcugccag

SEQ ID NO: 1956134 - RNA, 19 nt, Shigella flexneri 2a str. 301
uccagauaauuaugccgau

SEQ ID NO: 1956135 - RNA, 21 nt, Shigella flexneri 2a str. 301
uccaccuuaucgacaugcggu

SEQ ID NO: 1956136 - RNA, 16 nt, Shigella flexneri 2a str. 301
uccaccuugcggaaac

SEQ ID NO: 1956137 - RNA, 22 nt, Shigella flexneri 2a str. 301
uccacgccaagcucauaacggc

SEQ ID NO: 1956138 - RNA, 21 nt, Shigella flexneri 2a str. 301
ucauuagcccaauaaucaccg

SEQ ID NO: 1956139 - RNA, 12 nt, Shigella flexneri 2a str. 301
ucauuagcccaa

SEQ ID NO: 1956140 - RNA, 13 nt, Shigella flexneri 2a str. 301
uccaagccugaua

SEQ ID NO: 1956141 - RNA, 21 nt, Shigella flexneri 2a str. 301
uccaagcgcggcaggcaucgg

SEQ ID NO: 1956142 - RNA, 13 nt, Shigella flexneri 2a str. 301
uccaccaucacgc

SEQ ID NO: 1956143 - RNA, 15 nt, Shigella flexneri 2a str. 301
uccaccagcgcguag

SEQ ID NO: 1956144 - RNA, 21 nt, Shigella flexneri 2a str. 301
uccacaagaaugccugccagc

SEQ ID NO: 1956145 - RNA, 20 nt, Shigella flexneri 2a str. 301
uccagcgcuuucauggugag

SEQ ID NO: 1956146 - RNA, 16 nt, Shigella flexneri 2a str. 301
uccagugcauccagca

SEQ ID NO: 1956147 - RNA, 17 nt, Shigella flexneri 2a str. 301
uccagugccucaagaau

SEQ ID NO: 1956148 - RNA, 22 nt, Shigella flexneri 2a str. 301
uccagugcgguaacguaaucuu

SEQ ID NO: 1956149 - RNA, 13 nt, Shigella flexneri 2a str. 301
uccagucgcgugu

SEQ ID NO: 1956150 - RNA, 19 nt, Shigella flexneri 2a str. 301
uccagugcauccagcacga

SEQ ID NO: 1956151 - RNA, 14 nt, Shigella flexneri 2a str. 301
uccaguuucacaaa

SEQ ID NO: 1956152 - RNA, 14 nt, Shigella flexneri 2a str. 301
uccaguugaaguga

SEQ ID NO: 1956153 - RNA, 15 nt, Shigella flexneri 2a str. 301
uccgauucccgcaac

SEQ ID NO: 1956154 - RNA, 13 nt, Shigella flexneri 2a str. 301
uccgauuaccggc

SEQ ID NO: 1956155 - RNA, 18 nt, Shigella flexneri 2a str. 301
uccgaguggcugaaggag

SEQ ID NO: 1956156 - RNA, 15 nt, Shigella flexneri 2a str. 301
uccgacaucaaccgc

SEQ ID NO: 1956157 - RNA, 18 nt, Shigella flexneri 2a str. 301
uccgacaaauguguucag

SEQ ID NO: 1956158 - RNA, 18 nt, Shigella flexneri 2a str. 301
uccgccauccaccagcau

SEQ ID NO: 1956159 - RNA, 16 nt, Shigella flexneri 2a str. 301
uccgcaaauaacguaa

SEQ ID NO: 1956160 - RNA, 15 nt, Shigella flexneri 2a str. 301
uccgcaaacaggcgc

SEQ ID NO: 1956161 - RNA, 13 nt, Shigella flexneri 2a str. 301
uccgcaaagccca

SEQ ID NO: 1956162 - RNA, 21 nt, Shigella flexneri 2a str. 301
uccgccagcguagucggcaga

SEQ ID NO: 1956163 - RNA, 12 nt, Shigella flexneri 2a str. 301
uccggcgcaauu

SEQ ID NO: 1956164 - RNA, 15 nt, Shigella flexneri 2a str. 301
uccggccugcacugc

SEQ ID NO: 1956165 - RNA, 23 nt, Shigella flexneri 2a str. 301
uccggcuaccgggccugaacaag

SEQ ID NO: 1956166 - RNA, 16 nt, Shigella flexneri 2a str. 301
uccggcuccacuucgu

SEQ ID NO: 1956167 - RNA, 22 nt, Shigella flexneri 2a str. 301
uccggaucgccaaagcggcagu

SEQ ID NO: 1956168 - RNA, 19 nt, Shigella flexneri 2a str. 301
uccggaucccaccagacgu

SEQ ID NO: 1956169 - RNA, 13 nt, Shigella flexneri 2a str. 301
ucccagcgcguuc

SEQ ID NO: 1956170 - RNA, 14 nt, Shigella flexneri 2a str. 301
ucccaggcuucagg

SEQ ID NO: 1956171 - RNA, 19 nt, Shigella flexneri 2a str. 301
ucccagucgcgcaauugcc

SEQ ID NO: 1956172 - RNA, 20 nt, Shigella flexneri 2a str. 301
uccccagcggaaaauaucgc

SEQ ID NO: 1956173 - RNA, 18 nt, Shigella flexneri 2a str. 301
uccaucaauacaggcgac

SEQ ID NO: 1956174 - RNA, 23 nt, Shigella flexneri 2a str. 301
ucccaaaaacgcgguugccagau

SEQ ID NO: 1956175 - RNA, 13 nt, Shigella flexneri 2a str. 301
ucccaaaagcucg

SEQ ID NO: 1956176 - RNA, 13 nt, Shigella flexneri 2a str. 301
uccaucacuucgc

SEQ ID NO: 1956177 - RNA, 23 nt, Shigella flexneri 2a str. 301
ucccacugacgcucggcgcaauc

SEQ ID NO: 1956178 - RNA, 20 nt, Shigella flexneri 2a str. 301
ucccacggcggugucgccag

SEQ ID NO: 1956179 - RNA, 13 nt, Shigella flexneri 2a str. 301
ucccagccacgau

SEQ ID NO: 1956180 - RNA, 23 nt, Shigella flexneri 2a str. 301
ucccagacguuucgccagccgau

SEQ ID NO: 1956181 - RNA, 16 nt, Shigella flexneri 2a str. 301
uccccgagcacaugca

SEQ ID NO: 1956182 - RNA, 12 nt, Shigella flexneri 2a str. 301
uccccggugaaa

SEQ ID NO: 1956183 - RNA, 14 nt, Shigella flexneri 2a str. 301
uccccuccagcgag

SEQ ID NO: 1956184 - RNA, 21 nt, Shigella flexneri 2a str. 301
uccccugcccgcgauccagcg

SEQ ID NO: 1956185 - RNA, 23 nt, Shigella flexneri 2a str. 301
ucccgcuguuuguucaagcgcaa

SEQ ID NO: 1956186 - RNA, 23 nt, Shigella flexneri 2a str. 301
guuggcgacgucaguuuccagca

SEQ ID NO: 1956187 - RNA, 17 nt, Shigella flexneri 2a str. 301
guuggguucacuuuccc

SEQ ID NO: 1956188 - RNA, 22 nt, Shigella flexneri 2a str. 301
guugucgguaauugcgccguug

SEQ ID NO: 1956189 - RNA, 17 nt, Shigella flexneri 2a str. 301
guuguuaaccaccagua

SEQ ID NO: 1956190 - RNA, 16 nt, Shigella flexneri 2a str. 301
guuguuacaacaucaa

SEQ ID NO: 1956191 - RNA, 15 nt, Shigella flexneri 2a str. 301
guugcgccugauaau

SEQ ID NO: 1956192 - RNA, 12 nt, Shigella flexneri 2a str. 301
guugaucgccac

SEQ ID NO: 1956193 - RNA, 23 nt, Shigella flexneri 2a str. 301
guugaucgccccggaagcaucaa

SEQ ID NO: 1956194 - RNA, 20 nt, Shigella flexneri 2a str. 301
guugauguuuggccgcgcca

SEQ ID NO: 1956195 - RNA, 15 nt, Shigella flexneri 2a str. 301
guugaugcuccuggc

SEQ ID NO: 1956196 - RNA, 13 nt, Shigella flexneri 2a str. 301
guugcccagcgca

SEQ ID NO: 1956197 - RNA, 22 nt, Shigella flexneri 2a str. 301
guugccccgcacgcuucaucgg

SEQ ID NO: 1956198 - RNA, 18 nt, Shigella flexneri 2a str. 301
guucgcgcgcugccagaa

SEQ ID NO: 1956199 - RNA, 17 nt, Shigella flexneri 2a str. 301
guucgcguacugcugac

SEQ ID NO: 1956200 - RNA, 13 nt, Shigella flexneri 2a str. 301
guucuguggcagg

SEQ ID NO: 1956201 - RNA, 17 nt, Shigella flexneri 2a str. 301
guucuggcaccggacgc

SEQ ID NO: 1956202 - RNA, 20 nt, Shigella flexneri 2a str. 301
guucugccgcgcacgucagc

SEQ ID NO: 1956203 - RNA, 16 nt, Shigella flexneri 2a str. 301
guucgauggcgcgcca

SEQ ID NO: 1956204 - RNA, 16 nt, Shigella flexneri 2a str. 301
guuccucaccuuccac

SEQ ID NO: 1956205 - RNA, 22 nt, Shigella flexneri 2a str. 301
guuccggcaacgacgucgauuu

SEQ ID NO: 1956206 - RNA, 21 nt, Shigella flexneri 2a str. 301
guuccggcaugauucauccgu

SEQ ID NO: 1956207 - RNA, 22 nt, Shigella flexneri 2a str. 301
guuccgccagagcuucaaccgu

SEQ ID NO: 1956208 - RNA, 19 nt, Shigella flexneri 2a str. 301
guucaaugcgaucuacccg

SEQ ID NO: 1956209 - RNA, 18 nt, Shigella flexneri 2a str. 301
guucaacgcccgcuuuca

SEQ ID NO: 1956210 - RNA, 23 nt, Shigella flexneri 2a str. 301
guuauccugaucaagcacaugcu

SEQ ID NO: 1956211 - RNA, 20 nt, Shigella flexneri 2a str. 301
guuauccacgauacgcugca

SEQ ID NO: 1956212 - RNA, 20 nt, Shigella flexneri 2a str. 301
guuaguguuaaccaacggcg

SEQ ID NO: 1956213 - RNA, 23 nt, Shigella flexneri 2a str. 301
guuaucgcucgucgcgacgacca

SEQ ID NO: 1956214 - RNA, 14 nt, Shigella flexneri 2a str. 301
guuauucccaacgc

SEQ ID NO: 1956215 - RNA, 15 nt, Shigella flexneri 2a str. 301
guuacggaucucccg

SEQ ID NO: 1956216 - RNA, 19 nt, Shigella flexneri 2a str. 301
guuacguuucucugcuaau

SEQ ID NO: 1956217 - RNA, 14 nt, Shigella flexneri 2a str. 301
guuagcucaacgca

SEQ ID NO: 1956218 - RNA, 16 nt, Shigella flexneri 2a str. 301
guuacccgacgcgcca

SEQ ID NO: 1956219 - RNA, 17 nt, Shigella flexneri 2a str. 301
guuacccccauccacgc

SEQ ID NO: 1956220 - RNA, 20 nt, Shigella flexneri 2a str. 301
guuaauuuuucaaacucuuc

SEQ ID NO: 1956221 - RNA, 14 nt, Shigella flexneri 2a str. 301
guuaaugcgccaag

SEQ ID NO: 1956222 - RNA, 13 nt, Shigella flexneri 2a str. 301
guucacugccgua

SEQ ID NO: 1956223 - RNA, 23 nt, Shigella flexneri 2a str. 301
guucagcggcccguuggugcggu

SEQ ID NO: 1956224 - RNA, 23 nt, Shigella flexneri 2a str. 301
guucagcguacguucauggcgcg

SEQ ID NO: 1956225 - RNA, 22 nt, Shigella flexneri 2a str. 301
guucaggucggugugaaugacu

SEQ ID NO: 1956226 - RNA, 11 nt, Shigella flexneri 2a str. 301
guucaguuccg

SEQ ID NO: 1956227 - RNA, 16 nt, Shigella flexneri 2a str. 301
guucaguucagaaagc

SEQ ID NO: 1956228 - RNA, 20 nt, Shigella flexneri 2a str. 301
guuccacaucuaccgccagc

SEQ ID NO: 1956229 - RNA, 22 nt, Shigella flexneri 2a str. 301
guuccagcuucagauucagcgu

SEQ ID NO: 1956230 - RNA, 17 nt, Shigella flexneri 2a str. 301
guuccagugcgguaacg

SEQ ID NO: 1956231 - RNA, 18 nt, Shigella flexneri 2a str. 301
guuccagugcgguaacgu

SEQ ID NO: 1956232 - RNA, 23 nt, Shigella flexneri 2a str. 301
guucaucacaccaguccagcgcc

SEQ ID NO: 1956233 - RNA, 16 nt, Shigella flexneri 2a str. 301
gugcguggcgauacgg

SEQ ID NO: 1956234 - RNA, 15 nt, Shigella flexneri 2a str. 301
gugguguagggcagg

SEQ ID NO: 1956235 - RNA, 14 nt, Shigella flexneri 2a str. 301
gugguugucgcagg

SEQ ID NO: 1956236 - RNA, 13 nt, Shigella flexneri 2a str. 301
guguaacgcuugc

SEQ ID NO: 1956237 - RNA, 18 nt, Shigella flexneri 2a str. 301
guguaagaaaggcagagu

SEQ ID NO: 1956238 - RNA, 19 nt, Shigella flexneri 2a str. 301
guguacaucucaacaacuu

SEQ ID NO: 1956239 - RNA, 16 nt, Shigella flexneri 2a str. 301
gugucgaugugccgga

SEQ ID NO: 1956240 - RNA, 15 nt, Shigella flexneri 2a str. 301
gugugccaccagcgc

SEQ ID NO: 1956241 - RNA, 13 nt, Shigella flexneri 2a str. 301
guguggcgcgcca

SEQ ID NO: 1956242 - RNA, 16 nt, Shigella flexneri 2a str. 301
guguuaaccaacggcg

SEQ ID NO: 1956243 - RNA, 22 nt, Shigella flexneri 2a str. 301
guguucacgccgcauccggcau

SEQ ID NO: 1956244 - RNA, 11 nt, Shigella flexneri 2a str. 301
guguuauucag

SEQ ID NO: 1956245 - RNA, 18 nt, Shigella flexneri 2a str. 301
guguucgucacuggcgca

SEQ ID NO: 1956246 - RNA, 12 nt, Shigella flexneri 2a str. 301
guguucaugacc

SEQ ID NO: 1956247 - RNA, 23 nt, Shigella flexneri 2a str. 301
guuaaucaaaucaacaaccugca

SEQ ID NO: 1956248 - RNA, 13 nt, Shigella flexneri 2a str. 301
guuaagcaauacc

SEQ ID NO: 1956249 - RNA, 14 nt, Shigella flexneri 2a str. 301
guuaacaaucacaa

SEQ ID NO: 1956250 - RNA, 17 nt, Shigella flexneri 2a str. 301
guuaacguuuuucgcug

SEQ ID NO: 1956251 - RNA, 19 nt, Shigella flexneri 2a str. 301
guguuucgacaauaaucaa

SEQ ID NO: 1956252 - RNA, 15 nt, Shigella flexneri 2a str. 301
uaccccaucagcgua

SEQ ID NO: 1956253 - RNA, 18 nt, Shigella flexneri 2a str. 301
uacccaaaucgcccgguu

SEQ ID NO: 1956254 - RNA, 18 nt, Shigella flexneri 2a str. 301
uacccuucaucacgcagc

SEQ ID NO: 1956255 - RNA, 18 nt, Shigella flexneri 2a str. 301
uacccugaaucaaucaga

SEQ ID NO: 1956256 - RNA, 22 nt, Shigella flexneri 2a str. 301
uacccugaaucaaucagagcca

SEQ ID NO: 1956257 - RNA, 18 nt, Shigella flexneri 2a str. 301
uacccugcccgacgauac

SEQ ID NO: 1956258 - RNA, 17 nt, Shigella flexneri 2a str. 301
uacccguugguuugaua

SEQ ID NO: 1956259 - RNA, 21 nt, Shigella flexneri 2a str. 301
uacccgcuggcguaccaucuu

SEQ ID NO: 1956260 - RNA, 22 nt, Shigella flexneri 2a str. 301
uacccggccuguuuauccauca

SEQ ID NO: 1956261 - RNA, 23 nt, Shigella flexneri 2a str. 301
uaccagauuaauuauugauucca

SEQ ID NO: 1956262 - RNA, 19 nt, Shigella flexneri 2a str. 301
uaccagcgacaucaccgcc

SEQ ID NO: 1956263 - RNA, 17 nt, Shigella flexneri 2a str. 301
uaccaauaaacuucaau

SEQ ID NO: 1956264 - RNA, 22 nt, Shigella flexneri 2a str. 301
uaccaaucgcaauaccggcaaa

SEQ ID NO: 1956265 - RNA, 12 nt, Shigella flexneri 2a str. 301
uacaucagcgac

SEQ ID NO: 1956266 - RNA, 20 nt, Shigella flexneri 2a str. 301
uacauacuuaaauaaugcuu

SEQ ID NO: 1956267 - RNA, 16 nt, Shigella flexneri 2a str. 301
uaccgcguaauacauc

SEQ ID NO: 1956268 - RNA, 13 nt, Shigella flexneri 2a str. 301
uaccggacuccag

SEQ ID NO: 1956269 - RNA, 20 nt, Shigella flexneri 2a str. 301
uaccggaacacucuuccagu

SEQ ID NO: 1956270 - RNA, 20 nt, Shigella flexneri 2a str. 301
uaccgggcaguaccaccgga

SEQ ID NO: 1956271 - RNA, 12 nt, Shigella flexneri 2a str. 301
uaccgaucgcca

SEQ ID NO: 1956272 - RNA, 19 nt, Shigella flexneri 2a str. 301
uaccgcaccaccagcagcu

SEQ ID NO: 1956273 - RNA, 12 nt, Shigella flexneri 2a str. 301
uaccgcaucagc

SEQ ID NO: 1956274 - RNA, 13 nt, Shigella flexneri 2a str. 301
uaccgagcagcca

SEQ ID NO: 1956275 - RNA, 19 nt, Shigella flexneri 2a str. 301
uaccgacgcgcuauugccg

SEQ ID NO: 1956276 - RNA, 20 nt, Shigella flexneri 2a str. 301
uaccgccgaucucaccgauc

SEQ ID NO: 1956277 - RNA, 18 nt, Shigella flexneri 2a str. 301
uaccgccgaucucaccga

SEQ ID NO: 1956278 - RNA, 17 nt, Shigella flexneri 2a str. 301
uaccgccacagcagccu

SEQ ID NO: 1956279 - RNA, 15 nt, Shigella flexneri 2a str. 301
uaccgucaucgccca

SEQ ID NO: 1956280 - RNA, 17 nt, Shigella flexneri 2a str. 301
uaccggugccagcaacu

SEQ ID NO: 1956281 - RNA, 15 nt, Shigella flexneri 2a str. 301
uaccgucgaugccaa

SEQ ID NO: 1956282 - RNA, 22 nt, Shigella flexneri 2a str. 301
uacgacuuucuccgcauccggc

SEQ ID NO: 1956283 - RNA, 16 nt, Shigella flexneri 2a str. 301
uacgcccucgaucggc

SEQ ID NO: 1956284 - RNA, 14 nt, Shigella flexneri 2a str. 301
uacgccagacugcg

SEQ ID NO: 1956285 - RNA, 17 nt, Shigella flexneri 2a str. 301
uacgccagauuguguga

SEQ ID NO: 1956286 - RNA, 19 nt, Shigella flexneri 2a str. 301
uacgcauaugcaucagauc

SEQ ID NO: 1956287 - RNA, 14 nt, Shigella flexneri 2a str. 301
uacgcaucaccaga

SEQ ID NO: 1956288 - RNA, 17 nt, Shigella flexneri 2a str. 301
uacgcaucaccagacaa

SEQ ID NO: 1956289 - RNA, 24 nt, Shigella flexneri 2a str. 301
uacgcaaaaccucuuccagcagau

SEQ ID NO: 1956290 - RNA, 20 nt, Shigella flexneri 2a str. 301
uacgcaccagauaagcagcg

SEQ ID NO: 1956291 - RNA, 15 nt, Shigella flexneri 2a str. 301
uacuaaucucaccca

SEQ ID NO: 1956292 - RNA, 18 nt, Shigella flexneri 2a str. 301
uacgccgcaucuggcaua

SEQ ID NO: 1956293 - RNA, 18 nt, Shigella flexneri 2a str. 301
uacgccgcauccggcaua

SEQ ID NO: 1956294 - RNA, 16 nt, Shigella flexneri 2a str. 301
uacgcccucacccgua

SEQ ID NO: 1956295 - RNA, 14 nt, Shigella flexneri 2a str. 301
uacgccgcagagcg

SEQ ID NO: 1956296 - RNA, 18 nt, Shigella flexneri 2a str. 301
uacucaagagucgguaga

SEQ ID NO: 1956297 - RNA, 12 nt, Shigella flexneri 2a str. 301
uagaaugcgccu

SEQ ID NO: 1956298 - RNA, 17 nt, Shigella flexneri 2a str. 301
uagaaaacgaaagcgcc

SEQ ID NO: 1956299 - RNA, 15 nt, Shigella flexneri 2a str. 301
uagagauagccugau

SEQ ID NO: 1956300 - RNA, 22 nt, Shigella flexneri 2a str. 301
uagcagcccgcagcgccuggcg

SEQ ID NO: 1956301 - RNA, 19 nt, Shigella flexneri 2a str. 301
uagacugcagcggucacau

SEQ ID NO: 1956302 - RNA, 19 nt, Shigella flexneri 2a str. 301
uagagugguuagagcacag

SEQ ID NO: 1956303 - RNA, 12 nt, Shigella flexneri 2a str. 301
uagccagcgcac

SEQ ID NO: 1956304 - RNA, 18 nt, Shigella flexneri 2a str. 301
uaaucaucuguugugcca

SEQ ID NO: 1956305 - RNA, 17 nt, Shigella flexneri 2a str. 301
uaaugaaugaugcggcg

SEQ ID NO: 1956306 - RNA, 16 nt, Shigella flexneri 2a str. 301
uaauccaccuggccug

SEQ ID NO: 1956307 - RNA, 17 nt, Shigella flexneri 2a str. 301
uaagcgcgcuagccugu

SEQ ID NO: 1956308 - RNA, 14 nt, Shigella flexneri 2a str. 301
uaaguuuaacugcc

SEQ ID NO: 1956309 - RNA, 17 nt, Shigella flexneri 2a str. 301
uaaguuagaggcacaua

SEQ ID NO: 1956310 - RNA, 16 nt, Shigella flexneri 2a str. 301
uaagccaaauccagcg

SEQ ID NO: 1956311 - RNA, 13 nt, Shigella flexneri 2a str. 301
uaagcccaguuca

SEQ ID NO: 1956312 - RNA, 15 nt, Shigella flexneri 2a str. 301
uacaaucugcccgag

SEQ ID NO: 1956313 - RNA, 16 nt, Shigella flexneri 2a str. 301
uacaauauccagcgcg

SEQ ID NO: 1956314 - RNA, 14 nt, Shigella flexneri 2a str. 301
uacagccugccagc

SEQ ID NO: 1956315 - RNA, 14 nt, Shigella flexneri 2a str. 301
uaauuaauacgcca

SEQ ID NO: 1956316 - RNA, 20 nt, Shigella flexneri 2a str. 301
uaauuaaucugguaucgagu

SEQ ID NO: 1956317 - RNA, 13 nt, Shigella flexneri 2a str. 301
uaacgaaagcgcc

SEQ ID NO: 1956318 - RNA, 22 nt, Shigella flexneri 2a str. 301
uaacgccuucccuuucagcaaa

SEQ ID NO: 1956319 - RNA, 23 nt, Shigella flexneri 2a str. 301
uaacgccccacaaacccgccaga

SEQ ID NO: 1956320 - RNA, 12 nt, Shigella flexneri 2a str. 301
uaaccacuucag

SEQ ID NO: 1956321 - RNA, 19 nt, Shigella flexneri 2a str. 301
uaaccacguucauuucaua

SEQ ID NO: 1956322 - RNA, 17 nt, Shigella flexneri 2a str. 301
uaaaugcacccgccaga

SEQ ID NO: 1956323 - RNA, 13 nt, Shigella flexneri 2a str. 301
uaaauuucugcca

SEQ ID NO: 1956324 - RNA, 15 nt, Shigella flexneri 2a str. 301
uaaaugccaucaggg

SEQ ID NO: 1956325 - RNA, 16 nt, Shigella flexneri 2a str. 301
uaaaucccuggcugca

SEQ ID NO: 1956326 - RNA, 18 nt, Shigella flexneri 2a str. 301
uaaaucgacguucugcca

SEQ ID NO: 1956327 - RNA, 18 nt, Shigella flexneri 2a str. 301
uaaauaccuuccggcgua

SEQ ID NO: 1956328 - RNA, 23 nt, Shigella flexneri 2a str. 301
uaaagugcgcuuuguuuaugcca

SEQ ID NO: 1956329 - RNA, 19 nt, Shigella flexneri 2a str. 301
uaaaaagguccuguaauga

SEQ ID NO: 1956330 - RNA, 22 nt, Shigella flexneri 2a str. 301
uaaaaaguugcagcgucaucaa

SEQ ID NO: 1956331 - RNA, 13 nt, Shigella flexneri 2a str. 301
guuucaccgcgua

SEQ ID NO: 1956332 - RNA, 19 nt, Shigella flexneri 2a str. 301
guuucagauuguugacaaa

SEQ ID NO: 1956333 - RNA, 15 nt, Shigella flexneri 2a str. 301
guuuauuucccagau

SEQ ID NO: 1956334 - RNA, 21 nt, Shigella flexneri 2a str. 301
guuuaucgaccgcuucaucga

SEQ ID NO: 1956335 - RNA, 21 nt, Shigella flexneri 2a str. 301
guuuaugacgcuugagcagga

SEQ ID NO: 1956336 - RNA, 16 nt, Shigella flexneri 2a str. 301
uaaaccacugacacag

SEQ ID NO: 1956337 - RNA, 18 nt, Shigella flexneri 2a str. 301
uaaaccacugacacaggc

SEQ ID NO: 1956338 - RNA, 16 nt, Shigella flexneri 2a str. 301
uaaacccuggccgcac

SEQ ID NO: 1956339 - RNA, 23 nt, Shigella flexneri 2a str. 301
uaaaccacugacacaggcagcaa

SEQ ID NO: 1956340 - RNA, 20 nt, Shigella flexneri 2a str. 301
uaaaccacccaccagcgccg

SEQ ID NO: 1956341 - RNA, 19 nt, Shigella flexneri 2a str. 301
uaaaccaggcgagaucggc

SEQ ID NO: 1956342 - RNA, 20 nt, Shigella flexneri 2a str. 301
uaaaauagcgugaaacgcgu

SEQ ID NO: 1956343 - RNA, 21 nt, Shigella flexneri 2a str. 301
uaaacgugugugccagguucg

SEQ ID NO: 1956344 - RNA, 19 nt, Shigella flexneri 2a str. 301
gggauguaauuaagcgcaa

SEQ ID NO: 1956345 - RNA, 13 nt, Shigella flexneri 2a str. 301
gggauguguaagu

SEQ ID NO: 1956346 - RNA, 15 nt, Shigella flexneri 2a str. 301
gggauuuauucccgg

SEQ ID NO: 1956347 - RNA, 17 nt, Shigella flexneri 2a str. 301
ggcuuucgcaauaauca

SEQ ID NO: 1956348 - RNA, 17 nt, Shigella flexneri 2a str. 301
ggcuuucacgucaggau

SEQ ID NO: 1956349 - RNA, 20 nt, Shigella flexneri 2a str. 301
ggcuuguacgccgccgcaac

SEQ ID NO: 1956350 - RNA, 13 nt, Shigella flexneri 2a str. 301
ggcuguaauucag

SEQ ID NO: 1956351 - RNA, 18 nt, Shigella flexneri 2a str. 301
gggcgcggaaagcaccug

SEQ ID NO: 1956352 - RNA, 13 nt, Shigella flexneri 2a str. 301
gggcgcgcucagc

SEQ ID NO: 1956353 - RNA, 19 nt, Shigella flexneri 2a str. 301
ggcuacuacggcgugcagg

SEQ ID NO: 1956354 - RNA, 19 nt, Shigella flexneri 2a str. 301
ggcguuuacgccgcaucag

SEQ ID NO: 1956355 - RNA, 15 nt, Shigella flexneri 2a str. 301
ggcguuuucgccgca

SEQ ID NO: 1956356 - RNA, 15 nt, Shigella flexneri 2a str. 301
ggcguuuacgccgca

SEQ ID NO: 1956357 - RNA, 20 nt, Shigella flexneri 2a str. 301
ggcucaacgucuuccggcgu

SEQ ID NO: 1956358 - RNA, 22 nt, Shigella flexneri 2a str. 301
ggcguucugccuggcgcagcaa

SEQ ID NO: 1956359 - RNA, 15 nt, Shigella flexneri 2a str. 301
ggcgucuuguugaac

SEQ ID NO: 1956360 - RNA, 20 nt, Shigella flexneri 2a str. 301
ggcugacggucgaugcgcaa

SEQ ID NO: 1956361 - RNA, 16 nt, Shigella flexneri 2a str. 301
ggcuggccacaaaccu

SEQ ID NO: 1956362 - RNA, 16 nt, Shigella flexneri 2a str. 301
ggcuggcacgcucuuc

SEQ ID NO: 1956363 - RNA, 22 nt, Shigella flexneri 2a str. 301
ggcgaauggcacguugcugcgg

SEQ ID NO: 1956364 - RNA, 18 nt, Shigella flexneri 2a str. 301
ggcgauucauaugcgcca

SEQ ID NO: 1956365 - RNA, 14 nt, Shigella flexneri 2a str. 301
ggcgcacgccgaca

SEQ ID NO: 1956366 - RNA, 15 nt, Shigella flexneri 2a str. 301
ggcgcaucggucaga

SEQ ID NO: 1956367 - RNA, 19 nt, Shigella flexneri 2a str. 301
ggcggucaugacgauacgg

SEQ ID NO: 1956368 - RNA, 19 nt, Shigella flexneri 2a str. 301
ggcgguagccccgcgaacg

SEQ ID NO: 1956369 - RNA, 12 nt, Shigella flexneri 2a str. 301
ggcgcgcgcuuu

SEQ ID NO: 1956370 - RNA, 12 nt, Shigella flexneri 2a str. 301
ggcgcgaccauu

SEQ ID NO: 1956371 - RNA, 18 nt, Shigella flexneri 2a str. 301
ggcgcgucgaaaacggcu

SEQ ID NO: 1956372 - RNA, 13 nt, Shigella flexneri 2a str. 301
ggcgcugcuguac

SEQ ID NO: 1956373 - RNA, 18 nt, Shigella flexneri 2a str. 301
ggcauuuggcucucgaug

SEQ ID NO: 1956374 - RNA, 17 nt, Shigella flexneri 2a str. 301
ggccaaagguuuccuca

SEQ ID NO: 1956375 - RNA, 12 nt, Shigella flexneri 2a str. 301
ggcaugcagcgu

SEQ ID NO: 1956376 - RNA, 21 nt, Shigella flexneri 2a str. 301
ggcauuuacgccgcauccggc

SEQ ID NO: 1956377 - RNA, 12 nt, Shigella flexneri 2a str. 301
ggcaucgugcac

SEQ ID NO: 1956378 - RNA, 13 nt, Shigella flexneri 2a str. 301
ggcaguauagcgg

SEQ ID NO: 1956379 - RNA, 18 nt, Shigella flexneri 2a str. 301
ggcaucgcaaaccagacg

SEQ ID NO: 1956380 - RNA, 17 nt, Shigella flexneri 2a str. 301
ggcagaauaacggcaga

SEQ ID NO: 1956381 - RNA, 21 nt, Shigella flexneri 2a str. 301
ggcagaauaacggcugauaac

SEQ ID NO: 1956382 - RNA, 16 nt, Shigella flexneri 2a str. 301
ggcagaacagaacauc

SEQ ID NO: 1956383 - RNA, 19 nt, Shigella flexneri 2a str. 301
ggcacuggauuauuacugg

SEQ ID NO: 1956384 - RNA, 20 nt, Shigella flexneri 2a str. 301
ggcacuuacucauuaaugca

SEQ ID NO: 1956385 - RNA, 11 nt, Shigella flexneri 2a str. 301
ggcaccauuua

SEQ ID NO: 1956386 - RNA, 13 nt, Shigella flexneri 2a str. 301
ggcaccacuugca

SEQ ID NO: 1956387 - RNA, 22 nt, Shigella flexneri 2a str. 301
ggcacaucgacggugacacuuu

SEQ ID NO: 1956388 - RNA, 19 nt, Shigella flexneri 2a str. 301
ggcacacguaggccaaccg

SEQ ID NO: 1956389 - RNA, 22 nt, Shigella flexneri 2a str. 301
ggcacacguaggccaaccguca

SEQ ID NO: 1956390 - RNA, 15 nt, Shigella flexneri 2a str. 301
ggcaaugcccggugu

SEQ ID NO: 1956391 - RNA, 21 nt, Shigella flexneri 2a str. 301
ggcaaucacaucaccauaaau

SEQ ID NO: 1956392 - RNA, 18 nt, Shigella flexneri 2a str. 301
ggcaauguagcgcugcaa

SEQ ID NO: 1956393 - RNA, 14 nt, Shigella flexneri 2a str. 301
ggcaauuucacguu

SEQ ID NO: 1956394 - RNA, 12 nt, Shigella flexneri 2a str. 301
ggcaacguucca

SEQ ID NO: 1956395 - RNA, 22 nt, Shigella flexneri 2a str. 301
ggcaaauacaguugcgccagua

SEQ ID NO: 1956396 - RNA, 22 nt, Shigella flexneri 2a str. 301
ggcaaagugcaucucaccguug

SEQ ID NO: 1956397 - RNA, 21 nt, Shigella flexneri 2a str. 301
ggcaaauaacgccccggcaaa

SEQ ID NO: 1956398 - RNA, 16 nt, Shigella flexneri 2a str. 301
ggcaaauucuucacgg

SEQ ID NO: 1956399 - RNA, 16 nt, Shigella flexneri 2a str. 301
ggcaaauaccggacac

SEQ ID NO: 1956400 - RNA, 21 nt, Shigella flexneri 2a str. 301
ggcaacaugacugcggcgugg

SEQ ID NO: 1956401 - RNA, 16 nt, Shigella flexneri 2a str. 301
ggcaacgacgguaaac

SEQ ID NO: 1956402 - RNA, 19 nt, Shigella flexneri 2a str. 301
ggauuuucaccaucgccau

SEQ ID NO: 1956403 - RNA, 14 nt, Shigella flexneri 2a str. 301
ggauuuuuauuccg

SEQ ID NO: 1956404 - RNA, 19 nt, Shigella flexneri 2a str. 301
ggcaaaauuaucacaacuu

SEQ ID NO: 1956405 - RNA, 17 nt, Shigella flexneri 2a str. 301
ggcaaacagacuggcaa

SEQ ID NO: 1956406 - RNA, 18 nt, Shigella flexneri 2a str. 301
ggauugcuccugcucauc

SEQ ID NO: 1956407 - RNA, 17 nt, Shigella flexneri 2a str. 301
ggccgcaaaccagcgca

SEQ ID NO: 1956408 - RNA, 19 nt, Shigella flexneri 2a str. 301
ggccgccacacagcacgca

SEQ ID NO: 1956409 - RNA, 18 nt, Shigella flexneri 2a str. 301
ggccggaugucgcugcua

SEQ ID NO: 1956410 - RNA, 11 nt, Shigella flexneri 2a str. 301
ggccgcuuucu

SEQ ID NO: 1956411 - RNA, 21 nt, Shigella flexneri 2a str. 301
ggcgaaaacgccacauccggc

SEQ ID NO: 1956412 - RNA, 19 nt, Shigella flexneri 2a str. 301
ggcgaaccgcugucacccg

SEQ ID NO: 1956413 - RNA, 16 nt, Shigella flexneri 2a str. 301
ggcgaacuggucugca

SEQ ID NO: 1956414 - RNA, 14 nt, Shigella flexneri 2a str. 301
ggucgacagcagcc

SEQ ID NO: 1956415 - RNA, 18 nt, Shigella flexneri 2a str. 301
gguccuggucugaugaau

SEQ ID NO: 1956416 - RNA, 17 nt, Shigella flexneri 2a str. 301
ggucaguugccagacgg

SEQ ID NO: 1956417 - RNA, 21 nt, Shigella flexneri 2a str. 301
ggucaucacuuuugaaaucaa

SEQ ID NO: 1956418 - RNA, 13 nt, Shigella flexneri 2a str. 301
ggugaaggcaaac

SEQ ID NO: 1956419 - RNA, 16 nt, Shigella flexneri 2a str. 301
ggugaaggcaaacugu

SEQ ID NO: 1956420 - RNA, 12 nt, Shigella flexneri 2a str. 301
ggugcagccgug

SEQ ID NO: 1956421 - RNA, 15 nt, Shigella flexneri 2a str. 301
ggugauguauaucgg

SEQ ID NO: 1956422 - RNA, 15 nt, Shigella flexneri 2a str. 301
ggugauuaucggcau

SEQ ID NO: 1956423 - RNA, 22 nt, Shigella flexneri 2a str. 301
ggucguucgcccauuccaguaa

SEQ ID NO: 1956424 - RNA, 15 nt, Shigella flexneri 2a str. 301
ggucuggaacuggcu

SEQ ID NO: 1956425 - RNA, 21 nt, Shigella flexneri 2a str. 301
ggucuuacuggggaaguggcg

SEQ ID NO: 1956426 - RNA, 15 nt, Shigella flexneri 2a str. 301
ggucgcuuuguggcg

SEQ ID NO: 1956427 - RNA, 20 nt, Shigella flexneri 2a str. 301
gguauauuucaggccaacgg

SEQ ID NO: 1956428 - RNA, 17 nt, Shigella flexneri 2a str. 301
gguacuucaaucgccac

SEQ ID NO: 1956429 - RNA, 21 nt, Shigella flexneri 2a str. 301
gguagagcagcgcauucguaa

SEQ ID NO: 1956430 - RNA, 18 nt, Shigella flexneri 2a str. 301
gguagccaaugcggcaac

SEQ ID NO: 1956431 - RNA, 18 nt, Shigella flexneri 2a str. 301
gguagcacgucaucugca

SEQ ID NO: 1956432 - RNA, 10 nt, Shigella flexneri 2a str. 301
gguacgcagc

SEQ ID NO: 1956433 - RNA, 18 nt, Shigella flexneri 2a str. 301
ggucaauggucagcgcca

SEQ ID NO: 1956434 - RNA, 22 nt, Shigella flexneri 2a str. 301
ggucaacauucccugcaccggu

SEQ ID NO: 1956435 - RNA, 16 nt, Shigella flexneri 2a str. 301
gguaugcgaagguggc

SEQ ID NO: 1956436 - RNA, 22 nt, Shigella flexneri 2a str. 301
ggucaccugccagggugcuggc

SEQ ID NO: 1956437 - RNA, 20 nt, Shigella flexneri 2a str. 301
ggucacgauggaaccguaca

SEQ ID NO: 1956438 - RNA, 20 nt, Shigella flexneri 2a str. 301
ggucacgcaaaacgcugcaa

SEQ ID NO: 1956439 - RNA, 17 nt, Shigella flexneri 2a str. 301
ggguugccaccgguaca

SEQ ID NO: 1956440 - RNA, 15 nt, Shigella flexneri 2a str. 301
ggguguuaagcgcag

SEQ ID NO: 1956441 - RNA, 19 nt, Shigella flexneri 2a str. 301
ggguuagucugcauuuucu

SEQ ID NO: 1956442 - RNA, 22 nt, Shigella flexneri 2a str. 301
gguaaagaagagcggcaaacgu

SEQ ID NO: 1956443 - RNA, 16 nt, Shigella flexneri 2a str. 301
gguaaaauaucacucg

SEQ ID NO: 1956444 - RNA, 13 nt, Shigella flexneri 2a str. 301
gguacacgauaau

SEQ ID NO: 1956445 - RNA, 13 nt, Shigella flexneri 2a str. 301
gguaagcaaaggu

SEQ ID NO: 1956446 - RNA, 23 nt, Shigella flexneri 2a str. 301
gguaagcgccacaaucgcuucau

SEQ ID NO: 1956447 - RNA, 13 nt, Shigella flexneri 2a str. 301
guaccaucgccag

SEQ ID NO: 1956448 - RNA, 15 nt, Shigella flexneri 2a str. 301
guacccgcugcugac

SEQ ID NO: 1956449 - RNA, 16 nt, Shigella flexneri 2a str. 301
guacccggaucgcggu

SEQ ID NO: 1956450 - RNA, 11 nt, Shigella flexneri 2a str. 301
guaccagcgca

SEQ ID NO: 1956451 - RNA, 22 nt, Shigella flexneri 2a str. 301
guaccguugcugccagugcggu

SEQ ID NO: 1956452 - RNA, 14 nt, Shigella flexneri 2a str. 301
guacguucauggcg

SEQ ID NO: 1956453 - RNA, 19 nt, Shigella flexneri 2a str. 301
guacguguuguuccaguaa

SEQ ID NO: 1956454 - RNA, 19 nt, Shigella flexneri 2a str. 301
guacgucauccguggcgac

SEQ ID NO: 1956455 - RNA, 17 nt, Shigella flexneri 2a str. 301
guaccuucagcggcagc

SEQ ID NO: 1956456 - RNA, 17 nt, Shigella flexneri 2a str. 301
guaccugggcgauaacg

SEQ ID NO: 1956457 - RNA, 20 nt, Shigella flexneri 2a str. 301
guacgauacagaagcaccgu

SEQ ID NO: 1956458 - RNA, 22 nt, Shigella flexneri 2a str. 301
guagccaugcauaaugcagcca

SEQ ID NO: 1956459 - RNA, 20 nt, Shigella flexneri 2a str. 301
guagcaccgacgucgauaua

SEQ ID NO: 1956460 - RNA, 16 nt, Shigella flexneri 2a str. 301
guagcauccccggcaa

SEQ ID NO: 1956461 - RNA, 17 nt, Shigella flexneri 2a str. 301
guacuucacaaucagcg

SEQ ID NO: 1956462 - RNA, 22 nt, Shigella flexneri 2a str. 301
guacuuccggacguucagccau

SEQ ID NO: 1956463 - RNA, 14 nt, Shigella flexneri 2a str. 301
guagaaaaucucaa

SEQ ID NO: 1956464 - RNA, 23 nt, Shigella flexneri 2a str. 301
guagacauaaggaaacuccagcc

SEQ ID NO: 1956465 - RNA, 18 nt, Shigella flexneri 2a str. 301
guagcgccauacugacua

SEQ ID NO: 1956466 - RNA, 22 nt, Shigella flexneri 2a str. 301
guagcugguaccuugaaacgau

SEQ ID NO: 1956467 - RNA, 22 nt, Shigella flexneri 2a str. 301
guagcuuuucauguacucguaa

SEQ ID NO: 1956468 - RNA, 20 nt, Shigella flexneri 2a str. 301
guagcuggcggcaaugaaag

SEQ ID NO: 1956469 - RNA, 20 nt, Shigella flexneri 2a str. 301
guagcugcaggaauaaucag

SEQ ID NO: 1956470 - RNA, 12 nt, Shigella flexneri 2a str. 301
guaguccgcuga

SEQ ID NO: 1956471 - RNA, 17 nt, Shigella flexneri 2a str. 301
guaugaggcaaaccuua

SEQ ID NO: 1956472 - RNA, 14 nt, Shigella flexneri 2a str. 301
guaucaaacccuuc

SEQ ID NO: 1956473 - RNA, 15 nt, Shigella flexneri 2a str. 301
gucaaccugaccaaa

SEQ ID NO: 1956474 - RNA, 19 nt, Shigella flexneri 2a str. 301
gucaacaucgcauucgaca

SEQ ID NO: 1956475 - RNA, 19 nt, Shigella flexneri 2a str. 301
gucacgccgaccagaccgg

SEQ ID NO: 1956476 - RNA, 13 nt, Shigella flexneri 2a str. 301
gucaccggucaga

SEQ ID NO: 1956477 - RNA, 12 nt, Shigella flexneri 2a str. 301
gguuagcguuug

SEQ ID NO: 1956478 - RNA, 18 nt, Shigella flexneri 2a str. 301
ggugucacaugcagcgcc

SEQ ID NO: 1956479 - RNA, 13 nt, Shigella flexneri 2a str. 301
ggugucacggugu

SEQ ID NO: 1956480 - RNA, 15 nt, Shigella flexneri 2a str. 301
ggugcagcggcuccu

SEQ ID NO: 1956481 - RNA, 13 nt, Shigella flexneri 2a str. 301
gguggcgguaaca

SEQ ID NO: 1956482 - RNA, 15 nt, Shigella flexneri 2a str. 301
gguuuugaucuccag

SEQ ID NO: 1956483 - RNA, 19 nt, Shigella flexneri 2a str. 301
gguuuucucccucgcucug

SEQ ID NO: 1956484 - RNA, 18 nt, Shigella flexneri 2a str. 301
gguuuguaggccggauaa

SEQ ID NO: 1956485 - RNA, 18 nt, Shigella flexneri 2a str. 301
gguuuucgcgcgcaguua

SEQ ID NO: 1956486 - RNA, 15 nt, Shigella flexneri 2a str. 301
guaacgcacacaucc

SEQ ID NO: 1956487 - RNA, 13 nt, Shigella flexneri 2a str. 301
guaacgaucgccu

SEQ ID NO: 1956488 - RNA, 19 nt, Shigella flexneri 2a str. 301
guaaaugggccaacaccag

SEQ ID NO: 1956489 - RNA, 20 nt, Shigella flexneri 2a str. 301
guaaaucccagugccugcau

SEQ ID NO: 1956490 - RNA, 19 nt, Shigella flexneri 2a str. 301
guaaaggcggcagaacaga

SEQ ID NO: 1956491 - RNA, 19 nt, Shigella flexneri 2a str. 301
guaaaguacguguggucuu

SEQ ID NO: 1956492 - RNA, 14 nt, Shigella flexneri 2a str. 301
gguugcuuaucccg

SEQ ID NO: 1956493 - RNA, 20 nt, Shigella flexneri 2a str. 301
guaacucacugaugccguuu

SEQ ID NO: 1956494 - RNA, 16 nt, Shigella flexneri 2a str. 301
guaagaguuucaacau

SEQ ID NO: 1956495 - RNA, 14 nt, Shigella flexneri 2a str. 301
guaaugaucgcgau

SEQ ID NO: 1956496 - RNA, 15 nt, Shigella flexneri 2a str. 301
guaaugcucaauucc

SEQ ID NO: 1956497 - RNA, 19 nt, Shigella flexneri 2a str. 301
guaauugcuuuuaccauac

SEQ ID NO: 1956498 - RNA, 12 nt, Shigella flexneri 2a str. 301
guacaccaccua

SEQ ID NO: 1956499 - RNA, 16 nt, Shigella flexneri 2a str. 301
guacagauccgccauu

SEQ ID NO: 1956500 - RNA, 15 nt, Shigella flexneri 2a str. 301
guacagauccgccau

SEQ ID NO: 1956501 - RNA, 15 nt, Shigella flexneri 2a str. 301
guacauuaagcgcau

SEQ ID NO: 1956502 - RNA, 19 nt, Shigella flexneri 2a str. 301
guaccaccagaaucgccag

SEQ ID NO: 1956503 - RNA, 23 nt, Shigella flexneri 2a str. 301
guaccaccgcgaaaacaauuacg

SEQ ID NO: 1956504 - RNA, 14 nt, Shigella flexneri 2a str. 301
gugcaguacaucgu

SEQ ID NO: 1956505 - RNA, 21 nt, Shigella flexneri 2a str. 301
gugccgaaccguaggccggau

SEQ ID NO: 1956506 - RNA, 12 nt, Shigella flexneri 2a str. 301
gugccgccgcca

SEQ ID NO: 1956507 - RNA, 14 nt, Shigella flexneri 2a str. 301
gugcgucagggcga

SEQ ID NO: 1956508 - RNA, 13 nt, Shigella flexneri 2a str. 301
gugcgauccacgc

SEQ ID NO: 1956509 - RNA, 14 nt, Shigella flexneri 2a str. 301
gugccguuauucag

SEQ ID NO: 1956510 - RNA, 16 nt, Shigella flexneri 2a str. 301
gugacugggugccgcg

SEQ ID NO: 1956511 - RNA, 21 nt, Shigella flexneri 2a str. 301
gugagggcaaacaggcgcugg

SEQ ID NO: 1956512 - RNA, 13 nt, Shigella flexneri 2a str. 301
gugacgguaacgu

SEQ ID NO: 1956513 - RNA, 14 nt, Shigella flexneri 2a str. 301
gugacgcgggcagc

SEQ ID NO: 1956514 - RNA, 23 nt, Shigella flexneri 2a str. 301
gugauuguggcaaucauauucac

SEQ ID NO: 1956515 - RNA, 16 nt, Shigella flexneri 2a str. 301
gucgucaguuccauaa

SEQ ID NO: 1956516 - RNA, 14 nt, Shigella flexneri 2a str. 301
gucgguuucgcgca

SEQ ID NO: 1956517 - RNA, 15 nt, Shigella flexneri 2a str. 301
gucguacccggcgac

SEQ ID NO: 1956518 - RNA, 15 nt, Shigella flexneri 2a str. 301
gucggcagauaacac

SEQ ID NO: 1956519 - RNA, 20 nt, Shigella flexneri 2a str. 301
gugacagauuugauuaucaa

SEQ ID NO: 1956520 - RNA, 13 nt, Shigella flexneri 2a str. 301
gugaauucacaau

SEQ ID NO: 1956521 - RNA, 17 nt, Shigella flexneri 2a str. 301
gugaccaaaggcgaugc

SEQ ID NO: 1956522 - RNA, 21 nt, Shigella flexneri 2a str. 301
gugaagaugccaacuggcaua

SEQ ID NO: 1956523 - RNA, 15 nt, Shigella flexneri 2a str. 301
gugaagguugucauc

SEQ ID NO: 1956524 - RNA, 14 nt, Shigella flexneri 2a str. 301
gucugggccgauaa

SEQ ID NO: 1956525 - RNA, 14 nt, Shigella flexneri 2a str. 301
gucgugaaacgcgu

SEQ ID NO: 1956526 - RNA, 16 nt, Shigella flexneri 2a str. 301
gucgugaagcagagca

SEQ ID NO: 1956527 - RNA, 23 nt, Shigella flexneri 2a str. 301
gucgugauugucggugccggaac

SEQ ID NO: 1956528 - RNA, 16 nt, Shigella flexneri 2a str. 301
guccucuucagcauca

SEQ ID NO: 1956529 - RNA, 15 nt, Shigella flexneri 2a str. 301
guccguuauggcgug

SEQ ID NO: 1956530 - RNA, 21 nt, Shigella flexneri 2a str. 301
guccgcucaaacgacgauaau

SEQ ID NO: 1956531 - RNA, 20 nt, Shigella flexneri 2a str. 301
guccgcgaacagcagcgguu

SEQ ID NO: 1956532 - RNA, 19 nt, Shigella flexneri 2a str. 301
gucacggugcagcucgcaa

SEQ ID NO: 1956533 - RNA, 19 nt, Shigella flexneri 2a str. 301
guccauacccagcaucagu

SEQ ID NO: 1956534 - RNA, 13 nt, Shigella flexneri 2a str. 301
gucgcgcagcacu

SEQ ID NO: 1956535 - RNA, 17 nt, Shigella flexneri 2a str. 301
gucgcguuguaggucga

SEQ ID NO: 1956536 - RNA, 18 nt, Shigella flexneri 2a str. 301
gucggaccauuauuucca

SEQ ID NO: 1956537 - RNA, 17 nt, Shigella flexneri 2a str. 301
gucgcugaaagcugaac

SEQ ID NO: 1956538 - RNA, 15 nt, Shigella flexneri 2a str. 301
gucgccagcgccagc

SEQ ID NO: 1956539 - RNA, 17 nt, Shigella flexneri 2a str. 301
gucgagaucgcggcaau

SEQ ID NO: 1956540 - RNA, 20 nt, Shigella flexneri 2a str. 301
gucgcaggcaguacugcaua

SEQ ID NO: 1956541 - RNA, 14 nt, Shigella flexneri 2a str. 301
gucgcauccggcaa

SEQ ID NO: 1956542 - RNA, 18 nt, Shigella flexneri 2a str. 301
gucgagaauaucgauauc

SEQ ID NO: 1956543 - RNA, 19 nt, Shigella flexneri 2a str. 301
gucgaaugcgcaaccguaa

SEQ ID NO: 1956544 - RNA, 16 nt, Shigella flexneri 2a str. 301
gcgccgcauccggcau

SEQ ID NO: 1956545 - RNA, 14 nt, Shigella flexneri 2a str. 301
gcgccgcauccgac

SEQ ID NO: 1956546 - RNA, 23 nt, Shigella flexneri 2a str. 301
gcgccagucggucaaugugcuaa

SEQ ID NO: 1956547 - RNA, 20 nt, Shigella flexneri 2a str. 301
gcgccagcuucgaggccgga

SEQ ID NO: 1956548 - RNA, 18 nt, Shigella flexneri 2a str. 301
gcgcaucggucgaugaaa

SEQ ID NO: 1956549 - RNA, 16 nt, Shigella flexneri 2a str. 301
gcgcaucgggcaaugg

SEQ ID NO: 1956550 - RNA, 18 nt, Shigella flexneri 2a str. 301
gcgccacucgauaccaga

SEQ ID NO: 1956551 - RNA, 20 nt, Shigella flexneri 2a str. 301
gcgccagaacacgcucccag

SEQ ID NO: 1956552 - RNA, 15 nt, Shigella flexneri 2a str. 301
gcgccagauggcaaa

SEQ ID NO: 1956553 - RNA, 23 nt, Shigella flexneri 2a str. 301
gcgccauuggcuuuugcuugcga

SEQ ID NO: 1956554 - RNA, 21 nt, Shigella flexneri 2a str. 301
gcgauaucgcgguacuucuca

SEQ ID NO: 1956555 - RNA, 18 nt, Shigella flexneri 2a str. 301
gcgaucaaacgccagauc

SEQ ID NO: 1956556 - RNA, 19 nt, Shigella flexneri 2a str. 301
gcgcagauuagccgguaaa

SEQ ID NO: 1956557 - RNA, 18 nt, Shigella flexneri 2a str. 301
gcgcacuaugugccagcu

SEQ ID NO: 1956558 - RNA, 17 nt, Shigella flexneri 2a str. 301
gcgcaggagccacauag

SEQ ID NO: 1956559 - RNA, 22 nt, Shigella flexneri 2a str. 301
gcgcagcguucauaaauacaga

SEQ ID NO: 1956560 - RNA, 22 nt, Shigella flexneri 2a str. 301
gcgcagcugcgcuucaauacgc

SEQ ID NO: 1956561 - RNA, 19 nt, Shigella flexneri 2a str. 301
gcgcagucacaccagcgau

SEQ ID NO: 1956562 - RNA, 16 nt, Shigella flexneri 2a str. 301
gcgcaggucauccggc

SEQ ID NO: 1956563 - RNA, 22 nt, Shigella flexneri 2a str. 301
gcgcauccggcaccagcgcaca

SEQ ID NO: 1956564 - RNA, 21 nt, Shigella flexneri 2a str. 301
gcgcauccgggauggucagcg

SEQ ID NO: 1956565 - RNA, 13 nt, Shigella flexneri 2a str. 301
gcgcauccagcgu

SEQ ID NO: 1956566 - RNA, 14 nt, Shigella flexneri 2a str. 301
gcgcauccagcguu

SEQ ID NO: 1956567 - RNA, 18 nt, Shigella flexneri 2a str. 301
gcgcaucaaagccaggca

SEQ ID NO: 1956568 - RNA, 15 nt, Shigella flexneri 2a str. 301
gcgcaucaggcaguu

SEQ ID NO: 1956569 - RNA, 14 nt, Shigella flexneri 2a str. 301
gcgcggcaggcauc

SEQ ID NO: 1956570 - RNA, 20 nt, Shigella flexneri 2a str. 301
gcgcggauccacaccugacg

SEQ ID NO: 1956571 - RNA, 22 nt, Shigella flexneri 2a str. 301
gcgcguaaauaccuuccggcgu

SEQ ID NO: 1956572 - RNA, 14 nt, Shigella flexneri 2a str. 301
gcgcguaagcguca

SEQ ID NO: 1956573 - RNA, 21 nt, Shigella flexneri 2a str. 301
gcgcguaaauaccuuccggcg

SEQ ID NO: 1956574 - RNA, 19 nt, Shigella flexneri 2a str. 301
gcgcucacaccacagcagc

SEQ ID NO: 1956575 - RNA, 19 nt, Shigella flexneri 2a str. 301
gcgcguuuuuuaugccgga

SEQ ID NO: 1956576 - RNA, 19 nt, Shigella flexneri 2a str. 301
gcgcguuguucaugccgga

SEQ ID NO: 1956577 - RNA, 22 nt, Shigella flexneri 2a str. 301
gcgcguccgcagacacuuuccc

SEQ ID NO: 1956578 - RNA, 20 nt, Shigella flexneri 2a str. 301
gcgcuucgcuuaucaggccu

SEQ ID NO: 1956579 - RNA, 20 nt, Shigella flexneri 2a str. 301
gcgcuucgcuuauccgaccu

SEQ ID NO: 1956580 - RNA, 15 nt, Shigella flexneri 2a str. 301
gcgcuuccgucagac

SEQ ID NO: 1956581 - RNA, 15 nt, Shigella flexneri 2a str. 301
gcgcuucucaggccu

SEQ ID NO: 1956582 - RNA, 14 nt, Shigella flexneri 2a str. 301
gcgcuuucgccagg

SEQ ID NO: 1956583 - RNA, 15 nt, Shigella flexneri 2a str. 301
gcgcuuaucaggccu

SEQ ID NO: 1956584 - RNA, 14 nt, Shigella flexneri 2a str. 301
gcgcuucaccaguu

SEQ ID NO: 1956585 - RNA, 19 nt, Shigella flexneri 2a str. 301
gcgcuuaucaggccuacag

SEQ ID NO: 1956586 - RNA, 22 nt, Shigella flexneri 2a str. 301
gcgcucgugccgcauccggcau

SEQ ID NO: 1956587 - RNA, 17 nt, Shigella flexneri 2a str. 301
gcgcgcaaucagcaccg

SEQ ID NO: 1956588 - RNA, 12 nt, Shigella flexneri 2a str. 301
gcgccucaagcu

SEQ ID NO: 1956589 - RNA, 11 nt, Shigella flexneri 2a str. 301
gcgcgcuucgc

SEQ ID NO: 1956590 - RNA, 18 nt, Shigella flexneri 2a str. 301
gccgggauuuauucccgg

SEQ ID NO: 1956591 - RNA, 14 nt, Shigella flexneri 2a str. 301
gccggggagauauu

SEQ ID NO: 1956592 - RNA, 15 nt, Shigella flexneri 2a str. 301
gccgugacgaaucag

SEQ ID NO: 1956593 - RNA, 21 nt, Shigella flexneri 2a str. 301
gccgucguugagcaucugcaa

SEQ ID NO: 1956594 - RNA, 21 nt, Shigella flexneri 2a str. 301
gccuauuaugacuccagcgcc

SEQ ID NO: 1956595 - RNA, 13 nt, Shigella flexneri 2a str. 301
gccucaacgccua

SEQ ID NO: 1956596 - RNA, 12 nt, Shigella flexneri 2a str. 301
gccuauccagaa

SEQ ID NO: 1956597 - RNA, 14 nt, Shigella flexneri 2a str. 301
gccgugcagcacgg

SEQ ID NO: 1956598 - RNA, 15 nt, Shigella flexneri 2a str. 301
gccguugaucucucc

SEQ ID NO: 1956599 - RNA, 13 nt, Shigella flexneri 2a str. 301
gccugcucuuauu

SEQ ID NO: 1956600 - RNA, 19 nt, Shigella flexneri 2a str. 301
gccuuauccguccuacgaa

SEQ ID NO: 1956601 - RNA, 14 nt, Shigella flexneri 2a str. 301
gccuuauccguccu

SEQ ID NO: 1956602 - RNA, 21 nt, Shigella flexneri 2a str. 301
gccuguacggcagugaacgcg

SEQ ID NO: 1956603 - RNA, 13 nt, Shigella flexneri 2a str. 301
gccuguacggcag

SEQ ID NO: 1956604 - RNA, 15 nt, Shigella flexneri 2a str. 301
gccuguaacgccuuu

SEQ ID NO: 1956605 - RNA, 20 nt, Shigella flexneri 2a str. 301
gccuguaaagucauccuuaa

SEQ ID NO: 1956606 - RNA, 12 nt, Shigella flexneri 2a str. 301
gccuggugaccg

SEQ ID NO: 1956607 - RNA, 17 nt, Shigella flexneri 2a str. 301
gcgaagauacccgcgag

SEQ ID NO: 1956608 - RNA, 12 nt, Shigella flexneri 2a str. 301
gcgaacugcgca

SEQ ID NO: 1956609 - RNA, 15 nt, Shigella flexneri 2a str. 301
gcgaaccaggccgua

SEQ ID NO: 1956610 - RNA, 14 nt, Shigella flexneri 2a str. 301
gcgaaccaggaaga

SEQ ID NO: 1956611 - RNA, 18 nt, Shigella flexneri 2a str. 301
gcgaaaaucccggcaaca

SEQ ID NO: 1956612 - RNA, 18 nt, Shigella flexneri 2a str. 301
gccuuucggcgcagucac

SEQ ID NO: 1956613 - RNA, 15 nt, Shigella flexneri 2a str. 301
gcgaaaccuccgcaa

SEQ ID NO: 1956614 - RNA, 19 nt, Shigella flexneri 2a str. 301
gcgaaaccuuugccgaugg

SEQ ID NO: 1956615 - RNA, 23 nt, Shigella flexneri 2a str. 301
gcgaaacugcccuacaaacuggu

SEQ ID NO: 1956616 - RNA, 17 nt, Shigella flexneri 2a str. 301
gcgaaagcuggcacugg

SEQ ID NO: 1956617 - RNA, 19 nt, Shigella flexneri 2a str. 301
gcgaaaucuuccggcgugg

SEQ ID NO: 1956618 - RNA, 20 nt, Shigella flexneri 2a str. 301
gcgacgcugacgcgucuuau

SEQ ID NO: 1956619 - RNA, 20 nt, Shigella flexneri 2a str. 301
gcgacgcuggcgcgucuuau

SEQ ID NO: 1956620 - RNA, 21 nt, Shigella flexneri 2a str. 301
gcgacgcuggccgcgucuuau

SEQ ID NO: 1956621 - RNA, 19 nt, Shigella flexneri 2a str. 301
gcgacgcugcgcgucuuau

SEQ ID NO: 1956622 - RNA, 15 nt, Shigella flexneri 2a str. 301
gcgaccaaacugcuc

SEQ ID NO: 1956623 - RNA, 19 nt, Shigella flexneri 2a str. 301
gcgaccaccggguuaacgu

SEQ ID NO: 1956624 - RNA, 16 nt, Shigella flexneri 2a str. 301
gcgacaguaucaucau

SEQ ID NO: 1956625 - RNA, 15 nt, Shigella flexneri 2a str. 301
gcgacaagcgucgca

SEQ ID NO: 1956626 - RNA, 12 nt, Shigella flexneri 2a str. 301
gcgacacaaucc

SEQ ID NO: 1956627 - RNA, 16 nt, Shigella flexneri 2a str. 301
gcgauagccgcuuucu

SEQ ID NO: 1956628 - RNA, 13 nt, Shigella flexneri 2a str. 301
gcgauaaucgaac

SEQ ID NO: 1956629 - RNA, 12 nt, Shigella flexneri 2a str. 301
gcgauacgcagu

SEQ ID NO: 1956630 - RNA, 22 nt, Shigella flexneri 2a str. 301
gcgauaacgccccaauccacgc

SEQ ID NO: 1956631 - RNA, 13 nt, Shigella flexneri 2a str. 301
gcgagucgucagu

SEQ ID NO: 1956632 - RNA, 15 nt, Shigella flexneri 2a str. 301
gcgagucgcuccugc

SEQ ID NO: 1956633 - RNA, 21 nt, Shigella flexneri 2a str. 301
gcgacgcuggucgcgucuuau

SEQ ID NO: 1956634 - RNA, 20 nt, Shigella flexneri 2a str. 301
gcgacuugucgcccgucagu

SEQ ID NO: 1956635 - RNA, 13 nt, Shigella flexneri 2a str. 301
gcgacuggcggca

SEQ ID NO: 1956636 - RNA, 18 nt, Shigella flexneri 2a str. 301
gcggcaguggcuaagcag

SEQ ID NO: 1956637 - RNA, 14 nt, Shigella flexneri 2a str. 301
gcggaaaucuccag

SEQ ID NO: 1956638 - RNA, 16 nt, Shigella flexneri 2a str. 301
gcggaaagcaccugcg

SEQ ID NO: 1956639 - RNA, 22 nt, Shigella flexneri 2a str. 301
gcggcaugaacaccuucucagg

SEQ ID NO: 1956640 - RNA, 19 nt, Shigella flexneri 2a str. 301
gcggccggaugcgccgcca

SEQ ID NO: 1956641 - RNA, 21 nt, Shigella flexneri 2a str. 301
gcggccguuccauucaaacgu

SEQ ID NO: 1956642 - RNA, 21 nt, Shigella flexneri 2a str. 301
gcggcggcagauugagcguca

SEQ ID NO: 1956643 - RNA, 18 nt, Shigella flexneri 2a str. 301
gcggcgugaacgccuuau

SEQ ID NO: 1956644 - RNA, 18 nt, Shigella flexneri 2a str. 301
gcgggagcagauacggcg

SEQ ID NO: 1956645 - RNA, 20 nt, Shigella flexneri 2a str. 301
gcgggagagccccugccgca

SEQ ID NO: 1956646 - RNA, 14 nt, Shigella flexneri 2a str. 301
gcgggcggcauugg

SEQ ID NO: 1956647 - RNA, 19 nt, Shigella flexneri 2a str. 301
gcguugaauuuauguuucc

SEQ ID NO: 1956648 - RNA, 20 nt, Shigella flexneri 2a str. 301
gcguucacgccgcauccggc

SEQ ID NO: 1956649 - RNA, 18 nt, Shigella flexneri 2a str. 301
gcguuccugcucuuccgg

SEQ ID NO: 1956650 - RNA, 21 nt, Shigella flexneri 2a str. 301
gcguuaugccguaaugccagu

SEQ ID NO: 1956651 - RNA, 18 nt, Shigella flexneri 2a str. 301
gcguuagcaucgcaucag

SEQ ID NO: 1956652 - RNA, 17 nt, Shigella flexneri 2a str. 301
gcguuuguaggccggau

SEQ ID NO: 1956653 - RNA, 21 nt, Shigella flexneri 2a str. 301
gcguuucuggcuuaaacgcag

SEQ ID NO: 1956654 - RNA, 19 nt, Shigella flexneri 2a str. 301
gcguuugcuguuccacgag

SEQ ID NO: 1956655 - RNA, 16 nt, Shigella flexneri 2a str. 301
gcuaaccacgccgcuu

SEQ ID NO: 1956656 - RNA, 19 nt, Shigella flexneri 2a str. 301
gcguuguaacaauccgaua

SEQ ID NO: 1956657 - RNA, 22 nt, Shigella flexneri 2a str. 301
gcguuuacgccgcauccggcau

SEQ ID NO: 1956658 - RNA, 17 nt, Shigella flexneri 2a str. 301
gcgucuuguugaacagg

SEQ ID NO: 1956659 - RNA, 18 nt, Shigella flexneri 2a str. 301
gcgucuuccgugccugac

SEQ ID NO: 1956660 - RNA, 16 nt, Shigella flexneri 2a str. 301
gcgucuuauccggccu

SEQ ID NO: 1956661 - RNA, 16 nt, Shigella flexneri 2a str. 301
gcgugaccaguugcuc

SEQ ID NO: 1956662 - RNA, 14 nt, Shigella flexneri 2a str. 301
gcgugaaucaacac

SEQ ID NO: 1956663 - RNA, 20 nt, Shigella flexneri 2a str. 301
gcgugaagugugcaaacgau

SEQ ID NO: 1956664 - RNA, 20 nt, Shigella flexneri 2a str. 301
gcgucuuaucaggccagcca

SEQ ID NO: 1956665 - RNA, 20 nt, Shigella flexneri 2a str. 301
gcgucuuaucaggccuacaa

SEQ ID NO: 1956666 - RNA, 17 nt, Shigella flexneri 2a str. 301
gcgugauucauacagcg

SEQ ID NO: 1956667 - RNA, 21 nt, Shigella flexneri 2a str. 301
gcgugauucauacagcggcca

SEQ ID NO: 1956668 - RNA, 22 nt, Shigella flexneri 2a str. 301
gcgucaacaacacucucugaag

SEQ ID NO: 1956669 - RNA, 17 nt, Shigella flexneri 2a str. 301
gcguauuaauuccggug

SEQ ID NO: 1956670 - RNA, 22 nt, Shigella flexneri 2a str. 301
gcguauccggcccguaaauuca

SEQ ID NO: 1956671 - RNA, 14 nt, Shigella flexneri 2a str. 301
gcguagcugagcaa

SEQ ID NO: 1956672 - RNA, 17 nt, Shigella flexneri 2a str. 301
gcgucagaguuuagcga

SEQ ID NO: 1956673 - RNA, 15 nt, Shigella flexneri 2a str. 301
gcgucagaaacaguu

SEQ ID NO: 1956674 - RNA, 14 nt, Shigella flexneri 2a str. 301
gcgucagcaacaug

SEQ ID NO: 1956675 - RNA, 23 nt, Shigella flexneri 2a str. 301
gcgucaauuuguuccgccagcga

SEQ ID NO: 1956676 - RNA, 19 nt, Shigella flexneri 2a str. 301
gcgucacgccgaccagacc

SEQ ID NO: 1956677 - RNA, 20 nt, Shigella flexneri 2a str. 301
gcgucacgccgaccagaccg

SEQ ID NO: 1956678 - RNA, 13 nt, Shigella flexneri 2a str. 301
gcggucguaaucg

SEQ ID NO: 1956679 - RNA, 22 nt, Shigella flexneri 2a str. 301
gcggucauaaaauccguaaucg

SEQ ID NO: 1956680 - RNA, 13 nt, Shigella flexneri 2a str. 301
gcguaauuugcga

SEQ ID NO: 1956681 - RNA, 21 nt, Shigella flexneri 2a str. 301
gcguaaugccugggcgauuuc

SEQ ID NO: 1956682 - RNA, 23 nt, Shigella flexneri 2a str. 301
gcguaacggcucacgcccaucag

SEQ ID NO: 1956683 - RNA, 20 nt, Shigella flexneri 2a str. 301
gcgguugguggcgguaacau

SEQ ID NO: 1956684 - RNA, 22 nt, Shigella flexneri 2a str. 301
gcgguguacccugcucgcugga

SEQ ID NO: 1956685 - RNA, 20 nt, Shigella flexneri 2a str. 301
gcucgacgucacaggccauc

SEQ ID NO: 1956686 - RNA, 15 nt, Shigella flexneri 2a str. 301
gcuccuuuuggcaaa

SEQ ID NO: 1956687 - RNA, 17 nt, Shigella flexneri 2a str. 301
gcuaccaugcuaauaau

SEQ ID NO: 1956688 - RNA, 22 nt, Shigella flexneri 2a str. 301
gcuaauuccagucguguuccgg

SEQ ID NO: 1956689 - RNA, 13 nt, Shigella flexneri 2a str. 301
gcuacauaacgca

SEQ ID NO: 1956690 - RNA, 22 nt, Shigella flexneri 2a str. 301
gcuccggcgcgauaucgacgac

SEQ ID NO: 1956691 - RNA, 18 nt, Shigella flexneri 2a str. 301
gcuccggcggcacagcca

SEQ ID NO: 1956692 - RNA, 16 nt, Shigella flexneri 2a str. 301
gcucccguaauuccgc

SEQ ID NO: 1956693 - RNA, 19 nt, Shigella flexneri 2a str. 301
gcucccgcaggagcgccga

SEQ ID NO: 1956694 - RNA, 14 nt, Shigella flexneri 2a str. 301
gcucgccgccgcug

SEQ ID NO: 1956695 - RNA, 24 nt, Shigella flexneri 2a str. 301
gcucgcgcuugcggaagcaaccgg

SEQ ID NO: 1956696 - RNA, 16 nt, Shigella flexneri 2a str. 301
gcucgugggauugccg

SEQ ID NO: 1956697 - RNA, 20 nt, Shigella flexneri 2a str. 301
gcugaccagaauuuacccgc

SEQ ID NO: 1956698 - RNA, 20 nt, Shigella flexneri 2a str. 301
gcugacauuaucagacaccg

SEQ ID NO: 1956699 - RNA, 20 nt, Shigella flexneri 2a str. 301
gcugacauaaacaccagcaa

SEQ ID NO: 1956700 - RNA, 20 nt, Shigella flexneri 2a str. 301
gcugacaacgcugaauggcg

SEQ ID NO: 1956701 - RNA, 18 nt, Shigella flexneri 2a str. 301
gcugaaccguaggccgua

SEQ ID NO: 1956702 - RNA, 15 nt, Shigella flexneri 2a str. 301
gcugaacaaagccga

SEQ ID NO: 1956703 - RNA, 22 nt, Shigella flexneri 2a str. 301
gcugcacacagggcgcuagcca

SEQ ID NO: 1956704 - RNA, 19 nt, Shigella flexneri 2a str. 301
gcugcacaauugccagccc

SEQ ID NO: 1956705 - RNA, 17 nt, Shigella flexneri 2a str. 301
gcugauaacaauaucaa

SEQ ID NO: 1956706 - RNA, 15 nt, Shigella flexneri 2a str. 301
gcugauaaaucccgc

SEQ ID NO: 1956707 - RNA, 14 nt, Shigella flexneri 2a str. 301
gcugaggcguuuca

SEQ ID NO: 1956708 - RNA, 18 nt, Shigella flexneri 2a str. 301
gcugaggcguuucaacuc

SEQ ID NO: 1956709 - RNA, 22 nt, Shigella flexneri 2a str. 301
gcugacugucgcagccagcgcg

SEQ ID NO: 1956710 - RNA, 12 nt, Shigella flexneri 2a str. 301
gcugaccgcuug

SEQ ID NO: 1956711 - RNA, 19 nt, Shigella flexneri 2a str. 301
gcugacugauauugcccgu

SEQ ID NO: 1956712 - RNA, 14 nt, Shigella flexneri 2a str. 301
gcugcccaugcgcu

SEQ ID NO: 1956713 - RNA, 15 nt, Shigella flexneri 2a str. 301
gcugcagcucuuuca

SEQ ID NO: 1956714 - RNA, 15 nt, Shigella flexneri 2a str. 301
gcugcguggcgcuuu

SEQ ID NO: 1956715 - RNA, 19 nt, Shigella flexneri 2a str. 301
gcugcugauccagcuucca

SEQ ID NO: 1956716 - RNA, 18 nt, Shigella flexneri 2a str. 301
gcugcuacgccgucauua

SEQ ID NO: 1956717 - RNA, 16 nt, Shigella flexneri 2a str. 301
ggagacauuacgucca

SEQ ID NO: 1956718 - RNA, 22 nt, Shigella flexneri 2a str. 301
ggagacauuacguccaucacaa

SEQ ID NO: 1956719 - RNA, 13 nt, Shigella flexneri 2a str. 301
ggagaaacuucug

SEQ ID NO: 1956720 - RNA, 22 nt, Shigella flexneri 2a str. 301
ggacugggcgcgcucagcgcca

SEQ ID NO: 1956721 - RNA, 14 nt, Shigella flexneri 2a str. 301
ggacugacauuacg

SEQ ID NO: 1956722 - RNA, 17 nt, Shigella flexneri 2a str. 301
ggacugaacgcccacgg

SEQ ID NO: 1956723 - RNA, 14 nt, Shigella flexneri 2a str. 301
ggacguuaccauca

SEQ ID NO: 1956724 - RNA, 14 nt, Shigella flexneri 2a str. 301
ggacgugcaccguc

SEQ ID NO: 1956725 - RNA, 14 nt, Shigella flexneri 2a str. 301
ggaauguggcaaug

SEQ ID NO: 1956726 - RNA, 20 nt, Shigella flexneri 2a str. 301
ggacgagucgucgauaucga

SEQ ID NO: 1956727 - RNA, 16 nt, Shigella flexneri 2a str. 301
ggaagccuaucgucau

SEQ ID NO: 1956728 - RNA, 21 nt, Shigella flexneri 2a str. 301
ggaaaugggugacaucgcccu

SEQ ID NO: 1956729 - RNA, 23 nt, Shigella flexneri 2a str. 301
ggaaaucaugcaacacguuaaca

SEQ ID NO: 1956730 - RNA, 17 nt, Shigella flexneri 2a str. 301
ggaaauccaggucagca

SEQ ID NO: 1956731 - RNA, 20 nt, Shigella flexneri 2a str. 301
ggaaauccccuggcguuuga

SEQ ID NO: 1956732 - RNA, 14 nt, Shigella flexneri 2a str. 301
gcuuucgugaagcu

SEQ ID NO: 1956733 - RNA, 14 nt, Shigella flexneri 2a str. 301
gcuuuccugauaau

SEQ ID NO: 1956734 - RNA, 20 nt, Shigella flexneri 2a str. 301
gcuuuccgucagcggcaauu

SEQ ID NO: 1956735 - RNA, 17 nt, Shigella flexneri 2a str. 301
gcuuuccgggagcaauu

SEQ ID NO: 1956736 - RNA, 18 nt, Shigella flexneri 2a str. 301
gcuuuacgcuuaucccag

SEQ ID NO: 1956737 - RNA, 16 nt, Shigella flexneri 2a str. 301
gcuuuacaauauccag

SEQ ID NO: 1956738 - RNA, 20 nt, Shigella flexneri 2a str. 301
gcuuuacaauauccagcgcg

SEQ ID NO: 1956739 - RNA, 21 nt, Shigella flexneri 2a str. 301
gcuuuaaauuacugagcaauu

SEQ ID NO: 1956740 - RNA, 23 nt, Shigella flexneri 2a str. 301
gcuucuuuuuaccuucauuugcc

SEQ ID NO: 1956741 - RNA, 13 nt, Shigella flexneri 2a str. 301
gcuucuuccggcg

SEQ ID NO: 1956742 - RNA, 19 nt, Shigella flexneri 2a str. 301
ggaaacccaacgcaaagag

SEQ ID NO: 1956743 - RNA, 18 nt, Shigella flexneri 2a str. 301
ggaaaaucugcgggaaca

SEQ ID NO: 1956744 - RNA, 18 nt, Shigella flexneri 2a str. 301
gcuuuguucaugccggau

SEQ ID NO: 1956745 - RNA, 15 nt, Shigella flexneri 2a str. 301
gcuuuggugccagau

SEQ ID NO: 1956746 - RNA, 18 nt, Shigella flexneri 2a str. 301
gcuuuguuuaugccagau

SEQ ID NO: 1956747 - RNA, 15 nt, Shigella flexneri 2a str. 301
gcuuuuaaccgcuuu

SEQ ID NO: 1956748 - RNA, 16 nt, Shigella flexneri 2a str. 301
ggaaaauaucgcccau

SEQ ID NO: 1956749 - RNA, 16 nt, Shigella flexneri 2a str. 301
gcuguucuucugcuga

SEQ ID NO: 1956750 - RNA, 20 nt, Shigella flexneri 2a str. 301
gcuguguguaggccagcgau

SEQ ID NO: 1956751 - RNA, 14 nt, Shigella flexneri 2a str. 301
gcuguacgccuuca

SEQ ID NO: 1956752 - RNA, 15 nt, Shigella flexneri 2a str. 301
gcuguaaccagcgca

SEQ ID NO: 1956753 - RNA, 18 nt, Shigella flexneri 2a str. 301
gcugguguaacugcgcca

SEQ ID NO: 1956754 - RNA, 21 nt, Shigella flexneri 2a str. 301
gcuggguuucgccugccagau

SEQ ID NO: 1956755 - RNA, 18 nt, Shigella flexneri 2a str. 301
gcugguaacggcgucaac

SEQ ID NO: 1956756 - RNA, 14 nt, Shigella flexneri 2a str. 301
gcuggucagcaacu

SEQ ID NO: 1956757 - RNA, 21 nt, Shigella flexneri 2a str. 301
gcuggcgcucaagucgaaccu

SEQ ID NO: 1956758 - RNA, 15 nt, Shigella flexneri 2a str. 301
gcuuaaucaauugca

SEQ ID NO: 1956759 - RNA, 17 nt, Shigella flexneri 2a str. 301
gcuuaacugcgcuuucg

SEQ ID NO: 1956760 - RNA, 14 nt, Shigella flexneri 2a str. 301
gcuuaacugcgcuu

SEQ ID NO: 1956761 - RNA, 19 nt, Shigella flexneri 2a str. 301
gcuuaucaggccuacauga

SEQ ID NO: 1956762 - RNA, 14 nt, Shigella flexneri 2a str. 301
gcuuaucaggccua

SEQ ID NO: 1956763 - RNA, 14 nt, Shigella flexneri 2a str. 301
gcuucagcgcgucg

SEQ ID NO: 1956764 - RNA, 21 nt, Shigella flexneri 2a str. 301
gcuucacuucuuaccgcuuca

SEQ ID NO: 1956765 - RNA, 13 nt, Shigella flexneri 2a str. 301
gcuucaaagugau

SEQ ID NO: 1956766 - RNA, 16 nt, Shigella flexneri 2a str. 301
gcuucaaggugcgcga

SEQ ID NO: 1956767 - RNA, 18 nt, Shigella flexneri 2a str. 301
gcuucaaccguugcugga

SEQ ID NO: 1956768 - RNA, 15 nt, Shigella flexneri 2a str. 301
gcuucaccagcagcg

SEQ ID NO: 1956769 - RNA, 23 nt, Shigella flexneri 2a str. 301
gcuucaaaucauuacaguuucgg

SEQ ID NO: 1956770 - RNA, 14 nt, Shigella flexneri 2a str. 301
gcuuauugccggau

SEQ ID NO: 1956771 - RNA, 17 nt, Shigella flexneri 2a str. 301
gcuuauucaucaauucg

SEQ ID NO: 1956772 - RNA, 15 nt, Shigella flexneri 2a str. 301
gcuucaugcccgcca

SEQ ID NO: 1956773 - RNA, 21 nt, Shigella flexneri 2a str. 301
gcuucaucgugcucgcuuucc

SEQ ID NO: 1956774 - RNA, 17 nt, Shigella flexneri 2a str. 301
gcuucaucagacgcuua

SEQ ID NO: 1956775 - RNA, 22 nt, Shigella flexneri 2a str. 301
gcuucagugacuucugccagcu

SEQ ID NO: 1956776 - RNA, 14 nt, Shigella flexneri 2a str. 301
gcuucggcggguuu

SEQ ID NO: 1956777 - RNA, 14 nt, Shigella flexneri 2a str. 301
gcuucguagaagcc

SEQ ID NO: 1956778 - RNA, 23 nt, Shigella flexneri 2a str. 301
gcuucuggcgacauuuucucuac

SEQ ID NO: 1956779 - RNA, 17 nt, Shigella flexneri 2a str. 301
gcuucugcguucugauu

SEQ ID NO: 1956780 - RNA, 23 nt, Shigella flexneri 2a str. 301
gcuucgcaucccgguaucaaagc

SEQ ID NO: 1956781 - RNA, 21 nt, Shigella flexneri 2a str. 301
gcuucgccuuuuaccagcgcc

SEQ ID NO: 1956782 - RNA, 15 nt, Shigella flexneri 2a str. 301
gcuuccggcaauggc

SEQ ID NO: 1956783 - RNA, 13 nt, Shigella flexneri 2a str. 301
gcuucccaacgca

SEQ ID NO: 1956784 - RNA, 12 nt, Shigella flexneri 2a str. 301
gcuuccugcaac

SEQ ID NO: 1956785 - RNA, 16 nt, Shigella flexneri 2a str. 301
aauauuucccggccag

SEQ ID NO: 1956786 - RNA, 22 nt, Shigella flexneri 2a str. 301
uggucaucacuuuugaaaucaa

SEQ ID NO: 1956787 - RNA, 17 nt, Shigella flexneri 2a str. 301
ugguugucaccgccagg

SEQ ID NO: 1956788 - RNA, 17 nt, Shigella flexneri 2a str. 301
ugguuucagccggaucg

SEQ ID NO: 1956789 - RNA, 14 nt, Shigella flexneri 2a str. 301
ugguugcuggaaag

SEQ ID NO: 1956790 - RNA, 17 nt, Shigella flexneri 2a str. 301
uguaccguugcugccag

SEQ ID NO: 1956791 - RNA, 19 nt, Shigella flexneri 2a str. 301
uguaagaucgaaggcuguu

SEQ ID NO: 1956792 - RNA, 19 nt, Shigella flexneri 2a str. 301
uguaggccagauaagacgc

SEQ ID NO: 1956793 - RNA, 19 nt, Shigella flexneri 2a str. 301
uguaggcaggauaaggcgu

SEQ ID NO: 1956794 - RNA, 20 nt, Shigella flexneri 2a str. 301
uguaggccagauaagacguu

SEQ ID NO: 1956795 - RNA, 18 nt, Shigella flexneri 2a str. 301
uguacuuuccagccacag

SEQ ID NO: 1956796 - RNA, 20 nt, Shigella flexneri 2a str. 301
uguagaccggaaaagguguu

SEQ ID NO: 1956797 - RNA, 16 nt, Shigella flexneri 2a str. 301
uguagauauacugcac

SEQ ID NO: 1956798 - RNA, 19 nt, Shigella flexneri 2a str. 301
uguaggcuggauaaggcgu

SEQ ID NO: 1956799 - RNA, 18 nt, Shigella flexneri 2a str. 301
uguaggcggauaaggcgu

SEQ ID NO: 1956800 - RNA, 15 nt, Shigella flexneri 2a str. 301
aaucacgauugcugc

SEQ ID NO: 1956801 - RNA, 13 nt, Shigella flexneri 2a str. 301
ugucaaacccgau

SEQ ID NO: 1956802 - RNA, 19 nt, Shigella flexneri 2a str. 301
uguaggccggauaagcgua

SEQ ID NO: 1956803 - RNA, 20 nt, Shigella flexneri 2a str. 301
uguaggccggauaaggcauu

SEQ ID NO: 1956804 - RNA, 17 nt, Shigella flexneri 2a str. 301
aaucaccaucagcagca

SEQ ID NO: 1956805 - RNA, 13 nt, Shigella flexneri 2a str. 301
aaucaccgcuuca

SEQ ID NO: 1956806 - RNA, 21 nt, Shigella flexneri 2a str. 301
aauaugggucggcgauaacca

SEQ ID NO: 1956807 - RNA, 17 nt, Shigella flexneri 2a str. 301
aauauuaacgccagccu

SEQ ID NO: 1956808 - RNA, 13 nt, Shigella flexneri 2a str. 301
aauauugauaaua

SEQ ID NO: 1956809 - RNA, 13 nt, Shigella flexneri 2a str. 301
aauauccugcgcu

SEQ ID NO: 1956810 - RNA, 20 nt, Shigella flexneri 2a str. 301
aauaucuuccacuucacggc

SEQ ID NO: 1956811 - RNA, 20 nt, Shigella flexneri 2a str. 301
ugguaggccggauaaggcgu

SEQ ID NO: 1956812 - RNA, 23 nt, Shigella flexneri 2a str. 301
uggcgggaucaccugcacaugca

SEQ ID NO: 1956813 - RNA, 16 nt, Shigella flexneri 2a str. 301
uggcgguaacauccag

SEQ ID NO: 1956814 - RNA, 18 nt, Shigella flexneri 2a str. 301
uggcggguggcgauaaua

SEQ ID NO: 1956815 - RNA, 18 nt, Shigella flexneri 2a str. 301
uggcgcguuuaaucacac

SEQ ID NO: 1956816 - RNA, 16 nt, Shigella flexneri 2a str. 301
uggcgcuaucaauacu

SEQ ID NO: 1956817 - RNA, 20 nt, Shigella flexneri 2a str. 301
uggcgaaccuugcgcggugu

SEQ ID NO: 1956818 - RNA, 12 nt, Shigella flexneri 2a str. 301
uggcccaucaga

SEQ ID NO: 1956819 - RNA, 19 nt, Shigella flexneri 2a str. 301
uggccgcgucuuauccggc

SEQ ID NO: 1956820 - RNA, 21 nt, Shigella flexneri 2a str. 301
uggacaggcucuugaucuggu

SEQ ID NO: 1956821 - RNA, 14 nt, Shigella flexneri 2a str. 301
uggccacagauaau

SEQ ID NO: 1956822 - RNA, 19 nt, Shigella flexneri 2a str. 301
ugccguccggcaucgcaaa

SEQ ID NO: 1956823 - RNA, 15 nt, Shigella flexneri 2a str. 301
ugccguaaaucccag

SEQ ID NO: 1956824 - RNA, 24 nt, Shigella flexneri 2a str. 301
aauagccgcagccaucagcgagac

SEQ ID NO: 1956825 - RNA, 16 nt, Shigella flexneri 2a str. 301
aauagcccucgccgcu

SEQ ID NO: 1956826 - RNA, 19 nt, Shigella flexneri 2a str. 301
aauagcaacugauuuauag

SEQ ID NO: 1956827 - RNA, 17 nt, Shigella flexneri 2a str. 301
ugccgguacagccggaa

SEQ ID NO: 1956828 - RNA, 15 nt, Shigella flexneri 2a str. 301
ugccggagucgcauu

SEQ ID NO: 1956829 - RNA, 15 nt, Shigella flexneri 2a str. 301
ugccggauagcgugu

SEQ ID NO: 1956830 - RNA, 20 nt, Shigella flexneri 2a str. 301
ugccggaugcaugauccggc

SEQ ID NO: 1956831 - RNA, 21 nt, Shigella flexneri 2a str. 301
ugccggaugcaugauccggca

SEQ ID NO: 1956832 - RNA, 22 nt, Shigella flexneri 2a str. 301
ugccggaugcaucacauccggc

SEQ ID NO: 1956833 - RNA, 21 nt, Shigella flexneri 2a str. 301
ugccggauguuugcauccggc

SEQ ID NO: 1956834 - RNA, 16 nt, Shigella flexneri 2a str. 301
ugccgcuuccagcaga

SEQ ID NO: 1956835 - RNA, 13 nt, Shigella flexneri 2a str. 301
ugccgcugacauc

SEQ ID NO: 1956836 - RNA, 20 nt, Shigella flexneri 2a str. 301
ugccuuuaauaccaucggca

SEQ ID NO: 1956837 - RNA, 18 nt, Shigella flexneri 2a str. 301
ugcgacgcuuaacgcguc

SEQ ID NO: 1956838 - RNA, 16 nt, Shigella flexneri 2a str. 301
ugccuuaugcccggca

SEQ ID NO: 1956839 - RNA, 20 nt, Shigella flexneri 2a str. 301
ugccuucacaggccgccagg

SEQ ID NO: 1956840 - RNA, 21 nt, Shigella flexneri 2a str. 301
ugccuuccaccagauggcuuu

SEQ ID NO: 1956841 - RNA, 18 nt, Shigella flexneri 2a str. 301
ugccuuagccacaaagca

SEQ ID NO: 1956842 - RNA, 16 nt, Shigella flexneri 2a str. 301
ugccuuccccgagcgg

SEQ ID NO: 1956843 - RNA, 14 nt, Shigella flexneri 2a str. 301
ugcgaugccuggca

SEQ ID NO: 1956844 - RNA, 16 nt, Shigella flexneri 2a str. 301
ugcgacgcuugacgcg

SEQ ID NO: 1956845 - RNA, 15 nt, Shigella flexneri 2a str. 301
ugcgagcaaagcgca

SEQ ID NO: 1956846 - RNA, 18 nt, Shigella flexneri 2a str. 301
ugcgccagcguuacuuca

SEQ ID NO: 1956847 - RNA, 17 nt, Shigella flexneri 2a str. 301
ugcgccagcgcgcguug

SEQ ID NO: 1956848 - RNA, 16 nt, Shigella flexneri 2a str. 301
ugcgccacgcagcgau

SEQ ID NO: 1956849 - RNA, 18 nt, Shigella flexneri 2a str. 301
ugcgccacauccggcaua

SEQ ID NO: 1956850 - RNA, 17 nt, Shigella flexneri 2a str. 301
ugcgccagcaucgcauc

SEQ ID NO: 1956851 - RNA, 14 nt, Shigella flexneri 2a str. 301
ugcgccagagcgcg

SEQ ID NO: 1956852 - RNA, 17 nt, Shigella flexneri 2a str. 301
ugcgccgaaaucgcauc

SEQ ID NO: 1956853 - RNA, 20 nt, Shigella flexneri 2a str. 301
ugcgcccccgauccagcggu

SEQ ID NO: 1956854 - RNA, 16 nt, Shigella flexneri 2a str. 301
ugcgcccaucaucauc

SEQ ID NO: 1956855 - RNA, 14 nt, Shigella flexneri 2a str. 301
ugcgcccaguuaga

SEQ ID NO: 1956856 - RNA, 20 nt, Shigella flexneri 2a str. 301
ugcgucucaucaguuaacgg

SEQ ID NO: 1956857 - RNA, 21 nt, Shigella flexneri 2a str. 301
ugcggucuaaaucuuccgccg

SEQ ID NO: 1956858 - RNA, 15 nt, Shigella flexneri 2a str. 301
ugcgggcaucaucuu

SEQ ID NO: 1956859 - RNA, 22 nt, Shigella flexneri 2a str. 301
ugcgcuuauccggcccacauca

SEQ ID NO: 1956860 - RNA, 16 nt, Shigella flexneri 2a str. 301
ugcgcuuauccggccc

SEQ ID NO: 1956861 - RNA, 19 nt, Shigella flexneri 2a str. 301
ugcggaaagcuugcgucgc

SEQ ID NO: 1956862 - RNA, 22 nt, Shigella flexneri 2a str. 301
ugcggcacccauuuauccagcg

SEQ ID NO: 1956863 - RNA, 15 nt, Shigella flexneri 2a str. 301
ugcggcaccagcggu

SEQ ID NO: 1956864 - RNA, 17 nt, Shigella flexneri 2a str. 301
ugcggcguaaacgccuu

SEQ ID NO: 1956865 - RNA, 13 nt, Shigella flexneri 2a str. 301
ugcggcugcaucu

SEQ ID NO: 1956866 - RNA, 17 nt, Shigella flexneri 2a str. 301
ugcugcgccgagcaaua

SEQ ID NO: 1956867 - RNA, 13 nt, Shigella flexneri 2a str. 301
ugcuggacgcauu

SEQ ID NO: 1956868 - RNA, 15 nt, Shigella flexneri 2a str. 301
ugcugugugccgcga

SEQ ID NO: 1956869 - RNA, 15 nt, Shigella flexneri 2a str. 301
ugcuguuacgccaga

SEQ ID NO: 1956870 - RNA, 14 nt, Shigella flexneri 2a str. 301
ugcuuaaucgcggc

SEQ ID NO: 1956871 - RNA, 14 nt, Shigella flexneri 2a str. 301
ugcuucaccgauau

SEQ ID NO: 1956872 - RNA, 20 nt, Shigella flexneri 2a str. 301
ugcuucaccgauauccgcca

SEQ ID NO: 1956873 - RNA, 18 nt, Shigella flexneri 2a str. 301
ugcuugccagauacgaug

SEQ ID NO: 1956874 - RNA, 14 nt, Shigella flexneri 2a str. 301
ugcuuuuucgcgau

SEQ ID NO: 1956875 - RNA, 14 nt, Shigella flexneri 2a str. 301
uggaaacagugauu

SEQ ID NO: 1956876 - RNA, 20 nt, Shigella flexneri 2a str. 301
uggaauggucaaugguggca

SEQ ID NO: 1956877 - RNA, 23 nt, Shigella flexneri 2a str. 301
ugcuccggcgcgauaucgacgac

SEQ ID NO: 1956878 - RNA, 14 nt, Shigella flexneri 2a str. 301
ugcguucaauaccg

SEQ ID NO: 1956879 - RNA, 14 nt, Shigella flexneri 2a str. 301
ugcguuaaucgccg

SEQ ID NO: 1956880 - RNA, 17 nt, Shigella flexneri 2a str. 301
ugcucgcgagaacggcg

SEQ ID NO: 1956881 - RNA, 16 nt, Shigella flexneri 2a str. 301
ugcucgcaucagggaa

SEQ ID NO: 1956882 - RNA, 18 nt, Shigella flexneri 2a str. 301
ugcugcaauugcggcagg

SEQ ID NO: 1956883 - RNA, 17 nt, Shigella flexneri 2a str. 301
ugcugauguucgccaga

SEQ ID NO: 1956884 - RNA, 17 nt, Shigella flexneri 2a str. 301
ugcugacggugauaauc

SEQ ID NO: 1956885 - RNA, 11 nt, Shigella flexneri 2a str. 301
ugcugaggcug

SEQ ID NO: 1956886 - RNA, 23 nt, Shigella flexneri 2a str. 301
ugucuaacaugagguccagcgag

SEQ ID NO: 1956887 - RNA, 17 nt, Shigella flexneri 2a str. 301
ugucguuacgccgcaga

SEQ ID NO: 1956888 - RNA, 15 nt, Shigella flexneri 2a str. 301
ugucucagauucaga

SEQ ID NO: 1956889 - RNA, 13 nt, Shigella flexneri 2a str. 301
ugugacagcagcg

SEQ ID NO: 1956890 - RNA, 17 nt, Shigella flexneri 2a str. 301
ugugacgacaccaucuc

SEQ ID NO: 1956891 - RNA, 23 nt, Shigella flexneri 2a str. 301
ugugcagcgugaguaugauacgu

SEQ ID NO: 1956892 - RNA, 21 nt, Shigella flexneri 2a str. 301
ugucacuaugagguagccuga

SEQ ID NO: 1956893 - RNA, 19 nt, Shigella flexneri 2a str. 301
ugucgggcguuucgccagg

SEQ ID NO: 1956894 - RNA, 18 nt, Shigella flexneri 2a str. 301
ugucgggccgcacgcugu

SEQ ID NO: 1956895 - RNA, 23 nt, Shigella flexneri 2a str. 301
ugucaccgccaggugaaauccgg

SEQ ID NO: 1956896 - RNA, 20 nt, Shigella flexneri 2a str. 301
ugucaagauugauacgggga

SEQ ID NO: 1956897 - RNA, 23 nt, Shigella flexneri 2a str. 301
ugucaacuccaguuccgguacga

SEQ ID NO: 1956898 - RNA, 14 nt, Shigella flexneri 2a str. 301
ugugcugguacugg

SEQ ID NO: 1956899 - RNA, 16 nt, Shigella flexneri 2a str. 301
ugugcuggcaaaucag

SEQ ID NO: 1956900 - RNA, 21 nt, Shigella flexneri 2a str. 301
ugugcuaacucaucaccauca

SEQ ID NO: 1956901 - RNA, 15 nt, Shigella flexneri 2a str. 301
uguggaacgugcugc

SEQ ID NO: 1956902 - RNA, 17 nt, Shigella flexneri 2a str. 301
ugugcgagcaaagcgca

SEQ ID NO: 1956903 - RNA, 23 nt, Shigella flexneri 2a str. 301
ugugcgagcaaagcgcagccguc

SEQ ID NO: 1956904 - RNA, 22 nt, Shigella flexneri 2a str. 301
uguuauccaccgaaauaaucag

SEQ ID NO: 1956905 - RNA, 13 nt, Shigella flexneri 2a str. 301
uguucaauaucga

SEQ ID NO: 1956906 - RNA, 13 nt, Shigella flexneri 2a str. 301
uuacccagcagca

SEQ ID NO: 1956907 - RNA, 14 nt, Shigella flexneri 2a str. 301
uuacgaccagccga

SEQ ID NO: 1956908 - RNA, 13 nt, Shigella flexneri 2a str. 301
uuacccauucaag

SEQ ID NO: 1956909 - RNA, 20 nt, Shigella flexneri 2a str. 301
uuacgaucaagauugauccc

SEQ ID NO: 1956910 - RNA, 12 nt, Shigella flexneri 2a str. 301
uuacuaaaugug

SEQ ID NO: 1956911 - RNA, 17 nt, Shigella flexneri 2a str. 301
uuagcgaauuuuucgag

SEQ ID NO: 1956912 - RNA, 14 nt, Shigella flexneri 2a str. 301
uuagguucucucag

SEQ ID NO: 1956913 - RNA, 21 nt, Shigella flexneri 2a str. 301
uuagggugagggggcguucac

SEQ ID NO: 1956914 - RNA, 18 nt, Shigella flexneri 2a str. 301
uuaggcacaguagcccac

SEQ ID NO: 1956915 - RNA, 14 nt, Shigella flexneri 2a str. 301
uuaucacugugaug

SEQ ID NO: 1956916 - RNA, 17 nt, Shigella flexneri 2a str. 301
uuaucagguauugaucu

SEQ ID NO: 1956917 - RNA, 12 nt, Shigella flexneri 2a str. 301
uuacaucaucag

SEQ ID NO: 1956918 - RNA, 15 nt, Shigella flexneri 2a str. 301
uuaaucgagauaccu

SEQ ID NO: 1956919 - RNA, 14 nt, Shigella flexneri 2a str. 301
uuaauaaucucgcc

SEQ ID NO: 1956920 - RNA, 23 nt, Shigella flexneri 2a str. 301
uuaacaacacccggucagccauu

SEQ ID NO: 1956921 - RNA, 15 nt, Shigella flexneri 2a str. 301
uuaacauccaucgcc

SEQ ID NO: 1956922 - RNA, 15 nt, Shigella flexneri 2a str. 301
uguugcaucgccugc

SEQ ID NO: 1956923 - RNA, 19 nt, Shigella flexneri 2a str. 301
uguugccguuuaccgccau

SEQ ID NO: 1956924 - RNA, 10 nt, Shigella flexneri 2a str. 301
uucgucgcua

SEQ ID NO: 1956925 - RNA, 12 nt, Shigella flexneri 2a str. 301
uucuaaauguuc

SEQ ID NO: 1956926 - RNA, 18 nt, Shigella flexneri 2a str. 301
uucggcgucuuguugaac

SEQ ID NO: 1956927 - RNA, 23 nt, Shigella flexneri 2a str. 301
uucgggauggcguagcagcagcg

SEQ ID NO: 1956928 - RNA, 18 nt, Shigella flexneri 2a str. 301
uucuccucccuugucuga

SEQ ID NO: 1956929 - RNA, 19 nt, Shigella flexneri 2a str. 301
uucuccguguucgucacug

SEQ ID NO: 1956930 - RNA, 17 nt, Shigella flexneri 2a str. 301
uucugccgcuuccagca

SEQ ID NO: 1956931 - RNA, 22 nt, Shigella flexneri 2a str. 301
uucugcgacgcgcggugguacg

SEQ ID NO: 1956932 - RNA, 21 nt, Shigella flexneri 2a str. 301
uucucgcuccauuccaucgcc

SEQ ID NO: 1956933 - RNA, 19 nt, Shigella flexneri 2a str. 301
uucugccaguuugccgaac

SEQ ID NO: 1956934 - RNA, 13 nt, Shigella flexneri 2a str. 301
aaucagcagaacc

SEQ ID NO: 1956935 - RNA, 21 nt, Shigella flexneri 2a str. 301
uucuaccgucuguaaccagau

SEQ ID NO: 1956936 - RNA, 13 nt, Shigella flexneri 2a str. 301
aaucacugccaga

SEQ ID NO: 1956937 - RNA, 16 nt, Shigella flexneri 2a str. 301
uucgccgcacgcucaa

SEQ ID NO: 1956938 - RNA, 16 nt, Shigella flexneri 2a str. 301
uucgcgccaauccaga

SEQ ID NO: 1956939 - RNA, 13 nt, Shigella flexneri 2a str. 301
uucgcgcgggcag

SEQ ID NO: 1956940 - RNA, 18 nt, Shigella flexneri 2a str. 301
uucgcgccgcauccggca

SEQ ID NO: 1956941 - RNA, 18 nt, Shigella flexneri 2a str. 301
uucggcaaccgcauccag

SEQ ID NO: 1956942 - RNA, 13 nt, Shigella flexneri 2a str. 301
uucggcaauccag

SEQ ID NO: 1956943 - RNA, 21 nt, Shigella flexneri 2a str. 301
uucgcuuaccaugccaacgcg

SEQ ID NO: 1956944 - RNA, 16 nt, Shigella flexneri 2a str. 301
uucggacguuugccau

SEQ ID NO: 1956945 - RNA, 20 nt, Shigella flexneri 2a str. 301
uucggacauguuuuccagca

SEQ ID NO: 1956946 - RNA, 14 nt, Shigella flexneri 2a str. 301
uucgcuuucaucga

SEQ ID NO: 1956947 - RNA, 18 nt, Shigella flexneri 2a str. 301
uuccgcgcaaucgcccag

SEQ ID NO: 1956948 - RNA, 16 nt, Shigella flexneri 2a str. 301
uucgaagaaaccgaug

SEQ ID NO: 1956949 - RNA, 21 nt, Shigella flexneri 2a str. 301
uucgaaauccagacguuccgg

SEQ ID NO: 1956950 - RNA, 17 nt, Shigella flexneri 2a str. 301
uuccgcguuacccauuc

SEQ ID NO: 1956951 - RNA, 15 nt, Shigella flexneri 2a str. 301
uucgccacuccccac

SEQ ID NO: 1956952 - RNA, 9 nt, Shigella flexneri 2a str. 301
uucgccaga

SEQ ID NO: 1956953 - RNA, 19 nt, Shigella flexneri 2a str. 301
uucccagauagcaacagca

SEQ ID NO: 1956954 - RNA, 15 nt, Shigella flexneri 2a str. 301
uucccaacaacagcg

SEQ ID NO: 1956955 - RNA, 17 nt, Shigella flexneri 2a str. 301
uucccaauauugcaccu

SEQ ID NO: 1956956 - RNA, 15 nt, Shigella flexneri 2a str. 301
uucccugcgguaagu

SEQ ID NO: 1956957 - RNA, 14 nt, Shigella flexneri 2a str. 301
uuccauaucaagca

SEQ ID NO: 1956958 - RNA, 17 nt, Shigella flexneri 2a str. 301
uuccaucagauucagca

SEQ ID NO: 1956959 - RNA, 15 nt, Shigella flexneri 2a str. 301
uuccaggcaucagca

SEQ ID NO: 1956960 - RNA, 21 nt, Shigella flexneri 2a str. 301
uuccaggcuggucgcgcggaa

SEQ ID NO: 1956961 - RNA, 18 nt, Shigella flexneri 2a str. 301
uuccagcuccauccacca

SEQ ID NO: 1956962 - RNA, 22 nt, Shigella flexneri 2a str. 301
uuccaguucaauagcaccauua

SEQ ID NO: 1956963 - RNA, 12 nt, Shigella flexneri 2a str. 301
uuccaccgccgg

SEQ ID NO: 1956964 - RNA, 15 nt, Shigella flexneri 2a str. 301
uucauuuuggcgaau

SEQ ID NO: 1956965 - RNA, 15 nt, Shigella flexneri 2a str. 301
uuccagcaccaguuc

SEQ ID NO: 1956966 - RNA, 14 nt, Shigella flexneri 2a str. 301
uuccagcaucagca

SEQ ID NO: 1956967 - RNA, 17 nt, Shigella flexneri 2a str. 301
uuccagcaguuccagca

SEQ ID NO: 1956968 - RNA, 23 nt, Shigella flexneri 2a str. 301
uuccagcgcaaggaaauaacguu

SEQ ID NO: 1956969 - RNA, 16 nt, Shigella flexneri 2a str. 301
uuccagcaucgaccag

SEQ ID NO: 1956970 - RNA, 23 nt, Shigella flexneri 2a str. 301
uuccacgccguuuuuacccagca

SEQ ID NO: 1956971 - RNA, 21 nt, Shigella flexneri 2a str. 301
uucagauaaaucacgcuucac

SEQ ID NO: 1956972 - RNA, 23 nt, Shigella flexneri 2a str. 301
uucagaucgguuuuuuucgaacc

SEQ ID NO: 1956973 - RNA, 14 nt, Shigella flexneri 2a str. 301
uucagcgugcccac

SEQ ID NO: 1956974 - RNA, 21 nt, Shigella flexneri 2a str. 301
uucagcgucgugaaacgcguc

SEQ ID NO: 1956975 - RNA, 21 nt, Shigella flexneri 2a str. 301
uucacugccguacaggcagcu

SEQ ID NO: 1956976 - RNA, 12 nt, Shigella flexneri 2a str. 301
uucacugcccac

SEQ ID NO: 1956977 - RNA, 19 nt, Shigella flexneri 2a str. 301
uucacugccaccagcagcg

SEQ ID NO: 1956978 - RNA, 18 nt, Shigella flexneri 2a str. 301
uucacgcggguugccacc

SEQ ID NO: 1956979 - RNA, 22 nt, Shigella flexneri 2a str. 301
uucacgcauuuacacucgcccc

SEQ ID NO: 1956980 - RNA, 15 nt, Shigella flexneri 2a str. 301
uucacgccgggaaau

SEQ ID NO: 1956981 - RNA, 18 nt, Shigella flexneri 2a str. 301
uucacgcaggcgagaauc

SEQ ID NO: 1956982 - RNA, 23 nt, Shigella flexneri 2a str. 301
uucaccucugcggcaagaucgcg

SEQ ID NO: 1956983 - RNA, 22 nt, Shigella flexneri 2a str. 301
uucaugguacgggacagcaggu

SEQ ID NO: 1956984 - RNA, 15 nt, Shigella flexneri 2a str. 301
uucaugccauccgca

SEQ ID NO: 1956985 - RNA, 15 nt, Shigella flexneri 2a str. 301
uucaugaguuccacu

SEQ ID NO: 1956986 - RNA, 18 nt, Shigella flexneri 2a str. 301
uucaucuucauccggcug

SEQ ID NO: 1956987 - RNA, 19 nt, Shigella flexneri 2a str. 301
uucaucgcggucagcugcu

SEQ ID NO: 1956988 - RNA, 22 nt, Shigella flexneri 2a str. 301
uucaggcgugauucauacagcg

SEQ ID NO: 1956989 - RNA, 17 nt, Shigella flexneri 2a str. 301
uucagggccgauauagc

SEQ ID NO: 1956990 - RNA, 11 nt, Shigella flexneri 2a str. 301
uucauccagca

SEQ ID NO: 1956991 - RNA, 23 nt, Shigella flexneri 2a str. 301
uucaucacugaauuucgccgcac

SEQ ID NO: 1956992 - RNA, 22 nt, Shigella flexneri 2a str. 301
uucauauuauuugcuaucgcga

SEQ ID NO: 1956993 - RNA, 16 nt, Shigella flexneri 2a str. 301
uuugcuaucgggaaua

SEQ ID NO: 1956994 - RNA, 20 nt, Shigella flexneri 2a str. 301
uuugcgucauaccgcaucuu

SEQ ID NO: 1956995 - RNA, 13 nt, Shigella flexneri 2a str. 301
uuuggccgcgcca

SEQ ID NO: 1956996 - RNA, 14 nt, Shigella flexneri 2a str. 301
uuugugucagcgcc

SEQ ID NO: 1956997 - RNA, 13 nt, Shigella flexneri 2a str. 301
uuuuaaucgccau

SEQ ID NO: 1956998 - RNA, 20 nt, Shigella flexneri 2a str. 301
uuuguccaccaauagcccau

SEQ ID NO: 1956999 - RNA, 15 nt, Shigella flexneri 2a str. 301
uuuguaggccggaua

SEQ ID NO: 1957000 - RNA, 15 nt, Shigella flexneri 2a str. 301
uuuguacuccagcag

SEQ ID NO: 1957001 - RNA, 12 nt, Shigella flexneri 2a str. 301
uuugauccagcc

SEQ ID NO: 1957002 - RNA, 20 nt, Shigella flexneri 2a str. 301
uuugaaaauaacaucgccag

SEQ ID NO: 1957003 - RNA, 14 nt, Shigella flexneri 2a str. 301
uuuaccgucaccga

SEQ ID NO: 1957004 - RNA, 14 nt, Shigella flexneri 2a str. 301
uuuacccuacacca

SEQ ID NO: 1957005 - RNA, 23 nt, Shigella flexneri 2a str. 301
uuuccgccaccugauccaucguc

SEQ ID NO: 1957006 - RNA, 21 nt, Shigella flexneri 2a str. 301
uuuccaucauuagugugauca

SEQ ID NO: 1957007 - RNA, 16 nt, Shigella flexneri 2a str. 301
uuucuuccagcgccau

SEQ ID NO: 1957008 - RNA, 23 nt, Shigella flexneri 2a str. 301
uuuccggaucgccaaagcggcag

SEQ ID NO: 1957009 - RNA, 22 nt, Shigella flexneri 2a str. 301
uuucgccggacgucaggccgcc

SEQ ID NO: 1957010 - RNA, 18 nt, Shigella flexneri 2a str. 301
uuucggaaagaucgccac

SEQ ID NO: 1957011 - RNA, 17 nt, Shigella flexneri 2a str. 301
uuucgcuuuaucgccua

SEQ ID NO: 1957012 - RNA, 19 nt, Shigella flexneri 2a str. 301
uuucggugaauucagcgac

SEQ ID NO: 1957013 - RNA, 21 nt, Shigella flexneri 2a str. 301
aauguacucuuuauugcaaac

SEQ ID NO: 1957014 - RNA, 20 nt, Shigella flexneri 2a str. 301
aaugucagaugcggcgugaa

SEQ ID NO: 1957015 - RNA, 16 nt, Shigella flexneri 2a str. 301
aauguccuggcgggaa

SEQ ID NO: 1957016 - RNA, 20 nt, Shigella flexneri 2a str. 301
aauggcgauuuuugauaauu

SEQ ID NO: 1957017 - RNA, 17 nt, Shigella flexneri 2a str. 301
aauggcuuuacgcgcca

SEQ ID NO: 1957018 - RNA, 14 nt, Shigella flexneri 2a str. 301
aaugggaucgaaag

SEQ ID NO: 1957019 - RNA, 21 nt, Shigella flexneri 2a str. 301
aauggguuguacuucgcuuca

SEQ ID NO: 1957020 - RNA, 20 nt, Shigella flexneri 2a str. 301
aaugcgcuccucgccguuaa

SEQ ID NO: 1957021 - RNA, 20 nt, Shigella flexneri 2a str. 301
aaugcgcccagcgucagcau

SEQ ID NO: 1957022 - RNA, 17 nt, Shigella flexneri 2a str. 301
aaugcguggcgcguacc

SEQ ID NO: 1957023 - RNA, 22 nt, Shigella flexneri 2a str. 301
aaugacuccaacuuacugauag

SEQ ID NO: 1957024 - RNA, 16 nt, Shigella flexneri 2a str. 301
aaugacugauugccga

SEQ ID NO: 1957025 - RNA, 15 nt, Shigella flexneri 2a str. 301
aaucggcgaucccau

SEQ ID NO: 1957026 - RNA, 14 nt, Shigella flexneri 2a str. 301
aaucggcugaacgu

SEQ ID NO: 1957027 - RNA, 18 nt, Shigella flexneri 2a str. 301
aaucggcugaacgugcuc

SEQ ID NO: 1957028 - RNA, 17 nt, Shigella flexneri 2a str. 301
aaucgcuacugauaaua

SEQ ID NO: 1957029 - RNA, 17 nt, Shigella flexneri 2a str. 301
uuuuacuccacuuccug

SEQ ID NO: 1957030 - RNA, 17 nt, Shigella flexneri 2a str. 301
aaucggugcaaaugcca

SEQ ID NO: 1957031 - RNA, 18 nt, Shigella flexneri 2a str. 301
aaucgucgguuccguuca

SEQ ID NO: 1957032 - RNA, 21 nt, Shigella flexneri 2a str. 301
uuuuucugcacuacgcaggga

SEQ ID NO: 1957033 - RNA, 19 nt, Shigella flexneri 2a str. 301
uuuuugcgcgaagaaacga

SEQ ID NO: 1957034 - RNA, 18 nt, Shigella flexneri 2a str. 301
uuuuugucugcuauuuac

SEQ ID NO: 1957035 - RNA, 22 nt, Shigella flexneri 2a str. 301
aaugaaagaagcuuuccacgca

SEQ ID NO: 1957036 - RNA, 16 nt, Shigella flexneri 2a str. 301
uugauguccaguuccc

SEQ ID NO: 1957037 - RNA, 16 nt, Shigella flexneri 2a str. 301
uugauuaauugcaacg

SEQ ID NO: 1957038 - RNA, 20 nt, Shigella flexneri 2a str. 301
uugauuacacaaauccagca

SEQ ID NO: 1957039 - RNA, 15 nt, Shigella flexneri 2a str. 301
uucuucgaagcacuc

SEQ ID NO: 1957040 - RNA, 14 nt, Shigella flexneri 2a str. 301
uucuggcggcggug

SEQ ID NO: 1957041 - RNA, 20 nt, Shigella flexneri 2a str. 301
uucuggugcgagaucgccaa

SEQ ID NO: 1957042 - RNA, 22 nt, Shigella flexneri 2a str. 301
uucugugauuccgccaguugcg

SEQ ID NO: 1957043 - RNA, 21 nt, Shigella flexneri 2a str. 301
uugcaauaauggaaccuaacg

SEQ ID NO: 1957044 - RNA, 22 nt, Shigella flexneri 2a str. 301
uugcagaggugcugaaagggca

SEQ ID NO: 1957045 - RNA, 21 nt, Shigella flexneri 2a str. 301
aaucagguacuguaacgcuac

SEQ ID NO: 1957046 - RNA, 17 nt, Shigella flexneri 2a str. 301
uugccggaugugaugca

SEQ ID NO: 1957047 - RNA, 24 nt, Shigella flexneri 2a str. 301
uugccggaugcaugauccggcauc

SEQ ID NO: 1957048 - RNA, 15 nt, Shigella flexneri 2a str. 301
uugcgcaguaccagc

SEQ ID NO: 1957049 - RNA, 18 nt, Shigella flexneri 2a str. 301
uugccguuuaccgccauc

SEQ ID NO: 1957050 - RNA, 14 nt, Shigella flexneri 2a str. 301
uugccugaucgcgc

SEQ ID NO: 1957051 - RNA, 13 nt, Shigella flexneri 2a str. 301
uugccugaugcgc

SEQ ID NO: 1957052 - RNA, 15 nt, Shigella flexneri 2a str. 301
uugccguaccacgcc

SEQ ID NO: 1957053 - RNA, 16 nt, Shigella flexneri 2a str. 301
uugccauguugauccc

SEQ ID NO: 1957054 - RNA, 21 nt, Shigella flexneri 2a str. 301
uugccauuucugcugccacuu

SEQ ID NO: 1957055 - RNA, 19 nt, Shigella flexneri 2a str. 301
uugccccagcgggaucggc

SEQ ID NO: 1957056 - RNA, 17 nt, Shigella flexneri 2a str. 301
uugcccgguuucgccac

SEQ ID NO: 1957057 - RNA, 17 nt, Shigella flexneri 2a str. 301
uugccagcaugacuacc

SEQ ID NO: 1957058 - RNA, 11 nt, Shigella flexneri 2a str. 301
uugccagccgu

SEQ ID NO: 1957059 - RNA, 13 nt, Shigella flexneri 2a str. 301
uugccagaucgcc

SEQ ID NO: 1957060 - RNA, 21 nt, Shigella flexneri 2a str. 301
aaucaugguuuauuucccaga

SEQ ID NO: 1957061 - RNA, 12 nt, Shigella flexneri 2a str. 301
aaucauccgcuc

SEQ ID NO: 1957062 - RNA, 22 nt, Shigella flexneri 2a str. 301
uugugauuaaacuucaccagca

SEQ ID NO: 1957063 - RNA, 11 nt, Shigella flexneri 2a str. 301
uugugauucga

SEQ ID NO: 1957064 - RNA, 19 nt, Shigella flexneri 2a str. 301
uugugcgccacauccggca

SEQ ID NO: 1957065 - RNA, 23 nt, Shigella flexneri 2a str. 301
uugucaugcagcuccaccgauuu

SEQ ID NO: 1957066 - RNA, 21 nt, Shigella flexneri 2a str. 301
uuguaagccggaucggaggca

SEQ ID NO: 1957067 - RNA, 21 nt, Shigella flexneri 2a str. 301
uugguugcgcuucuuccagca

SEQ ID NO: 1957068 - RNA, 16 nt, Shigella flexneri 2a str. 301
aaucgauaaaacuucc

SEQ ID NO: 1957069 - RNA, 13 nt, Shigella flexneri 2a str. 301
aaucgauaaacca

SEQ ID NO: 1957070 - RNA, 22 nt, Shigella flexneri 2a str. 301
uugucagcaaucugauugacau

SEQ ID NO: 1957071 - RNA, 23 nt, Shigella flexneri 2a str. 301
uugucaccgccaggugaaauccg

SEQ ID NO: 1957072 - RNA, 20 nt, Shigella flexneri 2a str. 301
aaucgacggggugcgguaaa

SEQ ID NO: 1957073 - RNA, 20 nt, Shigella flexneri 2a str. 301
aaucgcacguugucagcaac

SEQ ID NO: 1957074 - RNA, 16 nt, Shigella flexneri 2a str. 301
aaucgcaguagcgggc

SEQ ID NO: 1957075 - RNA, 19 nt, Shigella flexneri 2a str. 301
aaucgcacguugucagcaa

SEQ ID NO: 1957076 - RNA, 18 nt, Shigella flexneri 2a str. 301
aaucgaucucaaugagcc

SEQ ID NO: 1957077 - RNA, 19 nt, Shigella flexneri 2a str. 301
aaucccuuucucuucaaac

SEQ ID NO: 1957078 - RNA, 19 nt, Shigella flexneri 2a str. 301
aaucccugcuucggucaga

SEQ ID NO: 1957079 - RNA, 17 nt, Shigella flexneri 2a str. 301
aauccggaaacgcucac

SEQ ID NO: 1957080 - RNA, 13 nt, Shigella flexneri 2a str. 301
uuggguaacagcc

SEQ ID NO: 1957081 - RNA, 20 nt, Shigella flexneri 2a str. 301
uuggcgcucugacaccauca

SEQ ID NO: 1957082 - RNA, 15 nt, Shigella flexneri 2a str. 301
uuggcacccagcgcu

SEQ ID NO: 1957083 - RNA, 22 nt, Shigella flexneri 2a str. 301
aauccccucuucagccgcaaac

SEQ ID NO: 1957084 - RNA, 16 nt, Shigella flexneri 2a str. 301
aauccccuccagcgag

SEQ ID NO: 1957085 - RNA, 15 nt, Shigella flexneri 2a str. 301
uugcgccugcuuaac

SEQ ID NO: 1957086 - RNA, 14 nt, Shigella flexneri 2a str. 301
aauccacagcaaug

SEQ ID NO: 1957087 - RNA, 23 nt, Shigella flexneri 2a str. 301
aauccagggaucaacauucagau

SEQ ID NO: 1957088 - RNA, 23 nt, Shigella flexneri 2a str. 301
aauccaggggagcugauucagau

SEQ ID NO: 1957089 - RNA, 16 nt, Shigella flexneri 2a str. 301
aauccauaccagcaca

SEQ ID NO: 1957090 - RNA, 19 nt, Shigella flexneri 2a str. 301
acgcuuguacggcuccgcc

SEQ ID NO: 1957091 - RNA, 22 nt, Shigella flexneri 2a str. 301
acgcuugcugauaacgugcagc

SEQ ID NO: 1957092 - RNA, 18 nt, Shigella flexneri 2a str. 301
acggcagagaucgccgcu

SEQ ID NO: 1957093 - RNA, 11 nt, Shigella flexneri 2a str. 301
acggaugcagc

SEQ ID NO: 1957094 - RNA, 19 nt, Shigella flexneri 2a str. 301
acgcggcagcgucgcauca

SEQ ID NO: 1957095 - RNA, 20 nt, Shigella flexneri 2a str. 301
acgcgcuagcuucagguguu

SEQ ID NO: 1957096 - RNA, 22 nt, Shigella flexneri 2a str. 301
acgcuggcagcaagugcggcgc

SEQ ID NO: 1957097 - RNA, 20 nt, Shigella flexneri 2a str. 301
acgcuguuguuuuuucaacc

SEQ ID NO: 1957098 - RNA, 19 nt, Shigella flexneri 2a str. 301
acggcauuuccgccaauca

SEQ ID NO: 1957099 - RNA, 21 nt, Shigella flexneri 2a str. 301
acggcauucugcacauuauca

SEQ ID NO: 1957100 - RNA, 17 nt, Shigella flexneri 2a str. 301
acggcauuuaguggauc

SEQ ID NO: 1957101 - RNA, 16 nt, Shigella flexneri 2a str. 301
acggcauuuccgccaa

SEQ ID NO: 1957102 - RNA, 15 nt, Shigella flexneri 2a str. 301
acggcauucugcaca

SEQ ID NO: 1957103 - RNA, 14 nt, Shigella flexneri 2a str. 301
acggcaucguccau

SEQ ID NO: 1957104 - RNA, 14 nt, Shigella flexneri 2a str. 301
acggcgcagcuuca

SEQ ID NO: 1957105 - RNA, 17 nt, Shigella flexneri 2a str. 301
acggcgagccagcgcau

SEQ ID NO: 1957106 - RNA, 14 nt, Shigella flexneri 2a str. 301
acggguucaagucc

SEQ ID NO: 1957107 - RNA, 18 nt, Shigella flexneri 2a str. 301
acgggcgaggaaauugcg

SEQ ID NO: 1957108 - RNA, 22 nt, Shigella flexneri 2a str. 301
acgucgcuuuauagguggcaaa

SEQ ID NO: 1957109 - RNA, 18 nt, Shigella flexneri 2a str. 301
acgucaucaccggcuucu

SEQ ID NO: 1957110 - RNA, 18 nt, Shigella flexneri 2a str. 301
acguagugaaaucgccaa

SEQ ID NO: 1957111 - RNA, 17 nt, Shigella flexneri 2a str. 301
acgguaucuuuccagcc

SEQ ID NO: 1957112 - RNA, 15 nt, Shigella flexneri 2a str. 301
acguucauggcgcga

SEQ ID NO: 1957113 - RNA, 14 nt, Shigella flexneri 2a str. 301
acguucgcccacuu

SEQ ID NO: 1957114 - RNA, 19 nt, Shigella flexneri 2a str. 301
acgucguuccccauuaccu

SEQ ID NO: 1957115 - RNA, 15 nt, Shigella flexneri 2a str. 301
acguugucgccgcug

SEQ ID NO: 1957116 - RNA, 17 nt, Shigella flexneri 2a str. 301
acguuuauucccgcgaa

SEQ ID NO: 1957117 - RNA, 14 nt, Shigella flexneri 2a str. 301
acguuggcgcauaa

SEQ ID NO: 1957118 - RNA, 21 nt, Shigella flexneri 2a str. 301
acguucugucuccggcaucca

SEQ ID NO: 1957119 - RNA, 19 nt, Shigella flexneri 2a str. 301
acguugcuucaugccggau

SEQ ID NO: 1957120 - RNA, 22 nt, Shigella flexneri 2a str. 301
acguugcuucucuugcuggauu

SEQ ID NO: 1957121 - RNA, 22 nt, Shigella flexneri 2a str. 301
acguuuuuuacucuuguggcca

SEQ ID NO: 1957122 - RNA, 15 nt, Shigella flexneri 2a str. 301
acguuugccaugcau

SEQ ID NO: 1957123 - RNA, 23 nt, Shigella flexneri 2a str. 301
acucuucugaaaaggucacuccc

SEQ ID NO: 1957124 - RNA, 19 nt, Shigella flexneri 2a str. 301
acucuuucagcaccagccc

SEQ ID NO: 1957125 - RNA, 18 nt, Shigella flexneri 2a str. 301
acucuuuuuccugcugca

SEQ ID NO: 1957126 - RNA, 12 nt, Shigella flexneri 2a str. 301
acugaauacgcu

SEQ ID NO: 1957127 - RNA, 17 nt, Shigella flexneri 2a str. 301
acucuuccccgcuucag

SEQ ID NO: 1957128 - RNA, 19 nt, Shigella flexneri 2a str. 301
acugccggacguucgccca

SEQ ID NO: 1957129 - RNA, 15 nt, Shigella flexneri 2a str. 301
acugccggaugcggc

SEQ ID NO: 1957130 - RNA, 20 nt, Shigella flexneri 2a str. 301
acugccggaugcggcgugaa

SEQ ID NO: 1957131 - RNA, 18 nt, Shigella flexneri 2a str. 301
acugcgccagcgucauca

SEQ ID NO: 1957132 - RNA, 18 nt, Shigella flexneri 2a str. 301
acugcgccaucaaugccg

SEQ ID NO: 1957133 - RNA, 15 nt, Shigella flexneri 2a str. 301
acugcgccgaagcgc

SEQ ID NO: 1957134 - RNA, 18 nt, Shigella flexneri 2a str. 301
acugcuccuguaugaccc

SEQ ID NO: 1957135 - RNA, 13 nt, Shigella flexneri 2a str. 301
acugcgacgcggc

SEQ ID NO: 1957136 - RNA, 23 nt, Shigella flexneri 2a str. 301
acugauuaacaggcggcuaugcu

SEQ ID NO: 1957137 - RNA, 18 nt, Shigella flexneri 2a str. 301
acucgauaauaaagcggc

SEQ ID NO: 1957138 - RNA, 21 nt, Shigella flexneri 2a str. 301
acuccuuucugagcaucacau

SEQ ID NO: 1957139 - RNA, 12 nt, Shigella flexneri 2a str. 301
acuccagcagac

SEQ ID NO: 1957140 - RNA, 13 nt, Shigella flexneri 2a str. 301
acuaucaucgccg

SEQ ID NO: 1957141 - RNA, 16 nt, Shigella flexneri 2a str. 301
acucaugggucugcgg

SEQ ID NO: 1957142 - RNA, 15 nt, Shigella flexneri 2a str. 301
accugaaucgucaga

SEQ ID NO: 1957143 - RNA, 22 nt, Shigella flexneri 2a str. 301
accugcacgaaaccacugcaac

SEQ ID NO: 1957144 - RNA, 22 nt, Shigella flexneri 2a str. 301
accugcaaauucaauaaauugc

SEQ ID NO: 1957145 - RNA, 20 nt, Shigella flexneri 2a str. 301
accugcaguucaucaacgcc

SEQ ID NO: 1957146 - RNA, 14 nt, Shigella flexneri 2a str. 301
accugccuggcagu

SEQ ID NO: 1957147 - RNA, 20 nt, Shigella flexneri 2a str. 301
accugcgcaggcauucagau

SEQ ID NO: 1957148 - RNA, 15 nt, Shigella flexneri 2a str. 301
accuccacgcccagc

SEQ ID NO: 1957149 - RNA, 11 nt, Shigella flexneri 2a str. 301
accucaccgcu

SEQ ID NO: 1957150 - RNA, 23 nt, Shigella flexneri 2a str. 301
accucgccccgugaugaacugcg

SEQ ID NO: 1957151 - RNA, 14 nt, Shigella flexneri 2a str. 301
accuccagcaucag

SEQ ID NO: 1957152 - RNA, 15 nt, Shigella flexneri 2a str. 301
accugcggugcagcc

SEQ ID NO: 1957153 - RNA, 19 nt, Shigella flexneri 2a str. 301
accugcggcaccagcggua

SEQ ID NO: 1957154 - RNA, 21 nt, Shigella flexneri 2a str. 301
acgaccgcuuuugucggcacu

SEQ ID NO: 1957155 - RNA, 15 nt, Shigella flexneri 2a str. 301
acgaaucccgcgauu

SEQ ID NO: 1957156 - RNA, 19 nt, Shigella flexneri 2a str. 301
acgcgcagcgucgcaucag

SEQ ID NO: 1957157 - RNA, 15 nt, Shigella flexneri 2a str. 301
acgcgcaauacaggu

SEQ ID NO: 1957158 - RNA, 20 nt, Shigella flexneri 2a str. 301
acgccuuauccggccuacca

SEQ ID NO: 1957159 - RNA, 20 nt, Shigella flexneri 2a str. 301
acgccuuauccgaccuacaa

SEQ ID NO: 1957160 - RNA, 14 nt, Shigella flexneri 2a str. 301
acgcgaggcgcuaa

SEQ ID NO: 1957161 - RNA, 18 nt, Shigella flexneri 2a str. 301
acgccuucuuccagcgca

SEQ ID NO: 1957162 - RNA, 17 nt, Shigella flexneri 2a str. 301
acgccgcauccggcauu

SEQ ID NO: 1957163 - RNA, 14 nt, Shigella flexneri 2a str. 301
acgccgccagacca

SEQ ID NO: 1957164 - RNA, 11 nt, Shigella flexneri 2a str. 301
acgccgccaga

SEQ ID NO: 1957165 - RNA, 17 nt, Shigella flexneri 2a str. 301
acgccgcauccggcaau

SEQ ID NO: 1957166 - RNA, 22 nt, Shigella flexneri 2a str. 301
acgccgagacguuuugccaguu

SEQ ID NO: 1957167 - RNA, 18 nt, Shigella flexneri 2a str. 301
acgccgacgcccugcgcu

SEQ ID NO: 1957168 - RNA, 19 nt, Shigella flexneri 2a str. 301
acgccgaaugccggguaau

SEQ ID NO: 1957169 - RNA, 21 nt, Shigella flexneri 2a str. 301
acgccggaugaaaucaccgcu

SEQ ID NO: 1957170 - RNA, 16 nt, Shigella flexneri 2a str. 301
acgaugaccgcaucaa

SEQ ID NO: 1957171 - RNA, 17 nt, Shigella flexneri 2a str. 301
acgaucuucggcgucag

SEQ ID NO: 1957172 - RNA, 12 nt, Shigella flexneri 2a str. 301
acgauggcgcgc

SEQ ID NO: 1957173 - RNA, 16 nt, Shigella flexneri 2a str. 301
acgauguaggccugau

SEQ ID NO: 1957174 - RNA, 13 nt, Shigella flexneri 2a str. 301
acgaugucaauca

SEQ ID NO: 1957175 - RNA, 18 nt, Shigella flexneri 2a str. 301
acgauucggcaaucacca

SEQ ID NO: 1957176 - RNA, 18 nt, Shigella flexneri 2a str. 301
acgcaauaaacaugauga

SEQ ID NO: 1957177 - RNA, 22 nt, Shigella flexneri 2a str. 301
acgcaaucaaauaccaccagcg

SEQ ID NO: 1957178 - RNA, 14 nt, Shigella flexneri 2a str. 301
acgcagacuggauu

SEQ ID NO: 1957179 - RNA, 22 nt, Shigella flexneri 2a str. 301
acgcagaaucuucuucucagcc

SEQ ID NO: 1957180 - RNA, 22 nt, Shigella flexneri 2a str. 301
acgcaccaauagccgcgccgag

SEQ ID NO: 1957181 - RNA, 22 nt, Shigella flexneri 2a str. 301
acgcaggucgucuuuuacagcg

SEQ ID NO: 1957182 - RNA, 14 nt, Shigella flexneri 2a str. 301
acgcccacggcgug

SEQ ID NO: 1957183 - RNA, 21 nt, Shigella flexneri 2a str. 301
acgcauccgcuggcccaucag

SEQ ID NO: 1957184 - RNA, 21 nt, Shigella flexneri 2a str. 301
acgcauccgaucgcgcaucag

SEQ ID NO: 1957185 - RNA, 16 nt, Shigella flexneri 2a str. 301
acgccaaucugcaaaa

SEQ ID NO: 1957186 - RNA, 19 nt, Shigella flexneri 2a str. 301
acgccacaauacugaucau

SEQ ID NO: 1957187 - RNA, 20 nt, Shigella flexneri 2a str. 301
acgccacaauacugaucauc

SEQ ID NO: 1957188 - RNA, 14 nt, Shigella flexneri 2a str. 301
acgcaguuaacgcg

SEQ ID NO: 1957189 - RNA, 17 nt, Shigella flexneri 2a str. 301
acgcaguuccgccagcu

SEQ ID NO: 1957190 - RNA, 19 nt, Shigella flexneri 2a str. 301
acgcagucucucuccguua

SEQ ID NO: 1957191 - RNA, 19 nt, Shigella flexneri 2a str. 301
acgccaauuacgcgcaaua

SEQ ID NO: 1957192 - RNA, 12 nt, Shigella flexneri 2a str. 301
acagcagcaacg

SEQ ID NO: 1957193 - RNA, 13 nt, Shigella flexneri 2a str. 301
acagccagcagcg

SEQ ID NO: 1957194 - RNA, 23 nt, Shigella flexneri 2a str. 301
acacugguucccaacaacagcgc

SEQ ID NO: 1957195 - RNA, 21 nt, Shigella flexneri 2a str. 301
acacuguaagccaccgaacaa

SEQ ID NO: 1957196 - RNA, 13 nt, Shigella flexneri 2a str. 301
acacuuagccugu

SEQ ID NO: 1957197 - RNA, 19 nt, Shigella flexneri 2a str. 301
acacucggcgucaaacggc

SEQ ID NO: 1957198 - RNA, 19 nt, Shigella flexneri 2a str. 301
acacucugaccugccgcag

SEQ ID NO: 1957199 - RNA, 17 nt, Shigella flexneri 2a str. 301
acacuccagucccaguu

SEQ ID NO: 1957200 - RNA, 19 nt, Shigella flexneri 2a str. 301
acagcgagggccguauuga

SEQ ID NO: 1957201 - RNA, 18 nt, Shigella flexneri 2a str. 301
acagcgacagacgacgac

SEQ ID NO: 1957202 - RNA, 22 nt, Shigella flexneri 2a str. 301
acagccuaccagaccgcacacc

SEQ ID NO: 1957203 - RNA, 20 nt, Shigella flexneri 2a str. 301
acagccucuuuuuucagugc

SEQ ID NO: 1957204 - RNA, 20 nt, Shigella flexneri 2a str. 301
acacaggaugggcauauuug

SEQ ID NO: 1957205 - RNA, 16 nt, Shigella flexneri 2a str. 301
acaccgcccaacagac

SEQ ID NO: 1957206 - RNA, 12 nt, Shigella flexneri 2a str. 301
acaccgcgacgg

SEQ ID NO: 1957207 - RNA, 12 nt, Shigella flexneri 2a str. 301
acaccgcgugag

SEQ ID NO: 1957208 - RNA, 15 nt, Shigella flexneri 2a str. 301
acacgagucauuccg

SEQ ID NO: 1957209 - RNA, 24 nt, Shigella flexneri 2a str. 301
acaccgguagagauuaacgucacu

SEQ ID NO: 1957210 - RNA, 19 nt, Shigella flexneri 2a str. 301
acacgcuucaaguucagca

SEQ ID NO: 1957211 - RNA, 17 nt, Shigella flexneri 2a str. 301
acaacaucaucugccac

SEQ ID NO: 1957212 - RNA, 13 nt, Shigella flexneri 2a str. 301
acaacaucaucug

SEQ ID NO: 1957213 - RNA, 13 nt, Shigella flexneri 2a str. 301
acaaccacuuugu

SEQ ID NO: 1957214 - RNA, 18 nt, Shigella flexneri 2a str. 301
acaacccaagcgcgcugu

SEQ ID NO: 1957215 - RNA, 13 nt, Shigella flexneri 2a str. 301
acaaccaucccca

SEQ ID NO: 1957216 - RNA, 22 nt, Shigella flexneri 2a str. 301
aauguggcaaugaguggugaaa

SEQ ID NO: 1957217 - RNA, 21 nt, Shigella flexneri 2a str. 301
aaugugcuccauuguuagcaa

SEQ ID NO: 1957218 - RNA, 18 nt, Shigella flexneri 2a str. 301
aauguguaaucaggcaau

SEQ ID NO: 1957219 - RNA, 16 nt, Shigella flexneri 2a str. 301
acaaacuuaccgccgc

SEQ ID NO: 1957220 - RNA, 21 nt, Shigella flexneri 2a str. 301
acaaaacagcgaguucaggcg

SEQ ID NO: 1957221 - RNA, 16 nt, Shigella flexneri 2a str. 301
acaaaacccuccguua

SEQ ID NO: 1957222 - RNA, 13 nt, Shigella flexneri 2a str. 301
acaaaaccugccg

SEQ ID NO: 1957223 - RNA, 22 nt, Shigella flexneri 2a str. 301
acaaaaaaaacagcgcccaaca

SEQ ID NO: 1957224 - RNA, 14 nt, Shigella flexneri 2a str. 301
acaaaaauagcccc

SEQ ID NO: 1957225 - RNA, 23 nt, Shigella flexneri 2a str. 301
acaaguccgggauuaucccgcag

SEQ ID NO: 1957226 - RNA, 15 nt, Shigella flexneri 2a str. 301
acaagcuaccagccc

SEQ ID NO: 1957227 - RNA, 19 nt, Shigella flexneri 2a str. 301
acaagcgauaacucgcuuu

SEQ ID NO: 1957228 - RNA, 17 nt, Shigella flexneri 2a str. 301
acaagcgucgcaucagg

SEQ ID NO: 1957229 - RNA, 14 nt, Shigella flexneri 2a str. 301
acaagcguuagcgu

SEQ ID NO: 1957230 - RNA, 22 nt, Shigella flexneri 2a str. 301
acaacucgcuuaagccaucauc

SEQ ID NO: 1957231 - RNA, 21 nt, Shigella flexneri 2a str. 301
acaacucggcggcuuaaccgu

SEQ ID NO: 1957232 - RNA, 16 nt, Shigella flexneri 2a str. 301
acaauugagauucaaa

SEQ ID NO: 1957233 - RNA, 12 nt, Shigella flexneri 2a str. 301
acaaugccugau

SEQ ID NO: 1957234 - RNA, 20 nt, Shigella flexneri 2a str. 301
acaaugccugaugcgacgcu

SEQ ID NO: 1957235 - RNA, 22 nt, Shigella flexneri 2a str. 301
acaauacgucggcaucgggcag

SEQ ID NO: 1957236 - RNA, 20 nt, Shigella flexneri 2a str. 301
acaaucuggugguaaucgac

SEQ ID NO: 1957237 - RNA, 18 nt, Shigella flexneri 2a str. 301
accaauaucaacguaaug

SEQ ID NO: 1957238 - RNA, 18 nt, Shigella flexneri 2a str. 301
accaacaauugucgccac

SEQ ID NO: 1957239 - RNA, 14 nt, Shigella flexneri 2a str. 301
acauucuccggcag

SEQ ID NO: 1957240 - RNA, 23 nt, Shigella flexneri 2a str. 301
acauugccaccaccagcguaccg

SEQ ID NO: 1957241 - RNA, 20 nt, Shigella flexneri 2a str. 301
acauuuaaacaauuucagaa

SEQ ID NO: 1957242 - RNA, 20 nt, Shigella flexneri 2a str. 301
acauuguuauucuccuucac

SEQ ID NO: 1957243 - RNA, 19 nt, Shigella flexneri 2a str. 301
acauuucugcugccuacac

SEQ ID NO: 1957244 - RNA, 15 nt, Shigella flexneri 2a str. 301
acaugacgcgcauca

SEQ ID NO: 1957245 - RNA, 17 nt, Shigella flexneri 2a str. 301
acaugacuaaucugaca

SEQ ID NO: 1957246 - RNA, 19 nt, Shigella flexneri 2a str. 301
acaugcaaaccaucaccau

SEQ ID NO: 1957247 - RNA, 20 nt, Shigella flexneri 2a str. 301
acaugcaaaccaucaccauc

SEQ ID NO: 1957248 - RNA, 24 nt, Shigella flexneri 2a str. 301
acaucucaacaacuuuaccgcuca

SEQ ID NO: 1957249 - RNA, 21 nt, Shigella flexneri 2a str. 301
acauacugcuccauaauugcc

SEQ ID NO: 1957250 - RNA, 19 nt, Shigella flexneri 2a str. 301
acauagaaacucauaugca

SEQ ID NO: 1957251 - RNA, 18 nt, Shigella flexneri 2a str. 301
acauccguggguugccag

SEQ ID NO: 1957252 - RNA, 11 nt, Shigella flexneri 2a str. 301
acauccggcuu

SEQ ID NO: 1957253 - RNA, 17 nt, Shigella flexneri 2a str. 301
acauccggcaauauuca

SEQ ID NO: 1957254 - RNA, 11 nt, Shigella flexneri 2a str. 301
acauccggcaa

SEQ ID NO: 1957255 - RNA, 14 nt, Shigella flexneri 2a str. 301
acaucuaccgccag

SEQ ID NO: 1957256 - RNA, 22 nt, Shigella flexneri 2a str. 301
acaguuuuaucuccauccggga

SEQ ID NO: 1957257 - RNA, 15 nt, Shigella flexneri 2a str. 301
acagugcaccggaca

SEQ ID NO: 1957258 - RNA, 17 nt, Shigella flexneri 2a str. 301
acaguuccgcaaagccc

SEQ ID NO: 1957259 - RNA, 18 nt, Shigella flexneri 2a str. 301
acaguacguguuguucca

SEQ ID NO: 1957260 - RNA, 15 nt, Shigella flexneri 2a str. 301
acagucgcucggcga

SEQ ID NO: 1957261 - RNA, 14 nt, Shigella flexneri 2a str. 301
acagucgcucggcg

SEQ ID NO: 1957262 - RNA, 21 nt, Shigella flexneri 2a str. 301
acagugaccaucuuccagcau

SEQ ID NO: 1957263 - RNA, 23 nt, Shigella flexneri 2a str. 301
accagaaaguuuuucaacaccau

SEQ ID NO: 1957264 - RNA, 17 nt, Shigella flexneri 2a str. 301
accagcagcauuucaaa

SEQ ID NO: 1957265 - RNA, 14 nt, Shigella flexneri 2a str. 301
accagaaucgccag

SEQ ID NO: 1957266 - RNA, 17 nt, Shigella flexneri 2a str. 301
accagcagcgccggauu

SEQ ID NO: 1957267 - RNA, 22 nt, Shigella flexneri 2a str. 301
accacuggcgauauugccgcga

SEQ ID NO: 1957268 - RNA, 15 nt, Shigella flexneri 2a str. 301
accacuucagaaccg

SEQ ID NO: 1957269 - RNA, 12 nt, Shigella flexneri 2a str. 301
accacugauaag

SEQ ID NO: 1957270 - RNA, 15 nt, Shigella flexneri 2a str. 301
accacucaccgccgu

SEQ ID NO: 1957271 - RNA, 17 nt, Shigella flexneri 2a str. 301
accagcgguaaagcggc

SEQ ID NO: 1957272 - RNA, 17 nt, Shigella flexneri 2a str. 301
accagcgucgcaucagg

SEQ ID NO: 1957273 - RNA, 14 nt, Shigella flexneri 2a str. 301
accagcuccggcac

SEQ ID NO: 1957274 - RNA, 23 nt, Shigella flexneri 2a str. 301
accagccuucuucauccagcgca

SEQ ID NO: 1957275 - RNA, 17 nt, Shigella flexneri 2a str. 301
accacccaccagcgccg

SEQ ID NO: 1957276 - RNA, 17 nt, Shigella flexneri 2a str. 301
accaccaaaaacgccau

SEQ ID NO: 1957277 - RNA, 22 nt, Shigella flexneri 2a str. 301
accacaugaucauucaccagcc

SEQ ID NO: 1957278 - RNA, 15 nt, Shigella flexneri 2a str. 301
accacaucaaucccu

SEQ ID NO: 1957279 - RNA, 17 nt, Shigella flexneri 2a str. 301
accaaucagaaaggcgu

SEQ ID NO: 1957280 - RNA, 13 nt, Shigella flexneri 2a str. 301
accaauccagccg

SEQ ID NO: 1957281 - RNA, 12 nt, Shigella flexneri 2a str. 301
accaauccgcca

SEQ ID NO: 1957282 - RNA, 16 nt, Shigella flexneri 2a str. 301
accaaucucccagccg

SEQ ID NO: 1957283 - RNA, 18 nt, Shigella flexneri 2a str. 301
accacggccaaaucgcca

SEQ ID NO: 1957284 - RNA, 20 nt, Shigella flexneri 2a str. 301
accacggcgcauuugcggca

SEQ ID NO: 1957285 - RNA, 22 nt, Shigella flexneri 2a str. 301
accgcucuucauacgcggcaga

SEQ ID NO: 1957286 - RNA, 20 nt, Shigella flexneri 2a str. 301
accgcuucaacagcggcauu

SEQ ID NO: 1957287 - RNA, 16 nt, Shigella flexneri 2a str. 301
accggaaaagguguuc

SEQ ID NO: 1957288 - RNA, 12 nt, Shigella flexneri 2a str. 301
accgcuuggcga

SEQ ID NO: 1957289 - RNA, 24 nt, Shigella flexneri 2a str. 301
accggauaaauuuaaaacugccug

SEQ ID NO: 1957290 - RNA, 16 nt, Shigella flexneri 2a str. 301
accggauaugcgggga

SEQ ID NO: 1957291 - RNA, 12 nt, Shigella flexneri 2a str. 301
accgcuccgcca

SEQ ID NO: 1957292 - RNA, 20 nt, Shigella flexneri 2a str. 301
accgcuauuugccgcgacgc

SEQ ID NO: 1957293 - RNA, 21 nt, Shigella flexneri 2a str. 301
accgcuauuugcgccuggauu

SEQ ID NO: 1957294 - RNA, 18 nt, Shigella flexneri 2a str. 301
accgcgcguuuaggcgca

SEQ ID NO: 1957295 - RNA, 20 nt, Shigella flexneri 2a str. 301
accgguaaagaagagcggca

SEQ ID NO: 1957296 - RNA, 15 nt, Shigella flexneri 2a str. 301
accgccagcaucggc

SEQ ID NO: 1957297 - RNA, 21 nt, Shigella flexneri 2a str. 301
accgcaucggcaucaaaccau

SEQ ID NO: 1957298 - RNA, 21 nt, Shigella flexneri 2a str. 301
accgcaucacgacagcaccac

SEQ ID NO: 1957299 - RNA, 19 nt, Shigella flexneri 2a str. 301
accgcagcaucgucaucag

SEQ ID NO: 1957300 - RNA, 18 nt, Shigella flexneri 2a str. 301
accgcaguaaucggcgaa

SEQ ID NO: 1957301 - RNA, 19 nt, Shigella flexneri 2a str. 301
accgcauacgcagcaucau

SEQ ID NO: 1957302 - RNA, 16 nt, Shigella flexneri 2a str. 301
accgcgcaggcggauu

SEQ ID NO: 1957303 - RNA, 17 nt, Shigella flexneri 2a str. 301
accgccugauaacgaau

SEQ ID NO: 1957304 - RNA, 21 nt, Shigella flexneri 2a str. 301
accgcgaaucauaacugccgu

SEQ ID NO: 1957305 - RNA, 15 nt, Shigella flexneri 2a str. 301
accgccuucugcgcc

SEQ ID NO: 1957306 - RNA, 19 nt, Shigella flexneri 2a str. 301
acccucuccccagaagggc

SEQ ID NO: 1957307 - RNA, 19 nt, Shigella flexneri 2a str. 301
acccgucgggcagaaacgg

SEQ ID NO: 1957308 - RNA, 14 nt, Shigella flexneri 2a str. 301
accccugauaaccg

SEQ ID NO: 1957309 - RNA, 20 nt, Shigella flexneri 2a str. 301
acccgcucauucguaaacga

SEQ ID NO: 1957310 - RNA, 18 nt, Shigella flexneri 2a str. 301
acccauguugaucgccac

SEQ ID NO: 1957311 - RNA, 23 nt, Shigella flexneri 2a str. 301
acccaguuucggcaucagcagaa

SEQ ID NO: 1957312 - RNA, 15 nt, Shigella flexneri 2a str. 301
acccagcaccgcaga

SEQ ID NO: 1957313 - RNA, 17 nt, Shigella flexneri 2a str. 301
acccagcgaauccagca

SEQ ID NO: 1957314 - RNA, 23 nt, Shigella flexneri 2a str. 301
acccagaagaaagccggaugauc

SEQ ID NO: 1957315 - RNA, 18 nt, Shigella flexneri 2a str. 301
accaggccaucagcagcg

SEQ ID NO: 1957316 - RNA, 19 nt, Shigella flexneri 2a str. 301
accaggccaucagcagcgg

SEQ ID NO: 1957317 - RNA, 21 nt, Shigella flexneri 2a str. 301
accccgcaauuucauuauuca

SEQ ID NO: 1957318 - RNA, 15 nt, Shigella flexneri 2a str. 301
accccgcagcaaccg

SEQ ID NO: 1957319 - RNA, 15 nt, Shigella flexneri 2a str. 301
acccccauccacgca

SEQ ID NO: 1957320 - RNA, 14 nt, Shigella flexneri 2a str. 301
accccacgucaucu

SEQ ID NO: 1957321 - RNA, 14 nt, Shigella flexneri 2a str. 301
ucggccagcguguu

SEQ ID NO: 1957322 - RNA, 14 nt, Shigella flexneri 2a str. 301
ucggcaaucacauc

SEQ ID NO: 1957323 - RNA, 17 nt, Shigella flexneri 2a str. 301
aauacgccggucacgcc

SEQ ID NO: 1957324 - RNA, 15 nt, Shigella flexneri 2a str. 301
aauacgcaucgacau

SEQ ID NO: 1957325 - RNA, 19 nt, Shigella flexneri 2a str. 301
aauaccuucuuccugcgcc

SEQ ID NO: 1957326 - RNA, 17 nt, Shigella flexneri 2a str. 301
ucgcgguaaacugcaug

SEQ ID NO: 1957327 - RNA, 17 nt, Shigella flexneri 2a str. 301
ucgcgguaaugacucca

SEQ ID NO: 1957328 - RNA, 23 nt, Shigella flexneri 2a str. 301
ucgcguaacugcugcucaaucug

SEQ ID NO: 1957329 - RNA, 17 nt, Shigella flexneri 2a str. 301
ucgcguaguaaagccuu

SEQ ID NO: 1957330 - RNA, 16 nt, Shigella flexneri 2a str. 301
ucgcucaucagcuccg

SEQ ID NO: 1957331 - RNA, 21 nt, Shigella flexneri 2a str. 301
ucgcuugcaggaucagcuccg

SEQ ID NO: 1957332 - RNA, 16 nt, Shigella flexneri 2a str. 301
ucgcugcgcggcagcu

SEQ ID NO: 1957333 - RNA, 21 nt, Shigella flexneri 2a str. 301
ucgcugaauaccgauucccag

SEQ ID NO: 1957334 - RNA, 23 nt, Shigella flexneri 2a str. 301
ucgcuuacccuaaauccgccauc

SEQ ID NO: 1957335 - RNA, 15 nt, Shigella flexneri 2a str. 301
ucgcuuaccaugcca

SEQ ID NO: 1957336 - RNA, 21 nt, Shigella flexneri 2a str. 301
ucgccacaccaguaaagccca

SEQ ID NO: 1957337 - RNA, 14 nt, Shigella flexneri 2a str. 301
ucgccacaccggug

SEQ ID NO: 1957338 - RNA, 14 nt, Shigella flexneri 2a str. 301
ucgcaucuggcaua

SEQ ID NO: 1957339 - RNA, 19 nt, Shigella flexneri 2a str. 301
ucgcaucaggcaucaugcu

SEQ ID NO: 1957340 - RNA, 23 nt, Shigella flexneri 2a str. 301
ucgcaucccgguaucaaagcgcc

SEQ ID NO: 1957341 - RNA, 17 nt, Shigella flexneri 2a str. 301
ucgcaguagccaugcau

SEQ ID NO: 1957342 - RNA, 14 nt, Shigella flexneri 2a str. 301
ucgcaguagcgggc

SEQ ID NO: 1957343 - RNA, 16 nt, Shigella flexneri 2a str. 301
ucgcagguauaccgga

SEQ ID NO: 1957344 - RNA, 19 nt, Shigella flexneri 2a str. 301
ucgcaggcaguacugcaua

SEQ ID NO: 1957345 - RNA, 15 nt, Shigella flexneri 2a str. 301
ucgaucuccgccuga

SEQ ID NO: 1957346 - RNA, 20 nt, Shigella flexneri 2a str. 301
ucgccccgugaugaacugcg

SEQ ID NO: 1957347 - RNA, 14 nt, Shigella flexneri 2a str. 301
ucgccagcaucggc

SEQ ID NO: 1957348 - RNA, 19 nt, Shigella flexneri 2a str. 301
ucgccagcggaauaacgcg

SEQ ID NO: 1957349 - RNA, 17 nt, Shigella flexneri 2a str. 301
ucgccagcgccagcgcu

SEQ ID NO: 1957350 - RNA, 23 nt, Shigella flexneri 2a str. 301
ucgccagauagauugcgcuggca

SEQ ID NO: 1957351 - RNA, 14 nt, Shigella flexneri 2a str. 301
ucgccagaaaucag

SEQ ID NO: 1957352 - RNA, 13 nt, Shigella flexneri 2a str. 301
ucgccagcggcag

SEQ ID NO: 1957353 - RNA, 18 nt, Shigella flexneri 2a str. 301
ucgccauuuugcgcggca

SEQ ID NO: 1957354 - RNA, 15 nt, Shigella flexneri 2a str. 301
ucgccguuaccguac

SEQ ID NO: 1957355 - RNA, 19 nt, Shigella flexneri 2a str. 301
ucgccgcugugauuucagc

SEQ ID NO: 1957356 - RNA, 15 nt, Shigella flexneri 2a str. 301
ucgccgcugccuguu

SEQ ID NO: 1957357 - RNA, 16 nt, Shigella flexneri 2a str. 301
ucgcgcagcacuugca

SEQ ID NO: 1957358 - RNA, 13 nt, Shigella flexneri 2a str. 301
ucgcgcacuggau

SEQ ID NO: 1957359 - RNA, 15 nt, Shigella flexneri 2a str. 301
ucgcgaugaugcgac

SEQ ID NO: 1957360 - RNA, 16 nt, Shigella flexneri 2a str. 301
ucgcgaccaaucacac

SEQ ID NO: 1957361 - RNA, 18 nt, Shigella flexneri 2a str. 301
ucgcgaauggccugcgca

SEQ ID NO: 1957362 - RNA, 15 nt, Shigella flexneri 2a str. 301
ucgccuuuuaaugcg

SEQ ID NO: 1957363 - RNA, 22 nt, Shigella flexneri 2a str. 301
ucgccugccagaugcagcggua

SEQ ID NO: 1957364 - RNA, 14 nt, Shigella flexneri 2a str. 301
ucgauaaaccagca

SEQ ID NO: 1957365 - RNA, 23 nt, Shigella flexneri 2a str. 301
ucgauaaaaccuuccucaccguu

SEQ ID NO: 1957366 - RNA, 22 nt, Shigella flexneri 2a str. 301
ucgauaaacaguuccgcaaagc

SEQ ID NO: 1957367 - RNA, 17 nt, Shigella flexneri 2a str. 301
ucgagauacguuugcca

SEQ ID NO: 1957368 - RNA, 22 nt, Shigella flexneri 2a str. 301
ucgagagaauggggucagcagg

SEQ ID NO: 1957369 - RNA, 21 nt, Shigella flexneri 2a str. 301
ucgaccaggccaucagcagcg

SEQ ID NO: 1957370 - RNA, 20 nt, Shigella flexneri 2a str. 301
ucgaccacuuuaaccagucg

SEQ ID NO: 1957371 - RNA, 14 nt, Shigella flexneri 2a str. 301
uccgguacgugcgu

SEQ ID NO: 1957372 - RNA, 23 nt, Shigella flexneri 2a str. 301
uccgguuuacuuccgggaaaacc

SEQ ID NO: 1957373 - RNA, 22 nt, Shigella flexneri 2a str. 301
uccguaucgguguuauccacga

SEQ ID NO: 1957374 - RNA, 13 nt, Shigella flexneri 2a str. 301
uccucuucccaga

SEQ ID NO: 1957375 - RNA, 18 nt, Shigella flexneri 2a str. 301
uccugcccacuccagcua

SEQ ID NO: 1957376 - RNA, 18 nt, Shigella flexneri 2a str. 301
uccugcgcaggaagcggu

SEQ ID NO: 1957377 - RNA, 17 nt, Shigella flexneri 2a str. 301
uccugcgcuuccagcuc

SEQ ID NO: 1957378 - RNA, 19 nt, Shigella flexneri 2a str. 301
uccugccaguuauagcgca

SEQ ID NO: 1957379 - RNA, 21 nt, Shigella flexneri 2a str. 301
uccugcacggucacaucgcug

SEQ ID NO: 1957380 - RNA, 16 nt, Shigella flexneri 2a str. 301
uccugacuugccagau

SEQ ID NO: 1957381 - RNA, 15 nt, Shigella flexneri 2a str. 301
uccugaaucaccuga

SEQ ID NO: 1957382 - RNA, 18 nt, Shigella flexneri 2a str. 301
uccuggcgaucgggcauu

SEQ ID NO: 1957383 - RNA, 23 nt, Shigella flexneri 2a str. 301
uccuggcgaaaacgcccggcauu

SEQ ID NO: 1957384 - RNA, 18 nt, Shigella flexneri 2a str. 301
uccugguuucuggucauu

SEQ ID NO: 1957385 - RNA, 24 nt, Shigella flexneri 2a str. 301
ucccguacccagcaagaccgcgac

SEQ ID NO: 1957386 - RNA, 21 nt, Shigella flexneri 2a str. 301
ucccguaauccguaaagccca

SEQ ID NO: 1957387 - RNA, 20 nt, Shigella flexneri 2a str. 301
ucccggcaaugcgccgaaau

SEQ ID NO: 1957388 - RNA, 20 nt, Shigella flexneri 2a str. 301
ucccgcuucaacgaccgcuu

SEQ ID NO: 1957389 - RNA, 16 nt, Shigella flexneri 2a str. 301
ucccgugccagagcau

SEQ ID NO: 1957390 - RNA, 17 nt, Shigella flexneri 2a str. 301
ucccgccgcuggcggga

SEQ ID NO: 1957391 - RNA, 14 nt, Shigella flexneri 2a str. 301
ucccauuaccauuc

SEQ ID NO: 1957392 - RNA, 17 nt, Shigella flexneri 2a str. 301
ucccauaggaugagguu

SEQ ID NO: 1957393 - RNA, 12 nt, Shigella flexneri 2a str. 301
ucccagucuuca

SEQ ID NO: 1957394 - RNA, 16 nt, Shigella flexneri 2a str. 301
ucccagucuuuccaua

SEQ ID NO: 1957395 - RNA, 17 nt, Shigella flexneri 2a str. 301
ucccaguagugcuuuca

SEQ ID NO: 1957396 - RNA, 16 nt, Shigella flexneri 2a str. 301
ucccauaagugcguca

SEQ ID NO: 1957397 - RNA, 16 nt, Shigella flexneri 2a str. 301
uccccauaucaggcac

SEQ ID NO: 1957398 - RNA, 13 nt, Shigella flexneri 2a str. 301
ucccagccgggua

SEQ ID NO: 1957399 - RNA, 17 nt, Shigella flexneri 2a str. 301
ucccagccuugccagau

SEQ ID NO: 1957400 - RNA, 22 nt, Shigella flexneri 2a str. 301
ucccagcgcggugauaaccguu

SEQ ID NO: 1957401 - RNA, 22 nt, Shigella flexneri 2a str. 301
ucccaggccgccugcaacgcuu

SEQ ID NO: 1957402 - RNA, 19 nt, Shigella flexneri 2a str. 301
uccggauuuuuuuaugcac

SEQ ID NO: 1957403 - RNA, 23 nt, Shigella flexneri 2a str. 301
uccggcaaauaacgccccggcaa

SEQ ID NO: 1957404 - RNA, 13 nt, Shigella flexneri 2a str. 301
uccggaucgccaa

SEQ ID NO: 1957405 - RNA, 21 nt, Shigella flexneri 2a str. 301
uccggcaauaagcaacgcgca

SEQ ID NO: 1957406 - RNA, 18 nt, Shigella flexneri 2a str. 301
uccgcucucauccauucg

SEQ ID NO: 1957407 - RNA, 21 nt, Shigella flexneri 2a str. 301
uccgcugauucaaaaccgguu

SEQ ID NO: 1957408 - RNA, 17 nt, Shigella flexneri 2a str. 301
uccgcuuaucaggccua

SEQ ID NO: 1957409 - RNA, 17 nt, Shigella flexneri 2a str. 301
uccgcgugacgcuggca

SEQ ID NO: 1957410 - RNA, 15 nt, Shigella flexneri 2a str. 301
uccggguucucgcaa

SEQ ID NO: 1957411 - RNA, 13 nt, Shigella flexneri 2a str. 301
uccggcgucgcuu

SEQ ID NO: 1957412 - RNA, 14 nt, Shigella flexneri 2a str. 301
ucccuguaucccag

SEQ ID NO: 1957413 - RNA, 12 nt, Shigella flexneri 2a str. 301
ucccuugucuga

SEQ ID NO: 1957414 - RNA, 15 nt, Shigella flexneri 2a str. 301
ucccuucccagccgg

SEQ ID NO: 1957415 - RNA, 22 nt, Shigella flexneri 2a str. 301
uccgacaaauguguucagcgau

SEQ ID NO: 1957416 - RNA, 17 nt, Shigella flexneri 2a str. 301
uccgaagucccacggug

SEQ ID NO: 1957417 - RNA, 18 nt, Shigella flexneri 2a str. 301
uccgccgcccauauuagc

SEQ ID NO: 1957418 - RNA, 15 nt, Shigella flexneri 2a str. 301
uccgccgccagcaga

SEQ ID NO: 1957419 - RNA, 14 nt, Shigella flexneri 2a str. 301
uccgcgaaggcggc

SEQ ID NO: 1957420 - RNA, 19 nt, Shigella flexneri 2a str. 301
ucgggagguaaugacucca

SEQ ID NO: 1957421 - RNA, 13 nt, Shigella flexneri 2a str. 301
ucggguaacggac

SEQ ID NO: 1957422 - RNA, 15 nt, Shigella flexneri 2a str. 301
ucgggcguuaucgcg

SEQ ID NO: 1957423 - RNA, 15 nt, Shigella flexneri 2a str. 301
ucgggccguugucga

SEQ ID NO: 1957424 - RNA, 22 nt, Shigella flexneri 2a str. 301
ucgucaaucagcgugaccaguu

SEQ ID NO: 1957425 - RNA, 23 nt, Shigella flexneri 2a str. 301
ucgucaagaaugacaacugcauu

SEQ ID NO: 1957426 - RNA, 16 nt, Shigella flexneri 2a str. 301
ucguccacgucaucaa

SEQ ID NO: 1957427 - RNA, 20 nt, Shigella flexneri 2a str. 301
ucguaggucggauaagacgc

SEQ ID NO: 1957428 - RNA, 20 nt, Shigella flexneri 2a str. 301
ucguauuaaagagaucgaac

SEQ ID NO: 1957429 - RNA, 20 nt, Shigella flexneri 2a str. 301
ucguaggccugauaagacgc

SEQ ID NO: 1957430 - RNA, 20 nt, Shigella flexneri 2a str. 301
ucguaggccagauaaggcgu

SEQ ID NO: 1957431 - RNA, 16 nt, Shigella flexneri 2a str. 301
ucgguccgacgugcuc

SEQ ID NO: 1957432 - RNA, 20 nt, Shigella flexneri 2a str. 301
ucgugaauaugucgcgccag

SEQ ID NO: 1957433 - RNA, 12 nt, Shigella flexneri 2a str. 301
ucugccgcuuca

SEQ ID NO: 1957434 - RNA, 20 nt, Shigella flexneri 2a str. 301
ucugccguaccaucgccagc

SEQ ID NO: 1957435 - RNA, 15 nt, Shigella flexneri 2a str. 301
ucugcgauagcagca

SEQ ID NO: 1957436 - RNA, 12 nt, Shigella flexneri 2a str. 301
ucugccgcaauu

SEQ ID NO: 1957437 - RNA, 17 nt, Shigella flexneri 2a str. 301
ucugcccgagauacauc

SEQ ID NO: 1957438 - RNA, 23 nt, Shigella flexneri 2a str. 301
ucugccagucaggcaugaucagc

SEQ ID NO: 1957439 - RNA, 15 nt, Shigella flexneri 2a str. 301
ucugcaugacggcug

SEQ ID NO: 1957440 - RNA, 18 nt, Shigella flexneri 2a str. 301
ucugcacguuuugcugau

SEQ ID NO: 1957441 - RNA, 17 nt, Shigella flexneri 2a str. 301
ucugcacgcuugccugu

SEQ ID NO: 1957442 - RNA, 13 nt, Shigella flexneri 2a str. 301
ucugcacgccagg

SEQ ID NO: 1957443 - RNA, 16 nt, Shigella flexneri 2a str. 301
ucugcaaaaaugccuu

SEQ ID NO: 1957444 - RNA, 20 nt, Shigella flexneri 2a str. 301
ucucuucaacacggcgcauu

SEQ ID NO: 1957445 - RNA, 20 nt, Shigella flexneri 2a str. 301
ucugaaggauuagccggaua

SEQ ID NO: 1957446 - RNA, 14 nt, Shigella flexneri 2a str. 301
ucugagaaacucau

SEQ ID NO: 1957447 - RNA, 14 nt, Shigella flexneri 2a str. 301
ucucucuucagcuu

SEQ ID NO: 1957448 - RNA, 17 nt, Shigella flexneri 2a str. 301
ucucacuguucacuuuu

SEQ ID NO: 1957449 - RNA, 22 nt, Shigella flexneri 2a str. 301
ucucaucguugcgaucgaccug

SEQ ID NO: 1957450 - RNA, 17 nt, Shigella flexneri 2a str. 301
ucucauggguggcagau

SEQ ID NO: 1957451 - RNA, 15 nt, Shigella flexneri 2a str. 301
ucucauuacagcgac

SEQ ID NO: 1957452 - RNA, 20 nt, Shigella flexneri 2a str. 301
ucucaagggaggagucaucc

SEQ ID NO: 1957453 - RNA, 21 nt, Shigella flexneri 2a str. 301
ucucaaacacgccgauaucgc

SEQ ID NO: 1957454 - RNA, 12 nt, Shigella flexneri 2a str. 301
ugaacaaagcgc

SEQ ID NO: 1957455 - RNA, 13 nt, Shigella flexneri 2a str. 301
ugaacaaccagaa

SEQ ID NO: 1957456 - RNA, 17 nt, Shigella flexneri 2a str. 301
ugaacaccuucucaggc

SEQ ID NO: 1957457 - RNA, 14 nt, Shigella flexneri 2a str. 301
ugaacacguaauuc

SEQ ID NO: 1957458 - RNA, 22 nt, Shigella flexneri 2a str. 301
ugaaaucguuugcauccagcuc

SEQ ID NO: 1957459 - RNA, 21 nt, Shigella flexneri 2a str. 301
ugaacauuauuuuugcgacag

SEQ ID NO: 1957460 - RNA, 22 nt, Shigella flexneri 2a str. 301
ugaacgagaaaaugacgaugac

SEQ ID NO: 1957461 - RNA, 20 nt, Shigella flexneri 2a str. 301
ugaaaguuuaacuaccgugu

SEQ ID NO: 1957462 - RNA, 21 nt, Shigella flexneri 2a str. 301
ugaaagauaaucacacagcgg

SEQ ID NO: 1957463 - RNA, 17 nt, Shigella flexneri 2a str. 301
ugaaagaagcggugaaa

SEQ ID NO: 1957464 - RNA, 18 nt, Shigella flexneri 2a str. 301
ucuuugaugaaacaugau

SEQ ID NO: 1957465 - RNA, 15 nt, Shigella flexneri 2a str. 301
ucuuucccggcaauc

SEQ ID NO: 1957466 - RNA, 19 nt, Shigella flexneri 2a str. 301
ucuuucccggcaaucaccg

SEQ ID NO: 1957467 - RNA, 13 nt, Shigella flexneri 2a str. 301
ucuuugaaaucac

SEQ ID NO: 1957468 - RNA, 20 nt, Shigella flexneri 2a str. 301
ucuuaaaauauaaaacugaa

SEQ ID NO: 1957469 - RNA, 15 nt, Shigella flexneri 2a str. 301
ucuuaucaggccaau

SEQ ID NO: 1957470 - RNA, 20 nt, Shigella flexneri 2a str. 301
ucuuagcccuuaauuacguu

SEQ ID NO: 1957471 - RNA, 16 nt, Shigella flexneri 2a str. 301
ucuucaaacucaccag

SEQ ID NO: 1957472 - RNA, 21 nt, Shigella flexneri 2a str. 301
ucugcgccuuuuuucgccgca

SEQ ID NO: 1957473 - RNA, 19 nt, Shigella flexneri 2a str. 301
ucugcuucgccugagcggc

SEQ ID NO: 1957474 - RNA, 18 nt, Shigella flexneri 2a str. 301
ucugcuucgcgacggcau

SEQ ID NO: 1957475 - RNA, 21 nt, Shigella flexneri 2a str. 301
ucugcugcugcguuccggcau

SEQ ID NO: 1957476 - RNA, 13 nt, Shigella flexneri 2a str. 301
ucuucagcaucaa

SEQ ID NO: 1957477 - RNA, 15 nt, Shigella flexneri 2a str. 301
ugcaguuaucugccg

SEQ ID NO: 1957478 - RNA, 17 nt, Shigella flexneri 2a str. 301
ugcauaauuucuucguu

SEQ ID NO: 1957479 - RNA, 16 nt, Shigella flexneri 2a str. 301
ugcauacaguacgugu

SEQ ID NO: 1957480 - RNA, 21 nt, Shigella flexneri 2a str. 301
ugccagaaagcguauccauca

SEQ ID NO: 1957481 - RNA, 13 nt, Shigella flexneri 2a str. 301
ugccagcaccauc

SEQ ID NO: 1957482 - RNA, 21 nt, Shigella flexneri 2a str. 301
ugccagaggagccaucaccau

SEQ ID NO: 1957483 - RNA, 22 nt, Shigella flexneri 2a str. 301
ugccagacuucaucggcgguga

SEQ ID NO: 1957484 - RNA, 16 nt, Shigella flexneri 2a str. 301
ugccaucgggcaaaau

SEQ ID NO: 1957485 - RNA, 19 nt, Shigella flexneri 2a str. 301
ugccagcgauuuaucggca

SEQ ID NO: 1957486 - RNA, 20 nt, Shigella flexneri 2a str. 301
ugcccacgcuuuucaucaga

SEQ ID NO: 1957487 - RNA, 17 nt, Shigella flexneri 2a str. 301
ugccauuaaugucagau

SEQ ID NO: 1957488 - RNA, 18 nt, Shigella flexneri 2a str. 301
ugcccggucgggugcuca

SEQ ID NO: 1957489 - RNA, 16 nt, Shigella flexneri 2a str. 301
ugcccgccccggcgau

SEQ ID NO: 1957490 - RNA, 22 nt, Shigella flexneri 2a str. 301
ugaugcguugcgcuucucaggc

SEQ ID NO: 1957491 - RNA, 17 nt, Shigella flexneri 2a str. 301
ugcaccauaaauccaac

SEQ ID NO: 1957492 - RNA, 17 nt, Shigella flexneri 2a str. 301
ugcacgauauaccgugc

SEQ ID NO: 1957493 - RNA, 21 nt, Shigella flexneri 2a str. 301
ugcacgcagaucgguugccau

SEQ ID NO: 1957494 - RNA, 15 nt, Shigella flexneri 2a str. 301
ugcacgaugccugau

SEQ ID NO: 1957495 - RNA, 19 nt, Shigella flexneri 2a str. 301
ugcacggagauauccagcg

SEQ ID NO: 1957496 - RNA, 21 nt, Shigella flexneri 2a str. 301
ugcacguggugugggcgguga

SEQ ID NO: 1957497 - RNA, 20 nt, Shigella flexneri 2a str. 301
ugcagacaugacgcccggca

SEQ ID NO: 1957498 - RNA, 20 nt, Shigella flexneri 2a str. 301
ugcagaguauccaugcgcau

SEQ ID NO: 1957499 - RNA, 22 nt, Shigella flexneri 2a str. 301
ugcagauauucaugcaggccau

SEQ ID NO: 1957500 - RNA, 20 nt, Shigella flexneri 2a str. 301
ugcagcaguauuaacgccau

SEQ ID NO: 1957501 - RNA, 16 nt, Shigella flexneri 2a str. 301
ugcagcccguaagcaa

SEQ ID NO: 1957502 - RNA, 17 nt, Shigella flexneri 2a str. 301
ugcagcccagcaucaga

SEQ ID NO: 1957503 - RNA, 18 nt, Shigella flexneri 2a str. 301
ugcagcccagcaucagac

SEQ ID NO: 1957504 - RNA, 20 nt, Shigella flexneri 2a str. 301
ugcagccagugauuaacgcg

SEQ ID NO: 1957505 - RNA, 20 nt, Shigella flexneri 2a str. 301
ugcaggccagauaaggcguu

SEQ ID NO: 1957506 - RNA, 16 nt, Shigella flexneri 2a str. 301
ugcaggcauucagcaa

SEQ ID NO: 1957507 - RNA, 23 nt, Shigella flexneri 2a str. 301
ugcaggccauguuuaccaucugc

SEQ ID NO: 1957508 - RNA, 23 nt, Shigella flexneri 2a str. 301
ugcaggacuuaaccguucgcggc

SEQ ID NO: 1957509 - RNA, 22 nt, Shigella flexneri 2a str. 301
ugcagcuuucccuucaggcgug

SEQ ID NO: 1957510 - RNA, 14 nt, Shigella flexneri 2a str. 301
ugcagcuccaccga

SEQ ID NO: 1957511 - RNA, 17 nt, Shigella flexneri 2a str. 301
ugacgcuugagcaggag

SEQ ID NO: 1957512 - RNA, 23 nt, Shigella flexneri 2a str. 301
ugacgcuugagcaggagcagcag

SEQ ID NO: 1957513 - RNA, 16 nt, Shigella flexneri 2a str. 301
ugacgcgucuuaucag

SEQ ID NO: 1957514 - RNA, 21 nt, Shigella flexneri 2a str. 301
ugacgcgucuuaucaggccua

SEQ ID NO: 1957515 - RNA, 20 nt, Shigella flexneri 2a str. 301
ugacgcgucuuaucuggccu

SEQ ID NO: 1957516 - RNA, 15 nt, Shigella flexneri 2a str. 301
ugacgcgcuaagcga

SEQ ID NO: 1957517 - RNA, 22 nt, Shigella flexneri 2a str. 301
ugacgcgcgcccgauuaacugg

SEQ ID NO: 1957518 - RNA, 21 nt, Shigella flexneri 2a str. 301
ugacgggcaagaauaucugcu

SEQ ID NO: 1957519 - RNA, 16 nt, Shigella flexneri 2a str. 301
ugacgcauccgaucgc

SEQ ID NO: 1957520 - RNA, 17 nt, Shigella flexneri 2a str. 301
ugacgaccacccagcau

SEQ ID NO: 1957521 - RNA, 19 nt, Shigella flexneri 2a str. 301
ugacgaucaccacaccguc

SEQ ID NO: 1957522 - RNA, 21 nt, Shigella flexneri 2a str. 301
ugaccugcggcaccagcggua

SEQ ID NO: 1957523 - RNA, 20 nt, Shigella flexneri 2a str. 301
ugaacgccuaauccagccua

SEQ ID NO: 1957524 - RNA, 19 nt, Shigella flexneri 2a str. 301
ugaacgccuaauccagccu

SEQ ID NO: 1957525 - RNA, 20 nt, Shigella flexneri 2a str. 301
ugaccgccuuauccggccua

SEQ ID NO: 1957526 - RNA, 18 nt, Shigella flexneri 2a str. 301
ugaccgccgcagcaaccg

SEQ ID NO: 1957527 - RNA, 17 nt, Shigella flexneri 2a str. 301
ugaugaaaaaaccagaa

SEQ ID NO: 1957528 - RNA, 19 nt, Shigella flexneri 2a str. 301
ugaucucuaaggcaugaau

SEQ ID NO: 1957529 - RNA, 19 nt, Shigella flexneri 2a str. 301
ugaugcgacuugucaucau

SEQ ID NO: 1957530 - RNA, 22 nt, Shigella flexneri 2a str. 301
ugaugcgcuacgcuuaucaggc

SEQ ID NO: 1957531 - RNA, 18 nt, Shigella flexneri 2a str. 301
ugaugacguaauccgccu

SEQ ID NO: 1957532 - RNA, 22 nt, Shigella flexneri 2a str. 301
ugauauugcucgcacugggcga

SEQ ID NO: 1957533 - RNA, 13 nt, Shigella flexneri 2a str. 301
ugaucgauccacg

SEQ ID NO: 1957534 - RNA, 19 nt, Shigella flexneri 2a str. 301
ugaucgcgccgccgcccau

SEQ ID NO: 1957535 - RNA, 17 nt, Shigella flexneri 2a str. 301
ugagcggacugaacgcg

SEQ ID NO: 1957536 - RNA, 13 nt, Shigella flexneri 2a str. 301
ugagcuucucgau

SEQ ID NO: 1957537 - RNA, 22 nt, Shigella flexneri 2a str. 301
ugagcuuuguucaugccggaug

SEQ ID NO: 1957538 - RNA, 13 nt, Shigella flexneri 2a str. 301
ugagcgacaucuu

SEQ ID NO: 1957539 - RNA, 17 nt, Shigella flexneri 2a str. 301
ugacuauccuggacuuu

SEQ ID NO: 1957540 - RNA, 19 nt, Shigella flexneri 2a str. 301
ugacucagaccauauuccc

SEQ ID NO: 1957541 - RNA, 19 nt, Shigella flexneri 2a str. 301
ugacuaccggggacaggcg

SEQ ID NO: 1957542 - RNA, 21 nt, Shigella flexneri 2a str. 301
ugacucuccccguuuuccggg

SEQ ID NO: 1957543 - RNA, 21 nt, Shigella flexneri 2a str. 301
ugacgugucuuaucaggccua

SEQ ID NO: 1957544 - RNA, 17 nt, Shigella flexneri 2a str. 301
ugaguuccgcugcuggg

SEQ ID NO: 1957545 - RNA, 12 nt, Shigella flexneri 2a str. 301
ugauacaacgac

SEQ ID NO: 1957546 - RNA, 15 nt, Shigella flexneri 2a str. 301
ugauacaggcgcugu

SEQ ID NO: 1957547 - RNA, 13 nt, Shigella flexneri 2a str. 301
ugauaauccauca

SEQ ID NO: 1957548 - RNA, 18 nt, Shigella flexneri 2a str. 301
ugauaaaaaccauucagg

SEQ ID NO: 1957549 - RNA, 16 nt, Shigella flexneri 2a str. 301
ugauaaaucaccugcg

SEQ ID NO: 1957550 - RNA, 18 nt, Shigella flexneri 2a str. 301
ugauaacuucuaccagau

SEQ ID NO: 1957551 - RNA, 18 nt, Shigella flexneri 2a str. 301
uaucggagaacaggaaua

SEQ ID NO: 1957552 - RNA, 15 nt, Shigella flexneri 2a str. 301
uaugccggaugcgga

SEQ ID NO: 1957553 - RNA, 17 nt, Shigella flexneri 2a str. 301
uaugcgcggcauacagc

SEQ ID NO: 1957554 - RNA, 13 nt, Shigella flexneri 2a str. 301
uaugcgccacagg

SEQ ID NO: 1957555 - RNA, 22 nt, Shigella flexneri 2a str. 301
uaucgauaaauggcgcauccag

SEQ ID NO: 1957556 - RNA, 16 nt, Shigella flexneri 2a str. 301
uaucgaucacauccag

SEQ ID NO: 1957557 - RNA, 13 nt, Shigella flexneri 2a str. 301
uaucgcuggccuc

SEQ ID NO: 1957558 - RNA, 23 nt, Shigella flexneri 2a str. 301
uaucgcgguacuucucaccggua

SEQ ID NO: 1957559 - RNA, 17 nt, Shigella flexneri 2a str. 301
uaucgcgauacaccaga

SEQ ID NO: 1957560 - RNA, 17 nt, Shigella flexneri 2a str. 301
uaucgcgccagccagua

SEQ ID NO: 1957561 - RNA, 12 nt, Shigella flexneri 2a str. 301
uauucagcagca

SEQ ID NO: 1957562 - RNA, 17 nt, Shigella flexneri 2a str. 301
uauuuuuaaccguauuu

SEQ ID NO: 1957563 - RNA, 12 nt, Shigella flexneri 2a str. 301
uauuucaccagc

SEQ ID NO: 1957564 - RNA, 20 nt, Shigella flexneri 2a str. 301
ucaacaccuguugcgcgucg

SEQ ID NO: 1957565 - RNA, 14 nt, Shigella flexneri 2a str. 301
ucaacaucgcguug

SEQ ID NO: 1957566 - RNA, 22 nt, Shigella flexneri 2a str. 301
ucaacagguuguuucggugaau

SEQ ID NO: 1957567 - RNA, 16 nt, Shigella flexneri 2a str. 301
ucaaaacguccggcaa

SEQ ID NO: 1957568 - RNA, 16 nt, Shigella flexneri 2a str. 301
ucaaaacggugaucaa

SEQ ID NO: 1957569 - RNA, 16 nt, Shigella flexneri 2a str. 301
ucaaaaaugucaucgu

SEQ ID NO: 1957570 - RNA, 14 nt, Shigella flexneri 2a str. 301
uagugaaaucgcca

SEQ ID NO: 1957571 - RNA, 22 nt, Shigella flexneri 2a str. 301
uaguuggguuucauccugccau

SEQ ID NO: 1957572 - RNA, 14 nt, Shigella flexneri 2a str. 301
uagugccgucagca

SEQ ID NO: 1957573 - RNA, 15 nt, Shigella flexneri 2a str. 301
uagcuucaccgcauc

SEQ ID NO: 1957574 - RNA, 23 nt, Shigella flexneri 2a str. 301
uagcuuacggcgcugugagcagg

SEQ ID NO: 1957575 - RNA, 14 nt, Shigella flexneri 2a str. 301
uagcuuuaauccau

SEQ ID NO: 1957576 - RNA, 20 nt, Shigella flexneri 2a str. 301
uaguauuugaguucacugcc

SEQ ID NO: 1957577 - RNA, 14 nt, Shigella flexneri 2a str. 301
uauccacugucaaa

SEQ ID NO: 1957578 - RNA, 21 nt, Shigella flexneri 2a str. 301
uauccacgucgacaacucccg

SEQ ID NO: 1957579 - RNA, 20 nt, Shigella flexneri 2a str. 301
uauccugucaguucguuuua

SEQ ID NO: 1957580 - RNA, 19 nt, Shigella flexneri 2a str. 301
uauccagcacgucgagcag

SEQ ID NO: 1957581 - RNA, 20 nt, Shigella flexneri 2a str. 301
uaucaaacgugacauucuga

SEQ ID NO: 1957582 - RNA, 14 nt, Shigella flexneri 2a str. 301
uaucaaucaccgcu

SEQ ID NO: 1957583 - RNA, 21 nt, Shigella flexneri 2a str. 301
uaucaagccauagcgccguag

SEQ ID NO: 1957584 - RNA, 21 nt, Shigella flexneri 2a str. 301
uaucaucauuugcauacccag

SEQ ID NO: 1957585 - RNA, 14 nt, Shigella flexneri 2a str. 301
uauaaaaaacccuc

SEQ ID NO: 1957586 - RNA, 13 nt, Shigella flexneri 2a str. 301
uauaaacaacggc

SEQ ID NO: 1957587 - RNA, 13 nt, Shigella flexneri 2a str. 301
uacucugacccag

SEQ ID NO: 1957588 - RNA, 13 nt, Shigella flexneri 2a str. 301
uacugucugcuuc

SEQ ID NO: 1957589 - RNA, 22 nt, Shigella flexneri 2a str. 301
uacuccaugaguaacagucagu

SEQ ID NO: 1957590 - RNA, 17 nt, Shigella flexneri 2a str. 301
uagaggucauuaggcca

SEQ ID NO: 1957591 - RNA, 18 nt, Shigella flexneri 2a str. 301
uagcgauaaaugucggca

SEQ ID NO: 1957592 - RNA, 15 nt, Shigella flexneri 2a str. 301
uagcgcaucaggcaa

SEQ ID NO: 1957593 - RNA, 15 nt, Shigella flexneri 2a str. 301
uagcgucguggcaaa

SEQ ID NO: 1957594 - RNA, 16 nt, Shigella flexneri 2a str. 301
uagcgucgcaucaggc

SEQ ID NO: 1957595 - RNA, 21 nt, Shigella flexneri 2a str. 301
uagcggcgguaaaaucauccu

SEQ ID NO: 1957596 - RNA, 14 nt, Shigella flexneri 2a str. 301
uagcgccuucuaca

SEQ ID NO: 1957597 - RNA, 13 nt, Shigella flexneri 2a str. 301
uagccgcgcaguu

SEQ ID NO: 1957598 - RNA, 14 nt, Shigella flexneri 2a str. 301
uagcaguuccagca

SEQ ID NO: 1957599 - RNA, 16 nt, Shigella flexneri 2a str. 301
uagaugugcaguuccu

SEQ ID NO: 1957600 - RNA, 14 nt, Shigella flexneri 2a str. 301
uagccaaugcggca

SEQ ID NO: 1957601 - RNA, 22 nt, Shigella flexneri 2a str. 301
uagccacaaagcagggcuggca

SEQ ID NO: 1957602 - RNA, 17 nt, Shigella flexneri 2a str. 301
uagcauguuccaguucg

SEQ ID NO: 1957603 - RNA, 21 nt, Shigella flexneri 2a str. 301
uagcauccaccacaucgcaaa

SEQ ID NO: 1957604 - RNA, 13 nt, Shigella flexneri 2a str. 301
uaccuuaaccguu

SEQ ID NO: 1957605 - RNA, 21 nt, Shigella flexneri 2a str. 301
uaccuguguuuugcaucaacu

SEQ ID NO: 1957606 - RNA, 18 nt, Shigella flexneri 2a str. 301
uaccugcuuaaucauauu

SEQ ID NO: 1957607 - RNA, 17 nt, Shigella flexneri 2a str. 301
uaccugacagcagagca

SEQ ID NO: 1957608 - RNA, 20 nt, Shigella flexneri 2a str. 301
uaccuaaggaauccagcgac

SEQ ID NO: 1957609 - RNA, 18 nt, Shigella flexneri 2a str. 301
uacgccgccgcaaccgua

SEQ ID NO: 1957610 - RNA, 15 nt, Shigella flexneri 2a str. 301
uacgcgacauugaug

SEQ ID NO: 1957611 - RNA, 16 nt, Shigella flexneri 2a str. 301
uacgccgagcgccagc

SEQ ID NO: 1957612 - RNA, 15 nt, Shigella flexneri 2a str. 301
uacgccgcaucaggc

SEQ ID NO: 1957613 - RNA, 15 nt, Shigella flexneri 2a str. 301
uacgccaucgccagc

SEQ ID NO: 1957614 - RNA, 14 nt, Shigella flexneri 2a str. 301
uacgccaucgccag

SEQ ID NO: 1957615 - RNA, 22 nt, Shigella flexneri 2a str. 301
uaccgcugaagguguaauggau

SEQ ID NO: 1957616 - RNA, 16 nt, Shigella flexneri 2a str. 301
uaccgcuguccacgcc

SEQ ID NO: 1957617 - RNA, 19 nt, Shigella flexneri 2a str. 301
uaccgccucgcggcagcag

SEQ ID NO: 1957618 - RNA, 17 nt, Shigella flexneri 2a str. 301
uaccgguuucaauccag

SEQ ID NO: 1957619 - RNA, 19 nt, Shigella flexneri 2a str. 301
uaccggcgucccaucggca

SEQ ID NO: 1957620 - RNA, 14 nt, Shigella flexneri 2a str. 301
uaccguugcggcgu

SEQ ID NO: 1957621 - RNA, 18 nt, Shigella flexneri 2a str. 301
uaccgugcuguacagcag

SEQ ID NO: 1957622 - RNA, 20 nt, Shigella flexneri 2a str. 301
uaccgugucggaugcggcgu

SEQ ID NO: 1957623 - RNA, 17 nt, Shigella flexneri 2a str. 301
uaccgugaaucaccaca

SEQ ID NO: 1957624 - RNA, 12 nt, Shigella flexneri 2a str. 301
uaccgucaccga

SEQ ID NO: 1957625 - RNA, 17 nt, Shigella flexneri 2a str. 301
uaccguaaugaucgcga

SEQ ID NO: 1957626 - RNA, 21 nt, Shigella flexneri 2a str. 301
uacaaagggcuaacgugcagg

SEQ ID NO: 1957627 - RNA, 20 nt, Shigella flexneri 2a str. 301
uacaaaguguuguucuagcg

SEQ ID NO: 1957628 - RNA, 18 nt, Shigella flexneri 2a str. 301
uaccaggugugcgcggua

SEQ ID NO: 1957629 - RNA, 18 nt, Shigella flexneri 2a str. 301
uacaaaagauuauugcuu

SEQ ID NO: 1957630 - RNA, 15 nt, Shigella flexneri 2a str. 301
uacccagcagcagcg

SEQ ID NO: 1957631 - RNA, 15 nt, Shigella flexneri 2a str. 301
uacccacugcgcagu

SEQ ID NO: 1957632 - RNA, 18 nt, Shigella flexneri 2a str. 301
uaccauggcucaccagca

SEQ ID NO: 1957633 - RNA, 16 nt, Shigella flexneri 2a str. 301
uaccaucuucaccgcc

SEQ ID NO: 1957634 - RNA, 17 nt, Shigella flexneri 2a str. 301
uaccauuuacaagcguu

SEQ ID NO: 1957635 - RNA, 17 nt, Shigella flexneri 2a str. 301
uaccgacauaugcuuaa

SEQ ID NO: 1957636 - RNA, 19 nt, Shigella flexneri 2a str. 301
uaccgcaccuuccggaaua

SEQ ID NO: 1957637 - RNA, 13 nt, Shigella flexneri 2a str. 301
uaccgaucaccga

SEQ ID NO: 1957638 - RNA, 15 nt, Shigella flexneri 2a str. 301
uaccgaucaccgaug

SEQ ID NO: 1957639 - RNA, 20 nt, Shigella flexneri 2a str. 301
uacccugcaaugaaccggua

SEQ ID NO: 1957640 - RNA, 16 nt, Shigella flexneri 2a str. 301
ucagggccgaucaacg

SEQ ID NO: 1957641 - RNA, 13 nt, Shigella flexneri 2a str. 301
ucaggcugccaga

SEQ ID NO: 1957642 - RNA, 15 nt, Shigella flexneri 2a str. 301
ucaggugucuggcag

SEQ ID NO: 1957643 - RNA, 18 nt, Shigella flexneri 2a str. 301
ucagguggacgacugaca

SEQ ID NO: 1957644 - RNA, 19 nt, Shigella flexneri 2a str. 301
ucaggucacccaacaugcc

SEQ ID NO: 1957645 - RNA, 13 nt, Shigella flexneri 2a str. 301
ucaggcuaaagaa

SEQ ID NO: 1957646 - RNA, 21 nt, Shigella flexneri 2a str. 301
ucaggccuacaaaaugugcca

SEQ ID NO: 1957647 - RNA, 16 nt, Shigella flexneri 2a str. 301
ucaguagaauaaucug

SEQ ID NO: 1957648 - RNA, 15 nt, Shigella flexneri 2a str. 301
ucaguagauuucguu

SEQ ID NO: 1957649 - RNA, 15 nt, Shigella flexneri 2a str. 301
ucagugcaaaugcca

SEQ ID NO: 1957650 - RNA, 21 nt, Shigella flexneri 2a str. 301
ucagucucaaaccggcuccag

SEQ ID NO: 1957651 - RNA, 19 nt, Shigella flexneri 2a str. 301
ucaguguuggauggcggcu

SEQ ID NO: 1957652 - RNA, 17 nt, Shigella flexneri 2a str. 301
ucagugcuucaccgaua

SEQ ID NO: 1957653 - RNA, 14 nt, Shigella flexneri 2a str. 301
ucaguuccaguuca

SEQ ID NO: 1957654 - RNA, 14 nt, Shigella flexneri 2a str. 301
ucaguuaacggcag

SEQ ID NO: 1957655 - RNA, 12 nt, Shigella flexneri 2a str. 301
ucaucacaccag

SEQ ID NO: 1957656 - RNA, 14 nt, Shigella flexneri 2a str. 301
ucauccauacggca

SEQ ID NO: 1957657 - RNA, 13 nt, Shigella flexneri 2a str. 301
ucauccagcagcg

SEQ ID NO: 1957658 - RNA, 18 nt, Shigella flexneri 2a str. 301
ucauccagcacggugaag

SEQ ID NO: 1957659 - RNA, 15 nt, Shigella flexneri 2a str. 301
ucauccagugcuuca

SEQ ID NO: 1957660 - RNA, 23 nt, Shigella flexneri 2a str. 301
ucaucggcguugcccaucgccac

SEQ ID NO: 1957661 - RNA, 21 nt, Shigella flexneri 2a str. 301
ucaucggaaugcaccgccuga

SEQ ID NO: 1957662 - RNA, 23 nt, Shigella flexneri 2a str. 301
ucaucgcccaguugaucaccagu

SEQ ID NO: 1957663 - RNA, 13 nt, Shigella flexneri 2a str. 301
uccaacaggcgag

SEQ ID NO: 1957664 - RNA, 21 nt, Shigella flexneri 2a str. 301
uccaacaggcgagaaacgcuu

SEQ ID NO: 1957665 - RNA, 22 nt, Shigella flexneri 2a str. 301
ucaugacgauacggaauaucgc

SEQ ID NO: 1957666 - RNA, 16 nt, Shigella flexneri 2a str. 301
ucaugagcagaccaau

SEQ ID NO: 1957667 - RNA, 18 nt, Shigella flexneri 2a str. 301
uccacgaaacggcguuga

SEQ ID NO: 1957668 - RNA, 19 nt, Shigella flexneri 2a str. 301
uccacauuuuccaucacga

SEQ ID NO: 1957669 - RNA, 23 nt, Shigella flexneri 2a str. 301
uccaccaauggcggaaaagcucc

SEQ ID NO: 1957670 - RNA, 20 nt, Shigella flexneri 2a str. 301
uccagcuuuuuaaucgccau

SEQ ID NO: 1957671 - RNA, 23 nt, Shigella flexneri 2a str. 301
uccagcuuauuagggaucaucuu

SEQ ID NO: 1957672 - RNA, 14 nt, Shigella flexneri 2a str. 301
uccaggcaaucagc

SEQ ID NO: 1957673 - RNA, 21 nt, Shigella flexneri 2a str. 301
uccagccacggcuccagcaau

SEQ ID NO: 1957674 - RNA, 12 nt, Shigella flexneri 2a str. 301
uccagcaucaga

SEQ ID NO: 1957675 - RNA, 23 nt, Shigella flexneri 2a str. 301
uccagccagucggaaccggcgau

SEQ ID NO: 1957676 - RNA, 13 nt, Shigella flexneri 2a str. 301
uccacgccugcau

SEQ ID NO: 1957677 - RNA, 18 nt, Shigella flexneri 2a str. 301
uccacgcugcaucgccaa

SEQ ID NO: 1957678 - RNA, 20 nt, Shigella flexneri 2a str. 301
uccacgccgcugucuaccag

SEQ ID NO: 1957679 - RNA, 14 nt, Shigella flexneri 2a str. 301
ucacaucgcuaccg

SEQ ID NO: 1957680 - RNA, 20 nt, Shigella flexneri 2a str. 301
ucacauccagcguuaccggc

SEQ ID NO: 1957681 - RNA, 21 nt, Shigella flexneri 2a str. 301
ucacaccauugauaauccauc

SEQ ID NO: 1957682 - RNA, 16 nt, Shigella flexneri 2a str. 301
ucaacgccaucgccag

SEQ ID NO: 1957683 - RNA, 20 nt, Shigella flexneri 2a str. 301
ucaaccacuuuaucgagaau

SEQ ID NO: 1957684 - RNA, 18 nt, Shigella flexneri 2a str. 301
ucaacgaucagcguggca

SEQ ID NO: 1957685 - RNA, 18 nt, Shigella flexneri 2a str. 301
ucaccagcugacguagca

SEQ ID NO: 1957686 - RNA, 16 nt, Shigella flexneri 2a str. 301
ucaccagcaaauccag

SEQ ID NO: 1957687 - RNA, 18 nt, Shigella flexneri 2a str. 301
ucaccagcaucgccggua

SEQ ID NO: 1957688 - RNA, 19 nt, Shigella flexneri 2a str. 301
ucaccauauucagcagcag

SEQ ID NO: 1957689 - RNA, 22 nt, Shigella flexneri 2a str. 301
ucaccacugacgggaaacucug

SEQ ID NO: 1957690 - RNA, 17 nt, Shigella flexneri 2a str. 301
ucaccacugccagcggu

SEQ ID NO: 1957691 - RNA, 16 nt, Shigella flexneri 2a str. 301
ucaccacccugcccgu

SEQ ID NO: 1957692 - RNA, 15 nt, Shigella flexneri 2a str. 301
ucaccaccagcaccg

SEQ ID NO: 1957693 - RNA, 19 nt, Shigella flexneri 2a str. 301
ucaccggcuucucgccuac

SEQ ID NO: 1957694 - RNA, 20 nt, Shigella flexneri 2a str. 301
ucaccggguaggccugagaa

SEQ ID NO: 1957695 - RNA, 15 nt, Shigella flexneri 2a str. 301
ucacgaaucgccgca

SEQ ID NO: 1957696 - RNA, 14 nt, Shigella flexneri 2a str. 301
ucacgaauccgcac

SEQ ID NO: 1957697 - RNA, 17 nt, Shigella flexneri 2a str. 301
ucacgacagaacucguu

SEQ ID NO: 1957698 - RNA, 18 nt, Shigella flexneri 2a str. 301
ucaccguugacgauaacc

SEQ ID NO: 1957699 - RNA, 18 nt, Shigella flexneri 2a str. 301
ucagcagcuuugcccgau

SEQ ID NO: 1957700 - RNA, 23 nt, Shigella flexneri 2a str. 301
ucagcaguuuuuccccugccaga

SEQ ID NO: 1957701 - RNA, 12 nt, Shigella flexneri 2a str. 301
ucagcgcagaca

SEQ ID NO: 1957702 - RNA, 20 nt, Shigella flexneri 2a str. 301
aauaauuucauuuacuggau

SEQ ID NO: 1957703 - RNA, 20 nt, Shigella flexneri 2a str. 301
aauacaaggccaauccagcc

SEQ ID NO: 1957704 - RNA, 17 nt, Shigella flexneri 2a str. 301
aauacagguccccgcuu

SEQ ID NO: 1957705 - RNA, 19 nt, Shigella flexneri 2a str. 301
aauacagguccccgcuucg

SEQ ID NO: 1957706 - RNA, 22 nt, Shigella flexneri 2a str. 301
aauacagucacuuugcccuuca

SEQ ID NO: 1957707 - RNA, 13 nt, Shigella flexneri 2a str. 301
ucacugggcgauu

SEQ ID NO: 1957708 - RNA, 22 nt, Shigella flexneri 2a str. 301
ucagaccaguuuuuucaccagc

SEQ ID NO: 1957709 - RNA, 20 nt, Shigella flexneri 2a str. 301
ucagaccaauccagccggca

SEQ ID NO: 1957710 - RNA, 14 nt, Shigella flexneri 2a str. 301
ucagaccaccgguu

SEQ ID NO: 1957711 - RNA, 17 nt, Shigella flexneri 2a str. 301
ucagacuuaagccuguu

SEQ ID NO: 1957712 - RNA, 17 nt, Shigella flexneri 2a str. 301
ucagacuuaauccgggc

SEQ ID NO: 1957713 - RNA, 23 nt, Shigella flexneri 2a str. 301
ucagcaacaaaauggcaaagcga

SEQ ID NO: 1957714 - RNA, 14 nt, Shigella flexneri 2a str. 301
ucagcaaauccauc

SEQ ID NO: 1957715 - RNA, 13 nt, Shigella flexneri 2a str. 301
ucagcaacaugcc

SEQ ID NO: 1957716 - RNA, 15 nt, Shigella flexneri 2a str. 301
ucagcaaacgcaguu

SEQ ID NO: 1957717 - RNA, 13 nt, Shigella flexneri 2a str. 301
ucagcaaucucuu

SEQ ID NO: 1957718 - RNA, 16 nt, Shigella flexneri 2a str. 301
ucagcaaggaaagcca

SEQ ID NO: 1957719 - RNA, 18 nt, Shigella flexneri 2a str. 301
ucacgccgcauccggcau

SEQ ID NO: 1957720 - RNA, 18 nt, Shigella flexneri 2a str. 301
ucacgccgcauccggcag

SEQ ID NO: 1957721 - RNA, 14 nt, Shigella flexneri 2a str. 301
ucacgaucacagca

SEQ ID NO: 1957722 - RNA, 16 nt, Shigella flexneri 2a str. 301
ucacgcgccugccagg

SEQ ID NO: 1957723 - RNA, 21 nt, Shigella flexneri 2a str. 301
ucacgucaggaucgugcggca

SEQ ID NO: 1957724 - RNA, 16 nt, Shigella flexneri 2a str. 301
ucacucgacagcaccg

SEQ ID NO: 1957725 - RNA, 16 nt, Shigella flexneri 2a str. 301
ucacugaccacuucgg

SEQ ID NO: 1957726 - RNA, 16 nt, Shigella flexneri 2a str. 301
gugcagcaugcacccu

SEQ ID NO: 1957727 - RNA, 22 nt, Shigella flexneri 2a str. 301
gugcacgauugccggaugcggc

SEQ ID NO: 1957728 - RNA, 15 nt, Shigella flexneri 2a str. 301
gugcaaaugccagau

SEQ ID NO: 1957729 - RNA, 22 nt, Shigella flexneri 2a str. 301
gugccacauccaguggcagagu

SEQ ID NO: 1957730 - RNA, 19 nt, Shigella flexneri 2a str. 301
gugcaguggcuccagcgca

SEQ ID NO: 1957731 - RNA, 17 nt, Shigella flexneri 2a str. 301
gugaugguaacgcgcca

SEQ ID NO: 1957732 - RNA, 15 nt, Shigella flexneri 2a str. 301
gugauuaacgcgccg

SEQ ID NO: 1957733 - RNA, 16 nt, Shigella flexneri 2a str. 301
gugauuacacgcgaca

SEQ ID NO: 1957734 - RNA, 15 nt, Shigella flexneri 2a str. 301
gugauugccggaaug

SEQ ID NO: 1957735 - RNA, 16 nt, Shigella flexneri 2a str. 301
gugauugccggaaugg

SEQ ID NO: 1957736 - RNA, 16 nt, Shigella flexneri 2a str. 301
gugcgcgcccauacgg

SEQ ID NO: 1957737 - RNA, 13 nt, Shigella flexneri 2a str. 301
gugcgcggcuuaa

SEQ ID NO: 1957738 - RNA, 20 nt, Shigella flexneri 2a str. 301
gugcugaaaucacagcggcg

SEQ ID NO: 1957739 - RNA, 21 nt, Shigella flexneri 2a str. 301
gugcugaaccguaggccguau

SEQ ID NO: 1957740 - RNA, 20 nt, Shigella flexneri 2a str. 301
gugcucucaaauaucugccg

SEQ ID NO: 1957741 - RNA, 18 nt, Shigella flexneri 2a str. 301
gugcugaaaucacagcgg

SEQ ID NO: 1957742 - RNA, 21 nt, Shigella flexneri 2a str. 301
guggcgauguaauucagccau

SEQ ID NO: 1957743 - RNA, 16 nt, Shigella flexneri 2a str. 301
guggcguggcgcucca

SEQ ID NO: 1957744 - RNA, 14 nt, Shigella flexneri 2a str. 301
guggcgugaacgcc

SEQ ID NO: 1957745 - RNA, 18 nt, Shigella flexneri 2a str. 301
gugggaucacaucuucaa

SEQ ID NO: 1957746 - RNA, 14 nt, Shigella flexneri 2a str. 301
guguagcgcaucac

SEQ ID NO: 1957747 - RNA, 21 nt, Shigella flexneri 2a str. 301
gugucuuaucuggcauuugca

SEQ ID NO: 1957748 - RNA, 19 nt, Shigella flexneri 2a str. 301
guguuaaaugauaccgggc

SEQ ID NO: 1957749 - RNA, 24 nt, Shigella flexneri 2a str. 301
guguuagcccugucgaggccaauu

SEQ ID NO: 1957750 - RNA, 15 nt, Shigella flexneri 2a str. 301
guguuaucaaaucac

SEQ ID NO: 1957751 - RNA, 21 nt, Shigella flexneri 2a str. 301
gugugaaaccuuuaugcagcu

SEQ ID NO: 1957752 - RNA, 19 nt, Shigella flexneri 2a str. 301
guggguauauuucaggcca

SEQ ID NO: 1957753 - RNA, 13 nt, Shigella flexneri 2a str. 301
guggugcguacca

SEQ ID NO: 1957754 - RNA, 15 nt, Shigella flexneri 2a str. 301
gugguugucgcaggc

SEQ ID NO: 1957755 - RNA, 18 nt, Shigella flexneri 2a str. 301
guguaaugccagucaguu

SEQ ID NO: 1957756 - RNA, 15 nt, Shigella flexneri 2a str. 301
guuaccgaucgccag

SEQ ID NO: 1957757 - RNA, 17 nt, Shigella flexneri 2a str. 301
guuaccagcggccggau

SEQ ID NO: 1957758 - RNA, 20 nt, Shigella flexneri 2a str. 301
guuauuaaauaaccagcgca

SEQ ID NO: 1957759 - RNA, 18 nt, Shigella flexneri 2a str. 301
guuauguaacaacuggcg

SEQ ID NO: 1957760 - RNA, 19 nt, Shigella flexneri 2a str. 301
guuauuacgcccgccagaa

SEQ ID NO: 1957761 - RNA, 16 nt, Shigella flexneri 2a str. 301
guucaaaguuaccgga

SEQ ID NO: 1957762 - RNA, 14 nt, Shigella flexneri 2a str. 301
guuacagcuggagu

SEQ ID NO: 1957763 - RNA, 21 nt, Shigella flexneri 2a str. 301
guuacaacauccuauauuccu

SEQ ID NO: 1957764 - RNA, 20 nt, Shigella flexneri 2a str. 301
guuaauggcuuuacgcgcca

SEQ ID NO: 1957765 - RNA, 15 nt, Shigella flexneri 2a str. 301
guuaaucgccguaua

SEQ ID NO: 1957766 - RNA, 20 nt, Shigella flexneri 2a str. 301
guuaacgccuuauccggccu

SEQ ID NO: 1957767 - RNA, 14 nt, Shigella flexneri 2a str. 301
guuaacguuuuucg

SEQ ID NO: 1957768 - RNA, 16 nt, Shigella flexneri 2a str. 301
guguucucaucgccau

SEQ ID NO: 1957769 - RNA, 14 nt, Shigella flexneri 2a str. 301
guuaaccagcacca

SEQ ID NO: 1957770 - RNA, 20 nt, Shigella flexneri 2a str. 301
guuaaaacuuuccaugccau

SEQ ID NO: 1957771 - RNA, 19 nt, Shigella flexneri 2a str. 301
guucugguaaaccuuccac

SEQ ID NO: 1957772 - RNA, 18 nt, Shigella flexneri 2a str. 301
guucugcgacgcgcggug

SEQ ID NO: 1957773 - RNA, 15 nt, Shigella flexneri 2a str. 301
guucugaaucacgcc

SEQ ID NO: 1957774 - RNA, 18 nt, Shigella flexneri 2a str. 301
guugacguucaugccggu

SEQ ID NO: 1957775 - RNA, 14 nt, Shigella flexneri 2a str. 301
guucuacgugcgcu

SEQ ID NO: 1957776 - RNA, 22 nt, Shigella flexneri 2a str. 301
guucgcgaaaguuaccgcgcca

SEQ ID NO: 1957777 - RNA, 15 nt, Shigella flexneri 2a str. 301
guucggcaauccagu

SEQ ID NO: 1957778 - RNA, 22 nt, Shigella flexneri 2a str. 301
guucgcaaagguuuuaccgcac

SEQ ID NO: 1957779 - RNA, 21 nt, Shigella flexneri 2a str. 301
guucgauauccaguccgcgcu

SEQ ID NO: 1957780 - RNA, 18 nt, Shigella flexneri 2a str. 301
guucgagcaucacaucaa

SEQ ID NO: 1957781 - RNA, 15 nt, Shigella flexneri 2a str. 301
guucaaccaccggca

SEQ ID NO: 1957782 - RNA, 15 nt, Shigella flexneri 2a str. 301
guugagcggcaguaa

SEQ ID NO: 1957783 - RNA, 21 nt, Shigella flexneri 2a str. 301
guugagagguaaaaccugaca

SEQ ID NO: 1957784 - RNA, 18 nt, Shigella flexneri 2a str. 301
guugccuugccgaaucag

SEQ ID NO: 1957785 - RNA, 15 nt, Shigella flexneri 2a str. 301
guugcuuuucacaac

SEQ ID NO: 1957786 - RNA, 12 nt, Shigella flexneri 2a str. 301
guugcuucaucu

SEQ ID NO: 1957787 - RNA, 21 nt, Shigella flexneri 2a str. 301
guuggcggugccaucgauaau

SEQ ID NO: 1957788 - RNA, 16 nt, Shigella flexneri 2a str. 301
guugucaucaacgacg

SEQ ID NO: 1957789 - RNA, 16 nt, Shigella flexneri 2a str. 301
guuggcguugcaccga

SEQ ID NO: 1957790 - RNA, 16 nt, Shigella flexneri 2a str. 301
guuguccucgccguuu

SEQ ID NO: 1957791 - RNA, 12 nt, Shigella flexneri 2a str. 301
guugucgauaaa

SEQ ID NO: 1957792 - RNA, 23 nt, Shigella flexneri 2a str. 301
guugugauuaaacuucaccagca

SEQ ID NO: 1957793 - RNA, 16 nt, Shigella flexneri 2a str. 301
guugucugaauccauc

SEQ ID NO: 1957794 - RNA, 21 nt, Shigella flexneri 2a str. 301
guuuaacacgcucuggcaggc

SEQ ID NO: 1957795 - RNA, 20 nt, Shigella flexneri 2a str. 301
guuuaauaugcaauucacac

SEQ ID NO: 1957796 - RNA, 14 nt, Shigella flexneri 2a str. 301
guuguggguaacgu

SEQ ID NO: 1957797 - RNA, 16 nt, Shigella flexneri 2a str. 301
guuuacgaauacggcg

SEQ ID NO: 1957798 - RNA, 20 nt, Shigella flexneri 2a str. 301
guuuacgccgcauccggcau

SEQ ID NO: 1957799 - RNA, 20 nt, Shigella flexneri 2a str. 301
guuuaucgucuggaucggca

SEQ ID NO: 1957800 - RNA, 13 nt, Shigella flexneri 2a str. 301
uaagaucaucggc

SEQ ID NO: 1957801 - RNA, 20 nt, Shigella flexneri 2a str. 301
uaagaguagcccgauacgcu

SEQ ID NO: 1957802 - RNA, 18 nt, Shigella flexneri 2a str. 301
uaagacuggcaaaugaca

SEQ ID NO: 1957803 - RNA, 20 nt, Shigella flexneri 2a str. 301
uaagaaugcgaaaacgaugu

SEQ ID NO: 1957804 - RNA, 20 nt, Shigella flexneri 2a str. 301
uaacgaacgcagugauaacu

SEQ ID NO: 1957805 - RNA, 14 nt, Shigella flexneri 2a str. 301
uaaccuucaccgug

SEQ ID NO: 1957806 - RNA, 11 nt, Shigella flexneri 2a str. 301
uaauaccggau

SEQ ID NO: 1957807 - RNA, 11 nt, Shigella flexneri 2a str. 301
uaauaccguag

SEQ ID NO: 1957808 - RNA, 12 nt, Shigella flexneri 2a str. 301
uaauacgccaga

SEQ ID NO: 1957809 - RNA, 16 nt, Shigella flexneri 2a str. 301
uaauacgcaucgacau

SEQ ID NO: 1957810 - RNA, 13 nt, Shigella flexneri 2a str. 301
uaauaccaucggc

SEQ ID NO: 1957811 - RNA, 19 nt, Shigella flexneri 2a str. 301
uaagcguagcgcaucaggc

SEQ ID NO: 1957812 - RNA, 14 nt, Shigella flexneri 2a str. 301
uaagccaagcgccg

SEQ ID NO: 1957813 - RNA, 16 nt, Shigella flexneri 2a str. 301
uaagcucagaaacgcu

SEQ ID NO: 1957814 - RNA, 13 nt, Shigella flexneri 2a str. 301
uaagcugaugacg

SEQ ID NO: 1957815 - RNA, 22 nt, Shigella flexneri 2a str. 301
uaaugguccgugacccggaaua

SEQ ID NO: 1957816 - RNA, 16 nt, Shigella flexneri 2a str. 301
uaauuaggauacuuau

SEQ ID NO: 1957817 - RNA, 23 nt, Shigella flexneri 2a str. 301
uaauuacuugaugcccgguauuu

SEQ ID NO: 1957818 - RNA, 16 nt, Shigella flexneri 2a str. 301
uaaugcugucgguuua

SEQ ID NO: 1957819 - RNA, 17 nt, Shigella flexneri 2a str. 301
uaauggcgauaaucgaa

SEQ ID NO: 1957820 - RNA, 19 nt, Shigella flexneri 2a str. 301
uaaugcagaucuuacggcu

SEQ ID NO: 1957821 - RNA, 17 nt, Shigella flexneri 2a str. 301
uaaucgcauugacgcca

SEQ ID NO: 1957822 - RNA, 23 nt, Shigella flexneri 2a str. 301
uaaucgaaccaaacagcgccaga

SEQ ID NO: 1957823 - RNA, 21 nt, Shigella flexneri 2a str. 301
uaauccucuuugcuuccugag

SEQ ID NO: 1957824 - RNA, 18 nt, Shigella flexneri 2a str. 301
uaaucuuccagaucaccg

SEQ ID NO: 1957825 - RNA, 21 nt, Shigella flexneri 2a str. 301
uaaugacccaccccagcagca

SEQ ID NO: 1957826 - RNA, 18 nt, Shigella flexneri 2a str. 301
uaacacuucaucacuacc

SEQ ID NO: 1957827 - RNA, 14 nt, Shigella flexneri 2a str. 301
uaaccguccaguug

SEQ ID NO: 1957828 - RNA, 14 nt, Shigella flexneri 2a str. 301
uaaccguugaccag

SEQ ID NO: 1957829 - RNA, 15 nt, Shigella flexneri 2a str. 301
uaaccuggcaguucg

SEQ ID NO: 1957830 - RNA, 14 nt, Shigella flexneri 2a str. 301
uaaauugcgccaga

SEQ ID NO: 1957831 - RNA, 20 nt, Shigella flexneri 2a str. 301
uaaauugcguaaagccugcu

SEQ ID NO: 1957832 - RNA, 13 nt, Shigella flexneri 2a str. 301
uaacaaccggagu

SEQ ID NO: 1957833 - RNA, 20 nt, Shigella flexneri 2a str. 301
uaaaucagaacuucgcguug

SEQ ID NO: 1957834 - RNA, 14 nt, Shigella flexneri 2a str. 301
uaaaucccgccauu

SEQ ID NO: 1957835 - RNA, 19 nt, Shigella flexneri 2a str. 301
uaaaugaacucaacgccuu

SEQ ID NO: 1957836 - RNA, 23 nt, Shigella flexneri 2a str. 301
uaaaucucaucguugcgaucgac

SEQ ID NO: 1957837 - RNA, 20 nt, Shigella flexneri 2a str. 301
uaaaugccuuauccggccua

SEQ ID NO: 1957838 - RNA, 17 nt, Shigella flexneri 2a str. 301
uaaauggcgaacgggau

SEQ ID NO: 1957839 - RNA, 21 nt, Shigella flexneri 2a str. 301
uaaauauugucuauacgccuc

SEQ ID NO: 1957840 - RNA, 17 nt, Shigella flexneri 2a str. 301
uaaacagcgcugcgaaa

SEQ ID NO: 1957841 - RNA, 12 nt, Shigella flexneri 2a str. 301
uaaacgguaccg

SEQ ID NO: 1957842 - RNA, 15 nt, Shigella flexneri 2a str. 301
uaaacucaaucaggc

SEQ ID NO: 1957843 - RNA, 20 nt, Shigella flexneri 2a str. 301
uaaagccgugcugcugccaa

SEQ ID NO: 1957844 - RNA, 19 nt, Shigella flexneri 2a str. 301
uaaagauugauuauugagc

SEQ ID NO: 1957845 - RNA, 18 nt, Shigella flexneri 2a str. 301
uaaaggucgacagcagcc

SEQ ID NO: 1957846 - RNA, 20 nt, Shigella flexneri 2a str. 301
guuucauaucugccagauaa

SEQ ID NO: 1957847 - RNA, 13 nt, Shigella flexneri 2a str. 301
guuuccagcacca

SEQ ID NO: 1957848 - RNA, 21 nt, Shigella flexneri 2a str. 301
guuuccgccagcgggccggag

SEQ ID NO: 1957849 - RNA, 19 nt, Shigella flexneri 2a str. 301
uaaaauucaucaaauggca

SEQ ID NO: 1957850 - RNA, 12 nt, Shigella flexneri 2a str. 301
uaaaauuaucca

SEQ ID NO: 1957851 - RNA, 18 nt, Shigella flexneri 2a str. 301
agcgaaaacgaauacgcc

SEQ ID NO: 1957852 - RNA, 15 nt, Shigella flexneri 2a str. 301
agccugcaaacgcug

SEQ ID NO: 1957853 - RNA, 19 nt, Shigella flexneri 2a str. 301
agccucuacccgucaccgu

SEQ ID NO: 1957854 - RNA, 20 nt, Shigella flexneri 2a str. 301
agccugaagaucaacgucug

SEQ ID NO: 1957855 - RNA, 17 nt, Shigella flexneri 2a str. 301
agccugaauaaacgcca

SEQ ID NO: 1957856 - RNA, 19 nt, Shigella flexneri 2a str. 301
agccugaguuuaacggaca

SEQ ID NO: 1957857 - RNA, 22 nt, Shigella flexneri 2a str. 301
agcgacuaccacguaacgacug

SEQ ID NO: 1957858 - RNA, 14 nt, Shigella flexneri 2a str. 301
agcgaagcgugauu

SEQ ID NO: 1957859 - RNA, 22 nt, Shigella flexneri 2a str. 301
agccgaaauauggcucugcggc

SEQ ID NO: 1957860 - RNA, 20 nt, Shigella flexneri 2a str. 301
agcccuuuguaggccagaua

SEQ ID NO: 1957861 - RNA, 22 nt, Shigella flexneri 2a str. 301
agccgaucgugcuaaacaaguu

SEQ ID NO: 1957862 - RNA, 15 nt, Shigella flexneri 2a str. 301
agccggaugccucuc

SEQ ID NO: 1957863 - RNA, 19 nt, Shigella flexneri 2a str. 301
agccggaugaucauccggc

SEQ ID NO: 1957864 - RNA, 16 nt, Shigella flexneri 2a str. 301
agccggaugucuggaa

SEQ ID NO: 1957865 - RNA, 15 nt, Shigella flexneri 2a str. 301
agccggagcuggcgc

SEQ ID NO: 1957866 - RNA, 14 nt, Shigella flexneri 2a str. 301
agccgccacgaccu

SEQ ID NO: 1957867 - RNA, 19 nt, Shigella flexneri 2a str. 301
agcgaugcccagugaccaa

SEQ ID NO: 1957868 - RNA, 20 nt, Shigella flexneri 2a str. 301
agcgauuuguaggccugaua

SEQ ID NO: 1957869 - RNA, 14 nt, Shigella flexneri 2a str. 301
agcgcaaauugcug

SEQ ID NO: 1957870 - RNA, 20 nt, Shigella flexneri 2a str. 301
agcgccguuuuuuugacggu

SEQ ID NO: 1957871 - RNA, 21 nt, Shigella flexneri 2a str. 301
agcgccgucuuccccucgaaa

SEQ ID NO: 1957872 - RNA, 17 nt, Shigella flexneri 2a str. 301
agcguagcgcaucgggc

SEQ ID NO: 1957873 - RNA, 14 nt, Shigella flexneri 2a str. 301
agcguagcgcauca

SEQ ID NO: 1957874 - RNA, 22 nt, Shigella flexneri 2a str. 301
agcguagcgcaucaggcaguuu

SEQ ID NO: 1957875 - RNA, 17 nt, Shigella flexneri 2a str. 301
agcguauucgcgcagaa

SEQ ID NO: 1957876 - RNA, 15 nt, Shigella flexneri 2a str. 301
agcgguuuuugcgcc

SEQ ID NO: 1957877 - RNA, 21 nt, Shigella flexneri 2a str. 301
agcgguuuuugcgccauucau

SEQ ID NO: 1957878 - RNA, 22 nt, Shigella flexneri 2a str. 301
agcguaaaucccagcaccguca

SEQ ID NO: 1957879 - RNA, 13 nt, Shigella flexneri 2a str. 301
agcgucacaucag

SEQ ID NO: 1957880 - RNA, 17 nt, Shigella flexneri 2a str. 301
agcgucagcaccagaga

SEQ ID NO: 1957881 - RNA, 23 nt, Shigella flexneri 2a str. 301
agcgucaguuccgcuucgccaau

SEQ ID NO: 1957882 - RNA, 16 nt, Shigella flexneri 2a str. 301
agcgucaucauagacu

SEQ ID NO: 1957883 - RNA, 20 nt, Shigella flexneri 2a str. 301
agcggcggcagauugagcgu

SEQ ID NO: 1957884 - RNA, 18 nt, Shigella flexneri 2a str. 301
agcaagccgucgugaaug

SEQ ID NO: 1957885 - RNA, 19 nt, Shigella flexneri 2a str. 301
agcaaggguuuguaggccg

SEQ ID NO: 1957886 - RNA, 18 nt, Shigella flexneri 2a str. 301
agcaagucuucacugcuc

SEQ ID NO: 1957887 - RNA, 22 nt, Shigella flexneri 2a str. 301
agcaaacgaaagcagggcggca

SEQ ID NO: 1957888 - RNA, 11 nt, Shigella flexneri 2a str. 301
agcaaacgcag

SEQ ID NO: 1957889 - RNA, 18 nt, Shigella flexneri 2a str. 301
agcaaaguggcgcagagc

SEQ ID NO: 1957890 - RNA, 20 nt, Shigella flexneri 2a str. 301
agcaaauaaaacaucaccaa

SEQ ID NO: 1957891 - RNA, 14 nt, Shigella flexneri 2a str. 301
agcacaaagcgaug

SEQ ID NO: 1957892 - RNA, 17 nt, Shigella flexneri 2a str. 301
agcaaaaauaagcgacg

SEQ ID NO: 1957893 - RNA, 13 nt, Shigella flexneri 2a str. 301
agcaaaacgcccc

SEQ ID NO: 1957894 - RNA, 16 nt, Shigella flexneri 2a str. 301
agcaaaaacgcauacg

SEQ ID NO: 1957895 - RNA, 21 nt, Shigella flexneri 2a str. 301
agauccuggcgaaaacgcccg

SEQ ID NO: 1957896 - RNA, 15 nt, Shigella flexneri 2a str. 301
agauugauccccgcu

SEQ ID NO: 1957897 - RNA, 18 nt, Shigella flexneri 2a str. 301
agaucauccaugauaauu

SEQ ID NO: 1957898 - RNA, 13 nt, Shigella flexneri 2a str. 301
agcacuggcggca

SEQ ID NO: 1957899 - RNA, 22 nt, Shigella flexneri 2a str. 301
agcacgccagacaucaccagua

SEQ ID NO: 1957900 - RNA, 19 nt, Shigella flexneri 2a str. 301
agcacuuuucgcacugcag

SEQ ID NO: 1957901 - RNA, 14 nt, Shigella flexneri 2a str. 301
agcaccaccgcccg

SEQ ID NO: 1957902 - RNA, 21 nt, Shigella flexneri 2a str. 301
agcaccugcuugaacgcaccg

SEQ ID NO: 1957903 - RNA, 21 nt, Shigella flexneri 2a str. 301
agcauuggguaaaauggccga

SEQ ID NO: 1957904 - RNA, 22 nt, Shigella flexneri 2a str. 301
agcaucuguucuuuuaacgcau

SEQ ID NO: 1957905 - RNA, 14 nt, Shigella flexneri 2a str. 301
agcauaaucaccag

SEQ ID NO: 1957906 - RNA, 19 nt, Shigella flexneri 2a str. 301
agcauaaucaccaguaccg

SEQ ID NO: 1957907 - RNA, 15 nt, Shigella flexneri 2a str. 301
agcauacgaaucgcc

SEQ ID NO: 1957908 - RNA, 23 nt, Shigella flexneri 2a str. 301
agcaguuacuccgauuaccggca

SEQ ID NO: 1957909 - RNA, 14 nt, Shigella flexneri 2a str. 301
agcaguuccagcau

SEQ ID NO: 1957910 - RNA, 17 nt, Shigella flexneri 2a str. 301
agcaggagcagcagguu

SEQ ID NO: 1957911 - RNA, 14 nt, Shigella flexneri 2a str. 301
agcaggauguuccg

SEQ ID NO: 1957912 - RNA, 21 nt, Shigella flexneri 2a str. 301
agacgcggcagcgucgcaucc

SEQ ID NO: 1957913 - RNA, 13 nt, Shigella flexneri 2a str. 301
agacgccacaauc

SEQ ID NO: 1957914 - RNA, 17 nt, Shigella flexneri 2a str. 301
agaccauugcaucaucg

SEQ ID NO: 1957915 - RNA, 20 nt, Shigella flexneri 2a str. 301
agaccccagguuuucaacgu

SEQ ID NO: 1957916 - RNA, 19 nt, Shigella flexneri 2a str. 301
agaccuuaauugcuggcgc

SEQ ID NO: 1957917 - RNA, 15 nt, Shigella flexneri 2a str. 301
agagcggagcaauga

SEQ ID NO: 1957918 - RNA, 23 nt, Shigella flexneri 2a str. 301
agauaaggcguucacgccgcauc

SEQ ID NO: 1957919 - RNA, 20 nt, Shigella flexneri 2a str. 301
agauaagacgcgucaguguc

SEQ ID NO: 1957920 - RNA, 20 nt, Shigella flexneri 2a str. 301
agauaagacgcguuaguguc

SEQ ID NO: 1957921 - RNA, 15 nt, Shigella flexneri 2a str. 301
agauacaucagcgac

SEQ ID NO: 1957922 - RNA, 16 nt, Shigella flexneri 2a str. 301
agauagaaugccaagu

SEQ ID NO: 1957923 - RNA, 23 nt, Shigella flexneri 2a str. 301
agacuggcaaagcaggccagaua

SEQ ID NO: 1957924 - RNA, 16 nt, Shigella flexneri 2a str. 301
agagaaacgccagcag

SEQ ID NO: 1957925 - RNA, 14 nt, Shigella flexneri 2a str. 301
agacugaauacgcu

SEQ ID NO: 1957926 - RNA, 21 nt, Shigella flexneri 2a str. 301
agacggcugucauccagcagc

SEQ ID NO: 1957927 - RNA, 20 nt, Shigella flexneri 2a str. 301
agacgguuugcggcacaguc

SEQ ID NO: 1957928 - RNA, 18 nt, Shigella flexneri 2a str. 301
agaauuagcguccggcug

SEQ ID NO: 1957929 - RNA, 16 nt, Shigella flexneri 2a str. 301
agaauuuguaggccgg

SEQ ID NO: 1957930 - RNA, 16 nt, Shigella flexneri 2a str. 301
agacaaaauguucguc

SEQ ID NO: 1957931 - RNA, 20 nt, Shigella flexneri 2a str. 301
agacaccccuucauucaggu

SEQ ID NO: 1957932 - RNA, 14 nt, Shigella flexneri 2a str. 301
agacaccgcugcuu

SEQ ID NO: 1957933 - RNA, 16 nt, Shigella flexneri 2a str. 301
agacacuaacgcgucu

SEQ ID NO: 1957934 - RNA, 18 nt, Shigella flexneri 2a str. 301
agacacgccgccagacca

SEQ ID NO: 1957935 - RNA, 23 nt, Shigella flexneri 2a str. 301
agaccaaucccgccauaacggcu

SEQ ID NO: 1957936 - RNA, 12 nt, Shigella flexneri 2a str. 301
agacaucaaacc

SEQ ID NO: 1957937 - RNA, 18 nt, Shigella flexneri 2a str. 301
agaauaugcuuugccuua

SEQ ID NO: 1957938 - RNA, 22 nt, Shigella flexneri 2a str. 301
agaauaccuugcugcuccagcg

SEQ ID NO: 1957939 - RNA, 15 nt, Shigella flexneri 2a str. 301
agaauaauaccgucc

SEQ ID NO: 1957940 - RNA, 20 nt, Shigella flexneri 2a str. 301
agaagguuauccuucugcgu

SEQ ID NO: 1957941 - RNA, 21 nt, Shigella flexneri 2a str. 301
agaagccauuaaacaccagua

SEQ ID NO: 1957942 - RNA, 17 nt, Shigella flexneri 2a str. 301
agaagcaguaagugcgc

SEQ ID NO: 1957943 - RNA, 19 nt, Shigella flexneri 2a str. 301
agaagaugcgucagcaucg

SEQ ID NO: 1957944 - RNA, 23 nt, Shigella flexneri 2a str. 301
agaagcguagguguuacgcggau

SEQ ID NO: 1957945 - RNA, 22 nt, Shigella flexneri 2a str. 301
agaagcguaaaucccagcaccg

SEQ ID NO: 1957946 - RNA, 21 nt, Shigella flexneri 2a str. 301
agaacugagcgccgucgcgaa

SEQ ID NO: 1957947 - RNA, 22 nt, Shigella flexneri 2a str. 301
agaacugauaacgcauuucaug

SEQ ID NO: 1957948 - RNA, 16 nt, Shigella flexneri 2a str. 301
agaacggauucaguga

SEQ ID NO: 1957949 - RNA, 11 nt, Shigella flexneri 2a str. 301
agaacggcaga

SEQ ID NO: 1957950 - RNA, 14 nt, Shigella flexneri 2a str. 301
agaaauaccacccg

SEQ ID NO: 1957951 - RNA, 17 nt, Shigella flexneri 2a str. 301
acuggaaaaaguugcac

SEQ ID NO: 1957952 - RNA, 18 nt, Shigella flexneri 2a str. 301
acugcugcggaauugccg

SEQ ID NO: 1957953 - RNA, 14 nt, Shigella flexneri 2a str. 301
acugcugacgcaga

SEQ ID NO: 1957954 - RNA, 11 nt, Shigella flexneri 2a str. 301
aguggcgcauc

SEQ ID NO: 1957955 - RNA, 12 nt, Shigella flexneri 2a str. 301
aguguggcggcu

SEQ ID NO: 1957956 - RNA, 17 nt, Shigella flexneri 2a str. 301
aguguuuuauguucaga

SEQ ID NO: 1957957 - RNA, 23 nt, Shigella flexneri 2a str. 301
aguuaagcccaguucagcggcug

SEQ ID NO: 1957958 - RNA, 18 nt, Shigella flexneri 2a str. 301
aguuaccagcggccggau

SEQ ID NO: 1957959 - RNA, 16 nt, Shigella flexneri 2a str. 301
aguuacccagccugca

SEQ ID NO: 1957960 - RNA, 22 nt, Shigella flexneri 2a str. 301
aguuaguccacacgccaggcca

SEQ ID NO: 1957961 - RNA, 22 nt, Shigella flexneri 2a str. 301
aguuaguguuaaccaacggcga

SEQ ID NO: 1957962 - RNA, 22 nt, Shigella flexneri 2a str. 301
aguucgaucucuucgccugccu

SEQ ID NO: 1957963 - RNA, 14 nt, Shigella flexneri 2a str. 301
aguucacagcgcag

SEQ ID NO: 1957964 - RNA, 12 nt, Shigella flexneri 2a str. 301
aguuucaugaua

SEQ ID NO: 1957965 - RNA, 22 nt, Shigella flexneri 2a str. 301
agugcgcguuuuuuaugccgga

SEQ ID NO: 1957966 - RNA, 20 nt, Shigella flexneri 2a str. 301
agugcugaguuucagaccaa

SEQ ID NO: 1957967 - RNA, 22 nt, Shigella flexneri 2a str. 301
agugcuggccaaccggcacaau

SEQ ID NO: 1957968 - RNA, 15 nt, Shigella flexneri 2a str. 301
aguggacgaacaguu

SEQ ID NO: 1957969 - RNA, 19 nt, Shigella flexneri 2a str. 301
agugaggcuauuccacgca

SEQ ID NO: 1957970 - RNA, 19 nt, Shigella flexneri 2a str. 301
agugcauaaauaccggcau

SEQ ID NO: 1957971 - RNA, 23 nt, Shigella flexneri 2a str. 301
agugccagucgccgacguagaag

SEQ ID NO: 1957972 - RNA, 16 nt, Shigella flexneri 2a str. 301
agucuuuccccguuga

SEQ ID NO: 1957973 - RNA, 19 nt, Shigella flexneri 2a str. 301
agugaauagcgcccggaaa

SEQ ID NO: 1957974 - RNA, 23 nt, Shigella flexneri 2a str. 301
agugaaggcaaacuucucgccau

SEQ ID NO: 1957975 - RNA, 22 nt, Shigella flexneri 2a str. 301
agucuucaucauccucuucagc

SEQ ID NO: 1957976 - RNA, 21 nt, Shigella flexneri 2a str. 301
agucugaaugccgcuaccgcc

SEQ ID NO: 1957977 - RNA, 19 nt, Shigella flexneri 2a str. 301
agucgggauauucagcuca

SEQ ID NO: 1957978 - RNA, 16 nt, Shigella flexneri 2a str. 301
agucguaggccugaua

SEQ ID NO: 1957979 - RNA, 15 nt, Shigella flexneri 2a str. 301
agucguagaccgggc

SEQ ID NO: 1957980 - RNA, 16 nt, Shigella flexneri 2a str. 301
agucgcgccuuacgcu

SEQ ID NO: 1957981 - RNA, 15 nt, Shigella flexneri 2a str. 301
agucggcaucgccac

SEQ ID NO: 1957982 - RNA, 22 nt, Shigella flexneri 2a str. 301
aguccggcugcgauauucggaa

SEQ ID NO: 1957983 - RNA, 22 nt, Shigella flexneri 2a str. 301
aguccuacacacgccagugcgc

SEQ ID NO: 1957984 - RNA, 12 nt, Shigella flexneri 2a str. 301
aguccgguaaug

SEQ ID NO: 1957985 - RNA, 16 nt, Shigella flexneri 2a str. 301
agucgcgcaauugcca

SEQ ID NO: 1957986 - RNA, 14 nt, Shigella flexneri 2a str. 301
agucaaugaaauua

SEQ ID NO: 1957987 - RNA, 20 nt, Shigella flexneri 2a str. 301
aguauucaggucagcggcca

SEQ ID NO: 1957988 - RNA, 14 nt, Shigella flexneri 2a str. 301
aguaguuccagcau

SEQ ID NO: 1957989 - RNA, 16 nt, Shigella flexneri 2a str. 301
aguacgccaucacgca

SEQ ID NO: 1957990 - RNA, 13 nt, Shigella flexneri 2a str. 301
aggucgcuggcgu

SEQ ID NO: 1957991 - RNA, 14 nt, Shigella flexneri 2a str. 301
aguacguucacgca

SEQ ID NO: 1957992 - RNA, 23 nt, Shigella flexneri 2a str. 301
aguacguaaaacaagaucgcccu

SEQ ID NO: 1957993 - RNA, 23 nt, Shigella flexneri 2a str. 301
aguagcuauaaaccugcuggcgc

SEQ ID NO: 1957994 - RNA, 16 nt, Shigella flexneri 2a str. 301
auacggaauaucgcug

SEQ ID NO: 1957995 - RNA, 16 nt, Shigella flexneri 2a str. 301
auacgcuugcgcaucg

SEQ ID NO: 1957996 - RNA, 12 nt, Shigella flexneri 2a str. 301
auacgcucaucg

SEQ ID NO: 1957997 - RNA, 22 nt, Shigella flexneri 2a str. 301
auacgcaccgggcuuccggcaa

SEQ ID NO: 1957998 - RNA, 19 nt, Shigella flexneri 2a str. 301
auacgcaccgcuccaucgc

SEQ ID NO: 1957999 - RNA, 17 nt, Shigella flexneri 2a str. 301
auacgaucaaccaccgu

SEQ ID NO: 1958000 - RNA, 17 nt, Shigella flexneri 2a str. 301
auacgcauaugcaucag

SEQ ID NO: 1958001 - RNA, 15 nt, Shigella flexneri 2a str. 301
auacgccccacagac

SEQ ID NO: 1958002 - RNA, 19 nt, Shigella flexneri 2a str. 301
auaccugauuaaacggguc

SEQ ID NO: 1958003 - RNA, 17 nt, Shigella flexneri 2a str. 301
auaccgggcguccugcu

SEQ ID NO: 1958004 - RNA, 19 nt, Shigella flexneri 2a str. 301
auaccggugcaccuucaag

SEQ ID NO: 1958005 - RNA, 15 nt, Shigella flexneri 2a str. 301
auaccagaccuuuac

SEQ ID NO: 1958006 - RNA, 23 nt, Shigella flexneri 2a str. 301
auaccagccuucuucauccagcg

SEQ ID NO: 1958007 - RNA, 20 nt, Shigella flexneri 2a str. 301
auacaacucgcuuaagccau

SEQ ID NO: 1958008 - RNA, 20 nt, Shigella flexneri 2a str. 301
auacacgcccgucaugccgu

SEQ ID NO: 1958009 - RNA, 17 nt, Shigella flexneri 2a str. 301
auaagaugcgccagcau

SEQ ID NO: 1958010 - RNA, 18 nt, Shigella flexneri 2a str. 301
auaacugcuauucaccag

SEQ ID NO: 1958011 - RNA, 16 nt, Shigella flexneri 2a str. 301
auaacucauauaacgc

SEQ ID NO: 1958012 - RNA, 16 nt, Shigella flexneri 2a str. 301
auaacguuauaaccgc

SEQ ID NO: 1958013 - RNA, 21 nt, Shigella flexneri 2a str. 301
auaaguugccacgcuucaauc

SEQ ID NO: 1958014 - RNA, 12 nt, Shigella flexneri 2a str. 301
auaaccaucagc

SEQ ID NO: 1958015 - RNA, 13 nt, Shigella flexneri 2a str. 301
aguuugccguuga

SEQ ID NO: 1958016 - RNA, 15 nt, Shigella flexneri 2a str. 301
aguuugauuaacgca

SEQ ID NO: 1958017 - RNA, 19 nt, Shigella flexneri 2a str. 301
aguuugauuauucacaauu

SEQ ID NO: 1958018 - RNA, 19 nt, Shigella flexneri 2a str. 301
aguuugcaccucugcugcu

SEQ ID NO: 1958019 - RNA, 13 nt, Shigella flexneri 2a str. 301
auaacgcgucuca

SEQ ID NO: 1958020 - RNA, 11 nt, Shigella flexneri 2a str. 301
auaaccuucaa

SEQ ID NO: 1958021 - RNA, 23 nt, Shigella flexneri 2a str. 301
auaaccguaauaguuauagccgu

SEQ ID NO: 1958022 - RNA, 23 nt, Shigella flexneri 2a str. 301
auagcuaaucaucuguugugcca

SEQ ID NO: 1958023 - RNA, 17 nt, Shigella flexneri 2a str. 301
auagcggcgacuugcuc

SEQ ID NO: 1958024 - RNA, 15 nt, Shigella flexneri 2a str. 301
auaggaauccggguc

SEQ ID NO: 1958025 - RNA, 20 nt, Shigella flexneri 2a str. 301
auagucaucucuuccggcac

SEQ ID NO: 1958026 - RNA, 13 nt, Shigella flexneri 2a str. 301
auaggcaucagca

SEQ ID NO: 1958027 - RNA, 19 nt, Shigella flexneri 2a str. 301
auaggcuuugcuuagcgca

SEQ ID NO: 1958028 - RNA, 15 nt, Shigella flexneri 2a str. 301
auaucaaacgccuga

SEQ ID NO: 1958029 - RNA, 21 nt, Shigella flexneri 2a str. 301
auaugaaauccggcaccuguc

SEQ ID NO: 1958030 - RNA, 16 nt, Shigella flexneri 2a str. 301
auauucuccagcuuca

SEQ ID NO: 1958031 - RNA, 13 nt, Shigella flexneri 2a str. 301
auauucguucaga

SEQ ID NO: 1958032 - RNA, 19 nt, Shigella flexneri 2a str. 301
auauucgauacauucagaa

SEQ ID NO: 1958033 - RNA, 18 nt, Shigella flexneri 2a str. 301
auauucgccgcccugcag

SEQ ID NO: 1958034 - RNA, 18 nt, Shigella flexneri 2a str. 301
auauucaccauuacgcaa

SEQ ID NO: 1958035 - RNA, 17 nt, Shigella flexneri 2a str. 301
auauacgccaucgccag

SEQ ID NO: 1958036 - RNA, 16 nt, Shigella flexneri 2a str. 301
auauaaagcugaucac

SEQ ID NO: 1958037 - RNA, 17 nt, Shigella flexneri 2a str. 301
auauaauuccacgccau

SEQ ID NO: 1958038 - RNA, 19 nt, Shigella flexneri 2a str. 301
auaucgcugucgccauccc

SEQ ID NO: 1958039 - RNA, 19 nt, Shigella flexneri 2a str. 301
auaucaacaauacgcaccg

SEQ ID NO: 1958040 - RNA, 19 nt, Shigella flexneri 2a str. 301
agcuuucgcuuaacgccca

SEQ ID NO: 1958041 - RNA, 20 nt, Shigella flexneri 2a str. 301
agcuuucagagaagcaccgc

SEQ ID NO: 1958042 - RNA, 17 nt, Shigella flexneri 2a str. 301
agcuuuaaauuacugag

SEQ ID NO: 1958043 - RNA, 13 nt, Shigella flexneri 2a str. 301
aggaaggcaagaa

SEQ ID NO: 1958044 - RNA, 15 nt, Shigella flexneri 2a str. 301
aggaauugauucauc

SEQ ID NO: 1958045 - RNA, 20 nt, Shigella flexneri 2a str. 301
aggaaugcagucgcuguauu

SEQ ID NO: 1958046 - RNA, 16 nt, Shigella flexneri 2a str. 301
aggaaccacaaccacu

SEQ ID NO: 1958047 - RNA, 20 nt, Shigella flexneri 2a str. 301
aggaaauacguaggccugau

SEQ ID NO: 1958048 - RNA, 19 nt, Shigella flexneri 2a str. 301
agcugcucgcgagaacggc

SEQ ID NO: 1958049 - RNA, 21 nt, Shigella flexneri 2a str. 301
agcuggcaucgcaaacaugcc

SEQ ID NO: 1958050 - RNA, 17 nt, Shigella flexneri 2a str. 301
agcgucgugaaacgcgu

SEQ ID NO: 1958051 - RNA, 20 nt, Shigella flexneri 2a str. 301
agcgucguggcaaaaugcau

SEQ ID NO: 1958052 - RNA, 13 nt, Shigella flexneri 2a str. 301
agcuguaucccag

SEQ ID NO: 1958053 - RNA, 14 nt, Shigella flexneri 2a str. 301
agcuguucuggcgu

SEQ ID NO: 1958054 - RNA, 20 nt, Shigella flexneri 2a str. 301
agcuucaaauuagccgcagg

SEQ ID NO: 1958055 - RNA, 15 nt, Shigella flexneri 2a str. 301
agcuucaccgcaucg

SEQ ID NO: 1958056 - RNA, 17 nt, Shigella flexneri 2a str. 301
agcuuaguccgcgacgu

SEQ ID NO: 1958057 - RNA, 17 nt, Shigella flexneri 2a str. 301
aggcaaaaaaaaugccc

SEQ ID NO: 1958058 - RNA, 17 nt, Shigella flexneri 2a str. 301
aggcaauaaugacgcug

SEQ ID NO: 1958059 - RNA, 14 nt, Shigella flexneri 2a str. 301
aggcacaccgccgc

SEQ ID NO: 1958060 - RNA, 18 nt, Shigella flexneri 2a str. 301
aggcaaucgagcccagau

SEQ ID NO: 1958061 - RNA, 13 nt, Shigella flexneri 2a str. 301
aggcaccuggaaa

SEQ ID NO: 1958062 - RNA, 20 nt, Shigella flexneri 2a str. 301
aggcacgauaaguuugcgca

SEQ ID NO: 1958063 - RNA, 23 nt, Shigella flexneri 2a str. 301
aggaggcguaauuuccacgccaa

SEQ ID NO: 1958064 - RNA, 16 nt, Shigella flexneri 2a str. 301
aggacuucuuugcgcc

SEQ ID NO: 1958065 - RNA, 12 nt, Shigella flexneri 2a str. 301
aggcuugcugca

SEQ ID NO: 1958066 - RNA, 15 nt, Shigella flexneri 2a str. 301
agggcgauuugcucc

SEQ ID NO: 1958067 - RNA, 17 nt, Shigella flexneri 2a str. 301
agggcuaacgugcaggu

SEQ ID NO: 1958068 - RNA, 20 nt, Shigella flexneri 2a str. 301
agguccuccuguaccuucac

SEQ ID NO: 1958069 - RNA, 21 nt, Shigella flexneri 2a str. 301
agguccguauagaucagcggu

SEQ ID NO: 1958070 - RNA, 22 nt, Shigella flexneri 2a str. 301
aggucaaccuagccuuccuugu

SEQ ID NO: 1958071 - RNA, 20 nt, Shigella flexneri 2a str. 301
agguauaccgaaaucgccau

SEQ ID NO: 1958072 - RNA, 23 nt, Shigella flexneri 2a str. 301
agguauaccggaccaauaacgcu

SEQ ID NO: 1958073 - RNA, 20 nt, Shigella flexneri 2a str. 301
agguaacaaaugugccauua

SEQ ID NO: 1958074 - RNA, 17 nt, Shigella flexneri 2a str. 301
aggguuuuauaaucgca

SEQ ID NO: 1958075 - RNA, 14 nt, Shigella flexneri 2a str. 301
agggcuggcaauga

SEQ ID NO: 1958076 - RNA, 18 nt, Shigella flexneri 2a str. 301
aggggacauuuagcggcc

SEQ ID NO: 1958077 - RNA, 19 nt, Shigella flexneri 2a str. 301
aggggcgaaaucggcguaa

SEQ ID NO: 1958078 - RNA, 14 nt, Shigella flexneri 2a str. 301
aggcucugauugcc

SEQ ID NO: 1958079 - RNA, 17 nt, Shigella flexneri 2a str. 301
aggcgaaaggcuggcgg

SEQ ID NO: 1958080 - RNA, 17 nt, Shigella flexneri 2a str. 301
aggccuguggugauuca

SEQ ID NO: 1958081 - RNA, 22 nt, Shigella flexneri 2a str. 301
aggccugauaagcgcagcgcau

SEQ ID NO: 1958082 - RNA, 23 nt, Shigella flexneri 2a str. 301
aggcgaaucuuagugcgccugau

SEQ ID NO: 1958083 - RNA, 14 nt, Shigella flexneri 2a str. 301
cacaggcaucguga

SEQ ID NO: 1958084 - RNA, 23 nt, Shigella flexneri 2a str. 301
cacagcggugcgaauugccacca

SEQ ID NO: 1958085 - RNA, 16 nt, Shigella flexneri 2a str. 301
cacauacugcaucagc

SEQ ID NO: 1958086 - RNA, 21 nt, Shigella flexneri 2a str. 301
cacaguuucauaucugccaga

SEQ ID NO: 1958087 - RNA, 16 nt, Shigella flexneri 2a str. 301
cacaucaucaaagcca

SEQ ID NO: 1958088 - RNA, 11 nt, Shigella flexneri 2a str. 301
cacauccggcc

SEQ ID NO: 1958089 - RNA, 14 nt, Shigella flexneri 2a str. 301
cacauccaguggcg

SEQ ID NO: 1958090 - RNA, 13 nt, Shigella flexneri 2a str. 301
cacaucgcugaca

SEQ ID NO: 1958091 - RNA, 13 nt, Shigella flexneri 2a str. 301
caccaauauugac

SEQ ID NO: 1958092 - RNA, 22 nt, Shigella flexneri 2a str. 301
caccaaacgggcaagccagcau

SEQ ID NO: 1958093 - RNA, 17 nt, Shigella flexneri 2a str. 301
caccaaacuucagcccu

SEQ ID NO: 1958094 - RNA, 19 nt, Shigella flexneri 2a str. 301
cacauuuuguaggccugau

SEQ ID NO: 1958095 - RNA, 17 nt, Shigella flexneri 2a str. 301
cacauuauaggccugau

SEQ ID NO: 1958096 - RNA, 21 nt, Shigella flexneri 2a str. 301
cacaugccgcgcgguauaucc

SEQ ID NO: 1958097 - RNA, 12 nt, Shigella flexneri 2a str. 301
cacaugcugaca

SEQ ID NO: 1958098 - RNA, 23 nt, Shigella flexneri 2a str. 301
caccaauguaggccugauaagac

SEQ ID NO: 1958099 - RNA, 15 nt, Shigella flexneri 2a str. 301
caccaauugccggau

SEQ ID NO: 1958100 - RNA, 22 nt, Shigella flexneri 2a str. 301
caccacaaacucuuuuccggaa

SEQ ID NO: 1958101 - RNA, 18 nt, Shigella flexneri 2a str. 301
caccaauguaggccugau

SEQ ID NO: 1958102 - RNA, 19 nt, Shigella flexneri 2a str. 301
caccacaccggaccagacg

SEQ ID NO: 1958103 - RNA, 21 nt, Shigella flexneri 2a str. 301
caccaccgcccguuccaccgc

SEQ ID NO: 1958104 - RNA, 15 nt, Shigella flexneri 2a str. 301
caccaccgcauccgg

SEQ ID NO: 1958105 - RNA, 21 nt, Shigella flexneri 2a str. 301
caccacgccugccgccagcau

SEQ ID NO: 1958106 - RNA, 14 nt, Shigella flexneri 2a str. 301
caccacgcagcagc

SEQ ID NO: 1958107 - RNA, 18 nt, Shigella flexneri 2a str. 301
cacaccaguccagcgccu

SEQ ID NO: 1958108 - RNA, 16 nt, Shigella flexneri 2a str. 301
cacaccacugcgcaua

SEQ ID NO: 1958109 - RNA, 13 nt, Shigella flexneri 2a str. 301
cacaccaccguuu

SEQ ID NO: 1958110 - RNA, 21 nt, Shigella flexneri 2a str. 301
cacaaaaaguaguuccagcau

SEQ ID NO: 1958111 - RNA, 14 nt, Shigella flexneri 2a str. 301
cacaaacagcgccu

SEQ ID NO: 1958112 - RNA, 21 nt, Shigella flexneri 2a str. 301
cacaacauccgaggacagcau

SEQ ID NO: 1958113 - RNA, 20 nt, Shigella flexneri 2a str. 301
cacagaggcagcaucucgcg

SEQ ID NO: 1958114 - RNA, 15 nt, Shigella flexneri 2a str. 301
cacagaaggccagga

SEQ ID NO: 1958115 - RNA, 17 nt, Shigella flexneri 2a str. 301
caaugaccacuccggca

SEQ ID NO: 1958116 - RNA, 22 nt, Shigella flexneri 2a str. 301
caaugcgcugaguguaacgcuu

SEQ ID NO: 1958117 - RNA, 23 nt, Shigella flexneri 2a str. 301
caaugcgcugaguguaacgcuug

SEQ ID NO: 1958118 - RNA, 21 nt, Shigella flexneri 2a str. 301
caaugcgggugcaaucaacac

SEQ ID NO: 1958119 - RNA, 18 nt, Shigella flexneri 2a str. 301
caaugaaauccauugauu

SEQ ID NO: 1958120 - RNA, 15 nt, Shigella flexneri 2a str. 301
caauuauaauacgcu

SEQ ID NO: 1958121 - RNA, 23 nt, Shigella flexneri 2a str. 301
caauuagugggauucaccaaucg

SEQ ID NO: 1958122 - RNA, 18 nt, Shigella flexneri 2a str. 301
caauucacgaauauuucc

SEQ ID NO: 1958123 - RNA, 17 nt, Shigella flexneri 2a str. 301
caauuaccgccaccagg

SEQ ID NO: 1958124 - RNA, 18 nt, Shigella flexneri 2a str. 301
caauuaauugccagccgu

SEQ ID NO: 1958125 - RNA, 22 nt, Shigella flexneri 2a str. 301
caauuaccuuccacaauggcau

SEQ ID NO: 1958126 - RNA, 19 nt, Shigella flexneri 2a str. 301
caauuacgccgagcgccag

SEQ ID NO: 1958127 - RNA, 18 nt, Shigella flexneri 2a str. 301
caauggccguuccggcaa

SEQ ID NO: 1958128 - RNA, 13 nt, Shigella flexneri 2a str. 301
caccaggcuugcu

SEQ ID NO: 1958129 - RNA, 15 nt, Shigella flexneri 2a str. 301
caccaguaccgccac

SEQ ID NO: 1958130 - RNA, 17 nt, Shigella flexneri 2a str. 301
caccagugcaggcacca

SEQ ID NO: 1958131 - RNA, 17 nt, Shigella flexneri 2a str. 301
caccacuucacccgccg

SEQ ID NO: 1958132 - RNA, 17 nt, Shigella flexneri 2a str. 301
caccacugccagcgguu

SEQ ID NO: 1958133 - RNA, 16 nt, Shigella flexneri 2a str. 301
caccaugccacagaau

SEQ ID NO: 1958134 - RNA, 19 nt, Shigella flexneri 2a str. 301
caccaucuuugugacgugu

SEQ ID NO: 1958135 - RNA, 17 nt, Shigella flexneri 2a str. 301
caccaucucuuacuuga

SEQ ID NO: 1958136 - RNA, 18 nt, Shigella flexneri 2a str. 301
caccaucggacggaagac

SEQ ID NO: 1958137 - RNA, 21 nt, Shigella flexneri 2a str. 301
caccauauucagcagcagaca

SEQ ID NO: 1958138 - RNA, 16 nt, Shigella flexneri 2a str. 301
caccauauucagcagc

SEQ ID NO: 1958139 - RNA, 23 nt, Shigella flexneri 2a str. 301
caccaucauuauucucagcgguu

SEQ ID NO: 1958140 - RNA, 21 nt, Shigella flexneri 2a str. 301
caccaguuuucggauuuaccg

SEQ ID NO: 1958141 - RNA, 21 nt, Shigella flexneri 2a str. 301
cacccauguugaucgccacgu

SEQ ID NO: 1958142 - RNA, 19 nt, Shigella flexneri 2a str. 301
cacccgaaggaggcgugcu

SEQ ID NO: 1958143 - RNA, 14 nt, Shigella flexneri 2a str. 301
cacccgcagcacgg

SEQ ID NO: 1958144 - RNA, 15 nt, Shigella flexneri 2a str. 301
cacccgcagccauca

SEQ ID NO: 1958145 - RNA, 17 nt, Shigella flexneri 2a str. 301
caccgccagcaucggcg

SEQ ID NO: 1958146 - RNA, 22 nt, Shigella flexneri 2a str. 301
caccgccagcaucggcggcgua

SEQ ID NO: 1958147 - RNA, 21 nt, Shigella flexneri 2a str. 301
caccgcaccuguaauacggcu

SEQ ID NO: 1958148 - RNA, 12 nt, Shigella flexneri 2a str. 301
caccgcagccgc

SEQ ID NO: 1958149 - RNA, 18 nt, Shigella flexneri 2a str. 301
caccgcagagaucgcccc

SEQ ID NO: 1958150 - RNA, 23 nt, Shigella flexneri 2a str. 301
caccgcaaaauagguaucguaau

SEQ ID NO: 1958151 - RNA, 19 nt, Shigella flexneri 2a str. 301
caccgauuuuguaaaagaa

SEQ ID NO: 1958152 - RNA, 19 nt, Shigella flexneri 2a str. 301
cacccgguaucaaacccuu

SEQ ID NO: 1958153 - RNA, 12 nt, Shigella flexneri 2a str. 301
caccgccgagac

SEQ ID NO: 1958154 - RNA, 15 nt, Shigella flexneri 2a str. 301
caacgcggcggugau

SEQ ID NO: 1958155 - RNA, 22 nt, Shigella flexneri 2a str. 301
caacgcuuucccugaagcaguu

SEQ ID NO: 1958156 - RNA, 16 nt, Shigella flexneri 2a str. 301
caacggaugugacgga

SEQ ID NO: 1958157 - RNA, 14 nt, Shigella flexneri 2a str. 301
caacgcgcggugau

SEQ ID NO: 1958158 - RNA, 15 nt, Shigella flexneri 2a str. 301
caacgcgccgccaac

SEQ ID NO: 1958159 - RNA, 15 nt, Shigella flexneri 2a str. 301
caacgccgccagacc

SEQ ID NO: 1958160 - RNA, 19 nt, Shigella flexneri 2a str. 301
caacgcccuuaccgccagu

SEQ ID NO: 1958161 - RNA, 18 nt, Shigella flexneri 2a str. 301
caacgccccuucugccgc

SEQ ID NO: 1958162 - RNA, 15 nt, Shigella flexneri 2a str. 301
caacgcaacaucgca

SEQ ID NO: 1958163 - RNA, 14 nt, Shigella flexneri 2a str. 301
caacgccagcagca

SEQ ID NO: 1958164 - RNA, 18 nt, Shigella flexneri 2a str. 301
caacccuuuccagcgccg

SEQ ID NO: 1958165 - RNA, 20 nt, Shigella flexneri 2a str. 301
caacacucaguccgccuuca

SEQ ID NO: 1958166 - RNA, 13 nt, Shigella flexneri 2a str. 301
caaaguuaccgga

SEQ ID NO: 1958167 - RNA, 18 nt, Shigella flexneri 2a str. 301
caaaguaaaaaagggcga

SEQ ID NO: 1958168 - RNA, 18 nt, Shigella flexneri 2a str. 301
caaaguacggacgcggca

SEQ ID NO: 1958169 - RNA, 14 nt, Shigella flexneri 2a str. 301
caaagucaaacugg

SEQ ID NO: 1958170 - RNA, 21 nt, Shigella flexneri 2a str. 301
caacagacgacgagucacgga

SEQ ID NO: 1958171 - RNA, 17 nt, Shigella flexneri 2a str. 301
caacagcaccagcaggu

SEQ ID NO: 1958172 - RNA, 17 nt, Shigella flexneri 2a str. 301
caacagguaaggcgcga

SEQ ID NO: 1958173 - RNA, 23 nt, Shigella flexneri 2a str. 301
caacauauuccgcaccugccagc

SEQ ID NO: 1958174 - RNA, 14 nt, Shigella flexneri 2a str. 301
caacaucacaccug

SEQ ID NO: 1958175 - RNA, 21 nt, Shigella flexneri 2a str. 301
caaccagcagauguagcucac

SEQ ID NO: 1958176 - RNA, 14 nt, Shigella flexneri 2a str. 301
caaccagcacgccg

SEQ ID NO: 1958177 - RNA, 19 nt, Shigella flexneri 2a str. 301
caaccacuuuaucgagaau

SEQ ID NO: 1958178 - RNA, 14 nt, Shigella flexneri 2a str. 301
caaccagcgucagc

SEQ ID NO: 1958179 - RNA, 22 nt, Shigella flexneri 2a str. 301
caaccaguuacgugcugcgcag

SEQ ID NO: 1958180 - RNA, 22 nt, Shigella flexneri 2a str. 301
caaccauacggucugccagucg

SEQ ID NO: 1958181 - RNA, 20 nt, Shigella flexneri 2a str. 301
caagaacagccuuaaacuca

SEQ ID NO: 1958182 - RNA, 19 nt, Shigella flexneri 2a str. 301
caacggccaaauauccgcg

SEQ ID NO: 1958183 - RNA, 16 nt, Shigella flexneri 2a str. 301
caacggcgagccagcg

SEQ ID NO: 1958184 - RNA, 23 nt, Shigella flexneri 2a str. 301
caacgggcaccgccgccgcuucu

SEQ ID NO: 1958185 - RNA, 22 nt, Shigella flexneri 2a str. 301
caacugauguagucauacugcg

SEQ ID NO: 1958186 - RNA, 10 nt, Shigella flexneri 2a str. 301
caacugcgcu

SEQ ID NO: 1958187 - RNA, 11 nt, Shigella flexneri 2a str. 301
caacugccagu

SEQ ID NO: 1958188 - RNA, 20 nt, Shigella flexneri 2a str. 301
caagcggagaagguuggcgu

SEQ ID NO: 1958189 - RNA, 21 nt, Shigella flexneri 2a str. 301
caagcggaauauuuuuaccgu

SEQ ID NO: 1958190 - RNA, 15 nt, Shigella flexneri 2a str. 301
caaggcaucgugauc

SEQ ID NO: 1958191 - RNA, 18 nt, Shigella flexneri 2a str. 301
caagcgucgcaucaggca

SEQ ID NO: 1958192 - RNA, 19 nt, Shigella flexneri 2a str. 301
caagcguaugauugccuga

SEQ ID NO: 1958193 - RNA, 22 nt, Shigella flexneri 2a str. 301
caagccagguuuugaccagucg

SEQ ID NO: 1958194 - RNA, 22 nt, Shigella flexneri 2a str. 301
caagcagagagacaaucgccac

SEQ ID NO: 1958195 - RNA, 18 nt, Shigella flexneri 2a str. 301
caagcaccuuauccggcc

SEQ ID NO: 1958196 - RNA, 16 nt, Shigella flexneri 2a str. 301
caagcacaugcugaca

SEQ ID NO: 1958197 - RNA, 15 nt, Shigella flexneri 2a str. 301
caagauuagcgacga

SEQ ID NO: 1958198 - RNA, 21 nt, Shigella flexneri 2a str. 301
caaacagcgcgccagccacca

SEQ ID NO: 1958199 - RNA, 20 nt, Shigella flexneri 2a str. 301
caaacagaugaugcgucuca

SEQ ID NO: 1958200 - RNA, 17 nt, Shigella flexneri 2a str. 301
caaacagacuggcaacg

SEQ ID NO: 1958201 - RNA, 21 nt, Shigella flexneri 2a str. 301
caaaaucuucuaacgacauuu

SEQ ID NO: 1958202 - RNA, 17 nt, Shigella flexneri 2a str. 301
caaaauagguaucguaa

SEQ ID NO: 1958203 - RNA, 22 nt, Shigella flexneri 2a str. 301
caaaacugcacuggcuuccagc

SEQ ID NO: 1958204 - RNA, 22 nt, Shigella flexneri 2a str. 301
caaaaccgauuaauugccgcca

SEQ ID NO: 1958205 - RNA, 13 nt, Shigella flexneri 2a str. 301
caaaaccugccgc

SEQ ID NO: 1958206 - RNA, 15 nt, Shigella flexneri 2a str. 301
caaaacggucacggc

SEQ ID NO: 1958207 - RNA, 13 nt, Shigella flexneri 2a str. 301
caaaacacugcgc

SEQ ID NO: 1958208 - RNA, 21 nt, Shigella flexneri 2a str. 301
caaaacagcgacaccagccau

SEQ ID NO: 1958209 - RNA, 20 nt, Shigella flexneri 2a str. 301
caaagauaaaauaaccaucu

SEQ ID NO: 1958210 - RNA, 16 nt, Shigella flexneri 2a str. 301
caaagcagaguugcug

SEQ ID NO: 1958211 - RNA, 19 nt, Shigella flexneri 2a str. 301
caaagccaauuaacgaaau

SEQ ID NO: 1958212 - RNA, 13 nt, Shigella flexneri 2a str. 301
caaagcccaucac

SEQ ID NO: 1958213 - RNA, 22 nt, Shigella flexneri 2a str. 301
caaaggugaagguugucaucaa

SEQ ID NO: 1958214 - RNA, 22 nt, Shigella flexneri 2a str. 301
caaacagucgcccgaccaucgc

SEQ ID NO: 1958215 - RNA, 20 nt, Shigella flexneri 2a str. 301
caaacaucaugccggccagc

SEQ ID NO: 1958216 - RNA, 17 nt, Shigella flexneri 2a str. 301
caaaccacccagcagcg

SEQ ID NO: 1958217 - RNA, 15 nt, Shigella flexneri 2a str. 301
caaaccaacgcuguc

SEQ ID NO: 1958218 - RNA, 16 nt, Shigella flexneri 2a str. 301
caaacgcucccugcca

SEQ ID NO: 1958219 - RNA, 15 nt, Shigella flexneri 2a str. 301
caaacgcaucgccaa

SEQ ID NO: 1958220 - RNA, 21 nt, Shigella flexneri 2a str. 301
auuuuuaugccggaucaggcg

SEQ ID NO: 1958221 - RNA, 14 nt, Shigella flexneri 2a str. 301
auuuuucagcccac

SEQ ID NO: 1958222 - RNA, 16 nt, Shigella flexneri 2a str. 301
auuuuuucgacaucaa

SEQ ID NO: 1958223 - RNA, 17 nt, Shigella flexneri 2a str. 301
auuuuuuccagcgcaug

SEQ ID NO: 1958224 - RNA, 16 nt, Shigella flexneri 2a str. 301
caaaaaaaacagcgcc

SEQ ID NO: 1958225 - RNA, 18 nt, Shigella flexneri 2a str. 301
caaaaagcguauccugac

SEQ ID NO: 1958226 - RNA, 15 nt, Shigella flexneri 2a str. 301
caaaaagcgggcgac

SEQ ID NO: 1958227 - RNA, 17 nt, Shigella flexneri 2a str. 301
caaaaacuucggcgcga

SEQ ID NO: 1958228 - RNA, 17 nt, Shigella flexneri 2a str. 301
caaaaaauugcgucagu

SEQ ID NO: 1958229 - RNA, 13 nt, Shigella flexneri 2a str. 301
auuuugugcagca

SEQ ID NO: 1958230 - RNA, 20 nt, Shigella flexneri 2a str. 301
auuuugcccggacauugcgc

SEQ ID NO: 1958231 - RNA, 21 nt, Shigella flexneri 2a str. 301
auuuugcccugcugaucgcca

SEQ ID NO: 1958232 - RNA, 21 nt, Shigella flexneri 2a str. 301
auuuugcgacccguuuacggc

SEQ ID NO: 1958233 - RNA, 18 nt, Shigella flexneri 2a str. 301
auuuuccuccagcagcac

SEQ ID NO: 1958234 - RNA, 16 nt, Shigella flexneri 2a str. 301
auuugcuccagcgaac

SEQ ID NO: 1958235 - RNA, 18 nt, Shigella flexneri 2a str. 301
auuugcgccgcaucgcca

SEQ ID NO: 1958236 - RNA, 18 nt, Shigella flexneri 2a str. 301
auuuguaguuugauaauu

SEQ ID NO: 1958237 - RNA, 19 nt, Shigella flexneri 2a str. 301
auuuggcugagugaaucag

SEQ ID NO: 1958238 - RNA, 22 nt, Shigella flexneri 2a str. 301
auuugugcuggcaaaucagugg

SEQ ID NO: 1958239 - RNA, 14 nt, Shigella flexneri 2a str. 301
auuuguugagcugg

SEQ ID NO: 1958240 - RNA, 15 nt, Shigella flexneri 2a str. 301
auuucugccagcggg

SEQ ID NO: 1958241 - RNA, 19 nt, Shigella flexneri 2a str. 301
auuucuucaccagccugca

SEQ ID NO: 1958242 - RNA, 16 nt, Shigella flexneri 2a str. 301
auuucuuuaucaccaa

SEQ ID NO: 1958243 - RNA, 20 nt, Shigella flexneri 2a str. 301
auuucgauagacucccagcc

SEQ ID NO: 1958244 - RNA, 18 nt, Shigella flexneri 2a str. 301
auuucguugugucgccag

SEQ ID NO: 1958245 - RNA, 19 nt, Shigella flexneri 2a str. 301
auuucaaugcauuaucaga

SEQ ID NO: 1958246 - RNA, 20 nt, Shigella flexneri 2a str. 301
auuucaauaucguuaucacc

SEQ ID NO: 1958247 - RNA, 23 nt, Shigella flexneri 2a str. 301
auuucaccgggccgaccgcuuca

SEQ ID NO: 1958248 - RNA, 17 nt, Shigella flexneri 2a str. 301
auuuccgcgcaaucgcc

SEQ ID NO: 1958249 - RNA, 22 nt, Shigella flexneri 2a str. 301
auuuccgccaccugauccaucg

SEQ ID NO: 1958250 - RNA, 14 nt, Shigella flexneri 2a str. 301
auuuccccaaaacg

SEQ ID NO: 1958251 - RNA, 15 nt, Shigella flexneri 2a str. 301
auuuccccuguugca

SEQ ID NO: 1958252 - RNA, 20 nt, Shigella flexneri 2a str. 301
auuucccgcacguuggcggu

SEQ ID NO: 1958253 - RNA, 13 nt, Shigella flexneri 2a str. 301
auuuccgcugauu

SEQ ID NO: 1958254 - RNA, 20 nt, Shigella flexneri 2a str. 301
auuuccguuaaccuaaagcc

SEQ ID NO: 1958255 - RNA, 14 nt, Shigella flexneri 2a str. 301
auuucauccaugcc

SEQ ID NO: 1958256 - RNA, 16 nt, Shigella flexneri 2a str. 301
auuuccaggagauuaa

SEQ ID NO: 1958257 - RNA, 16 nt, Shigella flexneri 2a str. 301
auuucagcguacaaua

SEQ ID NO: 1958258 - RNA, 16 nt, Shigella flexneri 2a str. 301
auucccgccagaugau

SEQ ID NO: 1958259 - RNA, 21 nt, Shigella flexneri 2a str. 301
auucccagcaccuguugugcg

SEQ ID NO: 1958260 - RNA, 19 nt, Shigella flexneri 2a str. 301
auucccaggcaccgucaac

SEQ ID NO: 1958261 - RNA, 18 nt, Shigella flexneri 2a str. 301
auuccagucugcuggcga

SEQ ID NO: 1958262 - RNA, 12 nt, Shigella flexneri 2a str. 301
auuuauaucagu

SEQ ID NO: 1958263 - RNA, 22 nt, Shigella flexneri 2a str. 301
auuuaucgacugccagagucaa

SEQ ID NO: 1958264 - RNA, 20 nt, Shigella flexneri 2a str. 301
auuuacgccgcauccggcaa

SEQ ID NO: 1958265 - RNA, 21 nt, Shigella flexneri 2a str. 301
aucccagaagguuucgccgcu

SEQ ID NO: 1958266 - RNA, 22 nt, Shigella flexneri 2a str. 301
aucccaaccgcgacaguaucau

SEQ ID NO: 1958267 - RNA, 12 nt, Shigella flexneri 2a str. 301
aucccauccgcg

SEQ ID NO: 1958268 - RNA, 18 nt, Shigella flexneri 2a str. 301
auccccagccuaagccau

SEQ ID NO: 1958269 - RNA, 15 nt, Shigella flexneri 2a str. 301
auccauaagauugca

SEQ ID NO: 1958270 - RNA, 22 nt, Shigella flexneri 2a str. 301
auccauacggcagagaucgccg

SEQ ID NO: 1958271 - RNA, 22 nt, Shigella flexneri 2a str. 301
auccauuccggccaucgccuga

SEQ ID NO: 1958272 - RNA, 21 nt, Shigella flexneri 2a str. 301
auccauuccggccaucgccug

SEQ ID NO: 1958273 - RNA, 16 nt, Shigella flexneri 2a str. 301
auccaucagaccuucg

SEQ ID NO: 1958274 - RNA, 14 nt, Shigella flexneri 2a str. 301
auccagcagcaaug

SEQ ID NO: 1958275 - RNA, 21 nt, Shigella flexneri 2a str. 301
auccacugccugucacggcgc

SEQ ID NO: 1958276 - RNA, 22 nt, Shigella flexneri 2a str. 301
auccacguugugguaaagcggc

SEQ ID NO: 1958277 - RNA, 17 nt, Shigella flexneri 2a str. 301
auccacugucaaaucca

SEQ ID NO: 1958278 - RNA, 19 nt, Shigella flexneri 2a str. 301
auccagaaacucugcggca

SEQ ID NO: 1958279 - RNA, 16 nt, Shigella flexneri 2a str. 301
auccagcugcgcgcga

SEQ ID NO: 1958280 - RNA, 13 nt, Shigella flexneri 2a str. 301
auccggccuuccu

SEQ ID NO: 1958281 - RNA, 15 nt, Shigella flexneri 2a str. 301
auccguaaagcccau

SEQ ID NO: 1958282 - RNA, 16 nt, Shigella flexneri 2a str. 301
auccguaaugccugau

SEQ ID NO: 1958283 - RNA, 14 nt, Shigella flexneri 2a str. 301
auccguccuacgaa

SEQ ID NO: 1958284 - RNA, 22 nt, Shigella flexneri 2a str. 301
auccggucuaccgauccggcac

SEQ ID NO: 1958285 - RNA, 17 nt, Shigella flexneri 2a str. 301
auccggccuacagaccg

SEQ ID NO: 1958286 - RNA, 14 nt, Shigella flexneri 2a str. 301
aucccucucaucca

SEQ ID NO: 1958287 - RNA, 21 nt, Shigella flexneri 2a str. 301
aucccgcuaaguugaaucggc

SEQ ID NO: 1958288 - RNA, 12 nt, Shigella flexneri 2a str. 301
auccccugcgcg

SEQ ID NO: 1958289 - RNA, 16 nt, Shigella flexneri 2a str. 301
aucccgccagcaccag

SEQ ID NO: 1958290 - RNA, 14 nt, Shigella flexneri 2a str. 301
aucagcuccggcag

SEQ ID NO: 1958291 - RNA, 17 nt, Shigella flexneri 2a str. 301
auauugccguccggcau

SEQ ID NO: 1958292 - RNA, 22 nt, Shigella flexneri 2a str. 301
auauugccguccggcaucgcaa

SEQ ID NO: 1958293 - RNA, 14 nt, Shigella flexneri 2a str. 301
auauugaugcucac

SEQ ID NO: 1958294 - RNA, 16 nt, Shigella flexneri 2a str. 301
aucaggggcagcacca

SEQ ID NO: 1958295 - RNA, 15 nt, Shigella flexneri 2a str. 301
aucaguuaacggcag

SEQ ID NO: 1958296 - RNA, 18 nt, Shigella flexneri 2a str. 301
aucauagcgaauaauccc

SEQ ID NO: 1958297 - RNA, 23 nt, Shigella flexneri 2a str. 301
auccaccauuggcgcauagccgu

SEQ ID NO: 1958298 - RNA, 18 nt, Shigella flexneri 2a str. 301
auccaccgccacgccgag

SEQ ID NO: 1958299 - RNA, 18 nt, Shigella flexneri 2a str. 301
aucauuuuuucccauuac

SEQ ID NO: 1958300 - RNA, 22 nt, Shigella flexneri 2a str. 301
aucaugguaucgggcaguuuac

SEQ ID NO: 1958301 - RNA, 19 nt, Shigella flexneri 2a str. 301
aucaugucgcccacgccag

SEQ ID NO: 1958302 - RNA, 13 nt, Shigella flexneri 2a str. 301
aucauuacgccag

SEQ ID NO: 1958303 - RNA, 22 nt, Shigella flexneri 2a str. 301
aucaugcugccgggcaaucgcc

SEQ ID NO: 1958304 - RNA, 18 nt, Shigella flexneri 2a str. 301
aucaugccggccagcgcc

SEQ ID NO: 1958305 - RNA, 17 nt, Shigella flexneri 2a str. 301
aucaugacgggcaagaa

SEQ ID NO: 1958306 - RNA, 22 nt, Shigella flexneri 2a str. 301
aucaucuuccgguagaugccag

SEQ ID NO: 1958307 - RNA, 22 nt, Shigella flexneri 2a str. 301
aucaucucccacgcggcaacgg

SEQ ID NO: 1958308 - RNA, 20 nt, Shigella flexneri 2a str. 301
aucaucggucagcguugcca

SEQ ID NO: 1958309 - RNA, 12 nt, Shigella flexneri 2a str. 301
aucaucgucacc

SEQ ID NO: 1958310 - RNA, 20 nt, Shigella flexneri 2a str. 301
aucaucgcguacucaccgcu

SEQ ID NO: 1958311 - RNA, 23 nt, Shigella flexneri 2a str. 301
aucaucgcccaguugaucaccag

SEQ ID NO: 1958312 - RNA, 17 nt, Shigella flexneri 2a str. 301
aucauccagcacgguga

SEQ ID NO: 1958313 - RNA, 13 nt, Shigella flexneri 2a str. 301
aucauccagaccg

SEQ ID NO: 1958314 - RNA, 20 nt, Shigella flexneri 2a str. 301
aucaucaauugccacuucgu

SEQ ID NO: 1958315 - RNA, 16 nt, Shigella flexneri 2a str. 301
aucguuaauuaacgcg

SEQ ID NO: 1958316 - RNA, 21 nt, Shigella flexneri 2a str. 301
aucgugcugguagaagcuggc

SEQ ID NO: 1958317 - RNA, 19 nt, Shigella flexneri 2a str. 301
aucgucgcggucgccguca

SEQ ID NO: 1958318 - RNA, 19 nt, Shigella flexneri 2a str. 301
aucucagauaaaugcaaac

SEQ ID NO: 1958319 - RNA, 16 nt, Shigella flexneri 2a str. 301
aucucauagcgcccuu

SEQ ID NO: 1958320 - RNA, 14 nt, Shigella flexneri 2a str. 301
aucucauccaucaa

SEQ ID NO: 1958321 - RNA, 16 nt, Shigella flexneri 2a str. 301
aucucagauaaaugca

SEQ ID NO: 1958322 - RNA, 13 nt, Shigella flexneri 2a str. 301
aucuccagcgcau

SEQ ID NO: 1958323 - RNA, 22 nt, Shigella flexneri 2a str. 301
aucuccagaucuuuuugcgcaa

SEQ ID NO: 1958324 - RNA, 13 nt, Shigella flexneri 2a str. 301
aucucgucagcau

SEQ ID NO: 1958325 - RNA, 23 nt, Shigella flexneri 2a str. 301
aucucugcgcuauccagcgcaua

SEQ ID NO: 1958326 - RNA, 21 nt, Shigella flexneri 2a str. 301
aucucugguuuguuuucagau

SEQ ID NO: 1958327 - RNA, 18 nt, Shigella flexneri 2a str. 301
aucucuucguuuucaacg

SEQ ID NO: 1958328 - RNA, 16 nt, Shigella flexneri 2a str. 301
aucucuugcuggcauu

SEQ ID NO: 1958329 - RNA, 15 nt, Shigella flexneri 2a str. 301
aucggcaucgcucca

SEQ ID NO: 1958330 - RNA, 19 nt, Shigella flexneri 2a str. 301
aucggcauuaaucugcucg

SEQ ID NO: 1958331 - RNA, 22 nt, Shigella flexneri 2a str. 301
aucggagaacugcaacucaccu

SEQ ID NO: 1958332 - RNA, 17 nt, Shigella flexneri 2a str. 301
aucgggauaucgccggu

SEQ ID NO: 1958333 - RNA, 12 nt, Shigella flexneri 2a str. 301
aucgggcguuau

SEQ ID NO: 1958334 - RNA, 21 nt, Shigella flexneri 2a str. 301
aucgggaacgcuuuugcaucg

SEQ ID NO: 1958335 - RNA, 18 nt, Shigella flexneri 2a str. 301
aucggugaggaucaccag

SEQ ID NO: 1958336 - RNA, 15 nt, Shigella flexneri 2a str. 301
aucggugcaaaugcc

SEQ ID NO: 1958337 - RNA, 20 nt, Shigella flexneri 2a str. 301
aucggugcaucgcgcaaaga

SEQ ID NO: 1958338 - RNA, 20 nt, Shigella flexneri 2a str. 301
aucggugguguaaccuucac

SEQ ID NO: 1958339 - RNA, 21 nt, Shigella flexneri 2a str. 301
aucgguuuguaagcgggcaau

SEQ ID NO: 1958340 - RNA, 18 nt, Shigella flexneri 2a str. 301
aucgcaaaccagacgcgc

SEQ ID NO: 1958341 - RNA, 23 nt, Shigella flexneri 2a str. 301
aucgauaugaccauugguaaugg

SEQ ID NO: 1958342 - RNA, 20 nt, Shigella flexneri 2a str. 301
aucgauaaucucuacaccau

SEQ ID NO: 1958343 - RNA, 19 nt, Shigella flexneri 2a str. 301
aucgaggccauauuucaca

SEQ ID NO: 1958344 - RNA, 13 nt, Shigella flexneri 2a str. 301
auccguccuccgu

SEQ ID NO: 1958345 - RNA, 13 nt, Shigella flexneri 2a str. 301
aucgccaggaaca

SEQ ID NO: 1958346 - RNA, 15 nt, Shigella flexneri 2a str. 301
aucgccagcucaaac

SEQ ID NO: 1958347 - RNA, 12 nt, Shigella flexneri 2a str. 301
aucgcagcgcaa

SEQ ID NO: 1958348 - RNA, 17 nt, Shigella flexneri 2a str. 301
aucgcaggccaguugcg

SEQ ID NO: 1958349 - RNA, 17 nt, Shigella flexneri 2a str. 301
aucgcacguugucagca

SEQ ID NO: 1958350 - RNA, 23 nt, Shigella flexneri 2a str. 301
aucgcauucaggaccucacggaa

SEQ ID NO: 1958351 - RNA, 16 nt, Shigella flexneri 2a str. 301
aucgcgaaaccacggu

SEQ ID NO: 1958352 - RNA, 18 nt, Shigella flexneri 2a str. 301
aucgcuuucggauuggcg

SEQ ID NO: 1958353 - RNA, 18 nt, Shigella flexneri 2a str. 301
auggugcaccgauugccg

SEQ ID NO: 1958354 - RNA, 16 nt, Shigella flexneri 2a str. 301
auggucgcaucauuua

SEQ ID NO: 1958355 - RNA, 17 nt, Shigella flexneri 2a str. 301
auggucuguaccaccag

SEQ ID NO: 1958356 - RNA, 17 nt, Shigella flexneri 2a str. 301
auggucgccccggaacg

SEQ ID NO: 1958357 - RNA, 23 nt, Shigella flexneri 2a str. 301
auggucagcuucaccuuccagua

SEQ ID NO: 1958358 - RNA, 18 nt, Shigella flexneri 2a str. 301
auggcuucauccaccgau

SEQ ID NO: 1958359 - RNA, 20 nt, Shigella flexneri 2a str. 301
auggcuguuuucagcaccag

SEQ ID NO: 1958360 - RNA, 22 nt, Shigella flexneri 2a str. 301
augucgauauggggauccccau

SEQ ID NO: 1958361 - RNA, 21 nt, Shigella flexneri 2a str. 301
auguccguuggauaagcggua

SEQ ID NO: 1958362 - RNA, 22 nt, Shigella flexneri 2a str. 301
auggccgguuuguuauccaccg

SEQ ID NO: 1958363 - RNA, 17 nt, Shigella flexneri 2a str. 301
auggcgcacauugugcg

SEQ ID NO: 1958364 - RNA, 15 nt, Shigella flexneri 2a str. 301
auggcgcccaucggc

SEQ ID NO: 1958365 - RNA, 13 nt, Shigella flexneri 2a str. 301
auggcgcauccag

SEQ ID NO: 1958366 - RNA, 20 nt, Shigella flexneri 2a str. 301
augcugaaauuacgcggugc

SEQ ID NO: 1958367 - RNA, 18 nt, Shigella flexneri 2a str. 301
augcucagaugccugaug

SEQ ID NO: 1958368 - RNA, 12 nt, Shigella flexneri 2a str. 301
augcuccacgcu

SEQ ID NO: 1958369 - RNA, 14 nt, Shigella flexneri 2a str. 301
augcucaugaucgu

SEQ ID NO: 1958370 - RNA, 20 nt, Shigella flexneri 2a str. 301
augcuccacgcugcaucgcc

SEQ ID NO: 1958371 - RNA, 21 nt, Shigella flexneri 2a str. 301
auggcggcagccuccugcacg

SEQ ID NO: 1958372 - RNA, 16 nt, Shigella flexneri 2a str. 301
auucaaaauccgccac

SEQ ID NO: 1958373 - RNA, 16 nt, Shigella flexneri 2a str. 301
auuauccgucagccac

SEQ ID NO: 1958374 - RNA, 21 nt, Shigella flexneri 2a str. 301
auuaucgaucaugacgggcaa

SEQ ID NO: 1958375 - RNA, 12 nt, Shigella flexneri 2a str. 301
auuauccaugcc

SEQ ID NO: 1958376 - RNA, 20 nt, Shigella flexneri 2a str. 301
auucaauauauugcaaucau

SEQ ID NO: 1958377 - RNA, 23 nt, Shigella flexneri 2a str. 301
auucauugccugaugcgacgcuu

SEQ ID NO: 1958378 - RNA, 23 nt, Shigella flexneri 2a str. 301
auucauucacgcuaucuuucaac

SEQ ID NO: 1958379 - RNA, 18 nt, Shigella flexneri 2a str. 301
auuacuuuaagccuuccg

SEQ ID NO: 1958380 - RNA, 19 nt, Shigella flexneri 2a str. 301
auuacguggguaggaucag

SEQ ID NO: 1958381 - RNA, 11 nt, Shigella flexneri 2a str. 301
auuacgcgccc

SEQ ID NO: 1958382 - RNA, 22 nt, Shigella flexneri 2a str. 301
auuagcccaauaaucaccguga

SEQ ID NO: 1958383 - RNA, 23 nt, Shigella flexneri 2a str. 301
auuagcguccggcugccagccag

SEQ ID NO: 1958384 - RNA, 14 nt, Shigella flexneri 2a str. 301
augucggaugcaga

SEQ ID NO: 1958385 - RNA, 18 nt, Shigella flexneri 2a str. 301
auguuugaaucaacauau

SEQ ID NO: 1958386 - RNA, 22 nt, Shigella flexneri 2a str. 301
auuacccuucgcccugcgucgc

SEQ ID NO: 1958387 - RNA, 19 nt, Shigella flexneri 2a str. 301
auuaccgccaccaggaacg

SEQ ID NO: 1958388 - RNA, 18 nt, Shigella flexneri 2a str. 301
auuaccgccacuaucgcc

SEQ ID NO: 1958389 - RNA, 17 nt, Shigella flexneri 2a str. 301
auuaccaacucaucgcc

SEQ ID NO: 1958390 - RNA, 19 nt, Shigella flexneri 2a str. 301
auuacagcgcauugcuaau

SEQ ID NO: 1958391 - RNA, 15 nt, Shigella flexneri 2a str. 301
auuaauugccgccag

SEQ ID NO: 1958392 - RNA, 14 nt, Shigella flexneri 2a str. 301
augccaccacaccg

SEQ ID NO: 1958393 - RNA, 18 nt, Shigella flexneri 2a str. 301
augccacaaacgccgugc

SEQ ID NO: 1958394 - RNA, 23 nt, Shigella flexneri 2a str. 301
augccaaucuucacaucaucauc

SEQ ID NO: 1958395 - RNA, 15 nt, Shigella flexneri 2a str. 301
augccacaaacgccg

SEQ ID NO: 1958396 - RNA, 21 nt, Shigella flexneri 2a str. 301
augcacguuccguauaccguc

SEQ ID NO: 1958397 - RNA, 14 nt, Shigella flexneri 2a str. 301
augccaacuggcau

SEQ ID NO: 1958398 - RNA, 12 nt, Shigella flexneri 2a str. 301
augcacgcucug

SEQ ID NO: 1958399 - RNA, 14 nt, Shigella flexneri 2a str. 301
augcacgauaacgu

SEQ ID NO: 1958400 - RNA, 22 nt, Shigella flexneri 2a str. 301
augccagaaagcguauccauca

SEQ ID NO: 1958401 - RNA, 19 nt, Shigella flexneri 2a str. 301
augccagcuuucaccugcg

SEQ ID NO: 1958402 - RNA, 17 nt, Shigella flexneri 2a str. 301
augauuucauaacugau

SEQ ID NO: 1958403 - RNA, 14 nt, Shigella flexneri 2a str. 301
augcaaaaaggcau

SEQ ID NO: 1958404 - RNA, 20 nt, Shigella flexneri 2a str. 301
augccaucuacacgcuacca

SEQ ID NO: 1958405 - RNA, 22 nt, Shigella flexneri 2a str. 301
augcccggccugugucacuuug

SEQ ID NO: 1958406 - RNA, 22 nt, Shigella flexneri 2a str. 301
augcccgccccggcgaucccag

SEQ ID NO: 1958407 - RNA, 15 nt, Shigella flexneri 2a str. 301
augcccgaugaccuu

SEQ ID NO: 1958408 - RNA, 20 nt, Shigella flexneri 2a str. 301
augcccggucgcuccggcua

SEQ ID NO: 1958409 - RNA, 16 nt, Shigella flexneri 2a str. 301
augcccggcugcgcga

SEQ ID NO: 1958410 - RNA, 23 nt, Shigella flexneri 2a str. 301
aucugccgaacaggcugcucgca

SEQ ID NO: 1958411 - RNA, 22 nt, Shigella flexneri 2a str. 301
augacggucaucaccuccagcc

SEQ ID NO: 1958412 - RNA, 18 nt, Shigella flexneri 2a str. 301
aucugccagcaagcgcac

SEQ ID NO: 1958413 - RNA, 12 nt, Shigella flexneri 2a str. 301
aucugccagcaa

SEQ ID NO: 1958414 - RNA, 15 nt, Shigella flexneri 2a str. 301
aucugcaauuacugc

SEQ ID NO: 1958415 - RNA, 14 nt, Shigella flexneri 2a str. 301
aucugcacggugug

SEQ ID NO: 1958416 - RNA, 17 nt, Shigella flexneri 2a str. 301
aucucuuuuuccaccgc

SEQ ID NO: 1958417 - RNA, 13 nt, Shigella flexneri 2a str. 301
augauuccggcaa

SEQ ID NO: 1958418 - RNA, 18 nt, Shigella flexneri 2a str. 301
augaugcgccaauugccu

SEQ ID NO: 1958419 - RNA, 16 nt, Shigella flexneri 2a str. 301
augcguugucgccauc

SEQ ID NO: 1958420 - RNA, 19 nt, Shigella flexneri 2a str. 301
augcguucguagccacgau

SEQ ID NO: 1958421 - RNA, 15 nt, Shigella flexneri 2a str. 301
augcguuugccagcg

SEQ ID NO: 1958422 - RNA, 16 nt, Shigella flexneri 2a str. 301
augcguuuagccgccg

SEQ ID NO: 1958423 - RNA, 19 nt, Shigella flexneri 2a str. 301
augcgcuccucgccguuaa

SEQ ID NO: 1958424 - RNA, 20 nt, Shigella flexneri 2a str. 301
augcgcguagcgcguacaaa

SEQ ID NO: 1958425 - RNA, 17 nt, Shigella flexneri 2a str. 301
augcgcggcauacagcc

SEQ ID NO: 1958426 - RNA, 19 nt, Shigella flexneri 2a str. 301
augccuuguuugaucaucg

SEQ ID NO: 1958427 - RNA, 16 nt, Shigella flexneri 2a str. 301
augccuggcaaugcgc

SEQ ID NO: 1958428 - RNA, 13 nt, Shigella flexneri 2a str. 301
augccgacgaugu

SEQ ID NO: 1958429 - RNA, 20 nt, Shigella flexneri 2a str. 301
augccgacgauguuagcggc

SEQ ID NO: 1958430 - RNA, 20 nt, Shigella flexneri 2a str. 301
augccgaucaucauccagca

SEQ ID NO: 1958431 - RNA, 15 nt, Shigella flexneri 2a str. 301
augccgaucaucauc

SEQ ID NO: 1958432 - RNA, 20 nt, Shigella flexneri 2a str. 301
augccgcguggccuggaauu

SEQ ID NO: 1958433 - RNA, 19 nt, Shigella flexneri 2a str. 301
augccgggacgaucggcga

SEQ ID NO: 1958434 - RNA, 16 nt, Shigella flexneri 2a str. 301
augccggcaucaaacg

SEQ ID NO: 1958435 - RNA, 18 nt, Shigella flexneri 2a str. 301
augccggaugcggcguga

SEQ ID NO: 1958436 - RNA, 17 nt, Shigella flexneri 2a str. 301
augccggaugcggcgug

SEQ ID NO: 1958437 - RNA, 12 nt, Shigella flexneri 2a str. 301
augccggaagcu

SEQ ID NO: 1958438 - RNA, 21 nt, Shigella flexneri 2a str. 301
augccgugcagcacggagaga

SEQ ID NO: 1958439 - RNA, 23 nt, Shigella flexneri 2a str. 301
cccggagggguuuuugccagcaa

SEQ ID NO: 1958440 - RNA, 15 nt, Shigella flexneri 2a str. 301
cccgguuuucgcgcg

SEQ ID NO: 1958441 - RNA, 15 nt, Shigella flexneri 2a str. 301
cccgucguugcaauc

SEQ ID NO: 1958442 - RNA, 18 nt, Shigella flexneri 2a str. 301
cccguuacgauucucugc

SEQ ID NO: 1958443 - RNA, 18 nt, Shigella flexneri 2a str. 301
cccuggcaauagcgcacg

SEQ ID NO: 1958444 - RNA, 14 nt, Shigella flexneri 2a str. 301
cccugccuccauga

SEQ ID NO: 1958445 - RNA, 13 nt, Shigella flexneri 2a str. 301
cccugcccgcgau

SEQ ID NO: 1958446 - RNA, 13 nt, Shigella flexneri 2a str. 301
ccgaauccgggaa

SEQ ID NO: 1958447 - RNA, 22 nt, Shigella flexneri 2a str. 301
cccgaugaccuugucaugcagc

SEQ ID NO: 1958448 - RNA, 22 nt, Shigella flexneri 2a str. 301
cccgaugccaucauggcgauga

SEQ ID NO: 1958449 - RNA, 13 nt, Shigella flexneri 2a str. 301
cccgccagcacga

SEQ ID NO: 1958450 - RNA, 14 nt, Shigella flexneri 2a str. 301
cccgccaucgccca

SEQ ID NO: 1958451 - RNA, 22 nt, Shigella flexneri 2a str. 301
cccgccaguuugucuggcaauc

SEQ ID NO: 1958452 - RNA, 19 nt, Shigella flexneri 2a str. 301
cccgccaaccaccgccagu

SEQ ID NO: 1958453 - RNA, 13 nt, Shigella flexneri 2a str. 301
cccgcgacgcgcu

SEQ ID NO: 1958454 - RNA, 19 nt, Shigella flexneri 2a str. 301
cccgcgcggcgcaggcgcu

SEQ ID NO: 1958455 - RNA, 22 nt, Shigella flexneri 2a str. 301
ccccgguuaauugcgccagcac

SEQ ID NO: 1958456 - RNA, 14 nt, Shigella flexneri 2a str. 301
ccccugccagaucg

SEQ ID NO: 1958457 - RNA, 19 nt, Shigella flexneri 2a str. 301
ccccugccgcaaacgacac

SEQ ID NO: 1958458 - RNA, 20 nt, Shigella flexneri 2a str. 301
ccccugauaauggcguauuu

SEQ ID NO: 1958459 - RNA, 19 nt, Shigella flexneri 2a str. 301
cccgaaggaauuuuacagc

SEQ ID NO: 1958460 - RNA, 14 nt, Shigella flexneri 2a str. 301
cccgaccaaugcau

SEQ ID NO: 1958461 - RNA, 18 nt, Shigella flexneri 2a str. 301
cccgacgauacaacgcuu

SEQ ID NO: 1958462 - RNA, 16 nt, Shigella flexneri 2a str. 301
cccagacacaguucuu

SEQ ID NO: 1958463 - RNA, 18 nt, Shigella flexneri 2a str. 301
cccacuucuuucgcccag

SEQ ID NO: 1958464 - RNA, 17 nt, Shigella flexneri 2a str. 301
cccagaauucacgcacu

SEQ ID NO: 1958465 - RNA, 12 nt, Shigella flexneri 2a str. 301
cccagcaucaga

SEQ ID NO: 1958466 - RNA, 16 nt, Shigella flexneri 2a str. 301
cccauaaauuccggcu

SEQ ID NO: 1958467 - RNA, 14 nt, Shigella flexneri 2a str. 301
cccagcgcaucagg

SEQ ID NO: 1958468 - RNA, 16 nt, Shigella flexneri 2a str. 301
ccaucguccagcagca

SEQ ID NO: 1958469 - RNA, 21 nt, Shigella flexneri 2a str. 301
ccaucggcaaucauucccaga

SEQ ID NO: 1958470 - RNA, 18 nt, Shigella flexneri 2a str. 301
ccaucagacuuugcgcca

SEQ ID NO: 1958471 - RNA, 19 nt, Shigella flexneri 2a str. 301
ccaucagacuuugcgccau

SEQ ID NO: 1958472 - RNA, 18 nt, Shigella flexneri 2a str. 301
ccaucacuaaggguaaaa

SEQ ID NO: 1958473 - RNA, 18 nt, Shigella flexneri 2a str. 301
ccaugcgaaugccaauuu

SEQ ID NO: 1958474 - RNA, 16 nt, Shigella flexneri 2a str. 301
ccaucugccgauacgc

SEQ ID NO: 1958475 - RNA, 14 nt, Shigella flexneri 2a str. 301
ccaucuggcugacg

SEQ ID NO: 1958476 - RNA, 15 nt, Shigella flexneri 2a str. 301
ccaucuggcugacgg

SEQ ID NO: 1958477 - RNA, 20 nt, Shigella flexneri 2a str. 301
ccaucguugaaagauaauca

SEQ ID NO: 1958478 - RNA, 20 nt, Shigella flexneri 2a str. 301
ccaucucaaaacguccggca

SEQ ID NO: 1958479 - RNA, 20 nt, Shigella flexneri 2a str. 301
ccaucuccgcauguuucgac

SEQ ID NO: 1958480 - RNA, 15 nt, Shigella flexneri 2a str. 301
ccaucuccagcugcu

SEQ ID NO: 1958481 - RNA, 17 nt, Shigella flexneri 2a str. 301
cccaacaacagcgcgcu

SEQ ID NO: 1958482 - RNA, 13 nt, Shigella flexneri 2a str. 301
cccaacuggcgac

SEQ ID NO: 1958483 - RNA, 19 nt, Shigella flexneri 2a str. 301
cccaauuaauugccagccg

SEQ ID NO: 1958484 - RNA, 17 nt, Shigella flexneri 2a str. 301
cccacagacgacgaacu

SEQ ID NO: 1958485 - RNA, 16 nt, Shigella flexneri 2a str. 301
ccaugucgcauccgac

SEQ ID NO: 1958486 - RNA, 15 nt, Shigella flexneri 2a str. 301
ccauuggaggacgcg

SEQ ID NO: 1958487 - RNA, 16 nt, Shigella flexneri 2a str. 301
ccauguugcuggaaga

SEQ ID NO: 1958488 - RNA, 16 nt, Shigella flexneri 2a str. 301
cccaaacagcagaacg

SEQ ID NO: 1958489 - RNA, 18 nt, Shigella flexneri 2a str. 301
ccauuuuuucgauaauca

SEQ ID NO: 1958490 - RNA, 19 nt, Shigella flexneri 2a str. 301
ccaguaaaccaauuucugu

SEQ ID NO: 1958491 - RNA, 14 nt, Shigella flexneri 2a str. 301
ccaguacaugaagc

SEQ ID NO: 1958492 - RNA, 14 nt, Shigella flexneri 2a str. 301
ccaguaaucgggca

SEQ ID NO: 1958493 - RNA, 23 nt, Shigella flexneri 2a str. 301
ccaggcugcgaacgguuuucacg

SEQ ID NO: 1958494 - RNA, 15 nt, Shigella flexneri 2a str. 301
ccauauucagcagca

SEQ ID NO: 1958495 - RNA, 15 nt, Shigella flexneri 2a str. 301
ccaucaacuucucgc

SEQ ID NO: 1958496 - RNA, 23 nt, Shigella flexneri 2a str. 301
ccaucaaucacuuugcgcucgcu

SEQ ID NO: 1958497 - RNA, 20 nt, Shigella flexneri 2a str. 301
ccaucaauccacuucgccag

SEQ ID NO: 1958498 - RNA, 18 nt, Shigella flexneri 2a str. 301
ccaucaauggcugcaaag

SEQ ID NO: 1958499 - RNA, 19 nt, Shigella flexneri 2a str. 301
ccauauacgccaucgccag

SEQ ID NO: 1958500 - RNA, 11 nt, Shigella flexneri 2a str. 301
ccaguuugcgu

SEQ ID NO: 1958501 - RNA, 20 nt, Shigella flexneri 2a str. 301
ccaguuuuucgucaacauac

SEQ ID NO: 1958502 - RNA, 13 nt, Shigella flexneri 2a str. 301
ccaguuuucgcca

SEQ ID NO: 1958503 - RNA, 20 nt, Shigella flexneri 2a str. 301
ccauaagccugauaagcguu

SEQ ID NO: 1958504 - RNA, 22 nt, Shigella flexneri 2a str. 301
ccauaagauugcauagcggcga

SEQ ID NO: 1958505 - RNA, 18 nt, Shigella flexneri 2a str. 301
ccauaaccugugcaccag

SEQ ID NO: 1958506 - RNA, 18 nt, Shigella flexneri 2a str. 301
ccauaaccccaccagcau

SEQ ID NO: 1958507 - RNA, 14 nt, Shigella flexneri 2a str. 301
ccagucauccggcu

SEQ ID NO: 1958508 - RNA, 21 nt, Shigella flexneri 2a str. 301
ccagucauccggcucguaauc

SEQ ID NO: 1958509 - RNA, 14 nt, Shigella flexneri 2a str. 301
ccaguccaucggca

SEQ ID NO: 1958510 - RNA, 15 nt, Shigella flexneri 2a str. 301
ccagugccaaagcca

SEQ ID NO: 1958511 - RNA, 15 nt, Shigella flexneri 2a str. 301
ccaguccauuaccga

SEQ ID NO: 1958512 - RNA, 12 nt, Shigella flexneri 2a str. 301
ccagugccgccu

SEQ ID NO: 1958513 - RNA, 14 nt, Shigella flexneri 2a str. 301
ccagugccuggcga

SEQ ID NO: 1958514 - RNA, 21 nt, Shigella flexneri 2a str. 301
ccagugcgccccagguaauuu

SEQ ID NO: 1958515 - RNA, 19 nt, Shigella flexneri 2a str. 301
ccagugccgcccaccacuc

SEQ ID NO: 1958516 - RNA, 16 nt, Shigella flexneri 2a str. 301
ccaguggcagcaauuu

SEQ ID NO: 1958517 - RNA, 21 nt, Shigella flexneri 2a str. 301
ccagugcucccucggugccgc

SEQ ID NO: 1958518 - RNA, 13 nt, Shigella flexneri 2a str. 301
ccaggcaccguca

SEQ ID NO: 1958519 - RNA, 17 nt, Shigella flexneri 2a str. 301
ccaggcaaucagcaauc

SEQ ID NO: 1958520 - RNA, 18 nt, Shigella flexneri 2a str. 301
ccaggcaucagcaacacg

SEQ ID NO: 1958521 - RNA, 21 nt, Shigella flexneri 2a str. 301
ccaggcaucagcaacacgcug

SEQ ID NO: 1958522 - RNA, 13 nt, Shigella flexneri 2a str. 301
ccaggccaucagc

SEQ ID NO: 1958523 - RNA, 20 nt, Shigella flexneri 2a str. 301
ccagaccggcaaucgcgcca

SEQ ID NO: 1958524 - RNA, 20 nt, Shigella flexneri 2a str. 301
ccagaccugcguucagcagu

SEQ ID NO: 1958525 - RNA, 17 nt, Shigella flexneri 2a str. 301
ccagacgccagccacag

SEQ ID NO: 1958526 - RNA, 22 nt, Shigella flexneri 2a str. 301
ccagacgcgcguccccugcccg

SEQ ID NO: 1958527 - RNA, 15 nt, Shigella flexneri 2a str. 301
ccagaccuuaucaca

SEQ ID NO: 1958528 - RNA, 16 nt, Shigella flexneri 2a str. 301
ccagacgagagugacg

SEQ ID NO: 1958529 - RNA, 18 nt, Shigella flexneri 2a str. 301
ccacugcgccagcgucau

SEQ ID NO: 1958530 - RNA, 17 nt, Shigella flexneri 2a str. 301
ccagacccggcaagccu

SEQ ID NO: 1958531 - RNA, 18 nt, Shigella flexneri 2a str. 301
ccacuggucugacgcuga

SEQ ID NO: 1958532 - RNA, 22 nt, Shigella flexneri 2a str. 301
ccagacaucaccaguaccgcca

SEQ ID NO: 1958533 - RNA, 22 nt, Shigella flexneri 2a str. 301
ccagauaauauugauauccgca

SEQ ID NO: 1958534 - RNA, 18 nt, Shigella flexneri 2a str. 301
ccagauacaucagcgaca

SEQ ID NO: 1958535 - RNA, 22 nt, Shigella flexneri 2a str. 301
ccagauaauagcguuucagcgg

SEQ ID NO: 1958536 - RNA, 19 nt, Shigella flexneri 2a str. 301
ccacuaucgccaucaggca

SEQ ID NO: 1958537 - RNA, 18 nt, Shigella flexneri 2a str. 301
ccacgccugcauccgcca

SEQ ID NO: 1958538 - RNA, 12 nt, Shigella flexneri 2a str. 301
ccacgccugccg

SEQ ID NO: 1958539 - RNA, 17 nt, Shigella flexneri 2a str. 301
ccacgcaaaggcguuau

SEQ ID NO: 1958540 - RNA, 22 nt, Shigella flexneri 2a str. 301
ccacgccauagcggagcaauuu

SEQ ID NO: 1958541 - RNA, 13 nt, Shigella flexneri 2a str. 301
ccacgcaggcauu

SEQ ID NO: 1958542 - RNA, 15 nt, Shigella flexneri 2a str. 301
ccaccuacaccggca

SEQ ID NO: 1958543 - RNA, 19 nt, Shigella flexneri 2a str. 301
ccaccucauuaagaugcau

SEQ ID NO: 1958544 - RNA, 22 nt, Shigella flexneri 2a str. 301
ccaccauucaccaagcaaaacg

SEQ ID NO: 1958545 - RNA, 22 nt, Shigella flexneri 2a str. 301
ccagcccgaucggcuggcauuu

SEQ ID NO: 1958546 - RNA, 18 nt, Shigella flexneri 2a str. 301
ccagccgaccauugccag

SEQ ID NO: 1958547 - RNA, 16 nt, Shigella flexneri 2a str. 301
ccagccagccaagcau

SEQ ID NO: 1958548 - RNA, 14 nt, Shigella flexneri 2a str. 301
ccagccagcaccag

SEQ ID NO: 1958549 - RNA, 14 nt, Shigella flexneri 2a str. 301
ccagccauccguca

SEQ ID NO: 1958550 - RNA, 18 nt, Shigella flexneri 2a str. 301
ccagcauauguuuacgcu

SEQ ID NO: 1958551 - RNA, 15 nt, Shigella flexneri 2a str. 301
ccagcauaaucacca

SEQ ID NO: 1958552 - RNA, 21 nt, Shigella flexneri 2a str. 301
ccagcauaguacgggcaauuu

SEQ ID NO: 1958553 - RNA, 14 nt, Shigella flexneri 2a str. 301
ccagcaguuuccgc

SEQ ID NO: 1958554 - RNA, 18 nt, Shigella flexneri 2a str. 301
ccagcagauauugcccca

SEQ ID NO: 1958555 - RNA, 15 nt, Shigella flexneri 2a str. 301
ccagcacguugaacu

SEQ ID NO: 1958556 - RNA, 14 nt, Shigella flexneri 2a str. 301
ccagcgcgccgcca

SEQ ID NO: 1958557 - RNA, 15 nt, Shigella flexneri 2a str. 301
ccagcguacguaacu

SEQ ID NO: 1958558 - RNA, 15 nt, Shigella flexneri 2a str. 301
ccagcgcaucaggca

SEQ ID NO: 1958559 - RNA, 18 nt, Shigella flexneri 2a str. 301
ccagcgcaucaggcaauc

SEQ ID NO: 1958560 - RNA, 19 nt, Shigella flexneri 2a str. 301
ccagccgccgcuaucggca

SEQ ID NO: 1958561 - RNA, 15 nt, Shigella flexneri 2a str. 301
caucguccagcagca

SEQ ID NO: 1958562 - RNA, 12 nt, Shigella flexneri 2a str. 301
caucgucaucag

SEQ ID NO: 1958563 - RNA, 17 nt, Shigella flexneri 2a str. 301
caucgucaggggcauuu

SEQ ID NO: 1958564 - RNA, 12 nt, Shigella flexneri 2a str. 301
caucggugcgcu

SEQ ID NO: 1958565 - RNA, 15 nt, Shigella flexneri 2a str. 301
caucguauuucagac

SEQ ID NO: 1958566 - RNA, 24 nt, Shigella flexneri 2a str. 301
caucguaguuuuugcccaucaugc

SEQ ID NO: 1958567 - RNA, 13 nt, Shigella flexneri 2a str. 301
caucgugauaaac

SEQ ID NO: 1958568 - RNA, 13 nt, Shigella flexneri 2a str. 301
caucgugccggaa

SEQ ID NO: 1958569 - RNA, 22 nt, Shigella flexneri 2a str. 301
caucggcuuauucauaucaaac

SEQ ID NO: 1958570 - RNA, 13 nt, Shigella flexneri 2a str. 301
cauccgcgcaaua

SEQ ID NO: 1958571 - RNA, 19 nt, Shigella flexneri 2a str. 301
cauccguccuccguaucuu

SEQ ID NO: 1958572 - RNA, 24 nt, Shigella flexneri 2a str. 301
caucucccacgcggcaacggcuuc

SEQ ID NO: 1958573 - RNA, 17 nt, Shigella flexneri 2a str. 301
caucuaccgccagccag

SEQ ID NO: 1958574 - RNA, 15 nt, Shigella flexneri 2a str. 301
caucugccuuauuga

SEQ ID NO: 1958575 - RNA, 15 nt, Shigella flexneri 2a str. 301
caucugcgacagcca

SEQ ID NO: 1958576 - RNA, 14 nt, Shigella flexneri 2a str. 301
caucugcgccgcca

SEQ ID NO: 1958577 - RNA, 19 nt, Shigella flexneri 2a str. 301
caucugcauuccgguguaa

SEQ ID NO: 1958578 - RNA, 14 nt, Shigella flexneri 2a str. 301
caucucuuccggca

SEQ ID NO: 1958579 - RNA, 20 nt, Shigella flexneri 2a str. 301
caucugaccacggccacagc

SEQ ID NO: 1958580 - RNA, 15 nt, Shigella flexneri 2a str. 301
caucuuugaaaucac

SEQ ID NO: 1958581 - RNA, 21 nt, Shigella flexneri 2a str. 301
caucuggcugugauccauucc

SEQ ID NO: 1958582 - RNA, 14 nt, Shigella flexneri 2a str. 301
caucuuauccggcc

SEQ ID NO: 1958583 - RNA, 18 nt, Shigella flexneri 2a str. 301
caugaaccgugucgccau

SEQ ID NO: 1958584 - RNA, 18 nt, Shigella flexneri 2a str. 301
caugaugacaacauagcu

SEQ ID NO: 1958585 - RNA, 19 nt, Shigella flexneri 2a str. 301
caugaugacuugccuccag

SEQ ID NO: 1958586 - RNA, 15 nt, Shigella flexneri 2a str. 301
caugauagcccggau

SEQ ID NO: 1958587 - RNA, 20 nt, Shigella flexneri 2a str. 301
caugacgcacuuucgcuuua

SEQ ID NO: 1958588 - RNA, 12 nt, Shigella flexneri 2a str. 301
caugaguugcug

SEQ ID NO: 1958589 - RNA, 11 nt, Shigella flexneri 2a str. 301
caugacgauca

SEQ ID NO: 1958590 - RNA, 16 nt, Shigella flexneri 2a str. 301
caugccgaugccgacg

SEQ ID NO: 1958591 - RNA, 12 nt, Shigella flexneri 2a str. 301
caugccggugau

SEQ ID NO: 1958592 - RNA, 14 nt, Shigella flexneri 2a str. 301
caugccggucgcgc

SEQ ID NO: 1958593 - RNA, 18 nt, Shigella flexneri 2a str. 301
caugccgaugccgacgau

SEQ ID NO: 1958594 - RNA, 13 nt, Shigella flexneri 2a str. 301
caugccauccgca

SEQ ID NO: 1958595 - RNA, 17 nt, Shigella flexneri 2a str. 301
caugccgaauccgggaa

SEQ ID NO: 1958596 - RNA, 15 nt, Shigella flexneri 2a str. 301
caugcgaagaccgca

SEQ ID NO: 1958597 - RNA, 13 nt, Shigella flexneri 2a str. 301
caugcgauggagu

SEQ ID NO: 1958598 - RNA, 15 nt, Shigella flexneri 2a str. 301
caugcgagaagcaac

SEQ ID NO: 1958599 - RNA, 23 nt, Shigella flexneri 2a str. 301
caugcuucugcacgcuugccugu

SEQ ID NO: 1958600 - RNA, 22 nt, Shigella flexneri 2a str. 301
caugcuguccagcaggcgauga

SEQ ID NO: 1958601 - RNA, 21 nt, Shigella flexneri 2a str. 301
cauggcauuggccguugccau

SEQ ID NO: 1958602 - RNA, 23 nt, Shigella flexneri 2a str. 301
cauggugcacauugcggacuucc

SEQ ID NO: 1958603 - RNA, 14 nt, Shigella flexneri 2a str. 301
ccaagaaacaccag

SEQ ID NO: 1958604 - RNA, 13 nt, Shigella flexneri 2a str. 301
ccaacugccugau

SEQ ID NO: 1958605 - RNA, 16 nt, Shigella flexneri 2a str. 301
ccaagauagaaccacg

SEQ ID NO: 1958606 - RNA, 18 nt, Shigella flexneri 2a str. 301
ccaaguugugauugagau

SEQ ID NO: 1958607 - RNA, 19 nt, Shigella flexneri 2a str. 301
ccaauaauccccaauacga

SEQ ID NO: 1958608 - RNA, 12 nt, Shigella flexneri 2a str. 301
ccaagccugaua

SEQ ID NO: 1958609 - RNA, 15 nt, Shigella flexneri 2a str. 301
ccaacguuaucgccg

SEQ ID NO: 1958610 - RNA, 21 nt, Shigella flexneri 2a str. 301
ccaacucaucgccgcuggcca

SEQ ID NO: 1958611 - RNA, 21 nt, Shigella flexneri 2a str. 301
ccaccauauucgccaccgcgc

SEQ ID NO: 1958612 - RNA, 23 nt, Shigella flexneri 2a str. 301
ccaccaguaccucuucgcuggca

SEQ ID NO: 1958613 - RNA, 17 nt, Shigella flexneri 2a str. 301
ccacaccguugccgcgu

SEQ ID NO: 1958614 - RNA, 21 nt, Shigella flexneri 2a str. 301
ccacaguuucauaucugccag

SEQ ID NO: 1958615 - RNA, 21 nt, Shigella flexneri 2a str. 301
ccacaugaucauucaccagcc

SEQ ID NO: 1958616 - RNA, 15 nt, Shigella flexneri 2a str. 301
ccacaucuaccgcca

SEQ ID NO: 1958617 - RNA, 16 nt, Shigella flexneri 2a str. 301
ccacaucuaccgccag

SEQ ID NO: 1958618 - RNA, 12 nt, Shigella flexneri 2a str. 301
ccacauccggca

SEQ ID NO: 1958619 - RNA, 19 nt, Shigella flexneri 2a str. 301
cauucgguugccagcgcca

SEQ ID NO: 1958620 - RNA, 18 nt, Shigella flexneri 2a str. 301
cauucucacuccagccag

SEQ ID NO: 1958621 - RNA, 19 nt, Shigella flexneri 2a str. 301
cauucccucuacauucaua

SEQ ID NO: 1958622 - RNA, 11 nt, Shigella flexneri 2a str. 301
caugucaucaa

SEQ ID NO: 1958623 - RNA, 21 nt, Shigella flexneri 2a str. 301
cauucauagaggaauggcaga

SEQ ID NO: 1958624 - RNA, 22 nt, Shigella flexneri 2a str. 301
cauugcauaaacaccugcggcg

SEQ ID NO: 1958625 - RNA, 15 nt, Shigella flexneri 2a str. 301
cauugccaggcagga

SEQ ID NO: 1958626 - RNA, 21 nt, Shigella flexneri 2a str. 301
cauugcccaauacagcgcgga

SEQ ID NO: 1958627 - RNA, 17 nt, Shigella flexneri 2a str. 301
ccaaacguggucgccag

SEQ ID NO: 1958628 - RNA, 14 nt, Shigella flexneri 2a str. 301
ccaaacagcgccag

SEQ ID NO: 1958629 - RNA, 16 nt, Shigella flexneri 2a str. 301
cauuuuguaggccuga

SEQ ID NO: 1958630 - RNA, 14 nt, Shigella flexneri 2a str. 301
cauuuugcgcggca

SEQ ID NO: 1958631 - RNA, 12 nt, Shigella flexneri 2a str. 301
cauuuucgcugg

SEQ ID NO: 1958632 - RNA, 22 nt, Shigella flexneri 2a str. 301
cauuuuccaucacgaucagcgg

SEQ ID NO: 1958633 - RNA, 17 nt, Shigella flexneri 2a str. 301
cauuguguuaucccgau

SEQ ID NO: 1958634 - RNA, 23 nt, Shigella flexneri 2a str. 301
cauugucgggccgcacgcuguau

SEQ ID NO: 1958635 - RNA, 19 nt, Shigella flexneri 2a str. 301
cauuugcuugccggaagca

SEQ ID NO: 1958636 - RNA, 16 nt, Shigella flexneri 2a str. 301
cauuugcuccagacgc

SEQ ID NO: 1958637 - RNA, 18 nt, Shigella flexneri 2a str. 301
ccaaauauccgcgcuaag

SEQ ID NO: 1958638 - RNA, 18 nt, Shigella flexneri 2a str. 301
ccaaauccagcgccacau

SEQ ID NO: 1958639 - RNA, 19 nt, Shigella flexneri 2a str. 301
ccaaaucgccauauccgca

SEQ ID NO: 1958640 - RNA, 22 nt, Shigella flexneri 2a str. 301
ccaaaguacggacgcggcauuu

SEQ ID NO: 1958641 - RNA, 20 nt, Shigella flexneri 2a str. 301
ccaaauaaacgaaucugcaa

SEQ ID NO: 1958642 - RNA, 13 nt, Shigella flexneri 2a str. 301
ccaaagguuuccu

SEQ ID NO: 1958643 - RNA, 16 nt, Shigella flexneri 2a str. 301
ccaaagccuuucacuu

SEQ ID NO: 1958644 - RNA, 20 nt, Shigella flexneri 2a str. 301
ccaacccuucugcacgccag

SEQ ID NO: 1958645 - RNA, 13 nt, Shigella flexneri 2a str. 301
cagcgucgguuuc

SEQ ID NO: 1958646 - RNA, 13 nt, Shigella flexneri 2a str. 301
cagcgucagcgaa

SEQ ID NO: 1958647 - RNA, 12 nt, Shigella flexneri 2a str. 301
cagcgucaucau

SEQ ID NO: 1958648 - RNA, 14 nt, Shigella flexneri 2a str. 301
cagcgucagcacca

SEQ ID NO: 1958649 - RNA, 15 nt, Shigella flexneri 2a str. 301
cagcucacuucgauc

SEQ ID NO: 1958650 - RNA, 23 nt, Shigella flexneri 2a str. 301
cagcguuaacugcuuaucaucac

SEQ ID NO: 1958651 - RNA, 22 nt, Shigella flexneri 2a str. 301
cagcucaaccagauucggcgca

SEQ ID NO: 1958652 - RNA, 21 nt, Shigella flexneri 2a str. 301
cagcguguugcggagcuuguu

SEQ ID NO: 1958653 - RNA, 22 nt, Shigella flexneri 2a str. 301
cagcguguuaaugcccaucagu

SEQ ID NO: 1958654 - RNA, 12 nt, Shigella flexneri 2a str. 301
cagcggcugcca

SEQ ID NO: 1958655 - RNA, 12 nt, Shigella flexneri 2a str. 301
cagcggccggau

SEQ ID NO: 1958656 - RNA, 20 nt, Shigella flexneri 2a str. 301
cagcggaaaauaucgcccau

SEQ ID NO: 1958657 - RNA, 13 nt, Shigella flexneri 2a str. 301
cagcgcuuucaug

SEQ ID NO: 1958658 - RNA, 16 nt, Shigella flexneri 2a str. 301
cagcggcagcucgcgu

SEQ ID NO: 1958659 - RNA, 13 nt, Shigella flexneri 2a str. 301
cagcgcuucgcuc

SEQ ID NO: 1958660 - RNA, 16 nt, Shigella flexneri 2a str. 301
cagcgcuucacuauga

SEQ ID NO: 1958661 - RNA, 19 nt, Shigella flexneri 2a str. 301
cagcgcuaaccgccugaaa

SEQ ID NO: 1958662 - RNA, 15 nt, Shigella flexneri 2a str. 301
cagcgcuaauacgau

SEQ ID NO: 1958663 - RNA, 17 nt, Shigella flexneri 2a str. 301
cagcgcggcgaacuuaa

SEQ ID NO: 1958664 - RNA, 22 nt, Shigella flexneri 2a str. 301
cagcugcgcgcgaacugucggu

SEQ ID NO: 1958665 - RNA, 20 nt, Shigella flexneri 2a str. 301
cagcugccguccccaucagg

SEQ ID NO: 1958666 - RNA, 14 nt, Shigella flexneri 2a str. 301
cagcugggcgauuu

SEQ ID NO: 1958667 - RNA, 16 nt, Shigella flexneri 2a str. 301
cagcuggugauccacg

SEQ ID NO: 1958668 - RNA, 18 nt, Shigella flexneri 2a str. 301
cagcuguccauaccggac

SEQ ID NO: 1958669 - RNA, 21 nt, Shigella flexneri 2a str. 301
cagcugguguaacugcgccag

SEQ ID NO: 1958670 - RNA, 21 nt, Shigella flexneri 2a str. 301
cagcuuuaaauuacugagcaa

SEQ ID NO: 1958671 - RNA, 18 nt, Shigella flexneri 2a str. 301
cagcuuuuuaaucgccau

SEQ ID NO: 1958672 - RNA, 18 nt, Shigella flexneri 2a str. 301
caggaacgggauugccag

SEQ ID NO: 1958673 - RNA, 15 nt, Shigella flexneri 2a str. 301
caggaaccgcauacg

SEQ ID NO: 1958674 - RNA, 19 nt, Shigella flexneri 2a str. 301
caggaacagccacugguga

SEQ ID NO: 1958675 - RNA, 16 nt, Shigella flexneri 2a str. 301
cagcuuagaaaucgac

SEQ ID NO: 1958676 - RNA, 16 nt, Shigella flexneri 2a str. 301
cagcuuagaaauucac

SEQ ID NO: 1958677 - RNA, 21 nt, Shigella flexneri 2a str. 301
cagcuuauuagggaucaucuu

SEQ ID NO: 1958678 - RNA, 16 nt, Shigella flexneri 2a str. 301
cagcuuaaucaccagc

SEQ ID NO: 1958679 - RNA, 21 nt, Shigella flexneri 2a str. 301
caggacgcccgguaucaacga

SEQ ID NO: 1958680 - RNA, 14 nt, Shigella flexneri 2a str. 301
caggagcagcaggu

SEQ ID NO: 1958681 - RNA, 20 nt, Shigella flexneri 2a str. 301
caggcagcuuagaaauucac

SEQ ID NO: 1958682 - RNA, 19 nt, Shigella flexneri 2a str. 301
caggcagauuuuuuaacug

SEQ ID NO: 1958683 - RNA, 17 nt, Shigella flexneri 2a str. 301
caggaucgcagccgagu

SEQ ID NO: 1958684 - RNA, 18 nt, Shigella flexneri 2a str. 301
caggcgaaacccgcugcc

SEQ ID NO: 1958685 - RNA, 16 nt, Shigella flexneri 2a str. 301
caggcauauucgcgcu

SEQ ID NO: 1958686 - RNA, 23 nt, Shigella flexneri 2a str. 301
caggcagggccaccagcguggca

SEQ ID NO: 1958687 - RNA, 17 nt, Shigella flexneri 2a str. 301
caggccaggauuacgcu

SEQ ID NO: 1958688 - RNA, 19 nt, Shigella flexneri 2a str. 301
caggccaucacauccugau

SEQ ID NO: 1958689 - RNA, 16 nt, Shigella flexneri 2a str. 301
caggccauguuuacca

SEQ ID NO: 1958690 - RNA, 14 nt, Shigella flexneri 2a str. 301
caggccaucacauc

SEQ ID NO: 1958691 - RNA, 21 nt, Shigella flexneri 2a str. 301
caguaccgccagugcagcgaa

SEQ ID NO: 1958692 - RNA, 19 nt, Shigella flexneri 2a str. 301
caguacauuguuuuccaga

SEQ ID NO: 1958693 - RNA, 14 nt, Shigella flexneri 2a str. 301
caguacauagccau

SEQ ID NO: 1958694 - RNA, 17 nt, Shigella flexneri 2a str. 301
cagguuuaaacagagau

SEQ ID NO: 1958695 - RNA, 23 nt, Shigella flexneri 2a str. 301
cagucccguacccagcaagaccg

SEQ ID NO: 1958696 - RNA, 15 nt, Shigella flexneri 2a str. 301
caguacuggccucca

SEQ ID NO: 1958697 - RNA, 19 nt, Shigella flexneri 2a str. 301
caguacuggccuccacggu

SEQ ID NO: 1958698 - RNA, 21 nt, Shigella flexneri 2a str. 301
cagguauaccgaaaucgccau

SEQ ID NO: 1958699 - RNA, 20 nt, Shigella flexneri 2a str. 301
caggucaccgaaaucgccaa

SEQ ID NO: 1958700 - RNA, 14 nt, Shigella flexneri 2a str. 301
caggguaucccgcc

SEQ ID NO: 1958701 - RNA, 14 nt, Shigella flexneri 2a str. 301
cagguaaucggcau

SEQ ID NO: 1958702 - RNA, 13 nt, Shigella flexneri 2a str. 301
cagguaaacaccu

SEQ ID NO: 1958703 - RNA, 14 nt, Shigella flexneri 2a str. 301
cagggcgcuggcga

SEQ ID NO: 1958704 - RNA, 16 nt, Shigella flexneri 2a str. 301
cauaucgaaccagcgg

SEQ ID NO: 1958705 - RNA, 16 nt, Shigella flexneri 2a str. 301
cauauaggaggccucg

SEQ ID NO: 1958706 - RNA, 19 nt, Shigella flexneri 2a str. 301
cauaucaauaguaaccaga

SEQ ID NO: 1958707 - RNA, 18 nt, Shigella flexneri 2a str. 301
cauaucauuuugcugcca

SEQ ID NO: 1958708 - RNA, 17 nt, Shigella flexneri 2a str. 301
cauauggaagaaacgcu

SEQ ID NO: 1958709 - RNA, 21 nt, Shigella flexneri 2a str. 301
cauaugcgccagacugaucau

SEQ ID NO: 1958710 - RNA, 17 nt, Shigella flexneri 2a str. 301
cauauguguuugugccg

SEQ ID NO: 1958711 - RNA, 14 nt, Shigella flexneri 2a str. 301
caucaccauccacg

SEQ ID NO: 1958712 - RNA, 12 nt, Shigella flexneri 2a str. 301
caucaccauagc

SEQ ID NO: 1958713 - RNA, 13 nt, Shigella flexneri 2a str. 301
caucaccaucagg

SEQ ID NO: 1958714 - RNA, 18 nt, Shigella flexneri 2a str. 301
caucaccgacguuugcgc

SEQ ID NO: 1958715 - RNA, 17 nt, Shigella flexneri 2a str. 301
caucaccgcgaggccua

SEQ ID NO: 1958716 - RNA, 16 nt, Shigella flexneri 2a str. 301
caucacuccauccagc

SEQ ID NO: 1958717 - RNA, 17 nt, Shigella flexneri 2a str. 301
caucacaucccagcaga

SEQ ID NO: 1958718 - RNA, 18 nt, Shigella flexneri 2a str. 301
caucaacgccaucgccag

SEQ ID NO: 1958719 - RNA, 18 nt, Shigella flexneri 2a str. 301
caucaguacgcauucgcg

SEQ ID NO: 1958720 - RNA, 14 nt, Shigella flexneri 2a str. 301
caucaucgcuuuca

SEQ ID NO: 1958721 - RNA, 23 nt, Shigella flexneri 2a str. 301
caucaucgcuuugugcuggaaag

SEQ ID NO: 1958722 - RNA, 17 nt, Shigella flexneri 2a str. 301
caucaucgccccgcuca

SEQ ID NO: 1958723 - RNA, 18 nt, Shigella flexneri 2a str. 301
caucaucgccccgcucac

SEQ ID NO: 1958724 - RNA, 18 nt, Shigella flexneri 2a str. 301
caucagacuuugcgccau

SEQ ID NO: 1958725 - RNA, 15 nt, Shigella flexneri 2a str. 301
caucagaaaugccag

SEQ ID NO: 1958726 - RNA, 18 nt, Shigella flexneri 2a str. 301
caucacuuucggugacag

SEQ ID NO: 1958727 - RNA, 14 nt, Shigella flexneri 2a str. 301
caucacuuccagua

SEQ ID NO: 1958728 - RNA, 13 nt, Shigella flexneri 2a str. 301
caucacugccagg

SEQ ID NO: 1958729 - RNA, 16 nt, Shigella flexneri 2a str. 301
caucaggggcagcacc

SEQ ID NO: 1958730 - RNA, 23 nt, Shigella flexneri 2a str. 301
caucaggcguucgcggcggcacu

SEQ ID NO: 1958731 - RNA, 20 nt, Shigella flexneri 2a str. 301
caucaugucgcccacgccag

SEQ ID NO: 1958732 - RNA, 24 nt, Shigella flexneri 2a str. 301
caucauucgccgcuuaccauaacg

SEQ ID NO: 1958733 - RNA, 13 nt, Shigella flexneri 2a str. 301
caucauugcaguc

SEQ ID NO: 1958734 - RNA, 22 nt, Shigella flexneri 2a str. 301
caucccgguaucaaagcgccag

SEQ ID NO: 1958735 - RNA, 16 nt, Shigella flexneri 2a str. 301
cauaacugccggaugc

SEQ ID NO: 1958736 - RNA, 13 nt, Shigella flexneri 2a str. 301
cauaccaccgacg

SEQ ID NO: 1958737 - RNA, 15 nt, Shigella flexneri 2a str. 301
caguuuguucagcug

SEQ ID NO: 1958738 - RNA, 18 nt, Shigella flexneri 2a str. 301
caguuuguucagcugcgu

SEQ ID NO: 1958739 - RNA, 16 nt, Shigella flexneri 2a str. 301
caguugucgguaauug

SEQ ID NO: 1958740 - RNA, 12 nt, Shigella flexneri 2a str. 301
caguugucggua

SEQ ID NO: 1958741 - RNA, 16 nt, Shigella flexneri 2a str. 301
caguuucaccagcagu

SEQ ID NO: 1958742 - RNA, 23 nt, Shigella flexneri 2a str. 301
cauacuggauuucauucguacca

SEQ ID NO: 1958743 - RNA, 19 nt, Shigella flexneri 2a str. 301
cauacugcccgagcgccau

SEQ ID NO: 1958744 - RNA, 17 nt, Shigella flexneri 2a str. 301
cauacucuuucccggca

SEQ ID NO: 1958745 - RNA, 17 nt, Shigella flexneri 2a str. 301
cauaccggacgacggca

SEQ ID NO: 1958746 - RNA, 15 nt, Shigella flexneri 2a str. 301
cauauaauacgcauc

SEQ ID NO: 1958747 - RNA, 14 nt, Shigella flexneri 2a str. 301
cauagucauccucu

SEQ ID NO: 1958748 - RNA, 13 nt, Shigella flexneri 2a str. 301
cauacuuccacgc

SEQ ID NO: 1958749 - RNA, 19 nt, Shigella flexneri 2a str. 301
cauagguugaaauaaaccg

SEQ ID NO: 1958750 - RNA, 16 nt, Shigella flexneri 2a str. 301
cauaguagccagccag

SEQ ID NO: 1958751 - RNA, 17 nt, Shigella flexneri 2a str. 301
caguggcugauuggcau

SEQ ID NO: 1958752 - RNA, 21 nt, Shigella flexneri 2a str. 301
caguggcuaagcaggcuggcu

SEQ ID NO: 1958753 - RNA, 15 nt, Shigella flexneri 2a str. 301
cagucgccagcgcca

SEQ ID NO: 1958754 - RNA, 20 nt, Shigella flexneri 2a str. 301
cagugguuucgccagcaccg

SEQ ID NO: 1958755 - RNA, 18 nt, Shigella flexneri 2a str. 301
caguuauuuggcauaucg

SEQ ID NO: 1958756 - RNA, 22 nt, Shigella flexneri 2a str. 301
caguucaaaguuaccggaagcg

SEQ ID NO: 1958757 - RNA, 22 nt, Shigella flexneri 2a str. 301
caguucacgaauauuucccggc

SEQ ID NO: 1958758 - RNA, 22 nt, Shigella flexneri 2a str. 301
caguucauguucaucaauagcu

SEQ ID NO: 1958759 - RNA, 14 nt, Shigella flexneri 2a str. 301
caguuccugcaacu

SEQ ID NO: 1958760 - RNA, 18 nt, Shigella flexneri 2a str. 301
caguugcucaaucaucuc

SEQ ID NO: 1958761 - RNA, 20 nt, Shigella flexneri 2a str. 301
cacguccgguggcauccgca

SEQ ID NO: 1958762 - RNA, 13 nt, Shigella flexneri 2a str. 301
cacggugucggua

SEQ ID NO: 1958763 - RNA, 15 nt, Shigella flexneri 2a str. 301
cacgguuacgcuacc

SEQ ID NO: 1958764 - RNA, 18 nt, Shigella flexneri 2a str. 301
cacgguuaguucaaugcg

SEQ ID NO: 1958765 - RNA, 15 nt, Shigella flexneri 2a str. 301
cacggcaaucaugau

SEQ ID NO: 1958766 - RNA, 16 nt, Shigella flexneri 2a str. 301
cacuggcggcagcagg

SEQ ID NO: 1958767 - RNA, 14 nt, Shigella flexneri 2a str. 301
cacuggcggcagca

SEQ ID NO: 1958768 - RNA, 19 nt, Shigella flexneri 2a str. 301
cacuggcagccaggcgcga

SEQ ID NO: 1958769 - RNA, 12 nt, Shigella flexneri 2a str. 301
cacuggcaauga

SEQ ID NO: 1958770 - RNA, 17 nt, Shigella flexneri 2a str. 301
cacuuucaaauccggcc

SEQ ID NO: 1958771 - RNA, 21 nt, Shigella flexneri 2a str. 301
cacuugucguucaggcgcuga

SEQ ID NO: 1958772 - RNA, 23 nt, Shigella flexneri 2a str. 301
cacuuccagcuccguuaaccgug

SEQ ID NO: 1958773 - RNA, 20 nt, Shigella flexneri 2a str. 301
cacuuuucggcaaccgcauc

SEQ ID NO: 1958774 - RNA, 15 nt, Shigella flexneri 2a str. 301
cacuuugaccgccag

SEQ ID NO: 1958775 - RNA, 16 nt, Shigella flexneri 2a str. 301
cagaaauuuccugagc

SEQ ID NO: 1958776 - RNA, 14 nt, Shigella flexneri 2a str. 301
cagaaccgccauca

SEQ ID NO: 1958777 - RNA, 14 nt, Shigella flexneri 2a str. 301
cacugacaccagca

SEQ ID NO: 1958778 - RNA, 14 nt, Shigella flexneri 2a str. 301
cacugccugcugau

SEQ ID NO: 1958779 - RNA, 20 nt, Shigella flexneri 2a str. 301
cacugccuuucagcgcaugu

SEQ ID NO: 1958780 - RNA, 20 nt, Shigella flexneri 2a str. 301
cacugcgaccgaucaccaca

SEQ ID NO: 1958781 - RNA, 16 nt, Shigella flexneri 2a str. 301
cacucgcagaagcagu

SEQ ID NO: 1958782 - RNA, 22 nt, Shigella flexneri 2a str. 301
cacgaacacagugguuuuaacg

SEQ ID NO: 1958783 - RNA, 14 nt, Shigella flexneri 2a str. 301
cacgaagcaauggc

SEQ ID NO: 1958784 - RNA, 15 nt, Shigella flexneri 2a str. 301
cacgaaucgccgcau

SEQ ID NO: 1958785 - RNA, 14 nt, Shigella flexneri 2a str. 301
cacgacauacaccg

SEQ ID NO: 1958786 - RNA, 14 nt, Shigella flexneri 2a str. 301
caccuucuggcgac

SEQ ID NO: 1958787 - RNA, 19 nt, Shigella flexneri 2a str. 301
cacgaaaccacugcaacag

SEQ ID NO: 1958788 - RNA, 20 nt, Shigella flexneri 2a str. 301
caccugcgcaggcauucaga

SEQ ID NO: 1958789 - RNA, 13 nt, Shigella flexneri 2a str. 301
caccucucgcccg

SEQ ID NO: 1958790 - RNA, 14 nt, Shigella flexneri 2a str. 301
cacgccgcauccgg

SEQ ID NO: 1958791 - RNA, 12 nt, Shigella flexneri 2a str. 301
cacgccgcaucc

SEQ ID NO: 1958792 - RNA, 16 nt, Shigella flexneri 2a str. 301
cacgccgcaucuggca

SEQ ID NO: 1958793 - RNA, 20 nt, Shigella flexneri 2a str. 301
cacgcccugauaaaucaccu

SEQ ID NO: 1958794 - RNA, 14 nt, Shigella flexneri 2a str. 301
cacgcccuccugau

SEQ ID NO: 1958795 - RNA, 14 nt, Shigella flexneri 2a str. 301
cacgccgcauuacc

SEQ ID NO: 1958796 - RNA, 14 nt, Shigella flexneri 2a str. 301
cacgccgccagacc

SEQ ID NO: 1958797 - RNA, 20 nt, Shigella flexneri 2a str. 301
cacgccuuuuuucacuaugu

SEQ ID NO: 1958798 - RNA, 18 nt, Shigella flexneri 2a str. 301
cacgccagcagcgcaauc

SEQ ID NO: 1958799 - RNA, 13 nt, Shigella flexneri 2a str. 301
cacgcaucgcgaa

SEQ ID NO: 1958800 - RNA, 14 nt, Shigella flexneri 2a str. 301
cacgccacauccgg

SEQ ID NO: 1958801 - RNA, 20 nt, Shigella flexneri 2a str. 301
cacgcagaagcgcagaucga

SEQ ID NO: 1958802 - RNA, 21 nt, Shigella flexneri 2a str. 301
cacgcagggggucgcggguuc

SEQ ID NO: 1958803 - RNA, 13 nt, Shigella flexneri 2a str. 301
cacgaucagugcc

SEQ ID NO: 1958804 - RNA, 23 nt, Shigella flexneri 2a str. 301
cacgacucaagaacuguugacca

SEQ ID NO: 1958805 - RNA, 20 nt, Shigella flexneri 2a str. 301
cacgacguuuuccaucgacc

SEQ ID NO: 1958806 - RNA, 12 nt, Shigella flexneri 2a str. 301
cacgacguguuc

SEQ ID NO: 1958807 - RNA, 20 nt, Shigella flexneri 2a str. 301
cacgaucucgccagugacca

SEQ ID NO: 1958808 - RNA, 14 nt, Shigella flexneri 2a str. 301
cacgauguauccgg

SEQ ID NO: 1958809 - RNA, 19 nt, Shigella flexneri 2a str. 301
cacgauuuguaggccggau

SEQ ID NO: 1958810 - RNA, 20 nt, Shigella flexneri 2a str. 301
cacgauuuuguaggccggau

SEQ ID NO: 1958811 - RNA, 13 nt, Shigella flexneri 2a str. 301
cagaugcgcuuca

SEQ ID NO: 1958812 - RNA, 16 nt, Shigella flexneri 2a str. 301
cagaucauccugcggc

SEQ ID NO: 1958813 - RNA, 17 nt, Shigella flexneri 2a str. 301
cagaugcgacggcacca

SEQ ID NO: 1958814 - RNA, 16 nt, Shigella flexneri 2a str. 301
cagaucagaccaaucc

SEQ ID NO: 1958815 - RNA, 23 nt, Shigella flexneri 2a str. 301
cagauaguucgcgaucgcgccag

SEQ ID NO: 1958816 - RNA, 21 nt, Shigella flexneri 2a str. 301
cagauuaugucgcucaaugcg

SEQ ID NO: 1958817 - RNA, 19 nt, Shigella flexneri 2a str. 301
cagauaccaaaaucggcaa

SEQ ID NO: 1958818 - RNA, 16 nt, Shigella flexneri 2a str. 301
cagauacaaccaaucg

SEQ ID NO: 1958819 - RNA, 14 nt, Shigella flexneri 2a str. 301
cagauaaucgccau

SEQ ID NO: 1958820 - RNA, 17 nt, Shigella flexneri 2a str. 301
cagauacgaccguucca

SEQ ID NO: 1958821 - RNA, 19 nt, Shigella flexneri 2a str. 301
cagaauaaacaacuguggu

SEQ ID NO: 1958822 - RNA, 20 nt, Shigella flexneri 2a str. 301
cagaauagccgcagccauca

SEQ ID NO: 1958823 - RNA, 14 nt, Shigella flexneri 2a str. 301
cagaagugaccguc

SEQ ID NO: 1958824 - RNA, 15 nt, Shigella flexneri 2a str. 301
cagaaucgcgcccca

SEQ ID NO: 1958825 - RNA, 15 nt, Shigella flexneri 2a str. 301
cagaaugcgggcgaa

SEQ ID NO: 1958826 - RNA, 17 nt, Shigella flexneri 2a str. 301
cagaauuaacgcugaca

SEQ ID NO: 1958827 - RNA, 16 nt, Shigella flexneri 2a str. 301
cagcaaccgcuuccgg

SEQ ID NO: 1958828 - RNA, 18 nt, Shigella flexneri 2a str. 301
cagauugagcauuggcau

SEQ ID NO: 1958829 - RNA, 16 nt, Shigella flexneri 2a str. 301
cagcaacgaaacgccg

SEQ ID NO: 1958830 - RNA, 19 nt, Shigella flexneri 2a str. 301
cagcaacgaacuaaccgcg

SEQ ID NO: 1958831 - RNA, 14 nt, Shigella flexneri 2a str. 301
cagcaaccgcuucc

SEQ ID NO: 1958832 - RNA, 23 nt, Shigella flexneri 2a str. 301
cagcaaucgaccaggccaucagc

SEQ ID NO: 1958833 - RNA, 17 nt, Shigella flexneri 2a str. 301
cagcaaucacugccaga

SEQ ID NO: 1958834 - RNA, 15 nt, Shigella flexneri 2a str. 301
cagcacaucagccag

SEQ ID NO: 1958835 - RNA, 18 nt, Shigella flexneri 2a str. 301
cagcaccagagaacugaa

SEQ ID NO: 1958836 - RNA, 14 nt, Shigella flexneri 2a str. 301
cagcaccgcagaga

SEQ ID NO: 1958837 - RNA, 22 nt, Shigella flexneri 2a str. 301
cagcagauauugccccacaccg

SEQ ID NO: 1958838 - RNA, 21 nt, Shigella flexneri 2a str. 301
cagcagauaucccgccagcac

SEQ ID NO: 1958839 - RNA, 20 nt, Shigella flexneri 2a str. 301
cagcagagaaaauaucccgu

SEQ ID NO: 1958840 - RNA, 14 nt, Shigella flexneri 2a str. 301
cagccagcagcgaa

SEQ ID NO: 1958841 - RNA, 22 nt, Shigella flexneri 2a str. 301
cagcauugcucaccgccagcau

SEQ ID NO: 1958842 - RNA, 14 nt, Shigella flexneri 2a str. 301
cagcaugcucacca

SEQ ID NO: 1958843 - RNA, 15 nt, Shigella flexneri 2a str. 301
cagcaucaugccgcu

SEQ ID NO: 1958844 - RNA, 16 nt, Shigella flexneri 2a str. 301
cagcaucaucgcaaug

SEQ ID NO: 1958845 - RNA, 13 nt, Shigella flexneri 2a str. 301
cagcaucagcagu

SEQ ID NO: 1958846 - RNA, 15 nt, Shigella flexneri 2a str. 301
cagcauaaugacucu

SEQ ID NO: 1958847 - RNA, 18 nt, Shigella flexneri 2a str. 301
cagcccagcggaaauuac

SEQ ID NO: 1958848 - RNA, 21 nt, Shigella flexneri 2a str. 301
cagcccauuggcgagauaucg

SEQ ID NO: 1958849 - RNA, 20 nt, Shigella flexneri 2a str. 301
cagccauugcuaccgcuucg

SEQ ID NO: 1958850 - RNA, 22 nt, Shigella flexneri 2a str. 301
cagccauuuugcacauuccaga

SEQ ID NO: 1958851 - RNA, 13 nt, Shigella flexneri 2a str. 301
cagccauuuugca

SEQ ID NO: 1958852 - RNA, 13 nt, Shigella flexneri 2a str. 301
cagcccaauaccu

SEQ ID NO: 1958853 - RNA, 17 nt, Shigella flexneri 2a str. 301
cagccauuaaccagcca

SEQ ID NO: 1958854 - RNA, 20 nt, Shigella flexneri 2a str. 301
cagccagccgaacagcgcca

SEQ ID NO: 1958855 - RNA, 22 nt, Shigella flexneri 2a str. 301
cagcccauuggcgagauaucga

SEQ ID NO: 1958856 - RNA, 14 nt, Shigella flexneri 2a str. 301
cagcccggcggcgu

SEQ ID NO: 1958857 - RNA, 14 nt, Shigella flexneri 2a str. 301
cagccugccagcau

SEQ ID NO: 1958858 - RNA, 23 nt, Shigella flexneri 2a str. 301
cagccgucgagggcaaccugcuu

SEQ ID NO: 1958859 - RNA, 17 nt, Shigella flexneri 2a str. 301
cagcgaagcccacgccg

SEQ ID NO: 1958860 - RNA, 22 nt, Shigella flexneri 2a str. 301
cagcgaaccuuccaucgcaucu

SEQ ID NO: 1958861 - RNA, 21 nt, Shigella flexneri 2a str. 301
cagcgacaagaugguggucau

SEQ ID NO: 1958862 - RNA, 15 nt, Shigella flexneri 2a str. 301
cagccggagguguuc

SEQ ID NO: 1958863 - RNA, 19 nt, Shigella flexneri 2a str. 301
cagccgcuaacuuccugcu

SEQ ID NO: 1958864 - RNA, 23 nt, Shigella flexneri 2a str. 301
cagccgccgcuaucggcaaggaa

SEQ ID NO: 1958865 - RNA, 17 nt, Shigella flexneri 2a str. 301
cgcacgcagaaucucug

SEQ ID NO: 1958866 - RNA, 13 nt, Shigella flexneri 2a str. 301
cgcagcagcgcgc

SEQ ID NO: 1958867 - RNA, 15 nt, Shigella flexneri 2a str. 301
cgcacuuccgcccau

SEQ ID NO: 1958868 - RNA, 17 nt, Shigella flexneri 2a str. 301
cgcacuuccgcccaucg

SEQ ID NO: 1958869 - RNA, 14 nt, Shigella flexneri 2a str. 301
cgcagccagcgcgc

SEQ ID NO: 1958870 - RNA, 13 nt, Shigella flexneri 2a str. 301
cgcagccaguuaa

SEQ ID NO: 1958871 - RNA, 21 nt, Shigella flexneri 2a str. 301
cgcagccagcacugccgcauc

SEQ ID NO: 1958872 - RNA, 13 nt, Shigella flexneri 2a str. 301
cgcagcgcaagcu

SEQ ID NO: 1958873 - RNA, 21 nt, Shigella flexneri 2a str. 301
cgcagguagguucugcggcgu

SEQ ID NO: 1958874 - RNA, 19 nt, Shigella flexneri 2a str. 301
cgcaggucauccggcacgc

SEQ ID NO: 1958875 - RNA, 19 nt, Shigella flexneri 2a str. 301
cgcaggaucugacuggcga

SEQ ID NO: 1958876 - RNA, 15 nt, Shigella flexneri 2a str. 301
cgccaauuucaucac

SEQ ID NO: 1958877 - RNA, 21 nt, Shigella flexneri 2a str. 301
cgccaaugaccgcgccaucca

SEQ ID NO: 1958878 - RNA, 13 nt, Shigella flexneri 2a str. 301
cgccaagcagcgc

SEQ ID NO: 1958879 - RNA, 16 nt, Shigella flexneri 2a str. 301
cgccaacuucaugacc

SEQ ID NO: 1958880 - RNA, 23 nt, Shigella flexneri 2a str. 301
cgccaacuucaugaccuuccagc

SEQ ID NO: 1958881 - RNA, 12 nt, Shigella flexneri 2a str. 301
cgccaccagcgu

SEQ ID NO: 1958882 - RNA, 13 nt, Shigella flexneri 2a str. 301
cgccacagcaauu

SEQ ID NO: 1958883 - RNA, 22 nt, Shigella flexneri 2a str. 301
cgccaccaccagacgcaacaga

SEQ ID NO: 1958884 - RNA, 22 nt, Shigella flexneri 2a str. 301
cgcauggcugcgaaucgcuuca

SEQ ID NO: 1958885 - RNA, 21 nt, Shigella flexneri 2a str. 301
cgcaucugccggaaccagcca

SEQ ID NO: 1958886 - RNA, 15 nt, Shigella flexneri 2a str. 301
cgcaucggcgucgug

SEQ ID NO: 1958887 - RNA, 15 nt, Shigella flexneri 2a str. 301
cgcaucgcugcgcuu

SEQ ID NO: 1958888 - RNA, 13 nt, Shigella flexneri 2a str. 301
cgcaucgcagcau

SEQ ID NO: 1958889 - RNA, 13 nt, Shigella flexneri 2a str. 301
cgcagguuccgca

SEQ ID NO: 1958890 - RNA, 16 nt, Shigella flexneri 2a str. 301
cgcaguaaauccgcca

SEQ ID NO: 1958891 - RNA, 14 nt, Shigella flexneri 2a str. 301
cgcaguaaagcgca

SEQ ID NO: 1958892 - RNA, 17 nt, Shigella flexneri 2a str. 301
cgcauccggcaauuggu

SEQ ID NO: 1958893 - RNA, 14 nt, Shigella flexneri 2a str. 301
cgcauccggcauca

SEQ ID NO: 1958894 - RNA, 18 nt, Shigella flexneri 2a str. 301
cgcaguaagcgacgggcg

SEQ ID NO: 1958895 - RNA, 20 nt, Shigella flexneri 2a str. 301
cgcaguaagcgccagggcau

SEQ ID NO: 1958896 - RNA, 21 nt, Shigella flexneri 2a str. 301
cgcaguaccagcaacgcuuca

SEQ ID NO: 1958897 - RNA, 18 nt, Shigella flexneri 2a str. 301
cgccagcuugccgcgcuc

SEQ ID NO: 1958898 - RNA, 17 nt, Shigella flexneri 2a str. 301
cgccagcggcagcucgc

SEQ ID NO: 1958899 - RNA, 15 nt, Shigella flexneri 2a str. 301
cgccagcgccagcgc

SEQ ID NO: 1958900 - RNA, 15 nt, Shigella flexneri 2a str. 301
cgccagcagcagcgu

SEQ ID NO: 1958901 - RNA, 15 nt, Shigella flexneri 2a str. 301
cgccagcagggcaaa

SEQ ID NO: 1958902 - RNA, 17 nt, Shigella flexneri 2a str. 301
cgccagauagccgaccg

SEQ ID NO: 1958903 - RNA, 21 nt, Shigella flexneri 2a str. 301
cgccagauaugaucgaaaaug

SEQ ID NO: 1958904 - RNA, 22 nt, Shigella flexneri 2a str. 301
cgccacuuuaaauucagcauua

SEQ ID NO: 1958905 - RNA, 16 nt, Shigella flexneri 2a str. 301
cgccacuuuucggcaa

SEQ ID NO: 1958906 - RNA, 18 nt, Shigella flexneri 2a str. 301
cgccacuucccagccuuc

SEQ ID NO: 1958907 - RNA, 15 nt, Shigella flexneri 2a str. 301
cgccaccgcaagcca

SEQ ID NO: 1958908 - RNA, 13 nt, Shigella flexneri 2a str. 301
cgaguugaucacg

SEQ ID NO: 1958909 - RNA, 12 nt, Shigella flexneri 2a str. 301
cgauacccauuu

SEQ ID NO: 1958910 - RNA, 23 nt, Shigella flexneri 2a str. 301
cgauaccacccgcagugauugcc

SEQ ID NO: 1958911 - RNA, 18 nt, Shigella flexneri 2a str. 301
cgauacagaagcaccgua

SEQ ID NO: 1958912 - RNA, 20 nt, Shigella flexneri 2a str. 301
cgauacgcaguacggcagca

SEQ ID NO: 1958913 - RNA, 13 nt, Shigella flexneri 2a str. 301
cgauaugcgucag

SEQ ID NO: 1958914 - RNA, 20 nt, Shigella flexneri 2a str. 301
cgauagagcaaccaccugca

SEQ ID NO: 1958915 - RNA, 22 nt, Shigella flexneri 2a str. 301
cgauacgcugcacaauugccag

SEQ ID NO: 1958916 - RNA, 13 nt, Shigella flexneri 2a str. 301
cgaucagcggacg

SEQ ID NO: 1958917 - RNA, 12 nt, Shigella flexneri 2a str. 301
cgaucagcggac

SEQ ID NO: 1958918 - RNA, 21 nt, Shigella flexneri 2a str. 301
cgaucacuuucugcgccagcg

SEQ ID NO: 1958919 - RNA, 17 nt, Shigella flexneri 2a str. 301
cgaucacugcgaaagcg

SEQ ID NO: 1958920 - RNA, 18 nt, Shigella flexneri 2a str. 301
cgaucacuuucugcgcca

SEQ ID NO: 1958921 - RNA, 22 nt, Shigella flexneri 2a str. 301
cgaucauguaccguugcugcca

SEQ ID NO: 1958922 - RNA, 11 nt, Shigella flexneri 2a str. 301
cgauccacgcc

SEQ ID NO: 1958923 - RNA, 19 nt, Shigella flexneri 2a str. 301
cgaguucaucacaccaguc

SEQ ID NO: 1958924 - RNA, 13 nt, Shigella flexneri 2a str. 301
cgaguagaucaac

SEQ ID NO: 1958925 - RNA, 14 nt, Shigella flexneri 2a str. 301
cgagucaacgcuuc

SEQ ID NO: 1958926 - RNA, 18 nt, Shigella flexneri 2a str. 301
cgagguuauccgccagcg

SEQ ID NO: 1958927 - RNA, 22 nt, Shigella flexneri 2a str. 301
cgauuugugcacgugccagaug

SEQ ID NO: 1958928 - RNA, 13 nt, Shigella flexneri 2a str. 301
cgcaaauucggcg

SEQ ID NO: 1958929 - RNA, 18 nt, Shigella flexneri 2a str. 301
cgcaaaggccagcaaucc

SEQ ID NO: 1958930 - RNA, 15 nt, Shigella flexneri 2a str. 301
cgcaacggcugcugc

SEQ ID NO: 1958931 - RNA, 20 nt, Shigella flexneri 2a str. 301
cgcaacgccuaaauccgcca

SEQ ID NO: 1958932 - RNA, 15 nt, Shigella flexneri 2a str. 301
cgcaacgacaccguu

SEQ ID NO: 1958933 - RNA, 22 nt, Shigella flexneri 2a str. 301
cgauuaacgccagacucgccag

SEQ ID NO: 1958934 - RNA, 17 nt, Shigella flexneri 2a str. 301
cgauuaaaaacccugca

SEQ ID NO: 1958935 - RNA, 14 nt, Shigella flexneri 2a str. 301
cgauguuugcugcg

SEQ ID NO: 1958936 - RNA, 13 nt, Shigella flexneri 2a str. 301
cgauuaucgccau

SEQ ID NO: 1958937 - RNA, 21 nt, Shigella flexneri 2a str. 301
cgauugcaggaaauuauggau

SEQ ID NO: 1958938 - RNA, 16 nt, Shigella flexneri 2a str. 301
cgauuuccaucuccag

SEQ ID NO: 1958939 - RNA, 23 nt, Shigella flexneri 2a str. 301
cgaugggagcagccagccagacg

SEQ ID NO: 1958940 - RNA, 20 nt, Shigella flexneri 2a str. 301
cgaugccaguaaucacgauc

SEQ ID NO: 1958941 - RNA, 12 nt, Shigella flexneri 2a str. 301
cgaugcacagca

SEQ ID NO: 1958942 - RNA, 21 nt, Shigella flexneri 2a str. 301
cgaugcagguuggcgacguca

SEQ ID NO: 1958943 - RNA, 12 nt, Shigella flexneri 2a str. 301
cgaugccagcac

SEQ ID NO: 1958944 - RNA, 18 nt, Shigella flexneri 2a str. 301
cgaucuuccacgccugca

SEQ ID NO: 1958945 - RNA, 17 nt, Shigella flexneri 2a str. 301
cgaucuuccacgccugc

SEQ ID NO: 1958946 - RNA, 21 nt, Shigella flexneri 2a str. 301
cgaucgaugugauaaauacga

SEQ ID NO: 1958947 - RNA, 21 nt, Shigella flexneri 2a str. 301
cgaccuguaccuucagcggca

SEQ ID NO: 1958948 - RNA, 15 nt, Shigella flexneri 2a str. 301
cgacgaugaucaagc

SEQ ID NO: 1958949 - RNA, 19 nt, Shigella flexneri 2a str. 301
cgaccgccucgcgccagcg

SEQ ID NO: 1958950 - RNA, 16 nt, Shigella flexneri 2a str. 301
cgagcagcacaaugcc

SEQ ID NO: 1958951 - RNA, 13 nt, Shigella flexneri 2a str. 301
cgagaguaacaca

SEQ ID NO: 1958952 - RNA, 19 nt, Shigella flexneri 2a str. 301
cgagauacagguugccgau

SEQ ID NO: 1958953 - RNA, 21 nt, Shigella flexneri 2a str. 301
cgagaauuucucgugccacca

SEQ ID NO: 1958954 - RNA, 18 nt, Shigella flexneri 2a str. 301
cgagcccagaugccggau

SEQ ID NO: 1958955 - RNA, 21 nt, Shigella flexneri 2a str. 301
cgagcgccguugcgcccauca

SEQ ID NO: 1958956 - RNA, 21 nt, Shigella flexneri 2a str. 301
cgacuucuucauucauccgcc

SEQ ID NO: 1958957 - RNA, 18 nt, Shigella flexneri 2a str. 301
cgagaagcaagcauuaua

SEQ ID NO: 1958958 - RNA, 16 nt, Shigella flexneri 2a str. 301
cgagaauaaaacaggc

SEQ ID NO: 1958959 - RNA, 21 nt, Shigella flexneri 2a str. 301
cgacuaauacaccaucaugga

SEQ ID NO: 1958960 - RNA, 20 nt, Shigella flexneri 2a str. 301
cgacugucaacucuggcaug

SEQ ID NO: 1958961 - RNA, 17 nt, Shigella flexneri 2a str. 301
cgacgggauucgaaccu

SEQ ID NO: 1958962 - RNA, 20 nt, Shigella flexneri 2a str. 301
ccuggcgaacccaaccguga

SEQ ID NO: 1958963 - RNA, 20 nt, Shigella flexneri 2a str. 301
ccuggcgcaguggauagacg

SEQ ID NO: 1958964 - RNA, 11 nt, Shigella flexneri 2a str. 301
ccuggcgcugg

SEQ ID NO: 1958965 - RNA, 14 nt, Shigella flexneri 2a str. 301
ccuggcuggugacg

SEQ ID NO: 1958966 - RNA, 19 nt, Shigella flexneri 2a str. 301
ccugccgcaggacgggcaa

SEQ ID NO: 1958967 - RNA, 22 nt, Shigella flexneri 2a str. 301
ccugccgggcugaugccgcguu

SEQ ID NO: 1958968 - RNA, 19 nt, Shigella flexneri 2a str. 301
ccugccuucacuuccggca

SEQ ID NO: 1958969 - RNA, 20 nt, Shigella flexneri 2a str. 301
ccugguugcuggauaagaug

SEQ ID NO: 1958970 - RNA, 14 nt, Shigella flexneri 2a str. 301
ccuguaccagcccg

SEQ ID NO: 1958971 - RNA, 23 nt, Shigella flexneri 2a str. 301
ccugguaaaaaaugauuuccugc

SEQ ID NO: 1958972 - RNA, 19 nt, Shigella flexneri 2a str. 301
cgaaauccauguugcugga

SEQ ID NO: 1958973 - RNA, 20 nt, Shigella flexneri 2a str. 301
cgaaaucaccgccaccagcg

SEQ ID NO: 1958974 - RNA, 19 nt, Shigella flexneri 2a str. 301
cgaaaguaacaccauccau

SEQ ID NO: 1958975 - RNA, 18 nt, Shigella flexneri 2a str. 301
cgaaaaucaccgcgacca

SEQ ID NO: 1958976 - RNA, 16 nt, Shigella flexneri 2a str. 301
cgaaacauacaggcua

SEQ ID NO: 1958977 - RNA, 19 nt, Shigella flexneri 2a str. 301
cgaaaccggauacccugcc

SEQ ID NO: 1958978 - RNA, 16 nt, Shigella flexneri 2a str. 301
ccuuuaaaucccgcuu

SEQ ID NO: 1958979 - RNA, 11 nt, Shigella flexneri 2a str. 301
ccuuuaccaga

SEQ ID NO: 1958980 - RNA, 14 nt, Shigella flexneri 2a str. 301
ccuuuagcgagcga

SEQ ID NO: 1958981 - RNA, 22 nt, Shigella flexneri 2a str. 301
ccuuucacuucggucaccguca

SEQ ID NO: 1958982 - RNA, 15 nt, Shigella flexneri 2a str. 301
ccuuuaugacgaucg

SEQ ID NO: 1958983 - RNA, 21 nt, Shigella flexneri 2a str. 301
ccuucacuuuugccagacgaa

SEQ ID NO: 1958984 - RNA, 14 nt, Shigella flexneri 2a str. 301
ccuucacgauagcc

SEQ ID NO: 1958985 - RNA, 17 nt, Shigella flexneri 2a str. 301
ccuucacgaucgaagcc

SEQ ID NO: 1958986 - RNA, 19 nt, Shigella flexneri 2a str. 301
ccuucaucuucauccggcu

SEQ ID NO: 1958987 - RNA, 22 nt, Shigella flexneri 2a str. 301
ccuguaucccagaucgcuuucc

SEQ ID NO: 1958988 - RNA, 23 nt, Shigella flexneri 2a str. 301
ccuugcggcuuaacugucgcuga

SEQ ID NO: 1958989 - RNA, 13 nt, Shigella flexneri 2a str. 301
ccuugaguuucgu

SEQ ID NO: 1958990 - RNA, 16 nt, Shigella flexneri 2a str. 301
cgacagacgccagcgc

SEQ ID NO: 1958991 - RNA, 22 nt, Shigella flexneri 2a str. 301
cgacagaacucguucagcgcau

SEQ ID NO: 1958992 - RNA, 17 nt, Shigella flexneri 2a str. 301
cgacacagguaucgaca

SEQ ID NO: 1958993 - RNA, 13 nt, Shigella flexneri 2a str. 301
cgacacaacgcuu

SEQ ID NO: 1958994 - RNA, 16 nt, Shigella flexneri 2a str. 301
cgacaaucaucgccuu

SEQ ID NO: 1958995 - RNA, 19 nt, Shigella flexneri 2a str. 301
cgacaauccgguagguuca

SEQ ID NO: 1958996 - RNA, 21 nt, Shigella flexneri 2a str. 301
cgacaaucucaauuuucacuu

SEQ ID NO: 1958997 - RNA, 20 nt, Shigella flexneri 2a str. 301
cgacaggcuuucuucgucgu

SEQ ID NO: 1958998 - RNA, 16 nt, Shigella flexneri 2a str. 301
cgacagggaucucuuc

SEQ ID NO: 1958999 - RNA, 19 nt, Shigella flexneri 2a str. 301
cgacagggaucucuuccag

SEQ ID NO: 1959000 - RNA, 18 nt, Shigella flexneri 2a str. 301
cgaaucagauucacggua

SEQ ID NO: 1959001 - RNA, 19 nt, Shigella flexneri 2a str. 301
cgaauaccuucuuccugcg

SEQ ID NO: 1959002 - RNA, 23 nt, Shigella flexneri 2a str. 301
cgaauacguugcuucaugccgga

SEQ ID NO: 1959003 - RNA, 14 nt, Shigella flexneri 2a str. 301
cgaauacacccuga

SEQ ID NO: 1959004 - RNA, 17 nt, Shigella flexneri 2a str. 301
cgacaaaugcgccgcca

SEQ ID NO: 1959005 - RNA, 18 nt, Shigella flexneri 2a str. 301
cgacaaacuccgcgacca

SEQ ID NO: 1959006 - RNA, 17 nt, Shigella flexneri 2a str. 301
cgacaacuggcagcacc

SEQ ID NO: 1959007 - RNA, 23 nt, Shigella flexneri 2a str. 301
cgacaacagaaauaaucgcaauu

SEQ ID NO: 1959008 - RNA, 14 nt, Shigella flexneri 2a str. 301
cgaauucuggcuga

SEQ ID NO: 1959009 - RNA, 16 nt, Shigella flexneri 2a str. 301
cgaauuguucugcgcc

SEQ ID NO: 1959010 - RNA, 14 nt, Shigella flexneri 2a str. 301
cgaauugccaccau

SEQ ID NO: 1959011 - RNA, 15 nt, Shigella flexneri 2a str. 301
cgaauugccaccauc

SEQ ID NO: 1959012 - RNA, 19 nt, Shigella flexneri 2a str. 301
cgaauguuccaucaccaga

SEQ ID NO: 1959013 - RNA, 22 nt, Shigella flexneri 2a str. 301
cgaauguggcagcaacuggcga

SEQ ID NO: 1959014 - RNA, 16 nt, Shigella flexneri 2a str. 301
cgaaugucguuuccau

SEQ ID NO: 1959015 - RNA, 13 nt, Shigella flexneri 2a str. 301
cgaacaccagcag

SEQ ID NO: 1959016 - RNA, 15 nt, Shigella flexneri 2a str. 301
cgaacaccagcagua

SEQ ID NO: 1959017 - RNA, 22 nt, Shigella flexneri 2a str. 301
cgaaccggaaauccaggucagc

SEQ ID NO: 1959018 - RNA, 14 nt, Shigella flexneri 2a str. 301
cgaacgcugcacgc

SEQ ID NO: 1959019 - RNA, 15 nt, Shigella flexneri 2a str. 301
cgaacucuuccggca

SEQ ID NO: 1959020 - RNA, 22 nt, Shigella flexneri 2a str. 301
cgaagcuucucauccuuccccg

SEQ ID NO: 1959021 - RNA, 13 nt, Shigella flexneri 2a str. 301
cgaagccgugcca

SEQ ID NO: 1959022 - RNA, 19 nt, Shigella flexneri 2a str. 301
ccgccugauagaccggacc

SEQ ID NO: 1959023 - RNA, 14 nt, Shigella flexneri 2a str. 301
ccgcgauccagcgc

SEQ ID NO: 1959024 - RNA, 18 nt, Shigella flexneri 2a str. 301
ccgcgauaaaaauccugu

SEQ ID NO: 1959025 - RNA, 12 nt, Shigella flexneri 2a str. 301
ccgcgcaguucg

SEQ ID NO: 1959026 - RNA, 21 nt, Shigella flexneri 2a str. 301
ccgcgcauuacgcucacugca

SEQ ID NO: 1959027 - RNA, 20 nt, Shigella flexneri 2a str. 301
ccgcccguuuucuccagcgc

SEQ ID NO: 1959028 - RNA, 12 nt, Shigella flexneri 2a str. 301
ccgcccuacgcg

SEQ ID NO: 1959029 - RNA, 18 nt, Shigella flexneri 2a str. 301
ccgcccguuuucuccagc

SEQ ID NO: 1959030 - RNA, 15 nt, Shigella flexneri 2a str. 301
ccgccaucgcccauc

SEQ ID NO: 1959031 - RNA, 22 nt, Shigella flexneri 2a str. 301
ccgccgauuuccugcgucgcua

SEQ ID NO: 1959032 - RNA, 14 nt, Shigella flexneri 2a str. 301
ccgccgcaauccgc

SEQ ID NO: 1959033 - RNA, 14 nt, Shigella flexneri 2a str. 301
ccgcguggcgcaag

SEQ ID NO: 1959034 - RNA, 15 nt, Shigella flexneri 2a str. 301
ccgcguguuuccggg

SEQ ID NO: 1959035 - RNA, 16 nt, Shigella flexneri 2a str. 301
ccgcguaccgcagcaa

SEQ ID NO: 1959036 - RNA, 14 nt, Shigella flexneri 2a str. 301
ccgcucucauccau

SEQ ID NO: 1959037 - RNA, 18 nt, Shigella flexneri 2a str. 301
ccgcugacggcucgcccg

SEQ ID NO: 1959038 - RNA, 21 nt, Shigella flexneri 2a str. 301
ccgcuggccauuucugccagu

SEQ ID NO: 1959039 - RNA, 19 nt, Shigella flexneri 2a str. 301
ccgcuaacagcagcagcgc

SEQ ID NO: 1959040 - RNA, 15 nt, Shigella flexneri 2a str. 301
ccgcucgucacauca

SEQ ID NO: 1959041 - RNA, 23 nt, Shigella flexneri 2a str. 301
ccgcgcucgaagcgggcgcgcag

SEQ ID NO: 1959042 - RNA, 16 nt, Shigella flexneri 2a str. 301
ccgcgcgccaccauuc

SEQ ID NO: 1959043 - RNA, 17 nt, Shigella flexneri 2a str. 301
ccgacaaauuucaucgc

SEQ ID NO: 1959044 - RNA, 19 nt, Shigella flexneri 2a str. 301
ccgacuuaucacugccagu

SEQ ID NO: 1959045 - RNA, 15 nt, Shigella flexneri 2a str. 301
ccgacgugcagcauc

SEQ ID NO: 1959046 - RNA, 23 nt, Shigella flexneri 2a str. 301
ccgacgugguuaacgaccagcgg

SEQ ID NO: 1959047 - RNA, 13 nt, Shigella flexneri 2a str. 301
ccgauaaccacgc

SEQ ID NO: 1959048 - RNA, 18 nt, Shigella flexneri 2a str. 301
ccgauaauaaagccuauc

SEQ ID NO: 1959049 - RNA, 21 nt, Shigella flexneri 2a str. 301
ccgaguaguuauauuccggcg

SEQ ID NO: 1959050 - RNA, 15 nt, Shigella flexneri 2a str. 301
ccgcagcuccagccc

SEQ ID NO: 1959051 - RNA, 12 nt, Shigella flexneri 2a str. 301
ccgcauccggca

SEQ ID NO: 1959052 - RNA, 17 nt, Shigella flexneri 2a str. 301
ccgcaguaaagcgcagg

SEQ ID NO: 1959053 - RNA, 16 nt, Shigella flexneri 2a str. 301
ccgcaguguaguucug

SEQ ID NO: 1959054 - RNA, 17 nt, Shigella flexneri 2a str. 301
ccgccagacguccggcg

SEQ ID NO: 1959055 - RNA, 18 nt, Shigella flexneri 2a str. 301
ccgccagagcuucaaccg

SEQ ID NO: 1959056 - RNA, 19 nt, Shigella flexneri 2a str. 301
ccgccaaaacgguccggca

SEQ ID NO: 1959057 - RNA, 19 nt, Shigella flexneri 2a str. 301
ccgccaggcugcgaacggu

SEQ ID NO: 1959058 - RNA, 11 nt, Shigella flexneri 2a str. 301
ccgccaucaga

SEQ ID NO: 1959059 - RNA, 13 nt, Shigella flexneri 2a str. 301
ccgccaucagcag

SEQ ID NO: 1959060 - RNA, 17 nt, Shigella flexneri 2a str. 301
ccgaugaccuugucaug

SEQ ID NO: 1959061 - RNA, 19 nt, Shigella flexneri 2a str. 301
ccgaugaucaacagcauca

SEQ ID NO: 1959062 - RNA, 22 nt, Shigella flexneri 2a str. 301
ccgaucaucacgaucgcuucgg

SEQ ID NO: 1959063 - RNA, 15 nt, Shigella flexneri 2a str. 301
ccgauacgcuggaug

SEQ ID NO: 1959064 - RNA, 15 nt, Shigella flexneri 2a str. 301
ccucuuucauccgau

SEQ ID NO: 1959065 - RNA, 18 nt, Shigella flexneri 2a str. 301
ccucuuuacgcaaaauca

SEQ ID NO: 1959066 - RNA, 13 nt, Shigella flexneri 2a str. 301
ccucuuucuagac

SEQ ID NO: 1959067 - RNA, 17 nt, Shigella flexneri 2a str. 301
ccucuucccagacccag

SEQ ID NO: 1959068 - RNA, 16 nt, Shigella flexneri 2a str. 301
ccucuccuguucucac

SEQ ID NO: 1959069 - RNA, 13 nt, Shigella flexneri 2a str. 301
ccucgcuacgcca

SEQ ID NO: 1959070 - RNA, 15 nt, Shigella flexneri 2a str. 301
ccugacagcagagca

SEQ ID NO: 1959071 - RNA, 22 nt, Shigella flexneri 2a str. 301
ccugaauaaucguaaucagcau

SEQ ID NO: 1959072 - RNA, 14 nt, Shigella flexneri 2a str. 301
ccugauaagcgcag

SEQ ID NO: 1959073 - RNA, 19 nt, Shigella flexneri 2a str. 301
ccugaugcgacgcuugacg

SEQ ID NO: 1959074 - RNA, 16 nt, Shigella flexneri 2a str. 301
ccugaugagggcgcua

SEQ ID NO: 1959075 - RNA, 19 nt, Shigella flexneri 2a str. 301
ccugauagcuuacggcgcu

SEQ ID NO: 1959076 - RNA, 21 nt, Shigella flexneri 2a str. 301
ccugauagcuuacggcgcugu

SEQ ID NO: 1959077 - RNA, 18 nt, Shigella flexneri 2a str. 301
ccugccagaacaaccaga

SEQ ID NO: 1959078 - RNA, 13 nt, Shigella flexneri 2a str. 301
ccugcauccgcca

SEQ ID NO: 1959079 - RNA, 14 nt, Shigella flexneri 2a str. 301
ccugcacuuucagc

SEQ ID NO: 1959080 - RNA, 17 nt, Shigella flexneri 2a str. 301
ccuaccgcccgcgcggu

SEQ ID NO: 1959081 - RNA, 18 nt, Shigella flexneri 2a str. 301
ccuagagcaucaugaaua

SEQ ID NO: 1959082 - RNA, 23 nt, Shigella flexneri 2a str. 301
ccguucgccaggucagagagcca

SEQ ID NO: 1959083 - RNA, 13 nt, Shigella flexneri 2a str. 301
ccguucauccgcu

SEQ ID NO: 1959084 - RNA, 13 nt, Shigella flexneri 2a str. 301
ccguucaguuccg

SEQ ID NO: 1959085 - RNA, 16 nt, Shigella flexneri 2a str. 301
ccuccacgcccagcgc

SEQ ID NO: 1959086 - RNA, 19 nt, Shigella flexneri 2a str. 301
ccuccgggaccuuucugau

SEQ ID NO: 1959087 - RNA, 16 nt, Shigella flexneri 2a str. 301
ccgugccggacggucg

SEQ ID NO: 1959088 - RNA, 21 nt, Shigella flexneri 2a str. 301
ccgugacacacugaaccgcgc

SEQ ID NO: 1959089 - RNA, 22 nt, Shigella flexneri 2a str. 301
ccguuaccguaccaaccgcaau

SEQ ID NO: 1959090 - RNA, 15 nt, Shigella flexneri 2a str. 301
ccguuaaccguggga

SEQ ID NO: 1959091 - RNA, 16 nt, Shigella flexneri 2a str. 301
ccgugugccgacaucg

SEQ ID NO: 1959092 - RNA, 13 nt, Shigella flexneri 2a str. 301
ccgguugaccggc

SEQ ID NO: 1959093 - RNA, 13 nt, Shigella flexneri 2a str. 301
ccguaagcaacgc

SEQ ID NO: 1959094 - RNA, 18 nt, Shigella flexneri 2a str. 301
ccguacauagcgucaaga

SEQ ID NO: 1959095 - RNA, 15 nt, Shigella flexneri 2a str. 301
ccguaccaucgccag

SEQ ID NO: 1959096 - RNA, 19 nt, Shigella flexneri 2a str. 301
ccguaugaugugcgcuaac

SEQ ID NO: 1959097 - RNA, 20 nt, Shigella flexneri 2a str. 301
ccguauuuuuugcucauaaa

SEQ ID NO: 1959098 - RNA, 13 nt, Shigella flexneri 2a str. 301
ccgucagcggcaa

SEQ ID NO: 1959099 - RNA, 16 nt, Shigella flexneri 2a str. 301
ccgucagauccgccag

SEQ ID NO: 1959100 - RNA, 15 nt, Shigella flexneri 2a str. 301
ccgucagauccgcca

SEQ ID NO: 1959101 - RNA, 15 nt, Shigella flexneri 2a str. 301
ccgucaaagcgccag

SEQ ID NO: 1959102 - RNA, 17 nt, Shigella flexneri 2a str. 301
ccgucauuguuaacgcc

SEQ ID NO: 1959103 - RNA, 22 nt, Shigella flexneri 2a str. 301
ccgucaguuugccguaccacgc

SEQ ID NO: 1959104 - RNA, 17 nt, Shigella flexneri 2a str. 301
ccgggcugguuuucagc

SEQ ID NO: 1959105 - RNA, 12 nt, Shigella flexneri 2a str. 301
ccgggcuggauu

SEQ ID NO: 1959106 - RNA, 14 nt, Shigella flexneri 2a str. 301
ccggguaccacgca

SEQ ID NO: 1959107 - RNA, 16 nt, Shigella flexneri 2a str. 301
ccggguaccagaauca

SEQ ID NO: 1959108 - RNA, 17 nt, Shigella flexneri 2a str. 301
ccgggcuucucgcucga

SEQ ID NO: 1959109 - RNA, 17 nt, Shigella flexneri 2a str. 301
ccggcuaccgggccuga

SEQ ID NO: 1959110 - RNA, 22 nt, Shigella flexneri 2a str. 301
ccggcgggaaaaaucuucgauc

SEQ ID NO: 1959111 - RNA, 17 nt, Shigella flexneri 2a str. 301
ccggcgucccaucggca

SEQ ID NO: 1959112 - RNA, 17 nt, Shigella flexneri 2a str. 301
ccggcgucgcauccgac

SEQ ID NO: 1959113 - RNA, 13 nt, Shigella flexneri 2a str. 301
ccggcgcauccau

SEQ ID NO: 1959114 - RNA, 14 nt, Shigella flexneri 2a str. 301
ccggcgcauccaug

SEQ ID NO: 1959115 - RNA, 18 nt, Shigella flexneri 2a str. 301
ccggcgaauuaccagcca

SEQ ID NO: 1959116 - RNA, 15 nt, Shigella flexneri 2a str. 301
ccggccacagcgcca

SEQ ID NO: 1959117 - RNA, 21 nt, Shigella flexneri 2a str. 301
ccggaauaaaugucacgucau

SEQ ID NO: 1959118 - RNA, 22 nt, Shigella flexneri 2a str. 301
ccggaaggaagacgcagcaugc

SEQ ID NO: 1959119 - RNA, 22 nt, Shigella flexneri 2a str. 301
ccggaauaacucccuauaaugc

SEQ ID NO: 1959120 - RNA, 18 nt, Shigella flexneri 2a str. 301
ccggaaguaccaauggca

SEQ ID NO: 1959121 - RNA, 19 nt, Shigella flexneri 2a str. 301
ccggcauaccacggucauu

SEQ ID NO: 1959122 - RNA, 13 nt, Shigella flexneri 2a str. 301
ccggcaucaacca

SEQ ID NO: 1959123 - RNA, 16 nt, Shigella flexneri 2a str. 301
ccggcauccuuaucac

SEQ ID NO: 1959124 - RNA, 21 nt, Shigella flexneri 2a str. 301
ccggcaucgcaaaccagacgc

SEQ ID NO: 1959125 - RNA, 22 nt, Shigella flexneri 2a str. 301
ccggcauuaucacaucagcgca

SEQ ID NO: 1959126 - RNA, 13 nt, Shigella flexneri 2a str. 301
ccggcauuaucac

SEQ ID NO: 1959127 - RNA, 15 nt, Shigella flexneri 2a str. 301
ccggcauuacggauu

SEQ ID NO: 1959128 - RNA, 20 nt, Shigella flexneri 2a str. 301
cgcggcaauuuuuaccgguc

SEQ ID NO: 1959129 - RNA, 19 nt, Shigella flexneri 2a str. 301
cgcggcagugacugcccca

SEQ ID NO: 1959130 - RNA, 16 nt, Shigella flexneri 2a str. 301
cgcggcagucacauuc

SEQ ID NO: 1959131 - RNA, 22 nt, Shigella flexneri 2a str. 301
cgcgcaguuugucuucaaugcg

SEQ ID NO: 1959132 - RNA, 13 nt, Shigella flexneri 2a str. 301
cgcgcauccggca

SEQ ID NO: 1959133 - RNA, 17 nt, Shigella flexneri 2a str. 301
cgcgcagcgucgcauca

SEQ ID NO: 1959134 - RNA, 21 nt, Shigella flexneri 2a str. 301
cgcgcacuaugugccagcuuc

SEQ ID NO: 1959135 - RNA, 17 nt, Shigella flexneri 2a str. 301
cgcgcaaucagcaccgc

SEQ ID NO: 1959136 - RNA, 13 nt, Shigella flexneri 2a str. 301
cgcgccaccauuc

SEQ ID NO: 1959137 - RNA, 18 nt, Shigella flexneri 2a str. 301
cgcgccagaaagcagcau

SEQ ID NO: 1959138 - RNA, 21 nt, Shigella flexneri 2a str. 301
cgcgccauauaauacgcaucg

SEQ ID NO: 1959139 - RNA, 13 nt, Shigella flexneri 2a str. 301
cgcgccgcauccg

SEQ ID NO: 1959140 - RNA, 17 nt, Shigella flexneri 2a str. 301
cgcgccgcagccggaaa

SEQ ID NO: 1959141 - RNA, 22 nt, Shigella flexneri 2a str. 301
cgcgucaacagggcagacauuc

SEQ ID NO: 1959142 - RNA, 17 nt, Shigella flexneri 2a str. 301
cgcguaccgccgagucg

SEQ ID NO: 1959143 - RNA, 20 nt, Shigella flexneri 2a str. 301
cgcguagagaauccagugcu

SEQ ID NO: 1959144 - RNA, 21 nt, Shigella flexneri 2a str. 301
cgcguaaauuugcucaucgau

SEQ ID NO: 1959145 - RNA, 14 nt, Shigella flexneri 2a str. 301
cgcguaacggcggu

SEQ ID NO: 1959146 - RNA, 22 nt, Shigella flexneri 2a str. 301
cgcgguugcggguuuucgcugc

SEQ ID NO: 1959147 - RNA, 14 nt, Shigella flexneri 2a str. 301
cgcgggucaccgcg

SEQ ID NO: 1959148 - RNA, 15 nt, Shigella flexneri 2a str. 301
cgcgggucguugauc

SEQ ID NO: 1959149 - RNA, 20 nt, Shigella flexneri 2a str. 301
cgcgucuuauccggccucca

SEQ ID NO: 1959150 - RNA, 20 nt, Shigella flexneri 2a str. 301
cgcgucguccccacagcguc

SEQ ID NO: 1959151 - RNA, 21 nt, Shigella flexneri 2a str. 301
cgcguuggcaagauaggcauc

SEQ ID NO: 1959152 - RNA, 22 nt, Shigella flexneri 2a str. 301
cgcguugaugccgugcagcacg

SEQ ID NO: 1959153 - RNA, 20 nt, Shigella flexneri 2a str. 301
cgcguugcuuauugccggau

SEQ ID NO: 1959154 - RNA, 17 nt, Shigella flexneri 2a str. 301
cgcgugacgcuggcaga

SEQ ID NO: 1959155 - RNA, 18 nt, Shigella flexneri 2a str. 301
cgcugggagaauugcgaa

SEQ ID NO: 1959156 - RNA, 22 nt, Shigella flexneri 2a str. 301
cgcugcuaauuuaucggcguua

SEQ ID NO: 1959157 - RNA, 16 nt, Shigella flexneri 2a str. 301
cgcugccguugcuuga

SEQ ID NO: 1959158 - RNA, 20 nt, Shigella flexneri 2a str. 301
cgcugcccaugcgcucgacg

SEQ ID NO: 1959159 - RNA, 19 nt, Shigella flexneri 2a str. 301
cgcugaccuucuucagcaa

SEQ ID NO: 1959160 - RNA, 14 nt, Shigella flexneri 2a str. 301
cgcugacggcagcg

SEQ ID NO: 1959161 - RNA, 17 nt, Shigella flexneri 2a str. 301
cgcugacgccaugccau

SEQ ID NO: 1959162 - RNA, 20 nt, Shigella flexneri 2a str. 301
cgcugagugugaauaccgcu

SEQ ID NO: 1959163 - RNA, 18 nt, Shigella flexneri 2a str. 301
cgcucgguagugccaacg

SEQ ID NO: 1959164 - RNA, 21 nt, Shigella flexneri 2a str. 301
cgcguuucugcgcuucugcca

SEQ ID NO: 1959165 - RNA, 17 nt, Shigella flexneri 2a str. 301
cgcccauuuuucaugau

SEQ ID NO: 1959166 - RNA, 20 nt, Shigella flexneri 2a str. 301
cgcccauugagcuggucuga

SEQ ID NO: 1959167 - RNA, 21 nt, Shigella flexneri 2a str. 301
cgcccaguugaucaccagugc

SEQ ID NO: 1959168 - RNA, 20 nt, Shigella flexneri 2a str. 301
cgcccagugcggugccgcga

SEQ ID NO: 1959169 - RNA, 18 nt, Shigella flexneri 2a str. 301
cgcccagcguugcacaug

SEQ ID NO: 1959170 - RNA, 23 nt, Shigella flexneri 2a str. 301
cgcccaacuaaaugcugcagcca

SEQ ID NO: 1959171 - RNA, 17 nt, Shigella flexneri 2a str. 301
cgccauuuucugccgca

SEQ ID NO: 1959172 - RNA, 18 nt, Shigella flexneri 2a str. 301
cgccauuuuuuugucugc

SEQ ID NO: 1959173 - RNA, 17 nt, Shigella flexneri 2a str. 301
cgccauuuuaaucaucu

SEQ ID NO: 1959174 - RNA, 17 nt, Shigella flexneri 2a str. 301
cgccauugccauaagcg

SEQ ID NO: 1959175 - RNA, 16 nt, Shigella flexneri 2a str. 301
cgccgagcgccagcca

SEQ ID NO: 1959176 - RNA, 16 nt, Shigella flexneri 2a str. 301
cgcccuuucagcgccu

SEQ ID NO: 1959177 - RNA, 14 nt, Shigella flexneri 2a str. 301
cgccgaaaccgcgc

SEQ ID NO: 1959178 - RNA, 14 nt, Shigella flexneri 2a str. 301
cgccgcagccggaa

SEQ ID NO: 1959179 - RNA, 17 nt, Shigella flexneri 2a str. 301
cgccgcccugcagcauc

SEQ ID NO: 1959180 - RNA, 19 nt, Shigella flexneri 2a str. 301
cgcgaagcuggucagcauc

SEQ ID NO: 1959181 - RNA, 12 nt, Shigella flexneri 2a str. 301
cgccuucugcgc

SEQ ID NO: 1959182 - RNA, 17 nt, Shigella flexneri 2a str. 301
cgccugguaccagcacc

SEQ ID NO: 1959183 - RNA, 14 nt, Shigella flexneri 2a str. 301
cgccuggugaccgc

SEQ ID NO: 1959184 - RNA, 15 nt, Shigella flexneri 2a str. 301
cgccugggaaguuaa

SEQ ID NO: 1959185 - RNA, 18 nt, Shigella flexneri 2a str. 301
cgccugcggccagcagcu

SEQ ID NO: 1959186 - RNA, 17 nt, Shigella flexneri 2a str. 301
cgccugcggccagcagc

SEQ ID NO: 1959187 - RNA, 11 nt, Shigella flexneri 2a str. 301
cgccuggcagu

SEQ ID NO: 1959188 - RNA, 18 nt, Shigella flexneri 2a str. 301
cgccuuacgcugcggucg

SEQ ID NO: 1959189 - RNA, 14 nt, Shigella flexneri 2a str. 301
cgccuuauccggcc

SEQ ID NO: 1959190 - RNA, 20 nt, Shigella flexneri 2a str. 301
cgccuuauccgcccuacgcg

SEQ ID NO: 1959191 - RNA, 13 nt, Shigella flexneri 2a str. 301
cgccuguuaauca

SEQ ID NO: 1959192 - RNA, 14 nt, Shigella flexneri 2a str. 301
cgccuuauccggcu

SEQ ID NO: 1959193 - RNA, 13 nt, Shigella flexneri 2a str. 301
cgccuucauucag

SEQ ID NO: 1959194 - RNA, 15 nt, Shigella flexneri 2a str. 301
cgccugauucaauga

SEQ ID NO: 1959195 - RNA, 18 nt, Shigella flexneri 2a str. 301
cgccugaucuuccgcguc

SEQ ID NO: 1959196 - RNA, 20 nt, Shigella flexneri 2a str. 301
cgccugcaccauugcugccg

SEQ ID NO: 1959197 - RNA, 19 nt, Shigella flexneri 2a str. 301
cgccugcauccgccaucca

SEQ ID NO: 1959198 - RNA, 20 nt, Shigella flexneri 2a str. 301
cgccguuuuuacccagcagc

SEQ ID NO: 1959199 - RNA, 21 nt, Shigella flexneri 2a str. 301
cgccgcguuuaucgacagacg

SEQ ID NO: 1959200 - RNA, 15 nt, Shigella flexneri 2a str. 301
cgccgcguguucacg

SEQ ID NO: 1959201 - RNA, 18 nt, Shigella flexneri 2a str. 301
cgccgcuaacaucgucgg

SEQ ID NO: 1959202 - RNA, 16 nt, Shigella flexneri 2a str. 301
cgccgcuuucgucugg

SEQ ID NO: 1959203 - RNA, 18 nt, Shigella flexneri 2a str. 301
cgccggaaauaucaaccg

SEQ ID NO: 1959204 - RNA, 13 nt, Shigella flexneri 2a str. 301
cggcgagccagcg

SEQ ID NO: 1959205 - RNA, 13 nt, Shigella flexneri 2a str. 301
cggcgaguauucu

SEQ ID NO: 1959206 - RNA, 14 nt, Shigella flexneri 2a str. 301
cggcgaacuuaauc

SEQ ID NO: 1959207 - RNA, 19 nt, Shigella flexneri 2a str. 301
cggccuacaaaaucgugca

SEQ ID NO: 1959208 - RNA, 18 nt, Shigella flexneri 2a str. 301
cggccaguaaccuuucag

SEQ ID NO: 1959209 - RNA, 15 nt, Shigella flexneri 2a str. 301
cggccagguuaacca

SEQ ID NO: 1959210 - RNA, 15 nt, Shigella flexneri 2a str. 301
cggccacgcauaacg

SEQ ID NO: 1959211 - RNA, 16 nt, Shigella flexneri 2a str. 301
cggcauccauucguuc

SEQ ID NO: 1959212 - RNA, 14 nt, Shigella flexneri 2a str. 301
cggcauuuccgcca

SEQ ID NO: 1959213 - RNA, 17 nt, Shigella flexneri 2a str. 301
cggcauuuauggugcua

SEQ ID NO: 1959214 - RNA, 14 nt, Shigella flexneri 2a str. 301
cggcauucugcugg

SEQ ID NO: 1959215 - RNA, 15 nt, Shigella flexneri 2a str. 301
cggcauuuuucggcg

SEQ ID NO: 1959216 - RNA, 23 nt, Shigella flexneri 2a str. 301
cggcagcgucggaagcgagguau

SEQ ID NO: 1959217 - RNA, 14 nt, Shigella flexneri 2a str. 301
cggcagcuccagca

SEQ ID NO: 1959218 - RNA, 13 nt, Shigella flexneri 2a str. 301
cggcauaaacgcu

SEQ ID NO: 1959219 - RNA, 14 nt, Shigella flexneri 2a str. 301
cggcagucugcuga

SEQ ID NO: 1959220 - RNA, 22 nt, Shigella flexneri 2a str. 301
cggcauacuuugauuaaccguu

SEQ ID NO: 1959221 - RNA, 11 nt, Shigella flexneri 2a str. 301
cggcauaauca

SEQ ID NO: 1959222 - RNA, 18 nt, Shigella flexneri 2a str. 301
cggcaucagaaacacacu

SEQ ID NO: 1959223 - RNA, 20 nt, Shigella flexneri 2a str. 301
cggcagccugggucgccauc

SEQ ID NO: 1959224 - RNA, 18 nt, Shigella flexneri 2a str. 301
cggcacuauuauauucug

SEQ ID NO: 1959225 - RNA, 15 nt, Shigella flexneri 2a str. 301
cggcaaucggugcaa

SEQ ID NO: 1959226 - RNA, 21 nt, Shigella flexneri 2a str. 301
cggcaaugaauauuccacagc

SEQ ID NO: 1959227 - RNA, 15 nt, Shigella flexneri 2a str. 301
cggcaaugaaagcga

SEQ ID NO: 1959228 - RNA, 18 nt, Shigella flexneri 2a str. 301
cggcaaugcguuccagca

SEQ ID NO: 1959229 - RNA, 13 nt, Shigella flexneri 2a str. 301
cggcaaucgccag

SEQ ID NO: 1959230 - RNA, 14 nt, Shigella flexneri 2a str. 301
cggcaauauucuuu

SEQ ID NO: 1959231 - RNA, 15 nt, Shigella flexneri 2a str. 301
cggcaccagcgcaga

SEQ ID NO: 1959232 - RNA, 21 nt, Shigella flexneri 2a str. 301
cggcacccauuuauccagcgg

SEQ ID NO: 1959233 - RNA, 17 nt, Shigella flexneri 2a str. 301
cggaugcgaugcuggcg

SEQ ID NO: 1959234 - RNA, 19 nt, Shigella flexneri 2a str. 301
cggaugcgaugcuggcgca

SEQ ID NO: 1959235 - RNA, 14 nt, Shigella flexneri 2a str. 301
cggaugcgccguca

SEQ ID NO: 1959236 - RNA, 15 nt, Shigella flexneri 2a str. 301
cggaugcgccagcau

SEQ ID NO: 1959237 - RNA, 22 nt, Shigella flexneri 2a str. 301
cggaugcggcgugaacgccuua

SEQ ID NO: 1959238 - RNA, 20 nt, Shigella flexneri 2a str. 301
cggcaaguguuggcgacauc

SEQ ID NO: 1959239 - RNA, 23 nt, Shigella flexneri 2a str. 301
cggcaaguaauaauaucuccagc

SEQ ID NO: 1959240 - RNA, 21 nt, Shigella flexneri 2a str. 301
cggagcagcagucaggcgcgc

SEQ ID NO: 1959241 - RNA, 13 nt, Shigella flexneri 2a str. 301
cggagcaaugauc

SEQ ID NO: 1959242 - RNA, 23 nt, Shigella flexneri 2a str. 301
cggagacaaacagggugcagcga

SEQ ID NO: 1959243 - RNA, 17 nt, Shigella flexneri 2a str. 301
cggaucgguagaccgga

SEQ ID NO: 1959244 - RNA, 17 nt, Shigella flexneri 2a str. 301
cggaucgguggcgcggu

SEQ ID NO: 1959245 - RNA, 16 nt, Shigella flexneri 2a str. 301
cggauccugagcaaac

SEQ ID NO: 1959246 - RNA, 14 nt, Shigella flexneri 2a str. 301
cggauaagacgcga

SEQ ID NO: 1959247 - RNA, 20 nt, Shigella flexneri 2a str. 301
cgcuggugacaucgccagag

SEQ ID NO: 1959248 - RNA, 20 nt, Shigella flexneri 2a str. 301
cgcuguacgguaauggcaaa

SEQ ID NO: 1959249 - RNA, 15 nt, Shigella flexneri 2a str. 301
cggacaaccagcuuc

SEQ ID NO: 1959250 - RNA, 22 nt, Shigella flexneri 2a str. 301
cggaauugccgguacagccgga

SEQ ID NO: 1959251 - RNA, 16 nt, Shigella flexneri 2a str. 301
cggaauucccgcuucu

SEQ ID NO: 1959252 - RNA, 24 nt, Shigella flexneri 2a str. 301
cggaaugggcuguucaccacugaa

SEQ ID NO: 1959253 - RNA, 15 nt, Shigella flexneri 2a str. 301
cggaauggugcuggu

SEQ ID NO: 1959254 - RNA, 14 nt, Shigella flexneri 2a str. 301
cggacagaccugcg

SEQ ID NO: 1959255 - RNA, 23 nt, Shigella flexneri 2a str. 301
cggacagagauucgguaaccauc

SEQ ID NO: 1959256 - RNA, 21 nt, Shigella flexneri 2a str. 301
cggacaugaaccgugucgcca

SEQ ID NO: 1959257 - RNA, 15 nt, Shigella flexneri 2a str. 301
cggacggacuuccag

SEQ ID NO: 1959258 - RNA, 18 nt, Shigella flexneri 2a str. 301
cggacggacuuccagcgg

SEQ ID NO: 1959259 - RNA, 16 nt, Shigella flexneri 2a str. 301
cggacgcguuucauuc

SEQ ID NO: 1959260 - RNA, 18 nt, Shigella flexneri 2a str. 301
cggacgcuaacccgcguc

SEQ ID NO: 1959261 - RNA, 19 nt, Shigella flexneri 2a str. 301
cggaccccacgcucucgca

SEQ ID NO: 1959262 - RNA, 14 nt, Shigella flexneri 2a str. 301
cggaccccacgcuc

SEQ ID NO: 1959263 - RNA, 21 nt, Shigella flexneri 2a str. 301
cggaccugucggggccagcgc

SEQ ID NO: 1959264 - RNA, 13 nt, Shigella flexneri 2a str. 301
cggcugcccauca

SEQ ID NO: 1959265 - RNA, 21 nt, Shigella flexneri 2a str. 301
cggcugcuucggucagcacgc

SEQ ID NO: 1959266 - RNA, 18 nt, Shigella flexneri 2a str. 301
cggcugcagugcaaugac

SEQ ID NO: 1959267 - RNA, 20 nt, Shigella flexneri 2a str. 301
cggcucguuacuuuccuuca

SEQ ID NO: 1959268 - RNA, 20 nt, Shigella flexneri 2a str. 301
cggcuuagcaaggcuggcgu

SEQ ID NO: 1959269 - RNA, 17 nt, Shigella flexneri 2a str. 301
cggcuguuucuggauga

SEQ ID NO: 1959270 - RNA, 15 nt, Shigella flexneri 2a str. 301
cggcuguugccggau

SEQ ID NO: 1959271 - RNA, 19 nt, Shigella flexneri 2a str. 301
cggcuguuggugccagaua

SEQ ID NO: 1959272 - RNA, 16 nt, Shigella flexneri 2a str. 301
cggcuguccggcacca

SEQ ID NO: 1959273 - RNA, 23 nt, Shigella flexneri 2a str. 301
cggcugggaaaucaccaccagca

SEQ ID NO: 1959274 - RNA, 15 nt, Shigella flexneri 2a str. 301
cggcugggaaaucac

SEQ ID NO: 1959275 - RNA, 14 nt, Shigella flexneri 2a str. 301
cggcuggcugaccg

SEQ ID NO: 1959276 - RNA, 14 nt, Shigella flexneri 2a str. 301
cggcuggcugaccu

SEQ ID NO: 1959277 - RNA, 23 nt, Shigella flexneri 2a str. 301
cggcuuuguuacccccauccacg

SEQ ID NO: 1959278 - RNA, 17 nt, Shigella flexneri 2a str. 301
cggcuuuuagcugguga

SEQ ID NO: 1959279 - RNA, 23 nt, Shigella flexneri 2a str. 301
cggcuuuggcaaauggcgcuaac

SEQ ID NO: 1959280 - RNA, 17 nt, Shigella flexneri 2a str. 301
cggcuuugcagguucug

SEQ ID NO: 1959281 - RNA, 16 nt, Shigella flexneri 2a str. 301
cggcuuuuuuacgccu

SEQ ID NO: 1959282 - RNA, 19 nt, Shigella flexneri 2a str. 301
cgggaaaccaacuccagcg

SEQ ID NO: 1959283 - RNA, 23 nt, Shigella flexneri 2a str. 301
cgggaaacgaaccauaaaaucac

SEQ ID NO: 1959284 - RNA, 16 nt, Shigella flexneri 2a str. 301
cggcguccaccugcgu

SEQ ID NO: 1959285 - RNA, 16 nt, Shigella flexneri 2a str. 301
cggcguuucacuucug

SEQ ID NO: 1959286 - RNA, 19 nt, Shigella flexneri 2a str. 301
cggcguuucacauucgccg

SEQ ID NO: 1959287 - RNA, 22 nt, Shigella flexneri 2a str. 301
cggcguuuucaaccagccgacg

SEQ ID NO: 1959288 - RNA, 22 nt, Shigella flexneri 2a str. 301
cggcguuuuucguuuuggcaga

SEQ ID NO: 1959289 - RNA, 11 nt, Shigella flexneri 2a str. 301
cggcuccagca

SEQ ID NO: 1959290 - RNA, 17 nt, Shigella flexneri 2a str. 301
cggcgugauuggcauca

SEQ ID NO: 1959291 - RNA, 13 nt, Shigella flexneri 2a str. 301
cggcggcacagcg

SEQ ID NO: 1959292 - RNA, 21 nt, Shigella flexneri 2a str. 301
cggcggcaguugcccgguuuc

SEQ ID NO: 1959293 - RNA, 13 nt, Shigella flexneri 2a str. 301
cggcgcuuucagc

SEQ ID NO: 1959294 - RNA, 23 nt, Shigella flexneri 2a str. 301
cggcgcugcaauuggucgcgcaa

SEQ ID NO: 1959295 - RNA, 18 nt, Shigella flexneri 2a str. 301
cggcgcuaauucaacgcc

SEQ ID NO: 1959296 - RNA, 18 nt, Shigella flexneri 2a str. 301
cggggcuaccgccagacc

SEQ ID NO: 1959297 - RNA, 23 nt, Shigella flexneri 2a str. 301
cgggguaaauccacguuccugga

SEQ ID NO: 1959298 - RNA, 20 nt, Shigella flexneri 2a str. 301
cggguaaauaauauccccag

SEQ ID NO: 1959299 - RNA, 14 nt, Shigella flexneri 2a str. 301
cggguaaccagcca

SEQ ID NO: 1959300 - RNA, 20 nt, Shigella flexneri 2a str. 301
cggguaacggaccgcauuca

SEQ ID NO: 1959301 - RNA, 13 nt, Shigella flexneri 2a str. 301
cggguauucaucc

SEQ ID NO: 1959302 - RNA, 20 nt, Shigella flexneri 2a str. 301
cgggucaguccccacgccau

SEQ ID NO: 1959303 - RNA, 16 nt, Shigella flexneri 2a str. 301
cggguuggagcgcguc

SEQ ID NO: 1959304 - RNA, 13 nt, Shigella flexneri 2a str. 301
cgguacuucucac

SEQ ID NO: 1959305 - RNA, 17 nt, Shigella flexneri 2a str. 301
cggguggcucucgccag

SEQ ID NO: 1959306 - RNA, 20 nt, Shigella flexneri 2a str. 301
cggguggcucucgccagcac

SEQ ID NO: 1959307 - RNA, 22 nt, Shigella flexneri 2a str. 301
cgguagcacgucaucugcacgg

SEQ ID NO: 1959308 - RNA, 22 nt, Shigella flexneri 2a str. 301
cgguagcagcuuucagcagcgg

SEQ ID NO: 1959309 - RNA, 17 nt, Shigella flexneri 2a str. 301
cgguaguuucagcggcg

SEQ ID NO: 1959310 - RNA, 15 nt, Shigella flexneri 2a str. 301
cgguaguuucagcgg

SEQ ID NO: 1959311 - RNA, 18 nt, Shigella flexneri 2a str. 301
cgguaguuaaacuuucau

SEQ ID NO: 1959312 - RNA, 19 nt, Shigella flexneri 2a str. 301
cgguaucaccacccagcgg

SEQ ID NO: 1959313 - RNA, 21 nt, Shigella flexneri 2a str. 301
cgguaucaccacccagcggua

SEQ ID NO: 1959314 - RNA, 19 nt, Shigella flexneri 2a str. 301
cggucacgcccggaauuuc

SEQ ID NO: 1959315 - RNA, 16 nt, Shigella flexneri 2a str. 301
cggucaaccaucgcau

SEQ ID NO: 1959316 - RNA, 19 nt, Shigella flexneri 2a str. 301
cggucacauguuccagggc

SEQ ID NO: 1959317 - RNA, 19 nt, Shigella flexneri 2a str. 301
cgggcaugauagcccggau

SEQ ID NO: 1959318 - RNA, 16 nt, Shigella flexneri 2a str. 301
cgggcaucaucuuccg

SEQ ID NO: 1959319 - RNA, 17 nt, Shigella flexneri 2a str. 301
cgggcgaaguucgccau

SEQ ID NO: 1959320 - RNA, 15 nt, Shigella flexneri 2a str. 301
cgggcgaacuggcgu

SEQ ID NO: 1959321 - RNA, 20 nt, Shigella flexneri 2a str. 301
cgggcguagugcccgcagua

SEQ ID NO: 1959322 - RNA, 15 nt, Shigella flexneri 2a str. 301
cgggcgugcugccgu

SEQ ID NO: 1959323 - RNA, 13 nt, Shigella flexneri 2a str. 301
gaggaagcgcagc

SEQ ID NO: 1959324 - RNA, 14 nt, Shigella flexneri 2a str. 301
gaggauucgaaccu

SEQ ID NO: 1959325 - RNA, 21 nt, Shigella flexneri 2a str. 301
gagcuugugcaccagcuggcu

SEQ ID NO: 1959326 - RNA, 17 nt, Shigella flexneri 2a str. 301
gaguaugcgcgucagag

SEQ ID NO: 1959327 - RNA, 19 nt, Shigella flexneri 2a str. 301
gagucacucgacagcaccg

SEQ ID NO: 1959328 - RNA, 12 nt, Shigella flexneri 2a str. 301
gaguaccagcgc

SEQ ID NO: 1959329 - RNA, 16 nt, Shigella flexneri 2a str. 301
gagguacgcuccagca

SEQ ID NO: 1959330 - RNA, 14 nt, Shigella flexneri 2a str. 301
gagggaauccagca

SEQ ID NO: 1959331 - RNA, 15 nt, Shigella flexneri 2a str. 301
gauaaccgcaccuuc

SEQ ID NO: 1959332 - RNA, 20 nt, Shigella flexneri 2a str. 301
gauaacggugcaacccgcca

SEQ ID NO: 1959333 - RNA, 16 nt, Shigella flexneri 2a str. 301
gaguccuuccagguca

SEQ ID NO: 1959334 - RNA, 20 nt, Shigella flexneri 2a str. 301
gauaauggcuguugaaugcc

SEQ ID NO: 1959335 - RNA, 20 nt, Shigella flexneri 2a str. 301
gauaaugguuuccagcaucg

SEQ ID NO: 1959336 - RNA, 16 nt, Shigella flexneri 2a str. 301
gauaaucaacgcgccg

SEQ ID NO: 1959337 - RNA, 23 nt, Shigella flexneri 2a str. 301
gauaauauugaugcacaccaucg

SEQ ID NO: 1959338 - RNA, 16 nt, Shigella flexneri 2a str. 301
gauaauagcguuucag

SEQ ID NO: 1959339 - RNA, 13 nt, Shigella flexneri 2a str. 301
gauaagcaacgcg

SEQ ID NO: 1959340 - RNA, 18 nt, Shigella flexneri 2a str. 301
gauaucccgccagcacca

SEQ ID NO: 1959341 - RNA, 13 nt, Shigella flexneri 2a str. 301
gauauccgccagg

SEQ ID NO: 1959342 - RNA, 19 nt, Shigella flexneri 2a str. 301
gauauccgccaggcugcga

SEQ ID NO: 1959343 - RNA, 14 nt, Shigella flexneri 2a str. 301
gauaggcaccgcca

SEQ ID NO: 1959344 - RNA, 18 nt, Shigella flexneri 2a str. 301
gauacuacguucaaucac

SEQ ID NO: 1959345 - RNA, 18 nt, Shigella flexneri 2a str. 301
gauagcucgggcgauaau

SEQ ID NO: 1959346 - RNA, 15 nt, Shigella flexneri 2a str. 301
gauaggcaucagcaa

SEQ ID NO: 1959347 - RNA, 14 nt, Shigella flexneri 2a str. 301
gauacguugccgua

SEQ ID NO: 1959348 - RNA, 20 nt, Shigella flexneri 2a str. 301
gauagcguucggcaacgucg

SEQ ID NO: 1959349 - RNA, 14 nt, Shigella flexneri 2a str. 301
gauacucgcaguca

SEQ ID NO: 1959350 - RNA, 21 nt, Shigella flexneri 2a str. 301
gauaauuaugccgaucaucau

SEQ ID NO: 1959351 - RNA, 20 nt, Shigella flexneri 2a str. 301
gauacgcugcacaauugcca

SEQ ID NO: 1959352 - RNA, 23 nt, Shigella flexneri 2a str. 301
gaucaccaguccaucggcauuaa

SEQ ID NO: 1959353 - RNA, 13 nt, Shigella flexneri 2a str. 301
gaucaaucggcgc

SEQ ID NO: 1959354 - RNA, 16 nt, Shigella flexneri 2a str. 301
gauaucggaggccugu

SEQ ID NO: 1959355 - RNA, 23 nt, Shigella flexneri 2a str. 301
gauaucuacaaaaccacacuucu

SEQ ID NO: 1959356 - RNA, 22 nt, Shigella flexneri 2a str. 301
gauauuguuuagcuucugcgug

SEQ ID NO: 1959357 - RNA, 17 nt, Shigella flexneri 2a str. 301
gaucaaaucucgccgug

SEQ ID NO: 1959358 - RNA, 20 nt, Shigella flexneri 2a str. 301
gauauuuagccagcaacuga

SEQ ID NO: 1959359 - RNA, 18 nt, Shigella flexneri 2a str. 301
gagcaugguaacgcccca

SEQ ID NO: 1959360 - RNA, 14 nt, Shigella flexneri 2a str. 301
gagcauugccgccc

SEQ ID NO: 1959361 - RNA, 19 nt, Shigella flexneri 2a str. 301
gagcaguacagccgccaga

SEQ ID NO: 1959362 - RNA, 12 nt, Shigella flexneri 2a str. 301
gagccagucagu

SEQ ID NO: 1959363 - RNA, 14 nt, Shigella flexneri 2a str. 301
gagcagcauuaccu

SEQ ID NO: 1959364 - RNA, 17 nt, Shigella flexneri 2a str. 301
gagcaggagcagcaggu

SEQ ID NO: 1959365 - RNA, 12 nt, Shigella flexneri 2a str. 301
gagccgcaguaa

SEQ ID NO: 1959366 - RNA, 22 nt, Shigella flexneri 2a str. 301
gagcugauacgggaggucauca

SEQ ID NO: 1959367 - RNA, 17 nt, Shigella flexneri 2a str. 301
gagcuaaagggccuuaa

SEQ ID NO: 1959368 - RNA, 22 nt, Shigella flexneri 2a str. 301
gagcgguuuuuuuaauuacugc

SEQ ID NO: 1959369 - RNA, 13 nt, Shigella flexneri 2a str. 301
gagcgguuaacac

SEQ ID NO: 1959370 - RNA, 20 nt, Shigella flexneri 2a str. 301
gagcggcaaugaauauucca

SEQ ID NO: 1959371 - RNA, 22 nt, Shigella flexneri 2a str. 301
gagcgcuuuuuuccugccgcua

SEQ ID NO: 1959372 - RNA, 18 nt, Shigella flexneri 2a str. 301
gagcgauaacccagcgca

SEQ ID NO: 1959373 - RNA, 17 nt, Shigella flexneri 2a str. 301
gagcgccccagaccuga

SEQ ID NO: 1959374 - RNA, 16 nt, Shigella flexneri 2a str. 301
gagcgccagccauuca

SEQ ID NO: 1959375 - RNA, 14 nt, Shigella flexneri 2a str. 301
gaugagggcgcuaa

SEQ ID NO: 1959376 - RNA, 19 nt, Shigella flexneri 2a str. 301
gaugauaguuuucuaugcg

SEQ ID NO: 1959377 - RNA, 21 nt, Shigella flexneri 2a str. 301
gaugauaguuuucuaugcgcu

SEQ ID NO: 1959378 - RNA, 22 nt, Shigella flexneri 2a str. 301
gaugaucaagcgcacaauggcg

SEQ ID NO: 1959379 - RNA, 17 nt, Shigella flexneri 2a str. 301
gaugacgccacuggcug

SEQ ID NO: 1959380 - RNA, 17 nt, Shigella flexneri 2a str. 301
gaugcaggcccagcggu

SEQ ID NO: 1959381 - RNA, 13 nt, Shigella flexneri 2a str. 301
gaugcacagcacg

SEQ ID NO: 1959382 - RNA, 14 nt, Shigella flexneri 2a str. 301
gaugcacagaaccg

SEQ ID NO: 1959383 - RNA, 21 nt, Shigella flexneri 2a str. 301
gaugaucgcggcauuaccggc

SEQ ID NO: 1959384 - RNA, 17 nt, Shigella flexneri 2a str. 301
gaucuuuaucaaucacc

SEQ ID NO: 1959385 - RNA, 14 nt, Shigella flexneri 2a str. 301
gaucuuucugugca

SEQ ID NO: 1959386 - RNA, 17 nt, Shigella flexneri 2a str. 301
gaucuuugccagaucgc

SEQ ID NO: 1959387 - RNA, 20 nt, Shigella flexneri 2a str. 301
gaucucaagacaauuagugg

SEQ ID NO: 1959388 - RNA, 13 nt, Shigella flexneri 2a str. 301
gaucguguggcgg

SEQ ID NO: 1959389 - RNA, 14 nt, Shigella flexneri 2a str. 301
gaucgugagcguau

SEQ ID NO: 1959390 - RNA, 22 nt, Shigella flexneri 2a str. 301
gaucguggccaugaccgccgca

SEQ ID NO: 1959391 - RNA, 17 nt, Shigella flexneri 2a str. 301
gaucgugcgcgccguga

SEQ ID NO: 1959392 - RNA, 17 nt, Shigella flexneri 2a str. 301
gaucgcggcauuaccgg

SEQ ID NO: 1959393 - RNA, 19 nt, Shigella flexneri 2a str. 301
gaucgcgccaaucagcgca

SEQ ID NO: 1959394 - RNA, 21 nt, Shigella flexneri 2a str. 301
gaucgcgccagaaagcagcau

SEQ ID NO: 1959395 - RNA, 13 nt, Shigella flexneri 2a str. 301
gaucgcgcaguaa

SEQ ID NO: 1959396 - RNA, 14 nt, Shigella flexneri 2a str. 301
gaucgcgaucgcca

SEQ ID NO: 1959397 - RNA, 18 nt, Shigella flexneri 2a str. 301
gaucggacuucaugcgca

SEQ ID NO: 1959398 - RNA, 11 nt, Shigella flexneri 2a str. 301
gaucgcucauc

SEQ ID NO: 1959399 - RNA, 18 nt, Shigella flexneri 2a str. 301
gaucgagcgcgagcaggc

SEQ ID NO: 1959400 - RNA, 19 nt, Shigella flexneri 2a str. 301
gaucaccgaaccagggcga

SEQ ID NO: 1959401 - RNA, 16 nt, Shigella flexneri 2a str. 301
gauccaguuacccagc

SEQ ID NO: 1959402 - RNA, 21 nt, Shigella flexneri 2a str. 301
gaucacguacacaacgcggca

SEQ ID NO: 1959403 - RNA, 21 nt, Shigella flexneri 2a str. 301
gauccgggcuaaucgucaucg

SEQ ID NO: 1959404 - RNA, 21 nt, Shigella flexneri 2a str. 301
gauccugcacuuucagcacgu

SEQ ID NO: 1959405 - RNA, 18 nt, Shigella flexneri 2a str. 301
gaugccaguauuaccggc

SEQ ID NO: 1959406 - RNA, 14 nt, Shigella flexneri 2a str. 301
gaugccaacuggca

SEQ ID NO: 1959407 - RNA, 16 nt, Shigella flexneri 2a str. 301
gaugcgccagcauccg

SEQ ID NO: 1959408 - RNA, 21 nt, Shigella flexneri 2a str. 301
gaugccgggacgaucggcgag

SEQ ID NO: 1959409 - RNA, 17 nt, Shigella flexneri 2a str. 301
gaugcgcuacgcuuauc

SEQ ID NO: 1959410 - RNA, 19 nt, Shigella flexneri 2a str. 301
gaugcgggugaacgcguua

SEQ ID NO: 1959411 - RNA, 22 nt, Shigella flexneri 2a str. 301
gaugcggugcaagcaccuuauc

SEQ ID NO: 1959412 - RNA, 20 nt, Shigella flexneri 2a str. 301
gcaaaaacuuccauguguuu

SEQ ID NO: 1959413 - RNA, 17 nt, Shigella flexneri 2a str. 301
gauuuuguaggccggau

SEQ ID NO: 1959414 - RNA, 18 nt, Shigella flexneri 2a str. 301
gcaaaaucccacugccaa

SEQ ID NO: 1959415 - RNA, 20 nt, Shigella flexneri 2a str. 301
gauuugugcacgugccagau

SEQ ID NO: 1959416 - RNA, 20 nt, Shigella flexneri 2a str. 301
gauuugguucggucacggcg

SEQ ID NO: 1959417 - RNA, 19 nt, Shigella flexneri 2a str. 301
gauuuuaauaaaucacgcu

SEQ ID NO: 1959418 - RNA, 23 nt, Shigella flexneri 2a str. 301
gauuuugccagcaugacuaccgg

SEQ ID NO: 1959419 - RNA, 14 nt, Shigella flexneri 2a str. 301
gauucccagucauc

SEQ ID NO: 1959420 - RNA, 22 nt, Shigella flexneri 2a str. 301
gauugcaacaagaggcaauagu

SEQ ID NO: 1959421 - RNA, 18 nt, Shigella flexneri 2a str. 301
gauugagcuuuaucccuu

SEQ ID NO: 1959422 - RNA, 24 nt, Shigella flexneri 2a str. 301
gauugcccuguuugucgaucauca

SEQ ID NO: 1959423 - RNA, 16 nt, Shigella flexneri 2a str. 301
gauugcuucaguugcc

SEQ ID NO: 1959424 - RNA, 17 nt, Shigella flexneri 2a str. 301
gauugccuuccaccaga

SEQ ID NO: 1959425 - RNA, 15 nt, Shigella flexneri 2a str. 301
gaugugauccaucag

SEQ ID NO: 1959426 - RNA, 21 nt, Shigella flexneri 2a str. 301
gaugucggggccagaacaaac

SEQ ID NO: 1959427 - RNA, 19 nt, Shigella flexneri 2a str. 301
gaugucgagguacgcucca

SEQ ID NO: 1959428 - RNA, 22 nt, Shigella flexneri 2a str. 301
gaugucagcacuuccagcuccg

SEQ ID NO: 1959429 - RNA, 23 nt, Shigella flexneri 2a str. 301
gaugguguuggcaaucagcggca

SEQ ID NO: 1959430 - RNA, 13 nt, Shigella flexneri 2a str. 301
gcagccagcgcgc

SEQ ID NO: 1959431 - RNA, 12 nt, Shigella flexneri 2a str. 301
gcagccagcguu

SEQ ID NO: 1959432 - RNA, 16 nt, Shigella flexneri 2a str. 301
gcagcgccagcgaagc

SEQ ID NO: 1959433 - RNA, 17 nt, Shigella flexneri 2a str. 301
gcagcgccgcguacgcc

SEQ ID NO: 1959434 - RNA, 13 nt, Shigella flexneri 2a str. 301
gcagcucaucaac

SEQ ID NO: 1959435 - RNA, 12 nt, Shigella flexneri 2a str. 301
gcagcuccagcc

SEQ ID NO: 1959436 - RNA, 21 nt, Shigella flexneri 2a str. 301
gcagcguuucgaacaggccga

SEQ ID NO: 1959437 - RNA, 18 nt, Shigella flexneri 2a str. 301
gcagcugcgcuucaauac

SEQ ID NO: 1959438 - RNA, 13 nt, Shigella flexneri 2a str. 301
gcagcucugcgcc

SEQ ID NO: 1959439 - RNA, 16 nt, Shigella flexneri 2a str. 301
gcagcgucagcaccag

SEQ ID NO: 1959440 - RNA, 15 nt, Shigella flexneri 2a str. 301
gcagcgucagcacca

SEQ ID NO: 1959441 - RNA, 20 nt, Shigella flexneri 2a str. 301
gcagcgucgcaucaggcauu

SEQ ID NO: 1959442 - RNA, 22 nt, Shigella flexneri 2a str. 301
gcagcguggugcugauacgcgc

SEQ ID NO: 1959443 - RNA, 19 nt, Shigella flexneri 2a str. 301
gcagcaggugcgccagcga

SEQ ID NO: 1959444 - RNA, 13 nt, Shigella flexneri 2a str. 301
gcagcaguugcca

SEQ ID NO: 1959445 - RNA, 20 nt, Shigella flexneri 2a str. 301
gcagcacuacaccccagcgu

SEQ ID NO: 1959446 - RNA, 14 nt, Shigella flexneri 2a str. 301
gcagcacugauaau

SEQ ID NO: 1959447 - RNA, 13 nt, Shigella flexneri 2a str. 301
gcagcaucgucau

SEQ ID NO: 1959448 - RNA, 22 nt, Shigella flexneri 2a str. 301
gcagagccugaauaaacgccau

SEQ ID NO: 1959449 - RNA, 16 nt, Shigella flexneri 2a str. 301
gcagauauugcacccc

SEQ ID NO: 1959450 - RNA, 15 nt, Shigella flexneri 2a str. 301
gcagcaauugucgca

SEQ ID NO: 1959451 - RNA, 15 nt, Shigella flexneri 2a str. 301
gcagaugaaaacgcu

SEQ ID NO: 1959452 - RNA, 17 nt, Shigella flexneri 2a str. 301
gcagaugacuugccgca

SEQ ID NO: 1959453 - RNA, 21 nt, Shigella flexneri 2a str. 301
gcaggauuucuucaccagccu

SEQ ID NO: 1959454 - RNA, 20 nt, Shigella flexneri 2a str. 301
gcaggagcgguguaggccug

SEQ ID NO: 1959455 - RNA, 21 nt, Shigella flexneri 2a str. 301
gcaggagcgguguaggccuga

SEQ ID NO: 1959456 - RNA, 21 nt, Shigella flexneri 2a str. 301
gcaggaaucacguaggccuga

SEQ ID NO: 1959457 - RNA, 20 nt, Shigella flexneri 2a str. 301
gcaggaaaacaauguucauc

SEQ ID NO: 1959458 - RNA, 19 nt, Shigella flexneri 2a str. 301
gcaggaaaagguaggccug

SEQ ID NO: 1959459 - RNA, 20 nt, Shigella flexneri 2a str. 301
gcaggaaauacguaggccug

SEQ ID NO: 1959460 - RNA, 22 nt, Shigella flexneri 2a str. 301
gcaggaacugcucauaaacgcg

SEQ ID NO: 1959461 - RNA, 22 nt, Shigella flexneri 2a str. 301
gcaggaacagugccucgcuaau

SEQ ID NO: 1959462 - RNA, 20 nt, Shigella flexneri 2a str. 301
gcagcuucucgugaaacuca

SEQ ID NO: 1959463 - RNA, 16 nt, Shigella flexneri 2a str. 301
gcaggcggcuggcauc

SEQ ID NO: 1959464 - RNA, 23 nt, Shigella flexneri 2a str. 301
gcaggcuguuaccccugcggccg

SEQ ID NO: 1959465 - RNA, 22 nt, Shigella flexneri 2a str. 301
gcaggcuucaacacaggccggc

SEQ ID NO: 1959466 - RNA, 21 nt, Shigella flexneri 2a str. 301
gcagggcaaacagacuggcaa

SEQ ID NO: 1959467 - RNA, 14 nt, Shigella flexneri 2a str. 301
gcaggcgcaauggc

SEQ ID NO: 1959468 - RNA, 19 nt, Shigella flexneri 2a str. 301
gcaggcggauugcuucugc

SEQ ID NO: 1959469 - RNA, 20 nt, Shigella flexneri 2a str. 301
gcaggccugauaagcgcagc

SEQ ID NO: 1959470 - RNA, 12 nt, Shigella flexneri 2a str. 301
gcaucagauggg

SEQ ID NO: 1959471 - RNA, 13 nt, Shigella flexneri 2a str. 301
gcaucaggcaauu

SEQ ID NO: 1959472 - RNA, 19 nt, Shigella flexneri 2a str. 301
gcaucagcgauucauugag

SEQ ID NO: 1959473 - RNA, 14 nt, Shigella flexneri 2a str. 301
gcaucaggcaaugg

SEQ ID NO: 1959474 - RNA, 20 nt, Shigella flexneri 2a str. 301
gcauauccaccacccagcgc

SEQ ID NO: 1959475 - RNA, 16 nt, Shigella flexneri 2a str. 301
gcauaugacgaaagcg

SEQ ID NO: 1959476 - RNA, 13 nt, Shigella flexneri 2a str. 301
gcaguucacgcag

SEQ ID NO: 1959477 - RNA, 18 nt, Shigella flexneri 2a str. 301
gcaguucacagcgcagau

SEQ ID NO: 1959478 - RNA, 16 nt, Shigella flexneri 2a str. 301
gcauacaugcuuagca

SEQ ID NO: 1959479 - RNA, 18 nt, Shigella flexneri 2a str. 301
gcauaccggacgacggca

SEQ ID NO: 1959480 - RNA, 21 nt, Shigella flexneri 2a str. 301
gcauacagccaggugauacgu

SEQ ID NO: 1959481 - RNA, 14 nt, Shigella flexneri 2a str. 301
gcagucuucccagc

SEQ ID NO: 1959482 - RNA, 19 nt, Shigella flexneri 2a str. 301
gcagugaucgugugccacc

SEQ ID NO: 1959483 - RNA, 23 nt, Shigella flexneri 2a str. 301
gcaguguuuguuaaaacuuucca

SEQ ID NO: 1959484 - RNA, 15 nt, Shigella flexneri 2a str. 301
gcaguuaaacgccuu

SEQ ID NO: 1959485 - RNA, 19 nt, Shigella flexneri 2a str. 301
gcaguccagcgccugacgc

SEQ ID NO: 1959486 - RNA, 21 nt, Shigella flexneri 2a str. 301
gcaguccagcgccugacgcgg

SEQ ID NO: 1959487 - RNA, 15 nt, Shigella flexneri 2a str. 301
gcagucgcaacggcu

SEQ ID NO: 1959488 - RNA, 20 nt, Shigella flexneri 2a str. 301
gcaguagcgucgccagcagu

SEQ ID NO: 1959489 - RNA, 14 nt, Shigella flexneri 2a str. 301
gcaccagcaacaag

SEQ ID NO: 1959490 - RNA, 18 nt, Shigella flexneri 2a str. 301
gcaccacuuuacgggcaa

SEQ ID NO: 1959491 - RNA, 22 nt, Shigella flexneri 2a str. 301
gcaccagaaaguuuuucaacac

SEQ ID NO: 1959492 - RNA, 17 nt, Shigella flexneri 2a str. 301
gcaccaccgcauccggg

SEQ ID NO: 1959493 - RNA, 14 nt, Shigella flexneri 2a str. 301
gcaccaaagcguuu

SEQ ID NO: 1959494 - RNA, 20 nt, Shigella flexneri 2a str. 301
gcacauugcggacuuccggg

SEQ ID NO: 1959495 - RNA, 17 nt, Shigella flexneri 2a str. 301
gcacauccgcgucggca

SEQ ID NO: 1959496 - RNA, 19 nt, Shigella flexneri 2a str. 301
gcaccaaucaccgccagca

SEQ ID NO: 1959497 - RNA, 14 nt, Shigella flexneri 2a str. 301
gcaccaacaaauag

SEQ ID NO: 1959498 - RNA, 20 nt, Shigella flexneri 2a str. 301
gcaccaccaaaaacgccaug

SEQ ID NO: 1959499 - RNA, 23 nt, Shigella flexneri 2a str. 301
gcaccaggcaguuuauccagcca

SEQ ID NO: 1959500 - RNA, 13 nt, Shigella flexneri 2a str. 301
gcaccagcgcaga

SEQ ID NO: 1959501 - RNA, 18 nt, Shigella flexneri 2a str. 301
gcaccauugcugccgcca

SEQ ID NO: 1959502 - RNA, 21 nt, Shigella flexneri 2a str. 301
gcacauaaaauggccguaaua

SEQ ID NO: 1959503 - RNA, 23 nt, Shigella flexneri 2a str. 301
gcacaguagcccaccuacaccgg

SEQ ID NO: 1959504 - RNA, 12 nt, Shigella flexneri 2a str. 301
gcacaucagcca

SEQ ID NO: 1959505 - RNA, 19 nt, Shigella flexneri 2a str. 301
gcacaucauacgggucauu

SEQ ID NO: 1959506 - RNA, 14 nt, Shigella flexneri 2a str. 301
gcacagaaccggag

SEQ ID NO: 1959507 - RNA, 15 nt, Shigella flexneri 2a str. 301
gcaauaccuggcgca

SEQ ID NO: 1959508 - RNA, 14 nt, Shigella flexneri 2a str. 301
gcaauacguuucau

SEQ ID NO: 1959509 - RNA, 20 nt, Shigella flexneri 2a str. 301
gcaaucaaauaccaccagcg

SEQ ID NO: 1959510 - RNA, 16 nt, Shigella flexneri 2a str. 301
gcaauaucgcggcaca

SEQ ID NO: 1959511 - RNA, 14 nt, Shigella flexneri 2a str. 301
gcaauaucgcggca

SEQ ID NO: 1959512 - RNA, 13 nt, Shigella flexneri 2a str. 301
gcaauaugcgccg

SEQ ID NO: 1959513 - RNA, 15 nt, Shigella flexneri 2a str. 301
gcaauaaucagaugg

SEQ ID NO: 1959514 - RNA, 12 nt, Shigella flexneri 2a str. 301
gcaauaccgcga

SEQ ID NO: 1959515 - RNA, 16 nt, Shigella flexneri 2a str. 301
gcaaacuacaaaucca

SEQ ID NO: 1959516 - RNA, 17 nt, Shigella flexneri 2a str. 301
gcaaacggcgcgacuuu

SEQ ID NO: 1959517 - RNA, 18 nt, Shigella flexneri 2a str. 301
gcaauggguaacggcaga

SEQ ID NO: 1959518 - RNA, 13 nt, Shigella flexneri 2a str. 301
gcaauggccggaa

SEQ ID NO: 1959519 - RNA, 21 nt, Shigella flexneri 2a str. 301
gcacaaacauccaucugcuuu

SEQ ID NO: 1959520 - RNA, 16 nt, Shigella flexneri 2a str. 301
gcaaucacugccagaa

SEQ ID NO: 1959521 - RNA, 15 nt, Shigella flexneri 2a str. 301
gcaaucgacgccguu

SEQ ID NO: 1959522 - RNA, 22 nt, Shigella flexneri 2a str. 301
gcaccgacguucagcgcaacuu

SEQ ID NO: 1959523 - RNA, 18 nt, Shigella flexneri 2a str. 301
gcaccgacacaaauggca

SEQ ID NO: 1959524 - RNA, 19 nt, Shigella flexneri 2a str. 301
gcaccggucgacgaugggu

SEQ ID NO: 1959525 - RNA, 13 nt, Shigella flexneri 2a str. 301
gcaccuguaccag

SEQ ID NO: 1959526 - RNA, 21 nt, Shigella flexneri 2a str. 301
gcaccuggcgcauuaacggca

SEQ ID NO: 1959527 - RNA, 19 nt, Shigella flexneri 2a str. 301
gcacgauuuguaggccgga

SEQ ID NO: 1959528 - RNA, 20 nt, Shigella flexneri 2a str. 301
gcacgauuuuguaggccgga

SEQ ID NO: 1959529 - RNA, 15 nt, Shigella flexneri 2a str. 301
gcacggugugcggca

SEQ ID NO: 1959530 - RNA, 19 nt, Shigella flexneri 2a str. 301
gcacuccgccacgucauca

SEQ ID NO: 1959531 - RNA, 23 nt, Shigella flexneri 2a str. 301
gcacguccgguggcauccgcaau

SEQ ID NO: 1959532 - RNA, 16 nt, Shigella flexneri 2a str. 301
gcacggaaagcagcau

SEQ ID NO: 1959533 - RNA, 22 nt, Shigella flexneri 2a str. 301
gcacggagauauccagcgccga

SEQ ID NO: 1959534 - RNA, 14 nt, Shigella flexneri 2a str. 301
gccgcgcaguuucu

SEQ ID NO: 1959535 - RNA, 14 nt, Shigella flexneri 2a str. 301
gccgcagcgauggu

SEQ ID NO: 1959536 - RNA, 19 nt, Shigella flexneri 2a str. 301
gccgccgagcaccacguug

SEQ ID NO: 1959537 - RNA, 20 nt, Shigella flexneri 2a str. 301
gccgcuucuucuucagcgcu

SEQ ID NO: 1959538 - RNA, 21 nt, Shigella flexneri 2a str. 301
gccgcugucuaccagcaccug

SEQ ID NO: 1959539 - RNA, 18 nt, Shigella flexneri 2a str. 301
gccggaggaguaucugcu

SEQ ID NO: 1959540 - RNA, 18 nt, Shigella flexneri 2a str. 301
gccggagucgcauuaaca

SEQ ID NO: 1959541 - RNA, 13 nt, Shigella flexneri 2a str. 301
gccggacuucaca

SEQ ID NO: 1959542 - RNA, 13 nt, Shigella flexneri 2a str. 301
gccgcuuuccagg

SEQ ID NO: 1959543 - RNA, 15 nt, Shigella flexneri 2a str. 301
gccggcacaggcauc

SEQ ID NO: 1959544 - RNA, 18 nt, Shigella flexneri 2a str. 301
gccggaugcgaugcugac

SEQ ID NO: 1959545 - RNA, 14 nt, Shigella flexneri 2a str. 301
gccggaugcggcgu

SEQ ID NO: 1959546 - RNA, 18 nt, Shigella flexneri 2a str. 301
gccggaugaucauccggc

SEQ ID NO: 1959547 - RNA, 19 nt, Shigella flexneri 2a str. 301
gccggaucgguagaccgga

SEQ ID NO: 1959548 - RNA, 20 nt, Shigella flexneri 2a str. 301
gccgcgucugaauaucaucc

SEQ ID NO: 1959549 - RNA, 13 nt, Shigella flexneri 2a str. 301
gccgcuaucggca

SEQ ID NO: 1959550 - RNA, 13 nt, Shigella flexneri 2a str. 301
gccgaauaacgcg

SEQ ID NO: 1959551 - RNA, 20 nt, Shigella flexneri 2a str. 301
gccgaugcgggauuccccca

SEQ ID NO: 1959552 - RNA, 17 nt, Shigella flexneri 2a str. 301
gccgaucauuggccgga

SEQ ID NO: 1959553 - RNA, 18 nt, Shigella flexneri 2a str. 301
gccgauccggacaugcug

SEQ ID NO: 1959554 - RNA, 21 nt, Shigella flexneri 2a str. 301
gcccugaaccaucgacgucca

SEQ ID NO: 1959555 - RNA, 14 nt, Shigella flexneri 2a str. 301
gcccugcgucgcac

SEQ ID NO: 1959556 - RNA, 17 nt, Shigella flexneri 2a str. 301
gcccugccaggucauca

SEQ ID NO: 1959557 - RNA, 17 nt, Shigella flexneri 2a str. 301
gcccugcaaugucauca

SEQ ID NO: 1959558 - RNA, 16 nt, Shigella flexneri 2a str. 301
gcccgguuguaugugc

SEQ ID NO: 1959559 - RNA, 13 nt, Shigella flexneri 2a str. 301
gcccuacaaacug

SEQ ID NO: 1959560 - RNA, 14 nt, Shigella flexneri 2a str. 301
gcccuugcuucgcc

SEQ ID NO: 1959561 - RNA, 23 nt, Shigella flexneri 2a str. 301
gcccuucuuucacuucagcaacg

SEQ ID NO: 1959562 - RNA, 23 nt, Shigella flexneri 2a str. 301
gcccuucguaggcagcauccggc

SEQ ID NO: 1959563 - RNA, 17 nt, Shigella flexneri 2a str. 301
gcccuuaauuacguuuc

SEQ ID NO: 1959564 - RNA, 18 nt, Shigella flexneri 2a str. 301
gccgaaccguaggccgga

SEQ ID NO: 1959565 - RNA, 17 nt, Shigella flexneri 2a str. 301
gccgaacuuugcacccc

SEQ ID NO: 1959566 - RNA, 23 nt, Shigella flexneri 2a str. 301
gccccgacgaacgcagcgucuca

SEQ ID NO: 1959567 - RNA, 15 nt, Shigella flexneri 2a str. 301
gccccagcaggaugu

SEQ ID NO: 1959568 - RNA, 15 nt, Shigella flexneri 2a str. 301
gcccagccgugaaug

SEQ ID NO: 1959569 - RNA, 14 nt, Shigella flexneri 2a str. 301
gcccaucaucaucg

SEQ ID NO: 1959570 - RNA, 23 nt, Shigella flexneri 2a str. 301
gcccauaugaacauuacuuuccg

SEQ ID NO: 1959571 - RNA, 14 nt, Shigella flexneri 2a str. 301
gcccaucagcaucc

SEQ ID NO: 1959572 - RNA, 13 nt, Shigella flexneri 2a str. 301
gcccgccagcauc

SEQ ID NO: 1959573 - RNA, 21 nt, Shigella flexneri 2a str. 301
gcccgauacgcuugcgcaucg

SEQ ID NO: 1959574 - RNA, 17 nt, Shigella flexneri 2a str. 301
gcccgagauacaucacc

SEQ ID NO: 1959575 - RNA, 20 nt, Shigella flexneri 2a str. 301
gccccugaucggccaugaua

SEQ ID NO: 1959576 - RNA, 22 nt, Shigella flexneri 2a str. 301
gccauaaacgguuucagcagcg

SEQ ID NO: 1959577 - RNA, 23 nt, Shigella flexneri 2a str. 301
gccauaaccacgcagcgccgcgu

SEQ ID NO: 1959578 - RNA, 18 nt, Shigella flexneri 2a str. 301
gccauacggaaaaucuca

SEQ ID NO: 1959579 - RNA, 21 nt, Shigella flexneri 2a str. 301
gccaucugccagcaagcgcac

SEQ ID NO: 1959580 - RNA, 17 nt, Shigella flexneri 2a str. 301
gccaucugcagggcauc

SEQ ID NO: 1959581 - RNA, 20 nt, Shigella flexneri 2a str. 301
gccaucucuucggcacugcg

SEQ ID NO: 1959582 - RNA, 21 nt, Shigella flexneri 2a str. 301
gccaucucaaaacguccggca

SEQ ID NO: 1959583 - RNA, 21 nt, Shigella flexneri 2a str. 301
gccaugcacgcaagaacgcau

SEQ ID NO: 1959584 - RNA, 20 nt, Shigella flexneri 2a str. 301
gccaugcacgcaagaacgca

SEQ ID NO: 1959585 - RNA, 17 nt, Shigella flexneri 2a str. 301
gccaugcccgugcugac

SEQ ID NO: 1959586 - RNA, 22 nt, Shigella flexneri 2a str. 301
gccaggaaccugugacagcagc

SEQ ID NO: 1959587 - RNA, 13 nt, Shigella flexneri 2a str. 301
gccaggagcacgc

SEQ ID NO: 1959588 - RNA, 20 nt, Shigella flexneri 2a str. 301
gccagguuucauagcguccc

SEQ ID NO: 1959589 - RNA, 21 nt, Shigella flexneri 2a str. 301
gccaguaagcaguccagcgcc

SEQ ID NO: 1959590 - RNA, 16 nt, Shigella flexneri 2a str. 301
gccaguaaauuuauca

SEQ ID NO: 1959591 - RNA, 22 nt, Shigella flexneri 2a str. 301
gccaguguuggcgucagaccgg

SEQ ID NO: 1959592 - RNA, 19 nt, Shigella flexneri 2a str. 301
gccaguucgaaauccagac

SEQ ID NO: 1959593 - RNA, 16 nt, Shigella flexneri 2a str. 301
gcccaccaccagcgaa

SEQ ID NO: 1959594 - RNA, 16 nt, Shigella flexneri 2a str. 301
gcccagcccccagcau

SEQ ID NO: 1959595 - RNA, 13 nt, Shigella flexneri 2a str. 301
gcccagccaguca

SEQ ID NO: 1959596 - RNA, 22 nt, Shigella flexneri 2a str. 301
gcccagaugccggaugcggcgu

SEQ ID NO: 1959597 - RNA, 15 nt, Shigella flexneri 2a str. 301
gccacgcugccgcgc

SEQ ID NO: 1959598 - RNA, 17 nt, Shigella flexneri 2a str. 301
gccagcaacugauaaac

SEQ ID NO: 1959599 - RNA, 22 nt, Shigella flexneri 2a str. 301
gccagcaaaaucaccaucacaa

SEQ ID NO: 1959600 - RNA, 15 nt, Shigella flexneri 2a str. 301
gccagauaagacgcg

SEQ ID NO: 1959601 - RNA, 16 nt, Shigella flexneri 2a str. 301
gccagcggguucccgg

SEQ ID NO: 1959602 - RNA, 15 nt, Shigella flexneri 2a str. 301
gccagcgcgccuuca

SEQ ID NO: 1959603 - RNA, 17 nt, Shigella flexneri 2a str. 301
gccagcgccgacagcag

SEQ ID NO: 1959604 - RNA, 22 nt, Shigella flexneri 2a str. 301
gccagcuucgcuucccaacgca

SEQ ID NO: 1959605 - RNA, 17 nt, Shigella flexneri 2a str. 301
gccagcuuucaccugcg

SEQ ID NO: 1959606 - RNA, 15 nt, Shigella flexneri 2a str. 301
gccagcuugccgcgc

SEQ ID NO: 1959607 - RNA, 16 nt, Shigella flexneri 2a str. 301
gccagcucaaacgaau

SEQ ID NO: 1959608 - RNA, 15 nt, Shigella flexneri 2a str. 301
gccagcucaaccugu

SEQ ID NO: 1959609 - RNA, 16 nt, Shigella flexneri 2a str. 301
gccagcgauaucgcga

SEQ ID NO: 1959610 - RNA, 14 nt, Shigella flexneri 2a str. 301
gccagccgguaacg

SEQ ID NO: 1959611 - RNA, 22 nt, Shigella flexneri 2a str. 301
gccagcccgaucggcuggcauu

SEQ ID NO: 1959612 - RNA, 22 nt, Shigella flexneri 2a str. 301
gccacacgagucauuccggccc

SEQ ID NO: 1959613 - RNA, 19 nt, Shigella flexneri 2a str. 301
gccacaccuggugcagcgg

SEQ ID NO: 1959614 - RNA, 20 nt, Shigella flexneri 2a str. 301
gccacaauacugaucaucau

SEQ ID NO: 1959615 - RNA, 20 nt, Shigella flexneri 2a str. 301
gccacaauaacugccggaac

SEQ ID NO: 1959616 - RNA, 17 nt, Shigella flexneri 2a str. 301
gccacacaccgcaaacu

SEQ ID NO: 1959617 - RNA, 13 nt, Shigella flexneri 2a str. 301
gccaauuuggcug

SEQ ID NO: 1959618 - RNA, 12 nt, Shigella flexneri 2a str. 301
gccacauccggc

SEQ ID NO: 1959619 - RNA, 13 nt, Shigella flexneri 2a str. 301
gccacauccgcgg

SEQ ID NO: 1959620 - RNA, 20 nt, Shigella flexneri 2a str. 301
gccacauugcaucugauaac

SEQ ID NO: 1959621 - RNA, 13 nt, Shigella flexneri 2a str. 301
gccaccacaccgg

SEQ ID NO: 1959622 - RNA, 20 nt, Shigella flexneri 2a str. 301
gccaccacaccggaccagac

SEQ ID NO: 1959623 - RNA, 20 nt, Shigella flexneri 2a str. 301
gccacagcagccuucgccac

SEQ ID NO: 1959624 - RNA, 14 nt, Shigella flexneri 2a str. 301
gccacaggucagca

SEQ ID NO: 1959625 - RNA, 21 nt, Shigella flexneri 2a str. 301
gcauccggucagacaacuucc

SEQ ID NO: 1959626 - RNA, 16 nt, Shigella flexneri 2a str. 301
gcauccgucgccgcuu

SEQ ID NO: 1959627 - RNA, 19 nt, Shigella flexneri 2a str. 301
gcauccggguacacgauaa

SEQ ID NO: 1959628 - RNA, 13 nt, Shigella flexneri 2a str. 301
gcaucccagaaaa

SEQ ID NO: 1959629 - RNA, 21 nt, Shigella flexneri 2a str. 301
gccaacuucaugaccuuccag

SEQ ID NO: 1959630 - RNA, 18 nt, Shigella flexneri 2a str. 301
gccaauaaucgcgcuaau

SEQ ID NO: 1959631 - RNA, 19 nt, Shigella flexneri 2a str. 301
gccaauagaagcaccguug

SEQ ID NO: 1959632 - RNA, 14 nt, Shigella flexneri 2a str. 301
gccaccgcgcguuu

SEQ ID NO: 1959633 - RNA, 23 nt, Shigella flexneri 2a str. 301
gccaccguguucaugaccgugau

SEQ ID NO: 1959634 - RNA, 15 nt, Shigella flexneri 2a str. 301
gccacccgaucgcuc

SEQ ID NO: 1959635 - RNA, 17 nt, Shigella flexneri 2a str. 301
gccaccagugcaggcac

SEQ ID NO: 1959636 - RNA, 14 nt, Shigella flexneri 2a str. 301
gaccgccagcgcca

SEQ ID NO: 1959637 - RNA, 17 nt, Shigella flexneri 2a str. 301
gaccgccgccaaucacc

SEQ ID NO: 1959638 - RNA, 17 nt, Shigella flexneri 2a str. 301
gaccgccuucagucaua

SEQ ID NO: 1959639 - RNA, 23 nt, Shigella flexneri 2a str. 301
gaccauugaugcucuccgccauc

SEQ ID NO: 1959640 - RNA, 16 nt, Shigella flexneri 2a str. 301
gaccaaucccgccaua

SEQ ID NO: 1959641 - RNA, 18 nt, Shigella flexneri 2a str. 301
gacccagcaccaguacca

SEQ ID NO: 1959642 - RNA, 17 nt, Shigella flexneri 2a str. 301
gaccggcaaccagcacc

SEQ ID NO: 1959643 - RNA, 20 nt, Shigella flexneri 2a str. 301
gaccugcagaaaauccucaa

SEQ ID NO: 1959644 - RNA, 20 nt, Shigella flexneri 2a str. 301
gaccugucggggccagcgca

SEQ ID NO: 1959645 - RNA, 18 nt, Shigella flexneri 2a str. 301
gacgacguaccagcgucg

SEQ ID NO: 1959646 - RNA, 18 nt, Shigella flexneri 2a str. 301
gacgcguuagugucuuau

SEQ ID NO: 1959647 - RNA, 18 nt, Shigella flexneri 2a str. 301
gacgcgucuggcaucacc

SEQ ID NO: 1959648 - RNA, 18 nt, Shigella flexneri 2a str. 301
gacgcgucagugucuuau

SEQ ID NO: 1959649 - RNA, 13 nt, Shigella flexneri 2a str. 301
gacggcaucagaa

SEQ ID NO: 1959650 - RNA, 21 nt, Shigella flexneri 2a str. 301
gacgcgacaagcgucgcauca

SEQ ID NO: 1959651 - RNA, 15 nt, Shigella flexneri 2a str. 301
gacgcgacaagcguc

SEQ ID NO: 1959652 - RNA, 19 nt, Shigella flexneri 2a str. 301
gacgcgaccggcgucgcau

SEQ ID NO: 1959653 - RNA, 23 nt, Shigella flexneri 2a str. 301
gacgcgccagcgucgcaucaggc

SEQ ID NO: 1959654 - RNA, 20 nt, Shigella flexneri 2a str. 301
gacgcgcuagcuucaggugu

SEQ ID NO: 1959655 - RNA, 17 nt, Shigella flexneri 2a str. 301
gacgccaccauucacca

SEQ ID NO: 1959656 - RNA, 14 nt, Shigella flexneri 2a str. 301
gacgccagaugcgg

SEQ ID NO: 1959657 - RNA, 17 nt, Shigella flexneri 2a str. 301
gacgcacuuucgcuuua

SEQ ID NO: 1959658 - RNA, 14 nt, Shigella flexneri 2a str. 301
gacgcauugauaau

SEQ ID NO: 1959659 - RNA, 12 nt, Shigella flexneri 2a str. 301
gacgcauugcau

SEQ ID NO: 1959660 - RNA, 14 nt, Shigella flexneri 2a str. 301
gacgauacaacgcu

SEQ ID NO: 1959661 - RNA, 16 nt, Shigella flexneri 2a str. 301
gaacgugcaaaaucaa

SEQ ID NO: 1959662 - RNA, 23 nt, Shigella flexneri 2a str. 301
gaacuguggcgcgaagcccucaa

SEQ ID NO: 1959663 - RNA, 16 nt, Shigella flexneri 2a str. 301
gaacguguaggccuga

SEQ ID NO: 1959664 - RNA, 17 nt, Shigella flexneri 2a str. 301
gaacgugggucuguccc

SEQ ID NO: 1959665 - RNA, 17 nt, Shigella flexneri 2a str. 301
gaacuuucucccgaaaa

SEQ ID NO: 1959666 - RNA, 17 nt, Shigella flexneri 2a str. 301
gaacuugcucauccgga

SEQ ID NO: 1959667 - RNA, 13 nt, Shigella flexneri 2a str. 301
gaagaaaccgcua

SEQ ID NO: 1959668 - RNA, 18 nt, Shigella flexneri 2a str. 301
gaagacgcagcaugcauc

SEQ ID NO: 1959669 - RNA, 13 nt, Shigella flexneri 2a str. 301
gaagauaccgaac

SEQ ID NO: 1959670 - RNA, 14 nt, Shigella flexneri 2a str. 301
gaagaucaacgucu

SEQ ID NO: 1959671 - RNA, 18 nt, Shigella flexneri 2a str. 301
gaaacgcauaccuaccug

SEQ ID NO: 1959672 - RNA, 21 nt, Shigella flexneri 2a str. 301
gaaacgaugguugucacugca

SEQ ID NO: 1959673 - RNA, 19 nt, Shigella flexneri 2a str. 301
gaacgauuuuagcaaacug

SEQ ID NO: 1959674 - RNA, 15 nt, Shigella flexneri 2a str. 301
gaacgcaaauguaaa

SEQ ID NO: 1959675 - RNA, 16 nt, Shigella flexneri 2a str. 301
gaacgcaccgaccauc

SEQ ID NO: 1959676 - RNA, 15 nt, Shigella flexneri 2a str. 301
gaacgguccuuacca

SEQ ID NO: 1959677 - RNA, 23 nt, Shigella flexneri 2a str. 301
gaagcucguuguuuaugccggau

SEQ ID NO: 1959678 - RNA, 14 nt, Shigella flexneri 2a str. 301
gaagcugaaaucau

SEQ ID NO: 1959679 - RNA, 12 nt, Shigella flexneri 2a str. 301
gaagcgcgugcu

SEQ ID NO: 1959680 - RNA, 23 nt, Shigella flexneri 2a str. 301
gaagcgggggagucgcugguuaa

SEQ ID NO: 1959681 - RNA, 16 nt, Shigella flexneri 2a str. 301
gaaggauuagccggau

SEQ ID NO: 1959682 - RNA, 15 nt, Shigella flexneri 2a str. 301
gaaggauucgaaccu

SEQ ID NO: 1959683 - RNA, 15 nt, Shigella flexneri 2a str. 301
gaagcuggucagcau

SEQ ID NO: 1959684 - RNA, 15 nt, Shigella flexneri 2a str. 301
gaagcuuuccacgca

SEQ ID NO: 1959685 - RNA, 20 nt, Shigella flexneri 2a str. 301
gaaggcgauuaaacgccauc

SEQ ID NO: 1959686 - RNA, 22 nt, Shigella flexneri 2a str. 301
gaagcacugcaucaaugccgga

SEQ ID NO: 1959687 - RNA, 23 nt, Shigella flexneri 2a str. 301
gaagcaaaauaaccggcaagcaa

SEQ ID NO: 1959688 - RNA, 20 nt, Shigella flexneri 2a str. 301
gaagcaguuucaccagcagu

SEQ ID NO: 1959689 - RNA, 21 nt, Shigella flexneri 2a str. 301
gaagccaaaucauccagaccg

SEQ ID NO: 1959690 - RNA, 13 nt, Shigella flexneri 2a str. 301
gaagcgccuucga

SEQ ID NO: 1959691 - RNA, 20 nt, Shigella flexneri 2a str. 301
gacacuuucagcgcagcgcg

SEQ ID NO: 1959692 - RNA, 17 nt, Shigella flexneri 2a str. 301
gacacuccugacgcggu

SEQ ID NO: 1959693 - RNA, 19 nt, Shigella flexneri 2a str. 301
gacagaacggauaucgaga

SEQ ID NO: 1959694 - RNA, 19 nt, Shigella flexneri 2a str. 301
gacaaccagcuucaacgau

SEQ ID NO: 1959695 - RNA, 21 nt, Shigella flexneri 2a str. 301
gacaacaacaucacaccugcu

SEQ ID NO: 1959696 - RNA, 18 nt, Shigella flexneri 2a str. 301
gacaaauguguucagcga

SEQ ID NO: 1959697 - RNA, 16 nt, Shigella flexneri 2a str. 301
gacauuguuuccauau

SEQ ID NO: 1959698 - RNA, 13 nt, Shigella flexneri 2a str. 301
gacauugaaggau

SEQ ID NO: 1959699 - RNA, 13 nt, Shigella flexneri 2a str. 301
gacauuggcaucc

SEQ ID NO: 1959700 - RNA, 17 nt, Shigella flexneri 2a str. 301
gaccaauaaacgccagg

SEQ ID NO: 1959701 - RNA, 20 nt, Shigella flexneri 2a str. 301
gaccaauaacgcuuuucuca

SEQ ID NO: 1959702 - RNA, 21 nt, Shigella flexneri 2a str. 301
gaccaauaauccccaauacga

SEQ ID NO: 1959703 - RNA, 20 nt, Shigella flexneri 2a str. 301
gaaguauuggugaguccuga

SEQ ID NO: 1959704 - RNA, 17 nt, Shigella flexneri 2a str. 301
gaaguaguugcugucga

SEQ ID NO: 1959705 - RNA, 20 nt, Shigella flexneri 2a str. 301
gaaguggugagccacauugc

SEQ ID NO: 1959706 - RNA, 16 nt, Shigella flexneri 2a str. 301
gaaguagccuucauca

SEQ ID NO: 1959707 - RNA, 21 nt, Shigella flexneri 2a str. 301
gaagguucaagacgaauaccu

SEQ ID NO: 1959708 - RNA, 21 nt, Shigella flexneri 2a str. 301
gaaguaauaaucaacgcaccg

SEQ ID NO: 1959709 - RNA, 13 nt, Shigella flexneri 2a str. 301
gaaguaaauaucu

SEQ ID NO: 1959710 - RNA, 22 nt, Shigella flexneri 2a str. 301
gaaggucggcugaaucagaugu

SEQ ID NO: 1959711 - RNA, 16 nt, Shigella flexneri 2a str. 301
gaagggauugugcagg

SEQ ID NO: 1959712 - RNA, 19 nt, Shigella flexneri 2a str. 301
gaagggucuuuuaaauccu

SEQ ID NO: 1959713 - RNA, 19 nt, Shigella flexneri 2a str. 301
gaaugaucaaacgaagcgg

SEQ ID NO: 1959714 - RNA, 16 nt, Shigella flexneri 2a str. 301
gaaucgcaaagccgau

SEQ ID NO: 1959715 - RNA, 16 nt, Shigella flexneri 2a str. 301
gaaucaaccaugguuu

SEQ ID NO: 1959716 - RNA, 13 nt, Shigella flexneri 2a str. 301
gaauauggcggcg

SEQ ID NO: 1959717 - RNA, 20 nt, Shigella flexneri 2a str. 301
gaauaugcgccacaccacug

SEQ ID NO: 1959718 - RNA, 22 nt, Shigella flexneri 2a str. 301
gaauaguuuccgcuucugcuuu

SEQ ID NO: 1959719 - RNA, 23 nt, Shigella flexneri 2a str. 301
gaauagucccuucgguagcagcu

SEQ ID NO: 1959720 - RNA, 18 nt, Shigella flexneri 2a str. 301
gaaguuuugucgcugauu

SEQ ID NO: 1959721 - RNA, 13 nt, Shigella flexneri 2a str. 301
gaauaaacgccau

SEQ ID NO: 1959722 - RNA, 13 nt, Shigella flexneri 2a str. 301
gaauuaaugguga

SEQ ID NO: 1959723 - RNA, 18 nt, Shigella flexneri 2a str. 301
gaaugcgcaacgccguaa

SEQ ID NO: 1959724 - RNA, 18 nt, Shigella flexneri 2a str. 301
gaaugcgaaaauccucaa

SEQ ID NO: 1959725 - RNA, 16 nt, Shigella flexneri 2a str. 301
gaaugccuuauccgau

SEQ ID NO: 1959726 - RNA, 16 nt, Shigella flexneri 2a str. 301
gaaugaugcggcgcuu

SEQ ID NO: 1959727 - RNA, 14 nt, Shigella flexneri 2a str. 301
gaauuauaauuccu

SEQ ID NO: 1959728 - RNA, 16 nt, Shigella flexneri 2a str. 301
cuggcccaugccaguu

SEQ ID NO: 1959729 - RNA, 18 nt, Shigella flexneri 2a str. 301
cuggccauuucugccagu

SEQ ID NO: 1959730 - RNA, 19 nt, Shigella flexneri 2a str. 301
cuggcauuuggcucucgau

SEQ ID NO: 1959731 - RNA, 20 nt, Shigella flexneri 2a str. 301
cuggcaguggcaaccagcgg

SEQ ID NO: 1959732 - RNA, 21 nt, Shigella flexneri 2a str. 301
cuggcauuacggcauaacgcc

SEQ ID NO: 1959733 - RNA, 22 nt, Shigella flexneri 2a str. 301
cugcuuuucccuccacuccggu

SEQ ID NO: 1959734 - RNA, 15 nt, Shigella flexneri 2a str. 301
cuggaacaacguggc

SEQ ID NO: 1959735 - RNA, 16 nt, Shigella flexneri 2a str. 301
cugcuuuuaaccgcuu

SEQ ID NO: 1959736 - RNA, 23 nt, Shigella flexneri 2a str. 301
cugcuuuuaaccgcuuucccagu

SEQ ID NO: 1959737 - RNA, 19 nt, Shigella flexneri 2a str. 301
cuggaaaaccuucuuccug

SEQ ID NO: 1959738 - RNA, 20 nt, Shigella flexneri 2a str. 301
cuggaaagcucuucaugcag

SEQ ID NO: 1959739 - RNA, 14 nt, Shigella flexneri 2a str. 301
cugcuucggucaga

SEQ ID NO: 1959740 - RNA, 13 nt, Shigella flexneri 2a str. 301
cuggaacgaugcc

SEQ ID NO: 1959741 - RNA, 20 nt, Shigella flexneri 2a str. 301
cugcuguagcaguuccagca

SEQ ID NO: 1959742 - RNA, 14 nt, Shigella flexneri 2a str. 301
cugcuguugcgucu

SEQ ID NO: 1959743 - RNA, 17 nt, Shigella flexneri 2a str. 301
cugcuuaaaccauucca

SEQ ID NO: 1959744 - RNA, 17 nt, Shigella flexneri 2a str. 301
cugcuuaucaucacgca

SEQ ID NO: 1959745 - RNA, 21 nt, Shigella flexneri 2a str. 301
cuggguagaguuugaacucac

SEQ ID NO: 1959746 - RNA, 15 nt, Shigella flexneri 2a str. 301
cuggucauugccagg

SEQ ID NO: 1959747 - RNA, 16 nt, Shigella flexneri 2a str. 301
cuggcuggcaucuuga

SEQ ID NO: 1959748 - RNA, 16 nt, Shigella flexneri 2a str. 301
cuggcuggugacgcgc

SEQ ID NO: 1959749 - RNA, 19 nt, Shigella flexneri 2a str. 301
cuggcugcagaauacggau

SEQ ID NO: 1959750 - RNA, 20 nt, Shigella flexneri 2a str. 301
cugggcgauuuccuucagca

SEQ ID NO: 1959751 - RNA, 13 nt, Shigella flexneri 2a str. 301
cuggcgcuggcgu

SEQ ID NO: 1959752 - RNA, 18 nt, Shigella flexneri 2a str. 301
cuggcgcguuaucgacaa

SEQ ID NO: 1959753 - RNA, 19 nt, Shigella flexneri 2a str. 301
cuggcguagccggugccga

SEQ ID NO: 1959754 - RNA, 23 nt, Shigella flexneri 2a str. 301
cuggcugacggugaugaucgcgc

SEQ ID NO: 1959755 - RNA, 19 nt, Shigella flexneri 2a str. 301
cugcggauccugagcaaac

SEQ ID NO: 1959756 - RNA, 14 nt, Shigella flexneri 2a str. 301
cugcggaucaaucg

SEQ ID NO: 1959757 - RNA, 19 nt, Shigella flexneri 2a str. 301
cugcggaugcgccauccag

SEQ ID NO: 1959758 - RNA, 13 nt, Shigella flexneri 2a str. 301
cugcgcuuaucag

SEQ ID NO: 1959759 - RNA, 21 nt, Shigella flexneri 2a str. 301
cugcggauuuguaauuucagc

SEQ ID NO: 1959760 - RNA, 13 nt, Shigella flexneri 2a str. 301
cugcggccagcag

SEQ ID NO: 1959761 - RNA, 14 nt, Shigella flexneri 2a str. 301
cugcgcuauccagc

SEQ ID NO: 1959762 - RNA, 14 nt, Shigella flexneri 2a str. 301
cugcgcuauaucgc

SEQ ID NO: 1959763 - RNA, 21 nt, Shigella flexneri 2a str. 301
cugcgcgaccaucggaucggc

SEQ ID NO: 1959764 - RNA, 17 nt, Shigella flexneri 2a str. 301
cugcgcccagcgugcgu

SEQ ID NO: 1959765 - RNA, 13 nt, Shigella flexneri 2a str. 301
cugcgccaauacc

SEQ ID NO: 1959766 - RNA, 22 nt, Shigella flexneri 2a str. 301
cugcgccaaacagaugaugcgu

SEQ ID NO: 1959767 - RNA, 18 nt, Shigella flexneri 2a str. 301
cugcucuuucagcaccgc

SEQ ID NO: 1959768 - RNA, 15 nt, Shigella flexneri 2a str. 301
cugcugaccaccagc

SEQ ID NO: 1959769 - RNA, 20 nt, Shigella flexneri 2a str. 301
cugcugacgcuacuggacau

SEQ ID NO: 1959770 - RNA, 14 nt, Shigella flexneri 2a str. 301
cugcucguugccug

SEQ ID NO: 1959771 - RNA, 22 nt, Shigella flexneri 2a str. 301
cugcugauuauccgcaucacuc

SEQ ID NO: 1959772 - RNA, 12 nt, Shigella flexneri 2a str. 301
cugcugaucgcc

SEQ ID NO: 1959773 - RNA, 16 nt, Shigella flexneri 2a str. 301
cugcugaggcugaccc

SEQ ID NO: 1959774 - RNA, 22 nt, Shigella flexneri 2a str. 301
cugcugacggugauaaucaucc

SEQ ID NO: 1959775 - RNA, 17 nt, Shigella flexneri 2a str. 301
cugcuccuccuucucac

SEQ ID NO: 1959776 - RNA, 21 nt, Shigella flexneri 2a str. 301
cugcucgccaucagggccgau

SEQ ID NO: 1959777 - RNA, 20 nt, Shigella flexneri 2a str. 301
cugcgugucggacggaauuu

SEQ ID NO: 1959778 - RNA, 21 nt, Shigella flexneri 2a str. 301
cugcguuguaccaguucgcuu

SEQ ID NO: 1959779 - RNA, 18 nt, Shigella flexneri 2a str. 301
cugcguucagcaguucug

SEQ ID NO: 1959780 - RNA, 20 nt, Shigella flexneri 2a str. 301
cugcguuagaaaacgccugc

SEQ ID NO: 1959781 - RNA, 14 nt, Shigella flexneri 2a str. 301
cugcguuccggcau

SEQ ID NO: 1959782 - RNA, 20 nt, Shigella flexneri 2a str. 301
cugcucagacggugaccaga

SEQ ID NO: 1959783 - RNA, 14 nt, Shigella flexneri 2a str. 301
cugcgucgcuuucc

SEQ ID NO: 1959784 - RNA, 17 nt, Shigella flexneri 2a str. 301
cugcgugccuaauuccg

SEQ ID NO: 1959785 - RNA, 20 nt, Shigella flexneri 2a str. 301
cugcguagcucaucuucaua

SEQ ID NO: 1959786 - RNA, 19 nt, Shigella flexneri 2a str. 301
cugcguauuuccugccaga

SEQ ID NO: 1959787 - RNA, 14 nt, Shigella flexneri 2a str. 301
cugcguacuggcau

SEQ ID NO: 1959788 - RNA, 13 nt, Shigella flexneri 2a str. 301
cugcggcucucag

SEQ ID NO: 1959789 - RNA, 13 nt, Shigella flexneri 2a str. 301
cugcggcugacca

SEQ ID NO: 1959790 - RNA, 13 nt, Shigella flexneri 2a str. 301
cugcggcuuccag

SEQ ID NO: 1959791 - RNA, 15 nt, Shigella flexneri 2a str. 301
cugcggugacgcaac

SEQ ID NO: 1959792 - RNA, 21 nt, Shigella flexneri 2a str. 301
cuugcguuuuucaucuuccgu

SEQ ID NO: 1959793 - RNA, 18 nt, Shigella flexneri 2a str. 301
cuuggauauuuuaaucag

SEQ ID NO: 1959794 - RNA, 18 nt, Shigella flexneri 2a str. 301
cuugcguaucgacggcgu

SEQ ID NO: 1959795 - RNA, 17 nt, Shigella flexneri 2a str. 301
cuugauauaaaucccag

SEQ ID NO: 1959796 - RNA, 18 nt, Shigella flexneri 2a str. 301
cuugccagauacgauguu

SEQ ID NO: 1959797 - RNA, 12 nt, Shigella flexneri 2a str. 301
cuugccagccau

SEQ ID NO: 1959798 - RNA, 16 nt, Shigella flexneri 2a str. 301
cuugcaaucuuuagca

SEQ ID NO: 1959799 - RNA, 21 nt, Shigella flexneri 2a str. 301
cuugcaagaucgcgcaucagc

SEQ ID NO: 1959800 - RNA, 21 nt, Shigella flexneri 2a str. 301
cuugcaagaucgcucaucagc

SEQ ID NO: 1959801 - RNA, 21 nt, Shigella flexneri 2a str. 301
cuuugaaaauaacaucgccag

SEQ ID NO: 1959802 - RNA, 19 nt, Shigella flexneri 2a str. 301
cuuucuuggcacccagcgc

SEQ ID NO: 1959803 - RNA, 23 nt, Shigella flexneri 2a str. 301
cuuucugggaugaucaccugcau

SEQ ID NO: 1959804 - RNA, 17 nt, Shigella flexneri 2a str. 301
cuuucuuaaauuaagaa

SEQ ID NO: 1959805 - RNA, 15 nt, Shigella flexneri 2a str. 301
cuuucgcuguaaacg

SEQ ID NO: 1959806 - RNA, 19 nt, Shigella flexneri 2a str. 301
cuuucggaaagaucgccac

SEQ ID NO: 1959807 - RNA, 16 nt, Shigella flexneri 2a str. 301
cuuucgcaauaaucau

SEQ ID NO: 1959808 - RNA, 16 nt, Shigella flexneri 2a str. 301
cuuugacuacgacgcc

SEQ ID NO: 1959809 - RNA, 14 nt, Shigella flexneri 2a str. 301
cuuugauccagcca

SEQ ID NO: 1959810 - RNA, 17 nt, Shigella flexneri 2a str. 301
cuuugcguuccaucaga

SEQ ID NO: 1959811 - RNA, 13 nt, Shigella flexneri 2a str. 301
cuuucagcaccgc

SEQ ID NO: 1959812 - RNA, 14 nt, Shigella flexneri 2a str. 301
cuuucagcaccgcg

SEQ ID NO: 1959813 - RNA, 23 nt, Shigella flexneri 2a str. 301
cuuucagcaccagcccgacgaua

SEQ ID NO: 1959814 - RNA, 18 nt, Shigella flexneri 2a str. 301
cuuuccauaccggcugca

SEQ ID NO: 1959815 - RNA, 15 nt, Shigella flexneri 2a str. 301
cuuuccagcgucagu

SEQ ID NO: 1959816 - RNA, 21 nt, Shigella flexneri 2a str. 301
cuugucauacggauuacgacu

SEQ ID NO: 1959817 - RNA, 15 nt, Shigella flexneri 2a str. 301
cuuucagaaucaggu

SEQ ID NO: 1959818 - RNA, 18 nt, Shigella flexneri 2a str. 301
cuuucagagaagcaccgc

SEQ ID NO: 1959819 - RNA, 19 nt, Shigella flexneri 2a str. 301
cuuucagagaagcaccgcc

SEQ ID NO: 1959820 - RNA, 19 nt, Shigella flexneri 2a str. 301
gaaaccgcuauuuacggua

SEQ ID NO: 1959821 - RNA, 13 nt, Shigella flexneri 2a str. 301
gaaaacagcggcc

SEQ ID NO: 1959822 - RNA, 18 nt, Shigella flexneri 2a str. 301
gaaaaaccuccggcguuu

SEQ ID NO: 1959823 - RNA, 16 nt, Shigella flexneri 2a str. 301
gaaaaaaugaccggcc

SEQ ID NO: 1959824 - RNA, 21 nt, Shigella flexneri 2a str. 301
cuuugugaagguagucccugc

SEQ ID NO: 1959825 - RNA, 17 nt, Shigella flexneri 2a str. 301
cuuuuuuguucaguuca

SEQ ID NO: 1959826 - RNA, 15 nt, Shigella flexneri 2a str. 301
cuuuuaaauccugca

SEQ ID NO: 1959827 - RNA, 22 nt, Shigella flexneri 2a str. 301
gaaaaacgggucgccagaaggu

SEQ ID NO: 1959828 - RNA, 16 nt, Shigella flexneri 2a str. 301
gaaaacaucaugguuu

SEQ ID NO: 1959829 - RNA, 20 nt, Shigella flexneri 2a str. 301
gaaaacaauguucaucugca

SEQ ID NO: 1959830 - RNA, 17 nt, Shigella flexneri 2a str. 301
gaaaacaacaccuggca

SEQ ID NO: 1959831 - RNA, 13 nt, Shigella flexneri 2a str. 301
cuucggucaccgu

SEQ ID NO: 1959832 - RNA, 16 nt, Shigella flexneri 2a str. 301
cuucuuccagcggcag

SEQ ID NO: 1959833 - RNA, 22 nt, Shigella flexneri 2a str. 301
cuucuggcgacauuuucucuac

SEQ ID NO: 1959834 - RNA, 12 nt, Shigella flexneri 2a str. 301
cuucccagcgca

SEQ ID NO: 1959835 - RNA, 13 nt, Shigella flexneri 2a str. 301
cuucccagcccag

SEQ ID NO: 1959836 - RNA, 23 nt, Shigella flexneri 2a str. 301
cuuccaccuggaaccaggcgcga

SEQ ID NO: 1959837 - RNA, 18 nt, Shigella flexneri 2a str. 301
cuucaccagauugugaau

SEQ ID NO: 1959838 - RNA, 15 nt, Shigella flexneri 2a str. 301
cuucaccagcagcgu

SEQ ID NO: 1959839 - RNA, 22 nt, Shigella flexneri 2a str. 301
cuucauuaaauuuccgcgaaac

SEQ ID NO: 1959840 - RNA, 14 nt, Shigella flexneri 2a str. 301
cuucauuaccuuca

SEQ ID NO: 1959841 - RNA, 14 nt, Shigella flexneri 2a str. 301
cuuccgcgaaggcg

SEQ ID NO: 1959842 - RNA, 14 nt, Shigella flexneri 2a str. 301
cuuccgccaucagu

SEQ ID NO: 1959843 - RNA, 22 nt, Shigella flexneri 2a str. 301
cuucgacuuucaguggcuuauc

SEQ ID NO: 1959844 - RNA, 21 nt, Shigella flexneri 2a str. 301
cuucgaagaucucgguaacga

SEQ ID NO: 1959845 - RNA, 20 nt, Shigella flexneri 2a str. 301
cuuaaguuugcgccaucggc

SEQ ID NO: 1959846 - RNA, 16 nt, Shigella flexneri 2a str. 301
cuuacauuccgucuca

SEQ ID NO: 1959847 - RNA, 14 nt, Shigella flexneri 2a str. 301
cuuaccuucacgaa

SEQ ID NO: 1959848 - RNA, 16 nt, Shigella flexneri 2a str. 301
cuguuaccccugcggc

SEQ ID NO: 1959849 - RNA, 12 nt, Shigella flexneri 2a str. 301
cuguugguucag

SEQ ID NO: 1959850 - RNA, 18 nt, Shigella flexneri 2a str. 301
cuguuucgcuucuucagc

SEQ ID NO: 1959851 - RNA, 18 nt, Shigella flexneri 2a str. 301
cuguugugaugcaacugu

SEQ ID NO: 1959852 - RNA, 16 nt, Shigella flexneri 2a str. 301
cuuauccguccuacga

SEQ ID NO: 1959853 - RNA, 13 nt, Shigella flexneri 2a str. 301
cuuauugaagcuc

SEQ ID NO: 1959854 - RNA, 19 nt, Shigella flexneri 2a str. 301
cuuaucuuuuucgguauau

SEQ ID NO: 1959855 - RNA, 13 nt, Shigella flexneri 2a str. 301
cuucaaucgccac

SEQ ID NO: 1959856 - RNA, 19 nt, Shigella flexneri 2a str. 301
cuucaauagcaguccauua

SEQ ID NO: 1959857 - RNA, 17 nt, Shigella flexneri 2a str. 301
cugucuccggcauccag

SEQ ID NO: 1959858 - RNA, 15 nt, Shigella flexneri 2a str. 301
cugucuguacggcag

SEQ ID NO: 1959859 - RNA, 19 nt, Shigella flexneri 2a str. 301
cugugacaacacuucauag

SEQ ID NO: 1959860 - RNA, 17 nt, Shigella flexneri 2a str. 301
cuguguuuaugccggau

SEQ ID NO: 1959861 - RNA, 13 nt, Shigella flexneri 2a str. 301
cuguggcgcgaag

SEQ ID NO: 1959862 - RNA, 19 nt, Shigella flexneri 2a str. 301
cuguaucccagcccagcgg

SEQ ID NO: 1959863 - RNA, 11 nt, Shigella flexneri 2a str. 301
cuguaugcaug

SEQ ID NO: 1959864 - RNA, 14 nt, Shigella flexneri 2a str. 301
cuguauacgggcuu

SEQ ID NO: 1959865 - RNA, 16 nt, Shigella flexneri 2a str. 301
cuguauacgcauauca

SEQ ID NO: 1959866 - RNA, 20 nt, Shigella flexneri 2a str. 301
cuguaucgucacugguucaa

SEQ ID NO: 1959867 - RNA, 14 nt, Shigella flexneri 2a str. 301
cugucacccggcaa

SEQ ID NO: 1959868 - RNA, 22 nt, Shigella flexneri 2a str. 301
cugucgacaaagccgcaggcgu

SEQ ID NO: 1959869 - RNA, 16 nt, Shigella flexneri 2a str. 301
cugucauuacgggcaa

SEQ ID NO: 1959870 - RNA, 15 nt, Shigella flexneri 2a str. 301
cggugcgaacaauca

SEQ ID NO: 1959871 - RNA, 12 nt, Shigella flexneri 2a str. 301
cggugcuggcgc

SEQ ID NO: 1959872 - RNA, 22 nt, Shigella flexneri 2a str. 301
cgguggaccacggcgugccguc

SEQ ID NO: 1959873 - RNA, 18 nt, Shigella flexneri 2a str. 301
cgguggaacauuuaccgc

SEQ ID NO: 1959874 - RNA, 19 nt, Shigella flexneri 2a str. 301
cgguggcguuuccagcagu

SEQ ID NO: 1959875 - RNA, 17 nt, Shigella flexneri 2a str. 301
cggugcaaaugccagau

SEQ ID NO: 1959876 - RNA, 16 nt, Shigella flexneri 2a str. 301
cggugcaaaugccaga

SEQ ID NO: 1959877 - RNA, 13 nt, Shigella flexneri 2a str. 301
cggugauuuccgc

SEQ ID NO: 1959878 - RNA, 14 nt, Shigella flexneri 2a str. 301
cggugcaccgcauc

SEQ ID NO: 1959879 - RNA, 21 nt, Shigella flexneri 2a str. 301
cggugauaaacccaacggcaa

SEQ ID NO: 1959880 - RNA, 17 nt, Shigella flexneri 2a str. 301
cggugagcugcaucugu

SEQ ID NO: 1959881 - RNA, 15 nt, Shigella flexneri 2a str. 301
cguaaugucggugaa

SEQ ID NO: 1959882 - RNA, 22 nt, Shigella flexneri 2a str. 301
cguaaugccugggcgauuuccu

SEQ ID NO: 1959883 - RNA, 18 nt, Shigella flexneri 2a str. 301
cguaaaaacccgcuucgg

SEQ ID NO: 1959884 - RNA, 19 nt, Shigella flexneri 2a str. 301
cgguuuucgcgccagccag

SEQ ID NO: 1959885 - RNA, 17 nt, Shigella flexneri 2a str. 301
cguaaucgcccgcuucc

SEQ ID NO: 1959886 - RNA, 21 nt, Shigella flexneri 2a str. 301
cguaaacgccuuauccggccu

SEQ ID NO: 1959887 - RNA, 21 nt, Shigella flexneri 2a str. 301
cgguuucagcucacggccggu

SEQ ID NO: 1959888 - RNA, 18 nt, Shigella flexneri 2a str. 301
cgguugaccggccagucu

SEQ ID NO: 1959889 - RNA, 20 nt, Shigella flexneri 2a str. 301
cggugugcgggaacauauca

SEQ ID NO: 1959890 - RNA, 23 nt, Shigella flexneri 2a str. 301
cggugugcagcguacuucaugag

SEQ ID NO: 1959891 - RNA, 20 nt, Shigella flexneri 2a str. 301
cgguuaacgccgcgcccgcu

SEQ ID NO: 1959892 - RNA, 14 nt, Shigella flexneri 2a str. 301
cgguuccagcuuca

SEQ ID NO: 1959893 - RNA, 21 nt, Shigella flexneri 2a str. 301
cgguuagucgcugguugcaug

SEQ ID NO: 1959894 - RNA, 19 nt, Shigella flexneri 2a str. 301
cgguguccacuuccgcguc

SEQ ID NO: 1959895 - RNA, 15 nt, Shigella flexneri 2a str. 301
cggugucaauucccg

SEQ ID NO: 1959896 - RNA, 20 nt, Shigella flexneri 2a str. 301
cgguguccacuuccgcguca

SEQ ID NO: 1959897 - RNA, 17 nt, Shigella flexneri 2a str. 301
cggugguuguuccugcg

SEQ ID NO: 1959898 - RNA, 16 nt, Shigella flexneri 2a str. 301
cguaccaugcgcauca

SEQ ID NO: 1959899 - RNA, 17 nt, Shigella flexneri 2a str. 301
cguaccaugauccugca

SEQ ID NO: 1959900 - RNA, 17 nt, Shigella flexneri 2a str. 301
cguacccgcugcugacu

SEQ ID NO: 1959901 - RNA, 16 nt, Shigella flexneri 2a str. 301
cguacccggaucgcgg

SEQ ID NO: 1959902 - RNA, 16 nt, Shigella flexneri 2a str. 301
cguacuguuauccgcc

SEQ ID NO: 1959903 - RNA, 18 nt, Shigella flexneri 2a str. 301
cguaccacgcacagcccg

SEQ ID NO: 1959904 - RNA, 19 nt, Shigella flexneri 2a str. 301
cguaccacgcacagcccgc

SEQ ID NO: 1959905 - RNA, 14 nt, Shigella flexneri 2a str. 301
cguaccaucgccag

SEQ ID NO: 1959906 - RNA, 21 nt, Shigella flexneri 2a str. 301
cguacauugccgacauggcaa

SEQ ID NO: 1959907 - RNA, 22 nt, Shigella flexneri 2a str. 301
cguaccaaccgcaauugcugua

SEQ ID NO: 1959908 - RNA, 22 nt, Shigella flexneri 2a str. 301
cguagaaaccacucgccagacc

SEQ ID NO: 1959909 - RNA, 22 nt, Shigella flexneri 2a str. 301
cguagaaaaugcccauggcaag

SEQ ID NO: 1959910 - RNA, 20 nt, Shigella flexneri 2a str. 301
cguaggccggauaaggcgua

SEQ ID NO: 1959911 - RNA, 20 nt, Shigella flexneri 2a str. 301
cguaggccagauaaggcguu

SEQ ID NO: 1959912 - RNA, 12 nt, Shigella flexneri 2a str. 301
cguaggccagau

SEQ ID NO: 1959913 - RNA, 20 nt, Shigella flexneri 2a str. 301
cguaggccugauaagcguag

SEQ ID NO: 1959914 - RNA, 20 nt, Shigella flexneri 2a str. 301
cguaucuucaugcuccagca

SEQ ID NO: 1959915 - RNA, 18 nt, Shigella flexneri 2a str. 301
cgucaacugacgcagugu

SEQ ID NO: 1959916 - RNA, 20 nt, Shigella flexneri 2a str. 301
cgucaaucugcuccauuagc

SEQ ID NO: 1959917 - RNA, 15 nt, Shigella flexneri 2a str. 301
cguaucccccagagc

SEQ ID NO: 1959918 - RNA, 13 nt, Shigella flexneri 2a str. 301
cgucaccggaacc

SEQ ID NO: 1959919 - RNA, 14 nt, Shigella flexneri 2a str. 301
cgucacgaucgcgc

SEQ ID NO: 1959920 - RNA, 20 nt, Shigella flexneri 2a str. 301
cgucacgaucgcgccagccu

SEQ ID NO: 1959921 - RNA, 15 nt, Shigella flexneri 2a str. 301
cgucacugaaucgcu

SEQ ID NO: 1959922 - RNA, 20 nt, Shigella flexneri 2a str. 301
cgucacugaaucgcuguuaa

SEQ ID NO: 1959923 - RNA, 17 nt, Shigella flexneri 2a str. 301
cgucacgauaucgauau

SEQ ID NO: 1959924 - RNA, 14 nt, Shigella flexneri 2a str. 301
cgucgcuuuccagu

SEQ ID NO: 1959925 - RNA, 20 nt, Shigella flexneri 2a str. 301
cgucggcaucgggcagcauc

SEQ ID NO: 1959926 - RNA, 15 nt, Shigella flexneri 2a str. 301
cgucgcauccggcaa

SEQ ID NO: 1959927 - RNA, 15 nt, Shigella flexneri 2a str. 301
cgucgcaucaggcau

SEQ ID NO: 1959928 - RNA, 18 nt, Shigella flexneri 2a str. 301
cgucgccagacgcagcaa

SEQ ID NO: 1959929 - RNA, 13 nt, Shigella flexneri 2a str. 301
cgucccagccuug

SEQ ID NO: 1959930 - RNA, 18 nt, Shigella flexneri 2a str. 301
cguccauuucagcgcaga

SEQ ID NO: 1959931 - RNA, 15 nt, Shigella flexneri 2a str. 301
cgucaggcaaccgcu

SEQ ID NO: 1959932 - RNA, 23 nt, Shigella flexneri 2a str. 301
cgucaggcaaucgagcccagaug

SEQ ID NO: 1959933 - RNA, 21 nt, Shigella flexneri 2a str. 301
cgucaguacauagccaucugc

SEQ ID NO: 1959934 - RNA, 15 nt, Shigella flexneri 2a str. 301
cguccucuucccaga

SEQ ID NO: 1959935 - RNA, 21 nt, Shigella flexneri 2a str. 301
cgugcagaacauccagcucgc

SEQ ID NO: 1959936 - RNA, 18 nt, Shigella flexneri 2a str. 301
cgugaucgaacaucugcg

SEQ ID NO: 1959937 - RNA, 22 nt, Shigella flexneri 2a str. 301
cgucuuuauugaguaccagcgc

SEQ ID NO: 1959938 - RNA, 19 nt, Shigella flexneri 2a str. 301
cgugcucgacagcgcuaau

SEQ ID NO: 1959939 - RNA, 16 nt, Shigella flexneri 2a str. 301
cgugcucgcuuuccau

SEQ ID NO: 1959940 - RNA, 18 nt, Shigella flexneri 2a str. 301
cgugcgggagaguaucca

SEQ ID NO: 1959941 - RNA, 18 nt, Shigella flexneri 2a str. 301
cgugcgcaauaacccaga

SEQ ID NO: 1959942 - RNA, 14 nt, Shigella flexneri 2a str. 301
cgugccgguaaugc

SEQ ID NO: 1959943 - RNA, 21 nt, Shigella flexneri 2a str. 301
cgucgguucguaggccagaua

SEQ ID NO: 1959944 - RNA, 20 nt, Shigella flexneri 2a str. 301
cgucgguuccguucauaugg

SEQ ID NO: 1959945 - RNA, 23 nt, Shigella flexneri 2a str. 301
cgucuggaacggcagauccaaac

SEQ ID NO: 1959946 - RNA, 17 nt, Shigella flexneri 2a str. 301
cgucuggcaucaccgcg

SEQ ID NO: 1959947 - RNA, 16 nt, Shigella flexneri 2a str. 301
cgucugaauaucaucc

SEQ ID NO: 1959948 - RNA, 14 nt, Shigella flexneri 2a str. 301
cgucugcgccacca

SEQ ID NO: 1959949 - RNA, 15 nt, Shigella flexneri 2a str. 301
cguuguucuacgugc

SEQ ID NO: 1959950 - RNA, 14 nt, Shigella flexneri 2a str. 301
cguugugucgccag

SEQ ID NO: 1959951 - RNA, 16 nt, Shigella flexneri 2a str. 301
cguugugucgccagca

SEQ ID NO: 1959952 - RNA, 14 nt, Shigella flexneri 2a str. 301
cguugugauuaaac

SEQ ID NO: 1959953 - RNA, 22 nt, Shigella flexneri 2a str. 301
cguuuauuuccccgcucuaccu

SEQ ID NO: 1959954 - RNA, 17 nt, Shigella flexneri 2a str. 301
cguuuaucgacagacgc

SEQ ID NO: 1959955 - RNA, 16 nt, Shigella flexneri 2a str. 301
cguuucagguuaaugc

SEQ ID NO: 1959956 - RNA, 14 nt, Shigella flexneri 2a str. 301
cguuuccagcacca

SEQ ID NO: 1959957 - RNA, 16 nt, Shigella flexneri 2a str. 301
cguuuagccgccguua

SEQ ID NO: 1959958 - RNA, 18 nt, Shigella flexneri 2a str. 301
cguuguaguguuccugcg

SEQ ID NO: 1959959 - RNA, 17 nt, Shigella flexneri 2a str. 301
cguuggugauaaaacgc

SEQ ID NO: 1959960 - RNA, 22 nt, Shigella flexneri 2a str. 301
cguuggcggguaagaauauccg

SEQ ID NO: 1959961 - RNA, 16 nt, Shigella flexneri 2a str. 301
cuaaacguuagcacga

SEQ ID NO: 1959962 - RNA, 17 nt, Shigella flexneri 2a str. 301
cuaacacugcguacagc

SEQ ID NO: 1959963 - RNA, 14 nt, Shigella flexneri 2a str. 301
cuaacaccaucagu

SEQ ID NO: 1959964 - RNA, 15 nt, Shigella flexneri 2a str. 301
cuaaauaaccagcau

SEQ ID NO: 1959965 - RNA, 17 nt, Shigella flexneri 2a str. 301
cguuugccagugccguu

SEQ ID NO: 1959966 - RNA, 15 nt, Shigella flexneri 2a str. 301
cguuucuuucaucag

SEQ ID NO: 1959967 - RNA, 20 nt, Shigella flexneri 2a str. 301
cguuucucugcuaauuuauc

SEQ ID NO: 1959968 - RNA, 14 nt, Shigella flexneri 2a str. 301
cguuucgccaccca

SEQ ID NO: 1959969 - RNA, 18 nt, Shigella flexneri 2a str. 301
cguuuuucuucagcagcc

SEQ ID NO: 1959970 - RNA, 23 nt, Shigella flexneri 2a str. 301
cguuuuggugaagugagaauuuu

SEQ ID NO: 1959971 - RNA, 18 nt, Shigella flexneri 2a str. 301
cguuuucuauuaucagaa

SEQ ID NO: 1959972 - RNA, 14 nt, Shigella flexneri 2a str. 301
cguuuucaccaguu

SEQ ID NO: 1959973 - RNA, 16 nt, Shigella flexneri 2a str. 301
cguuuguaggccggau

SEQ ID NO: 1959974 - RNA, 16 nt, Shigella flexneri 2a str. 301
cguuuucaaccagccg

SEQ ID NO: 1959975 - RNA, 15 nt, Shigella flexneri 2a str. 301
cguucgacaccacua

SEQ ID NO: 1959976 - RNA, 14 nt, Shigella flexneri 2a str. 301
cguuccccagaagc

SEQ ID NO: 1959977 - RNA, 19 nt, Shigella flexneri 2a str. 301
cguugcuuuuugcgcaucc

SEQ ID NO: 1959978 - RNA, 20 nt, Shigella flexneri 2a str. 301
cguugcuuauugccggaugc

SEQ ID NO: 1959979 - RNA, 15 nt, Shigella flexneri 2a str. 301
cguugcuaugcugaa

SEQ ID NO: 1959980 - RNA, 18 nt, Shigella flexneri 2a str. 301
cuaaguugaaucggcugc

SEQ ID NO: 1959981 - RNA, 14 nt, Shigella flexneri 2a str. 301
cuaaucgagccgau

SEQ ID NO: 1959982 - RNA, 17 nt, Shigella flexneri 2a str. 301
cuaaucgucaucgacag

SEQ ID NO: 1959983 - RNA, 14 nt, Shigella flexneri 2a str. 301
cuaagcugcguagc

SEQ ID NO: 1959984 - RNA, 17 nt, Shigella flexneri 2a str. 301
cuaacuguuucgcggua

SEQ ID NO: 1959985 - RNA, 18 nt, Shigella flexneri 2a str. 301
cuaccaugaugauaucac

SEQ ID NO: 1959986 - RNA, 23 nt, Shigella flexneri 2a str. 301
cuacccauauuuaaucaguucua

SEQ ID NO: 1959987 - RNA, 14 nt, Shigella flexneri 2a str. 301
cuacaaaaucuauu

SEQ ID NO: 1959988 - RNA, 18 nt, Shigella flexneri 2a str. 301
cuaauuuuuugcgccacu

SEQ ID NO: 1959989 - RNA, 22 nt, Shigella flexneri 2a str. 301
cuacaaaaccacacuucuucag

SEQ ID NO: 1959990 - RNA, 15 nt, Shigella flexneri 2a str. 301
cuaauguauggcgau

SEQ ID NO: 1959991 - RNA, 18 nt, Shigella flexneri 2a str. 301
cuaauggcugcgggcgac

SEQ ID NO: 1959992 - RNA, 20 nt, Shigella flexneri 2a str. 301
cuaauggcugcgggcgacca

SEQ ID NO: 1959993 - RNA, 17 nt, Shigella flexneri 2a str. 301
cuaugucgcauccggca

SEQ ID NO: 1959994 - RNA, 13 nt, Shigella flexneri 2a str. 301
cuauuacgcacac

SEQ ID NO: 1959995 - RNA, 17 nt, Shigella flexneri 2a str. 301
cuauuaugacuccagcg

SEQ ID NO: 1959996 - RNA, 14 nt, Shigella flexneri 2a str. 301
cuaucgccaucagg

SEQ ID NO: 1959997 - RNA, 18 nt, Shigella flexneri 2a str. 301
cuacgcucaucaggccua

SEQ ID NO: 1959998 - RNA, 19 nt, Shigella flexneri 2a str. 301
cuacgcgcaauauccugcg

SEQ ID NO: 1959999 - RNA, 16 nt, Shigella flexneri 2a str. 301
cucaaaccaauggcau

SEQ ID NO: 1960000 - RNA, 19 nt, Shigella flexneri 2a str. 301
cuauucacgaaucuauuca

SEQ ID NO: 1960001 - RNA, 11 nt, Shigella flexneri 2a str. 301
cuauucaucaa

SEQ ID NO: 1960002 - RNA, 18 nt, Shigella flexneri 2a str. 301
cucaccgaugaucgccau

SEQ ID NO: 1960003 - RNA, 20 nt, Shigella flexneri 2a str. 301
cucaccugauacgcgccaau

SEQ ID NO: 1960004 - RNA, 20 nt, Shigella flexneri 2a str. 301
cucaccguugccaaccugaa

SEQ ID NO: 1960005 - RNA, 19 nt, Shigella flexneri 2a str. 301
cucagauucagauuauguc

SEQ ID NO: 1960006 - RNA, 18 nt, Shigella flexneri 2a str. 301
cucauaaaaccauuuguu

SEQ ID NO: 1960007 - RNA, 16 nt, Shigella flexneri 2a str. 301
cuccacagucaggcug

SEQ ID NO: 1960008 - RNA, 18 nt, Shigella flexneri 2a str. 301
cucauacaccagcggcac

SEQ ID NO: 1960009 - RNA, 18 nt, Shigella flexneri 2a str. 301
cucauuugauugccggau

SEQ ID NO: 1960010 - RNA, 15 nt, Shigella flexneri 2a str. 301
cucaucaccaucagg

SEQ ID NO: 1960011 - RNA, 22 nt, Shigella flexneri 2a str. 301
cuccagucgcgugugauucagg

SEQ ID NO: 1960012 - RNA, 21 nt, Shigella flexneri 2a str. 301
cucccaguaaccacgcagcgu

SEQ ID NO: 1960013 - RNA, 17 nt, Shigella flexneri 2a str. 301
cucccaguaagccuaaa

SEQ ID NO: 1960014 - RNA, 14 nt, Shigella flexneri 2a str. 301
cucgcgccgcaucc

SEQ ID NO: 1960015 - RNA, 12 nt, Shigella flexneri 2a str. 301
cucgacgucaca

SEQ ID NO: 1960016 - RNA, 14 nt, Shigella flexneri 2a str. 301
cuccgucagcacgc

SEQ ID NO: 1960017 - RNA, 12 nt, Shigella flexneri 2a str. 301
cucccgauaacc

SEQ ID NO: 1960018 - RNA, 14 nt, Shigella flexneri 2a str. 301
cugagacgcgcuug

SEQ ID NO: 1960019 - RNA, 23 nt, Shigella flexneri 2a str. 301
cugacguuaagaaaacggaagcu

SEQ ID NO: 1960020 - RNA, 19 nt, Shigella flexneri 2a str. 301
cugacguuuucucguccag

SEQ ID NO: 1960021 - RNA, 14 nt, Shigella flexneri 2a str. 301
cugacugcgccacu

SEQ ID NO: 1960022 - RNA, 20 nt, Shigella flexneri 2a str. 301
cugacuggacucgaaccagu

SEQ ID NO: 1960023 - RNA, 16 nt, Shigella flexneri 2a str. 301
cugacugucgcagcca

SEQ ID NO: 1960024 - RNA, 19 nt, Shigella flexneri 2a str. 301
cugacuuugacauguugcu

SEQ ID NO: 1960025 - RNA, 13 nt, Shigella flexneri 2a str. 301
cugaagcaaacuu

SEQ ID NO: 1960026 - RNA, 14 nt, Shigella flexneri 2a str. 301
cugaaggacgccag

SEQ ID NO: 1960027 - RNA, 13 nt, Shigella flexneri 2a str. 301
cugaaggcacaga

SEQ ID NO: 1960028 - RNA, 20 nt, Shigella flexneri 2a str. 301
cugaccgugcgggcgaaagc

SEQ ID NO: 1960029 - RNA, 14 nt, Shigella flexneri 2a str. 301
cugaccuucuucag

SEQ ID NO: 1960030 - RNA, 16 nt, Shigella flexneri 2a str. 301
cugcaaggccauccgc

SEQ ID NO: 1960031 - RNA, 14 nt, Shigella flexneri 2a str. 301
cugauguucgccag

SEQ ID NO: 1960032 - RNA, 23 nt, Shigella flexneri 2a str. 301
cugauggcuguuuucagcaccag

SEQ ID NO: 1960033 - RNA, 21 nt, Shigella flexneri 2a str. 301
cugauuugauaaugccagccu

SEQ ID NO: 1960034 - RNA, 13 nt, Shigella flexneri 2a str. 301
cugauucgucaau

SEQ ID NO: 1960035 - RNA, 15 nt, Shigella flexneri 2a str. 301
cugauaacgugcagc

SEQ ID NO: 1960036 - RNA, 19 nt, Shigella flexneri 2a str. 301
cugauaagcccagcgacca

SEQ ID NO: 1960037 - RNA, 18 nt, Shigella flexneri 2a str. 301
cugauaaaucaccugcgc

SEQ ID NO: 1960038 - RNA, 22 nt, Shigella flexneri 2a str. 301
cugauggaauuucaucaucacg

SEQ ID NO: 1960039 - RNA, 13 nt, Shigella flexneri 2a str. 301
cugaugcgacacu

SEQ ID NO: 1960040 - RNA, 14 nt, Shigella flexneri 2a str. 301
cugauaacuucacu

SEQ ID NO: 1960041 - RNA, 15 nt, Shigella flexneri 2a str. 301
cugauacuaaugcca

SEQ ID NO: 1960042 - RNA, 12 nt, Shigella flexneri 2a str. 301
cucggugaccga

SEQ ID NO: 1960043 - RNA, 14 nt, Shigella flexneri 2a str. 301
cucuucuuccggca

SEQ ID NO: 1960044 - RNA, 22 nt, Shigella flexneri 2a str. 301
cugaaaccgugcaucuguuggu

SEQ ID NO: 1960045 - RNA, 20 nt, Shigella flexneri 2a str. 301
cugaaaguacuucacaauca

SEQ ID NO: 1960046 - RNA, 22 nt, Shigella flexneri 2a str. 301
cugaaaguacuucacaaucagc

SEQ ID NO: 1960047 - RNA, 17 nt, Shigella flexneri 2a str. 301
cucuguuggcgacguuu

SEQ ID NO: 1960048 - RNA, 14 nt, Shigella flexneri 2a str. 301
cucuguuuccagau

SEQ ID NO: 1960049 - RNA, 17 nt, Shigella flexneri 2a str. 301
cucuucgcgaucaaacg

SEQ ID NO: 1960050 - RNA, 11 nt, Shigella flexneri 2a str. 301
cucuuccaguc

SEQ ID NO: 1960051 - RNA, 14 nt, Shigella flexneri 2a str. 301
cucuccugccaguu

SEQ ID NO: 1960052 - RNA, 20 nt, Shigella flexneri 2a str. 301
cucucaccacgcuccaucau

SEQ ID NO: 1960053 - RNA, 18 nt, Shigella flexneri 2a str. 301
cucguuagacggcgcugc

SEQ ID NO: 1960054 - RNA, 15 nt, Shigella flexneri 2a str. 301
cucgugggauugccg

SEQ ID NO: 1960055 - RNA, 23 nt, Shigella flexneri 2a str. 301
cucgucguuguucuacgugcgcu

SEQ ID NO: 1960056 - RNA, 17 nt, Shigella flexneri 2a str. 301
cucuucgcgugugccgg

SEQ ID NO: 1960057 - RNA, 14 nt, Shigella flexneri 2a str. 301
cucuucgccugccu

SEQ ID NO: 1960058 - RNA, 14 nt, Shigella flexneri 2a str. 301
cucuuccggcgucg

SEQ ID NO: 1960059 - RNA, 14 nt, Shigella flexneri 2a str. 301
cucugauugccuuc

SEQ ID NO: 1960060 - RNA, 13 nt, Shigella flexneri 2a str. 301
cucugaaucgcua

SEQ ID NO: 1960061 - RNA, 18 nt, Shigella flexneri 2a str. 301
cucgguaaaaucaacgcc

SEQ ID NO: 1960062 - RNA, 19 nt, Shigella flexneri 2a str. 301
cucgccagcgauucccguu

SEQ ID NO: 1960063 - RNA, 19 nt, Shigella flexneri 2a str. 301
cucgccacuaaagccugcu

SEQ ID NO: 1960064 - RNA, 11 nt, Shigella flexneri 2a str. 301
cucgccagcac

SEQ ID NO: 1960065 - RNA, 15 nt, Shigella flexneri 2a str. 301
cucgcgagaacggcg

SEQ ID NO: 1960066 - RNA, 22 nt, Shigella flexneri 2a str. 301
cucgcgaaccgccuggcgcugc

SEQ ID NO: 1960067 - RNA, 23 nt, Shigella flexneri 2a str. 301
cucgcguuacuaccggcgugcgu

SEQ ID NO: 1960068 - RNA, 21 nt, Shigella flexneri 2a str. 301
cucgggcuuugcuacagccug

SEQ ID NO: 1960069 - RNA, 16 nt, Shigella flexneri 2a str. 301
cuccggcaggaaaugg

SEQ ID NO: 1960070 - RNA, 13 nt, Shigella flexneri 2a str. 301
cucgagcagcuga

SEQ ID NO: 1960071 - RNA, 16 nt, Shigella flexneri 2a str. 301
cucgacuguggcgcga

SEQ ID NO: 1960072 - RNA, 18 nt, Shigella flexneri 2a str. 301
cucaucuuccaccacguc

SEQ ID NO: 1960073 - RNA, 15 nt, Shigella flexneri 2a str. 301
cucaucggguaacgg

SEQ ID NO: 1960074 - RNA, 21 nt, Shigella flexneri 2a str. 301
cucaucgacggcuacgcucau

SEQ ID NO: 1960075 - RNA, 19 nt, Shigella flexneri 2a str. 301
cucauccgguguggcaugg

SEQ ID NO: 1960076 - RNA, 13 nt, Shigella flexneri 2a str. 301
cucaucagcgucg

SEQ ID NO: 1960077 - RNA, 19 nt, Shigella flexneri 2a str. 301
cucccuggcccaucgccag

SEQ ID NO: 1960078 - RNA, 14 nt, Shigella flexneri 2a str. 301
cuccagcgccgcca

SEQ ID NO: 1960079 - RNA, 11 nt, Shigella flexneri 2a str. 301
cuccagcgccg

SEQ ID NO: 1960080 - RNA, 17 nt, Shigella flexneri 2a str. 301
cguugaucggcuggcga

SEQ ID NO: 1960081 - RNA, 12 nt, Shigella flexneri 2a str. 301
cguugaucucuc

SEQ ID NO: 1960082 - RNA, 21 nt, Shigella flexneri 2a str. 301
cguugcauaaaugccgcaaug

SEQ ID NO: 1960083 - RNA, 19 nt, Shigella flexneri 2a str. 301
cguugagugcgacaugauc

SEQ ID NO: 1960084 - RNA, 15 nt, Shigella flexneri 2a str. 301
cguucugccaaacgc

SEQ ID NO: 1960085 - RNA, 18 nt, Shigella flexneri 2a str. 301
cguugcuuauugccggau

SEQ ID NO: 1960086 - RNA, 22 nt, Shigella flexneri 2a str. 301
cguugcugacuguaggccggau

SEQ ID NO: 1960087 - RNA, 16 nt, Shigella flexneri 2a str. 301
cguugcuaugcugaau

SEQ ID NO: 1960088 - RNA, 22 nt, Shigella flexneri 2a str. 301
cguucauggcgcgacauggcga

SEQ ID NO: 1960089 - RNA, 19 nt, Shigella flexneri 2a str. 301
cguuauacaucgcuuucca

SEQ ID NO: 1960090 - RNA, 15 nt, Shigella flexneri 2a str. 301
cguguggauaaucca

SEQ ID NO: 1960091 - RNA, 22 nt, Shigella flexneri 2a str. 301
cguuaccguaccaaccgcaauu

SEQ ID NO: 1960092 - RNA, 17 nt, Shigella flexneri 2a str. 301
cgugcuguacagcagua

SEQ ID NO: 1960093 - RNA, 14 nt, Shigella flexneri 2a str. 301
cgugcuucgccuua

SEQ ID NO: 1960094 - RNA, 20 nt, Shigella flexneri 2a str. 301
cguggagcaacacgccagcg

SEQ ID NO: 1960095 - RNA, 17 nt, Shigella flexneri 2a str. 301
cguggcaucgggcacag

SEQ ID NO: 1960096 - RNA, 20 nt, Shigella flexneri 2a str. 301
cgugcguuuguaggccggau

SEQ ID NO: 1960097 - RNA, 21 nt, Shigella flexneri 2a str. 301
cgugguugcgccugggccgau

SEQ ID NO: 1960098 - RNA, 20 nt, Shigella flexneri 2a str. 301
cgugucgagcauugccagca

SEQ ID NO: 1960099 - RNA, 21 nt, Shigella flexneri 2a str. 301
cguguacaaacccagccgccg

SEQ ID NO: 1960100 - RNA, 13 nt, Shigella flexneri 2a str. 301
cuacaagcagaga

SEQ ID NO: 1960101 - RNA, 21 nt, Shigella flexneri 2a str. 301
cuacaaaaucuauugcaacau

SEQ ID NO: 1960102 - RNA, 18 nt, Shigella flexneri 2a str. 301
cuaauuuuuccagcauuu

SEQ ID NO: 1960103 - RNA, 16 nt, Shigella flexneri 2a str. 301
cuacacauacuuauua

SEQ ID NO: 1960104 - RNA, 16 nt, Shigella flexneri 2a str. 301
cuaccacguaacgacu

SEQ ID NO: 1960105 - RNA, 16 nt, Shigella flexneri 2a str. 301
cuaccagcgccaccgg

SEQ ID NO: 1960106 - RNA, 13 nt, Shigella flexneri 2a str. 301
cuaccaugcuaau

SEQ ID NO: 1960107 - RNA, 24 nt, Shigella flexneri 2a str. 301
cuaaggguauagaagccauccagc

SEQ ID NO: 1960108 - RNA, 22 nt, Shigella flexneri 2a str. 301
cuaaugauguccugcauccgcu

SEQ ID NO: 1960109 - RNA, 21 nt, Shigella flexneri 2a str. 301
cuaaugcuuuuuccugcguca

SEQ ID NO: 1960110 - RNA, 21 nt, Shigella flexneri 2a str. 301
cuaauccagcccgauugcgcc

SEQ ID NO: 1960111 - RNA, 13 nt, Shigella flexneri 2a str. 301
cuacgcuuaucag

SEQ ID NO: 1960112 - RNA, 17 nt, Shigella flexneri 2a str. 301
cuacgcucauucgcccg

SEQ ID NO: 1960113 - RNA, 18 nt, Shigella flexneri 2a str. 301
cuacgcuuaucaggccua

SEQ ID NO: 1960114 - RNA, 16 nt, Shigella flexneri 2a str. 301
cuaccgggaugcugau

SEQ ID NO: 1960115 - RNA, 23 nt, Shigella flexneri 2a str. 301
cuacuuuguaaacgaagcgccau

SEQ ID NO: 1960116 - RNA, 15 nt, Shigella flexneri 2a str. 301
cuagagcaucaugaa

SEQ ID NO: 1960117 - RNA, 17 nt, Shigella flexneri 2a str. 301
cguuuacgcuuuccagc

SEQ ID NO: 1960118 - RNA, 15 nt, Shigella flexneri 2a str. 301
cguuuacgccgcauc

SEQ ID NO: 1960119 - RNA, 17 nt, Shigella flexneri 2a str. 301
cguuuacgccgcauccg

SEQ ID NO: 1960120 - RNA, 14 nt, Shigella flexneri 2a str. 301
cguuuaccgccauc

SEQ ID NO: 1960121 - RNA, 19 nt, Shigella flexneri 2a str. 301
cguuucgcagucgccagca

SEQ ID NO: 1960122 - RNA, 17 nt, Shigella flexneri 2a str. 301
cguuuccagcaccaguu

SEQ ID NO: 1960123 - RNA, 18 nt, Shigella flexneri 2a str. 301
cguuuaaaccaggcgaga

SEQ ID NO: 1960124 - RNA, 19 nt, Shigella flexneri 2a str. 301
cguuguuuucaugccgccg

SEQ ID NO: 1960125 - RNA, 15 nt, Shigella flexneri 2a str. 301
cguugucgccaucca

SEQ ID NO: 1960126 - RNA, 16 nt, Shigella flexneri 2a str. 301
cguugguaaugacucc

SEQ ID NO: 1960127 - RNA, 16 nt, Shigella flexneri 2a str. 301
cuaacaaggcuucgcu

SEQ ID NO: 1960128 - RNA, 15 nt, Shigella flexneri 2a str. 301
cuaacagagcacugu

SEQ ID NO: 1960129 - RNA, 19 nt, Shigella flexneri 2a str. 301
cuaacguuuuacgcgucac

SEQ ID NO: 1960130 - RNA, 20 nt, Shigella flexneri 2a str. 301
cuaaagcaacuccaucaagc

SEQ ID NO: 1960131 - RNA, 21 nt, Shigella flexneri 2a str. 301
cguuuucgccacaucagguaa

SEQ ID NO: 1960132 - RNA, 13 nt, Shigella flexneri 2a str. 301
cguuuugccgcca

SEQ ID NO: 1960133 - RNA, 20 nt, Shigella flexneri 2a str. 301
cguuuucuccagcgccgcca

SEQ ID NO: 1960134 - RNA, 23 nt, Shigella flexneri 2a str. 301
cguuuggggcauauuaucagcaa

SEQ ID NO: 1960135 - RNA, 17 nt, Shigella flexneri 2a str. 301
cguuugcugcaugaugu

SEQ ID NO: 1960136 - RNA, 15 nt, Shigella flexneri 2a str. 301
cguuuguaggcggau

SEQ ID NO: 1960137 - RNA, 21 nt, Shigella flexneri 2a str. 301
cguuuguggugcgcgagcugg

SEQ ID NO: 1960138 - RNA, 22 nt, Shigella flexneri 2a str. 301
cguuugccuuucggcgcaguca

SEQ ID NO: 1960139 - RNA, 16 nt, Shigella flexneri 2a str. 301
cguuugcgcccagcca

SEQ ID NO: 1960140 - RNA, 16 nt, Shigella flexneri 2a str. 301
cguuugcaggccugau

SEQ ID NO: 1960141 - RNA, 22 nt, Shigella flexneri 2a str. 301
cguuugacauaguagccagcca

SEQ ID NO: 1960142 - RNA, 17 nt, Shigella flexneri 2a str. 301
cggucgcugacgccaug

SEQ ID NO: 1960143 - RNA, 15 nt, Shigella flexneri 2a str. 301
cggugacagcgagcg

SEQ ID NO: 1960144 - RNA, 21 nt, Shigella flexneri 2a str. 301
cggugaagaagcggaaaucac

SEQ ID NO: 1960145 - RNA, 14 nt, Shigella flexneri 2a str. 301
cggugagcugcauc

SEQ ID NO: 1960146 - RNA, 17 nt, Shigella flexneri 2a str. 301
cggugaccgaucgcccg

SEQ ID NO: 1960147 - RNA, 14 nt, Shigella flexneri 2a str. 301
cggugauacagcaa

SEQ ID NO: 1960148 - RNA, 19 nt, Shigella flexneri 2a str. 301
cggugauacugaucgucau

SEQ ID NO: 1960149 - RNA, 18 nt, Shigella flexneri 2a str. 301
cggugcgguaaucgcccg

SEQ ID NO: 1960150 - RNA, 22 nt, Shigella flexneri 2a str. 301
cggugcgggaguugaucgccaa

SEQ ID NO: 1960151 - RNA, 15 nt, Shigella flexneri 2a str. 301
cggugguauuaccgc

SEQ ID NO: 1960152 - RNA, 17 nt, Shigella flexneri 2a str. 301
cgguggccuugccguug

SEQ ID NO: 1960153 - RNA, 12 nt, Shigella flexneri 2a str. 301
cggugucgccag

SEQ ID NO: 1960154 - RNA, 16 nt, Shigella flexneri 2a str. 301
cggugguuguuccugc

SEQ ID NO: 1960155 - RNA, 11 nt, Shigella flexneri 2a str. 301
cgguuuaaccg

SEQ ID NO: 1960156 - RNA, 18 nt, Shigella flexneri 2a str. 301
cguaaauaccuuccggcg

SEQ ID NO: 1960157 - RNA, 13 nt, Shigella flexneri 2a str. 301
cguaaaucaaacc

SEQ ID NO: 1960158 - RNA, 20 nt, Shigella flexneri 2a str. 301
cgguuucaaauuacgaucca

SEQ ID NO: 1960159 - RNA, 21 nt, Shigella flexneri 2a str. 301
cgguuuauccauccccagagc

SEQ ID NO: 1960160 - RNA, 23 nt, Shigella flexneri 2a str. 301
cgguuaaaucgacguucugccaa

SEQ ID NO: 1960161 - RNA, 18 nt, Shigella flexneri 2a str. 301
cgguuaaccuuuaaucag

SEQ ID NO: 1960162 - RNA, 15 nt, Shigella flexneri 2a str. 301
cgguucagcgucggc

SEQ ID NO: 1960163 - RNA, 11 nt, Shigella flexneri 2a str. 301
cgguucccaga

SEQ ID NO: 1960164 - RNA, 20 nt, Shigella flexneri 2a str. 301
cguaggcuggauaaggcguu

SEQ ID NO: 1960165 - RNA, 23 nt, Shigella flexneri 2a str. 301
cguaauggaugcccgcgggcgaa

SEQ ID NO: 1960166 - RNA, 23 nt, Shigella flexneri 2a str. 301
cguaauaguuucugacauuuuua

SEQ ID NO: 1960167 - RNA, 21 nt, Shigella flexneri 2a str. 301
cguaaguuaacugcacaccgc

SEQ ID NO: 1960168 - RNA, 20 nt, Shigella flexneri 2a str. 301
cgucaaggguugccggaugu

SEQ ID NO: 1960169 - RNA, 14 nt, Shigella flexneri 2a str. 301
cgucaguucacgcg

SEQ ID NO: 1960170 - RNA, 18 nt, Shigella flexneri 2a str. 301
cgucaguacauagccauc

SEQ ID NO: 1960171 - RNA, 13 nt, Shigella flexneri 2a str. 301
cgucagcuuucag

SEQ ID NO: 1960172 - RNA, 23 nt, Shigella flexneri 2a str. 301
cgucagcguuccacgugcggccg

SEQ ID NO: 1960173 - RNA, 16 nt, Shigella flexneri 2a str. 301
cgucacggacucggcg

SEQ ID NO: 1960174 - RNA, 19 nt, Shigella flexneri 2a str. 301
cgucacaggcacaccgccg

SEQ ID NO: 1960175 - RNA, 14 nt, Shigella flexneri 2a str. 301
cgucagauccgcca

SEQ ID NO: 1960176 - RNA, 15 nt, Shigella flexneri 2a str. 301
cgucgaaauuauuca

SEQ ID NO: 1960177 - RNA, 14 nt, Shigella flexneri 2a str. 301
cgucaucaaacggc

SEQ ID NO: 1960178 - RNA, 18 nt, Shigella flexneri 2a str. 301
cgucaucacgcaggcugu

SEQ ID NO: 1960179 - RNA, 22 nt, Shigella flexneri 2a str. 301
cgucaguuuuucacccgcaauc

SEQ ID NO: 1960180 - RNA, 23 nt, Shigella flexneri 2a str. 301
cguccauccacaggguguauuca

SEQ ID NO: 1960181 - RNA, 19 nt, Shigella flexneri 2a str. 301
cguccagaugcgagauguc

SEQ ID NO: 1960182 - RNA, 15 nt, Shigella flexneri 2a str. 301
cgucguaguaguuca

SEQ ID NO: 1960183 - RNA, 12 nt, Shigella flexneri 2a str. 301
cgucuccaucaa

SEQ ID NO: 1960184 - RNA, 13 nt, Shigella flexneri 2a str. 301
cgucucgauacgc

SEQ ID NO: 1960185 - RNA, 21 nt, Shigella flexneri 2a str. 301
cgucgugaagcagagcagacg

SEQ ID NO: 1960186 - RNA, 17 nt, Shigella flexneri 2a str. 301
cgucggcuuucagcgcg

SEQ ID NO: 1960187 - RNA, 18 nt, Shigella flexneri 2a str. 301
cgucgggcuggugcugaa

SEQ ID NO: 1960188 - RNA, 22 nt, Shigella flexneri 2a str. 301
cgucgauaaucguuggcagacg

SEQ ID NO: 1960189 - RNA, 19 nt, Shigella flexneri 2a str. 301
cgucgaucaacgcuggcau

SEQ ID NO: 1960190 - RNA, 23 nt, Shigella flexneri 2a str. 301
cugguucugcggguuagucugca

SEQ ID NO: 1960191 - RNA, 20 nt, Shigella flexneri 2a str. 301
cugguucugcggguuagucu

SEQ ID NO: 1960192 - RNA, 18 nt, Shigella flexneri 2a str. 301
cugguguucggcauucug

SEQ ID NO: 1960193 - RNA, 17 nt, Shigella flexneri 2a str. 301
cugguggacaauacgcg

SEQ ID NO: 1960194 - RNA, 21 nt, Shigella flexneri 2a str. 301
cugguaguccaggaugugcgu

SEQ ID NO: 1960195 - RNA, 13 nt, Shigella flexneri 2a str. 301
cuggugauugccg

SEQ ID NO: 1960196 - RNA, 14 nt, Shigella flexneri 2a str. 301
cuggugaccuggga

SEQ ID NO: 1960197 - RNA, 20 nt, Shigella flexneri 2a str. 301
cugggcaaaaucaucacucc

SEQ ID NO: 1960198 - RNA, 17 nt, Shigella flexneri 2a str. 301
cugggcaauggugaacu

SEQ ID NO: 1960199 - RNA, 18 nt, Shigella flexneri 2a str. 301
cugguacucgacuguggc

SEQ ID NO: 1960200 - RNA, 15 nt, Shigella flexneri 2a str. 301
cuggguuucgccugc

SEQ ID NO: 1960201 - RNA, 19 nt, Shigella flexneri 2a str. 301
cuggguaacaccaaucagc

SEQ ID NO: 1960202 - RNA, 14 nt, Shigella flexneri 2a str. 301
cugugacagcagcg

SEQ ID NO: 1960203 - RNA, 13 nt, Shigella flexneri 2a str. 301
cugucuuaacgca

SEQ ID NO: 1960204 - RNA, 18 nt, Shigella flexneri 2a str. 301
cugucguccggcagcaga

SEQ ID NO: 1960205 - RNA, 19 nt, Shigella flexneri 2a str. 301
cugugacagcagcggcaga

SEQ ID NO: 1960206 - RNA, 19 nt, Shigella flexneri 2a str. 301
cugugagaguucugcgcau

SEQ ID NO: 1960207 - RNA, 16 nt, Shigella flexneri 2a str. 301
cuguugaaaagccgga

SEQ ID NO: 1960208 - RNA, 14 nt, Shigella flexneri 2a str. 301
cugguuugccacgu

SEQ ID NO: 1960209 - RNA, 14 nt, Shigella flexneri 2a str. 301
cuguaacuggaagu

SEQ ID NO: 1960210 - RNA, 12 nt, Shigella flexneri 2a str. 301
cuguaauugccg

SEQ ID NO: 1960211 - RNA, 21 nt, Shigella flexneri 2a str. 301
cuguccugagugggcgucagc

SEQ ID NO: 1960212 - RNA, 15 nt, Shigella flexneri 2a str. 301
cuucaccgcaucguc

SEQ ID NO: 1960213 - RNA, 16 nt, Shigella flexneri 2a str. 301
cuucacccaucgccag

SEQ ID NO: 1960214 - RNA, 15 nt, Shigella flexneri 2a str. 301
cuucaccuuccagua

SEQ ID NO: 1960215 - RNA, 17 nt, Shigella flexneri 2a str. 301
cuuauagcgcaucgcag

SEQ ID NO: 1960216 - RNA, 20 nt, Shigella flexneri 2a str. 301
cuuauacggcuggauuucgc

SEQ ID NO: 1960217 - RNA, 16 nt, Shigella flexneri 2a str. 301
cuuauccggccuacga

SEQ ID NO: 1960218 - RNA, 17 nt, Shigella flexneri 2a str. 301
cuuauccgaccuacguu

SEQ ID NO: 1960219 - RNA, 11 nt, Shigella flexneri 2a str. 301
cuuaucaggcc

SEQ ID NO: 1960220 - RNA, 14 nt, Shigella flexneri 2a str. 301
cuuaucaggccugu

SEQ ID NO: 1960221 - RNA, 17 nt, Shigella flexneri 2a str. 301
cuuaucaugccuacaua

SEQ ID NO: 1960222 - RNA, 13 nt, Shigella flexneri 2a str. 301
cuuauccagcaga

SEQ ID NO: 1960223 - RNA, 13 nt, Shigella flexneri 2a str. 301
cuguugugaugca

SEQ ID NO: 1960224 - RNA, 17 nt, Shigella flexneri 2a str. 301
cuuaaucccauccgcgc

SEQ ID NO: 1960225 - RNA, 22 nt, Shigella flexneri 2a str. 301
cuuacaaguaagcgucgucuca

SEQ ID NO: 1960226 - RNA, 20 nt, Shigella flexneri 2a str. 301
cuuacguuacccagcacgga

SEQ ID NO: 1960227 - RNA, 13 nt, Shigella flexneri 2a str. 301
cuuacgcgucaga

SEQ ID NO: 1960228 - RNA, 21 nt, Shigella flexneri 2a str. 301
cuuaccacagacaaaauccug

SEQ ID NO: 1960229 - RNA, 21 nt, Shigella flexneri 2a str. 301
cuugcaccggcgacaucccag

SEQ ID NO: 1960230 - RNA, 22 nt, Shigella flexneri 2a str. 301
cuugccaagugccggucugaau

SEQ ID NO: 1960231 - RNA, 14 nt, Shigella flexneri 2a str. 301
cuugguuuugccau

SEQ ID NO: 1960232 - RNA, 20 nt, Shigella flexneri 2a str. 301
cuugcggcuuaacugucgcu

SEQ ID NO: 1960233 - RNA, 17 nt, Shigella flexneri 2a str. 301
cuugcggacccggcgga

SEQ ID NO: 1960234 - RNA, 18 nt, Shigella flexneri 2a str. 301
cuucgcgaacacccgacg

SEQ ID NO: 1960235 - RNA, 21 nt, Shigella flexneri 2a str. 301
cuucgccuuucaguucaacgg

SEQ ID NO: 1960236 - RNA, 15 nt, Shigella flexneri 2a str. 301
cuucgccgaugaagu

SEQ ID NO: 1960237 - RNA, 16 nt, Shigella flexneri 2a str. 301
cuucacucugcugcca

SEQ ID NO: 1960238 - RNA, 24 nt, Shigella flexneri 2a str. 301
cuucagccaccagguucaacagcg

SEQ ID NO: 1960239 - RNA, 19 nt, Shigella flexneri 2a str. 301
cuuccaguuugcucaaauc

SEQ ID NO: 1960240 - RNA, 21 nt, Shigella flexneri 2a str. 301
cuuccggucugcgaucgucgu

SEQ ID NO: 1960241 - RNA, 23 nt, Shigella flexneri 2a str. 301
cuuccguaccagccuugccagau

SEQ ID NO: 1960242 - RNA, 18 nt, Shigella flexneri 2a str. 301
cuucuucaaccgucgcgc

SEQ ID NO: 1960243 - RNA, 14 nt, Shigella flexneri 2a str. 301
cuucuucgcuuucg

SEQ ID NO: 1960244 - RNA, 14 nt, Shigella flexneri 2a str. 301
cuucugcacgccag

SEQ ID NO: 1960245 - RNA, 19 nt, Shigella flexneri 2a str. 301
cuucugcaagcaucauaaa

SEQ ID NO: 1960246 - RNA, 12 nt, Shigella flexneri 2a str. 301
cuucuaugccag

SEQ ID NO: 1960247 - RNA, 12 nt, Shigella flexneri 2a str. 301
cuucuaaucgca

SEQ ID NO: 1960248 - RNA, 21 nt, Shigella flexneri 2a str. 301
cugcgcuggaacaacgcgcgu

SEQ ID NO: 1960249 - RNA, 19 nt, Shigella flexneri 2a str. 301
cugcgcuuacacacccggc

SEQ ID NO: 1960250 - RNA, 12 nt, Shigella flexneri 2a str. 301
cugcgcuuccag

SEQ ID NO: 1960251 - RNA, 14 nt, Shigella flexneri 2a str. 301
cugcgcuuccugca

SEQ ID NO: 1960252 - RNA, 13 nt, Shigella flexneri 2a str. 301
cugcggacgcacc

SEQ ID NO: 1960253 - RNA, 16 nt, Shigella flexneri 2a str. 301
cugcggcgcgcaucuu

SEQ ID NO: 1960254 - RNA, 14 nt, Shigella flexneri 2a str. 301
cugcggccagcagc

SEQ ID NO: 1960255 - RNA, 17 nt, Shigella flexneri 2a str. 301
cugcggccagcagcugu

SEQ ID NO: 1960256 - RNA, 17 nt, Shigella flexneri 2a str. 301
cugcggcaagaucgcga

SEQ ID NO: 1960257 - RNA, 12 nt, Shigella flexneri 2a str. 301
cugcgccagacg

SEQ ID NO: 1960258 - RNA, 16 nt, Shigella flexneri 2a str. 301
cugcgcauuucccagc

SEQ ID NO: 1960259 - RNA, 16 nt, Shigella flexneri 2a str. 301
cugcgccagcggcagu

SEQ ID NO: 1960260 - RNA, 21 nt, Shigella flexneri 2a str. 301
cugcgcaacuuguugucuucu

SEQ ID NO: 1960261 - RNA, 15 nt, Shigella flexneri 2a str. 301
cugcgcgaugaugcc

SEQ ID NO: 1960262 - RNA, 17 nt, Shigella flexneri 2a str. 301
cugccucucuucgcugc

SEQ ID NO: 1960263 - RNA, 21 nt, Shigella flexneri 2a str. 301
cugccugcugauaagacgcau

SEQ ID NO: 1960264 - RNA, 15 nt, Shigella flexneri 2a str. 301
cugccuguacggcag

SEQ ID NO: 1960265 - RNA, 13 nt, Shigella flexneri 2a str. 301
cugccguugcugc

SEQ ID NO: 1960266 - RNA, 17 nt, Shigella flexneri 2a str. 301
cugcgauuuaacgccug

SEQ ID NO: 1960267 - RNA, 21 nt, Shigella flexneri 2a str. 301
cugcgauugugacacgcgcgc

SEQ ID NO: 1960268 - RNA, 22 nt, Shigella flexneri 2a str. 301
cugccuguugugcgagcaaagc

SEQ ID NO: 1960269 - RNA, 16 nt, Shigella flexneri 2a str. 301
cugccggaacgugcau

SEQ ID NO: 1960270 - RNA, 18 nt, Shigella flexneri 2a str. 301
cugccgcuucuucuucag

SEQ ID NO: 1960271 - RNA, 16 nt, Shigella flexneri 2a str. 301
cugccggaaccagcca

SEQ ID NO: 1960272 - RNA, 17 nt, Shigella flexneri 2a str. 301
cugccggagcgccacca

SEQ ID NO: 1960273 - RNA, 11 nt, Shigella flexneri 2a str. 301
cugccggaugg

SEQ ID NO: 1960274 - RNA, 15 nt, Shigella flexneri 2a str. 301
cugccggguucgcac

SEQ ID NO: 1960275 - RNA, 21 nt, Shigella flexneri 2a str. 301
cugaaauagaauggcaucaga

SEQ ID NO: 1960276 - RNA, 17 nt, Shigella flexneri 2a str. 301
cugaaauagaauggcau

SEQ ID NO: 1960277 - RNA, 22 nt, Shigella flexneri 2a str. 301
cugaaauuacaggcaguaacca

SEQ ID NO: 1960278 - RNA, 24 nt, Shigella flexneri 2a str. 301
cugaaacggcgauggcuucuucag

SEQ ID NO: 1960279 - RNA, 14 nt, Shigella flexneri 2a str. 301
cugccgcaauggcc

SEQ ID NO: 1960280 - RNA, 17 nt, Shigella flexneri 2a str. 301
cugccgauggcgcaaac

SEQ ID NO: 1960281 - RNA, 17 nt, Shigella flexneri 2a str. 301
cugcuccauuagcccga

SEQ ID NO: 1960282 - RNA, 14 nt, Shigella flexneri 2a str. 301
cugcuccugcggcu

SEQ ID NO: 1960283 - RNA, 16 nt, Shigella flexneri 2a str. 301
cugcguuccggcauga

SEQ ID NO: 1960284 - RNA, 19 nt, Shigella flexneri 2a str. 301
cugcgugguuuguuccgca

SEQ ID NO: 1960285 - RNA, 14 nt, Shigella flexneri 2a str. 301
cugcguaucgcccu

SEQ ID NO: 1960286 - RNA, 21 nt, Shigella flexneri 2a str. 301
cugcgguaauccgggugaacu

SEQ ID NO: 1960287 - RNA, 11 nt, Shigella flexneri 2a str. 301
cugcugcggcg

SEQ ID NO: 1960288 - RNA, 16 nt, Shigella flexneri 2a str. 301
cugcugcguuccggca

SEQ ID NO: 1960289 - RNA, 16 nt, Shigella flexneri 2a str. 301
cugcucggucugcugg

SEQ ID NO: 1960290 - RNA, 15 nt, Shigella flexneri 2a str. 301
cugcucugccagacg

SEQ ID NO: 1960291 - RNA, 18 nt, Shigella flexneri 2a str. 301
cugcucuucuuucaucau

SEQ ID NO: 1960292 - RNA, 16 nt, Shigella flexneri 2a str. 301
aaccggauuuucacca

SEQ ID NO: 1960293 - RNA, 19 nt, Shigella flexneri 2a str. 301
aaccgcuuuagcggugaag

SEQ ID NO: 1960294 - RNA, 18 nt, Shigella flexneri 2a str. 301
aaccgcugccuucggcgu

SEQ ID NO: 1960295 - RNA, 18 nt, Shigella flexneri 2a str. 301
aaccgcucgugggcaucg

SEQ ID NO: 1960296 - RNA, 23 nt, Shigella flexneri 2a str. 301
cuggcagcguauucgcgcagaac

SEQ ID NO: 1960297 - RNA, 22 nt, Shigella flexneri 2a str. 301
cuggauuuucucuguuuccaga

SEQ ID NO: 1960298 - RNA, 13 nt, Shigella flexneri 2a str. 301
cuggauugccagc

SEQ ID NO: 1960299 - RNA, 20 nt, Shigella flexneri 2a str. 301
cuggaucugcggguuagucu

SEQ ID NO: 1960300 - RNA, 13 nt, Shigella flexneri 2a str. 301
cuggcaugaaugg

SEQ ID NO: 1960301 - RNA, 16 nt, Shigella flexneri 2a str. 301
cuggcauuugcaccga

SEQ ID NO: 1960302 - RNA, 16 nt, Shigella flexneri 2a str. 301
cuggccaugcggcgag

SEQ ID NO: 1960303 - RNA, 13 nt, Shigella flexneri 2a str. 301
cuggaaccacagc

SEQ ID NO: 1960304 - RNA, 15 nt, Shigella flexneri 2a str. 301
cugcuuauagcgcau

SEQ ID NO: 1960305 - RNA, 13 nt, Shigella flexneri 2a str. 301
cugcuggugccga

SEQ ID NO: 1960306 - RNA, 12 nt, Shigella flexneri 2a str. 301
aacggcggcuug

SEQ ID NO: 1960307 - RNA, 14 nt, Shigella flexneri 2a str. 301
gaccgggcgcggcu

SEQ ID NO: 1960308 - RNA, 14 nt, Shigella flexneri 2a str. 301
gaccggacugacuc

SEQ ID NO: 1960309 - RNA, 15 nt, Shigella flexneri 2a str. 301
gaccgcuccgccauc

SEQ ID NO: 1960310 - RNA, 15 nt, Shigella flexneri 2a str. 301
aacgcuuaaaacgcu

SEQ ID NO: 1960311 - RNA, 19 nt, Shigella flexneri 2a str. 301
aacgcugugcguaaucgcc

SEQ ID NO: 1960312 - RNA, 15 nt, Shigella flexneri 2a str. 301
aacgcuucucccagc

SEQ ID NO: 1960313 - RNA, 16 nt, Shigella flexneri 2a str. 301
gacccgagccacguca

SEQ ID NO: 1960314 - RNA, 12 nt, Shigella flexneri 2a str. 301
aacgcuggugag

SEQ ID NO: 1960315 - RNA, 21 nt, Shigella flexneri 2a str. 301
aacgcuguccggcgcacuggu

SEQ ID NO: 1960316 - RNA, 13 nt, Shigella flexneri 2a str. 301
aacgcucugcgcg

SEQ ID NO: 1960317 - RNA, 15 nt, Shigella flexneri 2a str. 301
aacggugucgauacc

SEQ ID NO: 1960318 - RNA, 15 nt, Shigella flexneri 2a str. 301
aacggugcugcacau

SEQ ID NO: 1960319 - RNA, 17 nt, Shigella flexneri 2a str. 301
aacggugauacugaucg

SEQ ID NO: 1960320 - RNA, 22 nt, Shigella flexneri 2a str. 301
aacggugaucaaaacgggcaau

SEQ ID NO: 1960321 - RNA, 15 nt, Shigella flexneri 2a str. 301
aacggggcugccagc

SEQ ID NO: 1960322 - RNA, 12 nt, Shigella flexneri 2a str. 301
aacgggcaccgc

SEQ ID NO: 1960323 - RNA, 12 nt, Shigella flexneri 2a str. 301
aacggucgcgga

SEQ ID NO: 1960324 - RNA, 20 nt, Shigella flexneri 2a str. 301
aacggcugcuucggucagca

SEQ ID NO: 1960325 - RNA, 21 nt, Shigella flexneri 2a str. 301
aacggcugcuucggucagcac

SEQ ID NO: 1960326 - RNA, 17 nt, Shigella flexneri 2a str. 301
aacggcgguuucgcaaa

SEQ ID NO: 1960327 - RNA, 16 nt, Shigella flexneri 2a str. 301
gaccugaaaccgccuu

SEQ ID NO: 1960328 - RNA, 16 nt, Shigella flexneri 2a str. 301
gaccugacaaccggau

SEQ ID NO: 1960329 - RNA, 12 nt, Shigella flexneri 2a str. 301
gaccuuucugau

SEQ ID NO: 1960330 - RNA, 13 nt, Shigella flexneri 2a str. 301
gaccagcuaccac

SEQ ID NO: 1960331 - RNA, 17 nt, Shigella flexneri 2a str. 301
gaccagcgucgcaucag

SEQ ID NO: 1960332 - RNA, 19 nt, Shigella flexneri 2a str. 301
aacgccuuucgcuguaaac

SEQ ID NO: 1960333 - RNA, 17 nt, Shigella flexneri 2a str. 301
aacgccuuccgucagca

SEQ ID NO: 1960334 - RNA, 23 nt, Shigella flexneri 2a str. 301
aacgcgauucccagucgcgcaau

SEQ ID NO: 1960335 - RNA, 17 nt, Shigella flexneri 2a str. 301
aacgcccgcuuucacca

SEQ ID NO: 1960336 - RNA, 23 nt, Shigella flexneri 2a str. 301
aacgccaccauuuuacguccgcg

SEQ ID NO: 1960337 - RNA, 19 nt, Shigella flexneri 2a str. 301
aacgccaauuacgcgcaau

SEQ ID NO: 1960338 - RNA, 21 nt, Shigella flexneri 2a str. 301
aacgccggaaaacguuucaaa

SEQ ID NO: 1960339 - RNA, 24 nt, Shigella flexneri 2a str. 301
aacgccggugaccaucagcaugac

SEQ ID NO: 1960340 - RNA, 13 nt, Shigella flexneri 2a str. 301
gaccagaugcgac

SEQ ID NO: 1960341 - RNA, 21 nt, Shigella flexneri 2a str. 301
aacgccugauagcccgcacaa

SEQ ID NO: 1960342 - RNA, 23 nt, Shigella flexneri 2a str. 301
aacgccugcuuaucgcccugcuc

SEQ ID NO: 1960343 - RNA, 18 nt, Shigella flexneri 2a str. 301
aacgccuuauccggccua

SEQ ID NO: 1960344 - RNA, 18 nt, Shigella flexneri 2a str. 301
aacgcaccgaccaucggc

SEQ ID NO: 1960345 - RNA, 17 nt, Shigella flexneri 2a str. 301
aacgcagucuucccagc

SEQ ID NO: 1960346 - RNA, 17 nt, Shigella flexneri 2a str. 301
gaccaccauauucgcca

SEQ ID NO: 1960347 - RNA, 22 nt, Shigella flexneri 2a str. 301
gaccaaagccuuucacuucggu

SEQ ID NO: 1960348 - RNA, 21 nt, Shigella flexneri 2a str. 301
gaccaaacugcucguucagca

SEQ ID NO: 1960349 - RNA, 19 nt, Shigella flexneri 2a str. 301
aacgagaaaaugacgauga

SEQ ID NO: 1960350 - RNA, 15 nt, Shigella flexneri 2a str. 301
aacgagagucgacac

SEQ ID NO: 1960351 - RNA, 17 nt, Shigella flexneri 2a str. 301
gaccaauccgccagcca

SEQ ID NO: 1960352 - RNA, 13 nt, Shigella flexneri 2a str. 301
gaccaaucgcggg

SEQ ID NO: 1960353 - RNA, 18 nt, Shigella flexneri 2a str. 301
gaccacaguaucagcguu

SEQ ID NO: 1960354 - RNA, 22 nt, Shigella flexneri 2a str. 301
gaccaaucacacaaccaugcag

SEQ ID NO: 1960355 - RNA, 15 nt, Shigella flexneri 2a str. 301
gaccaauccgccagc

SEQ ID NO: 1960356 - RNA, 18 nt, Shigella flexneri 2a str. 301
gaccaaucacacaaccau

SEQ ID NO: 1960357 - RNA, 17 nt, Shigella flexneri 2a str. 301
gacauuacgcauuugcg

SEQ ID NO: 1960358 - RNA, 15 nt, Shigella flexneri 2a str. 301
gacauuccguuugcu

SEQ ID NO: 1960359 - RNA, 20 nt, Shigella flexneri 2a str. 301
gacaugcgguucacgcgcca

SEQ ID NO: 1960360 - RNA, 18 nt, Shigella flexneri 2a str. 301
gaauucacucuauaccgc

SEQ ID NO: 1960361 - RNA, 15 nt, Shigella flexneri 2a str. 301
gaauucacgccgcau

SEQ ID NO: 1960362 - RNA, 15 nt, Shigella flexneri 2a str. 301
aacgaaucaaucgcc

SEQ ID NO: 1960363 - RNA, 23 nt, Shigella flexneri 2a str. 301
gacagcgauuaccauuucaccgu

SEQ ID NO: 1960364 - RNA, 23 nt, Shigella flexneri 2a str. 301
gaagcaacaguaauaaugcccau

SEQ ID NO: 1960365 - RNA, 21 nt, Shigella flexneri 2a str. 301
gaagcaaccggugucaucauc

SEQ ID NO: 1960366 - RNA, 17 nt, Shigella flexneri 2a str. 301
gaagcauugcgccugca

SEQ ID NO: 1960367 - RNA, 15 nt, Shigella flexneri 2a str. 301
gaagagaacgucgca

SEQ ID NO: 1960368 - RNA, 22 nt, Shigella flexneri 2a str. 301
gaagauacccgcgaggcgcaua

SEQ ID NO: 1960369 - RNA, 20 nt, Shigella flexneri 2a str. 301
gaaggcaaacuucucgccau

SEQ ID NO: 1960370 - RNA, 17 nt, Shigella flexneri 2a str. 301
gaaggcaagaaagcgua

SEQ ID NO: 1960371 - RNA, 23 nt, Shigella flexneri 2a str. 301
gaagcgcauggcguccgucaucg

SEQ ID NO: 1960372 - RNA, 21 nt, Shigella flexneri 2a str. 301
gaagcgcauggcguccgucau

SEQ ID NO: 1960373 - RNA, 16 nt, Shigella flexneri 2a str. 301
gaagcgcaacgcauca

SEQ ID NO: 1960374 - RNA, 14 nt, Shigella flexneri 2a str. 301
gaagcgaaacugcc

SEQ ID NO: 1960375 - RNA, 17 nt, Shigella flexneri 2a str. 301
gaagccgugccacaggc

SEQ ID NO: 1960376 - RNA, 14 nt, Shigella flexneri 2a str. 301
gaagcggaaaucac

SEQ ID NO: 1960377 - RNA, 14 nt, Shigella flexneri 2a str. 301
gaaggguuggugaa

SEQ ID NO: 1960378 - RNA, 18 nt, Shigella flexneri 2a str. 301
gaagguaaagaagguaag

SEQ ID NO: 1960379 - RNA, 14 nt, Shigella flexneri 2a str. 301
gaaguaauaaucaa

SEQ ID NO: 1960380 - RNA, 16 nt, Shigella flexneri 2a str. 301
gaaguacguagcguaa

SEQ ID NO: 1960381 - RNA, 20 nt, Shigella flexneri 2a str. 301
gaagguucaagacgaauacc

SEQ ID NO: 1960382 - RNA, 19 nt, Shigella flexneri 2a str. 301
gaaggugaaauugucggcg

SEQ ID NO: 1960383 - RNA, 22 nt, Shigella flexneri 2a str. 301
gaaggugaaauugucggcguaa

SEQ ID NO: 1960384 - RNA, 13 nt, Shigella flexneri 2a str. 301
gaaucgcuguuga

SEQ ID NO: 1960385 - RNA, 20 nt, Shigella flexneri 2a str. 301
gaaucgucggaauggcaucu

SEQ ID NO: 1960386 - RNA, 16 nt, Shigella flexneri 2a str. 301
gaaugccggaugcggc

SEQ ID NO: 1960387 - RNA, 12 nt, Shigella flexneri 2a str. 301
gaaugccggaau

SEQ ID NO: 1960388 - RNA, 19 nt, Shigella flexneri 2a str. 301
gaauggcaucuacgcucuc

SEQ ID NO: 1960389 - RNA, 19 nt, Shigella flexneri 2a str. 301
gaaugccgcagcacccuga

SEQ ID NO: 1960390 - RNA, 15 nt, Shigella flexneri 2a str. 301
gaaugcccugcggcu

SEQ ID NO: 1960391 - RNA, 14 nt, Shigella flexneri 2a str. 301
gaaugaucagcggu

SEQ ID NO: 1960392 - RNA, 18 nt, Shigella flexneri 2a str. 301
gaaugaggaucagccgcu

SEQ ID NO: 1960393 - RNA, 24 nt, Shigella flexneri 2a str. 301
gaaugacgacguaccagcgucgga

SEQ ID NO: 1960394 - RNA, 16 nt, Shigella flexneri 2a str. 301
gaaucacguaggccug

SEQ ID NO: 1960395 - RNA, 19 nt, Shigella flexneri 2a str. 301
gaaucacuucaucgccguu

SEQ ID NO: 1960396 - RNA, 21 nt, Shigella flexneri 2a str. 301
gaaucacgucguucgggccga

SEQ ID NO: 1960397 - RNA, 21 nt, Shigella flexneri 2a str. 301
gaauagcguuaauggcagaua

SEQ ID NO: 1960398 - RNA, 21 nt, Shigella flexneri 2a str. 301
gaauaccggcgucccaucggc

SEQ ID NO: 1960399 - RNA, 20 nt, Shigella flexneri 2a str. 301
gaacgggagaaacccggcca

SEQ ID NO: 1960400 - RNA, 22 nt, Shigella flexneri 2a str. 301
gaacucggugaccgaucgcccg

SEQ ID NO: 1960401 - RNA, 21 nt, Shigella flexneri 2a str. 301
gaacugugcacccgcuucagu

SEQ ID NO: 1960402 - RNA, 17 nt, Shigella flexneri 2a str. 301
gaacucgcugcgcggca

SEQ ID NO: 1960403 - RNA, 19 nt, Shigella flexneri 2a str. 301
gaagaagucgaaugcgcaa

SEQ ID NO: 1960404 - RNA, 19 nt, Shigella flexneri 2a str. 301
gaagaauuuguaggccgga

SEQ ID NO: 1960405 - RNA, 14 nt, Shigella flexneri 2a str. 301
gaagacgcagcaug

SEQ ID NO: 1960406 - RNA, 19 nt, Shigella flexneri 2a str. 301
gaacuuugcugcaaugaag

SEQ ID NO: 1960407 - RNA, 15 nt, Shigella flexneri 2a str. 301
gaagaaaaacuggcg

SEQ ID NO: 1960408 - RNA, 11 nt, Shigella flexneri 2a str. 301
gaagaaaucag

SEQ ID NO: 1960409 - RNA, 14 nt, Shigella flexneri 2a str. 301
gaaccguacagcau

SEQ ID NO: 1960410 - RNA, 15 nt, Shigella flexneri 2a str. 301
gaaccggacgauccc

SEQ ID NO: 1960411 - RNA, 21 nt, Shigella flexneri 2a str. 301
gaaccuuccauguugguaucg

SEQ ID NO: 1960412 - RNA, 21 nt, Shigella flexneri 2a str. 301
gaacgccgaauaacgcgcagc

SEQ ID NO: 1960413 - RNA, 13 nt, Shigella flexneri 2a str. 301
gaacgccgccagu

SEQ ID NO: 1960414 - RNA, 15 nt, Shigella flexneri 2a str. 301
gaacgcagcgucuca

SEQ ID NO: 1960415 - RNA, 15 nt, Shigella flexneri 2a str. 301
gaacagaccagcacc

SEQ ID NO: 1960416 - RNA, 24 nt, Shigella flexneri 2a str. 301
gaacacucuuccagucgccugcuu

SEQ ID NO: 1960417 - RNA, 17 nt, Shigella flexneri 2a str. 301
gaacagaagaaagcaau

SEQ ID NO: 1960418 - RNA, 21 nt, Shigella flexneri 2a str. 301
gaaaugagauauuucagagcu

SEQ ID NO: 1960419 - RNA, 11 nt, Shigella flexneri 2a str. 301
gaaaucggcgu

SEQ ID NO: 1960420 - RNA, 18 nt, Shigella flexneri 2a str. 301
gaaaucgcaucgcgccau

SEQ ID NO: 1960421 - RNA, 19 nt, Shigella flexneri 2a str. 301
gaacaucgcuucgucguca

SEQ ID NO: 1960422 - RNA, 21 nt, Shigella flexneri 2a str. 301
gaacaguucagcagcacuaca

SEQ ID NO: 1960423 - RNA, 13 nt, Shigella flexneri 2a str. 301
gaaacucacgcag

SEQ ID NO: 1960424 - RNA, 19 nt, Shigella flexneri 2a str. 301
gaaacucauaugcagcauc

SEQ ID NO: 1960425 - RNA, 20 nt, Shigella flexneri 2a str. 301
gaaaccuugugcacgcgcuu

SEQ ID NO: 1960426 - RNA, 13 nt, Shigella flexneri 2a str. 301
gaaacgcauaccu

SEQ ID NO: 1960427 - RNA, 22 nt, Shigella flexneri 2a str. 301
cuuguucgaagaguuccaacgc

SEQ ID NO: 1960428 - RNA, 17 nt, Shigella flexneri 2a str. 301
gaaagucguaggccuga

SEQ ID NO: 1960429 - RNA, 21 nt, Shigella flexneri 2a str. 301
gaaagugacagcccggcaugu

SEQ ID NO: 1960430 - RNA, 17 nt, Shigella flexneri 2a str. 301
gaaagcagcgaugcuuu

SEQ ID NO: 1960431 - RNA, 23 nt, Shigella flexneri 2a str. 301
gaaagcagcauguagaugccggu

SEQ ID NO: 1960432 - RNA, 15 nt, Shigella flexneri 2a str. 301
gaaagccccaccagc

SEQ ID NO: 1960433 - RNA, 13 nt, Shigella flexneri 2a str. 301
gaaagcaccugcg

SEQ ID NO: 1960434 - RNA, 22 nt, Shigella flexneri 2a str. 301
gaaagcaaugaaauucauuuga

SEQ ID NO: 1960435 - RNA, 21 nt, Shigella flexneri 2a str. 301
gaaagagggcauucuuaccgg

SEQ ID NO: 1960436 - RNA, 19 nt, Shigella flexneri 2a str. 301
gaaacuuauucaaucucuu

SEQ ID NO: 1960437 - RNA, 22 nt, Shigella flexneri 2a str. 301
gccaaaauugguuucagccgga

SEQ ID NO: 1960438 - RNA, 22 nt, Shigella flexneri 2a str. 301
gccaaacagaugaugcgucuca

SEQ ID NO: 1960439 - RNA, 14 nt, Shigella flexneri 2a str. 301
gccaacaaucucuu

SEQ ID NO: 1960440 - RNA, 14 nt, Shigella flexneri 2a str. 301
gccaaauccggcaa

SEQ ID NO: 1960441 - RNA, 14 nt, Shigella flexneri 2a str. 301
gccaaaucgcugcu

SEQ ID NO: 1960442 - RNA, 18 nt, Shigella flexneri 2a str. 301
gccaaaugucaccagccg

SEQ ID NO: 1960443 - RNA, 13 nt, Shigella flexneri 2a str. 301
gcauuuugcagau

SEQ ID NO: 1960444 - RNA, 23 nt, Shigella flexneri 2a str. 301
gcauuucucacuuuucaccgcuu

SEQ ID NO: 1960445 - RNA, 23 nt, Shigella flexneri 2a str. 301
gcauuuggcucucgaugccugau

SEQ ID NO: 1960446 - RNA, 18 nt, Shigella flexneri 2a str. 301
gcauuugcuccagacgcc

SEQ ID NO: 1960447 - RNA, 23 nt, Shigella flexneri 2a str. 301
gcauuugcuccagacgccagaug

SEQ ID NO: 1960448 - RNA, 17 nt, Shigella flexneri 2a str. 301
gcauuguugaaaacgcg

SEQ ID NO: 1960449 - RNA, 14 nt, Shigella flexneri 2a str. 301
gcauucucaucacc

SEQ ID NO: 1960450 - RNA, 13 nt, Shigella flexneri 2a str. 301
gcauuggcaaauu

SEQ ID NO: 1960451 - RNA, 22 nt, Shigella flexneri 2a str. 301
gcauugcuuugguggucaccau

SEQ ID NO: 1960452 - RNA, 14 nt, Shigella flexneri 2a str. 301
gcauuggacagauu

SEQ ID NO: 1960453 - RNA, 21 nt, Shigella flexneri 2a str. 301
gccaaccgauaucuuuccggc

SEQ ID NO: 1960454 - RNA, 22 nt, Shigella flexneri 2a str. 301
gccaacccgcucuggauaauca

SEQ ID NO: 1960455 - RNA, 13 nt, Shigella flexneri 2a str. 301
gccaacggcucaa

SEQ ID NO: 1960456 - RNA, 18 nt, Shigella flexneri 2a str. 301
gccaaucagcagaaccgc

SEQ ID NO: 1960457 - RNA, 16 nt, Shigella flexneri 2a str. 301
gccaaugcaggcaucg

SEQ ID NO: 1960458 - RNA, 14 nt, Shigella flexneri 2a str. 301
gccacaauauuccg

SEQ ID NO: 1960459 - RNA, 20 nt, Shigella flexneri 2a str. 301
gccacaccaacugugccgcc

SEQ ID NO: 1960460 - RNA, 15 nt, Shigella flexneri 2a str. 301
gcauggaaauguucc

SEQ ID NO: 1960461 - RNA, 16 nt, Shigella flexneri 2a str. 301
gcauggggaucgugau

SEQ ID NO: 1960462 - RNA, 14 nt, Shigella flexneri 2a str. 301
gcaugguaccgugu

SEQ ID NO: 1960463 - RNA, 16 nt, Shigella flexneri 2a str. 301
gcauggggucagggcu

SEQ ID NO: 1960464 - RNA, 16 nt, Shigella flexneri 2a str. 301
gcauguguaaccgcuu

SEQ ID NO: 1960465 - RNA, 24 nt, Shigella flexneri 2a str. 301
gcaugucacaaauagagcgccgga

SEQ ID NO: 1960466 - RNA, 22 nt, Shigella flexneri 2a str. 301
gcauucagugcaaaugccagau

SEQ ID NO: 1960467 - RNA, 23 nt, Shigella flexneri 2a str. 301
gcauucagugcaaaugccagaua

SEQ ID NO: 1960468 - RNA, 15 nt, Shigella flexneri 2a str. 301
gcauucgaguaacgu

SEQ ID NO: 1960469 - RNA, 21 nt, Shigella flexneri 2a str. 301
gcauuacugcuaucugccaga

SEQ ID NO: 1960470 - RNA, 15 nt, Shigella flexneri 2a str. 301
gcauuaaccagucgg

SEQ ID NO: 1960471 - RNA, 22 nt, Shigella flexneri 2a str. 301
gcaugaugacuugccuccagcg

SEQ ID NO: 1960472 - RNA, 15 nt, Shigella flexneri 2a str. 301
gcaugauaagacgcg

SEQ ID NO: 1960473 - RNA, 14 nt, Shigella flexneri 2a str. 301
gcaugauaccgauu

SEQ ID NO: 1960474 - RNA, 15 nt, Shigella flexneri 2a str. 301
gcaugauagcccgga

SEQ ID NO: 1960475 - RNA, 23 nt, Shigella flexneri 2a str. 301
gcaucugcgcauaacugccggau

SEQ ID NO: 1960476 - RNA, 15 nt, Shigella flexneri 2a str. 301
gcaugaacauugcug

SEQ ID NO: 1960477 - RNA, 16 nt, Shigella flexneri 2a str. 301
gcaguugacagccaca

SEQ ID NO: 1960478 - RNA, 13 nt, Shigella flexneri 2a str. 301
gcaguuccgccag

SEQ ID NO: 1960479 - RNA, 22 nt, Shigella flexneri 2a str. 301
gcaguuggcgcacaaugccuga

SEQ ID NO: 1960480 - RNA, 24 nt, Shigella flexneri 2a str. 301
gcaguuugguuaagucacgggcag

SEQ ID NO: 1960481 - RNA, 22 nt, Shigella flexneri 2a str. 301
gcauaaaccgggcguggaucug

SEQ ID NO: 1960482 - RNA, 18 nt, Shigella flexneri 2a str. 301
gcauaaaccacagaccgg

SEQ ID NO: 1960483 - RNA, 21 nt, Shigella flexneri 2a str. 301
gcaguuuauccagccacggcu

SEQ ID NO: 1960484 - RNA, 18 nt, Shigella flexneri 2a str. 301
gcauaauccugccgagau

SEQ ID NO: 1960485 - RNA, 19 nt, Shigella flexneri 2a str. 301
gcauaacguugcagcguuu

SEQ ID NO: 1960486 - RNA, 10 nt, Shigella flexneri 2a str. 301
gcagugccag

SEQ ID NO: 1960487 - RNA, 15 nt, Shigella flexneri 2a str. 301
gcaguggcuucggcg

SEQ ID NO: 1960488 - RNA, 17 nt, Shigella flexneri 2a str. 301
gcauaaugcagccaucc

SEQ ID NO: 1960489 - RNA, 13 nt, Shigella flexneri 2a str. 301
gcauaaugccuga

SEQ ID NO: 1960490 - RNA, 22 nt, Shigella flexneri 2a str. 301
gcauaaucggcuggguuuccgg

SEQ ID NO: 1960491 - RNA, 22 nt, Shigella flexneri 2a str. 301
gcauacagccagacaaucgaaa

SEQ ID NO: 1960492 - RNA, 20 nt, Shigella flexneri 2a str. 301
gcauaccuuccagcgcguuc

SEQ ID NO: 1960493 - RNA, 24 nt, Shigella flexneri 2a str. 301
gcauaccuucacagaaggccagga

SEQ ID NO: 1960494 - RNA, 17 nt, Shigella flexneri 2a str. 301
gcauacugaaccacgga

SEQ ID NO: 1960495 - RNA, 22 nt, Shigella flexneri 2a str. 301
gcauagccaccuggcugcguuu

SEQ ID NO: 1960496 - RNA, 19 nt, Shigella flexneri 2a str. 301
gcauaucgguaaaugcuuu

SEQ ID NO: 1960497 - RNA, 12 nt, Shigella flexneri 2a str. 301
gcauauccucau

SEQ ID NO: 1960498 - RNA, 21 nt, Shigella flexneri 2a str. 301
gcauauguuuacgcuggcgga

SEQ ID NO: 1960499 - RNA, 17 nt, Shigella flexneri 2a str. 301
gcauaugcaaaaggcug

SEQ ID NO: 1960500 - RNA, 19 nt, Shigella flexneri 2a str. 301
gcauauuccgccaccugcg

SEQ ID NO: 1960501 - RNA, 14 nt, Shigella flexneri 2a str. 301
gcaucaauaaucaa

SEQ ID NO: 1960502 - RNA, 15 nt, Shigella flexneri 2a str. 301
gcaucaauaccgcgu

SEQ ID NO: 1960503 - RNA, 15 nt, Shigella flexneri 2a str. 301
gcaucaaugccggac

SEQ ID NO: 1960504 - RNA, 21 nt, Shigella flexneri 2a str. 301
gcaucacuucuuuguucggca

SEQ ID NO: 1960505 - RNA, 17 nt, Shigella flexneri 2a str. 301
gcaucagacauuauugc

SEQ ID NO: 1960506 - RNA, 23 nt, Shigella flexneri 2a str. 301
gcaucagacaaaugucacugcuu

SEQ ID NO: 1960507 - RNA, 17 nt, Shigella flexneri 2a str. 301
gcaucacgacagcacca

SEQ ID NO: 1960508 - RNA, 14 nt, Shigella flexneri 2a str. 301
gcaucagcgccacc

SEQ ID NO: 1960509 - RNA, 22 nt, Shigella flexneri 2a str. 301
gcaucgacaguuucaccugcug

SEQ ID NO: 1960510 - RNA, 16 nt, Shigella flexneri 2a str. 301
gcauccggugauaggc

SEQ ID NO: 1960511 - RNA, 21 nt, Shigella flexneri 2a str. 301
gcauccgugguggcagccagc

SEQ ID NO: 1960512 - RNA, 16 nt, Shigella flexneri 2a str. 301
gcaucgcaucaggcaa

SEQ ID NO: 1960513 - RNA, 18 nt, Shigella flexneri 2a str. 301
gcauccgacaaggcauca

SEQ ID NO: 1960514 - RNA, 13 nt, Shigella flexneri 2a str. 301
gcaucccucuuug

SEQ ID NO: 1960515 - RNA, 13 nt, Shigella flexneri 2a str. 301
gcaucaggcaaug

SEQ ID NO: 1960516 - RNA, 18 nt, Shigella flexneri 2a str. 301
gcaucaggcaugaugcgc

SEQ ID NO: 1960517 - RNA, 17 nt, Shigella flexneri 2a str. 301
gcaucaucgcuuugugc

SEQ ID NO: 1960518 - RNA, 16 nt, Shigella flexneri 2a str. 301
gcaucauggaagcaau

SEQ ID NO: 1960519 - RNA, 21 nt, Shigella flexneri 2a str. 301
gcaucaugcucagaugccuga

SEQ ID NO: 1960520 - RNA, 15 nt, Shigella flexneri 2a str. 301
gcaucgccaccguua

SEQ ID NO: 1960521 - RNA, 12 nt, Shigella flexneri 2a str. 301
gcaucgccgcua

SEQ ID NO: 1960522 - RNA, 15 nt, Shigella flexneri 2a str. 301
gcaucgcgaaaugca

SEQ ID NO: 1960523 - RNA, 20 nt, Shigella flexneri 2a str. 301
gcaucugagcaugaugccug

SEQ ID NO: 1960524 - RNA, 14 nt, Shigella flexneri 2a str. 301
gcaucucaccguug

SEQ ID NO: 1960525 - RNA, 16 nt, Shigella flexneri 2a str. 301
gcaucucauccaucaa

SEQ ID NO: 1960526 - RNA, 12 nt, Shigella flexneri 2a str. 301
gcaucguacugg

SEQ ID NO: 1960527 - RNA, 17 nt, Shigella flexneri 2a str. 301
gccagcgccaccaccag

SEQ ID NO: 1960528 - RNA, 12 nt, Shigella flexneri 2a str. 301
gccagccauccg

SEQ ID NO: 1960529 - RNA, 22 nt, Shigella flexneri 2a str. 301
gccagccgcuaacuuccugcug

SEQ ID NO: 1960530 - RNA, 18 nt, Shigella flexneri 2a str. 301
gccagcacgaccgccauu

SEQ ID NO: 1960531 - RNA, 14 nt, Shigella flexneri 2a str. 301
gccagaugcggcgu

SEQ ID NO: 1960532 - RNA, 17 nt, Shigella flexneri 2a str. 301
gccagaugcggcgugaa

SEQ ID NO: 1960533 - RNA, 14 nt, Shigella flexneri 2a str. 301
gccagcaccagcaa

SEQ ID NO: 1960534 - RNA, 15 nt, Shigella flexneri 2a str. 301
gccagauagauugcg

SEQ ID NO: 1960535 - RNA, 16 nt, Shigella flexneri 2a str. 301
gccagauaguucgcga

SEQ ID NO: 1960536 - RNA, 15 nt, Shigella flexneri 2a str. 301
gccacaggucagcag

SEQ ID NO: 1960537 - RNA, 21 nt, Shigella flexneri 2a str. 301
gccacaguuuuacugcagcca

SEQ ID NO: 1960538 - RNA, 19 nt, Shigella flexneri 2a str. 301
gccacgaugauagccauua

SEQ ID NO: 1960539 - RNA, 13 nt, Shigella flexneri 2a str. 301
gccagaagcccgg

SEQ ID NO: 1960540 - RNA, 14 nt, Shigella flexneri 2a str. 301
gccagacaauugcc

SEQ ID NO: 1960541 - RNA, 22 nt, Shigella flexneri 2a str. 301
gccagaccugcgacauauuccc

SEQ ID NO: 1960542 - RNA, 17 nt, Shigella flexneri 2a str. 301
gccagaccuuaucacaa

SEQ ID NO: 1960543 - RNA, 16 nt, Shigella flexneri 2a str. 301
gccagagcccaucaca

SEQ ID NO: 1960544 - RNA, 16 nt, Shigella flexneri 2a str. 301
gccagagagaacugcg

SEQ ID NO: 1960545 - RNA, 15 nt, Shigella flexneri 2a str. 301
gccacgguauuugcc

SEQ ID NO: 1960546 - RNA, 22 nt, Shigella flexneri 2a str. 301
gccacggcgaccguucgccagg

SEQ ID NO: 1960547 - RNA, 13 nt, Shigella flexneri 2a str. 301
gccacggcuccag

SEQ ID NO: 1960548 - RNA, 22 nt, Shigella flexneri 2a str. 301
gccacucugacggcgcauccga

SEQ ID NO: 1960549 - RNA, 14 nt, Shigella flexneri 2a str. 301
gccauaauaaucau

SEQ ID NO: 1960550 - RNA, 16 nt, Shigella flexneri 2a str. 301
gccauaacgcgucuca

SEQ ID NO: 1960551 - RNA, 19 nt, Shigella flexneri 2a str. 301
gccauaauaaucaucacgc

SEQ ID NO: 1960552 - RNA, 18 nt, Shigella flexneri 2a str. 301
gccaguugcuuauccagc

SEQ ID NO: 1960553 - RNA, 23 nt, Shigella flexneri 2a str. 301
gccaguuuacugucugcuucugc

SEQ ID NO: 1960554 - RNA, 22 nt, Shigella flexneri 2a str. 301
gccaguuguugauaagccccag

SEQ ID NO: 1960555 - RNA, 19 nt, Shigella flexneri 2a str. 301
gccauaucguucugccaga

SEQ ID NO: 1960556 - RNA, 18 nt, Shigella flexneri 2a str. 301
gccauagaaaggaccaaa

SEQ ID NO: 1960557 - RNA, 14 nt, Shigella flexneri 2a str. 301
gccaucaauugcuc

SEQ ID NO: 1960558 - RNA, 18 nt, Shigella flexneri 2a str. 301
gccauauuucuccauuag

SEQ ID NO: 1960559 - RNA, 13 nt, Shigella flexneri 2a str. 301
gccaucagcagcg

SEQ ID NO: 1960560 - RNA, 14 nt, Shigella flexneri 2a str. 301
gccaucagcagcgg

SEQ ID NO: 1960561 - RNA, 23 nt, Shigella flexneri 2a str. 301
gccauccauaauuacgcuguuca

SEQ ID NO: 1960562 - RNA, 23 nt, Shigella flexneri 2a str. 301
gccaucaucccuacagguaaggu

SEQ ID NO: 1960563 - RNA, 21 nt, Shigella flexneri 2a str. 301
gccaugagcggacugaacgcg

SEQ ID NO: 1960564 - RNA, 18 nt, Shigella flexneri 2a str. 301
aagaaucacuucaucgcc

SEQ ID NO: 1960565 - RNA, 19 nt, Shigella flexneri 2a str. 301
aagaauguuaaauacagau

SEQ ID NO: 1960566 - RNA, 16 nt, Shigella flexneri 2a str. 301
aagaauugcagauacc

SEQ ID NO: 1960567 - RNA, 21 nt, Shigella flexneri 2a str. 301
gccaucuccgcauguuucgac

SEQ ID NO: 1960568 - RNA, 16 nt, Shigella flexneri 2a str. 301
gccauccuuacgcagc

SEQ ID NO: 1960569 - RNA, 21 nt, Shigella flexneri 2a str. 301
gccaucgacaacgccauauaa

SEQ ID NO: 1960570 - RNA, 14 nt, Shigella flexneri 2a str. 301
gccauccguuucag

SEQ ID NO: 1960571 - RNA, 20 nt, Shigella flexneri 2a str. 301
gccauccgcugcgguaaggu

SEQ ID NO: 1960572 - RNA, 13 nt, Shigella flexneri 2a str. 301
gccauccguaauu

SEQ ID NO: 1960573 - RNA, 15 nt, Shigella flexneri 2a str. 301
gccaguuacugccac

SEQ ID NO: 1960574 - RNA, 14 nt, Shigella flexneri 2a str. 301
gccaguuacugcug

SEQ ID NO: 1960575 - RNA, 15 nt, Shigella flexneri 2a str. 301
gccagugccacacgc

SEQ ID NO: 1960576 - RNA, 14 nt, Shigella flexneri 2a str. 301
gccaguaccagcag

SEQ ID NO: 1960577 - RNA, 20 nt, Shigella flexneri 2a str. 301
gccagguucgauauccgcca

SEQ ID NO: 1960578 - RNA, 17 nt, Shigella flexneri 2a str. 301
gccaggucgugccagaa

SEQ ID NO: 1960579 - RNA, 21 nt, Shigella flexneri 2a str. 301
gccagcgucgcaucaggcauc

SEQ ID NO: 1960580 - RNA, 18 nt, Shigella flexneri 2a str. 301
gccagcgucgcacccggc

SEQ ID NO: 1960581 - RNA, 16 nt, Shigella flexneri 2a str. 301
gccagcguagucggca

SEQ ID NO: 1960582 - RNA, 15 nt, Shigella flexneri 2a str. 301
gccgcagcaguugcc

SEQ ID NO: 1960583 - RNA, 17 nt, Shigella flexneri 2a str. 301
gccgcaaaacccaggcu

SEQ ID NO: 1960584 - RNA, 13 nt, Shigella flexneri 2a str. 301
gccgcaaugugcu

SEQ ID NO: 1960585 - RNA, 17 nt, Shigella flexneri 2a str. 301
gccgcauggaaccaguu

SEQ ID NO: 1960586 - RNA, 11 nt, Shigella flexneri 2a str. 301
gccgcauugac

SEQ ID NO: 1960587 - RNA, 13 nt, Shigella flexneri 2a str. 301
gccgcagccauca

SEQ ID NO: 1960588 - RNA, 23 nt, Shigella flexneri 2a str. 301
gccgcaguuuuugcacgcuuucu

SEQ ID NO: 1960589 - RNA, 17 nt, Shigella flexneri 2a str. 301
gccgcaguaaagcgcag

SEQ ID NO: 1960590 - RNA, 23 nt, Shigella flexneri 2a str. 301
gccgccacacgcguaaaacgauc

SEQ ID NO: 1960591 - RNA, 19 nt, Shigella flexneri 2a str. 301
gccgccauugaaucguuau

SEQ ID NO: 1960592 - RNA, 21 nt, Shigella flexneri 2a str. 301
gccgccaucucuuccagcgau

SEQ ID NO: 1960593 - RNA, 19 nt, Shigella flexneri 2a str. 301
gccgcccuguuugguugcc

SEQ ID NO: 1960594 - RNA, 21 nt, Shigella flexneri 2a str. 301
gccgagaauaaaacaggcagc

SEQ ID NO: 1960595 - RNA, 20 nt, Shigella flexneri 2a str. 301
aagauuuaaacaccugggca

SEQ ID NO: 1960596 - RNA, 14 nt, Shigella flexneri 2a str. 301
aagauugccugaug

SEQ ID NO: 1960597 - RNA, 22 nt, Shigella flexneri 2a str. 301
gccgagcgugcgggcacaggcg

SEQ ID NO: 1960598 - RNA, 17 nt, Shigella flexneri 2a str. 301
gccgaacguaggcugga

SEQ ID NO: 1960599 - RNA, 15 nt, Shigella flexneri 2a str. 301
gccgaacguaggcug

SEQ ID NO: 1960600 - RNA, 19 nt, Shigella flexneri 2a str. 301
gccgaaugccacgacguuu

SEQ ID NO: 1960601 - RNA, 14 nt, Shigella flexneri 2a str. 301
gccgaaccagugcu

SEQ ID NO: 1960602 - RNA, 16 nt, Shigella flexneri 2a str. 301
gccgaaccguaggccg

SEQ ID NO: 1960603 - RNA, 17 nt, Shigella flexneri 2a str. 301
gccgaacauauucgaua

SEQ ID NO: 1960604 - RNA, 22 nt, Shigella flexneri 2a str. 301
gcccguccaucaacaagcgaau

SEQ ID NO: 1960605 - RNA, 16 nt, Shigella flexneri 2a str. 301
gcccguccaucaacaa

SEQ ID NO: 1960606 - RNA, 20 nt, Shigella flexneri 2a str. 301
gcccuaaucgcugccgcgca

SEQ ID NO: 1960607 - RNA, 13 nt, Shigella flexneri 2a str. 301
gcccguuuugaga

SEQ ID NO: 1960608 - RNA, 17 nt, Shigella flexneri 2a str. 301
gcccgugauuuuccugu

SEQ ID NO: 1960609 - RNA, 14 nt, Shigella flexneri 2a str. 301
gcccguaaauucaa

SEQ ID NO: 1960610 - RNA, 23 nt, Shigella flexneri 2a str. 301
gcccguaacgcucaaguacggca

SEQ ID NO: 1960611 - RNA, 18 nt, Shigella flexneri 2a str. 301
gcccggggagcaacagag

SEQ ID NO: 1960612 - RNA, 24 nt, Shigella flexneri 2a str. 301
gcccggcauucaccucugcggcaa

SEQ ID NO: 1960613 - RNA, 15 nt, Shigella flexneri 2a str. 301
gcccggaauggugcu

SEQ ID NO: 1960614 - RNA, 15 nt, Shigella flexneri 2a str. 301
gcccagugccgagag

SEQ ID NO: 1960615 - RNA, 16 nt, Shigella flexneri 2a str. 301
gcccaguucagcggcu

SEQ ID NO: 1960616 - RNA, 16 nt, Shigella flexneri 2a str. 301
gcccaugaaucagcaa

SEQ ID NO: 1960617 - RNA, 22 nt, Shigella flexneri 2a str. 301
gcccaugcguugucgccaucca

SEQ ID NO: 1960618 - RNA, 19 nt, Shigella flexneri 2a str. 301
gcccaugaugacaacauag

SEQ ID NO: 1960619 - RNA, 18 nt, Shigella flexneri 2a str. 301
aagacguucacgucgcau

SEQ ID NO: 1960620 - RNA, 20 nt, Shigella flexneri 2a str. 301
aagacgugucaacaucgcau

SEQ ID NO: 1960621 - RNA, 15 nt, Shigella flexneri 2a str. 301
gcccgccagcaccgg

SEQ ID NO: 1960622 - RNA, 18 nt, Shigella flexneri 2a str. 301
gccccggcaaaugacgau

SEQ ID NO: 1960623 - RNA, 13 nt, Shigella flexneri 2a str. 301
gcccgacgauaca

SEQ ID NO: 1960624 - RNA, 21 nt, Shigella flexneri 2a str. 301
gagcaccgcgugcgcggcagc

SEQ ID NO: 1960625 - RNA, 23 nt, Shigella flexneri 2a str. 301
gagaucuuuaucaaucaccgcuu

SEQ ID NO: 1960626 - RNA, 14 nt, Shigella flexneri 2a str. 301
gagacaaucgccac

SEQ ID NO: 1960627 - RNA, 21 nt, Shigella flexneri 2a str. 301
gagacagcuuagacagcgccg

SEQ ID NO: 1960628 - RNA, 15 nt, Shigella flexneri 2a str. 301
gagacagaaucaggc

SEQ ID NO: 1960629 - RNA, 22 nt, Shigella flexneri 2a str. 301
gagaagucggcuuuuagcgaca

SEQ ID NO: 1960630 - RNA, 15 nt, Shigella flexneri 2a str. 301
gagagaacugcgcca

SEQ ID NO: 1960631 - RNA, 13 nt, Shigella flexneri 2a str. 301
gagagaagccaga

SEQ ID NO: 1960632 - RNA, 12 nt, Shigella flexneri 2a str. 301
gagagcagcauc

SEQ ID NO: 1960633 - RNA, 17 nt, Shigella flexneri 2a str. 301
gagauaaccacguucau

SEQ ID NO: 1960634 - RNA, 13 nt, Shigella flexneri 2a str. 301
gagauaauauccu

SEQ ID NO: 1960635 - RNA, 13 nt, Shigella flexneri 2a str. 301
gagaucgccgcug

SEQ ID NO: 1960636 - RNA, 21 nt, Shigella flexneri 2a str. 301
gagauccggaucccaccagac

SEQ ID NO: 1960637 - RNA, 14 nt, Shigella flexneri 2a str. 301
gagcaggucaguca

SEQ ID NO: 1960638 - RNA, 15 nt, Shigella flexneri 2a str. 301
gagcauaggcauuaa

SEQ ID NO: 1960639 - RNA, 19 nt, Shigella flexneri 2a str. 301
gagcaucaguuaacggcac

SEQ ID NO: 1960640 - RNA, 20 nt, Shigella flexneri 2a str. 301
aacuccauacaucuucauca

SEQ ID NO: 1960641 - RNA, 14 nt, Shigella flexneri 2a str. 301
aacucaucgccgcu

SEQ ID NO: 1960642 - RNA, 13 nt, Shigella flexneri 2a str. 301
aacucaccaucaa

SEQ ID NO: 1960643 - RNA, 19 nt, Shigella flexneri 2a str. 301
aacucaccaucaaguagca

SEQ ID NO: 1960644 - RNA, 11 nt, Shigella flexneri 2a str. 301
aacuccgucgc

SEQ ID NO: 1960645 - RNA, 19 nt, Shigella flexneri 2a str. 301
gagcgccguugcgcccauc

SEQ ID NO: 1960646 - RNA, 15 nt, Shigella flexneri 2a str. 301
gacuccagcgccagc

SEQ ID NO: 1960647 - RNA, 20 nt, Shigella flexneri 2a str. 301
gacuauuaugaauuuacucu

SEQ ID NO: 1960648 - RNA, 13 nt, Shigella flexneri 2a str. 301
gacuauuugacac

SEQ ID NO: 1960649 - RNA, 13 nt, Shigella flexneri 2a str. 301
gacuaucauugcg

SEQ ID NO: 1960650 - RNA, 18 nt, Shigella flexneri 2a str. 301
gacgugcucgaacauccc

SEQ ID NO: 1960651 - RNA, 16 nt, Shigella flexneri 2a str. 301
gacguucgcguacugc

SEQ ID NO: 1960652 - RNA, 19 nt, Shigella flexneri 2a str. 301
gacguugauaaccacggcg

SEQ ID NO: 1960653 - RNA, 12 nt, Shigella flexneri 2a str. 301
gacgacaccauc

SEQ ID NO: 1960654 - RNA, 16 nt, Shigella flexneri 2a str. 301
gacguccggcgcugca

SEQ ID NO: 1960655 - RNA, 16 nt, Shigella flexneri 2a str. 301
gacguccaaucagcac

SEQ ID NO: 1960656 - RNA, 22 nt, Shigella flexneri 2a str. 301
gacugauguguaggucgcauag

SEQ ID NO: 1960657 - RNA, 18 nt, Shigella flexneri 2a str. 301
gacugaccgaaaccguaa

SEQ ID NO: 1960658 - RNA, 19 nt, Shigella flexneri 2a str. 301
gacuguacagauccgccau

SEQ ID NO: 1960659 - RNA, 16 nt, Shigella flexneri 2a str. 301
aacgugcuucgcgcug

SEQ ID NO: 1960660 - RNA, 14 nt, Shigella flexneri 2a str. 301
gacuguaggccgga

SEQ ID NO: 1960661 - RNA, 20 nt, Shigella flexneri 2a str. 301
aacgugcgguuucccggcag

SEQ ID NO: 1960662 - RNA, 17 nt, Shigella flexneri 2a str. 301
gacugcagcggucacau

SEQ ID NO: 1960663 - RNA, 12 nt, Shigella flexneri 2a str. 301
gacugcagcggu

SEQ ID NO: 1960664 - RNA, 18 nt, Shigella flexneri 2a str. 301
gacugcgcgccgccgcug

SEQ ID NO: 1960665 - RNA, 16 nt, Shigella flexneri 2a str. 301
gagaaagaaacgccau

SEQ ID NO: 1960666 - RNA, 20 nt, Shigella flexneri 2a str. 301
gagaaaguaaaccaccaguc

SEQ ID NO: 1960667 - RNA, 16 nt, Shigella flexneri 2a str. 301
gagaacaccaccugcc

SEQ ID NO: 1960668 - RNA, 14 nt, Shigella flexneri 2a str. 301
gagaaaaccggugu

SEQ ID NO: 1960669 - RNA, 17 nt, Shigella flexneri 2a str. 301
gacuuugaaagcguuua

SEQ ID NO: 1960670 - RNA, 12 nt, Shigella flexneri 2a str. 301
gacuuugccugg

SEQ ID NO: 1960671 - RNA, 23 nt, Shigella flexneri 2a str. 301
gacuuuucaggcuagccgccagc

SEQ ID NO: 1960672 - RNA, 16 nt, Shigella flexneri 2a str. 301
gagaacagcaguuguu

SEQ ID NO: 1960673 - RNA, 14 nt, Shigella flexneri 2a str. 301
gagaacgacauggc

SEQ ID NO: 1960674 - RNA, 22 nt, Shigella flexneri 2a str. 301
aacguugggaucaguaaacgcu

SEQ ID NO: 1960675 - RNA, 19 nt, Shigella flexneri 2a str. 301
aacguugagaauggccaau

SEQ ID NO: 1960676 - RNA, 17 nt, Shigella flexneri 2a str. 301
aacguuugauuaacgcc

SEQ ID NO: 1960677 - RNA, 20 nt, Shigella flexneri 2a str. 301
aacguguuuauauuugaaca

SEQ ID NO: 1960678 - RNA, 20 nt, Shigella flexneri 2a str. 301
aacuaaaacuuuauucagug

SEQ ID NO: 1960679 - RNA, 18 nt, Shigella flexneri 2a str. 301
aacuaucgacgcaaacgc

SEQ ID NO: 1960680 - RNA, 14 nt, Shigella flexneri 2a str. 301
aacucaacgccuuc

SEQ ID NO: 1960681 - RNA, 22 nt, Shigella flexneri 2a str. 301
gacuucaaaaauaaguugccac

SEQ ID NO: 1960682 - RNA, 17 nt, Shigella flexneri 2a str. 301
gacuuauaagucucaga

SEQ ID NO: 1960683 - RNA, 13 nt, Shigella flexneri 2a str. 301
gagggagcguccu

SEQ ID NO: 1960684 - RNA, 21 nt, Shigella flexneri 2a str. 301
gagucaagggugucggcacac

SEQ ID NO: 1960685 - RNA, 16 nt, Shigella flexneri 2a str. 301
gagguuauccgccagc

SEQ ID NO: 1960686 - RNA, 20 nt, Shigella flexneri 2a str. 301
gaguguuauaaaacgcgccc

SEQ ID NO: 1960687 - RNA, 18 nt, Shigella flexneri 2a str. 301
gaguggaguccagcgccu

SEQ ID NO: 1960688 - RNA, 17 nt, Shigella flexneri 2a str. 301
gagucagcccaacaaag

SEQ ID NO: 1960689 - RNA, 13 nt, Shigella flexneri 2a str. 301
gauaagacgcgca

SEQ ID NO: 1960690 - RNA, 13 nt, Shigella flexneri 2a str. 301
gauaaauacagcg

SEQ ID NO: 1960691 - RNA, 14 nt, Shigella flexneri 2a str. 301
gauaaagcauaccg

SEQ ID NO: 1960692 - RNA, 15 nt, Shigella flexneri 2a str. 301
gaguuuuaaacgcag

SEQ ID NO: 1960693 - RNA, 19 nt, Shigella flexneri 2a str. 301
gaguugcuccacugcucac

SEQ ID NO: 1960694 - RNA, 13 nt, Shigella flexneri 2a str. 301
gaguuuccaucag

SEQ ID NO: 1960695 - RNA, 17 nt, Shigella flexneri 2a str. 301
gauacgagagccggaag

SEQ ID NO: 1960696 - RNA, 22 nt, Shigella flexneri 2a str. 301
gauacgaccguuccauucaaac

SEQ ID NO: 1960697 - RNA, 18 nt, Shigella flexneri 2a str. 301
gauaauucagcagggcga

SEQ ID NO: 1960698 - RNA, 19 nt, Shigella flexneri 2a str. 301
gauaccgauagauucagca

SEQ ID NO: 1960699 - RNA, 14 nt, Shigella flexneri 2a str. 301
gauaagacgcguca

SEQ ID NO: 1960700 - RNA, 14 nt, Shigella flexneri 2a str. 301
gauaagacgcgcua

SEQ ID NO: 1960701 - RNA, 14 nt, Shigella flexneri 2a str. 301
gauaauacgcguaa

SEQ ID NO: 1960702 - RNA, 19 nt, Shigella flexneri 2a str. 301
gauaaguuaaccccaguaa

SEQ ID NO: 1960703 - RNA, 21 nt, Shigella flexneri 2a str. 301
gauaauccgguuuacccgcuu

SEQ ID NO: 1960704 - RNA, 14 nt, Shigella flexneri 2a str. 301
gauaaucgcuuucg

SEQ ID NO: 1960705 - RNA, 18 nt, Shigella flexneri 2a str. 301
gaucaagcacaugcugac

SEQ ID NO: 1960706 - RNA, 20 nt, Shigella flexneri 2a str. 301
gaucacccacaucagcggca

SEQ ID NO: 1960707 - RNA, 16 nt, Shigella flexneri 2a str. 301
gaucaaauuauuacca

SEQ ID NO: 1960708 - RNA, 13 nt, Shigella flexneri 2a str. 301
gauaucgccgguu

SEQ ID NO: 1960709 - RNA, 19 nt, Shigella flexneri 2a str. 301
gauaucgauaaagaacgca

SEQ ID NO: 1960710 - RNA, 16 nt, Shigella flexneri 2a str. 301
gauagugauccaucag

SEQ ID NO: 1960711 - RNA, 18 nt, Shigella flexneri 2a str. 301
gaucgcuucggucugcgg

SEQ ID NO: 1960712 - RNA, 20 nt, Shigella flexneri 2a str. 301
gaucgugugccaccagcgca

SEQ ID NO: 1960713 - RNA, 18 nt, Shigella flexneri 2a str. 301
gaucguguaacguacugc

SEQ ID NO: 1960714 - RNA, 19 nt, Shigella flexneri 2a str. 301
gaucuaugucgcauccggc

SEQ ID NO: 1960715 - RNA, 14 nt, Shigella flexneri 2a str. 301
gaucucgguaacga

SEQ ID NO: 1960716 - RNA, 15 nt, Shigella flexneri 2a str. 301
gaucgggcauuucca

SEQ ID NO: 1960717 - RNA, 17 nt, Shigella flexneri 2a str. 301
gaucgggucaccgccga

SEQ ID NO: 1960718 - RNA, 15 nt, Shigella flexneri 2a str. 301
gaucccaccagacgu

SEQ ID NO: 1960719 - RNA, 18 nt, Shigella flexneri 2a str. 301
gaucgacgcguccaggcu

SEQ ID NO: 1960720 - RNA, 17 nt, Shigella flexneri 2a str. 301
gauccggacaugcugca

SEQ ID NO: 1960721 - RNA, 22 nt, Shigella flexneri 2a str. 301
gaucgccccggaagcaucaaac

SEQ ID NO: 1960722 - RNA, 17 nt, Shigella flexneri 2a str. 301
gaucgccccggucauca

SEQ ID NO: 1960723 - RNA, 13 nt, Shigella flexneri 2a str. 301
gaucgcccgccaa

SEQ ID NO: 1960724 - RNA, 18 nt, Shigella flexneri 2a str. 301
gaucgccugaauuacugg

SEQ ID NO: 1960725 - RNA, 17 nt, Shigella flexneri 2a str. 301
gcacgccggauuugaga

SEQ ID NO: 1960726 - RNA, 16 nt, Shigella flexneri 2a str. 301
gcacgccgagcgcauc

SEQ ID NO: 1960727 - RNA, 12 nt, Shigella flexneri 2a str. 301
gcacgcuggaga

SEQ ID NO: 1960728 - RNA, 20 nt, Shigella flexneri 2a str. 301
gcacgguggucaggcgcgga

SEQ ID NO: 1960729 - RNA, 22 nt, Shigella flexneri 2a str. 301
gcacggugcaucuucacacuga

SEQ ID NO: 1960730 - RNA, 19 nt, Shigella flexneri 2a str. 301
gcacggugcaucuucacac

SEQ ID NO: 1960731 - RNA, 18 nt, Shigella flexneri 2a str. 301
gcaccuuuacgccaggca

SEQ ID NO: 1960732 - RNA, 20 nt, Shigella flexneri 2a str. 301
gcacgauuuguaggccggau

SEQ ID NO: 1960733 - RNA, 17 nt, Shigella flexneri 2a str. 301
gcacagcacgcuuuuca

SEQ ID NO: 1960734 - RNA, 13 nt, Shigella flexneri 2a str. 301
gcacagaugcgac

SEQ ID NO: 1960735 - RNA, 21 nt, Shigella flexneri 2a str. 301
gcagacguuuuuucugcccca

SEQ ID NO: 1960736 - RNA, 17 nt, Shigella flexneri 2a str. 301
gcagacuuuuugcggca

SEQ ID NO: 1960737 - RNA, 19 nt, Shigella flexneri 2a str. 301
gcagagccugaauaaacgc

SEQ ID NO: 1960738 - RNA, 23 nt, Shigella flexneri 2a str. 301
gcagagaucauacagaugcugcu

SEQ ID NO: 1960739 - RNA, 15 nt, Shigella flexneri 2a str. 301
gcagaaugguuucau

SEQ ID NO: 1960740 - RNA, 17 nt, Shigella flexneri 2a str. 301
gcagaagcgcgugcuaa

SEQ ID NO: 1960741 - RNA, 13 nt, Shigella flexneri 2a str. 301
gcagaagcaauca

SEQ ID NO: 1960742 - RNA, 17 nt, Shigella flexneri 2a str. 301
gcacguuuugcggaugc

SEQ ID NO: 1960743 - RNA, 20 nt, Shigella flexneri 2a str. 301
gcagcagaaagcgacuuugc

SEQ ID NO: 1960744 - RNA, 21 nt, Shigella flexneri 2a str. 301
gcagcagccgguauccagcgc

SEQ ID NO: 1960745 - RNA, 22 nt, Shigella flexneri 2a str. 301
gcagcagccgguauccagcgcg

SEQ ID NO: 1960746 - RNA, 12 nt, Shigella flexneri 2a str. 301
gcagcaccauca

SEQ ID NO: 1960747 - RNA, 21 nt, Shigella flexneri 2a str. 301
gcagcacccagaacgccgaau

SEQ ID NO: 1960748 - RNA, 17 nt, Shigella flexneri 2a str. 301
gcagaucggcauucaca

SEQ ID NO: 1960749 - RNA, 16 nt, Shigella flexneri 2a str. 301
gcagauccugaaauuc

SEQ ID NO: 1960750 - RNA, 18 nt, Shigella flexneri 2a str. 301
gcagauccugaaauuccu

SEQ ID NO: 1960751 - RNA, 19 nt, Shigella flexneri 2a str. 301
gcagccagggucaacauaa

SEQ ID NO: 1960752 - RNA, 15 nt, Shigella flexneri 2a str. 301
gcagccagugauuaa

SEQ ID NO: 1960753 - RNA, 18 nt, Shigella flexneri 2a str. 301
gcagcauucagguugauc

SEQ ID NO: 1960754 - RNA, 13 nt, Shigella flexneri 2a str. 301
gcagcagcgguug

SEQ ID NO: 1960755 - RNA, 15 nt, Shigella flexneri 2a str. 301
gcagcaucgucauca

SEQ ID NO: 1960756 - RNA, 13 nt, Shigella flexneri 2a str. 301
gcagcaucaccgg

SEQ ID NO: 1960757 - RNA, 16 nt, Shigella flexneri 2a str. 301
gcagccaucacugacu

SEQ ID NO: 1960758 - RNA, 17 nt, Shigella flexneri 2a str. 301
gcagccaucaccacgcu

SEQ ID NO: 1960759 - RNA, 15 nt, Shigella flexneri 2a str. 301
gcagccgccagaaau

SEQ ID NO: 1960760 - RNA, 20 nt, Shigella flexneri 2a str. 301
gcagccgucgccaguaccag

SEQ ID NO: 1960761 - RNA, 20 nt, Shigella flexneri 2a str. 301
gcagccuucauucaggcauu

SEQ ID NO: 1960762 - RNA, 23 nt, Shigella flexneri 2a str. 301
gaugggcgaagagaaagaacgag

SEQ ID NO: 1960763 - RNA, 19 nt, Shigella flexneri 2a str. 301
gauggucacggacagguga

SEQ ID NO: 1960764 - RNA, 16 nt, Shigella flexneri 2a str. 301
gauggcgggacagcau

SEQ ID NO: 1960765 - RNA, 18 nt, Shigella flexneri 2a str. 301
gauggcguagcagcagcg

SEQ ID NO: 1960766 - RNA, 18 nt, Shigella flexneri 2a str. 301
gaugugaacuugcucauc

SEQ ID NO: 1960767 - RNA, 18 nt, Shigella flexneri 2a str. 301
gaugugagcgauacccau

SEQ ID NO: 1960768 - RNA, 13 nt, Shigella flexneri 2a str. 301
gaugcggcgugaa

SEQ ID NO: 1960769 - RNA, 16 nt, Shigella flexneri 2a str. 301
gaugcggcgugaacgc

SEQ ID NO: 1960770 - RNA, 20 nt, Shigella flexneri 2a str. 301
gaugcggcgugaacgccuua

SEQ ID NO: 1960771 - RNA, 20 nt, Shigella flexneri 2a str. 301
gaugcggcgugaaugccuua

SEQ ID NO: 1960772 - RNA, 20 nt, Shigella flexneri 2a str. 301
gaugcggcgugaccgccuua

SEQ ID NO: 1960773 - RNA, 20 nt, Shigella flexneri 2a str. 301
gaugcggcguaaaugccuua

SEQ ID NO: 1960774 - RNA, 20 nt, Shigella flexneri 2a str. 301
gaugcggcguaaacgccuua

SEQ ID NO: 1960775 - RNA, 12 nt, Shigella flexneri 2a str. 301
gaugcggcguaa

SEQ ID NO: 1960776 - RNA, 14 nt, Shigella flexneri 2a str. 301
aacuuagauugcaa

SEQ ID NO: 1960777 - RNA, 19 nt, Shigella flexneri 2a str. 301
gaucugcgcccaauauccu

SEQ ID NO: 1960778 - RNA, 18 nt, Shigella flexneri 2a str. 301
gauggaagaaaccagcgu

SEQ ID NO: 1960779 - RNA, 18 nt, Shigella flexneri 2a str. 301
gauggaauuucaucauca

SEQ ID NO: 1960780 - RNA, 14 nt, Shigella flexneri 2a str. 301
gaugcuugauuucg

SEQ ID NO: 1960781 - RNA, 14 nt, Shigella flexneri 2a str. 301
gcaaaggcguuaua

SEQ ID NO: 1960782 - RNA, 22 nt, Shigella flexneri 2a str. 301
gcaaaggcguuauacugcggca

SEQ ID NO: 1960783 - RNA, 21 nt, Shigella flexneri 2a str. 301
gcaaauucucuauuucacccg

SEQ ID NO: 1960784 - RNA, 14 nt, Shigella flexneri 2a str. 301
gcaacaauggcauu

SEQ ID NO: 1960785 - RNA, 18 nt, Shigella flexneri 2a str. 301
gauuuuuugccagcacca

SEQ ID NO: 1960786 - RNA, 19 nt, Shigella flexneri 2a str. 301
gauuugguucggucacggc

SEQ ID NO: 1960787 - RNA, 12 nt, Shigella flexneri 2a str. 301
gcaaaaacgcau

SEQ ID NO: 1960788 - RNA, 16 nt, Shigella flexneri 2a str. 301
gcaaaaaucggcaaca

SEQ ID NO: 1960789 - RNA, 14 nt, Shigella flexneri 2a str. 301
gcaaaacacccgca

SEQ ID NO: 1960790 - RNA, 13 nt, Shigella flexneri 2a str. 301
gcaaaaaugccuu

SEQ ID NO: 1960791 - RNA, 18 nt, Shigella flexneri 2a str. 301
gcaaaauacugaacaggc

SEQ ID NO: 1960792 - RNA, 15 nt, Shigella flexneri 2a str. 301
gcaaaccaggccggu

SEQ ID NO: 1960793 - RNA, 17 nt, Shigella flexneri 2a str. 301
gcaaacaguucugcagc

SEQ ID NO: 1960794 - RNA, 21 nt, Shigella flexneri 2a str. 301
gcaaagagaacugagcgauca

SEQ ID NO: 1960795 - RNA, 20 nt, Shigella flexneri 2a str. 301
gauuauucgggaucugaugg

SEQ ID NO: 1960796 - RNA, 11 nt, Shigella flexneri 2a str. 301
gauucgaaccu

SEQ ID NO: 1960797 - RNA, 16 nt, Shigella flexneri 2a str. 301
gauuguauugauugcu

SEQ ID NO: 1960798 - RNA, 18 nt, Shigella flexneri 2a str. 301
gauuggucgcucgcgccg

SEQ ID NO: 1960799 - RNA, 18 nt, Shigella flexneri 2a str. 301
gauugcuccugcucauca

SEQ ID NO: 1960800 - RNA, 17 nt, Shigella flexneri 2a str. 301
gauugcuucaguugccu

SEQ ID NO: 1960801 - RNA, 15 nt, Shigella flexneri 2a str. 301
gauugcucaacgccg

SEQ ID NO: 1960802 - RNA, 17 nt, Shigella flexneri 2a str. 301
gauugaccgccagcgcc

SEQ ID NO: 1960803 - RNA, 14 nt, Shigella flexneri 2a str. 301
gauucuggcguuaa

SEQ ID NO: 1960804 - RNA, 21 nt, Shigella flexneri 2a str. 301
gcaaugcccgguguucccgcg

SEQ ID NO: 1960805 - RNA, 12 nt, Shigella flexneri 2a str. 301
gcaaugcgcaca

SEQ ID NO: 1960806 - RNA, 14 nt, Shigella flexneri 2a str. 301
gcaauggguaacgg

SEQ ID NO: 1960807 - RNA, 19 nt, Shigella flexneri 2a str. 301
gcaaugugcucuaacccuu

SEQ ID NO: 1960808 - RNA, 20 nt, Shigella flexneri 2a str. 301
gcaaucuccguguaggccug

SEQ ID NO: 1960809 - RNA, 21 nt, Shigella flexneri 2a str. 301
gcaaucuccguguaggccuga

SEQ ID NO: 1960810 - RNA, 15 nt, Shigella flexneri 2a str. 301
gcaaucuccugcgca

SEQ ID NO: 1960811 - RNA, 21 nt, Shigella flexneri 2a str. 301
gcacaagaugccugaugcgac

SEQ ID NO: 1960812 - RNA, 18 nt, Shigella flexneri 2a str. 301
gcacaaauuugccgucga

SEQ ID NO: 1960813 - RNA, 12 nt, Shigella flexneri 2a str. 301
gcacacguuuca

SEQ ID NO: 1960814 - RNA, 23 nt, Shigella flexneri 2a str. 301
gcacaccgcugacuuucaaacgc

SEQ ID NO: 1960815 - RNA, 22 nt, Shigella flexneri 2a str. 301
gcaaucacuuccucaagcguuu

SEQ ID NO: 1960816 - RNA, 17 nt, Shigella flexneri 2a str. 301
gcaaucaaaaaaggcug

SEQ ID NO: 1960817 - RNA, 18 nt, Shigella flexneri 2a str. 301
gcaauauuuuguugcaua

SEQ ID NO: 1960818 - RNA, 17 nt, Shigella flexneri 2a str. 301
gcaauacccugacccag

SEQ ID NO: 1960819 - RNA, 15 nt, Shigella flexneri 2a str. 301
gcaauagcacugcuu

SEQ ID NO: 1960820 - RNA, 22 nt, Shigella flexneri 2a str. 301
gcaauagcuucuuccacauugu

SEQ ID NO: 1960821 - RNA, 19 nt, Shigella flexneri 2a str. 301
gcaauccaccauuggcgca

SEQ ID NO: 1960822 - RNA, 15 nt, Shigella flexneri 2a str. 301
gcaauccccgccagc

SEQ ID NO: 1960823 - RNA, 20 nt, Shigella flexneri 2a str. 301
gcaaucaucuuguaggccug

SEQ ID NO: 1960824 - RNA, 16 nt, Shigella flexneri 2a str. 301
gcaaucgccagcggca

SEQ ID NO: 1960825 - RNA, 14 nt, Shigella flexneri 2a str. 301
gcaaucgccagcgg

SEQ ID NO: 1960826 - RNA, 22 nt, Shigella flexneri 2a str. 301
gcaaucgagcccagaugccgga

SEQ ID NO: 1960827 - RNA, 21 nt, Shigella flexneri 2a str. 301
gcaauaaugccagucccgcga

SEQ ID NO: 1960828 - RNA, 23 nt, Shigella flexneri 2a str. 301
gcaauaaucucuuuacccagcgg

SEQ ID NO: 1960829 - RNA, 20 nt, Shigella flexneri 2a str. 301
gcaacguguuuguucaacga

SEQ ID NO: 1960830 - RNA, 23 nt, Shigella flexneri 2a str. 301
gcaacgucggaaaccgcuuugcc

SEQ ID NO: 1960831 - RNA, 20 nt, Shigella flexneri 2a str. 301
gcaacgcuucaaccaacgca

SEQ ID NO: 1960832 - RNA, 19 nt, Shigella flexneri 2a str. 301
gcaacgaacuaaccgcgcu

SEQ ID NO: 1960833 - RNA, 22 nt, Shigella flexneri 2a str. 301
gcaacgaaguaauaaucaacgc

SEQ ID NO: 1960834 - RNA, 16 nt, Shigella flexneri 2a str. 301
gcaaccuuuuccauug

SEQ ID NO: 1960835 - RNA, 13 nt, Shigella flexneri 2a str. 301
gcaaccguaaacg

SEQ ID NO: 1960836 - RNA, 13 nt, Shigella flexneri 2a str. 301
gcaacgaccagaa

SEQ ID NO: 1960837 - RNA, 19 nt, Shigella flexneri 2a str. 301
gcaagcgggcggugguauu

SEQ ID NO: 1960838 - RNA, 16 nt, Shigella flexneri 2a str. 301
gcaagcggcggcaaug

SEQ ID NO: 1960839 - RNA, 20 nt, Shigella flexneri 2a str. 301
gcaagcccagcacccaguaa

SEQ ID NO: 1960840 - RNA, 14 nt, Shigella flexneri 2a str. 301
gcaagccgcuaaca

SEQ ID NO: 1960841 - RNA, 13 nt, Shigella flexneri 2a str. 301
gcaacucaaucgc

SEQ ID NO: 1960842 - RNA, 14 nt, Shigella flexneri 2a str. 301
gcaacugcgcugca

SEQ ID NO: 1960843 - RNA, 18 nt, Shigella flexneri 2a str. 301
gcaacugcggcgcaagcg

SEQ ID NO: 1960844 - RNA, 18 nt, Shigella flexneri 2a str. 301
gcaacugcugcgguugaa

SEQ ID NO: 1960845 - RNA, 16 nt, Shigella flexneri 2a str. 301
ggcggcucuccugaac

SEQ ID NO: 1960846 - RNA, 18 nt, Shigella flexneri 2a str. 301
ggcgggaagaacggcaac

SEQ ID NO: 1960847 - RNA, 22 nt, Shigella flexneri 2a str. 301
ggcggaauugguagacgcgcua

SEQ ID NO: 1960848 - RNA, 19 nt, Shigella flexneri 2a str. 301
ggcggcaacauggcaaccu

SEQ ID NO: 1960849 - RNA, 13 nt, Shigella flexneri 2a str. 301
ggcguauauugca

SEQ ID NO: 1960850 - RNA, 16 nt, Shigella flexneri 2a str. 301
ggcgguaaaaucaucc

SEQ ID NO: 1960851 - RNA, 19 nt, Shigella flexneri 2a str. 301
ggcgguaauggcgcucuca

SEQ ID NO: 1960852 - RNA, 17 nt, Shigella flexneri 2a str. 301
aaggugcaucggggaau

SEQ ID NO: 1960853 - RNA, 23 nt, Shigella flexneri 2a str. 301
aagguugucgauaccaauauccu

SEQ ID NO: 1960854 - RNA, 16 nt, Shigella flexneri 2a str. 301
aaggucgacagcagcc

SEQ ID NO: 1960855 - RNA, 19 nt, Shigella flexneri 2a str. 301
ggcgcuaucaauacuuucc

SEQ ID NO: 1960856 - RNA, 15 nt, Shigella flexneri 2a str. 301
ggcgcaggauaucgu

SEQ ID NO: 1960857 - RNA, 15 nt, Shigella flexneri 2a str. 301
ggcgcaagcggcgac

SEQ ID NO: 1960858 - RNA, 16 nt, Shigella flexneri 2a str. 301
aaggguuucgcgguug

SEQ ID NO: 1960859 - RNA, 14 nt, Shigella flexneri 2a str. 301
aagggguuguaauc

SEQ ID NO: 1960860 - RNA, 14 nt, Shigella flexneri 2a str. 301
ggcgagccagcgca

SEQ ID NO: 1960861 - RNA, 16 nt, Shigella flexneri 2a str. 301
ggccucuccuuuacca

SEQ ID NO: 1960862 - RNA, 17 nt, Shigella flexneri 2a str. 301
ggccucuuacgccgcca

SEQ ID NO: 1960863 - RNA, 18 nt, Shigella flexneri 2a str. 301
aaggcguacacgccgcau

SEQ ID NO: 1960864 - RNA, 23 nt, Shigella flexneri 2a str. 301
aaggcgucaauuuguuccgccag

SEQ ID NO: 1960865 - RNA, 19 nt, Shigella flexneri 2a str. 301
aaggcgaaaccuccgcaau

SEQ ID NO: 1960866 - RNA, 15 nt, Shigella flexneri 2a str. 301
ggcgaacauuccggu

SEQ ID NO: 1960867 - RNA, 19 nt, Shigella flexneri 2a str. 301
ggcgaaauugcugacgcaa

SEQ ID NO: 1960868 - RNA, 23 nt, Shigella flexneri 2a str. 301
ggccuuuuccgcgaugaucguca

SEQ ID NO: 1960869 - RNA, 12 nt, Shigella flexneri 2a str. 301
ggcgaaccgcug

SEQ ID NO: 1960870 - RNA, 18 nt, Shigella flexneri 2a str. 301
aaggcguucacgccgcau

SEQ ID NO: 1960871 - RNA, 20 nt, Shigella flexneri 2a str. 301
aaggcguucgcgccgcaucc

SEQ ID NO: 1960872 - RNA, 20 nt, Shigella flexneri 2a str. 301
aaggcguuuacgccgcaucc

SEQ ID NO: 1960873 - RNA, 12 nt, Shigella flexneri 2a str. 301
ggcgagagcuuu

SEQ ID NO: 1960874 - RNA, 22 nt, Shigella flexneri 2a str. 301
ggcgaauuaaucuuucugcgaa

SEQ ID NO: 1960875 - RNA, 19 nt, Shigella flexneri 2a str. 301
ggcgaauuaucggcagcgg

SEQ ID NO: 1960876 - RNA, 13 nt, Shigella flexneri 2a str. 301
ggccgccagaaac

SEQ ID NO: 1960877 - RNA, 16 nt, Shigella flexneri 2a str. 301
ggccgcguaccgcagc

SEQ ID NO: 1960878 - RNA, 20 nt, Shigella flexneri 2a str. 301
ggccuacauagucccugcaa

SEQ ID NO: 1960879 - RNA, 17 nt, Shigella flexneri 2a str. 301
ggccucgcuacgccagc

SEQ ID NO: 1960880 - RNA, 19 nt, Shigella flexneri 2a str. 301
ggccuacgcguccccugca

SEQ ID NO: 1960881 - RNA, 19 nt, Shigella flexneri 2a str. 301
ggccuaccaugaccugcaa

SEQ ID NO: 1960882 - RNA, 15 nt, Shigella flexneri 2a str. 301
ggccuaucaacgucg

SEQ ID NO: 1960883 - RNA, 22 nt, Shigella flexneri 2a str. 301
ggcagcaacggcaguuugcggu

SEQ ID NO: 1960884 - RNA, 22 nt, Shigella flexneri 2a str. 301
ggcagugcuuucauuucagcgu

SEQ ID NO: 1960885 - RNA, 20 nt, Shigella flexneri 2a str. 301
ggcaggggcuucuuccggcg

SEQ ID NO: 1960886 - RNA, 21 nt, Shigella flexneri 2a str. 301
ggcaucaccgcgaaauaauca

SEQ ID NO: 1960887 - RNA, 14 nt, Shigella flexneri 2a str. 301
ggcaucagcagaau

SEQ ID NO: 1960888 - RNA, 17 nt, Shigella flexneri 2a str. 301
ggcaucaucuuccggua

SEQ ID NO: 1960889 - RNA, 18 nt, Shigella flexneri 2a str. 301
ggcaaauucuucacggaa

SEQ ID NO: 1960890 - RNA, 23 nt, Shigella flexneri 2a str. 301
ggcaaauaacgccccggcaaaac

SEQ ID NO: 1960891 - RNA, 22 nt, Shigella flexneri 2a str. 301
ggcaauauagauaucaugcucu

SEQ ID NO: 1960892 - RNA, 14 nt, Shigella flexneri 2a str. 301
ggcaauaucgcggc

SEQ ID NO: 1960893 - RNA, 13 nt, Shigella flexneri 2a str. 301
ggcaaguuucgug

SEQ ID NO: 1960894 - RNA, 13 nt, Shigella flexneri 2a str. 301
ggcaauuucgcug

SEQ ID NO: 1960895 - RNA, 12 nt, Shigella flexneri 2a str. 301
ggcaauccguaa

SEQ ID NO: 1960896 - RNA, 12 nt, Shigella flexneri 2a str. 301
ggcaaucgccag

SEQ ID NO: 1960897 - RNA, 12 nt, Shigella flexneri 2a str. 301
ggcagaacgcuu

SEQ ID NO: 1960898 - RNA, 12 nt, Shigella flexneri 2a str. 301
ggcaccagcgca

SEQ ID NO: 1960899 - RNA, 21 nt, Shigella flexneri 2a str. 301
ggccaugggcgcgauaaugcg

SEQ ID NO: 1960900 - RNA, 20 nt, Shigella flexneri 2a str. 301
ggccauuuuuucgauaauca

SEQ ID NO: 1960901 - RNA, 10 nt, Shigella flexneri 2a str. 301
ggccaguugc

SEQ ID NO: 1960902 - RNA, 17 nt, Shigella flexneri 2a str. 301
ggccaguugcgccguca

SEQ ID NO: 1960903 - RNA, 19 nt, Shigella flexneri 2a str. 301
ggccaguuucauagugcaa

SEQ ID NO: 1960904 - RNA, 22 nt, Shigella flexneri 2a str. 301
ggccagucguaguggaucagca

SEQ ID NO: 1960905 - RNA, 14 nt, Shigella flexneri 2a str. 301
ggccagcgccacca

SEQ ID NO: 1960906 - RNA, 14 nt, Shigella flexneri 2a str. 301
ggccagccagagau

SEQ ID NO: 1960907 - RNA, 23 nt, Shigella flexneri 2a str. 301
aaggcaccuggaaauuuugcuga

SEQ ID NO: 1960908 - RNA, 19 nt, Shigella flexneri 2a str. 301
aaggcagaaacaaacgcaa

SEQ ID NO: 1960909 - RNA, 19 nt, Shigella flexneri 2a str. 301
ggagccacauagacgguuu

SEQ ID NO: 1960910 - RNA, 18 nt, Shigella flexneri 2a str. 301
ggagaagaugcgucagca

SEQ ID NO: 1960911 - RNA, 15 nt, Shigella flexneri 2a str. 301
ggacuucaucacgau

SEQ ID NO: 1960912 - RNA, 18 nt, Shigella flexneri 2a str. 301
ggacuggcugcguaagcg

SEQ ID NO: 1960913 - RNA, 23 nt, Shigella flexneri 2a str. 301
ggagcguccugcucgccacguca

SEQ ID NO: 1960914 - RNA, 23 nt, Shigella flexneri 2a str. 301
ggagucagacccugcucuuucag

SEQ ID NO: 1960915 - RNA, 15 nt, Shigella flexneri 2a str. 301
ggaggcgcugguaau

SEQ ID NO: 1960916 - RNA, 15 nt, Shigella flexneri 2a str. 301
ggaguugaucgccaa

SEQ ID NO: 1960917 - RNA, 19 nt, Shigella flexneri 2a str. 301
ggauaaaucuccauuucau

SEQ ID NO: 1960918 - RNA, 12 nt, Shigella flexneri 2a str. 301
ggaucacuggca

SEQ ID NO: 1960919 - RNA, 19 nt, Shigella flexneri 2a str. 301
ggaauuaacgauacuucug

SEQ ID NO: 1960920 - RNA, 21 nt, Shigella flexneri 2a str. 301
ggaaugcauuguuacaccguc

SEQ ID NO: 1960921 - RNA, 19 nt, Shigella flexneri 2a str. 301
ggaaucgcaaagccgauac

SEQ ID NO: 1960922 - RNA, 20 nt, Shigella flexneri 2a str. 301
ggaagguuuuaaucgcuauc

SEQ ID NO: 1960923 - RNA, 12 nt, Shigella flexneri 2a str. 301
ggaagaguuugu

SEQ ID NO: 1960924 - RNA, 19 nt, Shigella flexneri 2a str. 301
ggaagcgucaaggucaaca

SEQ ID NO: 1960925 - RNA, 23 nt, Shigella flexneri 2a str. 301
ggaacgcaaaauucccaccagac

SEQ ID NO: 1960926 - RNA, 20 nt, Shigella flexneri 2a str. 301
ggacgaauuagcauggcuga

SEQ ID NO: 1960927 - RNA, 14 nt, Shigella flexneri 2a str. 301
ggacaaagagcuuu

SEQ ID NO: 1960928 - RNA, 20 nt, Shigella flexneri 2a str. 301
ggaauuuuccuucggauuuc

SEQ ID NO: 1960929 - RNA, 14 nt, Shigella flexneri 2a str. 301
ggaccaauaaacgc

SEQ ID NO: 1960930 - RNA, 17 nt, Shigella flexneri 2a str. 301
gggcauggcgcagcgau

SEQ ID NO: 1960931 - RNA, 11 nt, Shigella flexneri 2a str. 301
gggcauuugca

SEQ ID NO: 1960932 - RNA, 17 nt, Shigella flexneri 2a str. 301
gggccgcugaacuggcg

SEQ ID NO: 1960933 - RNA, 17 nt, Shigella flexneri 2a str. 301
gggaucuucuuccgcgc

SEQ ID NO: 1960934 - RNA, 23 nt, Shigella flexneri 2a str. 301
gggcaaacaccgcuucaacagcg

SEQ ID NO: 1960935 - RNA, 13 nt, Shigella flexneri 2a str. 301
gggauucgaaccu

SEQ ID NO: 1960936 - RNA, 22 nt, Shigella flexneri 2a str. 301
gggcaccacgccggaugaaauc

SEQ ID NO: 1960937 - RNA, 22 nt, Shigella flexneri 2a str. 301
gggauauaacccucgcgcgaca

SEQ ID NO: 1960938 - RNA, 14 nt, Shigella flexneri 2a str. 301
gggaggauuucucc

SEQ ID NO: 1960939 - RNA, 12 nt, Shigella flexneri 2a str. 301
ggcgucaaacgg

SEQ ID NO: 1960940 - RNA, 21 nt, Shigella flexneri 2a str. 301
gggcugugggguauuuccagg

SEQ ID NO: 1960941 - RNA, 21 nt, Shigella flexneri 2a str. 301
gggcuuucaucacuugaucca

SEQ ID NO: 1960942 - RNA, 14 nt, Shigella flexneri 2a str. 301
ggggaaguugcguc

SEQ ID NO: 1960943 - RNA, 15 nt, Shigella flexneri 2a str. 301
aagguuuuaaucgcu

SEQ ID NO: 1960944 - RNA, 12 nt, Shigella flexneri 2a str. 301
ggggaucauucc

SEQ ID NO: 1960945 - RNA, 16 nt, Shigella flexneri 2a str. 301
gggcuggauuuuuccg

SEQ ID NO: 1960946 - RNA, 20 nt, Shigella flexneri 2a str. 301
gggcgauaaaucuccacccg

SEQ ID NO: 1960947 - RNA, 14 nt, Shigella flexneri 2a str. 301
gggccuagugcggu

SEQ ID NO: 1960948 - RNA, 12 nt, Shigella flexneri 2a str. 301
ggucacggcugu

SEQ ID NO: 1960949 - RNA, 17 nt, Shigella flexneri 2a str. 301
ggucgauguacuucaac

SEQ ID NO: 1960950 - RNA, 17 nt, Shigella flexneri 2a str. 301
ggucgauuaaauucacc

SEQ ID NO: 1960951 - RNA, 21 nt, Shigella flexneri 2a str. 301
ggucgauuaaauucaccaguu

SEQ ID NO: 1960952 - RNA, 20 nt, Shigella flexneri 2a str. 301
ggucgagcgacaggucagcg

SEQ ID NO: 1960953 - RNA, 23 nt, Shigella flexneri 2a str. 301
ggucaaguaauuaucuuuacuga

SEQ ID NO: 1960954 - RNA, 22 nt, Shigella flexneri 2a str. 301
gguauuagcgcaaagacggaug

SEQ ID NO: 1960955 - RNA, 19 nt, Shigella flexneri 2a str. 301
ggguguauucaugcccugc

SEQ ID NO: 1960956 - RNA, 20 nt, Shigella flexneri 2a str. 301
aaguagcgccauacugacua

SEQ ID NO: 1960957 - RNA, 21 nt, Shigella flexneri 2a str. 301
aaguacgcggcaauccccgcc

SEQ ID NO: 1960958 - RNA, 23 nt, Shigella flexneri 2a str. 301
gguaaccgaccuucacgcugcgc

SEQ ID NO: 1960959 - RNA, 23 nt, Shigella flexneri 2a str. 301
gguaaagccgugcugcugccaaa

SEQ ID NO: 1960960 - RNA, 17 nt, Shigella flexneri 2a str. 301
gguaacuuaucuguaau

SEQ ID NO: 1960961 - RNA, 14 nt, Shigella flexneri 2a str. 301
gguaaccgccagua

SEQ ID NO: 1960962 - RNA, 22 nt, Shigella flexneri 2a str. 301
gguaacggcgucaacaccgggu

SEQ ID NO: 1960963 - RNA, 22 nt, Shigella flexneri 2a str. 301
gguaaugaauggacuccaccgg

SEQ ID NO: 1960964 - RNA, 12 nt, Shigella flexneri 2a str. 301
gguaagugccac

SEQ ID NO: 1960965 - RNA, 16 nt, Shigella flexneri 2a str. 301
gguaagugcuggccaa

SEQ ID NO: 1960966 - RNA, 13 nt, Shigella flexneri 2a str. 301
gguaccagcaccg

SEQ ID NO: 1960967 - RNA, 16 nt, Shigella flexneri 2a str. 301
ggugauucaucggaua

SEQ ID NO: 1960968 - RNA, 20 nt, Shigella flexneri 2a str. 301
ggugcacaacaaucugcaaa

SEQ ID NO: 1960969 - RNA, 14 nt, Shigella flexneri 2a str. 301
ggugacaucgcccu

SEQ ID NO: 1960970 - RNA, 18 nt, Shigella flexneri 2a str. 301
ggugaagcgcccugcaau

SEQ ID NO: 1960971 - RNA, 18 nt, Shigella flexneri 2a str. 301
ggucuuagugcgcuguaa

SEQ ID NO: 1960972 - RNA, 14 nt, Shigella flexneri 2a str. 301
ggucugauauggau

SEQ ID NO: 1960973 - RNA, 18 nt, Shigella flexneri 2a str. 301
ggucugcuggaacuggcu

SEQ ID NO: 1960974 - RNA, 17 nt, Shigella flexneri 2a str. 301
ggugccagcaacuggcg

SEQ ID NO: 1960975 - RNA, 17 nt, Shigella flexneri 2a str. 301
ggugcgaccaaacugcu

SEQ ID NO: 1960976 - RNA, 15 nt, Shigella flexneri 2a str. 301
gucgccagacgcagc

SEQ ID NO: 1960977 - RNA, 15 nt, Shigella flexneri 2a str. 301
gucgcaucaggcauu

SEQ ID NO: 1960978 - RNA, 13 nt, Shigella flexneri 2a str. 301
gucggcaguucgu

SEQ ID NO: 1960979 - RNA, 19 nt, Shigella flexneri 2a str. 301
gucggcaauguagcgcugc

SEQ ID NO: 1960980 - RNA, 16 nt, Shigella flexneri 2a str. 301
gucggaugcgcuucgc

SEQ ID NO: 1960981 - RNA, 20 nt, Shigella flexneri 2a str. 301
gucgcuugcaggaucagcuc

SEQ ID NO: 1960982 - RNA, 17 nt, Shigella flexneri 2a str. 301
gucggccuuaaugccca

SEQ ID NO: 1960983 - RNA, 22 nt, Shigella flexneri 2a str. 301
gucauccggcgucauauuacug

SEQ ID NO: 1960984 - RNA, 19 nt, Shigella flexneri 2a str. 301
gucauauuucuguuugcgu

SEQ ID NO: 1960985 - RNA, 20 nt, Shigella flexneri 2a str. 301
gucaucaacgccauacggcu

SEQ ID NO: 1960986 - RNA, 15 nt, Shigella flexneri 2a str. 301
guccccacgccauac

SEQ ID NO: 1960987 - RNA, 15 nt, Shigella flexneri 2a str. 301
guccgguacgacaau

SEQ ID NO: 1960988 - RNA, 15 nt, Shigella flexneri 2a str. 301
guccgcguccgcugg

SEQ ID NO: 1960989 - RNA, 18 nt, Shigella flexneri 2a str. 301
gucccuuccgcaauacag

SEQ ID NO: 1960990 - RNA, 17 nt, Shigella flexneri 2a str. 301
guccuacacacgccagu

SEQ ID NO: 1960991 - RNA, 22 nt, Shigella flexneri 2a str. 301
guccugcucaaacuucgucaca

SEQ ID NO: 1960992 - RNA, 15 nt, Shigella flexneri 2a str. 301
aagucguaggccuga

SEQ ID NO: 1960993 - RNA, 18 nt, Shigella flexneri 2a str. 301
guauauuucgaaugcuca

SEQ ID NO: 1960994 - RNA, 13 nt, Shigella flexneri 2a str. 301
guagucggugcca

SEQ ID NO: 1960995 - RNA, 22 nt, Shigella flexneri 2a str. 301
aaguccccaguaaucgggcaac

SEQ ID NO: 1960996 - RNA, 19 nt, Shigella flexneri 2a str. 301
guaggccugauaagcguag

SEQ ID NO: 1960997 - RNA, 18 nt, Shigella flexneri 2a str. 301
aagucauuaccagcgagg

SEQ ID NO: 1960998 - RNA, 15 nt, Shigella flexneri 2a str. 301
guagcuuucaacgcu

SEQ ID NO: 1960999 - RNA, 20 nt, Shigella flexneri 2a str. 301
guagccaauaaaugccacca

SEQ ID NO: 1961000 - RNA, 16 nt, Shigella flexneri 2a str. 301
guacgggacagcaggu

SEQ ID NO: 1961001 - RNA, 17 nt, Shigella flexneri 2a str. 301
guacgaggauucgaacc

SEQ ID NO: 1961002 - RNA, 14 nt, Shigella flexneri 2a str. 301
guaccccugauaau

SEQ ID NO: 1961003 - RNA, 18 nt, Shigella flexneri 2a str. 301
guacccguucgaugcggu

SEQ ID NO: 1961004 - RNA, 23 nt, Shigella flexneri 2a str. 301
guaccgucaaucuucacgcgcag

SEQ ID NO: 1961005 - RNA, 18 nt, Shigella flexneri 2a str. 301
guacaaacgcuuuacuca

SEQ ID NO: 1961006 - RNA, 14 nt, Shigella flexneri 2a str. 301
guacaacgccguuu

SEQ ID NO: 1961007 - RNA, 17 nt, Shigella flexneri 2a str. 301
guacaccaacaucacgc

SEQ ID NO: 1961008 - RNA, 20 nt, Shigella flexneri 2a str. 301
guacaaauuuuaggcguuaa

SEQ ID NO: 1961009 - RNA, 20 nt, Shigella flexneri 2a str. 301
guacacaacaugcagcccag

SEQ ID NO: 1961010 - RNA, 12 nt, Shigella flexneri 2a str. 301
guacaugaagca

SEQ ID NO: 1961011 - RNA, 15 nt, Shigella flexneri 2a str. 301
gguuuuuugaacaga

SEQ ID NO: 1961012 - RNA, 23 nt, Shigella flexneri 2a str. 301
gguuuuucaguagacucaagcag

SEQ ID NO: 1961013 - RNA, 15 nt, Shigella flexneri 2a str. 301
guaaaaccaugccau

SEQ ID NO: 1961014 - RNA, 15 nt, Shigella flexneri 2a str. 301
guaaaauaacagcgg

SEQ ID NO: 1961015 - RNA, 21 nt, Shigella flexneri 2a str. 301
guaaagcccgccaucgcccau

SEQ ID NO: 1961016 - RNA, 19 nt, Shigella flexneri 2a str. 301
guaaaaggcgccauuuuca

SEQ ID NO: 1961017 - RNA, 17 nt, Shigella flexneri 2a str. 301
guaaaucggcgaagaga

SEQ ID NO: 1961018 - RNA, 17 nt, Shigella flexneri 2a str. 301
guaagguugucgauacc

SEQ ID NO: 1961019 - RNA, 16 nt, Shigella flexneri 2a str. 301
guaauaaccaacggcg

SEQ ID NO: 1961020 - RNA, 15 nt, Shigella flexneri 2a str. 301
guaaggccgaauacc

SEQ ID NO: 1961021 - RNA, 18 nt, Shigella flexneri 2a str. 301
guaacucacugaugccgu

SEQ ID NO: 1961022 - RNA, 15 nt, Shigella flexneri 2a str. 301
guaagcaaaggugcc

SEQ ID NO: 1961023 - RNA, 22 nt, Shigella flexneri 2a str. 301
guaagaggaauugauucaucaa

SEQ ID NO: 1961024 - RNA, 20 nt, Shigella flexneri 2a str. 301
gucacggcgacggcuggcaa

SEQ ID NO: 1961025 - RNA, 16 nt, Shigella flexneri 2a str. 301
gucacgccgaccagac

SEQ ID NO: 1961026 - RNA, 15 nt, Shigella flexneri 2a str. 301
gucacgaucgcgcca

SEQ ID NO: 1961027 - RNA, 13 nt, Shigella flexneri 2a str. 301
gucaccugcccuc

SEQ ID NO: 1961028 - RNA, 12 nt, Shigella flexneri 2a str. 301
gucagaugcggc

SEQ ID NO: 1961029 - RNA, 17 nt, Shigella flexneri 2a str. 301
gucacucgacagcaccg

SEQ ID NO: 1961030 - RNA, 17 nt, Shigella flexneri 2a str. 301
gucauaggugucaacca

SEQ ID NO: 1961031 - RNA, 19 nt, Shigella flexneri 2a str. 301
gucagccugcucaguugca

SEQ ID NO: 1961032 - RNA, 21 nt, Shigella flexneri 2a str. 301
gucagcaucauaccuccgcaa

SEQ ID NO: 1961033 - RNA, 17 nt, Shigella flexneri 2a str. 301
guauugcgcaaauguuu

SEQ ID NO: 1961034 - RNA, 19 nt, Shigella flexneri 2a str. 301
guauugccgaugaacggcg

SEQ ID NO: 1961035 - RNA, 14 nt, Shigella flexneri 2a str. 301
gucaaauaauuccu

SEQ ID NO: 1961036 - RNA, 19 nt, Shigella flexneri 2a str. 301
gucaaaacgcgacugcaaa

SEQ ID NO: 1961037 - RNA, 17 nt, Shigella flexneri 2a str. 301
guaugcgucagcaacau

SEQ ID NO: 1961038 - RNA, 22 nt, Shigella flexneri 2a str. 301
guaugcgucagcaacaugccgu

SEQ ID NO: 1961039 - RNA, 16 nt, Shigella flexneri 2a str. 301
guaucguaaucagcac

SEQ ID NO: 1961040 - RNA, 20 nt, Shigella flexneri 2a str. 301
gucaacuguacgccgacgcc

SEQ ID NO: 1961041 - RNA, 14 nt, Shigella flexneri 2a str. 301
gucaagaucggcga

SEQ ID NO: 1961042 - RNA, 22 nt, Shigella flexneri 2a str. 301
gucacaaauagagcgccggaaa

SEQ ID NO: 1961043 - RNA, 16 nt, Shigella flexneri 2a str. 301
gucacaggccaucaca

SEQ ID NO: 1961044 - RNA, 22 nt, Shigella flexneri 2a str. 301
gcguucgcgccgcauccggcau

SEQ ID NO: 1961045 - RNA, 17 nt, Shigella flexneri 2a str. 301
gcguucugccuggcgca

SEQ ID NO: 1961046 - RNA, 15 nt, Shigella flexneri 2a str. 301
gcguucugucgauaa

SEQ ID NO: 1961047 - RNA, 14 nt, Shigella flexneri 2a str. 301
gcguugagaaacgc

SEQ ID NO: 1961048 - RNA, 22 nt, Shigella flexneri 2a str. 301
gcguugagcaaucgacgccguu

SEQ ID NO: 1961049 - RNA, 23 nt, Shigella flexneri 2a str. 301
gcguuuuuucgauaucaagccau

SEQ ID NO: 1961050 - RNA, 13 nt, Shigella flexneri 2a str. 301
gcguuuugcagau

SEQ ID NO: 1961051 - RNA, 20 nt, Shigella flexneri 2a str. 301
gcuaaaugccgcguggccug

SEQ ID NO: 1961052 - RNA, 13 nt, Shigella flexneri 2a str. 301
gcuaacagcagca

SEQ ID NO: 1961053 - RNA, 14 nt, Shigella flexneri 2a str. 301
gcuaaaugccgcgu

SEQ ID NO: 1961054 - RNA, 19 nt, Shigella flexneri 2a str. 301
gcuaaagccguuaccgauu

SEQ ID NO: 1961055 - RNA, 17 nt, Shigella flexneri 2a str. 301
gcuaagcgccaccguca

SEQ ID NO: 1961056 - RNA, 17 nt, Shigella flexneri 2a str. 301
gcuaagcugggcggugg

SEQ ID NO: 1961057 - RNA, 21 nt, Shigella flexneri 2a str. 301
gcuaaggcuguuguagaccgg

SEQ ID NO: 1961058 - RNA, 16 nt, Shigella flexneri 2a str. 301
gcuaaggucaccaguu

SEQ ID NO: 1961059 - RNA, 14 nt, Shigella flexneri 2a str. 301
gcuaagccguuccg

SEQ ID NO: 1961060 - RNA, 20 nt, Shigella flexneri 2a str. 301
gcuaagauaccccagcgcaa

SEQ ID NO: 1961061 - RNA, 16 nt, Shigella flexneri 2a str. 301
gcuaauaccaaucgca

SEQ ID NO: 1961062 - RNA, 18 nt, Shigella flexneri 2a str. 301
gcuaauaccguuucgcag

SEQ ID NO: 1961063 - RNA, 14 nt, Shigella flexneri 2a str. 301
gcguuggcagguca

SEQ ID NO: 1961064 - RNA, 13 nt, Shigella flexneri 2a str. 301
gcguuggcaaugu

SEQ ID NO: 1961065 - RNA, 21 nt, Shigella flexneri 2a str. 301
gcguuggcgugacuucgccga

SEQ ID NO: 1961066 - RNA, 18 nt, Shigella flexneri 2a str. 301
gcguuuaucgacagacgc

SEQ ID NO: 1961067 - RNA, 22 nt, Shigella flexneri 2a str. 301
gcguuucgauacaacccgaagg

SEQ ID NO: 1961068 - RNA, 23 nt, Shigella flexneri 2a str. 301
gcguuugaacauuauuuuugcga

SEQ ID NO: 1961069 - RNA, 22 nt, Shigella flexneri 2a str. 301
gcuacgcuuaucaggccuacgc

SEQ ID NO: 1961070 - RNA, 21 nt, Shigella flexneri 2a str. 301
gcuacgcuuaucaggccuaca

SEQ ID NO: 1961071 - RNA, 14 nt, Shigella flexneri 2a str. 301
gcuauacagcagcc

SEQ ID NO: 1961072 - RNA, 15 nt, Shigella flexneri 2a str. 301
gcuaccgccagacca

SEQ ID NO: 1961073 - RNA, 20 nt, Shigella flexneri 2a str. 301
gcuacccugguuuccgcugu

SEQ ID NO: 1961074 - RNA, 14 nt, Shigella flexneri 2a str. 301
gcuaccugccgcca

SEQ ID NO: 1961075 - RNA, 12 nt, Shigella flexneri 2a str. 301
gcuaauucuguu

SEQ ID NO: 1961076 - RNA, 14 nt, Shigella flexneri 2a str. 301
gcuauauugcagga

SEQ ID NO: 1961077 - RNA, 16 nt, Shigella flexneri 2a str. 301
gcuaucagcgccacca

SEQ ID NO: 1961078 - RNA, 15 nt, Shigella flexneri 2a str. 301
gcuauuauaucgcuc

SEQ ID NO: 1961079 - RNA, 18 nt, Shigella flexneri 2a str. 301
gcuauuacuuuaagccuu

SEQ ID NO: 1961080 - RNA, 21 nt, Shigella flexneri 2a str. 301
gcuauuuuuugcaggccagau

SEQ ID NO: 1961081 - RNA, 19 nt, Shigella flexneri 2a str. 301
gcucaacaauaaacuggcu

SEQ ID NO: 1961082 - RNA, 14 nt, Shigella flexneri 2a str. 301
gcucaacaaaccgu

SEQ ID NO: 1961083 - RNA, 18 nt, Shigella flexneri 2a str. 301
gcucaaagacgcgguaaa

SEQ ID NO: 1961084 - RNA, 20 nt, Shigella flexneri 2a str. 301
gcucaaaggcauuaaacgca

SEQ ID NO: 1961085 - RNA, 16 nt, Shigella flexneri 2a str. 301
gcuauugcgccagccu

SEQ ID NO: 1961086 - RNA, 20 nt, Shigella flexneri 2a str. 301
gcuauugccgccaaaucgga

SEQ ID NO: 1961087 - RNA, 22 nt, Shigella flexneri 2a str. 301
gcuauugccgccaaaucggaac

SEQ ID NO: 1961088 - RNA, 14 nt, Shigella flexneri 2a str. 301
gcucaccgccagca

SEQ ID NO: 1961089 - RNA, 18 nt, Shigella flexneri 2a str. 301
gcucacagaguauuucca

SEQ ID NO: 1961090 - RNA, 16 nt, Shigella flexneri 2a str. 301
gcucaaggguuucgcg

SEQ ID NO: 1961091 - RNA, 12 nt, Shigella flexneri 2a str. 301
gcgucaaacggc

SEQ ID NO: 1961092 - RNA, 22 nt, Shigella flexneri 2a str. 301
gcguauucggcaagcguaacgu

SEQ ID NO: 1961093 - RNA, 16 nt, Shigella flexneri 2a str. 301
gcguaucguaaaacgc

SEQ ID NO: 1961094 - RNA, 17 nt, Shigella flexneri 2a str. 301
gcguagccgauccgcgu

SEQ ID NO: 1961095 - RNA, 18 nt, Shigella flexneri 2a str. 301
gcguagcgcaucaggcaa

SEQ ID NO: 1961096 - RNA, 21 nt, Shigella flexneri 2a str. 301
gcgucauuuucaucgcuuucu

SEQ ID NO: 1961097 - RNA, 15 nt, Shigella flexneri 2a str. 301
gcgucauaauccggc

SEQ ID NO: 1961098 - RNA, 22 nt, Shigella flexneri 2a str. 301
gcgucauauuacugcaacugcg

SEQ ID NO: 1961099 - RNA, 19 nt, Shigella flexneri 2a str. 301
gcgucauccagcacuugca

SEQ ID NO: 1961100 - RNA, 14 nt, Shigella flexneri 2a str. 301
gcguccgccgauac

SEQ ID NO: 1961101 - RNA, 21 nt, Shigella flexneri 2a str. 301
gcguggcgauaaucagcgcca

SEQ ID NO: 1961102 - RNA, 20 nt, Shigella flexneri 2a str. 301
gcgugcccgggucagcgcca

SEQ ID NO: 1961103 - RNA, 22 nt, Shigella flexneri 2a str. 301
gcgugaacgccuaauccagccu

SEQ ID NO: 1961104 - RNA, 13 nt, Shigella flexneri 2a str. 301
gcgugaacgccuu

SEQ ID NO: 1961105 - RNA, 21 nt, Shigella flexneri 2a str. 301
gcgugaccgccuuauccggcc

SEQ ID NO: 1961106 - RNA, 22 nt, Shigella flexneri 2a str. 301
aagcuuacguuacccagcacgg

SEQ ID NO: 1961107 - RNA, 23 nt, Shigella flexneri 2a str. 301
gcgugacaccagcacaucaucaa

SEQ ID NO: 1961108 - RNA, 14 nt, Shigella flexneri 2a str. 301
gcgugacaccagca

SEQ ID NO: 1961109 - RNA, 21 nt, Shigella flexneri 2a str. 301
gcgucguucgcgccaacagcg

SEQ ID NO: 1961110 - RNA, 15 nt, Shigella flexneri 2a str. 301
gcgucguuguacaaa

SEQ ID NO: 1961111 - RNA, 12 nt, Shigella flexneri 2a str. 301
gcugcugccgcu

SEQ ID NO: 1961112 - RNA, 18 nt, Shigella flexneri 2a str. 301
gcugcugcguuccggcau

SEQ ID NO: 1961113 - RNA, 14 nt, Shigella flexneri 2a str. 301
gcugcugcggcgaa

SEQ ID NO: 1961114 - RNA, 15 nt, Shigella flexneri 2a str. 301
gcugcuucauugcuc

SEQ ID NO: 1961115 - RNA, 13 nt, Shigella flexneri 2a str. 301
gcugcuuucgccg

SEQ ID NO: 1961116 - RNA, 17 nt, Shigella flexneri 2a str. 301
gcuggaucugcggguua

SEQ ID NO: 1961117 - RNA, 19 nt, Shigella flexneri 2a str. 301
gcuggaucagacgcagcca

SEQ ID NO: 1961118 - RNA, 19 nt, Shigella flexneri 2a str. 301
gcuggauggcgcaaugcca

SEQ ID NO: 1961119 - RNA, 17 nt, Shigella flexneri 2a str. 301
gcuggauaaggcguuua

SEQ ID NO: 1961120 - RNA, 15 nt, Shigella flexneri 2a str. 301
gcuggacgcgccaac

SEQ ID NO: 1961121 - RNA, 23 nt, Shigella flexneri 2a str. 301
gcuggacucccagaacaacccgg

SEQ ID NO: 1961122 - RNA, 20 nt, Shigella flexneri 2a str. 301
gcuggacguugcguugcagc

SEQ ID NO: 1961123 - RNA, 19 nt, Shigella flexneri 2a str. 301
gcuggcccaguugauucgc

SEQ ID NO: 1961124 - RNA, 13 nt, Shigella flexneri 2a str. 301
gcuggcagcugcu

SEQ ID NO: 1961125 - RNA, 16 nt, Shigella flexneri 2a str. 301
gcuggcacgcucuuca

SEQ ID NO: 1961126 - RNA, 18 nt, Shigella flexneri 2a str. 301
gcuggcaacgcgccgcca

SEQ ID NO: 1961127 - RNA, 17 nt, Shigella flexneri 2a str. 301
gcuggcagcugcuacgc

SEQ ID NO: 1961128 - RNA, 17 nt, Shigella flexneri 2a str. 301
gcugacuguaggccgga

SEQ ID NO: 1961129 - RNA, 21 nt, Shigella flexneri 2a str. 301
gcugacgugauuuagcaccga

SEQ ID NO: 1961130 - RNA, 13 nt, Shigella flexneri 2a str. 301
gcugccaucgcaa

SEQ ID NO: 1961131 - RNA, 16 nt, Shigella flexneri 2a str. 301
gcugcgaaucgcuuca

SEQ ID NO: 1961132 - RNA, 17 nt, Shigella flexneri 2a str. 301
gcugcggaauugccggu

SEQ ID NO: 1961133 - RNA, 15 nt, Shigella flexneri 2a str. 301
gcugcggcgcgcauc

SEQ ID NO: 1961134 - RNA, 21 nt, Shigella flexneri 2a str. 301
gcucuggauaaucacaauggu

SEQ ID NO: 1961135 - RNA, 16 nt, Shigella flexneri 2a str. 301
gcugaacucgacgccc

SEQ ID NO: 1961136 - RNA, 15 nt, Shigella flexneri 2a str. 301
gcugacgcacuguug

SEQ ID NO: 1961137 - RNA, 23 nt, Shigella flexneri 2a str. 301
gcucgccgcagagaucagauaau

SEQ ID NO: 1961138 - RNA, 17 nt, Shigella flexneri 2a str. 301
gcucgcgcaguuugcca

SEQ ID NO: 1961139 - RNA, 14 nt, Shigella flexneri 2a str. 301
gcuccugcauugac

SEQ ID NO: 1961140 - RNA, 17 nt, Shigella flexneri 2a str. 301
gcuccgguuaacgccgc

SEQ ID NO: 1961141 - RNA, 22 nt, Shigella flexneri 2a str. 301
gcggaaauggccccgcuuacgc

SEQ ID NO: 1961142 - RNA, 15 nt, Shigella flexneri 2a str. 301
gcggaaauuaccgca

SEQ ID NO: 1961143 - RNA, 18 nt, Shigella flexneri 2a str. 301
gcggaauagcguacggca

SEQ ID NO: 1961144 - RNA, 17 nt, Shigella flexneri 2a str. 301
gcgcuguacgguaaugg

SEQ ID NO: 1961145 - RNA, 22 nt, Shigella flexneri 2a str. 301
gcgcuucacaugccacacacga

SEQ ID NO: 1961146 - RNA, 16 nt, Shigella flexneri 2a str. 301
gcgcuuauagcgacca

SEQ ID NO: 1961147 - RNA, 15 nt, Shigella flexneri 2a str. 301
gcgcuuauccggccc

SEQ ID NO: 1961148 - RNA, 19 nt, Shigella flexneri 2a str. 301
gcgcugucauuacgggcaa

SEQ ID NO: 1961149 - RNA, 17 nt, Shigella flexneri 2a str. 301
gcgcugagguuaugcaa

SEQ ID NO: 1961150 - RNA, 21 nt, Shigella flexneri 2a str. 301
gcgcugaaagaagcggugaaa

SEQ ID NO: 1961151 - RNA, 22 nt, Shigella flexneri 2a str. 301
gcgcugacauuacgcgcuucgu

SEQ ID NO: 1961152 - RNA, 14 nt, Shigella flexneri 2a str. 301
gcgcucgcgccgca

SEQ ID NO: 1961153 - RNA, 15 nt, Shigella flexneri 2a str. 301
gcgcgcagugccggu

SEQ ID NO: 1961154 - RNA, 15 nt, Shigella flexneri 2a str. 301
gcgcugaugagcaaa

SEQ ID NO: 1961155 - RNA, 13 nt, Shigella flexneri 2a str. 301
gcgcuggcaaugg

SEQ ID NO: 1961156 - RNA, 18 nt, Shigella flexneri 2a str. 301
aagccugcuucaaacgcu

SEQ ID NO: 1961157 - RNA, 16 nt, Shigella flexneri 2a str. 301
gcggcacagaaacgcc

SEQ ID NO: 1961158 - RNA, 14 nt, Shigella flexneri 2a str. 301
gcggcaccagcggu

SEQ ID NO: 1961159 - RNA, 17 nt, Shigella flexneri 2a str. 301
gcggcaggguuugcgcc

SEQ ID NO: 1961160 - RNA, 23 nt, Shigella flexneri 2a str. 301
aagccgcuaacagcagcagcgca

SEQ ID NO: 1961161 - RNA, 15 nt, Shigella flexneri 2a str. 301
aagccgccgccgcug

SEQ ID NO: 1961162 - RNA, 18 nt, Shigella flexneri 2a str. 301
aagccgucccuaccggua

SEQ ID NO: 1961163 - RNA, 13 nt, Shigella flexneri 2a str. 301
aagccguugcuga

SEQ ID NO: 1961164 - RNA, 21 nt, Shigella flexneri 2a str. 301
gcggcaauucuuucucgcuca

SEQ ID NO: 1961165 - RNA, 18 nt, Shigella flexneri 2a str. 301
gcggauuuuauucagcag

SEQ ID NO: 1961166 - RNA, 21 nt, Shigella flexneri 2a str. 301
gcggauuuguaauuucagcgg

SEQ ID NO: 1961167 - RNA, 16 nt, Shigella flexneri 2a str. 301
gcggcaacggcuucgc

SEQ ID NO: 1961168 - RNA, 19 nt, Shigella flexneri 2a str. 301
gcggauacaggaagcgaau

SEQ ID NO: 1961169 - RNA, 23 nt, Shigella flexneri 2a str. 301
gcggaucguuaaacucugccgca

SEQ ID NO: 1961170 - RNA, 18 nt, Shigella flexneri 2a str. 301
gcggaugcggcguaaacg

SEQ ID NO: 1961171 - RNA, 23 nt, Shigella flexneri 2a str. 301
gcggauggccucugccagcugcu

SEQ ID NO: 1961172 - RNA, 16 nt, Shigella flexneri 2a str. 301
gcggagaguaaacggu

SEQ ID NO: 1961173 - RNA, 21 nt, Shigella flexneri 2a str. 301
gcggacgagagagugacguca

SEQ ID NO: 1961174 - RNA, 22 nt, Shigella flexneri 2a str. 301
gcggcuauauucaaacacccga

SEQ ID NO: 1961175 - RNA, 19 nt, Shigella flexneri 2a str. 301
gcggggagggaauccagca

SEQ ID NO: 1961176 - RNA, 16 nt, Shigella flexneri 2a str. 301
gcgggucaggccagga

SEQ ID NO: 1961177 - RNA, 17 nt, Shigella flexneri 2a str. 301
gcggguucuuaccggug

SEQ ID NO: 1961178 - RNA, 15 nt, Shigella flexneri 2a str. 301
gcggcggugauauaa

SEQ ID NO: 1961179 - RNA, 20 nt, Shigella flexneri 2a str. 301
gcggcggugagaagaccgcc

SEQ ID NO: 1961180 - RNA, 17 nt, Shigella flexneri 2a str. 301
gcggcguaaacgccuua

SEQ ID NO: 1961181 - RNA, 14 nt, Shigella flexneri 2a str. 301
gcggcguaaacgcc

SEQ ID NO: 1961182 - RNA, 18 nt, Shigella flexneri 2a str. 301
aagcugaaaauggcgcug

SEQ ID NO: 1961183 - RNA, 16 nt, Shigella flexneri 2a str. 301
aagcugcaaggugaaa

SEQ ID NO: 1961184 - RNA, 16 nt, Shigella flexneri 2a str. 301
gcggcgcaggcaauag

SEQ ID NO: 1961185 - RNA, 17 nt, Shigella flexneri 2a str. 301
gcggcgauauccagcgc

SEQ ID NO: 1961186 - RNA, 18 nt, Shigella flexneri 2a str. 301
gcggcgacuuccagcgau

SEQ ID NO: 1961187 - RNA, 20 nt, Shigella flexneri 2a str. 301
gcggcgacaaauguugcauc

SEQ ID NO: 1961188 - RNA, 17 nt, Shigella flexneri 2a str. 301
gcggcgaaccagccguu

SEQ ID NO: 1961189 - RNA, 14 nt, Shigella flexneri 2a str. 301
gcggcauuucgccg

SEQ ID NO: 1961190 - RNA, 18 nt, Shigella flexneri 2a str. 301
gcggccggaugacagacu

SEQ ID NO: 1961191 - RNA, 16 nt, Shigella flexneri 2a str. 301
gccgccgcgcucuuca

SEQ ID NO: 1961192 - RNA, 23 nt, Shigella flexneri 2a str. 301
gccgcuguguguaggccagcgau

SEQ ID NO: 1961193 - RNA, 15 nt, Shigella flexneri 2a str. 301
gccgcuucaguugcg

SEQ ID NO: 1961194 - RNA, 13 nt, Shigella flexneri 2a str. 301
gccggacaugcug

SEQ ID NO: 1961195 - RNA, 22 nt, Shigella flexneri 2a str. 301
gccggaccaucuuccaguugca

SEQ ID NO: 1961196 - RNA, 16 nt, Shigella flexneri 2a str. 301
gccggaaucaacggca

SEQ ID NO: 1961197 - RNA, 18 nt, Shigella flexneri 2a str. 301
gccggaaucaacggcaac

SEQ ID NO: 1961198 - RNA, 13 nt, Shigella flexneri 2a str. 301
gccggaaucagaa

SEQ ID NO: 1961199 - RNA, 16 nt, Shigella flexneri 2a str. 301
gccggaaaacguuuca

SEQ ID NO: 1961200 - RNA, 22 nt, Shigella flexneri 2a str. 301
gccggaaauaucaaccggcuca

SEQ ID NO: 1961201 - RNA, 18 nt, Shigella flexneri 2a str. 301
gccggaggcaaguuuccu

SEQ ID NO: 1961202 - RNA, 16 nt, Shigella flexneri 2a str. 301
gccggagacgacgccc

SEQ ID NO: 1961203 - RNA, 16 nt, Shigella flexneri 2a str. 301
gccggacguucgccca

SEQ ID NO: 1961204 - RNA, 23 nt, Shigella flexneri 2a str. 301
gccggacggcuguaaaugccgac

SEQ ID NO: 1961205 - RNA, 16 nt, Shigella flexneri 2a str. 301
gccggaccccgcgcaa

SEQ ID NO: 1961206 - RNA, 17 nt, Shigella flexneri 2a str. 301
gccggauaaggcgcucg

SEQ ID NO: 1961207 - RNA, 18 nt, Shigella flexneri 2a str. 301
gccggauaaggcguucgc

SEQ ID NO: 1961208 - RNA, 15 nt, Shigella flexneri 2a str. 301
gccggauaagacgcg

SEQ ID NO: 1961209 - RNA, 21 nt, Shigella flexneri 2a str. 301
gccggauaagcguaagcgcau

SEQ ID NO: 1961210 - RNA, 18 nt, Shigella flexneri 2a str. 301
gccggaugcgccagcauc

SEQ ID NO: 1961211 - RNA, 22 nt, Shigella flexneri 2a str. 301
gccggaugcggcguaaacgccu

SEQ ID NO: 1961212 - RNA, 22 nt, Shigella flexneri 2a str. 301
gccggauggaaacauccggcaa

SEQ ID NO: 1961213 - RNA, 15 nt, Shigella flexneri 2a str. 301
aagccaaaucaucca

SEQ ID NO: 1961214 - RNA, 17 nt, Shigella flexneri 2a str. 301
aagcauucacgccgcau

SEQ ID NO: 1961215 - RNA, 20 nt, Shigella flexneri 2a str. 301
aagcaguccagcgccugacg

SEQ ID NO: 1961216 - RNA, 19 nt, Shigella flexneri 2a str. 301
aagcagccuauuucgucgc

SEQ ID NO: 1961217 - RNA, 19 nt, Shigella flexneri 2a str. 301
gccuguuuauccaucacgc

SEQ ID NO: 1961218 - RNA, 18 nt, Shigella flexneri 2a str. 301
gccuuaccaauaccgcgu

SEQ ID NO: 1961219 - RNA, 14 nt, Shigella flexneri 2a str. 301
gccuuauccggccu

SEQ ID NO: 1961220 - RNA, 22 nt, Shigella flexneri 2a str. 301
gccuuaccacucugaccugaca

SEQ ID NO: 1961221 - RNA, 15 nt, Shigella flexneri 2a str. 301
gccuuaccgcuuggc

SEQ ID NO: 1961222 - RNA, 17 nt, Shigella flexneri 2a str. 301
gccuguauuacgccuuc

SEQ ID NO: 1961223 - RNA, 19 nt, Shigella flexneri 2a str. 301
gccuguauuacgccuucga

SEQ ID NO: 1961224 - RNA, 17 nt, Shigella flexneri 2a str. 301
gccugggucgccaucgu

SEQ ID NO: 1961225 - RNA, 19 nt, Shigella flexneri 2a str. 301
gccuacaggaaacgauucg

SEQ ID NO: 1961226 - RNA, 23 nt, Shigella flexneri 2a str. 301
gccuacaaauucaauaaauugca

SEQ ID NO: 1961227 - RNA, 17 nt, Shigella flexneri 2a str. 301
gccuaauuccgcgcgaa

SEQ ID NO: 1961228 - RNA, 13 nt, Shigella flexneri 2a str. 301
aagccacgccgaa

SEQ ID NO: 1961229 - RNA, 21 nt, Shigella flexneri 2a str. 301
gccuacagguuugugccgaac

SEQ ID NO: 1961230 - RNA, 14 nt, Shigella flexneri 2a str. 301
gccuaccauaauca

SEQ ID NO: 1961231 - RNA, 22 nt, Shigella flexneri 2a str. 301
gccugaugcgcuucgcuuauca

SEQ ID NO: 1961232 - RNA, 14 nt, Shigella flexneri 2a str. 301
gccugaugcggcgu

SEQ ID NO: 1961233 - RNA, 16 nt, Shigella flexneri 2a str. 301
gccugaugcgcuacgc

SEQ ID NO: 1961234 - RNA, 14 nt, Shigella flexneri 2a str. 301
gccugaauuacugg

SEQ ID NO: 1961235 - RNA, 18 nt, Shigella flexneri 2a str. 301
gccugaaugccacaaucg

SEQ ID NO: 1961236 - RNA, 17 nt, Shigella flexneri 2a str. 301
gccugaauauccagaua

SEQ ID NO: 1961237 - RNA, 11 nt, Shigella flexneri 2a str. 301
gccugccagag

SEQ ID NO: 1961238 - RNA, 16 nt, Shigella flexneri 2a str. 301
gccugcaacgcuuuca

SEQ ID NO: 1961239 - RNA, 20 nt, Shigella flexneri 2a str. 301
gccugaugugacgcuuguca

SEQ ID NO: 1961240 - RNA, 13 nt, Shigella flexneri 2a str. 301
gccugccgccagc

SEQ ID NO: 1961241 - RNA, 22 nt, Shigella flexneri 2a str. 301
gccguugcggguggcucucgcc

SEQ ID NO: 1961242 - RNA, 14 nt, Shigella flexneri 2a str. 301
gccguggcaaccuu

SEQ ID NO: 1961243 - RNA, 15 nt, Shigella flexneri 2a str. 301
gccguagagcaccgg

SEQ ID NO: 1961244 - RNA, 18 nt, Shigella flexneri 2a str. 301
gccguacugcauaaugcc

SEQ ID NO: 1961245 - RNA, 15 nt, Shigella flexneri 2a str. 301
gccguaguuccacau

SEQ ID NO: 1961246 - RNA, 19 nt, Shigella flexneri 2a str. 301
gccgucaggugacacuuca

SEQ ID NO: 1961247 - RNA, 15 nt, Shigella flexneri 2a str. 301
gccgucaggguugcc

SEQ ID NO: 1961248 - RNA, 20 nt, Shigella flexneri 2a str. 301
gccgucaccagcaucaacaa

SEQ ID NO: 1961249 - RNA, 15 nt, Shigella flexneri 2a str. 301
gccgucaccagcauc

SEQ ID NO: 1961250 - RNA, 14 nt, Shigella flexneri 2a str. 301
gccguccagccgga

SEQ ID NO: 1961251 - RNA, 12 nt, Shigella flexneri 2a str. 301
gccggugauuac

SEQ ID NO: 1961252 - RNA, 18 nt, Shigella flexneri 2a str. 301
gccgguaacguccaucac

SEQ ID NO: 1961253 - RNA, 17 nt, Shigella flexneri 2a str. 301
gcgcacuauuccggcgu

SEQ ID NO: 1961254 - RNA, 13 nt, Shigella flexneri 2a str. 301
gcgcaccgauaaa

SEQ ID NO: 1961255 - RNA, 12 nt, Shigella flexneri 2a str. 301
gcgcaauaccga

SEQ ID NO: 1961256 - RNA, 16 nt, Shigella flexneri 2a str. 301
gcgcaauauucaagau

SEQ ID NO: 1961257 - RNA, 20 nt, Shigella flexneri 2a str. 301
gcgauuaaacgccauccggc

SEQ ID NO: 1961258 - RNA, 15 nt, Shigella flexneri 2a str. 301
gcgauuaaacgccau

SEQ ID NO: 1961259 - RNA, 23 nt, Shigella flexneri 2a str. 301
gcgauuauuuauucccgccagau

SEQ ID NO: 1961260 - RNA, 19 nt, Shigella flexneri 2a str. 301
gcgcaaaauaccagcaauu

SEQ ID NO: 1961261 - RNA, 15 nt, Shigella flexneri 2a str. 301
gcgcaaaauaccagc

SEQ ID NO: 1961262 - RNA, 18 nt, Shigella flexneri 2a str. 301
gcgcaaauccacguucca

SEQ ID NO: 1961263 - RNA, 20 nt, Shigella flexneri 2a str. 301
gcgcaacccgugaagguugc

SEQ ID NO: 1961264 - RNA, 17 nt, Shigella flexneri 2a str. 301
gcgauuuaucggcaauu

SEQ ID NO: 1961265 - RNA, 14 nt, Shigella flexneri 2a str. 301
gcgauuuaacgccu

SEQ ID NO: 1961266 - RNA, 22 nt, Shigella flexneri 2a str. 301
gcgauuuaacgccugggcgagg

SEQ ID NO: 1961267 - RNA, 21 nt, Shigella flexneri 2a str. 301
gcgaucccacgccgaaugccg

SEQ ID NO: 1961268 - RNA, 12 nt, Shigella flexneri 2a str. 301
gcgauccggcaa

SEQ ID NO: 1961269 - RNA, 20 nt, Shigella flexneri 2a str. 301
gcgauccgguacuggcgugg

SEQ ID NO: 1961270 - RNA, 13 nt, Shigella flexneri 2a str. 301
gcgaugaccgcca

SEQ ID NO: 1961271 - RNA, 16 nt, Shigella flexneri 2a str. 301
gcgaugaacgccuggg

SEQ ID NO: 1961272 - RNA, 16 nt, Shigella flexneri 2a str. 301
gcgaugccuggcaaug

SEQ ID NO: 1961273 - RNA, 21 nt, Shigella flexneri 2a str. 301
gcgacgcuuaccgcgucuuau

SEQ ID NO: 1961274 - RNA, 20 nt, Shigella flexneri 2a str. 301
gcgacgcuuacgcgucuuau

SEQ ID NO: 1961275 - RNA, 21 nt, Shigella flexneri 2a str. 301
gcgacgcuugacgcgucuuau

SEQ ID NO: 1961276 - RNA, 19 nt, Shigella flexneri 2a str. 301
gcgacgaacguuuacaggg

SEQ ID NO: 1961277 - RNA, 19 nt, Shigella flexneri 2a str. 301
gcgaccguuuucaccaguu

SEQ ID NO: 1961278 - RNA, 14 nt, Shigella flexneri 2a str. 301
gcgacaccagccau

SEQ ID NO: 1961279 - RNA, 15 nt, Shigella flexneri 2a str. 301
gcgacaccagccauc

SEQ ID NO: 1961280 - RNA, 23 nt, Shigella flexneri 2a str. 301
gccuucgcaaaaaaccaucccug

SEQ ID NO: 1961281 - RNA, 12 nt, Shigella flexneri 2a str. 301
gccuuccgcuga

SEQ ID NO: 1961282 - RNA, 22 nt, Shigella flexneri 2a str. 301
gcgacagggaucucuuccagug

SEQ ID NO: 1961283 - RNA, 15 nt, Shigella flexneri 2a str. 301
gcgacgucugccggu

SEQ ID NO: 1961284 - RNA, 17 nt, Shigella flexneri 2a str. 301
gcgacuaauacaccauc

SEQ ID NO: 1961285 - RNA, 18 nt, Shigella flexneri 2a str. 301
gcgacuaauacaccauca

SEQ ID NO: 1961286 - RNA, 19 nt, Shigella flexneri 2a str. 301
gcgaggggaccgccccugc

SEQ ID NO: 1961287 - RNA, 20 nt, Shigella flexneri 2a str. 301
gcgaggcaaaauuaucacaa

SEQ ID NO: 1961288 - RNA, 19 nt, Shigella flexneri 2a str. 301
gcgagguauuuucugaaac

SEQ ID NO: 1961289 - RNA, 14 nt, Shigella flexneri 2a str. 301
gcgauaaucagcgc

SEQ ID NO: 1961290 - RNA, 15 nt, Shigella flexneri 2a str. 301
gcgauaaccgcaccu

SEQ ID NO: 1961291 - RNA, 23 nt, Shigella flexneri 2a str. 301
gcgauaaaucagauuauagugau

SEQ ID NO: 1961292 - RNA, 14 nt, Shigella flexneri 2a str. 301
gcgauauugcugca

SEQ ID NO: 1961293 - RNA, 17 nt, Shigella flexneri 2a str. 301
gcgauauccugaaacgc

SEQ ID NO: 1961294 - RNA, 21 nt, Shigella flexneri 2a str. 301
gcgccuucagauugcuacgag

SEQ ID NO: 1961295 - RNA, 12 nt, Shigella flexneri 2a str. 301
gcgccugcugcu

SEQ ID NO: 1961296 - RNA, 13 nt, Shigella flexneri 2a str. 301
gcgccucaagaau

SEQ ID NO: 1961297 - RNA, 14 nt, Shigella flexneri 2a str. 301
gcgccgccaaacgc

SEQ ID NO: 1961298 - RNA, 18 nt, Shigella flexneri 2a str. 301
gcgcaucagcuccgguau

SEQ ID NO: 1961299 - RNA, 12 nt, Shigella flexneri 2a str. 301
gcgcaucaaagc

SEQ ID NO: 1961300 - RNA, 14 nt, Shigella flexneri 2a str. 301
gcgcauccagcgcu

SEQ ID NO: 1961301 - RNA, 15 nt, Shigella flexneri 2a str. 301
gcgcauccgggaugg

SEQ ID NO: 1961302 - RNA, 14 nt, Shigella flexneri 2a str. 301
gcgccagccagcca

SEQ ID NO: 1961303 - RNA, 13 nt, Shigella flexneri 2a str. 301
gcgccagccagau

SEQ ID NO: 1961304 - RNA, 18 nt, Shigella flexneri 2a str. 301
gcgccagcgucaucauag

SEQ ID NO: 1961305 - RNA, 12 nt, Shigella flexneri 2a str. 301
gcgccagcggca

SEQ ID NO: 1961306 - RNA, 20 nt, Shigella flexneri 2a str. 301
gcgccagcgcuuccgucaga

SEQ ID NO: 1961307 - RNA, 15 nt, Shigella flexneri 2a str. 301
gcgccgacagcagcc

SEQ ID NO: 1961308 - RNA, 16 nt, Shigella flexneri 2a str. 301
cgcccguuaaccgcuc

SEQ ID NO: 1961309 - RNA, 12 nt, Shigella flexneri 2a str. 301
cgcccugcucgu

SEQ ID NO: 1961310 - RNA, 18 nt, Shigella flexneri 2a str. 301
cgcccuucggcaucacga

SEQ ID NO: 1961311 - RNA, 18 nt, Shigella flexneri 2a str. 301
cgccgagcgggaucgccg

SEQ ID NO: 1961312 - RNA, 21 nt, Shigella flexneri 2a str. 301
cgccgaggauacagccgaagc

SEQ ID NO: 1961313 - RNA, 20 nt, Shigella flexneri 2a str. 301
cgcccggaaacgggcgcuga

SEQ ID NO: 1961314 - RNA, 15 nt, Shigella flexneri 2a str. 301
cgcccgcgcagcugg

SEQ ID NO: 1961315 - RNA, 20 nt, Shigella flexneri 2a str. 301
cgcccagcguacguaacuuc

SEQ ID NO: 1961316 - RNA, 13 nt, Shigella flexneri 2a str. 301
cgccaccgcacgc

SEQ ID NO: 1961317 - RNA, 18 nt, Shigella flexneri 2a str. 301
cgcccaguggaugcgcca

SEQ ID NO: 1961318 - RNA, 14 nt, Shigella flexneri 2a str. 301
cgccccggaagcau

SEQ ID NO: 1961319 - RNA, 21 nt, Shigella flexneri 2a str. 301
cgccggugguugccggucugg

SEQ ID NO: 1961320 - RNA, 20 nt, Shigella flexneri 2a str. 301
aacagauaguuaccguacuc

SEQ ID NO: 1961321 - RNA, 17 nt, Shigella flexneri 2a str. 301
cgccucgcguccgcguc

SEQ ID NO: 1961322 - RNA, 23 nt, Shigella flexneri 2a str. 301
cgccguuuuuacccagcagcagc

SEQ ID NO: 1961323 - RNA, 21 nt, Shigella flexneri 2a str. 301
cgccguuuuuacccagcagca

SEQ ID NO: 1961324 - RNA, 11 nt, Shigella flexneri 2a str. 301
aacacgcucag

SEQ ID NO: 1961325 - RNA, 21 nt, Shigella flexneri 2a str. 301
aacacggcagcaaccgcuucc

SEQ ID NO: 1961326 - RNA, 19 nt, Shigella flexneri 2a str. 301
aacacucaguccgccuuca

SEQ ID NO: 1961327 - RNA, 22 nt, Shigella flexneri 2a str. 301
cgccgcguuuaucgacagacgc

SEQ ID NO: 1961328 - RNA, 19 nt, Shigella flexneri 2a str. 301
cgcggcgauauccagcgcg

SEQ ID NO: 1961329 - RNA, 19 nt, Shigella flexneri 2a str. 301
cgcggggaucacuggcaga

SEQ ID NO: 1961330 - RNA, 15 nt, Shigella flexneri 2a str. 301
cgcgggucaguauuc

SEQ ID NO: 1961331 - RNA, 14 nt, Shigella flexneri 2a str. 301
cgcggugcgccgua

SEQ ID NO: 1961332 - RNA, 15 nt, Shigella flexneri 2a str. 301
cgcgguauugccugu

SEQ ID NO: 1961333 - RNA, 22 nt, Shigella flexneri 2a str. 301
cgcucguagguuucugccagcg

SEQ ID NO: 1961334 - RNA, 23 nt, Shigella flexneri 2a str. 301
cgcugaauggcgauuucacaaga

SEQ ID NO: 1961335 - RNA, 15 nt, Shigella flexneri 2a str. 301
cgcugaauggcgauu

SEQ ID NO: 1961336 - RNA, 20 nt, Shigella flexneri 2a str. 301
cgcugacaguacccagauuc

SEQ ID NO: 1961337 - RNA, 22 nt, Shigella flexneri 2a str. 301
cgcugaaagcugaacaaagccg

SEQ ID NO: 1961338 - RNA, 12 nt, Shigella flexneri 2a str. 301
cgcucuggcagg

SEQ ID NO: 1961339 - RNA, 20 nt, Shigella flexneri 2a str. 301
cgcucauuuucucuuucagc

SEQ ID NO: 1961340 - RNA, 19 nt, Shigella flexneri 2a str. 301
cgcucgccaaagcagugaa

SEQ ID NO: 1961341 - RNA, 13 nt, Shigella flexneri 2a str. 301
cgcucgcccagcu

SEQ ID NO: 1961342 - RNA, 22 nt, Shigella flexneri 2a str. 301
cgcgucuuaucaugccuacggg

SEQ ID NO: 1961343 - RNA, 14 nt, Shigella flexneri 2a str. 301
cgcgucuggcauca

SEQ ID NO: 1961344 - RNA, 15 nt, Shigella flexneri 2a str. 301
cgcuauacagcagcc

SEQ ID NO: 1961345 - RNA, 16 nt, Shigella flexneri 2a str. 301
cgcuauccagcgcaua

SEQ ID NO: 1961346 - RNA, 23 nt, Shigella flexneri 2a str. 301
cgcguugacguucaugccggucg

SEQ ID NO: 1961347 - RNA, 12 nt, Shigella flexneri 2a str. 301
cgcucaucggca

SEQ ID NO: 1961348 - RNA, 17 nt, Shigella flexneri 2a str. 301
cgcucaucagcuccggu

SEQ ID NO: 1961349 - RNA, 18 nt, Shigella flexneri 2a str. 301
cgcucaucaggccuacaa

SEQ ID NO: 1961350 - RNA, 14 nt, Shigella flexneri 2a str. 301
cgcgccugcggcca

SEQ ID NO: 1961351 - RNA, 13 nt, Shigella flexneri 2a str. 301
cgcgcgcagcacg

SEQ ID NO: 1961352 - RNA, 21 nt, Shigella flexneri 2a str. 301
cgcgcgcugccagaaccgcuu

SEQ ID NO: 1961353 - RNA, 19 nt, Shigella flexneri 2a str. 301
cgcgcgcuuuuaccgcguc

SEQ ID NO: 1961354 - RNA, 22 nt, Shigella flexneri 2a str. 301
cgcgcguccccugcccgcgauc

SEQ ID NO: 1961355 - RNA, 14 nt, Shigella flexneri 2a str. 301
cgcgcucugccagc

SEQ ID NO: 1961356 - RNA, 14 nt, Shigella flexneri 2a str. 301
cgcgccaauccaga

SEQ ID NO: 1961357 - RNA, 15 nt, Shigella flexneri 2a str. 301
cgcgauauugcugca

SEQ ID NO: 1961358 - RNA, 10 nt, Shigella flexneri 2a str. 301
cgcgacguuc

SEQ ID NO: 1961359 - RNA, 18 nt, Shigella flexneri 2a str. 301
cgccugcggcgcaugcau

SEQ ID NO: 1961360 - RNA, 17 nt, Shigella flexneri 2a str. 301
cgcgcaauugccagaca

SEQ ID NO: 1961361 - RNA, 14 nt, Shigella flexneri 2a str. 301
cgcgcaauugcacg

SEQ ID NO: 1961362 - RNA, 18 nt, Shigella flexneri 2a str. 301
cggcccggcccaacgcau

SEQ ID NO: 1961363 - RNA, 13 nt, Shigella flexneri 2a str. 301
cggccguuccauu

SEQ ID NO: 1961364 - RNA, 15 nt, Shigella flexneri 2a str. 301
cggccuaccaugacc

SEQ ID NO: 1961365 - RNA, 17 nt, Shigella flexneri 2a str. 301
cggccuaucaacgucgu

SEQ ID NO: 1961366 - RNA, 23 nt, Shigella flexneri 2a str. 301
cggcauucagugcaaaugccaga

SEQ ID NO: 1961367 - RNA, 16 nt, Shigella flexneri 2a str. 301
cggcaugguuccggcu

SEQ ID NO: 1961368 - RNA, 15 nt, Shigella flexneri 2a str. 301
cggcauucugcuggc

SEQ ID NO: 1961369 - RNA, 15 nt, Shigella flexneri 2a str. 301
cggcauucagugcaa

SEQ ID NO: 1961370 - RNA, 16 nt, Shigella flexneri 2a str. 301
cggccacagccagcca

SEQ ID NO: 1961371 - RNA, 13 nt, Shigella flexneri 2a str. 301
aacagucacuuuc

SEQ ID NO: 1961372 - RNA, 19 nt, Shigella flexneri 2a str. 301
aacagucccaggcagaagc

SEQ ID NO: 1961373 - RNA, 18 nt, Shigella flexneri 2a str. 301
cggcaggaaaaaagcgcu

SEQ ID NO: 1961374 - RNA, 22 nt, Shigella flexneri 2a str. 301
cggcaggaagugauugccgaag

SEQ ID NO: 1961375 - RNA, 17 nt, Shigella flexneri 2a str. 301
cggccagugcuucgcgg

SEQ ID NO: 1961376 - RNA, 14 nt, Shigella flexneri 2a str. 301
cggccagcgguuga

SEQ ID NO: 1961377 - RNA, 17 nt, Shigella flexneri 2a str. 301
cggauauuuugccaggu

SEQ ID NO: 1961378 - RNA, 22 nt, Shigella flexneri 2a str. 301
cggauaaggcgcucgcgccgca

SEQ ID NO: 1961379 - RNA, 18 nt, Shigella flexneri 2a str. 301
cggauaaucgcuggugcc

SEQ ID NO: 1961380 - RNA, 19 nt, Shigella flexneri 2a str. 301
cggauaagaugcgccagca

SEQ ID NO: 1961381 - RNA, 22 nt, Shigella flexneri 2a str. 301
cggauaaacaauguuauccggc

SEQ ID NO: 1961382 - RNA, 17 nt, Shigella flexneri 2a str. 301
cggauaaagcagagcag

SEQ ID NO: 1961383 - RNA, 21 nt, Shigella flexneri 2a str. 301
cggagcucccaggcuccgcca

SEQ ID NO: 1961384 - RNA, 19 nt, Shigella flexneri 2a str. 301
cggaggcgcugguaaucac

SEQ ID NO: 1961385 - RNA, 13 nt, Shigella flexneri 2a str. 301
cggagaagcguag

SEQ ID NO: 1961386 - RNA, 15 nt, Shigella flexneri 2a str. 301
cggagaugcggaaau

SEQ ID NO: 1961387 - RNA, 23 nt, Shigella flexneri 2a str. 301
cggacguuugccaugcauaucca

SEQ ID NO: 1961388 - RNA, 16 nt, Shigella flexneri 2a str. 301
cggacuccgcaccgcc

SEQ ID NO: 1961389 - RNA, 22 nt, Shigella flexneri 2a str. 301
cggacguuugccaugcauaucc

SEQ ID NO: 1961390 - RNA, 15 nt, Shigella flexneri 2a str. 301
cggacgacggcaucg

SEQ ID NO: 1961391 - RNA, 19 nt, Shigella flexneri 2a str. 301
cggacgacggcaucgccau

SEQ ID NO: 1961392 - RNA, 14 nt, Shigella flexneri 2a str. 301
cggaccgcauucac

SEQ ID NO: 1961393 - RNA, 21 nt, Shigella flexneri 2a str. 301
cggaccagccgcuaccagcgc

SEQ ID NO: 1961394 - RNA, 18 nt, Shigella flexneri 2a str. 301
cggacauguuuuccagca

SEQ ID NO: 1961395 - RNA, 16 nt, Shigella flexneri 2a str. 301
cgcugagagaagcacg

SEQ ID NO: 1961396 - RNA, 22 nt, Shigella flexneri 2a str. 301
cgcugacguuauugaucgccag

SEQ ID NO: 1961397 - RNA, 17 nt, Shigella flexneri 2a str. 301
cggcaaaugacgaugca

SEQ ID NO: 1961398 - RNA, 23 nt, Shigella flexneri 2a str. 301
cggcaaauucauuaccaaccuga

SEQ ID NO: 1961399 - RNA, 21 nt, Shigella flexneri 2a str. 301
cggcaacgucggaaaccgcuu

SEQ ID NO: 1961400 - RNA, 22 nt, Shigella flexneri 2a str. 301
cggcaacuuuggguugccgcca

SEQ ID NO: 1961401 - RNA, 15 nt, Shigella flexneri 2a str. 301
cggcaagaucagcau

SEQ ID NO: 1961402 - RNA, 23 nt, Shigella flexneri 2a str. 301
cggcaaucggugcaaaugccaga

SEQ ID NO: 1961403 - RNA, 23 nt, Shigella flexneri 2a str. 301
cggcaaucgccagaucagcuuca

SEQ ID NO: 1961404 - RNA, 14 nt, Shigella flexneri 2a str. 301
cggcaauaccugac

SEQ ID NO: 1961405 - RNA, 15 nt, Shigella flexneri 2a str. 301
cggcaauaagcaacg

SEQ ID NO: 1961406 - RNA, 14 nt, Shigella flexneri 2a str. 301
cggcaccaaucacc

SEQ ID NO: 1961407 - RNA, 23 nt, Shigella flexneri 2a str. 301
cggcaccacaaacucuuuuccgg

SEQ ID NO: 1961408 - RNA, 20 nt, Shigella flexneri 2a str. 301
cggcaauggguaacggcaga

SEQ ID NO: 1961409 - RNA, 17 nt, Shigella flexneri 2a str. 301
cggcaauuagcggcugg

SEQ ID NO: 1961410 - RNA, 21 nt, Shigella flexneri 2a str. 301
cggcaauuuuaccuagcacug

SEQ ID NO: 1961411 - RNA, 14 nt, Shigella flexneri 2a str. 301
cggcaauuggugca

SEQ ID NO: 1961412 - RNA, 11 nt, Shigella flexneri 2a str. 301
cggcacaucga

SEQ ID NO: 1961413 - RNA, 16 nt, Shigella flexneri 2a str. 301
cggcaaacuucgucaa

SEQ ID NO: 1961414 - RNA, 14 nt, Shigella flexneri 2a str. 301
cggcaaagcgcuga

SEQ ID NO: 1961415 - RNA, 18 nt, Shigella flexneri 2a str. 301
cggcaaaggcuucguuca

SEQ ID NO: 1961416 - RNA, 19 nt, Shigella flexneri 2a str. 301
cggauuuacgccauccggc

SEQ ID NO: 1961417 - RNA, 20 nt, Shigella flexneri 2a str. 301
cggauuuucaccaucgccau

SEQ ID NO: 1961418 - RNA, 22 nt, Shigella flexneri 2a str. 301
cggauuggucgcucgcgccgca

SEQ ID NO: 1961419 - RNA, 20 nt, Shigella flexneri 2a str. 301
cggaugcggcgugaaugccu

SEQ ID NO: 1961420 - RNA, 22 nt, Shigella flexneri 2a str. 301
cggaugcggcguaaacgccuua

SEQ ID NO: 1961421 - RNA, 20 nt, Shigella flexneri 2a str. 301
cggaugcggugcaagcaccu

SEQ ID NO: 1961422 - RNA, 20 nt, Shigella flexneri 2a str. 301
cggaugcgaguuuucgcauc

SEQ ID NO: 1961423 - RNA, 22 nt, Shigella flexneri 2a str. 301
cggaugaggcguuaacagcgca

SEQ ID NO: 1961424 - RNA, 20 nt, Shigella flexneri 2a str. 301
cggaugccaaucacaagacc

SEQ ID NO: 1961425 - RNA, 12 nt, Shigella flexneri 2a str. 301
cggaugcagcgg

SEQ ID NO: 1961426 - RNA, 20 nt, Shigella flexneri 2a str. 301
cggaucuuuucuuucgccca

SEQ ID NO: 1961427 - RNA, 15 nt, Shigella flexneri 2a str. 301
cggcgcuuuugcauc

SEQ ID NO: 1961428 - RNA, 11 nt, Shigella flexneri 2a str. 301
cggcgcuucca

SEQ ID NO: 1961429 - RNA, 17 nt, Shigella flexneri 2a str. 301
cggcggcacagccagcg

SEQ ID NO: 1961430 - RNA, 15 nt, Shigella flexneri 2a str. 301
cggcgguaucgucgg

SEQ ID NO: 1961431 - RNA, 19 nt, Shigella flexneri 2a str. 301
cggcggugagaagaccgcc

SEQ ID NO: 1961432 - RNA, 20 nt, Shigella flexneri 2a str. 301
cggcggucuucucaccgccg

SEQ ID NO: 1961433 - RNA, 18 nt, Shigella flexneri 2a str. 301
cggcgugaccucuucggc

SEQ ID NO: 1961434 - RNA, 22 nt, Shigella flexneri 2a str. 301
cggcgugaaugccuuauccgau

SEQ ID NO: 1961435 - RNA, 17 nt, Shigella flexneri 2a str. 301
cggcguaucgacaauca

SEQ ID NO: 1961436 - RNA, 15 nt, Shigella flexneri 2a str. 301
cggcgucccaucggc

SEQ ID NO: 1961437 - RNA, 13 nt, Shigella flexneri 2a str. 301
cggcguaacgcac

SEQ ID NO: 1961438 - RNA, 22 nt, Shigella flexneri 2a str. 301
cggcguaaacgccuuauccggc

SEQ ID NO: 1961439 - RNA, 15 nt, Shigella flexneri 2a str. 301
cgggcuuaccacggg

SEQ ID NO: 1961440 - RNA, 23 nt, Shigella flexneri 2a str. 301
cgggcggccucuucaaacggcau

SEQ ID NO: 1961441 - RNA, 16 nt, Shigella flexneri 2a str. 301
cggggacgcugucggc

SEQ ID NO: 1961442 - RNA, 13 nt, Shigella flexneri 2a str. 301
cggggaucacucc

SEQ ID NO: 1961443 - RNA, 20 nt, Shigella flexneri 2a str. 301
cggggauuauugccgcagcg

SEQ ID NO: 1961444 - RNA, 23 nt, Shigella flexneri 2a str. 301
cgggguuugcguuugcagcauug

SEQ ID NO: 1961445 - RNA, 16 nt, Shigella flexneri 2a str. 301
cggguaaguacgccau

SEQ ID NO: 1961446 - RNA, 19 nt, Shigella flexneri 2a str. 301
cggguaagaauauccggcu

SEQ ID NO: 1961447 - RNA, 19 nt, Shigella flexneri 2a str. 301
cggggcuuuucucuaucug

SEQ ID NO: 1961448 - RNA, 17 nt, Shigella flexneri 2a str. 301
cgggaauauuaacgaca

SEQ ID NO: 1961449 - RNA, 20 nt, Shigella flexneri 2a str. 301
cgggaagcucucuuccaguu

SEQ ID NO: 1961450 - RNA, 15 nt, Shigella flexneri 2a str. 301
cggcuuuuuccugcc

SEQ ID NO: 1961451 - RNA, 20 nt, Shigella flexneri 2a str. 301
cgggaaaccaacuccagcgg

SEQ ID NO: 1961452 - RNA, 18 nt, Shigella flexneri 2a str. 301
cgggaacagaauaacguc

SEQ ID NO: 1961453 - RNA, 19 nt, Shigella flexneri 2a str. 301
cggcuguuggaaucacuca

SEQ ID NO: 1961454 - RNA, 20 nt, Shigella flexneri 2a str. 301
cggcugucauccagcagcgg

SEQ ID NO: 1961455 - RNA, 16 nt, Shigella flexneri 2a str. 301
cggcuuguggugaaac

SEQ ID NO: 1961456 - RNA, 15 nt, Shigella flexneri 2a str. 301
cggcuggcuggauga

SEQ ID NO: 1961457 - RNA, 13 nt, Shigella flexneri 2a str. 301
aacauuagcgcau

SEQ ID NO: 1961458 - RNA, 12 nt, Shigella flexneri 2a str. 301
aacauguugaau

SEQ ID NO: 1961459 - RNA, 21 nt, Shigella flexneri 2a str. 301
aacauuccacuuucgcggcuu

SEQ ID NO: 1961460 - RNA, 20 nt, Shigella flexneri 2a str. 301
aacaugagguccagcgagcc

SEQ ID NO: 1961461 - RNA, 13 nt, Shigella flexneri 2a str. 301
cgggauauggcga

SEQ ID NO: 1961462 - RNA, 22 nt, Shigella flexneri 2a str. 301
cgggaauucguucagacgcucu

SEQ ID NO: 1961463 - RNA, 23 nt, Shigella flexneri 2a str. 301
cgggacgccaguuacugcugacg

SEQ ID NO: 1961464 - RNA, 17 nt, Shigella flexneri 2a str. 301
cgggcaagccagcauac

SEQ ID NO: 1961465 - RNA, 19 nt, Shigella flexneri 2a str. 301
cgacggcgaaucaaccgcg

SEQ ID NO: 1961466 - RNA, 14 nt, Shigella flexneri 2a str. 301
cgacgcuuaacgcg

SEQ ID NO: 1961467 - RNA, 14 nt, Shigella flexneri 2a str. 301
cgacguaccagcgu

SEQ ID NO: 1961468 - RNA, 16 nt, Shigella flexneri 2a str. 301
aacaauacaaaugccu

SEQ ID NO: 1961469 - RNA, 21 nt, Shigella flexneri 2a str. 301
aacacaauaccuucugcgccc

SEQ ID NO: 1961470 - RNA, 12 nt, Shigella flexneri 2a str. 301
aacaaugcguuu

SEQ ID NO: 1961471 - RNA, 23 nt, Shigella flexneri 2a str. 301
cgacugauugaacuguggcgcga

SEQ ID NO: 1961472 - RNA, 20 nt, Shigella flexneri 2a str. 301
cgacguuugcgcccagccag

SEQ ID NO: 1961473 - RNA, 18 nt, Shigella flexneri 2a str. 301
cgacuacgggcaccagua

SEQ ID NO: 1961474 - RNA, 21 nt, Shigella flexneri 2a str. 301
cgagagagaaaauaauccgcu

SEQ ID NO: 1961475 - RNA, 23 nt, Shigella flexneri 2a str. 301
cgagauccggaucccaccagacg

SEQ ID NO: 1961476 - RNA, 16 nt, Shigella flexneri 2a str. 301
cgagaauaucgauauc

SEQ ID NO: 1961477 - RNA, 16 nt, Shigella flexneri 2a str. 301
cgagaauauuuccagu

SEQ ID NO: 1961478 - RNA, 15 nt, Shigella flexneri 2a str. 301
cgagaaucagcgaga

SEQ ID NO: 1961479 - RNA, 22 nt, Shigella flexneri 2a str. 301
cgagaauaaaacaggcagcugc

SEQ ID NO: 1961480 - RNA, 23 nt, Shigella flexneri 2a str. 301
cgagaagucggcuuuuagcgaca

SEQ ID NO: 1961481 - RNA, 24 nt, Shigella flexneri 2a str. 301
cgagacgguuaaaaacagccagca

SEQ ID NO: 1961482 - RNA, 22 nt, Shigella flexneri 2a str. 301
cgagagaauggggucagcaggu

SEQ ID NO: 1961483 - RNA, 16 nt, Shigella flexneri 2a str. 301
cgacugccgcucaccu

SEQ ID NO: 1961484 - RNA, 18 nt, Shigella flexneri 2a str. 301
cgacuggcccggcgaugg

SEQ ID NO: 1961485 - RNA, 17 nt, Shigella flexneri 2a str. 301
cgaaugaccgccccugc

SEQ ID NO: 1961486 - RNA, 23 nt, Shigella flexneri 2a str. 301
cgacaaauaccaccgugccgccg

SEQ ID NO: 1961487 - RNA, 23 nt, Shigella flexneri 2a str. 301
cgacaaaacgauguccgcucuca

SEQ ID NO: 1961488 - RNA, 21 nt, Shigella flexneri 2a str. 301
cgaauuucucauccgcagucc

SEQ ID NO: 1961489 - RNA, 21 nt, Shigella flexneri 2a str. 301
cgacauacaccgcagccgcca

SEQ ID NO: 1961490 - RNA, 16 nt, Shigella flexneri 2a str. 301
cgacauaggccagccg

SEQ ID NO: 1961491 - RNA, 16 nt, Shigella flexneri 2a str. 301
cgacaugcaucacgcg

SEQ ID NO: 1961492 - RNA, 20 nt, Shigella flexneri 2a str. 301
cgacaucuuuaccgcgacca

SEQ ID NO: 1961493 - RNA, 16 nt, Shigella flexneri 2a str. 301
cgacauuuccuggcga

SEQ ID NO: 1961494 - RNA, 12 nt, Shigella flexneri 2a str. 301
cgaccaaugaca

SEQ ID NO: 1961495 - RNA, 13 nt, Shigella flexneri 2a str. 301
cgaccaccaccgc

SEQ ID NO: 1961496 - RNA, 18 nt, Shigella flexneri 2a str. 301
cgaccacuucaugcccca

SEQ ID NO: 1961497 - RNA, 14 nt, Shigella flexneri 2a str. 301
cgaccagaccaggc

SEQ ID NO: 1961498 - RNA, 21 nt, Shigella flexneri 2a str. 301
cgaccgcguuuugucgcgcca

SEQ ID NO: 1961499 - RNA, 11 nt, Shigella flexneri 2a str. 301
cgacgauaacc

SEQ ID NO: 1961500 - RNA, 17 nt, Shigella flexneri 2a str. 301
ccuguugaaaaaccaga

SEQ ID NO: 1961501 - RNA, 16 nt, Shigella flexneri 2a str. 301
ccuguugccauuucug

SEQ ID NO: 1961502 - RNA, 22 nt, Shigella flexneri 2a str. 301
ccuguucgucccgauucagcac

SEQ ID NO: 1961503 - RNA, 20 nt, Shigella flexneri 2a str. 301
ccuguuuagccgcuucugca

SEQ ID NO: 1961504 - RNA, 17 nt, Shigella flexneri 2a str. 301
ccuguuuagccgcuucu

SEQ ID NO: 1961505 - RNA, 17 nt, Shigella flexneri 2a str. 301
ccuuaacuggcgcgacg

SEQ ID NO: 1961506 - RNA, 12 nt, Shigella flexneri 2a str. 301
ccuuauccggcc

SEQ ID NO: 1961507 - RNA, 20 nt, Shigella flexneri 2a str. 301
ccuuauccggccuaccguua

SEQ ID NO: 1961508 - RNA, 22 nt, Shigella flexneri 2a str. 301
ccuuacgcagcgguauaaucug

SEQ ID NO: 1961509 - RNA, 20 nt, Shigella flexneri 2a str. 301
ccuucaucccuuucgcuuca

SEQ ID NO: 1961510 - RNA, 14 nt, Shigella flexneri 2a str. 301
ccuuccagcuccag

SEQ ID NO: 1961511 - RNA, 12 nt, Shigella flexneri 2a str. 301
ccuucgcggcac

SEQ ID NO: 1961512 - RNA, 17 nt, Shigella flexneri 2a str. 301
ccuucgacuuucagugg

SEQ ID NO: 1961513 - RNA, 19 nt, Shigella flexneri 2a str. 301
cgaaacgaaagucccgaua

SEQ ID NO: 1961514 - RNA, 21 nt, Shigella flexneri 2a str. 301
cgaaaccgcgcgcgcuagcgu

SEQ ID NO: 1961515 - RNA, 23 nt, Shigella flexneri 2a str. 301
cgaaaaugcccgccgugcugcca

SEQ ID NO: 1961516 - RNA, 15 nt, Shigella flexneri 2a str. 301
cgaaaaugcgcauga

SEQ ID NO: 1961517 - RNA, 14 nt, Shigella flexneri 2a str. 301
cgaaaaaugaauac

SEQ ID NO: 1961518 - RNA, 23 nt, Shigella flexneri 2a str. 301
cgaaaaagaaucgauuaucuucg

SEQ ID NO: 1961519 - RNA, 17 nt, Shigella flexneri 2a str. 301
ccuuuuuuacagguguu

SEQ ID NO: 1961520 - RNA, 14 nt, Shigella flexneri 2a str. 301
ccuuuuuucagcgg

SEQ ID NO: 1961521 - RNA, 24 nt, Shigella flexneri 2a str. 301
ccuuuucgccaccggcaaucugcu

SEQ ID NO: 1961522 - RNA, 22 nt, Shigella flexneri 2a str. 301
ccuuuguaggccagauaagacg

SEQ ID NO: 1961523 - RNA, 13 nt, Shigella flexneri 2a str. 301
ccuuuaacgaagc

SEQ ID NO: 1961524 - RNA, 20 nt, Shigella flexneri 2a str. 301
ccuugugcacuggcgcgaau

SEQ ID NO: 1961525 - RNA, 23 nt, Shigella flexneri 2a str. 301
ccuugcggaaauuccagcggcag

SEQ ID NO: 1961526 - RNA, 21 nt, Shigella flexneri 2a str. 301
ccuugcgauuacgcucggcaa

SEQ ID NO: 1961527 - RNA, 15 nt, Shigella flexneri 2a str. 301
ccuugcacucgcaga

SEQ ID NO: 1961528 - RNA, 18 nt, Shigella flexneri 2a str. 301
ccuugauaaacgccgcca

SEQ ID NO: 1961529 - RNA, 14 nt, Shigella flexneri 2a str. 301
cgaaguacgcggca

SEQ ID NO: 1961530 - RNA, 15 nt, Shigella flexneri 2a str. 301
cgaaguacgcggcaa

SEQ ID NO: 1961531 - RNA, 15 nt, Shigella flexneri 2a str. 301
cgaagguggcggaau

SEQ ID NO: 1961532 - RNA, 23 nt, Shigella flexneri 2a str. 301
cgaagcucucugcuauuccguua

SEQ ID NO: 1961533 - RNA, 19 nt, Shigella flexneri 2a str. 301
cgaagccugcgaugucuga

SEQ ID NO: 1961534 - RNA, 17 nt, Shigella flexneri 2a str. 301
cgaauaccguaacgacu

SEQ ID NO: 1961535 - RNA, 23 nt, Shigella flexneri 2a str. 301
cgaauauucugaagcaaacuuga

SEQ ID NO: 1961536 - RNA, 17 nt, Shigella flexneri 2a str. 301
cgaaugacaugcccggu

SEQ ID NO: 1961537 - RNA, 20 nt, Shigella flexneri 2a str. 301
cgaaugacguuuacuucgcu

SEQ ID NO: 1961538 - RNA, 12 nt, Shigella flexneri 2a str. 301
cgaagccgcauc

SEQ ID NO: 1961539 - RNA, 19 nt, Shigella flexneri 2a str. 301
cgaaaugacaguaucguga

SEQ ID NO: 1961540 - RNA, 14 nt, Shigella flexneri 2a str. 301
cgaaauaacugaau

SEQ ID NO: 1961541 - RNA, 22 nt, Shigella flexneri 2a str. 301
cgaaauacagguccccgcuucg

SEQ ID NO: 1961542 - RNA, 18 nt, Shigella flexneri 2a str. 301
cgaaauaaucaaaugaau

SEQ ID NO: 1961543 - RNA, 21 nt, Shigella flexneri 2a str. 301
cgaacagguugcccagcgcgc

SEQ ID NO: 1961544 - RNA, 17 nt, Shigella flexneri 2a str. 301
cgaacagguugguaucg

SEQ ID NO: 1961545 - RNA, 12 nt, Shigella flexneri 2a str. 301
cgaaccggaaca

SEQ ID NO: 1961546 - RNA, 16 nt, Shigella flexneri 2a str. 301
cgaaccguaggccgga

SEQ ID NO: 1961547 - RNA, 22 nt, Shigella flexneri 2a str. 301
cgaaccguugaggauggcgucg

SEQ ID NO: 1961548 - RNA, 15 nt, Shigella flexneri 2a str. 301
cgaacauccagcagc

SEQ ID NO: 1961549 - RNA, 13 nt, Shigella flexneri 2a str. 301
cgaugccuggcaa

SEQ ID NO: 1961550 - RNA, 21 nt, Shigella flexneri 2a str. 301
cgaugccagucgcacgccugg

SEQ ID NO: 1961551 - RNA, 16 nt, Shigella flexneri 2a str. 301
cgaugagacccgccac

SEQ ID NO: 1961552 - RNA, 17 nt, Shigella flexneri 2a str. 301
cgaugaucgucacgauc

SEQ ID NO: 1961553 - RNA, 18 nt, Shigella flexneri 2a str. 301
cgaugaucgucacgaucg

SEQ ID NO: 1961554 - RNA, 16 nt, Shigella flexneri 2a str. 301
cgaugacaucgcagca

SEQ ID NO: 1961555 - RNA, 18 nt, Shigella flexneri 2a str. 301
cgaucauuaacaccacgc

SEQ ID NO: 1961556 - RNA, 15 nt, Shigella flexneri 2a str. 301
cgauccuguucaaac

SEQ ID NO: 1961557 - RNA, 18 nt, Shigella flexneri 2a str. 301
cgaucgaagccgucagcg

SEQ ID NO: 1961558 - RNA, 13 nt, Shigella flexneri 2a str. 301
cgauagcaacgag

SEQ ID NO: 1961559 - RNA, 18 nt, Shigella flexneri 2a str. 301
cgauaggcuuccgccauc

SEQ ID NO: 1961560 - RNA, 20 nt, Shigella flexneri 2a str. 301
cgaucacagcaguccagcgc

SEQ ID NO: 1961561 - RNA, 15 nt, Shigella flexneri 2a str. 301
cgaucacauccagua

SEQ ID NO: 1961562 - RNA, 18 nt, Shigella flexneri 2a str. 301
cgauacggucgaggaacc

SEQ ID NO: 1961563 - RNA, 18 nt, Shigella flexneri 2a str. 301
cgauacgcuugcgcaucg

SEQ ID NO: 1961564 - RNA, 19 nt, Shigella flexneri 2a str. 301
cgagucgcguuaaggcguc

SEQ ID NO: 1961565 - RNA, 14 nt, Shigella flexneri 2a str. 301
cgauaaccacgcuc

SEQ ID NO: 1961566 - RNA, 15 nt, Shigella flexneri 2a str. 301
cgaggcgcuggcaga

SEQ ID NO: 1961567 - RNA, 17 nt, Shigella flexneri 2a str. 301
cgagggcgauauccuga

SEQ ID NO: 1961568 - RNA, 20 nt, Shigella flexneri 2a str. 301
cgaggaucacaaugccacca

SEQ ID NO: 1961569 - RNA, 16 nt, Shigella flexneri 2a str. 301
cgcagcaguugccagu

SEQ ID NO: 1961570 - RNA, 15 nt, Shigella flexneri 2a str. 301
cgcagccagcacugc

SEQ ID NO: 1961571 - RNA, 18 nt, Shigella flexneri 2a str. 301
cgcagaugaagcuggcaa

SEQ ID NO: 1961572 - RNA, 17 nt, Shigella flexneri 2a str. 301
cgcacuauacaaccaga

SEQ ID NO: 1961573 - RNA, 16 nt, Shigella flexneri 2a str. 301
cgcaccugccagcgcc

SEQ ID NO: 1961574 - RNA, 18 nt, Shigella flexneri 2a str. 301
cgcaccgggcuuccggca

SEQ ID NO: 1961575 - RNA, 13 nt, Shigella flexneri 2a str. 301
cgcaccagcuugc

SEQ ID NO: 1961576 - RNA, 15 nt, Shigella flexneri 2a str. 301
cgcaacgguugcgga

SEQ ID NO: 1961577 - RNA, 15 nt, Shigella flexneri 2a str. 301
cgcaacggugcggcu

SEQ ID NO: 1961578 - RNA, 19 nt, Shigella flexneri 2a str. 301
cgcaagcagacgcucguua

SEQ ID NO: 1961579 - RNA, 17 nt, Shigella flexneri 2a str. 301
cgcaagcagacgcucgu

SEQ ID NO: 1961580 - RNA, 12 nt, Shigella flexneri 2a str. 301
cgcaaagcgacg

SEQ ID NO: 1961581 - RNA, 16 nt, Shigella flexneri 2a str. 301
cgcaacggcugcugcu

SEQ ID NO: 1961582 - RNA, 22 nt, Shigella flexneri 2a str. 301
cgaugcugauguacccgcugca

SEQ ID NO: 1961583 - RNA, 19 nt, Shigella flexneri 2a str. 301
cgauggcccgcuugccaga

SEQ ID NO: 1961584 - RNA, 18 nt, Shigella flexneri 2a str. 301
cgauuuccaucuccagcu

SEQ ID NO: 1961585 - RNA, 16 nt, Shigella flexneri 2a str. 301
cgauuucaucgcccag

SEQ ID NO: 1961586 - RNA, 21 nt, Shigella flexneri 2a str. 301
cgauuucaaccacucacgaua

SEQ ID NO: 1961587 - RNA, 18 nt, Shigella flexneri 2a str. 301
cgauuuuccgauucguuu

SEQ ID NO: 1961588 - RNA, 23 nt, Shigella flexneri 2a str. 301
cgcaauccgccgucgggucagcu

SEQ ID NO: 1961589 - RNA, 16 nt, Shigella flexneri 2a str. 301
cgcaauccuuucccug

SEQ ID NO: 1961590 - RNA, 13 nt, Shigella flexneri 2a str. 301
cgcaauuccggug

SEQ ID NO: 1961591 - RNA, 16 nt, Shigella flexneri 2a str. 301
cgcaauaaccaucagc

SEQ ID NO: 1961592 - RNA, 21 nt, Shigella flexneri 2a str. 301
cgcacauccgcgucggcaagu

SEQ ID NO: 1961593 - RNA, 19 nt, Shigella flexneri 2a str. 301
cgccaacaaucucuuccag

SEQ ID NO: 1961594 - RNA, 16 nt, Shigella flexneri 2a str. 301
cgccaccacaacauuc

SEQ ID NO: 1961595 - RNA, 21 nt, Shigella flexneri 2a str. 301
cgccacagccgagcgccacca

SEQ ID NO: 1961596 - RNA, 13 nt, Shigella flexneri 2a str. 301
cgccacagcagcc

SEQ ID NO: 1961597 - RNA, 22 nt, Shigella flexneri 2a str. 301
cgcauccggcaauaagcaacgc

SEQ ID NO: 1961598 - RNA, 20 nt, Shigella flexneri 2a str. 301
cgcaucgaauugcgcauccg

SEQ ID NO: 1961599 - RNA, 15 nt, Shigella flexneri 2a str. 301
cgcaucuucgcccac

SEQ ID NO: 1961600 - RNA, 16 nt, Shigella flexneri 2a str. 301
cgcaugaauuacgcaa

SEQ ID NO: 1961601 - RNA, 19 nt, Shigella flexneri 2a str. 301
cgcaucggucagacccagu

SEQ ID NO: 1961602 - RNA, 13 nt, Shigella flexneri 2a str. 301
cgcaucgggcgau

SEQ ID NO: 1961603 - RNA, 15 nt, Shigella flexneri 2a str. 301
cgcauggcggcagcg

SEQ ID NO: 1961604 - RNA, 14 nt, Shigella flexneri 2a str. 301
cgcagccaucagcg

SEQ ID NO: 1961605 - RNA, 13 nt, Shigella flexneri 2a str. 301
cgcagccaucagc

SEQ ID NO: 1961606 - RNA, 12 nt, Shigella flexneri 2a str. 301
cgcagcccaucc

SEQ ID NO: 1961607 - RNA, 15 nt, Shigella flexneri 2a str. 301
cgcaggauaucgugg

SEQ ID NO: 1961608 - RNA, 15 nt, Shigella flexneri 2a str. 301
cgcaggauaaccuuc

SEQ ID NO: 1961609 - RNA, 23 nt, Shigella flexneri 2a str. 301
cgcaggaucgacugcaaaccaug

SEQ ID NO: 1961610 - RNA, 15 nt, Shigella flexneri 2a str. 301
cgcaggacgggcaau

SEQ ID NO: 1961611 - RNA, 21 nt, Shigella flexneri 2a str. 301
cgcaucaggcaaugggcaaac

SEQ ID NO: 1961612 - RNA, 15 nt, Shigella flexneri 2a str. 301
cgcaucaggcaaugg

SEQ ID NO: 1961613 - RNA, 18 nt, Shigella flexneri 2a str. 301
cgcaucaggcaucugcgc

SEQ ID NO: 1961614 - RNA, 14 nt, Shigella flexneri 2a str. 301
cgcaucaggcauga

SEQ ID NO: 1961615 - RNA, 23 nt, Shigella flexneri 2a str. 301
cgcauaacugccggaugcggcgu

SEQ ID NO: 1961616 - RNA, 14 nt, Shigella flexneri 2a str. 301
cgcauacgcagcau

SEQ ID NO: 1961617 - RNA, 22 nt, Shigella flexneri 2a str. 301
cgcauacggguaaaggcguugg

SEQ ID NO: 1961618 - RNA, 22 nt, Shigella flexneri 2a str. 301
cgcaguaccacuucauccggau

SEQ ID NO: 1961619 - RNA, 15 nt, Shigella flexneri 2a str. 301
cgcagucaccagcau

SEQ ID NO: 1961620 - RNA, 19 nt, Shigella flexneri 2a str. 301
cgcaguuuaucgaccgcuu

SEQ ID NO: 1961621 - RNA, 17 nt, Shigella flexneri 2a str. 301
cgcaguucgcacaccgc

SEQ ID NO: 1961622 - RNA, 16 nt, Shigella flexneri 2a str. 301
cgcagugauugccgca

SEQ ID NO: 1961623 - RNA, 22 nt, Shigella flexneri 2a str. 301
ccguuuuuacccagcagcagcg

SEQ ID NO: 1961624 - RNA, 12 nt, Shigella flexneri 2a str. 301
ccguuuuccagc

SEQ ID NO: 1961625 - RNA, 14 nt, Shigella flexneri 2a str. 301
ccguuuuccagccu

SEQ ID NO: 1961626 - RNA, 21 nt, Shigella flexneri 2a str. 301
ccguugcuugaugcacuggga

SEQ ID NO: 1961627 - RNA, 13 nt, Shigella flexneri 2a str. 301
ccguuggcgcugg

SEQ ID NO: 1961628 - RNA, 17 nt, Shigella flexneri 2a str. 301
ccuacaggaaacgauuc

SEQ ID NO: 1961629 - RNA, 18 nt, Shigella flexneri 2a str. 301
ccuacauuggugccggau

SEQ ID NO: 1961630 - RNA, 22 nt, Shigella flexneri 2a str. 301
ccuaauuccgcgcgaacgguaa

SEQ ID NO: 1961631 - RNA, 19 nt, Shigella flexneri 2a str. 301
ccuacaaaaucuauugcaa

SEQ ID NO: 1961632 - RNA, 13 nt, Shigella flexneri 2a str. 301
ccuacaaagggcu

SEQ ID NO: 1961633 - RNA, 12 nt, Shigella flexneri 2a str. 301
ccuaaaucgcua

SEQ ID NO: 1961634 - RNA, 18 nt, Shigella flexneri 2a str. 301
ccuaagccauuuaacuca

SEQ ID NO: 1961635 - RNA, 18 nt, Shigella flexneri 2a str. 301
ccuaccggcuggcgcaua

SEQ ID NO: 1961636 - RNA, 20 nt, Shigella flexneri 2a str. 301
ccuagaaggaacaacguauc

SEQ ID NO: 1961637 - RNA, 15 nt, Shigella flexneri 2a str. 301
ccguuaauuuccgcg

SEQ ID NO: 1961638 - RNA, 12 nt, Shigella flexneri 2a str. 301
ccguuccgcgac

SEQ ID NO: 1961639 - RNA, 19 nt, Shigella flexneri 2a str. 301
ccguugcaauacuuccgcu

SEQ ID NO: 1961640 - RNA, 14 nt, Shigella flexneri 2a str. 301
ccguugccgcagcg

SEQ ID NO: 1961641 - RNA, 16 nt, Shigella flexneri 2a str. 301
ccuaugcauaauccug

SEQ ID NO: 1961642 - RNA, 19 nt, Shigella flexneri 2a str. 301
ccuccggggaagcgcaugg

SEQ ID NO: 1961643 - RNA, 23 nt, Shigella flexneri 2a str. 301
ccguccuucaucuucauccggcu

SEQ ID NO: 1961644 - RNA, 23 nt, Shigella flexneri 2a str. 301
ccguccguuauaucgcgcugacg

SEQ ID NO: 1961645 - RNA, 16 nt, Shigella flexneri 2a str. 301
ccguacgcaucaccag

SEQ ID NO: 1961646 - RNA, 17 nt, Shigella flexneri 2a str. 301
ccguacguuacguacuu

SEQ ID NO: 1961647 - RNA, 16 nt, Shigella flexneri 2a str. 301
ccguaaugaucgcgau

SEQ ID NO: 1961648 - RNA, 18 nt, Shigella flexneri 2a str. 301
ccguaaugaucgcgaucg

SEQ ID NO: 1961649 - RNA, 13 nt, Shigella flexneri 2a str. 301
ccguaauuccgcu

SEQ ID NO: 1961650 - RNA, 19 nt, Shigella flexneri 2a str. 301
ccgucaguuugccguacca

SEQ ID NO: 1961651 - RNA, 17 nt, Shigella flexneri 2a str. 301
ccgugacugggugccgc

SEQ ID NO: 1961652 - RNA, 17 nt, Shigella flexneri 2a str. 301
ccgugaacaauuucagc

SEQ ID NO: 1961653 - RNA, 15 nt, Shigella flexneri 2a str. 301
ccggucgcgcgggaa

SEQ ID NO: 1961654 - RNA, 19 nt, Shigella flexneri 2a str. 301
ccggucgcaggcaguacug

SEQ ID NO: 1961655 - RNA, 19 nt, Shigella flexneri 2a str. 301
ccggucuaccgauccggca

SEQ ID NO: 1961656 - RNA, 17 nt, Shigella flexneri 2a str. 301
ccggugaaucgcaauuu

SEQ ID NO: 1961657 - RNA, 17 nt, Shigella flexneri 2a str. 301
ccgguuuggcauaacca

SEQ ID NO: 1961658 - RNA, 18 nt, Shigella flexneri 2a str. 301
ccgguuuguaggccugau

SEQ ID NO: 1961659 - RNA, 12 nt, Shigella flexneri 2a str. 301
ccgguuucgcca

SEQ ID NO: 1961660 - RNA, 14 nt, Shigella flexneri 2a str. 301
ccguaagcgcggag

SEQ ID NO: 1961661 - RNA, 17 nt, Shigella flexneri 2a str. 301
ccguaagcgucguucgc

SEQ ID NO: 1961662 - RNA, 14 nt, Shigella flexneri 2a str. 301
ccgguucaucacga

SEQ ID NO: 1961663 - RNA, 18 nt, Shigella flexneri 2a str. 301
ccgguuaugccgcgaucg

SEQ ID NO: 1961664 - RNA, 14 nt, Shigella flexneri 2a str. 301
ccggugcaucaaca

SEQ ID NO: 1961665 - RNA, 22 nt, Shigella flexneri 2a str. 301
ccggugguuaacgaaucaaucg

SEQ ID NO: 1961666 - RNA, 15 nt, Shigella flexneri 2a str. 301
ccggcgcauccauga

SEQ ID NO: 1961667 - RNA, 17 nt, Shigella flexneri 2a str. 301
ccggccuaucaacgucg

SEQ ID NO: 1961668 - RNA, 23 nt, Shigella flexneri 2a str. 301
ccggccaguaagcaguccagcgc

SEQ ID NO: 1961669 - RNA, 12 nt, Shigella flexneri 2a str. 301
ccggccagcauc

SEQ ID NO: 1961670 - RNA, 22 nt, Shigella flexneri 2a str. 301
ccgcuuuguguaaguuuaaccu

SEQ ID NO: 1961671 - RNA, 18 nt, Shigella flexneri 2a str. 301
ccggaaacccugcgucag

SEQ ID NO: 1961672 - RNA, 19 nt, Shigella flexneri 2a str. 301
ccgggcuuccggcaauggc

SEQ ID NO: 1961673 - RNA, 13 nt, Shigella flexneri 2a str. 301
ccgggcuuuccgc

SEQ ID NO: 1961674 - RNA, 14 nt, Shigella flexneri 2a str. 301
ccgggaucacauca

SEQ ID NO: 1961675 - RNA, 19 nt, Shigella flexneri 2a str. 301
ccggcuuaccaaauaaacg

SEQ ID NO: 1961676 - RNA, 16 nt, Shigella flexneri 2a str. 301
ccgggcaucagcagca

SEQ ID NO: 1961677 - RNA, 19 nt, Shigella flexneri 2a str. 301
aaauugcuguuacgccaga

SEQ ID NO: 1961678 - RNA, 23 nt, Shigella flexneri 2a str. 301
ccggcguaugcccagggcaaugu

SEQ ID NO: 1961679 - RNA, 17 nt, Shigella flexneri 2a str. 301
ccggcgggucgcugccg

SEQ ID NO: 1961680 - RNA, 18 nt, Shigella flexneri 2a str. 301
ccggcgucgcauccggca

SEQ ID NO: 1961681 - RNA, 18 nt, Shigella flexneri 2a str. 301
ccggcgucgcauccgaca

SEQ ID NO: 1961682 - RNA, 15 nt, Shigella flexneri 2a str. 301
ccggcugcaaccaga

SEQ ID NO: 1961683 - RNA, 20 nt, Shigella flexneri 2a str. 301
ccgcucuuucaccgccgaga

SEQ ID NO: 1961684 - RNA, 20 nt, Shigella flexneri 2a str. 301
ccgcucuuuuguucgcggcg

SEQ ID NO: 1961685 - RNA, 22 nt, Shigella flexneri 2a str. 301
ccgcuucaucgguuaaccggca

SEQ ID NO: 1961686 - RNA, 16 nt, Shigella flexneri 2a str. 301
ccgcuucaucgugcuc

SEQ ID NO: 1961687 - RNA, 22 nt, Shigella flexneri 2a str. 301
ccgcucaccugauacgcgccaa

SEQ ID NO: 1961688 - RNA, 17 nt, Shigella flexneri 2a str. 301
ccgcucaaacaccgucg

SEQ ID NO: 1961689 - RNA, 14 nt, Shigella flexneri 2a str. 301
ccgcgugcgcggca

SEQ ID NO: 1961690 - RNA, 16 nt, Shigella flexneri 2a str. 301
aaauuaacgucaccau

SEQ ID NO: 1961691 - RNA, 16 nt, Shigella flexneri 2a str. 301
aaauuauccacggcac

SEQ ID NO: 1961692 - RNA, 14 nt, Shigella flexneri 2a str. 301
ccgcggaucacgcg

SEQ ID NO: 1961693 - RNA, 12 nt, Shigella flexneri 2a str. 301
ccgcgacuggga

SEQ ID NO: 1961694 - RNA, 12 nt, Shigella flexneri 2a str. 301
aaauggcgcuuu

SEQ ID NO: 1961695 - RNA, 18 nt, Shigella flexneri 2a str. 301
aaaugguaaagaaggcau

SEQ ID NO: 1961696 - RNA, 19 nt, Shigella flexneri 2a str. 301
aaaugacgaugacugguag

SEQ ID NO: 1961697 - RNA, 16 nt, Shigella flexneri 2a str. 301
ccgccgcuucaucggu

SEQ ID NO: 1961698 - RNA, 18 nt, Shigella flexneri 2a str. 301
ccgcauggaaccaguuca

SEQ ID NO: 1961699 - RNA, 22 nt, Shigella flexneri 2a str. 301
ccgcauuuuuucuucaguuccg

SEQ ID NO: 1961700 - RNA, 16 nt, Shigella flexneri 2a str. 301
ccgccaccaccagacg

SEQ ID NO: 1961701 - RNA, 12 nt, Shigella flexneri 2a str. 301
ccgccacagcgc

SEQ ID NO: 1961702 - RNA, 19 nt, Shigella flexneri 2a str. 301
ccgccaauucguaaguaca

SEQ ID NO: 1961703 - RNA, 14 nt, Shigella flexneri 2a str. 301
ccgccaaucacgcc

SEQ ID NO: 1961704 - RNA, 17 nt, Shigella flexneri 2a str. 301
ccgccaucucuuccagc

SEQ ID NO: 1961705 - RNA, 21 nt, Shigella flexneri 2a str. 301
ccgcaacagcaauacguuuca

SEQ ID NO: 1961706 - RNA, 19 nt, Shigella flexneri 2a str. 301
ccgcaacuuauuggcaauc

SEQ ID NO: 1961707 - RNA, 14 nt, Shigella flexneri 2a str. 301
ccgcaaagcccauc

SEQ ID NO: 1961708 - RNA, 13 nt, Shigella flexneri 2a str. 301
ccgcaaauaacgu

SEQ ID NO: 1961709 - RNA, 15 nt, Shigella flexneri 2a str. 301
ccgcaaaaccaacgc

SEQ ID NO: 1961710 - RNA, 14 nt, Shigella flexneri 2a str. 301
ccgcaaaccuggca

SEQ ID NO: 1961711 - RNA, 14 nt, Shigella flexneri 2a str. 301
ccgcaaacgacacu

SEQ ID NO: 1961712 - RNA, 12 nt, Shigella flexneri 2a str. 301
ccgcaccagcgg

SEQ ID NO: 1961713 - RNA, 17 nt, Shigella flexneri 2a str. 301
ccgcaaggaagccugac

SEQ ID NO: 1961714 - RNA, 15 nt, Shigella flexneri 2a str. 301
ccgcaagcagacgcu

SEQ ID NO: 1961715 - RNA, 14 nt, Shigella flexneri 2a str. 301
ccgcaauuccggug

SEQ ID NO: 1961716 - RNA, 20 nt, Shigella flexneri 2a str. 301
ccgcaauggccguuccggca

SEQ ID NO: 1961717 - RNA, 22 nt, Shigella flexneri 2a str. 301
ccgcaauacagccagccagcac

SEQ ID NO: 1961718 - RNA, 16 nt, Shigella flexneri 2a str. 301
ccgcaccugccagcgc

SEQ ID NO: 1961719 - RNA, 12 nt, Shigella flexneri 2a str. 301
ccgcacgcuuca

SEQ ID NO: 1961720 - RNA, 23 nt, Shigella flexneri 2a str. 301
ccgcacgcuggagaacaaggcuu

SEQ ID NO: 1961721 - RNA, 23 nt, Shigella flexneri 2a str. 301
ccgagcggucggagguucgaauc

SEQ ID NO: 1961722 - RNA, 19 nt, Shigella flexneri 2a str. 301
ccgaacaacaagaagcguu

SEQ ID NO: 1961723 - RNA, 20 nt, Shigella flexneri 2a str. 301
ccgaaaucgccaaccagacg

SEQ ID NO: 1961724 - RNA, 18 nt, Shigella flexneri 2a str. 301
ccgaggauacagccgaag

SEQ ID NO: 1961725 - RNA, 18 nt, Shigella flexneri 2a str. 301
ccgauccuagaucgggca

SEQ ID NO: 1961726 - RNA, 13 nt, Shigella flexneri 2a str. 301
ccgaucaaggcau

SEQ ID NO: 1961727 - RNA, 21 nt, Shigella flexneri 2a str. 301
ccgauauguucagaaagcgcc

SEQ ID NO: 1961728 - RNA, 12 nt, Shigella flexneri 2a str. 301
ccgauauccgcc

SEQ ID NO: 1961729 - RNA, 18 nt, Shigella flexneri 2a str. 301
ccgaugcgcaaacuuauc

SEQ ID NO: 1961730 - RNA, 20 nt, Shigella flexneri 2a str. 301
ccgaugaguuaagaagaucg

SEQ ID NO: 1961731 - RNA, 20 nt, Shigella flexneri 2a str. 301
cacuguucauuaaagccgcc

SEQ ID NO: 1961732 - RNA, 19 nt, Shigella flexneri 2a str. 301
cacuguucacuuuugcugc

SEQ ID NO: 1961733 - RNA, 19 nt, Shigella flexneri 2a str. 301
cacugucuaacaacaugac

SEQ ID NO: 1961734 - RNA, 16 nt, Shigella flexneri 2a str. 301
cagaaaccaaagcggu

SEQ ID NO: 1961735 - RNA, 23 nt, Shigella flexneri 2a str. 301
cacuuaauaagaagaaaccgcua

SEQ ID NO: 1961736 - RNA, 17 nt, Shigella flexneri 2a str. 301
cagaccaauccagccgg

SEQ ID NO: 1961737 - RNA, 21 nt, Shigella flexneri 2a str. 301
cagaagcgcagaucgaacacg

SEQ ID NO: 1961738 - RNA, 20 nt, Shigella flexneri 2a str. 301
cagaaggugauggcauaacg

SEQ ID NO: 1961739 - RNA, 20 nt, Shigella flexneri 2a str. 301
cagaauagaaaguugccaga

SEQ ID NO: 1961740 - RNA, 14 nt, Shigella flexneri 2a str. 301
cagaauaugcgcca

SEQ ID NO: 1961741 - RNA, 15 nt, Shigella flexneri 2a str. 301
cagaauaacggcuga

SEQ ID NO: 1961742 - RNA, 19 nt, Shigella flexneri 2a str. 301
cagaccagcuaccacgccg

SEQ ID NO: 1961743 - RNA, 23 nt, Shigella flexneri 2a str. 301
cagaccaguuuuuucaccagcgc

SEQ ID NO: 1961744 - RNA, 23 nt, Shigella flexneri 2a str. 301
cagaccauuugaucgcuggcagc

SEQ ID NO: 1961745 - RNA, 17 nt, Shigella flexneri 2a str. 301
cagacccagacgcucag

SEQ ID NO: 1961746 - RNA, 20 nt, Shigella flexneri 2a str. 301
cagacgaaaucgaucgcuau

SEQ ID NO: 1961747 - RNA, 19 nt, Shigella flexneri 2a str. 301
cagacgauaccgcugucca

SEQ ID NO: 1961748 - RNA, 14 nt, Shigella flexneri 2a str. 301
cagaccugcgucac

SEQ ID NO: 1961749 - RNA, 16 nt, Shigella flexneri 2a str. 301
cagacuggauugccag

SEQ ID NO: 1961750 - RNA, 22 nt, Shigella flexneri 2a str. 301
cagacugaugugauccaucagg

SEQ ID NO: 1961751 - RNA, 15 nt, Shigella flexneri 2a str. 301
cagacugaauacgcu

SEQ ID NO: 1961752 - RNA, 14 nt, Shigella flexneri 2a str. 301
cagagaagcaccgc

SEQ ID NO: 1961753 - RNA, 11 nt, Shigella flexneri 2a str. 301
cagacuuugcg

SEQ ID NO: 1961754 - RNA, 22 nt, Shigella flexneri 2a str. 301
cagagaaagcaaaaauaaaugc

SEQ ID NO: 1961755 - RNA, 15 nt, Shigella flexneri 2a str. 301
cagagcagcaacaag

SEQ ID NO: 1961756 - RNA, 14 nt, Shigella flexneri 2a str. 301
cagauaauagguaa

SEQ ID NO: 1961757 - RNA, 20 nt, Shigella flexneri 2a str. 301
cacgucgucaggcaaccgcu

SEQ ID NO: 1961758 - RNA, 21 nt, Shigella flexneri 2a str. 301
cacguggugugggcggugaug

SEQ ID NO: 1961759 - RNA, 15 nt, Shigella flexneri 2a str. 301
cacguaggccggaua

SEQ ID NO: 1961760 - RNA, 18 nt, Shigella flexneri 2a str. 301
cacguccgguggcauccg

SEQ ID NO: 1961761 - RNA, 15 nt, Shigella flexneri 2a str. 301
cacucgcugacugau

SEQ ID NO: 1961762 - RNA, 18 nt, Shigella flexneri 2a str. 301
cacucggcgcggaugcgu

SEQ ID NO: 1961763 - RNA, 22 nt, Shigella flexneri 2a str. 301
cacuacugcgucgcgcguaaca

SEQ ID NO: 1961764 - RNA, 15 nt, Shigella flexneri 2a str. 301
cacguuuugcugaug

SEQ ID NO: 1961765 - RNA, 21 nt, Shigella flexneri 2a str. 301
cacuaacgcauugaacucuuc

SEQ ID NO: 1961766 - RNA, 17 nt, Shigella flexneri 2a str. 301
cacguuccccagaugcg

SEQ ID NO: 1961767 - RNA, 19 nt, Shigella flexneri 2a str. 301
cacguucaaucuggugaug

SEQ ID NO: 1961768 - RNA, 14 nt, Shigella flexneri 2a str. 301
cacguucggcggau

SEQ ID NO: 1961769 - RNA, 15 nt, Shigella flexneri 2a str. 301
cacucugaaaacgcu

SEQ ID NO: 1961770 - RNA, 22 nt, Shigella flexneri 2a str. 301
cacucgugcgucgcauccggca

SEQ ID NO: 1961771 - RNA, 17 nt, Shigella flexneri 2a str. 301
cacucgugcgucgcauc

SEQ ID NO: 1961772 - RNA, 15 nt, Shigella flexneri 2a str. 301
cacugaaugacgacg

SEQ ID NO: 1961773 - RNA, 21 nt, Shigella flexneri 2a str. 301
cacugccugucacggcgcaug

SEQ ID NO: 1961774 - RNA, 18 nt, Shigella flexneri 2a str. 301
cacugccuuucagcgcau

SEQ ID NO: 1961775 - RNA, 13 nt, Shigella flexneri 2a str. 301
cacgcugucggca

SEQ ID NO: 1961776 - RNA, 17 nt, Shigella flexneri 2a str. 301
cacgcugucggcacuga

SEQ ID NO: 1961777 - RNA, 20 nt, Shigella flexneri 2a str. 301
cacgcugucggcacugacca

SEQ ID NO: 1961778 - RNA, 23 nt, Shigella flexneri 2a str. 301
cacggaaaggcaacaugaaacag

SEQ ID NO: 1961779 - RNA, 18 nt, Shigella flexneri 2a str. 301
cacgcuuuucaucagauc

SEQ ID NO: 1961780 - RNA, 21 nt, Shigella flexneri 2a str. 301
cacggaucaggcggcucaccu

SEQ ID NO: 1961781 - RNA, 17 nt, Shigella flexneri 2a str. 301
cacgcgguuacgcaccg

SEQ ID NO: 1961782 - RNA, 23 nt, Shigella flexneri 2a str. 301
cacgcggucaauggucagcgcca

SEQ ID NO: 1961783 - RNA, 14 nt, Shigella flexneri 2a str. 301
cacgcuaauaccaa

SEQ ID NO: 1961784 - RNA, 18 nt, Shigella flexneri 2a str. 301
cacgcuaauaccggaugc

SEQ ID NO: 1961785 - RNA, 21 nt, Shigella flexneri 2a str. 301
cacgcggagcgccugucugca

SEQ ID NO: 1961786 - RNA, 12 nt, Shigella flexneri 2a str. 301
cacgcgcugccu

SEQ ID NO: 1961787 - RNA, 13 nt, Shigella flexneri 2a str. 301
cacggcgauacca

SEQ ID NO: 1961788 - RNA, 23 nt, Shigella flexneri 2a str. 301
cacggcguggcaucaauaccgcg

SEQ ID NO: 1961789 - RNA, 22 nt, Shigella flexneri 2a str. 301
cacguaacgacugacuuucggc

SEQ ID NO: 1961790 - RNA, 14 nt, Shigella flexneri 2a str. 301
cacguaccacggca

SEQ ID NO: 1961791 - RNA, 15 nt, Shigella flexneri 2a str. 301
cacgguuuuuccagc

SEQ ID NO: 1961792 - RNA, 17 nt, Shigella flexneri 2a str. 301
cacggugcgacacugcg

SEQ ID NO: 1961793 - RNA, 14 nt, Shigella flexneri 2a str. 301
cacgguauuugcca

SEQ ID NO: 1961794 - RNA, 20 nt, Shigella flexneri 2a str. 301
cacgggcgcggaaagcaccu

SEQ ID NO: 1961795 - RNA, 15 nt, Shigella flexneri 2a str. 301
cagcauacgucgaua

SEQ ID NO: 1961796 - RNA, 18 nt, Shigella flexneri 2a str. 301
cagcauauaaugcaacau

SEQ ID NO: 1961797 - RNA, 17 nt, Shigella flexneri 2a str. 301
cagcaguacgccgagaa

SEQ ID NO: 1961798 - RNA, 22 nt, Shigella flexneri 2a str. 301
cagcaguaaaccacccaccagc

SEQ ID NO: 1961799 - RNA, 17 nt, Shigella flexneri 2a str. 301
cagcaggucaccgaaau

SEQ ID NO: 1961800 - RNA, 13 nt, Shigella flexneri 2a str. 301
cagcagcgcaauu

SEQ ID NO: 1961801 - RNA, 22 nt, Shigella flexneri 2a str. 301
cagcaucggcagcgccagcgaa

SEQ ID NO: 1961802 - RNA, 24 nt, Shigella flexneri 2a str. 301
cagcaucggcggcguaucgacaau

SEQ ID NO: 1961803 - RNA, 16 nt, Shigella flexneri 2a str. 301
cagcaugcacccucaa

SEQ ID NO: 1961804 - RNA, 17 nt, Shigella flexneri 2a str. 301
cagccacuucuuccagc

SEQ ID NO: 1961805 - RNA, 22 nt, Shigella flexneri 2a str. 301
cagccaggccauuuuuucgaua

SEQ ID NO: 1961806 - RNA, 17 nt, Shigella flexneri 2a str. 301
cagccagaaagaaccgu

SEQ ID NO: 1961807 - RNA, 18 nt, Shigella flexneri 2a str. 301
cagccagccgaacagcgc

SEQ ID NO: 1961808 - RNA, 22 nt, Shigella flexneri 2a str. 301
cagauacaaaaaaggccgcagg

SEQ ID NO: 1961809 - RNA, 13 nt, Shigella flexneri 2a str. 301
cagauagcccgga

SEQ ID NO: 1961810 - RNA, 15 nt, Shigella flexneri 2a str. 301
cagcacaaugccggu

SEQ ID NO: 1961811 - RNA, 19 nt, Shigella flexneri 2a str. 301
cagcacaaugccggugaug

SEQ ID NO: 1961812 - RNA, 16 nt, Shigella flexneri 2a str. 301
cagcaccguaccggca

SEQ ID NO: 1961813 - RNA, 17 nt, Shigella flexneri 2a str. 301
cagcaccaucccgcuaa

SEQ ID NO: 1961814 - RNA, 14 nt, Shigella flexneri 2a str. 301
cagcacgucuucca

SEQ ID NO: 1961815 - RNA, 18 nt, Shigella flexneri 2a str. 301
cagcagccacaccaauca

SEQ ID NO: 1961816 - RNA, 20 nt, Shigella flexneri 2a str. 301
cagcagcaaugcaggcaccu

SEQ ID NO: 1961817 - RNA, 17 nt, Shigella flexneri 2a str. 301
cagcacguuaaucaaau

SEQ ID NO: 1961818 - RNA, 16 nt, Shigella flexneri 2a str. 301
cagcagauaugccagu

SEQ ID NO: 1961819 - RNA, 13 nt, Shigella flexneri 2a str. 301
cagccauugccau

SEQ ID NO: 1961820 - RNA, 19 nt, Shigella flexneri 2a str. 301
cagcccaauaccuucauug

SEQ ID NO: 1961821 - RNA, 19 nt, Shigella flexneri 2a str. 301
cagcccacugguuuucuug

SEQ ID NO: 1961822 - RNA, 19 nt, Shigella flexneri 2a str. 301
cagccaguuuuucagcgcc

SEQ ID NO: 1961823 - RNA, 15 nt, Shigella flexneri 2a str. 301
cagccaucaccacgc

SEQ ID NO: 1961824 - RNA, 16 nt, Shigella flexneri 2a str. 301
cagccauaaucacucu

SEQ ID NO: 1961825 - RNA, 20 nt, Shigella flexneri 2a str. 301
cagccagucggaaccggcga

SEQ ID NO: 1961826 - RNA, 22 nt, Shigella flexneri 2a str. 301
cagccgaguagaucaacacauc

SEQ ID NO: 1961827 - RNA, 21 nt, Shigella flexneri 2a str. 301
cagcgccgccagaaucaccuc

SEQ ID NO: 1961828 - RNA, 23 nt, Shigella flexneri 2a str. 301
cagcgccaccgguuuauuauuga

SEQ ID NO: 1961829 - RNA, 15 nt, Shigella flexneri 2a str. 301
cagcgaugaugagcg

SEQ ID NO: 1961830 - RNA, 21 nt, Shigella flexneri 2a str. 301
cagcgaucugcaccuggcgca

SEQ ID NO: 1961831 - RNA, 19 nt, Shigella flexneri 2a str. 301
cagcgaucuuucgcggcag

SEQ ID NO: 1961832 - RNA, 17 nt, Shigella flexneri 2a str. 301
cagcgccacauccggcu

SEQ ID NO: 1961833 - RNA, 20 nt, Shigella flexneri 2a str. 301
cagcgccaacgcaccugaaa

SEQ ID NO: 1961834 - RNA, 21 nt, Shigella flexneri 2a str. 301
cagcgcauccauuacaucacg

SEQ ID NO: 1961835 - RNA, 14 nt, Shigella flexneri 2a str. 301
cagcgcaucaggca

SEQ ID NO: 1961836 - RNA, 13 nt, Shigella flexneri 2a str. 301
cagccuucgccac

SEQ ID NO: 1961837 - RNA, 15 nt, Shigella flexneri 2a str. 301
cagccugcacgaccg

SEQ ID NO: 1961838 - RNA, 23 nt, Shigella flexneri 2a str. 301
cagccucgcuggucagcgccagu

SEQ ID NO: 1961839 - RNA, 13 nt, Shigella flexneri 2a str. 301
cagccucugccgc

SEQ ID NO: 1961840 - RNA, 23 nt, Shigella flexneri 2a str. 301
cagcgaacaccagcaguaaacca

SEQ ID NO: 1961841 - RNA, 13 nt, Shigella flexneri 2a str. 301
cagcgagccggau

SEQ ID NO: 1961842 - RNA, 14 nt, Shigella flexneri 2a str. 301
caggagauuaacgg

SEQ ID NO: 1961843 - RNA, 16 nt, Shigella flexneri 2a str. 301
caggagaagcaucagc

SEQ ID NO: 1961844 - RNA, 19 nt, Shigella flexneri 2a str. 301
caggaauaaucagcaacga

SEQ ID NO: 1961845 - RNA, 18 nt, Shigella flexneri 2a str. 301
caggaauaaucagcaacg

SEQ ID NO: 1961846 - RNA, 19 nt, Shigella flexneri 2a str. 301
caggaaaagguaggccuga

SEQ ID NO: 1961847 - RNA, 17 nt, Shigella flexneri 2a str. 301
cagcuuuuagaucacuc

SEQ ID NO: 1961848 - RNA, 21 nt, Shigella flexneri 2a str. 301
caggaaauuauggaucaccau

SEQ ID NO: 1961849 - RNA, 15 nt, Shigella flexneri 2a str. 301
cagcuuucagcagcg

SEQ ID NO: 1961850 - RNA, 14 nt, Shigella flexneri 2a str. 301
caggaacugcucau

SEQ ID NO: 1961851 - RNA, 17 nt, Shigella flexneri 2a str. 301
aaagcccaucauccgcg

SEQ ID NO: 1961852 - RNA, 23 nt, Shigella flexneri 2a str. 301
caggccagauagccaauuacgca

SEQ ID NO: 1961853 - RNA, 13 nt, Shigella flexneri 2a str. 301
caggcaucgugca

SEQ ID NO: 1961854 - RNA, 14 nt, Shigella flexneri 2a str. 301
caggcaagccgcua

SEQ ID NO: 1961855 - RNA, 17 nt, Shigella flexneri 2a str. 301
caggcaaucagcaaucg

SEQ ID NO: 1961856 - RNA, 14 nt, Shigella flexneri 2a str. 301
caggcaagcauaug

SEQ ID NO: 1961857 - RNA, 14 nt, Shigella flexneri 2a str. 301
caggcgacauauca

SEQ ID NO: 1961858 - RNA, 22 nt, Shigella flexneri 2a str. 301
caggcguucuacauaaaacgcu

SEQ ID NO: 1961859 - RNA, 17 nt, Shigella flexneri 2a str. 301
cagcuugcgauccugca

SEQ ID NO: 1961860 - RNA, 16 nt, Shigella flexneri 2a str. 301
cagcuucgaggccgga

SEQ ID NO: 1961861 - RNA, 22 nt, Shigella flexneri 2a str. 301
cagcuucacaaaggcuugcugc

SEQ ID NO: 1961862 - RNA, 20 nt, Shigella flexneri 2a str. 301
cagcugcgcuucaauacgcu

SEQ ID NO: 1961863 - RNA, 13 nt, Shigella flexneri 2a str. 301
cagcucgcugcca

SEQ ID NO: 1961864 - RNA, 20 nt, Shigella flexneri 2a str. 301
cagcugacaaucgcugcggc

SEQ ID NO: 1961865 - RNA, 20 nt, Shigella flexneri 2a str. 301
cagcucauccauaaauaccu

SEQ ID NO: 1961866 - RNA, 12 nt, Shigella flexneri 2a str. 301
cagcucauccag

SEQ ID NO: 1961867 - RNA, 23 nt, Shigella flexneri 2a str. 301
cagcuccgggcucaugcugucca

SEQ ID NO: 1961868 - RNA, 18 nt, Shigella flexneri 2a str. 301
cagcuccucuuucaucuc

SEQ ID NO: 1961869 - RNA, 20 nt, Shigella flexneri 2a str. 301
cagcguuucgaacaggccga

SEQ ID NO: 1961870 - RNA, 23 nt, Shigella flexneri 2a str. 301
cagcguugaaugcaugcccggca

SEQ ID NO: 1961871 - RNA, 17 nt, Shigella flexneri 2a str. 301
cagcucacaaauacgcu

SEQ ID NO: 1961872 - RNA, 16 nt, Shigella flexneri 2a str. 301
cagcgucgcacccggc

SEQ ID NO: 1961873 - RNA, 21 nt, Shigella flexneri 2a str. 301
cagcgucgcaucaggcaaugu

SEQ ID NO: 1961874 - RNA, 23 nt, Shigella flexneri 2a str. 301
cagcgucagcauaaaaauauuga

SEQ ID NO: 1961875 - RNA, 14 nt, Shigella flexneri 2a str. 301
cagcgucagcauca

SEQ ID NO: 1961876 - RNA, 21 nt, Shigella flexneri 2a str. 301
cagcguaccaugauccugcaa

SEQ ID NO: 1961877 - RNA, 14 nt, Shigella flexneri 2a str. 301
cauccagcagacgc

SEQ ID NO: 1961878 - RNA, 19 nt, Shigella flexneri 2a str. 301
cauccagagaucgcguagc

SEQ ID NO: 1961879 - RNA, 17 nt, Shigella flexneri 2a str. 301
cauccagacugcucagc

SEQ ID NO: 1961880 - RNA, 12 nt, Shigella flexneri 2a str. 301
cauccaccagug

SEQ ID NO: 1961881 - RNA, 15 nt, Shigella flexneri 2a str. 301
caucaucgauaccaa

SEQ ID NO: 1961882 - RNA, 18 nt, Shigella flexneri 2a str. 301
caucaugguuugcaucca

SEQ ID NO: 1961883 - RNA, 18 nt, Shigella flexneri 2a str. 301
caucaccauaaaucagau

SEQ ID NO: 1961884 - RNA, 19 nt, Shigella flexneri 2a str. 301
cauccgcuggcccaucaga

SEQ ID NO: 1961885 - RNA, 16 nt, Shigella flexneri 2a str. 301
cauccgcgugacgcug

SEQ ID NO: 1961886 - RNA, 22 nt, Shigella flexneri 2a str. 301
cauccgcuugcguaucgacggc

SEQ ID NO: 1961887 - RNA, 13 nt, Shigella flexneri 2a str. 301
caucgacagcaaa

SEQ ID NO: 1961888 - RNA, 19 nt, Shigella flexneri 2a str. 301
cauccuuugggcauuugca

SEQ ID NO: 1961889 - RNA, 15 nt, Shigella flexneri 2a str. 301
caucgaaccaucggc

SEQ ID NO: 1961890 - RNA, 12 nt, Shigella flexneri 2a str. 301
cauccugcuggu

SEQ ID NO: 1961891 - RNA, 19 nt, Shigella flexneri 2a str. 301
caucgauaccaucgcuuca

SEQ ID NO: 1961892 - RNA, 16 nt, Shigella flexneri 2a str. 301
caucgauaaucaccga

SEQ ID NO: 1961893 - RNA, 21 nt, Shigella flexneri 2a str. 301
caucgcauccgacaucaaccg

SEQ ID NO: 1961894 - RNA, 18 nt, Shigella flexneri 2a str. 301
caucgcauaacagagcga

SEQ ID NO: 1961895 - RNA, 13 nt, Shigella flexneri 2a str. 301
caucgcagcaaac

SEQ ID NO: 1961896 - RNA, 14 nt, Shigella flexneri 2a str. 301
caucgccacaccag

SEQ ID NO: 1961897 - RNA, 16 nt, Shigella flexneri 2a str. 301
caucgccacaccagua

SEQ ID NO: 1961898 - RNA, 20 nt, Shigella flexneri 2a str. 301
cauaaacaacgagcuucagc

SEQ ID NO: 1961899 - RNA, 17 nt, Shigella flexneri 2a str. 301
cauaaacgccgucauca

SEQ ID NO: 1961900 - RNA, 15 nt, Shigella flexneri 2a str. 301
cauaccaccgacgug

SEQ ID NO: 1961901 - RNA, 22 nt, Shigella flexneri 2a str. 301
cauacaucgcgcuuaucgccag

SEQ ID NO: 1961902 - RNA, 14 nt, Shigella flexneri 2a str. 301
cauaaucugcaaau

SEQ ID NO: 1961903 - RNA, 20 nt, Shigella flexneri 2a str. 301
cauaaucgggaugcguaaca

SEQ ID NO: 1961904 - RNA, 15 nt, Shigella flexneri 2a str. 301
cauacagaugcugcu

SEQ ID NO: 1961905 - RNA, 13 nt, Shigella flexneri 2a str. 301
caguugguuaauc

SEQ ID NO: 1961906 - RNA, 13 nt, Shigella flexneri 2a str. 301
caguuguugcaua

SEQ ID NO: 1961907 - RNA, 16 nt, Shigella flexneri 2a str. 301
caguuuauccagccac

SEQ ID NO: 1961908 - RNA, 13 nt, Shigella flexneri 2a str. 301
caguuuugugccc

SEQ ID NO: 1961909 - RNA, 13 nt, Shigella flexneri 2a str. 301
cauaaaacgcuua

SEQ ID NO: 1961910 - RNA, 12 nt, Shigella flexneri 2a str. 301
cauaaaaaccug

SEQ ID NO: 1961911 - RNA, 15 nt, Shigella flexneri 2a str. 301
caguugcuucaucuc

SEQ ID NO: 1961912 - RNA, 21 nt, Shigella flexneri 2a str. 301
cauacccgcaacauacugccc

SEQ ID NO: 1961913 - RNA, 15 nt, Shigella flexneri 2a str. 301
cauagcgacaggcuu

SEQ ID NO: 1961914 - RNA, 15 nt, Shigella flexneri 2a str. 301
cauagcgucccagua

SEQ ID NO: 1961915 - RNA, 22 nt, Shigella flexneri 2a str. 301
cauagggugugacgacaccauc

SEQ ID NO: 1961916 - RNA, 13 nt, Shigella flexneri 2a str. 301
cauauccgcaaug

SEQ ID NO: 1961917 - RNA, 21 nt, Shigella flexneri 2a str. 301
cauaucauucgacaacugcug

SEQ ID NO: 1961918 - RNA, 22 nt, Shigella flexneri 2a str. 301
cauaucaacgccucgcguccgc

SEQ ID NO: 1961919 - RNA, 12 nt, Shigella flexneri 2a str. 301
cauauaagcguu

SEQ ID NO: 1961920 - RNA, 15 nt, Shigella flexneri 2a str. 301
cauauaccgcaucag

SEQ ID NO: 1961921 - RNA, 22 nt, Shigella flexneri 2a str. 301
cauauacgccaucgccagcagc

SEQ ID NO: 1961922 - RNA, 18 nt, Shigella flexneri 2a str. 301
cauauacgccaucgccag

SEQ ID NO: 1961923 - RNA, 15 nt, Shigella flexneri 2a str. 301
caucaaacgaagccu

SEQ ID NO: 1961924 - RNA, 16 nt, Shigella flexneri 2a str. 301
caucaaacggcauaug

SEQ ID NO: 1961925 - RNA, 14 nt, Shigella flexneri 2a str. 301
cauaugcgccagcu

SEQ ID NO: 1961926 - RNA, 23 nt, Shigella flexneri 2a str. 301
caucaacaacaauuucacuugcu

SEQ ID NO: 1961927 - RNA, 20 nt, Shigella flexneri 2a str. 301
caucaacaacuggcguuucu

SEQ ID NO: 1961928 - RNA, 22 nt, Shigella flexneri 2a str. 301
caucaaauuacccugcacguug

SEQ ID NO: 1961929 - RNA, 21 nt, Shigella flexneri 2a str. 301
caucaaaguuuuuaugaguuu

SEQ ID NO: 1961930 - RNA, 19 nt, Shigella flexneri 2a str. 301
caucaagauuagcgacgaa

SEQ ID NO: 1961931 - RNA, 15 nt, Shigella flexneri 2a str. 301
caucaacgccauacg

SEQ ID NO: 1961932 - RNA, 19 nt, Shigella flexneri 2a str. 301
caucaacuggcaaccagaa

SEQ ID NO: 1961933 - RNA, 18 nt, Shigella flexneri 2a str. 301
caggguuugcaucgccau

SEQ ID NO: 1961934 - RNA, 21 nt, Shigella flexneri 2a str. 301
cagggccaucgcgguuaaucg

SEQ ID NO: 1961935 - RNA, 19 nt, Shigella flexneri 2a str. 301
cagggacgagucgucgaua

SEQ ID NO: 1961936 - RNA, 18 nt, Shigella flexneri 2a str. 301
cagguaauuugaucaaau

SEQ ID NO: 1961937 - RNA, 14 nt, Shigella flexneri 2a str. 301
cagguaaggcgcga

SEQ ID NO: 1961938 - RNA, 18 nt, Shigella flexneri 2a str. 301
cagguaaagugcgagucg

SEQ ID NO: 1961939 - RNA, 23 nt, Shigella flexneri 2a str. 301
caggucaucauugcagucauaac

SEQ ID NO: 1961940 - RNA, 21 nt, Shigella flexneri 2a str. 301
cagguaguguuggaucugauc

SEQ ID NO: 1961941 - RNA, 13 nt, Shigella flexneri 2a str. 301
cagguaucgacaa

SEQ ID NO: 1961942 - RNA, 21 nt, Shigella flexneri 2a str. 301
cagguuucaccuuuuuccaga

SEQ ID NO: 1961943 - RNA, 12 nt, Shigella flexneri 2a str. 301
cagguucaacag

SEQ ID NO: 1961944 - RNA, 17 nt, Shigella flexneri 2a str. 301
caggugguuagcugcgu

SEQ ID NO: 1961945 - RNA, 16 nt, Shigella flexneri 2a str. 301
caggucguccugcaaa

SEQ ID NO: 1961946 - RNA, 16 nt, Shigella flexneri 2a str. 301
caguucgccguacuga

SEQ ID NO: 1961947 - RNA, 20 nt, Shigella flexneri 2a str. 301
caguucgccguacugacggc

SEQ ID NO: 1961948 - RNA, 13 nt, Shigella flexneri 2a str. 301
caguucgcggaua

SEQ ID NO: 1961949 - RNA, 17 nt, Shigella flexneri 2a str. 301
caguucgauuucccagc

SEQ ID NO: 1961950 - RNA, 16 nt, Shigella flexneri 2a str. 301
caguucuggcaccgga

SEQ ID NO: 1961951 - RNA, 12 nt, Shigella flexneri 2a str. 301
caguugaucacc

SEQ ID NO: 1961952 - RNA, 14 nt, Shigella flexneri 2a str. 301
caguugauccagcu

SEQ ID NO: 1961953 - RNA, 20 nt, Shigella flexneri 2a str. 301
caguugauuaugaucgccac

SEQ ID NO: 1961954 - RNA, 15 nt, Shigella flexneri 2a str. 301
caguucguucgggca

SEQ ID NO: 1961955 - RNA, 12 nt, Shigella flexneri 2a str. 301
caguggcugcgu

SEQ ID NO: 1961956 - RNA, 13 nt, Shigella flexneri 2a str. 301
cagugggcgcugc

SEQ ID NO: 1961957 - RNA, 17 nt, Shigella flexneri 2a str. 301
caguuacccagcggaua

SEQ ID NO: 1961958 - RNA, 19 nt, Shigella flexneri 2a str. 301
caguuccagcagcgcaauu

SEQ ID NO: 1961959 - RNA, 13 nt, Shigella flexneri 2a str. 301
caguaaacgcuuu

SEQ ID NO: 1961960 - RNA, 18 nt, Shigella flexneri 2a str. 301
cagguuuuguucuggugc

SEQ ID NO: 1961961 - RNA, 16 nt, Shigella flexneri 2a str. 301
cagguuuuucagcugc

SEQ ID NO: 1961962 - RNA, 14 nt, Shigella flexneri 2a str. 301
caguaacguugcau

SEQ ID NO: 1961963 - RNA, 19 nt, Shigella flexneri 2a str. 301
caguaagacaccccacagc

SEQ ID NO: 1961964 - RNA, 20 nt, Shigella flexneri 2a str. 301
caguaaugaucggcgcgaaa

SEQ ID NO: 1961965 - RNA, 19 nt, Shigella flexneri 2a str. 301
caguaauugacgcauccga

SEQ ID NO: 1961966 - RNA, 13 nt, Shigella flexneri 2a str. 301
caguaccagcagc

SEQ ID NO: 1961967 - RNA, 15 nt, Shigella flexneri 2a str. 301
cagucggcguaaucc

SEQ ID NO: 1961968 - RNA, 18 nt, Shigella flexneri 2a str. 301
cagugaaaguuuucaccg

SEQ ID NO: 1961969 - RNA, 15 nt, Shigella flexneri 2a str. 301
cagugaaaccgugaa

SEQ ID NO: 1961970 - RNA, 20 nt, Shigella flexneri 2a str. 301
cagugaacaauuaacguauc

SEQ ID NO: 1961971 - RNA, 23 nt, Shigella flexneri 2a str. 301
cagucgcuauuacgcacacuuuu

SEQ ID NO: 1961972 - RNA, 23 nt, Shigella flexneri 2a str. 301
cagugaugaaaacgaaggccgga

SEQ ID NO: 1961973 - RNA, 16 nt, Shigella flexneri 2a str. 301
cagugaccuuaaucag

SEQ ID NO: 1961974 - RNA, 15 nt, Shigella flexneri 2a str. 301
cagugaguguggcgu

SEQ ID NO: 1961975 - RNA, 18 nt, Shigella flexneri 2a str. 301
cagugaccaucuuccagc

SEQ ID NO: 1961976 - RNA, 18 nt, Shigella flexneri 2a str. 301
cagugacuucugccagcu

SEQ ID NO: 1961977 - RNA, 15 nt, Shigella flexneri 2a str. 301
cauguugaucauaaa

SEQ ID NO: 1961978 - RNA, 22 nt, Shigella flexneri 2a str. 301
cauuaaauccugaaaccauagc

SEQ ID NO: 1961979 - RNA, 15 nt, Shigella flexneri 2a str. 301
cauuaaacaccagua

SEQ ID NO: 1961980 - RNA, 16 nt, Shigella flexneri 2a str. 301
cauguugaucccggcu

SEQ ID NO: 1961981 - RNA, 15 nt, Shigella flexneri 2a str. 301
cauguugaucgccac

SEQ ID NO: 1961982 - RNA, 14 nt, Shigella flexneri 2a str. 301
cauguugcugaccu

SEQ ID NO: 1961983 - RNA, 20 nt, Shigella flexneri 2a str. 301
cauuaaugcacuuccagcgg

SEQ ID NO: 1961984 - RNA, 16 nt, Shigella flexneri 2a str. 301
cauuaaucugcucggc

SEQ ID NO: 1961985 - RNA, 19 nt, Shigella flexneri 2a str. 301
cauuagugauuaacgcuug

SEQ ID NO: 1961986 - RNA, 16 nt, Shigella flexneri 2a str. 301
cauucacacuccaguc

SEQ ID NO: 1961987 - RNA, 15 nt, Shigella flexneri 2a str. 301
cauucaccagcccac

SEQ ID NO: 1961988 - RNA, 21 nt, Shigella flexneri 2a str. 301
cauucaauacucgcacuaucg

SEQ ID NO: 1961989 - RNA, 16 nt, Shigella flexneri 2a str. 301
cauucgguugccagcg

SEQ ID NO: 1961990 - RNA, 13 nt, Shigella flexneri 2a str. 301
cauucgccagucc

SEQ ID NO: 1961991 - RNA, 18 nt, Shigella flexneri 2a str. 301
cauuccggcgcaguauga

SEQ ID NO: 1961992 - RNA, 22 nt, Shigella flexneri 2a str. 301
cauugccggaugacgcgucagg

SEQ ID NO: 1961993 - RNA, 17 nt, Shigella flexneri 2a str. 301
cauugcaucaucgacau

SEQ ID NO: 1961994 - RNA, 23 nt, Shigella flexneri 2a str. 301
cauucgucguauagaucacuuug

SEQ ID NO: 1961995 - RNA, 22 nt, Shigella flexneri 2a str. 301
cauucucggcccggcccaacgc

SEQ ID NO: 1961996 - RNA, 23 nt, Shigella flexneri 2a str. 301
cauugaauuuuauguuucgcauc

SEQ ID NO: 1961997 - RNA, 14 nt, Shigella flexneri 2a str. 301
cauugacgcaucgc

SEQ ID NO: 1961998 - RNA, 23 nt, Shigella flexneri 2a str. 301
caucgcccugauggcgcgccacc

SEQ ID NO: 1961999 - RNA, 14 nt, Shigella flexneri 2a str. 301
caucgcccugaugg

SEQ ID NO: 1962000 - RNA, 17 nt, Shigella flexneri 2a str. 301
caugcucagaugccuga

SEQ ID NO: 1962001 - RNA, 15 nt, Shigella flexneri 2a str. 301
caugcucaccacgua

SEQ ID NO: 1962002 - RNA, 12 nt, Shigella flexneri 2a str. 301
caugcuccagca

SEQ ID NO: 1962003 - RNA, 18 nt, Shigella flexneri 2a str. 301
caugcucagaugccugau

SEQ ID NO: 1962004 - RNA, 21 nt, Shigella flexneri 2a str. 301
caugcuccagcagauggcagu

SEQ ID NO: 1962005 - RNA, 14 nt, Shigella flexneri 2a str. 301
caugcucugccagc

SEQ ID NO: 1962006 - RNA, 15 nt, Shigella flexneri 2a str. 301
cauggacgcgucagu

SEQ ID NO: 1962007 - RNA, 22 nt, Shigella flexneri 2a str. 301
caugcugucggcugccagccau

SEQ ID NO: 1962008 - RNA, 15 nt, Shigella flexneri 2a str. 301
caugguaaugaucgc

SEQ ID NO: 1962009 - RNA, 17 nt, Shigella flexneri 2a str. 301
caugguuugcauccaca

SEQ ID NO: 1962010 - RNA, 23 nt, Shigella flexneri 2a str. 301
cauuggcgcgcguaugcgucagc

SEQ ID NO: 1962011 - RNA, 23 nt, Shigella flexneri 2a str. 301
cauugcuuugguggucaccauga

SEQ ID NO: 1962012 - RNA, 14 nt, Shigella flexneri 2a str. 301
cauugcugccagaa

SEQ ID NO: 1962013 - RNA, 19 nt, Shigella flexneri 2a str. 301
cauugcuguaucacuauga

SEQ ID NO: 1962014 - RNA, 20 nt, Shigella flexneri 2a str. 301
cauuggguucaucugauagc

SEQ ID NO: 1962015 - RNA, 15 nt, Shigella flexneri 2a str. 301
cauuguuucucugac

SEQ ID NO: 1962016 - RNA, 15 nt, Shigella flexneri 2a str. 301
cauuuacgccgcauc

SEQ ID NO: 1962017 - RNA, 18 nt, Shigella flexneri 2a str. 301
cauuuguggguucagcgg

SEQ ID NO: 1962018 - RNA, 14 nt, Shigella flexneri 2a str. 301
cauuuugacccggu

SEQ ID NO: 1962019 - RNA, 23 nt, Shigella flexneri 2a str. 301
cauuugcacugaaugccggaugc

SEQ ID NO: 1962020 - RNA, 12 nt, Shigella flexneri 2a str. 301
ccaaaaccgcuc

SEQ ID NO: 1962021 - RNA, 22 nt, Shigella flexneri 2a str. 301
cauuuuuggugcuuuaaucgcc

SEQ ID NO: 1962022 - RNA, 23 nt, Shigella flexneri 2a str. 301
ccaaaauugguuucagccggauc

SEQ ID NO: 1962023 - RNA, 16 nt, Shigella flexneri 2a str. 301
ccaaacagcgccagau

SEQ ID NO: 1962024 - RNA, 14 nt, Shigella flexneri 2a str. 301
ccaaaaugccugau

SEQ ID NO: 1962025 - RNA, 14 nt, Shigella flexneri 2a str. 301
ccaaaacguaacca

SEQ ID NO: 1962026 - RNA, 16 nt, Shigella flexneri 2a str. 301
ccaacaauugucgcca

SEQ ID NO: 1962027 - RNA, 17 nt, Shigella flexneri 2a str. 301
ccaaacgcucccugcca

SEQ ID NO: 1962028 - RNA, 12 nt, Shigella flexneri 2a str. 301
ccaaaccugcac

SEQ ID NO: 1962029 - RNA, 21 nt, Shigella flexneri 2a str. 301
ccaaccgauaucuuuccggca

SEQ ID NO: 1962030 - RNA, 23 nt, Shigella flexneri 2a str. 301
ccaagcguagcugguucucgcuu

SEQ ID NO: 1962031 - RNA, 18 nt, Shigella flexneri 2a str. 301
ccaacugugccgccgcca

SEQ ID NO: 1962032 - RNA, 20 nt, Shigella flexneri 2a str. 301
ccaauagucaucgucgcggu

SEQ ID NO: 1962033 - RNA, 21 nt, Shigella flexneri 2a str. 301
ccacaauggcauauuccgcca

SEQ ID NO: 1962034 - RNA, 16 nt, Shigella flexneri 2a str. 301
ccaauuccgcagcgcg

SEQ ID NO: 1962035 - RNA, 17 nt, Shigella flexneri 2a str. 301
ccacaccaagccggaau

SEQ ID NO: 1962036 - RNA, 23 nt, Shigella flexneri 2a str. 301
ccacagugacccgcagccagcac

SEQ ID NO: 1962037 - RNA, 15 nt, Shigella flexneri 2a str. 301
ccacaguaacgccug

SEQ ID NO: 1962038 - RNA, 23 nt, Shigella flexneri 2a str. 301
ccacaguuucauaucugccagau

SEQ ID NO: 1962039 - RNA, 20 nt, Shigella flexneri 2a str. 301
ccacaguuuuacugcagcca

SEQ ID NO: 1962040 - RNA, 22 nt, Shigella flexneri 2a str. 301
ccaccccacgauguauccggca

SEQ ID NO: 1962041 - RNA, 14 nt, Shigella flexneri 2a str. 301
ccacccagcagcgc

SEQ ID NO: 1962042 - RNA, 19 nt, Shigella flexneri 2a str. 301
ccaccagcaugaucagcgc

SEQ ID NO: 1962043 - RNA, 19 nt, Shigella flexneri 2a str. 301
ccaccagauggcuuuccac

SEQ ID NO: 1962044 - RNA, 16 nt, Shigella flexneri 2a str. 301
ccaccagcaacagcgc

SEQ ID NO: 1962045 - RNA, 13 nt, Shigella flexneri 2a str. 301
ccaccagcaccag

SEQ ID NO: 1962046 - RNA, 19 nt, Shigella flexneri 2a str. 301
ccaccagaaucgccagcau

SEQ ID NO: 1962047 - RNA, 16 nt, Shigella flexneri 2a str. 301
ccaccagaaucgccag

SEQ ID NO: 1962048 - RNA, 21 nt, Shigella flexneri 2a str. 301
ccaccagaaucgccagcaucg

SEQ ID NO: 1962049 - RNA, 19 nt, Shigella flexneri 2a str. 301
ccacgccgcugucuaccag

SEQ ID NO: 1962050 - RNA, 17 nt, Shigella flexneri 2a str. 301
aaauacacuuuaaugcc

SEQ ID NO: 1962051 - RNA, 20 nt, Shigella flexneri 2a str. 301
aaauaccggacacacuucau

SEQ ID NO: 1962052 - RNA, 13 nt, Shigella flexneri 2a str. 301
ccaccgaccaggc

SEQ ID NO: 1962053 - RNA, 16 nt, Shigella flexneri 2a str. 301
ccaccuggaaccaggc

SEQ ID NO: 1962054 - RNA, 20 nt, Shigella flexneri 2a str. 301
ccagacugaucaucgcccag

SEQ ID NO: 1962055 - RNA, 18 nt, Shigella flexneri 2a str. 301
ccagacugcacauggcgg

SEQ ID NO: 1962056 - RNA, 18 nt, Shigella flexneri 2a str. 301
ccagacuccaggcguuuu

SEQ ID NO: 1962057 - RNA, 22 nt, Shigella flexneri 2a str. 301
ccagaccuaacuuggcaaagcu

SEQ ID NO: 1962058 - RNA, 20 nt, Shigella flexneri 2a str. 301
ccagacccaguuuugcgcgu

SEQ ID NO: 1962059 - RNA, 13 nt, Shigella flexneri 2a str. 301
ccagacaucccag

SEQ ID NO: 1962060 - RNA, 21 nt, Shigella flexneri 2a str. 301
ccagaauccaggaaagccaug

SEQ ID NO: 1962061 - RNA, 23 nt, Shigella flexneri 2a str. 301
ccagcaagaaccaugcaauuacc

SEQ ID NO: 1962062 - RNA, 15 nt, Shigella flexneri 2a str. 301
ccagcaagaaccaug

SEQ ID NO: 1962063 - RNA, 16 nt, Shigella flexneri 2a str. 301
ccagcaauaaugccag

SEQ ID NO: 1962064 - RNA, 20 nt, Shigella flexneri 2a str. 301
ccagagugaugcguccgcua

SEQ ID NO: 1962065 - RNA, 21 nt, Shigella flexneri 2a str. 301
ccagauauuuuucaauccgca

SEQ ID NO: 1962066 - RNA, 14 nt, Shigella flexneri 2a str. 301
ccacuucauccgga

SEQ ID NO: 1962067 - RNA, 18 nt, Shigella flexneri 2a str. 301
ccagaaacgccaccauuu

SEQ ID NO: 1962068 - RNA, 19 nt, Shigella flexneri 2a str. 301
ccagaauaugcgccagcgu

SEQ ID NO: 1962069 - RNA, 12 nt, Shigella flexneri 2a str. 301
ccacuaacuguu

SEQ ID NO: 1962070 - RNA, 13 nt, Shigella flexneri 2a str. 301
ccacgggcaauau

SEQ ID NO: 1962071 - RNA, 20 nt, Shigella flexneri 2a str. 301
ccagccuucuucauccagcg

SEQ ID NO: 1962072 - RNA, 22 nt, Shigella flexneri 2a str. 301
ccagcgaaaucaccgccaccag

SEQ ID NO: 1962073 - RNA, 22 nt, Shigella flexneri 2a str. 301
aaaucaacaugaaaauaaccau

SEQ ID NO: 1962074 - RNA, 18 nt, Shigella flexneri 2a str. 301
aaaucaccucaucaccac

SEQ ID NO: 1962075 - RNA, 12 nt, Shigella flexneri 2a str. 301
aaaucacaccau

SEQ ID NO: 1962076 - RNA, 19 nt, Shigella flexneri 2a str. 301
ccagcgcgcguauccggca

SEQ ID NO: 1962077 - RNA, 14 nt, Shigella flexneri 2a str. 301
ccagcacugccgca

SEQ ID NO: 1962078 - RNA, 15 nt, Shigella flexneri 2a str. 301
aaauagccagcagag

SEQ ID NO: 1962079 - RNA, 11 nt, Shigella flexneri 2a str. 301
ccagcagcaca

SEQ ID NO: 1962080 - RNA, 14 nt, Shigella flexneri 2a str. 301
ccagcagcagcggu

SEQ ID NO: 1962081 - RNA, 16 nt, Shigella flexneri 2a str. 301
aaauacugacuggcaa

SEQ ID NO: 1962082 - RNA, 20 nt, Shigella flexneri 2a str. 301
ccagcagcgaaucagcccag

SEQ ID NO: 1962083 - RNA, 15 nt, Shigella flexneri 2a str. 301
ccagccacugcgcca

SEQ ID NO: 1962084 - RNA, 16 nt, Shigella flexneri 2a str. 301
ccagccacugcgccau

SEQ ID NO: 1962085 - RNA, 15 nt, Shigella flexneri 2a str. 301
ccagccagacgccag

SEQ ID NO: 1962086 - RNA, 21 nt, Shigella flexneri 2a str. 301
ccagcagggcaaacagcacgg

SEQ ID NO: 1962087 - RNA, 16 nt, Shigella flexneri 2a str. 301
cccgugggcaggccug

SEQ ID NO: 1962088 - RNA, 21 nt, Shigella flexneri 2a str. 301
cccgguugcuuuucacaaccg

SEQ ID NO: 1962089 - RNA, 13 nt, Shigella flexneri 2a str. 301
cccguaacauggc

SEQ ID NO: 1962090 - RNA, 14 nt, Shigella flexneri 2a str. 301
cccgugaugcaacu

SEQ ID NO: 1962091 - RNA, 13 nt, Shigella flexneri 2a str. 301
cccuucaucgcuc

SEQ ID NO: 1962092 - RNA, 12 nt, Shigella flexneri 2a str. 301
cccuuaguaacg

SEQ ID NO: 1962093 - RNA, 17 nt, Shigella flexneri 2a str. 301
cccuuaucgggaagcgg

SEQ ID NO: 1962094 - RNA, 14 nt, Shigella flexneri 2a str. 301
ccgaaaaagagcca

SEQ ID NO: 1962095 - RNA, 19 nt, Shigella flexneri 2a str. 301
cccugugcgcccuguucug

SEQ ID NO: 1962096 - RNA, 21 nt, Shigella flexneri 2a str. 301
cccuguggaacgugcugcauu

SEQ ID NO: 1962097 - RNA, 15 nt, Shigella flexneri 2a str. 301
cccugauaaccgcau

SEQ ID NO: 1962098 - RNA, 14 nt, Shigella flexneri 2a str. 301
cccugaaucaauca

SEQ ID NO: 1962099 - RNA, 20 nt, Shigella flexneri 2a str. 301
cccugcaaauuauuugcgua

SEQ ID NO: 1962100 - RNA, 14 nt, Shigella flexneri 2a str. 301
cccugccaguccug

SEQ ID NO: 1962101 - RNA, 18 nt, Shigella flexneri 2a str. 301
cccggcaauggguaacgg

SEQ ID NO: 1962102 - RNA, 21 nt, Shigella flexneri 2a str. 301
cccgguaauugcacguccggu

SEQ ID NO: 1962103 - RNA, 21 nt, Shigella flexneri 2a str. 301
cccgaucgccaucaugcacac

SEQ ID NO: 1962104 - RNA, 15 nt, Shigella flexneri 2a str. 301
cccgccgugcugcca

SEQ ID NO: 1962105 - RNA, 17 nt, Shigella flexneri 2a str. 301
cccgccgugcugccagc

SEQ ID NO: 1962106 - RNA, 16 nt, Shigella flexneri 2a str. 301
cccgccagcgcggcga

SEQ ID NO: 1962107 - RNA, 11 nt, Shigella flexneri 2a str. 301
cccgccagcau

SEQ ID NO: 1962108 - RNA, 21 nt, Shigella flexneri 2a str. 301
cccgcuucguuuucagcuucg

SEQ ID NO: 1962109 - RNA, 22 nt, Shigella flexneri 2a str. 301
cccgcuucuucugccgcuucca

SEQ ID NO: 1962110 - RNA, 17 nt, Shigella flexneri 2a str. 301
ccccagaucccauaacc

SEQ ID NO: 1962111 - RNA, 22 nt, Shigella flexneri 2a str. 301
ccccaguaaauggugauaucac

SEQ ID NO: 1962112 - RNA, 19 nt, Shigella flexneri 2a str. 301
ccccaggguuuugcccagc

SEQ ID NO: 1962113 - RNA, 21 nt, Shigella flexneri 2a str. 301
ccccagugguuucgccagcac

SEQ ID NO: 1962114 - RNA, 16 nt, Shigella flexneri 2a str. 301
cccgacgaggcgcugg

SEQ ID NO: 1962115 - RNA, 21 nt, Shigella flexneri 2a str. 301
ccagucauugagcuucucgau

SEQ ID NO: 1962116 - RNA, 23 nt, Shigella flexneri 2a str. 301
ccagugaaucgggaccagcauuc

SEQ ID NO: 1962117 - RNA, 19 nt, Shigella flexneri 2a str. 301
ccagucugaccauaacccg

SEQ ID NO: 1962118 - RNA, 15 nt, Shigella flexneri 2a str. 301
ccagugcgguaacgu

SEQ ID NO: 1962119 - RNA, 18 nt, Shigella flexneri 2a str. 301
ccaguugcuuauccagca

SEQ ID NO: 1962120 - RNA, 21 nt, Shigella flexneri 2a str. 301
ccaguucuuccaguuccggca

SEQ ID NO: 1962121 - RNA, 16 nt, Shigella flexneri 2a str. 301
ccaguugauucgcgcg

SEQ ID NO: 1962122 - RNA, 12 nt, Shigella flexneri 2a str. 301
ccaucagcagca

SEQ ID NO: 1962123 - RNA, 16 nt, Shigella flexneri 2a str. 301
ccaucacuaucgccau

SEQ ID NO: 1962124 - RNA, 17 nt, Shigella flexneri 2a str. 301
ccaucagcgccugaugg

SEQ ID NO: 1962125 - RNA, 18 nt, Shigella flexneri 2a str. 301
ccaucaccaucguugcua

SEQ ID NO: 1962126 - RNA, 14 nt, Shigella flexneri 2a str. 301
ccaucacuaccuga

SEQ ID NO: 1962127 - RNA, 19 nt, Shigella flexneri 2a str. 301
ccaucaacgccaucgccag

SEQ ID NO: 1962128 - RNA, 19 nt, Shigella flexneri 2a str. 301
ccaucaacaaacgccagau

SEQ ID NO: 1962129 - RNA, 22 nt, Shigella flexneri 2a str. 301
ccauaagaguagcccgauacgc

SEQ ID NO: 1962130 - RNA, 15 nt, Shigella flexneri 2a str. 301
ccauaaacuaucccu

SEQ ID NO: 1962131 - RNA, 15 nt, Shigella flexneri 2a str. 301
ccaguuguucgcgca

SEQ ID NO: 1962132 - RNA, 21 nt, Shigella flexneri 2a str. 301
ccaguuuacugauaacuucac

SEQ ID NO: 1962133 - RNA, 19 nt, Shigella flexneri 2a str. 301
ccaguuucggacgcggcac

SEQ ID NO: 1962134 - RNA, 15 nt, Shigella flexneri 2a str. 301
ccauaauggacguuu

SEQ ID NO: 1962135 - RNA, 14 nt, Shigella flexneri 2a str. 301
ccauacccagcauc

SEQ ID NO: 1962136 - RNA, 17 nt, Shigella flexneri 2a str. 301
ccauacccgcaacauac

SEQ ID NO: 1962137 - RNA, 20 nt, Shigella flexneri 2a str. 301
ccauacggcagagaucgccg

SEQ ID NO: 1962138 - RNA, 20 nt, Shigella flexneri 2a str. 301
ccauaguguguuccucugcu

SEQ ID NO: 1962139 - RNA, 21 nt, Shigella flexneri 2a str. 301
ccauacugacuaucaucgccg

SEQ ID NO: 1962140 - RNA, 13 nt, Shigella flexneri 2a str. 301
ccaguaguaacca

SEQ ID NO: 1962141 - RNA, 14 nt, Shigella flexneri 2a str. 301
ccaguaauccggcu

SEQ ID NO: 1962142 - RNA, 22 nt, Shigella flexneri 2a str. 301
ccagguuuuaguuucgccguuu

SEQ ID NO: 1962143 - RNA, 17 nt, Shigella flexneri 2a str. 301
ccaggccaucagcagcg

SEQ ID NO: 1962144 - RNA, 13 nt, Shigella flexneri 2a str. 301
cccacaacgaccu

SEQ ID NO: 1962145 - RNA, 22 nt, Shigella flexneri 2a str. 301
cccaauauccugagccggaacu

SEQ ID NO: 1962146 - RNA, 13 nt, Shigella flexneri 2a str. 301
cccagcgcaucag

SEQ ID NO: 1962147 - RNA, 13 nt, Shigella flexneri 2a str. 301
ccaucgccagcag

SEQ ID NO: 1962148 - RNA, 20 nt, Shigella flexneri 2a str. 301
ccaucgcgguuaaucggcag

SEQ ID NO: 1962149 - RNA, 19 nt, Shigella flexneri 2a str. 301
ccaucgcgguuaaucggca

SEQ ID NO: 1962150 - RNA, 14 nt, Shigella flexneri 2a str. 301
ccaucgggcuauuu

SEQ ID NO: 1962151 - RNA, 18 nt, Shigella flexneri 2a str. 301
ccaucgucggguaguuaa

SEQ ID NO: 1962152 - RNA, 14 nt, Shigella flexneri 2a str. 301
ccaucaucggcaaa

SEQ ID NO: 1962153 - RNA, 21 nt, Shigella flexneri 2a str. 301
ccaucaucaucgguaccgcca

SEQ ID NO: 1962154 - RNA, 15 nt, Shigella flexneri 2a str. 301
ccaucaggcguuugu

SEQ ID NO: 1962155 - RNA, 14 nt, Shigella flexneri 2a str. 301
ccauccggcaacau

SEQ ID NO: 1962156 - RNA, 20 nt, Shigella flexneri 2a str. 301
ccauccgcgugacgcuggca

SEQ ID NO: 1962157 - RNA, 12 nt, Shigella flexneri 2a str. 301
ccauggacgaug

SEQ ID NO: 1962158 - RNA, 21 nt, Shigella flexneri 2a str. 301
ccaugccggaugcgccagcau

SEQ ID NO: 1962159 - RNA, 18 nt, Shigella flexneri 2a str. 301
ccaugccaguuaucgcag

SEQ ID NO: 1962160 - RNA, 22 nt, Shigella flexneri 2a str. 301
caagcucguugguuccacggca

SEQ ID NO: 1962161 - RNA, 23 nt, Shigella flexneri 2a str. 301
caagcuuacguuacccagcacgg

SEQ ID NO: 1962162 - RNA, 14 nt, Shigella flexneri 2a str. 301
caaggaaauaacgu

SEQ ID NO: 1962163 - RNA, 11 nt, Shigella flexneri 2a str. 301
caaggaagcga

SEQ ID NO: 1962164 - RNA, 21 nt, Shigella flexneri 2a str. 301
caaggcugucgcaaauccgcu

SEQ ID NO: 1962165 - RNA, 22 nt, Shigella flexneri 2a str. 301
caaggcuuuaauauccggugca

SEQ ID NO: 1962166 - RNA, 12 nt, Shigella flexneri 2a str. 301
caagauauuccg

SEQ ID NO: 1962167 - RNA, 17 nt, Shigella flexneri 2a str. 301
caacugcgacguggauc

SEQ ID NO: 1962168 - RNA, 18 nt, Shigella flexneri 2a str. 301
caagaccaauccgccagc

SEQ ID NO: 1962169 - RNA, 20 nt, Shigella flexneri 2a str. 301
caagccgcuaacagcagcag

SEQ ID NO: 1962170 - RNA, 18 nt, Shigella flexneri 2a str. 301
caacggcggaucaccgcg

SEQ ID NO: 1962171 - RNA, 18 nt, Shigella flexneri 2a str. 301
caacggcgaaucuacgga

SEQ ID NO: 1962172 - RNA, 23 nt, Shigella flexneri 2a str. 301
caacggaggauuuuucgcgaccg

SEQ ID NO: 1962173 - RNA, 18 nt, Shigella flexneri 2a str. 301
caacggcgagccagcgca

SEQ ID NO: 1962174 - RNA, 21 nt, Shigella flexneri 2a str. 301
caacggcguaaauaguccgga

SEQ ID NO: 1962175 - RNA, 15 nt, Shigella flexneri 2a str. 301
caacgggcugaagaa

SEQ ID NO: 1962176 - RNA, 19 nt, Shigella flexneri 2a str. 301
caacguuguuccuuccagc

SEQ ID NO: 1962177 - RNA, 17 nt, Shigella flexneri 2a str. 301
caacgugguuuucgccg

SEQ ID NO: 1962178 - RNA, 15 nt, Shigella flexneri 2a str. 301
caacgugcucgucga

SEQ ID NO: 1962179 - RNA, 17 nt, Shigella flexneri 2a str. 301
caacguggauaccgaua

SEQ ID NO: 1962180 - RNA, 17 nt, Shigella flexneri 2a str. 301
caacguaguaucguaau

SEQ ID NO: 1962181 - RNA, 16 nt, Shigella flexneri 2a str. 301
caacguccugagcauu

SEQ ID NO: 1962182 - RNA, 16 nt, Shigella flexneri 2a str. 301
caacgguucgccauca

SEQ ID NO: 1962183 - RNA, 16 nt, Shigella flexneri 2a str. 301
caacguacucugccac

SEQ ID NO: 1962184 - RNA, 20 nt, Shigella flexneri 2a str. 301
caauuacgccgagcgccagc

SEQ ID NO: 1962185 - RNA, 17 nt, Shigella flexneri 2a str. 301
caauuaauugccagccg

SEQ ID NO: 1962186 - RNA, 17 nt, Shigella flexneri 2a str. 301
caauuaccugucgccag

SEQ ID NO: 1962187 - RNA, 15 nt, Shigella flexneri 2a str. 301
caauguuauccggcu

SEQ ID NO: 1962188 - RNA, 17 nt, Shigella flexneri 2a str. 301
caauucaguacguucac

SEQ ID NO: 1962189 - RNA, 13 nt, Shigella flexneri 2a str. 301
caauuccugacgu

SEQ ID NO: 1962190 - RNA, 20 nt, Shigella flexneri 2a str. 301
caauucgcgucggcgucagc

SEQ ID NO: 1962191 - RNA, 20 nt, Shigella flexneri 2a str. 301
caauuugcuuaagccgcucu

SEQ ID NO: 1962192 - RNA, 21 nt, Shigella flexneri 2a str. 301
caauuugcuucuggcuggcgc

SEQ ID NO: 1962193 - RNA, 14 nt, Shigella flexneri 2a str. 301
caauggcauccgcc

SEQ ID NO: 1962194 - RNA, 16 nt, Shigella flexneri 2a str. 301
caaugcugcgaucagu

SEQ ID NO: 1962195 - RNA, 22 nt, Shigella flexneri 2a str. 301
caaugcaggcaucggugaugcu

SEQ ID NO: 1962196 - RNA, 15 nt, Shigella flexneri 2a str. 301
caaugccauccagcu

SEQ ID NO: 1962197 - RNA, 20 nt, Shigella flexneri 2a str. 301
caaucuccguguaggccuga
